United States Patent 11,464,842 (COMPOSITIONS AND METHOD FOR OPTIMIZED PEPTIDE VACCINES USING RESIDUE OPTIMIZATION) - sequence listing, part 8

SEQ ID NO: 119143 - protein, 9 aa, Artificial Sequence
  Description of Artificial Sequence: Synthetic peptide
  Seed: GWYRPPFSR (MOG_HUMAN)
GYYRPPFSK

SEQ ID NO: 119144 - protein, 11 aa, Artificial Sequence
  Description of Artificial Sequence: Synthetic peptide
  Seed: VRFSDEGGFTC (MOG_HUMAN)
VHFSDEGGFTV

SEQ ID NO: 119145 - protein, 9 aa, Artificial Sequence
  Description of Artificial Sequence: Synthetic peptide
  Seed: RIRNVRFSD (MOG_HUMAN)
RYRNVRFSM

SEQ ID NO: 119146 - protein, 9 aa, Artificial Sequence
  Description of Artificial Sequence: Synthetic peptide
  Seed: VPCWKITLF (MOG_HUMAN)
VACWKITLF

SEQ ID NO: 119147 - protein, 9 aa, Artificial Sequence
  Description of Artificial Sequence: Synthetic peptide
  Seed: RVIGPRHPI (MOG_HUMAN)
RWIGPRHPK

SEQ ID NO: 119148 - protein, 10 aa, Artificial Sequence
  Description of Artificial Sequence: Synthetic peptide
  Seed: FSDEGGFTCF (MOG_HUMAN)
FNDEGGFTCI

SEQ ID NO: 119149 - protein, 9 aa, Artificial Sequence
  Description of Artificial Sequence: Synthetic peptide
  Seed: SRPSLPSCL (MOG_HUMAN)
SSPSLPSCI

SEQ ID NO: 119150 - protein, 9 aa, Artificial Sequence
  Description of Artificial Sequence: Synthetic peptide
  Seed: MASLSRPSL (MOG_HUMAN)
MFSLSRPSV

SEQ ID NO: 119151 - protein, 10 aa, Artificial Sequence
  Description of Artificial Sequence: Synthetic peptide
  Seed: SSYAGQFRVI (MOG_HUMAN)
STYAGQFRVK

SEQ ID NO: 119152 - protein, 11 aa, Artificial Sequence
  Description of Artificial Sequence: Synthetic peptide
  Seed: RISPGKNATGM (MOG_HUMAN)
RQSPGKNATGL

SEQ ID NO: 119153 - protein, 9 aa, Artificial Sequence
  Description of Artificial Sequence: Synthetic peptide
  Seed: TFDPHFLRV (MOG_HUMAN)
TTDPHFLRH

SEQ ID NO: 119154 - protein, 9 aa, Artificial Sequence
  Description of Artificial Sequence: Synthetic peptide
  Seed: WVSPGVLVL (MOG_HUMAN)
WFSPGVLVI

SEQ ID NO: 119155 - protein, 10 aa, Artificial Sequence
  Description of Artificial Sequence: Synthetic peptide
  Seed: VLLLQITVGL (MOG_HUMAN)
VFLLQITVGV

SEQ ID NO: 119156 - protein, 11 aa, Artificial Sequence
  Description of Artificial Sequence: Synthetic peptide
  Seed: RISPGKNATGM (MOG_HUMAN)
RPSPGKNATGL

SEQ ID NO: 119157 - protein, 11 aa, Artificial Sequence
  Description of Artificial Sequence: Synthetic peptide
  Seed: SLPSCLCSFLL (MOG_HUMAN)
SLPSCLCSFLV

SEQ ID NO: 119158 - protein, 11 aa, Artificial Sequence
  Description of Artificial Sequence: Synthetic peptide
  Seed: HRTFDPHFLRV (MOG_HUMAN)
HWTFDPHFLRR

SEQ ID NO: 119159 - protein, 10 aa, Artificial Sequence
  Description of Artificial Sequence: Synthetic peptide
  Seed: SLSRPSLPSC (MOG_HUMAN)
SMSRPSLPSL

SEQ ID NO: 119160 - protein, 10 aa, Artificial Sequence
  Description of Artificial Sequence: Synthetic peptide
  Seed: IGPRHPIRAL (MOG_HUMAN)
IIPRHPIRAM

SEQ ID NO: 119161 - protein, 9 aa, Artificial Sequence
  Description of Artificial Sequence: Synthetic peptide
  Seed: LHRRLAGQF (MOG_HUMAN)
LMRRLAGQF

SEQ ID NO: 119162 - protein, 9 aa, Artificial Sequence
  Description of Artificial Sequence: Synthetic peptide
  Seed: YRPPFSRVV (MOG_HUMAN)
YIPPFSRVM

SEQ ID NO: 119163 - protein, 9 aa, Artificial Sequence
  Description of Artificial Sequence: Synthetic peptide
  Seed: GWYRPPFSR (MOG_HUMAN)
GTYRPPFSK

SEQ ID NO: 119164 - protein, 9 aa, Artificial Sequence
  Description of Artificial Sequence: Synthetic peptide
  Seed: RVPCWKITL (MOG_HUMAN)
RFPCWKITW

SEQ ID NO: 119165 - protein, 10 aa, Artificial Sequence
  Description of Artificial Sequence: Synthetic peptide
  Seed: RVPCWKITLF (MOG_HUMAN)
RSPCWKITLY

SEQ ID NO: 119166 - protein, 10 aa, Artificial Sequence
  Description of Artificial Sequence: Synthetic peptide
  Seed: DAIGEGKVTL (MOG_HUMAN)
DTIGEGKVTW

SEQ ID NO: 119167 - protein, 10 aa, Artificial Sequence
  Description of Artificial Sequence: Synthetic peptide
  Seed: VLLLQITVGL (MOG_HUMAN)
VHLLQITVGL

SEQ ID NO: 119168 - protein, 10 aa, Artificial Sequence
  Description of Artificial Sequence: Synthetic peptide
  Seed: LVLLAVLPVL (MOG_HUMAN)
LLLLAVLPVA

SEQ ID NO: 119169 - protein, 10 aa, Artificial Sequence
  Description of Artificial Sequence: Synthetic peptide
  Seed: RPPFSRVVHL (MOG_HUMAN)
REPFSRVVHL

SEQ ID NO: 119170 - protein, 10 aa, Artificial Sequence
  Description of Artificial Sequence: Synthetic peptide
  Seed: VPVLGPLVAL (MOG_HUMAN)
VPVLGPLVAY

SEQ ID NO: 119171 - protein, 10 aa, Artificial Sequence
  Description of Artificial Sequence: Synthetic peptide
  Seed: FDPHFLRVPC (MOG_HUMAN)
FRPHFLRVPI

SEQ ID NO: 119172 - protein, 10 aa, Artificial Sequence
  Description of Artificial Sequence: Synthetic peptide
  Seed: RVVHLYRNGK (MOG_HUMAN)
RLVHLYRNGR

SEQ ID NO: 119173 - protein, 9 aa, Artificial Sequence
  Description of Artificial Sequence: Synthetic peptide
  Seed: KLRAEIENL (MOG_HUMAN)
KLRAEIENK

SEQ ID NO: 119174 - protein, 9 aa, Artificial Sequence
  Description of Artificial Sequence: Synthetic peptide
  Seed: VRFSDEGGF (MOG_HUMAN)
VQFSDEGGF

SEQ ID NO: 119175 - protein, 10 aa, Artificial Sequence
  Description of Artificial Sequence: Synthetic peptide
  Seed: GLIFLCLQYR (MOG_HUMAN)
GEIFLCLQYR

SEQ ID NO: 119176 - protein, 10 aa, Artificial Sequence
  Description of Artificial Sequence: Synthetic peptide
  Seed: FVIVPVLGPL (MOG_HUMAN)
FSIVPVLGPA

SEQ ID NO: 119177 - protein, 10 aa, Artificial Sequence
  Description of Artificial Sequence: Synthetic peptide
  Seed: TGMEVGWYRP (MOG_HUMAN)
TSMEVGWYRK

SEQ ID NO: 119178 - protein, 11 aa, Artificial Sequence
  Description of Artificial Sequence: Synthetic peptide
  Seed: RFSDEGGFTCF (MOG_HUMAN)
RMSDEGGFTCL

SEQ ID NO: 119179 - protein, 10 aa, Artificial Sequence
  Description of Artificial Sequence: Synthetic peptide
  Seed: RLRGKLRAEI (MOG_HUMAN)
RTRGKLRAEA

SEQ ID NO: 119180 - protein, 10 aa, Artificial Sequence
  Description of Artificial Sequence: Synthetic peptide
  Seed: VPVLGPLVAL (MOG_HUMAN)
VCVLGPLVAV

SEQ ID NO: 119181 - protein, 9 aa, Artificial Sequence
  Description of Artificial Sequence: Synthetic peptide
  Seed: MASLSRPSL (MOG_HUMAN)
MASLSRPSV

SEQ ID NO: 119182 - protein, 10 aa, Artificial Sequence
  Description of Artificial Sequence: Synthetic peptide
  Seed: FDPHFLRVPC (MOG_HUMAN)
FSPHFLRVPM

SEQ ID NO: 119183 - protein, 9 aa, Artificial Sequence
  Description of Artificial Sequence: Synthetic peptide
  Seed: RTFDPHFLR (MOG_HUMAN)
RCFDPHFLR

SEQ ID NO: 119184 - protein, 9 aa, Artificial Sequence
  Description of Artificial Sequence: Synthetic peptide
  Seed: EGGFTCFFR (MOG_HUMAN)
EMGFTCFFK

SEQ ID NO: 119185 - protein, 9 aa, Artificial Sequence
  Description of Artificial Sequence: Synthetic peptide
  Seed: LVLLAVLPV (MOG_HUMAN)
LMLLAVLPI

SEQ ID NO: 119186 - protein, 9 aa, Artificial Sequence
  Description of Artificial Sequence: Synthetic peptide
  Seed: RIRNVRFSD (MOG_HUMAN)
RARNVRFSY

SEQ ID NO: 119187 - protein, 9 aa, Artificial Sequence
  Description of Artificial Sequence: Synthetic peptide
  Seed: TFDPHFLRV (MOG_HUMAN)
TCDPHFLRI

SEQ ID NO: 119188 - protein, 10 aa, Artificial Sequence
  Description of Artificial Sequence: Synthetic peptide
  Seed: VLLAVLPVLL (MOG_HUMAN)
VYLAVLPVLV

SEQ ID NO: 119189 - protein, 9 aa, Artificial Sequence
  Description of Artificial Sequence: Synthetic peptide
  Seed: HSYQEEAAM (MOG_HUMAN)
HKYQEEAAL

SEQ ID NO: 119190 - protein, 9 aa, Artificial Sequence
  Description of Artificial Sequence: Synthetic peptide
  Seed: YQEEAAMEL (MOG_HUMAN)
YQEEAAMEM

SEQ ID NO: 119191 - protein, 9 aa, Artificial Sequence
  Description of Artificial Sequence: Synthetic peptide
  Seed: SYAGQFRVI (MOG_HUMAN)
SFAGQFRVF

SEQ ID NO: 119192 - protein, 10 aa, Artificial Sequence
  Description of Artificial Sequence: Synthetic peptide
  Seed: SLSRPSLPSC (MOG_HUMAN)
SKSRPSLPSM

SEQ ID NO: 119193 - protein, 11 aa, Artificial Sequence
  Description of Artificial Sequence: Synthetic peptide
  Seed: VIGPRHPIRAL (MOG_HUMAN)
VDGPRHPIRAM

SEQ ID NO: 119194 - protein, 9 aa, Artificial Sequence
  Description of Artificial Sequence: Synthetic peptide
  Seed: MASLSRPSL (MOG_HUMAN)
MPSLSRPSW

SEQ ID NO: 119195 - protein, 9 aa, Artificial Sequence
  Description of Artificial Sequence: Synthetic peptide
  Seed: VGDEVELPC (MOG_HUMAN)
VVDEVELPF

SEQ ID NO: 119196 - protein, 10 aa, Artificial Sequence
  Description of Artificial Sequence: Synthetic peptide
  Seed: RLAGQFLEEL (MOG_HUMAN)
RVAGQFLEEV

SEQ ID NO: 119197 - protein, 9 aa, Artificial Sequence
  Description of Artificial Sequence: Synthetic peptide
  Seed: AGQFLEELR (MOG_HUMAN)
AMQFLEELR

SEQ ID NO: 119198 - protein, 10 aa, Artificial Sequence
  Description of Artificial Sequence: Synthetic peptide
  Seed: FVIVPVLGPL (MOG_HUMAN)
FDIVPVLGPV

SEQ ID NO: 119199 - protein, 9 aa, Artificial Sequence
  Description of Artificial Sequence: Synthetic peptide
  Seed: FYWVSPGVL (MOG_HUMAN)
FFWVSPGVL

SEQ ID NO: 119200 - protein, 9 aa, Artificial Sequence
  Description of Artificial Sequence: Synthetic peptide
  Seed: CLCSFLLLL (MOG_HUMAN)
CLCSFLLLR

SEQ ID NO: 119201 - protein, 10 aa, Artificial Sequence
  Description of Artificial Sequence: Synthetic peptide
  Seed: TGMEVGWYRP (MOG_HUMAN)
TTMEVGWYRR

SEQ ID NO: 119202 - protein, 9 aa, Artificial Sequence
  Description of Artificial Sequence: Synthetic peptide
  Seed: ICYNWLHRR (MOG_HUMAN)
ILYNWLHRM

SEQ ID NO: 119203 - protein, 10 aa, Artificial Sequence
  Description of Artificial Sequence: Synthetic peptide
  Seed: AEIENLHRTF (MOG_HUMAN)
ARIENLHRTF

SEQ ID NO: 119204 - protein, 10 aa, Artificial Sequence
  Description of Artificial Sequence: Synthetic peptide
  Seed: FDPHFLRVPC (MOG_HUMAN)
FNPHFLRVPV

SEQ ID NO: 119205 - protein, 11 aa, Artificial Sequence
  Description of Artificial Sequence: Synthetic peptide
  Seed: RFSDEGGFTCF (MOG_HUMAN)
RKSDEGGFTCY

SEQ ID NO: 119206 - protein, 9 aa, Artificial Sequence
  Description of Artificial Sequence: Synthetic peptide
  Seed: TCFFRDHSY (MOG_HUMAN)
TQFFRDHSY

SEQ ID NO: 119207 - protein, 10 aa, Artificial Sequence
  Description of Artificial Sequence: Synthetic peptide
  Seed: LVLLAVLPVL (MOG_HUMAN)
LSLLAVLPVL

SEQ ID NO: 119208 - protein, 9 aa, Artificial Sequence
  Description of Artificial Sequence: Synthetic peptide
  Seed: VLGPLVALI (MOG_HUMAN)
VSGPLVALF

SEQ ID NO: 119209 - protein, 9 aa, Artificial Sequence
  Description of Artificial Sequence: Synthetic peptide
  Seed: LIFLCLQYR (MOG_HUMAN)
LQFLCLQYR

SEQ ID NO: 119210 - protein, 11 aa, Artificial Sequence
  Description of Artificial Sequence: Synthetic peptide
  Seed: FSDEGGFTCFF (MOG_HUMAN)
FVDEGGFTCFI

SEQ ID NO: 119211 - protein, 9 aa, Artificial Sequence
  Description of Artificial Sequence: Synthetic peptide
  Seed: FYWVSPGVL (MOG_HUMAN)
FLWVSPGVF

SEQ ID NO: 119212 - protein, 10 aa, Artificial Sequence
  Description of Artificial Sequence: Synthetic peptide
  Seed: SSYAGQFRVI (MOG_HUMAN)
SVYAGQFRVF

SEQ ID NO: 119213 - protein, 10 aa, Artificial Sequence
  Description of Artificial Sequence: Synthetic peptide
  Seed: VLLLQITVGL (MOG_HUMAN)
VPLLQITVGI

SEQ ID NO: 119214 - protein, 9 aa, Artificial Sequence
  Description of Artificial Sequence: Synthetic peptide
  Seed: FLLLLLLQV (MOG_HUMAN)
FLLLLLLQM

SEQ ID NO: 119215 - protein, 10 aa, Artificial Sequence
  Description of Artificial Sequence: Synthetic peptide
  Seed: LSRPSLPSCL (MOG_HUMAN)
LYRPSLPSCK

SEQ ID NO: 119216 - protein, 11 aa, Artificial Sequence
  Description of Artificial Sequence: Synthetic peptide
  Seed: HSYQEEAAMEL (MOG_HUMAN)
HSYQEEAAMEY

SEQ ID NO: 119217 - protein, 9 aa, Artificial Sequence
  Description of Artificial Sequence: Synthetic peptide
  Seed: FLEELRNPF (MOG_HUMAN)
FVEELRNPF

SEQ ID NO: 119218 - protein, 9 aa, Artificial Sequence
  Description of Artificial Sequence: Synthetic peptide
  Seed: RIRNVRFSD (MOG_HUMAN)
RTRNVRFSD

SEQ ID NO: 119219 - protein, 10 aa, Artificial Sequence
  Description of Artificial Sequence: Synthetic peptide
  Seed: RTFDPHFLRV (MOG_HUMAN)
RYFDPHFLRL

SEQ ID NO: 119220 - protein, 9 aa, Artificial Sequence
  Description of Artificial Sequence: Synthetic peptide
  Seed: GWYRPPFSR (MOG_HUMAN)
GIYRPPFSR

SEQ ID NO: 119221 - protein, 10 aa, Artificial Sequence
  Description of Artificial Sequence: Synthetic peptide
  Seed: SLSRPSLPSC (MOG_HUMAN)
SWSRPSLPSL

SEQ ID NO: 119222 - protein, 10 aa, Artificial Sequence
  Description of Artificial Sequence: Synthetic peptide
  Seed: SCLCSFLLLL (MOG_HUMAN)
SCLCSFLLLI

SEQ ID NO: 119223 - protein, 9 aa, Artificial Sequence
  Description of Artificial Sequence: Synthetic peptide
  Seed: IFLCLQYRL (MOG_HUMAN)
IMLCLQYRF

SEQ ID NO: 119224 - protein, 9 aa, Artificial Sequence
  Description of Artificial Sequence: Synthetic peptide
  Seed: WVSPGVLVL (MOG_HUMAN)
WRSPGVLVM

SEQ ID NO: 119225 - protein, 10 aa, Artificial Sequence
  Description of Artificial Sequence: Synthetic peptide
  Seed: FVIVPVLGPL (MOG_HUMAN)
FVIVPVLGPY

SEQ ID NO: 119226 - protein, 10 aa, Artificial Sequence
  Description of Artificial Sequence: Synthetic peptide
  Seed: LLLLQVSSSY (MOG_HUMAN)
LHLLQVSSSF

SEQ ID NO: 119227 - protein, 9 aa, Artificial Sequence
  Description of Artificial Sequence: Synthetic peptide
  Seed: QDGDQAPEY (MOG_HUMAN)
QEGDQAPEY

SEQ ID NO: 119228 - protein, 9 aa, Artificial Sequence
  Description of Artificial Sequence: Synthetic peptide
  Seed: LQVSSSYAG (MOG_HUMAN)
LSVSSSYAF

SEQ ID NO: 119229 - protein, 11 aa, Artificial Sequence
  Description of Artificial Sequence: Synthetic peptide
  Seed: RISPGKNATGM (MOG_HUMAN)
RTSPGKNATGW

SEQ ID NO: 119230 - protein, 9 aa, Artificial Sequence
  Description of Artificial Sequence: Synthetic peptide
  Seed: LKVEDPFYW (MOG_HUMAN)
LSVEDPFYW

SEQ ID NO: 119231 - protein, 9 aa, Artificial Sequence
  Description of Artificial Sequence: Synthetic peptide
  Seed: SLPSCLCSF (MOG_HUMAN)
SVPSCLCSV

SEQ ID NO: 119232 - protein, 9 aa, Artificial Sequence
  Description of Artificial Sequence: Synthetic peptide
  Seed: MASLSRPSL (MOG_HUMAN)
MYSLSRPSV

SEQ ID NO: 119233 - protein, 10 aa, Artificial Sequence
  Description of Artificial Sequence: Synthetic peptide
  Seed: RIRNVRFSDE (MOG_HUMAN)
RYRNVRFSDS

SEQ ID NO: 119234 - protein, 10 aa, Artificial Sequence
  Description of Artificial Sequence: Synthetic peptide
  Seed: RPPFSRVVHL (MOG_HUMAN)
RNPFSRVVHM

SEQ ID NO: 119235 - protein, 10 aa, Artificial Sequence
  Description of Artificial Sequence: Synthetic peptide
  Seed: WVSPGVLVLL (MOG_HUMAN)
WQSPGVLVLI

SEQ ID NO: 119236 - protein, 10 aa, Artificial Sequence
  Description of Artificial Sequence: Synthetic peptide
  Seed: FDPHFLRVPC (MOG_HUMAN)
FMPHFLRVPI

SEQ ID NO: 119237 - protein, 10 aa, Artificial Sequence
  Description of Artificial Sequence: Synthetic peptide
  Seed: ATGMEVGWYR (MOG_HUMAN)
AFGMEVGWYR

SEQ ID NO: 119238 - protein, 10 aa, Artificial Sequence
  Description of Artificial Sequence: Synthetic peptide
  Seed: FRVIGPRHPI (MOG_HUMAN)
FRVIGPRHPL

SEQ ID NO: 119239 - protein, 9 aa, Artificial Sequence
  Description of Artificial Sequence: Synthetic peptide
  Seed: FSDEGGFTC (MOG_HUMAN)
FRDEGGFTF

SEQ ID NO: 119240 - protein, 9 aa, Artificial Sequence
  Description of Artificial Sequence: Synthetic peptide
  Seed: LAGQFLEEL (MOG_HUMAN)
LMGQFLEEY

SEQ ID NO: 119241 - protein, 10 aa, Artificial Sequence
  Description of Artificial Sequence: Synthetic peptide
  Seed: LVLLAVLPVL (MOG_HUMAN)
LKLLAVLPVV

SEQ ID NO: 119242 - protein, 10 aa, Artificial Sequence
  Description of Artificial Sequence: Synthetic peptide
  Seed: FRVIGPRHPI (MOG_HUMAN)
FGVIGPRHPV

SEQ ID NO: 119243 - protein, 9 aa, Artificial Sequence
  Description of Artificial Sequence: Synthetic peptide
  Seed: LLAVLPVLL (MOG_HUMAN)
LMAVLPVLV

SEQ ID NO: 119244 - protein, 10 aa, Artificial Sequence
  Description of Artificial Sequence: Synthetic peptide
  Seed: KITLFVIVPV (MOG_HUMAN)
KFTLFVIVPV

SEQ ID NO: 119245 - protein, 10 aa, Artificial Sequence
  Description of Artificial Sequence: Synthetic peptide
  Seed: RPPFSRVVHL (MOG_HUMAN)
RPPFSRVVHI

SEQ ID NO: 119246 - protein, 9 aa, Artificial Sequence
  Description of Artificial Sequence: Synthetic peptide
  Seed: YRPPFSRVV (MOG_HUMAN)
YSPPFSRVA

SEQ ID NO: 119247 - protein, 10 aa, Artificial Sequence
  Description of Artificial Sequence: Synthetic peptide
  Seed: LLQITVGLIF (MOG_HUMAN)
LKQITVGLIM

SEQ ID NO: 119248 - protein, 11 aa, Artificial Sequence
  Description of Artificial Sequence: Synthetic peptide
  Seed: RISPGKNATGM (MOG_HUMAN)
RSSPGKNATGW

SEQ ID NO: 119249 - protein, 11 aa, Artificial Sequence
  Description of Artificial Sequence: Synthetic peptide
  Seed: CRISPGKNATG (MOG_HUMAN)
CRISPGKNATL

SEQ ID NO: 119250 - protein, 9 aa, Artificial Sequence
  Description of Artificial Sequence: Synthetic peptide
  Seed: AIGEGKVTL (MOG_HUMAN)
APGEGKVTM

SEQ ID NO: 119251 - protein, 9 aa, Artificial Sequence
  Description of Artificial Sequence: Synthetic peptide
  Seed: VLGPLVALI (MOG_HUMAN)
VMGPLVALA

SEQ ID NO: 119252 - protein, 11 aa, Artificial Sequence
  Description of Artificial Sequence: Synthetic peptide
  Seed: HSYQEEAAMEL (MOG_HUMAN)
HLYQEEAAMEW

SEQ ID NO: 119253 - protein, 9 aa, Artificial Sequence
  Description of Artificial Sequence: Synthetic peptide
  Seed: RTFDPHFLR (MOG_HUMAN)
RNFDPHFLR

SEQ ID NO: 119254 - protein, 9 aa, Artificial Sequence
  Description of Artificial Sequence: Synthetic peptide
  Seed: SLPSCLCSF (MOG_HUMAN)
SVPSCLCSY

SEQ ID NO: 119255 - protein, 10 aa, Artificial Sequence
  Description of Artificial Sequence: Synthetic peptide
  Seed: LLLQITVGLI (MOG_HUMAN)
LLLQITVGLV

SEQ ID NO: 119256 - protein, 9 aa, Artificial Sequence
  Description of Artificial Sequence: Synthetic peptide
  Seed: WVSPGVLVL (MOG_HUMAN)
WSSPGVLVW

SEQ ID NO: 119257 - protein, 9 aa, Artificial Sequence
  Description of Artificial Sequence: Synthetic peptide
  Seed: LSRPSLPSC (MOG_HUMAN)
LCRPSLPSK

SEQ ID NO: 119258 - protein, 9 aa, Artificial Sequence
  Description of Artificial Sequence: Synthetic peptide
  Seed: CSFLLLLLL (MOG_HUMAN)
CSFLLLLLF

SEQ ID NO: 119259 - protein, 10 aa, Artificial Sequence
  Description of Artificial Sequence: Synthetic peptide
  Seed: SCLCSFLLLL (MOG_HUMAN)
SPLCSFLLLI

SEQ ID NO: 119260 - protein, 9 aa, Artificial Sequence
  Description of Artificial Sequence: Synthetic peptide
  Seed: HSYQEEAAM (MOG_HUMAN)
HYYQEEAAM

SEQ ID NO: 119261 - protein, 10 aa, Artificial Sequence
  Description of Artificial Sequence: Synthetic peptide
  Seed: FTCFFRDHSY (MOG_HUMAN)
FYCFFRDHSY

SEQ ID NO: 119262 - protein, 9 aa, Artificial Sequence
  Description of Artificial Sequence: Synthetic peptide
  Seed: WVSPGVLVL (MOG_HUMAN)
WHSPGVLVM

SEQ ID NO: 119263 - protein, 11 aa, Artificial Sequence
  Description of Artificial Sequence: Synthetic peptide
  Seed: SSSYAGQFRVI (MOG_HUMAN)
SWSYAGQFRVF

SEQ ID NO: 119264 - protein, 10 aa, Artificial Sequence
  Description of Artificial Sequence: Synthetic peptide
  Seed: ITLFVIVPVL (MOG_HUMAN)
IFLFVIVPVV

SEQ ID NO: 119265 - protein, 9 aa, Artificial Sequence
  Description of Artificial Sequence: Synthetic peptide
  Seed: WVSPGVLVL (MOG_HUMAN)
WMSPGVLVY

SEQ ID NO: 119266 - protein, 9 aa, Artificial Sequence
  Description of Artificial Sequence: Synthetic peptide
  Seed: VSPGVLVLL (MOG_HUMAN)
VMPGVLVLI

SEQ ID NO: 119267 - protein, 10 aa, Artificial Sequence
  Description of Artificial Sequence: Synthetic peptide
  Seed: AGQFRVIGPR (MOG_HUMAN)
ALQFRVIGPR

SEQ ID NO: 119268 - protein, 10 aa, Artificial Sequence
  Description of Artificial Sequence: Synthetic peptide
  Seed: LVLLAVLPVL (MOG_HUMAN)
LELLAVLPVI

SEQ ID NO: 119269 - protein, 10 aa, Artificial Sequence
  Description of Artificial Sequence: Synthetic peptide
  Seed: RVVHLYRNGK (MOG_HUMAN)
RDVHLYRNGR

SEQ ID NO: 119270 - protein, 9 aa, Artificial Sequence
  Description of Artificial Sequence: Synthetic peptide
  Seed: SLPSCLCSF (MOG_HUMAN)
SMPSCLCSF

SEQ ID NO: 119271 - protein, 9 aa, Artificial Sequence
  Description of Artificial Sequence: Synthetic peptide
  Seed: KVTLRIRNV (MOG_HUMAN)
KATLRIRNK

SEQ ID NO: 119272 - protein, 9 aa, Artificial Sequence
  Description of Artificial Sequence: Synthetic peptide
  Seed: TVGLIFLCL (MOG_HUMAN)
TMGLIFLCV

SEQ ID NO: 119273 - protein, 9 aa, Artificial Sequence
  Description of Artificial Sequence: Synthetic peptide
  Seed: FSDEGGFTC (MOG_HUMAN)
FMDEGGFTY

SEQ ID NO: 119274 - protein, 10 aa, Artificial Sequence
  Description of Artificial Sequence: Synthetic peptide
  Seed: RTFDPHFLRV (MOG_HUMAN)
RSFDPHFLRI

SEQ ID NO: 119275 - protein, 10 aa, Artificial Sequence
  Description of Artificial Sequence: Synthetic peptide
  Seed: RTFDPHFLRV (MOG_HUMAN)
RTFDPHFLRQ

SEQ ID NO: 119276 - protein, 9 aa, Artificial Sequence
  Description of Artificial Sequence: Synthetic peptide
  Seed: YRPPFSRVV (MOG_HUMAN)
YHPPFSRVM

SEQ ID NO: 119277 - protein, 9 aa, Artificial Sequence
  Description of Artificial Sequence: Synthetic peptide
  Seed: GLIFLCLQY (MOG_HUMAN)
GIIFLCLQY

SEQ ID NO: 119278 - protein, 10 aa, Artificial Sequence
  Description of Artificial Sequence: Synthetic peptide
  Seed: RTFDPHFLRV (MOG_HUMAN)
RVFDPHFLRM

SEQ ID NO: 119279 - protein, 9 aa, Artificial Sequence
  Description of Artificial Sequence: Synthetic peptide
  Seed: HSYQEEAAM (MOG_HUMAN)
HLYQEEAAW

SEQ ID NO: 119280 - protein, 9 aa, Artificial Sequence
  Description of Artificial Sequence: Synthetic peptide
  Seed: SSYAGQFRV (MOG_HUMAN)
SQYAGQFRF

SEQ ID NO: 119281 - protein, 10 aa, Artificial Sequence
  Description of Artificial Sequence: Synthetic peptide
  Seed: MELKVEDPFY (MOG_HUMAN)
MYLKVEDPFY

SEQ ID NO: 119282 - protein, 10 aa, Artificial Sequence
  Description of Artificial Sequence: Synthetic peptide
  Seed: RTFDPHFLRV (MOG_HUMAN)
RTFDPHFLRF

SEQ ID NO: 119283 - protein, 9 aa, Artificial Sequence
  Description of Artificial Sequence: Synthetic peptide
  Seed: RIRNVRFSD (MOG_HUMAN)
RYRNVRFSA

SEQ ID NO: 119284 - protein, 9 aa, Artificial Sequence
  Description of Artificial Sequence: Synthetic peptide
  Seed: YQEEAAMEL (MOG_HUMAN)
YPEEAAMEY

SEQ ID NO: 119285 - protein, 10 aa, Artificial Sequence
  Description of Artificial Sequence: Synthetic peptide
  Seed: RTFDPHFLRV (MOG_HUMAN)
RTFDPHFLRS

SEQ ID NO: 119286 - protein, 11 aa, Artificial Sequence
  Description of Artificial Sequence: Synthetic peptide
  Seed: VLVLLAVLPVL (MOG_HUMAN)
VQVLLAVLPVV

SEQ ID NO: 119287 - protein, 10 aa, Artificial Sequence
  Description of Artificial Sequence: Synthetic peptide
  Seed: FVIVPVLGPL (MOG_HUMAN)
FQIVPVLGPI

SEQ ID NO: 119288 - protein, 9 aa, Artificial Sequence
  Description of Artificial Sequence: Synthetic peptide
  Seed: LSRPSLPSC (MOG_HUMAN)
LTRPSLPSF

SEQ ID NO: 119289 - protein, 9 aa, Artificial Sequence
  Description of Artificial Sequence: Synthetic peptide
  Seed: TCFFRDHSY (MOG_HUMAN)
TTFFRDHSF

SEQ ID NO: 119290 - protein, 10 aa, Artificial Sequence
  Description of Artificial Sequence: Synthetic peptide
  Seed: IGPRHPIRAL (MOG_HUMAN)
INPRHPIRAI

SEQ ID NO: 119291 - protein, 9 aa, Artificial Sequence
  Description of Artificial Sequence: Synthetic peptide
  Seed: RTFDPHFLR (MOG_HUMAN)
RFFDPHFLF

SEQ ID NO: 119292 - protein, 9 aa, Artificial Sequence
  Description of Artificial Sequence: Synthetic peptide
  Seed: SSSYAGQFR (MOG_HUMAN)
SISYAGQFK

SEQ ID NO: 119293 - protein, 11 aa, Artificial Sequence
  Description of Artificial Sequence: Synthetic peptide
  Seed: HSYQEEAAMEL (MOG_HUMAN)
HQYQEEAAMEF

SEQ ID NO: 119294 - protein, 8 aa, Artificial Sequence
  Description of Artificial Sequence: Synthetic peptide
  Seed: VIGPRHPI (MOG_HUMAN)
VVGPRHPL

SEQ ID NO: 119295 - protein, 9 aa, Artificial Sequence
  Description of Artificial Sequence: Synthetic peptide
  Seed: LGPLVALII (MOG_HUMAN)
LPPLVALIV

SEQ ID NO: 119296 - protein, 9 aa, Artificial Sequence
  Description of Artificial Sequence: Synthetic peptide
  Seed: FSDEGGFTC (MOG_HUMAN)
FGDEGGFTY

SEQ ID NO: 119297 - protein, 9 aa, Artificial Sequence
  Description of Artificial Sequence: Synthetic peptide
  Seed: VGDEVELPC (MOG_HUMAN)
VGDEVELPM

SEQ ID NO: 119298 - protein, 11 aa, Artificial Sequence
  Description of Artificial Sequence: Synthetic peptide
  Seed: FSDEGGFTCFF (MOG_HUMAN)
FVDEGGFTCFM

SEQ ID NO: 119299 - protein, 9 aa, Artificial Sequence
  Description of Artificial Sequence: Synthetic peptide
  Seed: RTFDPHFLR (MOG_HUMAN)
RWFDPHFLK

SEQ ID NO: 119300 - protein, 9 aa, Artificial Sequence
  Description of Artificial Sequence: Synthetic peptide
  Seed: RVIGPRHPI (MOG_HUMAN)
RAIGPRHPA

SEQ ID NO: 119301 - protein, 10 aa, Artificial Sequence
  Description of Artificial Sequence: Synthetic peptide
  Seed: WVSPGVLVLL (MOG_HUMAN)
WISPGVLVLV

SEQ ID NO: 119302 - protein, 10 aa, Artificial Sequence
  Description of Artificial Sequence: Synthetic peptide
  Seed: ATGMEVGWYR (MOG_HUMAN)
AVGMEVGWYK

SEQ ID NO: 119303 - protein, 9 aa, Artificial Sequence
  Description of Artificial Sequence: Synthetic peptide
  Seed: RVIGPRHPI (MOG_HUMAN)
RLIGPRHPY

SEQ ID NO: 119304 - protein, 9 aa, Artificial Sequence
  Description of Artificial Sequence: Synthetic peptide
  Seed: IGEGKVTLR (MOG_HUMAN)
IAEGKVTLM

SEQ ID NO: 119305 - protein, 10 aa, Artificial Sequence
  Description of Artificial Sequence: Synthetic peptide
  Seed: LVLLAVLPVL (MOG_HUMAN)
LVLLAVLPVV

SEQ ID NO: 119306 - protein, 10 aa, Artificial Sequence
  Description of Artificial Sequence: Synthetic peptide
  Seed: AGQFRVIGPR (MOG_HUMAN)
AWQFRVIGPR

SEQ ID NO: 119307 - protein, 9 aa, Artificial Sequence
  Description of Artificial Sequence: Synthetic peptide
  Seed: TFDPHFLRV (MOG_HUMAN)
TADPHFLRI

SEQ ID NO: 119308 - protein, 10 aa, Artificial Sequence
  Description of Artificial Sequence: Synthetic peptide
  Seed: FSDEGGFTCF (MOG_HUMAN)
FTDEGGFTCV

SEQ ID NO: 119309 - protein, 9 aa, Artificial Sequence
  Description of Artificial Sequence: Synthetic peptide
  Seed: VSPGVLVLL (MOG_HUMAN)
VAPGVLVLF

SEQ ID NO: 119310 - protein, 9 aa, Artificial Sequence
  Description of Artificial Sequence: Synthetic peptide
  Seed: RIRNVRFSD (MOG_HUMAN)
RQRNVRFST

SEQ ID NO: 119311 - protein, 10 aa, Artificial Sequence
  Description of Artificial Sequence: Synthetic peptide
  Seed: YWVSPGVLVL (MOG_HUMAN)
YMVSPGVLVF

SEQ ID NO: 119312 - protein, 9 aa, Artificial Sequence
  Description of Artificial Sequence: Synthetic peptide
  Seed: VSSSYAGQF (MOG_HUMAN)
VTSSYAGQW

SEQ ID NO: 119313 - protein, 10 aa, Artificial Sequence
  Description of Artificial Sequence: Synthetic peptide
  Seed: LVALIICYNW (MOG_HUMAN)
LTALIICYNW

SEQ ID NO: 119314 - protein, 10 aa, Artificial Sequence
  Description of Artificial Sequence: Synthetic peptide
  Seed: RVIGPRHPIR (MOG_HUMAN)
RSIGPRHPIA

SEQ ID NO: 119315 - protein, 8 aa, Artificial Sequence
  Description of Artificial Sequence: Synthetic peptide
  Seed: VLGPLVAL (MOG_HUMAN)
VAGPLVAM

SEQ ID NO: 119316 - protein, 9 aa, Artificial Sequence
  Description of Artificial Sequence: Synthetic peptide
  Seed: EVGWYRPPF (MOG_HUMAN)
EVGWYRPPR

SEQ ID NO: 119317 - protein, 9 aa, Artificial Sequence
  Description of Artificial Sequence: Synthetic peptide
  Seed: LSRPSLPSC (MOG_HUMAN)
LNRPSLPSW

SEQ ID NO: 119318 - protein, 10 aa, Artificial Sequence
  Description of Artificial Sequence: Synthetic peptide
  Seed: FRVIGPRHPI (MOG_HUMAN)
FYVIGPRHPV

SEQ ID NO: 119319 - protein, 10 aa, Artificial Sequence
  Description of Artificial Sequence: Synthetic peptide
  Seed: SCLCSFLLLL (MOG_HUMAN)
SALCSFLLLL

SEQ ID NO: 119320 - protein, 9 aa, Artificial Sequence
  Description of Artificial Sequence: Synthetic peptide
  Seed: GQFRVIGPR (MOG_HUMAN)
GRFRVIGPL

SEQ ID NO: 119321 - protein, 9 aa, Artificial Sequence
  Description of Artificial Sequence: Synthetic peptide
  Seed: YWVSPGVLV (MOG_HUMAN)
YFVSPGVLL

SEQ ID NO: 119322 - protein, 10 aa, Artificial Sequence
  Description of Artificial Sequence: Synthetic peptide
  Seed: AEIENLHRTF (MOG_HUMAN)
AEIENLHRTP

SEQ ID NO: 119323 - protein, 10 aa, Artificial Sequence
  Description of Artificial Sequence: Synthetic peptide
  Seed: VSSSYAGQFR (MOG_HUMAN)
VFSSYAGQFR

SEQ ID NO: 119324 - protein, 9 aa, Artificial Sequence
  Description of Artificial Sequence: Synthetic peptide
  Seed: ITLFVIVPV (MOG_HUMAN)
ILLFVIVPV

SEQ ID NO: 119325 - protein, 9 aa, Artificial Sequence
  Description of Artificial Sequence: Synthetic peptide
  Seed: MEVGWYRPP (MOG_HUMAN)
MEVGWYRPY

SEQ ID NO: 119326 - protein, 10 aa, Artificial Sequence
  Description of Artificial Sequence: Synthetic peptide
  Seed: SLSRPSLPSC (MOG_HUMAN)
SISRPSLPSA

SEQ ID NO: 119327 - protein, 9 aa, Artificial Sequence
  Description of Artificial Sequence: Synthetic peptide
  Seed: RVPCWKITL (MOG_HUMAN)
RTPCWKITL

SEQ ID NO: 119328 - protein, 11 aa, Artificial Sequence
  Description of Artificial Sequence: Synthetic peptide
  Seed: RFSDEGGFTCF (MOG_HUMAN)
RFSDEGGFTCY

SEQ ID NO: 119329 - protein, 9 aa, Artificial Sequence
  Description of Artificial Sequence: Synthetic peptide
  Seed: EGGFTCFFR (MOG_HUMAN)
EWGFTCFFR

SEQ ID NO: 119330 - protein, 11 aa, Artificial Sequence
  Description of Artificial Sequence: Synthetic peptide
  Seed: RDHSYQEEAAM (MOG_HUMAN)
RCHSYQEEAAF

SEQ ID NO: 119331 - protein, 9 aa, Artificial Sequence
  Description of Artificial Sequence: Synthetic peptide
  Seed: VVHLYRNGK (MOG_HUMAN)
VSHLYRNGR

SEQ ID NO: 119332 - protein, 9 aa, Artificial Sequence
  Description of Artificial Sequence: Synthetic peptide
  Seed: RRLAGQFLE (MOG_HUMAN)
RRLAGQFLA

SEQ ID NO: 119333 - protein, 9 aa, Artificial Sequence
  Description of Artificial Sequence: Synthetic peptide
  Seed: HSYQEEAAM (MOG_HUMAN)
HPYQEEAAY

SEQ ID NO: 119334 - protein, 10 aa, Artificial Sequence
  Description of Artificial Sequence: Synthetic peptide
  Seed: LQITVGLIFL (MOG_HUMAN)
LLITVGLIFA

SEQ ID NO: 119335 - protein, 10 aa, Artificial Sequence
  Description of Artificial Sequence: Synthetic peptide
  Seed: RTFDPHFLRV (MOG_HUMAN)
RMFDPHFLRY

SEQ ID NO: 119336 - protein, 10 aa, Artificial Sequence
  Description of Artificial Sequence: Synthetic peptide
  Seed: LVLLAVLPVL (MOG_HUMAN)
LNLLAVLPVV

SEQ ID NO: 119337 - protein, 9 aa, Artificial Sequence
  Description of Artificial Sequence: Synthetic peptide
  Seed: IICYNWLHR (MOG_HUMAN)
IQCYNWLHR

SEQ ID NO: 119338 - protein, 10 aa, Artificial Sequence
  Description of Artificial Sequence: Synthetic peptide
  Seed: VSSSYAGQFR (MOG_HUMAN)
VSSSYAGQFY

SEQ ID NO: 119339 - protein, 10 aa, Artificial Sequence
  Description of Artificial Sequence: Synthetic peptide
  Seed: ATGMEVGWYR (MOG_HUMAN)
AAGMEVGWYR

SEQ ID NO: 119340 - protein, 11 aa, Artificial Sequence
  Description of Artificial Sequence: Synthetic peptide
  Seed: VIGPRHPIRAL (MOG_HUMAN)
VHGPRHPIRAM

SEQ ID NO: 119341 - protein, 9 aa, Artificial Sequence
  Description of Artificial Sequence: Synthetic peptide
  Seed: WVSPGVLVL (MOG_HUMAN)
WTSPGVLVY

SEQ ID NO: 119342 - protein, 10 aa, Artificial Sequence
  Description of Artificial Sequence: Synthetic peptide
  Seed: RIRNVRFSDE (MOG_HUMAN)
RFRNVRFSDV

SEQ ID NO: 119343 - protein, 10 aa, Artificial Sequence
  Description of Artificial Sequence: Synthetic peptide
  Seed: LQITVGLIFL (MOG_HUMAN)
LMITVGLIFL

SEQ ID NO: 119344 - protein, 10 aa, Artificial Sequence
  Description of Artificial Sequence: Synthetic peptide
  Seed: VPVLGPLVAL (MOG_HUMAN)
VTVLGPLVAV

SEQ ID NO: 119345 - protein, 9 aa, Artificial Sequence
  Description of Artificial Sequence: Synthetic peptide
  Seed: VLGPLVALI (MOG_HUMAN)
VLGPLVALV

SEQ ID NO: 119346 - protein, 9 aa, Artificial Sequence
  Description of Artificial Sequence: Synthetic peptide
  Seed: WYRPPFSRV (MOG_HUMAN)
WYRPPFSRL

SEQ ID NO: 119347 - protein, 9 aa, Artificial Sequence
  Description of Artificial Sequence: Synthetic peptide
  Seed: RTFDPHFLR (MOG_HUMAN)
RQFDPHFLL

SEQ ID NO: 119348 - protein, 9 aa, Artificial Sequence
  Description of Artificial Sequence: Synthetic peptide
  Seed: RTFDPHFLR (MOG_HUMAN)
RVFDPHFLF

SEQ ID NO: 119349 - protein, 8 aa, Artificial Sequence
  Description of Artificial Sequence: Synthetic peptide
  Seed: FSDEGGFT (MOG_HUMAN)
FTDEGGFL

SEQ ID NO: 119350 - protein, 9 aa, Artificial Sequence
  Description of Artificial Sequence: Synthetic peptide
  Seed: FLEELRNPF (MOG_HUMAN)
FQEELRNPF

SEQ ID NO: 119351 - protein, 9 aa, Artificial Sequence
  Description of Artificial Sequence: Synthetic peptide
  Seed: GWYRPPFSR (MOG_HUMAN)
GVYRPPFSR

SEQ ID NO: 119352 - protein, 9 aa, Artificial Sequence
  Description of Artificial Sequence: Synthetic peptide
  Seed: SLPSCLCSF (MOG_HUMAN)
SFPSCLCSW

SEQ ID NO: 119353 - protein, 10 aa, Artificial Sequence
  Description of Artificial Sequence: Synthetic peptide
  Seed: AEIENLHRTF (MOG_HUMAN)
AQIENLHRTL

SEQ ID NO: 119354 - protein, 9 aa, Artificial Sequence
  Description of Artificial Sequence: Synthetic peptide
  Seed: ITVGLIFLC (MOG_HUMAN)
IIVGLIFLV

SEQ ID NO: 119355 - protein, 10 aa, Artificial Sequence
  Description of Artificial Sequence: Synthetic peptide
  Seed: LLQITVGLIF (MOG_HUMAN)
LHQITVGLIY

SEQ ID NO: 119356 - protein, 11 aa, Artificial Sequence
  Description of Artificial Sequence: Synthetic peptide
  Seed: SDEGGFTCFFR (MOG_HUMAN)
SVEGGFTCFFR

SEQ ID NO: 119357 - protein, 9 aa, Artificial Sequence
  Description of Artificial Sequence: Synthetic peptide
  Seed: KDAIGEGKV (MOG_HUMAN)
KEAIGEGKA

SEQ ID NO: 119358 - protein, 11 aa, Artificial Sequence
  Description of Artificial Sequence: Synthetic peptide
  Seed: RFSDEGGFTCF (MOG_HUMAN)
RTSDEGGFTCM

SEQ ID NO: 119359 - protein, 10 aa, Artificial Sequence
  Description of Artificial Sequence: Synthetic peptide
  Seed: FDPHFLRVPC (MOG_HUMAN)
FKPHFLRVPM

SEQ ID NO: 119360 - protein, 9 aa, Artificial Sequence
  Description of Artificial Sequence: Synthetic peptide
  Seed: TLFVIVPVL (MOG_HUMAN)
TVFVIVPVV

SEQ ID NO: 119361 - protein, 9 aa, Artificial Sequence
  Description of Artificial Sequence: Synthetic peptide
  Seed: LAGQFLEEL (MOG_HUMAN)
LLGQFLEEM

SEQ ID NO: 119362 - protein, 9 aa, Artificial Sequence
  Description of Artificial Sequence: Synthetic peptide
  Seed: TGMEVGWYR (MOG_HUMAN)
TAMEVGWYL

SEQ ID NO: 119363 - protein, 9 aa, Artificial Sequence
  Description of Artificial Sequence: Synthetic peptide
  Seed: RVIGPRHPI (MOG_HUMAN)
RFIGPRHPM

SEQ ID NO: 119364 - protein, 9 aa, Artificial Sequence
  Description of Artificial Sequence: Synthetic peptide
  Seed: KLRAEIENL (MOG_HUMAN)
KVRAEIENI

SEQ ID NO: 119365 - protein, 9 aa, Artificial Sequence
  Description of Artificial Sequence: Synthetic peptide
  Seed: SLPSCLCSF (MOG_HUMAN)
SWPSCLCSW

SEQ ID NO: 119366 - protein, 9 aa, Artificial Sequence
  Description of Artificial Sequence: Synthetic peptide
  Seed: FLEELRNPF (MOG_HUMAN)
FVEELRNPY

SEQ ID NO: 119367 - protein, 9 aa, Artificial Sequence
  Description of Artificial Sequence: Synthetic peptide
  Seed: TCFFRDHSY (MOG_HUMAN)
TKFFRDHSM

SEQ ID NO: 119368 - protein, 9 aa, Artificial Sequence
  Description of Artificial Sequence: Synthetic peptide
  Seed: RVIGPRHPI (MOG_HUMAN)
RVIGPRHPK

SEQ ID NO: 119369 - protein, 9 aa, Artificial Sequence
  Description of Artificial Sequence: Synthetic peptide
  Seed: ALVGDEVEL (MOG_HUMAN)
AAVGDEVEL

SEQ ID NO: 119370 - protein, 10 aa, Artificial Sequence
  Description of Artificial Sequence: Synthetic peptide
  Seed: LLQITVGLIF (MOG_HUMAN)
LPQITVGLIF

SEQ ID NO: 119371 - protein, 10 aa, Artificial Sequence
  Description of Artificial Sequence: Synthetic peptide
  Seed: VPVLGPLVAL (MOG_HUMAN)
VPVLGPLVAA

SEQ ID NO: 119372 - protein, 9 aa, Artificial Sequence
  Description of Artificial Sequence: Synthetic peptide
  Seed: QDGDQAPEY (MOG_HUMAN)
QLGDQAPEY

SEQ ID NO: 119373 - protein, 10 aa, Artificial Sequence
  Description of Artificial Sequence: Synthetic peptide
  Seed: IICYNWLHRR (MOG_HUMAN)
IYCYNWLHRR

SEQ ID NO: 119374 - protein, 8 aa, Artificial Sequence
  Description of Artificial Sequence: Synthetic peptide
  Seed: RIRNVRFS (MOG_HUMAN)
RVRNVRFI

SEQ ID NO: 119375 - protein, 9 aa, Artificial Sequence
  Description of Artificial Sequence: Synthetic peptide
  Seed: LVLLAVLPV (MOG_HUMAN)
LTLLAVLPV

SEQ ID NO: 119376 - protein, 10 aa, Artificial Sequence
  Description of Artificial Sequence: Synthetic peptide
  Seed: IGPRHPIRAL (MOG_HUMAN)
IWPRHPIRAV

SEQ ID NO: 119377 - protein, 9 aa, Artificial Sequence
  Description of Artificial Sequence: Synthetic peptide
  Seed: YWVSPGVLV (MOG_HUMAN)
YAVSPGVLL

SEQ ID NO: 119378 - protein, 10 aa, Artificial Sequence
  Description of Artificial Sequence: Synthetic peptide
  Seed: ATGMEVGWYR (MOG_HUMAN)
APGMEVGWYR

SEQ ID NO: 119379 - protein, 11 aa, Artificial Sequence
  Description of Artificial Sequence: Synthetic peptide
  Seed: HRTFDPHFLRV (MOG_HUMAN)
HETFDPHFLRK

SEQ ID NO: 119380 - protein, 10 aa, Artificial Sequence
  Description of Artificial Sequence: Synthetic peptide
  Seed: FRVIGPRHPI (MOG_HUMAN)
FLVIGPRHPV

SEQ ID NO: 119381 - protein, 9 aa, Artificial Sequence
  Description of Artificial Sequence: Synthetic peptide
  Seed: LKVEDPFYW (MOG_HUMAN)
LVVEDPFYW

SEQ ID NO: 119382 - protein, 10 aa, Artificial Sequence
  Description of Artificial Sequence: Synthetic peptide
  Seed: TGMEVGWYRP (MOG_HUMAN)
TLMEVGWYRK

SEQ ID NO: 119383 - protein, 9 aa, Artificial Sequence
  Description of Artificial Sequence: Synthetic peptide
  Seed: ITLFVIVPV (MOG_HUMAN)
ITLFVIVPL

SEQ ID NO: 119384 - protein, 9 aa, Artificial Sequence
  Description of Artificial Sequence: Synthetic peptide
  Seed: KLRAEIENL (MOG_HUMAN)
KSRAEIENA

SEQ ID NO: 119385 - protein, 10 aa, Artificial Sequence
  Description of Artificial Sequence: Synthetic peptide
  Seed: RIRNVRFSDE (MOG_HUMAN)
RWRNVRFSDA

SEQ ID NO: 119386 - protein, 11 aa, Artificial Sequence
  Description of Artificial Sequence: Synthetic peptide
  Seed: DAIGEGKVTLR (MOG_HUMAN)
DTIGEGKVTLR

SEQ ID NO: 119387 - protein, 10 aa, Artificial Sequence
  Description of Artificial Sequence: Synthetic peptide
  Seed: SLSRPSLPSC (MOG_HUMAN)
SLSRPSLPSA

SEQ ID NO: 119388 - protein, 10 aa, Artificial Sequence
  Description of Artificial Sequence: Synthetic peptide
  Seed: YWVSPGVLVL (MOG_HUMAN)
YMVSPGVLVI

SEQ ID NO: 119389 - protein, 10 aa, Artificial Sequence
  Description of Artificial Sequence: Synthetic peptide
  Seed: IGPRHPIRAL (MOG_HUMAN)
IAPRHPIRAV

SEQ ID NO: 119390 - protein, 11 aa, Artificial Sequence
  Description of Artificial Sequence: Synthetic peptide
  Seed: RPSLPSCLCSF (MOG_HUMAN)
RASLPSCLCSW

SEQ ID NO: 119391 - protein, 10 aa, Artificial Sequence
  Description of Artificial Sequence: Synthetic peptide
  Seed: RLRGKLRAEI (MOG_HUMAN)
RVRGKLRAEK

SEQ ID NO: 119392 - protein, 9 aa, Artificial Sequence
  Description of Artificial Sequence: Synthetic peptide
  Seed: AIGEGKVTL (MOG_HUMAN)
AMGEGKVTL

SEQ ID NO: 119393 - protein, 10 aa, Artificial Sequence
  Description of Artificial Sequence: Synthetic peptide
  Seed: IGPRHPIRAL (MOG_HUMAN)
IKPRHPIRAL

SEQ ID NO: 119394 - protein, 9 aa, Artificial Sequence
  Description of Artificial Sequence: Synthetic peptide
  Seed: LLLQVSSSY (MOG_HUMAN)
LSLQVSSSI

SEQ ID NO: 119395 - protein, 10 aa, Artificial Sequence
  Description of Artificial Sequence: Synthetic peptide
  Seed: RTFDPHFLRV (MOG_HUMAN)
RAFDPHFLRW

SEQ ID NO: 119396 - protein, 9 aa, Artificial Sequence
  Description of Artificial Sequence: Synthetic peptide
  Seed: YQEEAAMEL (MOG_HUMAN)
YIEEAAMEM

SEQ ID NO: 119397 - protein, 9 aa, Artificial Sequence
  Description of Artificial Sequence: Synthetic peptide
  Seed: NATGMEVGW (MOG_HUMAN)
NPTGMEVGW

SEQ ID NO: 119398 - protein, 10 aa, Artificial Sequence
  Description of Artificial Sequence: Synthetic peptide
  Seed: GLIFLCLQYR (MOG_HUMAN)
GSIFLCLQYR

SEQ ID NO: 119399 - protein, 10 aa, Artificial Sequence
  Description of Artificial Sequence: Synthetic peptide
  Seed: FDPHFLRVPC (MOG_HUMAN)
FSPHFLRVPA

SEQ ID NO: 119400 - protein, 10 aa, Artificial Sequence
  Description of Artificial Sequence: Synthetic peptide
  Seed: AVLPVLLLQI (MOG_HUMAN)
AMLPVLLLQV

SEQ ID NO: 119401 - protein, 11 aa, Artificial Sequence
  Description of Artificial Sequence: Synthetic peptide
  Seed: RTFDPHFLRVP (MOG_HUMAN)
RLFDPHFLRVK

SEQ ID NO: 119402 - protein, 10 aa, Artificial Sequence
  Description of Artificial Sequence: Synthetic peptide
  Seed: FVIVPVLGPL (MOG_HUMAN)
FSIVPVLGPL

SEQ ID NO: 119403 - protein, 10 aa, Artificial Sequence
  Description of Artificial Sequence: Synthetic peptide
  Seed: FYWVSPGVLV (MOG_HUMAN)
FYWVSPGVLF

SEQ ID NO: 119404 - protein, 9 aa, Artificial Sequence
  Description of Artificial Sequence: Synthetic peptide
  Seed: FSDEGGFTC (MOG_HUMAN)
FDDEGGFTI

SEQ ID NO: 119405 - protein, 10 aa, Artificial Sequence
  Description of Artificial Sequence: Synthetic peptide
  Seed: FDPHFLRVPC (MOG_HUMAN)
FAPHFLRVPA

SEQ ID NO: 119406 - protein, 9 aa, Artificial Sequence
  Description of Artificial Sequence: Synthetic peptide
  Seed: MASLSRPSL (MOG_HUMAN)
MTSLSRPSM

SEQ ID NO: 119407 - protein, 9 aa, Artificial Sequence
  Description of Artificial Sequence: Synthetic peptide
  Seed: RIRNVRFSD (MOG_HUMAN)
RARNVRFSL

SEQ ID NO: 119408 - protein, 11 aa, Artificial Sequence
  Description of Artificial Sequence: Synthetic peptide
  Seed: RTFDPHFLRVP (MOG_HUMAN)
RMFDPHFLRVP

SEQ ID NO: 119409 - protein, 9 aa, Artificial Sequence
  Description of Artificial Sequence: Synthetic peptide
  Seed: LHRTFDPHF (MOG_HUMAN)
LLRTFDPHY

SEQ ID NO: 119410 - protein, 9 aa, Artificial Sequence
  Description of Artificial Sequence: Synthetic peptide
  Seed: RTFDPHFLR (MOG_HUMAN)
RMFDPHFLH

SEQ ID NO: 119411 - protein, 9 aa, Artificial Sequence
  Description of Artificial Sequence: Synthetic peptide
  Seed: DEVELPCRI (MOG_HUMAN)
DEVELPCRY

SEQ ID NO: 119412 - protein, 10 aa, Artificial Sequence
  Description of Artificial Sequence: Synthetic peptide
  Seed: SDEGGFTCFF (MOG_HUMAN)
SNEGGFTCFW

SEQ ID NO: 119413 - protein, 11 aa, Artificial Sequence
  Description of Artificial Sequence: Synthetic peptide
  Seed: LHRTFDPHFLR (MOG_HUMAN)
LDRTFDPHFLK

SEQ ID NO: 119414 - protein, 11 aa, Artificial Sequence
  Description of Artificial Sequence: Synthetic peptide
  Seed: DGDQAPEYRGR (MOG_HUMAN)
DTDQAPEYRGR

SEQ ID NO: 119415 - protein, 9 aa, Artificial Sequence
  Description of Artificial Sequence: Synthetic peptide
  Seed: RTFDPHFLR (MOG_HUMAN)
RIFDPHFLK

SEQ ID NO: 119416 - protein, 10 aa, Artificial Sequence
  Description of Artificial Sequence: Synthetic peptide
  Seed: YWVSPGVLVL (MOG_HUMAN)
YCVSPGVLVM

SEQ ID NO: 119417 - protein, 10 aa, Artificial Sequence
  Description of Artificial Sequence: Synthetic peptide
  Seed: RIRNVRFSDE (MOG_HUMAN)
RSRNVRFSDL

SEQ ID NO: 119418 - protein, 9 aa, Artificial Sequence
  Description of Artificial Sequence: Synthetic peptide
  Seed: VGDEVELPC (MOG_HUMAN)
VCDEVELPI

SEQ ID NO: 119419 - protein, 10 aa, Artificial Sequence
  Description of Artificial Sequence: Synthetic peptide
  Seed: VGDEVELPCR (MOG_HUMAN)
VSDEVELPCY

SEQ ID NO: 119420 - protein, 10 aa, Artificial Sequence
  Description of Artificial Sequence: Synthetic peptide
  Seed: RTFDPHFLRV (MOG_HUMAN)
RSFDPHFLRM

SEQ ID NO: 119421 - protein, 9 aa, Artificial Sequence
  Description of Artificial Sequence: Synthetic peptide
  Seed: MASLSRPSL (MOG_HUMAN)
MISLSRPSW

SEQ ID NO: 119422 - protein, 10 aa, Artificial Sequence
  Description of Artificial Sequence: Synthetic peptide
  Seed: RTFDPHFLRV (MOG_HUMAN)
RAFDPHFLRL

SEQ ID NO: 119423 - protein, 10 aa, Artificial Sequence
  Description of Artificial Sequence: Synthetic peptide
  Seed: MEVGWYRPPF (MOG_HUMAN)
MLVGWYRPPF

SEQ ID NO: 119424 - protein, 9 aa, Artificial Sequence
  Description of Artificial Sequence: Synthetic peptide
  Seed: IFLCLQYRL (MOG_HUMAN)
IWLCLQYRI

SEQ ID NO: 119425 - protein, 9 aa, Artificial Sequence
  Description of Artificial Sequence: Synthetic peptide
  Seed: SCLCSFLLL (MOG_HUMAN)
SSLCSFLLF

SEQ ID NO: 119426 - protein, 9 aa, Artificial Sequence
  Description of Artificial Sequence: Synthetic peptide
  Seed: ALVGDEVEL (MOG_HUMAN)
ALVGDEVEY

SEQ ID NO: 119427 - protein, 11 aa, Artificial Sequence
  Description of Artificial Sequence: Synthetic peptide
  Seed: RDHSYQEEAAM (MOG_HUMAN)
RRHSYQEEAAF

SEQ ID NO: 119428 - protein, 11 aa, Artificial Sequence
  Description of Artificial Sequence: Synthetic peptide
  Seed: VIGPRHPIRAL (MOG_HUMAN)
VHGPRHPIRAL

SEQ ID NO: 119429 - protein, 9 aa, Artificial Sequence
  Description of Artificial Sequence: Synthetic peptide
  Seed: VLLAVLPVL (MOG_HUMAN)
VSLAVLPVF

SEQ ID NO: 119430 - protein, 9 aa, Artificial Sequence
  Description of Artificial Sequence: Synthetic peptide
  Seed: VSPGVLVLL (MOG_HUMAN)
VYPGVLVLV

SEQ ID NO: 119431 - protein, 9 aa, Artificial Sequence
  Description of Artificial Sequence: Synthetic peptide
  Seed: RVVHLYRNG (MOG_HUMAN)
RAVHLYRNK

SEQ ID NO: 119432 - protein, 10 aa, Artificial Sequence
  Description of Artificial Sequence: Synthetic peptide
  Seed: FSDEGGFTCF (MOG_HUMAN)
FIDEGGFTCL

SEQ ID NO: 119433 - protein, 10 aa, Artificial Sequence
  Description of Artificial Sequence: Synthetic peptide
  Seed: SSYAGQFRVI (MOG_HUMAN)
SSYAGQFRVL

SEQ ID NO: 119434 - protein, 11 aa, Artificial Sequence
  Description of Artificial Sequence: Synthetic peptide
  Seed: MELKVEDPFYW (MOG_HUMAN)
MGLKVEDPFYW

SEQ ID NO: 119435 - protein, 9 aa, Artificial Sequence
  Description of Artificial Sequence: Synthetic peptide
  Seed: SLPSCLCSF (MOG_HUMAN)
SMPSCLCSI

SEQ ID NO: 119436 - protein, 10 aa, Artificial Sequence
  Description of Artificial Sequence: Synthetic peptide
  Seed: RPPFSRVVHL (MOG_HUMAN)
RFPFSRVVHL

SEQ ID NO: 119437 - protein, 9 aa, Artificial Sequence
  Description of Artificial Sequence: Synthetic peptide
  Seed: ITLFVIVPV (MOG_HUMAN)
IMLFVIVPA

SEQ ID NO: 119438 - protein, 9 aa, Artificial Sequence
  Description of Artificial Sequence: Synthetic peptide
  Seed: SSYAGQFRV (MOG_HUMAN)
SLYAGQFRK

SEQ ID NO: 119439 - protein, 9 aa, Artificial Sequence
  Description of Artificial Sequence: Synthetic peptide
  Seed: LIICYNWLH (MOG_HUMAN)
LQICYNWLR

SEQ ID NO: 119440 - protein, 9 aa, Artificial Sequence
  Description of Artificial Sequence: Synthetic peptide
  Seed: MELKVEDPF (MOG_HUMAN)
MELKVEDPI

SEQ ID NO: 119441 - protein, 10 aa, Artificial Sequence
  Description of Artificial Sequence: Synthetic peptide
  Seed: VGDEVELPCR (MOG_HUMAN)
VIDEVELPCY

SEQ ID NO: 119442 - protein, 9 aa, Artificial Sequence
  Description of Artificial Sequence: Synthetic peptide
  Seed: FLEELRNPF (MOG_HUMAN)
FPEELRNPY

SEQ ID NO: 119443 - protein, 9 aa, Artificial Sequence
  Description of Artificial Sequence: Synthetic peptide
  Seed: WVSPGVLVL (MOG_HUMAN)
WMSPGVLVH

SEQ ID NO: 119444 - protein, 10 aa, Artificial Sequence
  Description of Artificial Sequence: Synthetic peptide
  Seed: RTFDPHFLRV (MOG_HUMAN)
RRFDPHFLRV

SEQ ID NO: 119445 - protein, 9 aa, Artificial Sequence
  Description of Artificial Sequence: Synthetic peptide
  Seed: RIRNVRFSD (MOG_HUMAN)
RTRNVRFSV

SEQ ID NO: 119446 - protein, 9 aa, Artificial Sequence
  Description of Artificial Sequence: Synthetic peptide
  Seed: VLGPLVALI (MOG_HUMAN)
VQGPLVALF

SEQ ID NO: 119447 - protein, 10 aa, Artificial Sequence
  Description of Artificial Sequence: Synthetic peptide
  Seed: RTFDPHFLRV (MOG_HUMAN)
RQFDPHFLRN

SEQ ID NO: 119448 - protein, 9 aa, Artificial Sequence
  Description of Artificial Sequence: Synthetic peptide
  Seed: VRFSDEGGF (MOG_HUMAN)
VKFSDEGGF

SEQ ID NO: 119449 - protein, 9 aa, Artificial Sequence
  Description of Artificial Sequence: Synthetic peptide
  Seed: KVEDPFYWV (MOG_HUMAN)
KMEDPFYWA

SEQ ID NO: 119450 - protein, 9 aa, Artificial Sequence
  Description of Artificial Sequence: Synthetic peptide
  Seed: EGKVTLRIR (MOG_HUMAN)
EVKVTLRIR

SEQ ID NO: 119451 - protein, 10 aa, Artificial Sequence
  Description of Artificial Sequence: Synthetic peptide
  Seed: HRTFDPHFLR (MOG_HUMAN)
HVTFDPHFLY

SEQ ID NO: 119452 - protein, 9 aa, Artificial Sequence
  Description of Artificial Sequence: Synthetic peptide
  Seed: LLLQVSSSY (MOG_HUMAN)
LQLQVSSSY

SEQ ID NO: 119453 - protein, 10 aa, Artificial Sequence
  Description of Artificial Sequence: Synthetic peptide
  Seed: TGMEVGWYRP (MOG_HUMAN)
TVMEVGWYRK

SEQ ID NO: 119454 - protein, 9 aa, Artificial Sequence
  Description of Artificial Sequence: Synthetic peptide
  Seed: TFDPHFLRV (MOG_HUMAN)
TRDPHFLRL

SEQ ID NO: 119455 - protein, 10 aa, Artificial Sequence
  Description of Artificial Sequence: Synthetic peptide
  Seed: FTCFFRDHSY (MOG_HUMAN)
FQCFFRDHSY

SEQ ID NO: 119456 - protein, 9 aa, Artificial Sequence
  Description of Artificial Sequence: Synthetic peptide
  Seed: AIGEGKVTL (MOG_HUMAN)
ATGEGKVTY

SEQ ID NO: 119457 - protein, 10 aa, Artificial Sequence
  Description of Artificial Sequence: Synthetic peptide
  Seed: VPVLGPLVAL (MOG_HUMAN)
VAVLGPLVAY

SEQ ID NO: 119458 - protein, 10 aa, Artificial Sequence
  Description of Artificial Sequence: Synthetic peptide
  Seed: FDPHFLRVPC (MOG_HUMAN)
FLPHFLRVPS

SEQ ID NO: 119459 - protein, 9 aa, Artificial Sequence
  Description of Artificial Sequence: Synthetic peptide
  Seed: LLLQITVGL (MOG_HUMAN)
LSLQITVGY

SEQ ID NO: 119460 - protein, 9 aa, Artificial Sequence
  Description of Artificial Sequence: Synthetic peptide
  Seed: RIRNVRFSD (MOG_HUMAN)
RSRNVRFSH

SEQ ID NO: 119461 - protein, 11 aa, Artificial Sequence
  Description of Artificial Sequence: Synthetic peptide
  Seed: VRFSDEGGFTC (MOG_HUMAN)
VQFSDEGGFTF

SEQ ID NO: 119462 - protein, 10 aa, Artificial Sequence
  Description of Artificial Sequence: Synthetic peptide
  Seed: RTFDPHFLRV (MOG_HUMAN)
RFFDPHFLRA

SEQ ID NO: 119463 - protein, 10 aa, Artificial Sequence
  Description of Artificial Sequence: Synthetic peptide
  Seed: ITVGLIFLCL (MOG_HUMAN)
IIVGLIFLCV

SEQ ID NO: 119464 - protein, 9 aa, Artificial Sequence
  Description of Artificial Sequence: Synthetic peptide
  Seed: FLEELRNPF (MOG_HUMAN)
FAEELRNPL

SEQ ID NO: 119465 - protein, 9 aa, Artificial Sequence
  Description of Artificial Sequence: Synthetic peptide
  Seed: VLLAVLPVL (MOG_HUMAN)
VALAVLPVF

SEQ ID NO: 119466 - protein, 10 aa, Artificial Sequence
  Description of Artificial Sequence: Synthetic peptide
  Seed: VPVLGPLVAL (MOG_HUMAN)
VPVLGPLVAM

SEQ ID NO: 119467 - protein, 9 aa, Artificial Sequence
  Description of Artificial Sequence: Synthetic peptide
  Seed: RIRNVRFSD (MOG_HUMAN)
RTRNVRFSY

SEQ ID NO: 119468 - protein, 9 aa, Artificial Sequence
  Description of Artificial Sequence: Synthetic peptide
  Seed: FSDEGGFTC (MOG_HUMAN)
FQDEGGFTI

SEQ ID NO: 119469 - protein, 9 aa, Artificial Sequence
  Description of Artificial Sequence: Synthetic peptide
  Seed: RRLAGQFLE (MOG_HUMAN)
RQLAGQFLL

SEQ ID NO: 119470 - protein, 10 aa, Artificial Sequence
  Description of Artificial Sequence: Synthetic peptide
  Seed: FSDEGGFTCF (MOG_HUMAN)
FMDEGGFTCY

SEQ ID NO: 119471 - protein, 9 aa, Artificial Sequence
  Description of Artificial Sequence: Synthetic peptide
  Seed: RVIGPRHPI (MOG_HUMAN)
RSIGPRHPA

SEQ ID NO: 119472 - protein, 9 aa, Artificial Sequence
  Description of Artificial Sequence: Synthetic peptide
  Seed: FLEELRNPF (MOG_HUMAN)
FIEELRNPV

SEQ ID NO: 119473 - protein, 9 aa, Artificial Sequence
  Description of Artificial Sequence: Synthetic peptide
  Seed: TGMEVGWYR (MOG_HUMAN)
TLMEVGWYL

SEQ ID NO: 119474 - protein, 9 aa, Artificial Sequence
  Description of Artificial Sequence: Synthetic peptide
  Seed: LSRPSLPSC (MOG_HUMAN)
LHRPSLPSK

SEQ ID NO: 119475 - protein, 10 aa, Artificial Sequence
  Description of Artificial Sequence: Synthetic peptide
  Seed: FRVIGPRHPI (MOG_HUMAN)
FLVIGPRHPM

SEQ ID NO: 119476 - protein, 9 aa, Artificial Sequence
  Description of Artificial Sequence: Synthetic peptide
  Seed: LAVLPVLLL (MOG_HUMAN)
LAVLPVLLM

SEQ ID NO: 119477 - protein, 10 aa, Artificial Sequence
  Description of Artificial Sequence: Synthetic peptide
  Seed: DEGGFTCFFR (MOG_HUMAN)
DQGGFTCFFR

SEQ ID NO: 119478 - protein, 9 aa, Artificial Sequence
  Description of Artificial Sequence: Synthetic peptide
  Seed: FSDEGGFTC (MOG_HUMAN)
FMDEGGFTI

SEQ ID NO: 119479 - protein, 10 aa, Artificial Sequence
  Description of Artificial Sequence: Synthetic peptide
  Seed: LLLLQVSSSY (MOG_HUMAN)
LWLLQVSSSF

SEQ ID NO: 119480 - protein, 8 aa, Artificial Sequence
  Description of Artificial Sequence: Synthetic peptide
  Seed: RTFDPHFL (MOG_HUMAN)
RVFDPHFW

SEQ ID NO: 119481 - protein, 9 aa, Artificial Sequence
  Description of Artificial Sequence: Synthetic peptide
  Seed: HSYQEEAAM (MOG_HUMAN)
HYYQEEAAL

SEQ ID NO: 119482 - protein, 10 aa, Artificial Sequence
  Description of Artificial Sequence: Synthetic peptide
  Seed: FDPHFLRVPC (MOG_HUMAN)
FQPHFLRVPP

SEQ ID NO: 119483 - protein, 9 aa, Artificial Sequence
  Description of Artificial Sequence: Synthetic peptide
  Seed: FYWVSPGVL (MOG_HUMAN)
FSWVSPGVL

SEQ ID NO: 119484 - protein, 8 aa, Artificial Sequence
  Description of Artificial Sequence: Synthetic peptide
  Seed: IENLHRTF (MOG_HUMAN)
IENLHRTY

SEQ ID NO: 119485 - protein, 10 aa, Artificial Sequence
  Description of Artificial Sequence: Synthetic peptide
  Seed: DAIGEGKVTL (MOG_HUMAN)
DAIGEGKVTW

SEQ ID NO: 119486 - protein, 9 aa, Artificial Sequence
  Description of Artificial Sequence: Synthetic peptide
  Seed: RVIGPRHPI (MOG_HUMAN)
RMIGPRHPL

SEQ ID NO: 119487 - protein, 10 aa, Artificial Sequence
  Description of Artificial Sequence: Synthetic peptide
  Seed: DEGGFTCFFR (MOG_HUMAN)
DLGGFTCFFR

SEQ ID NO: 119488 - protein, 9 aa, Artificial Sequence
  Description of Artificial Sequence: Synthetic peptide
  Seed: FSDEGGFTC (MOG_HUMAN)
FVDEGGFTA

SEQ ID NO: 119489 - protein, 11 aa, Artificial Sequence
  Description of Artificial Sequence: Synthetic peptide
  Seed: LQVSSSYAGQF (MOG_HUMAN)
LKVSSSYAGQY

SEQ ID NO: 119490 - protein, 9 aa, Artificial Sequence
  Description of Artificial Sequence: Synthetic peptide
  Seed: HSYQEEAAM (MOG_HUMAN)
HVYQEEAAF

SEQ ID NO: 119491 - protein, 10 aa, Artificial Sequence
  Description of Artificial Sequence: Synthetic peptide
  Seed: FVIVPVLGPL (MOG_HUMAN)
FVIVPVLGPR

SEQ ID NO: 119492 - protein, 9 aa, Artificial Sequence
  Description of Artificial Sequence: Synthetic peptide
  Seed: RVIGPRHPI (MOG_HUMAN)
RPIGPRHPM

SEQ ID NO: 119493 - protein, 10 aa, Artificial Sequence
  Description of Artificial Sequence: Synthetic peptide
  Seed: DQDGDQAPEY (MOG_HUMAN)
DTDGDQAPEY

SEQ ID NO: 119494 - protein, 9 aa, Artificial Sequence
  Description of Artificial Sequence: Synthetic peptide
  Seed: VSPGVLVLL (MOG_HUMAN)
VMPGVLVLT

SEQ ID NO: 119495 - protein, 9 aa, Artificial Sequence
  Description of Artificial Sequence: Synthetic peptide
  Seed: FLLLLLLQV (MOG_HUMAN)
FLLLLLLQL

SEQ ID NO: 119496 - protein, 10 aa, Artificial Sequence
  Description of Artificial Sequence: Synthetic peptide
  Seed: PVLGPLVALI (MOG_HUMAN)
PFLGPLVALA

SEQ ID NO: 119497 - protein, 9 aa, Artificial Sequence
  Description of Artificial Sequence: Synthetic peptide
  Seed: FYWVSPGVL (MOG_HUMAN)
FGWVSPGVY

SEQ ID NO: 119498 - protein, 11 aa, Artificial Sequence
  Description of Artificial Sequence: Synthetic peptide
  Seed: NATGMEVGWYR (MOG_HUMAN)
NFTGMEVGWYR

SEQ ID NO: 119499 - protein, 10 aa, Artificial Sequence
  Description of Artificial Sequence: Synthetic peptide
  Seed: VLLLQITVGL (MOG_HUMAN)
VGLLQITVGI

SEQ ID NO: 119500 - protein, 10 aa, Artificial Sequence
  Description of Artificial Sequence: Synthetic peptide
  Seed: WVSPGVLVLL (MOG_HUMAN)
WLSPGVLVLA

SEQ ID NO: 119501 - protein, 9 aa, Artificial Sequence
  Description of Artificial Sequence: Synthetic peptide
  Seed: ICYNWLHRR (MOG_HUMAN)
IVYNWLHRV

SEQ ID NO: 119502 - protein, 8 aa, Artificial Sequence
  Description of Artificial Sequence: Synthetic peptide
  Seed: RIRNVRFS (MOG_HUMAN)
RTRNVRFP

SEQ ID NO: 119503 - protein, 10 aa, Artificial Sequence
  Description of Artificial Sequence: Synthetic peptide
  Seed: AEIENLHRTF (MOG_HUMAN)
ALIENLHRTW

SEQ ID NO: 119504 - protein, 10 aa, Artificial Sequence
  Description of Artificial Sequence: Synthetic peptide
  Seed: FVIVPVLGPL (MOG_HUMAN)
FGIVPVLGPL

SEQ ID NO: 119505 - protein, 8 aa, Artificial Sequence
  Description of Artificial Sequence: Synthetic peptide
  Seed: RPPFSRVV (MOG_HUMAN)
RPPFSRVL

SEQ ID NO: 119506 - protein, 10 aa, Artificial Sequence
  Description of Artificial Sequence: Synthetic peptide
  Seed: KNATGMEVGW (MOG_HUMAN)
KQATGMEVGW

SEQ ID NO: 119507 - protein, 10 aa, Artificial Sequence
  Description of Artificial Sequence: Synthetic peptide
  Seed: SLPSCLCSFL (MOG_HUMAN)
SIPSCLCSFI

SEQ ID NO: 119508 - protein, 9 aa, Artificial Sequence
  Description of Artificial Sequence: Synthetic peptide
  Seed: CSFLLLLLL (MOG_HUMAN)
CTFLLLLLL

SEQ ID NO: 119509 - protein, 9 aa, Artificial Sequence
  Description of Artificial Sequence: Synthetic peptide
  Seed: LSRPSLPSC (MOG_HUMAN)
LQRPSLPSL

SEQ ID NO: 119510 - protein, 9 aa, Artificial Sequence
  Description of Artificial Sequence: Synthetic peptide
  Seed: GWYRPPFSR (MOG_HUMAN)
GNYRPPFSR

SEQ ID NO: 119511 - protein, 10 aa, Artificial Sequence
  Description of Artificial Sequence: Synthetic peptide
  Seed: FDPHFLRVPC (MOG_HUMAN)
FCPHFLRVPS

SEQ ID NO: 119512 - protein, 10 aa, Artificial Sequence
  Description of Artificial Sequence: Synthetic peptide
  Seed: FVIVPVLGPL (MOG_HUMAN)
FTIVPVLGPK

SEQ ID NO: 119513 - protein, 11 aa, Artificial Sequence
  Description of Artificial Sequence: Synthetic peptide
  Seed: HRTFDPHFLRV (MOG_HUMAN)
HKTFDPHFLRR

SEQ ID NO: 119514 - protein, 9 aa, Artificial Sequence
  Description of Artificial Sequence: Synthetic peptide
  Seed: TFDPHFLRV (MOG_HUMAN)
TCDPHFLRM

SEQ ID NO: 119515 - protein, 10 aa, Artificial Sequence
  Description of Artificial Sequence: Synthetic peptide
  Seed: LLKDAIGEGK (MOG_HUMAN)
LAKDAIGEGF

SEQ ID NO: 119516 - protein, 9 aa, Artificial Sequence
  Description of Artificial Sequence: Synthetic peptide
  Seed: ITLFVIVPV (MOG_HUMAN)
ILLFVIVPA

SEQ ID NO: 119517 - protein, 11 aa, Artificial Sequence
  Description of Artificial Sequence: Synthetic peptide
  Seed: RPSLPSCLCSF (MOG_HUMAN)
RTSLPSCLCSW

SEQ ID NO: 119518 - protein, 9 aa, Artificial Sequence
  Description of Artificial Sequence: Synthetic peptide
  Seed: VSPGVLVLL (MOG_HUMAN)
VRPGVLVLV

SEQ ID NO: 119519 - protein, 11 aa, Artificial Sequence
  Description of Artificial Sequence: Synthetic peptide
  Seed: IRALVGDEVEL (MOG_HUMAN)
IHALVGDEVEF

SEQ ID NO: 119520 - protein, 9 aa, Artificial Sequence
  Description of Artificial Sequence: Synthetic peptide
  Seed: RVIGPRHPI (MOG_HUMAN)
RIIGPRHPA

SEQ ID NO: 119521 - protein, 10 aa, Artificial Sequence
  Description of Artificial Sequence: Synthetic peptide
  Seed: FVIVPVLGPL (MOG_HUMAN)
FDIVPVLGPL

SEQ ID NO: 119522 - protein, 10 aa, Artificial Sequence
  Description of Artificial Sequence: Synthetic peptide
  Seed: RTFDPHFLRV (MOG_HUMAN)
RHFDPHFLRL

SEQ ID NO: 119523 - protein, 9 aa, Artificial Sequence
  Description of Artificial Sequence: Synthetic peptide
  Seed: WVSPGVLVL (MOG_HUMAN)
WSSPGVLVI

SEQ ID NO: 119524 - protein, 9 aa, Artificial Sequence
  Description of Artificial Sequence: Synthetic peptide
  Seed: FLCLQYRLR (MOG_HUMAN)
FTCLQYRLR

SEQ ID NO: 119525 - protein, 9 aa, Artificial Sequence
  Description of Artificial Sequence: Synthetic peptide
  Seed: HSYQEEAAM (MOG_HUMAN)
HEYQEEAAY

SEQ ID NO: 119526 - protein, 10 aa, Artificial Sequence
  Description of Artificial Sequence: Synthetic peptide
  Seed: FDPHFLRVPC (MOG_HUMAN)
FEPHFLRVPI

SEQ ID NO: 119527 - protein, 9 aa, Artificial Sequence
  Description of Artificial Sequence: Synthetic peptide
  Seed: VRFSDEGGF (MOG_HUMAN)
VMFSDEGGY

SEQ ID NO: 119528 - protein, 8 aa, Artificial Sequence
  Description of Artificial Sequence: Synthetic peptide
  Seed: GGFTCFFR (MOG_HUMAN)
GQFTCFFR

SEQ ID NO: 119529 - protein, 9 aa, Artificial Sequence
  Description of Artificial Sequence: Synthetic peptide
  Seed: KVEDPFYWV (MOG_HUMAN)
KQEDPFYWI

SEQ ID NO: 119530 - protein, 9 aa, Artificial Sequence
  Description of Artificial Sequence: Synthetic peptide
  Seed: RVIGPRHPI (MOG_HUMAN)
RPIGPRHPC

SEQ ID NO: 119531 - protein, 9 aa, Artificial Sequence
  Description of Artificial Sequence: Synthetic peptide
  Seed: LKVEDPFYW (MOG_HUMAN)
LLVEDPFYL

SEQ ID NO: 119532 - protein, 9 aa, Artificial Sequence
  Description of Artificial Sequence: Synthetic peptide
  Seed: FLEELRNPF (MOG_HUMAN)
FTEELRNPY

SEQ ID NO: 119533 - protein, 10 aa, Artificial Sequence
  Description of Artificial Sequence: Synthetic peptide
  Seed: RVPCWKITLF (MOG_HUMAN)
RSPCWKITLF

SEQ ID NO: 119534 - protein, 10 aa, Artificial Sequence
  Description of Artificial Sequence: Synthetic peptide
  Seed: FDPHFLRVPC (MOG_HUMAN)
FQPHFLRVPM

SEQ ID NO: 119535 - protein, 9 aa, Artificial Sequence
  Description of Artificial Sequence: Synthetic peptide
  Seed: VIVPVLGPL (MOG_HUMAN)
VTVPVLGPM

SEQ ID NO: 119536 - protein, 9 aa, Artificial Sequence
  Description of Artificial Sequence: Synthetic peptide
  Seed: LQITVGLIF (MOG_HUMAN)
LAITVGLIL

SEQ ID NO: 119537 - protein, 9 aa, Artificial Sequence
  Description of Artificial Sequence: Synthetic peptide
  Seed: FYWVSPGVL (MOG_HUMAN)
FQWVSPGVM

SEQ ID NO: 119538 - protein, 9 aa, Artificial Sequence
  Description of Artificial Sequence: Synthetic peptide
  Seed: FSDEGGFTC (MOG_HUMAN)
FADEGGFTY

SEQ ID NO: 119539 - protein, 10 aa, Artificial Sequence
  Description of Artificial Sequence: Synthetic peptide
  Seed: LPSCLCSFLL (MOG_HUMAN)
LPSCLCSFLF

SEQ ID NO: 119540 - protein, 9 aa, Artificial Sequence
  Description of Artificial Sequence: Synthetic peptide
  Seed: YQEEAAMEL (MOG_HUMAN)
YHEEAAMEW

SEQ ID NO: 119541 - protein, 10 aa, Artificial Sequence
  Description of Artificial Sequence: Synthetic peptide
  Seed: FDPHFLRVPC (MOG_HUMAN)
FAPHFLRVPL

SEQ ID NO: 119542 - protein, 9 aa, Artificial Sequence
  Description of Artificial Sequence: Synthetic peptide
  Seed: RIRNVRFSD (MOG_HUMAN)
RYRNVRFSS

SEQ ID NO: 119543 - protein, 11 aa, Artificial Sequence
  Description of Artificial Sequence: Synthetic peptide
  Seed: RFSDEGGFTCF (MOG_HUMAN)
RMSDEGGFTCW

SEQ ID NO: 119544 - protein, 10 aa, Artificial Sequence
  Description of Artificial Sequence: Synthetic peptide
  Seed: VSSSYAGQFR (MOG_HUMAN)
VVSSYAGQFR

SEQ ID NO: 119545 - protein, 9 aa, Artificial Sequence
  Description of Artificial Sequence: Synthetic peptide
  Seed: SYAGQFRVI (MOG_HUMAN)
SWAGQFRVI

SEQ ID NO: 119546 - protein, 9 aa, Artificial Sequence
  Description of Artificial Sequence: Synthetic peptide
  Seed: HSYQEEAAM (MOG_HUMAN)
HMYQEEAAL

SEQ ID NO: 119547 - protein, 9 aa, Artificial Sequence
  Description of Artificial Sequence: Synthetic peptide
  Seed: RRLAGQFLE (MOG_HUMAN)
RKLAGQFLM

SEQ ID NO: 119548 - protein, 10 aa, Artificial Sequence
  Description of Artificial Sequence: Synthetic peptide
  Seed: VLLAVLPVLL (MOG_HUMAN)
VFLAVLPVLM

SEQ ID NO: 119549 - protein, 9 aa, Artificial Sequence
  Description of Artificial Sequence: Synthetic peptide
  Seed: VIVPVLGPL (MOG_HUMAN)
VSVPVLGPV

SEQ ID NO: 119550 - protein, 10 aa, Artificial Sequence
  Description of Artificial Sequence: Synthetic peptide
  Seed: SLSRPSLPSC (MOG_HUMAN)
SQSRPSLPSI

SEQ ID NO: 119551 - protein, 9 aa, Artificial Sequence
  Description of Artificial Sequence: Synthetic peptide
  Seed: QITVGLIFL (MOG_HUMAN)
QMTVGLIFL

SEQ ID NO: 119552 - protein, 10 aa, Artificial Sequence
  Description of Artificial Sequence: Synthetic peptide
  Seed: AVLPVLLLQI (MOG_HUMAN)
ALLPVLLLQM

SEQ ID NO: 119553 - protein, 9 aa, Artificial Sequence
  Description of Artificial Sequence: Synthetic peptide
  Seed: TCFFRDHSY (MOG_HUMAN)
TLFFRDHSY

SEQ ID NO: 119554 - protein, 10 aa, Artificial Sequence
  Description of Artificial Sequence: Synthetic peptide
  Seed: RTFDPHFLRV (MOG_HUMAN)
RMFDPHFLRK

SEQ ID NO: 119555 - protein, 10 aa, Artificial Sequence
  Description of Artificial Sequence: Synthetic peptide
  Seed: RVPCWKITLF (MOG_HUMAN)
RAPCWKITLW

SEQ ID NO: 119556 - protein, 9 aa, Artificial Sequence
  Description of Artificial Sequence: Synthetic peptide
  Seed: GQFRVIGPR (MOG_HUMAN)
GTFRVIGPR

SEQ ID NO: 119557 - protein, 10 aa, Artificial Sequence
  Description of Artificial Sequence: Synthetic peptide
  Seed: FVIVPVLGPL (MOG_HUMAN)
FPIVPVLGPL

SEQ ID NO: 119558 - protein, 10 aa, Artificial Sequence
  Description of Artificial Sequence: Synthetic peptide
  Seed: FDPHFLRVPC (MOG_HUMAN)
FVPHFLRVPT

SEQ ID NO: 119559 - protein, 10 aa, Artificial Sequence
  Description of Artificial Sequence: Synthetic peptide
  Seed: FTCFFRDHSY (MOG_HUMAN)
FLCFFRDHSF

SEQ ID NO: 119560 - protein, 10 aa, Artificial Sequence
  Description of Artificial Sequence: Synthetic peptide
  Seed: YWVSPGVLVL (MOG_HUMAN)
YAVSPGVLVV

SEQ ID NO: 119561 - protein, 9 aa, Artificial Sequence
  Description of Artificial Sequence: Synthetic peptide
  Seed: GQFRVIGPR (MOG_HUMAN)
GLFRVIGPR

SEQ ID NO: 119562 - protein, 9 aa, Artificial Sequence
  Description of Artificial Sequence: Synthetic peptide
  Seed: QDGDQAPEY (MOG_HUMAN)
QEGDQAPEW

SEQ ID NO: 119563 - protein, 10 aa, Artificial Sequence
  Description of Artificial Sequence: Synthetic peptide
  Seed: RTFDPHFLRV (MOG_HUMAN)
RTFDPHFLRY

SEQ ID NO: 119564 - protein, 10 aa, Artificial Sequence
  Description of Artificial Sequence: Synthetic peptide
  Seed: SDEGGFTCFF (MOG_HUMAN)
SVEGGFTCFW

SEQ ID NO: 119565 - protein, 10 aa, Artificial Sequence
  Description of Artificial Sequence: Synthetic peptide
  Seed: RALVGDEVEL (MOG_HUMAN)
RLLVGDEVEF

SEQ ID NO: 119566 - protein, 9 aa, Artificial Sequence
  Description of Artificial Sequence: Synthetic peptide
  Seed: RIRNVRFSD (MOG_HUMAN)
RMRNVRFSK

SEQ ID NO: 119567 - protein, 9 aa, Artificial Sequence
  Description of Artificial Sequence: Synthetic peptide
  Seed: FSRVVHLYR (MOG_HUMAN)
FQRVVHLYK

SEQ ID NO: 119568 - protein, 9 aa, Artificial Sequence
  Description of Artificial Sequence: Synthetic peptide
  Seed: RTFDPHFLR (MOG_HUMAN)
RVFDPHFLK

SEQ ID NO: 119569 - protein, 9 aa, Artificial Sequence
  Description of Artificial Sequence: Synthetic peptide
  Seed: LQVSSSYAG (MOG_HUMAN)
LHVSSSYAL

SEQ ID NO: 119570 - protein, 8 aa, Artificial Sequence
  Description of Artificial Sequence: Synthetic peptide
  Seed: FYWVSPGV (MOG_HUMAN)
FYWVSPGL

SEQ ID NO: 119571 - protein, 9 aa, Artificial Sequence
  Description of Artificial Sequence: Synthetic peptide
  Seed: VLPVLLLQI (MOG_HUMAN)
VYPVLLLQI

SEQ ID NO: 119572 - protein, 9 aa, Artificial Sequence
  Description of Artificial Sequence: Synthetic peptide
  Seed: HSYQEEAAM (MOG_HUMAN)
HGYQEEAAF

SEQ ID NO: 119573 - protein, 10 aa, Artificial Sequence
  Description of Artificial Sequence: Synthetic peptide
  Seed: RDHSYQEEAA (MOG_HUMAN)
REHSYQEEAL

SEQ ID NO: 119574 - protein, 9 aa, Artificial Sequence
  Description of Artificial Sequence: Synthetic peptide
  Seed: LAGQFLEEL (MOG_HUMAN)
LAGQFLEEW

SEQ ID NO: 119575 - protein, 10 aa, Artificial Sequence
  Description of Artificial Sequence: Synthetic peptide
  Seed: TGMEVGWYRP (MOG_HUMAN)
TGMEVGWYRR

SEQ ID NO: 119576 - protein, 9 aa, Artificial Sequence
  Description of Artificial Sequence: Synthetic peptide
  Seed: ICYNWLHRR (MOG_HUMAN)
ILYNWLHRR

SEQ ID NO: 119577 - protein, 10 aa, Artificial Sequence
  Description of Artificial Sequence: Synthetic peptide
  Seed: PVLGPLVALI (MOG_HUMAN)
PYLGPLVALL

SEQ ID NO: 119578 - protein, 10 aa, Artificial Sequence
  Description of Artificial Sequence: Synthetic peptide
  Seed: SCLCSFLLLL (MOG_HUMAN)
SPLCSFLLLV

SEQ ID NO: 119579 - protein, 10 aa, Artificial Sequence
  Description of Artificial Sequence: Synthetic peptide
  Seed: LVLLAVLPVL (MOG_HUMAN)
LRLLAVLPVI

SEQ ID NO: 119580 - protein, 10 aa, Artificial Sequence
  Description of Artificial Sequence: Synthetic peptide
  Seed: LLLQVSSSYA (MOG_HUMAN)
LMLQVSSSYF

SEQ ID NO: 119581 - protein, 9 aa, Artificial Sequence
  Description of Artificial Sequence: Synthetic peptide
  Seed: LLLQITVGL (MOG_HUMAN)
LMLQITVGW

SEQ ID NO: 119582 - protein, 10 aa, Artificial Sequence
  Description of Artificial Sequence: Synthetic peptide
  Seed: YWVSPGVLVL (MOG_HUMAN)
YGVSPGVLVM

SEQ ID NO: 119583 - protein, 11 aa, Artificial Sequence
  Description of Artificial Sequence: Synthetic peptide
  Seed: RFSDEGGFTCF (MOG_HUMAN)
RSSDEGGFTCF

SEQ ID NO: 119584 - protein, 10 aa, Artificial Sequence
  Description of Artificial Sequence: Synthetic peptide
  Seed: FSRVVHLYRN (MOG_HUMAN)
FTRVVHLYRR

SEQ ID NO: 119585 - protein, 10 aa, Artificial Sequence
  Description of Artificial Sequence: Synthetic peptide
  Seed: RLRGKLRAEI (MOG_HUMAN)
RTRGKLRAEV

SEQ ID NO: 119586 - protein, 9 aa, Artificial Sequence
  Description of Artificial Sequence: Synthetic peptide
  Seed: SSYAGQFRV (MOG_HUMAN)
SSYAGQFRF

SEQ ID NO: 119587 - protein, 9 aa, Artificial Sequence
  Description of Artificial Sequence: Synthetic peptide
  Seed: SLPSCLCSF (MOG_HUMAN)
SWPSCLCSY

SEQ ID NO: 119588 - protein, 9 aa, Artificial Sequence
  Description of Artificial Sequence: Synthetic peptide
  Seed: LLLQITVGL (MOG_HUMAN)
LALQITVGF

SEQ ID NO: 119589 - protein, 10 aa, Artificial Sequence
  Description of Artificial Sequence: Synthetic peptide
  Seed: IFLCLQYRLR (MOG_HUMAN)
IGLCLQYRLR

SEQ ID NO: 119590 - protein, 9 aa, Artificial Sequence
  Description of Artificial Sequence: Synthetic peptide
  Seed: VSSSYAGQF (MOG_HUMAN)
VISSYAGQY

SEQ ID NO: 119591 - protein, 10 aa, Artificial Sequence
  Description of Artificial Sequence: Synthetic peptide
  Seed: SCLCSFLLLL (MOG_HUMAN)
SSLCSFLLLL

SEQ ID NO: 119592 - protein, 11 aa, Artificial Sequence
  Description of Artificial Sequence: Synthetic peptide
  Seed: VRFSDEGGFTC (MOG_HUMAN)
VRFSDEGGFTM

SEQ ID NO: 119593 - protein, 9 aa, Artificial Sequence
  Description of Artificial Sequence: Synthetic peptide
  Seed: SLPSCLCSF (MOG_HUMAN)
SRPSCLCSM

SEQ ID NO: 119594 - protein, 9 aa, Artificial Sequence
  Description of Artificial Sequence: Synthetic peptide
  Seed: TFDPHFLRV (MOG_HUMAN)
TGDPHFLRM

SEQ ID NO: 119595 - protein, 9 aa, Artificial Sequence
  Description of Artificial Sequence: Synthetic peptide
  Seed: YRPPFSRVV (MOG_HUMAN)
YCPPFSRVM

SEQ ID NO: 119596 - protein, 10 aa, Artificial Sequence
  Description of Artificial Sequence: Synthetic peptide
  Seed: FDPHFLRVPC (MOG_HUMAN)
FVPHFLRVPV

SEQ ID NO: 119597 - protein, 10 aa, Artificial Sequence
  Description of Artificial Sequence: Synthetic peptide
  Seed: RTFDPHFLRV (MOG_HUMAN)
RQFDPHFLRT

SEQ ID NO: 119598 - protein, 9 aa, Artificial Sequence
  Description of Artificial Sequence: Synthetic peptide
  Seed: YQEEAAMEL (MOG_HUMAN)
YHEEAAMEL

SEQ ID NO: 119599 - protein, 9 aa, Artificial Sequence
  Description of Artificial Sequence: Synthetic peptide
  Seed: HSYQEEAAM (MOG_HUMAN)
HIYQEEAAM

SEQ ID NO: 119600 - protein, 10 aa, Artificial Sequence
  Description of Artificial Sequence: Synthetic peptide
  Seed: LLQITVGLIF (MOG_HUMAN)
LEQITVGLIF

SEQ ID NO: 119601 - protein, 10 aa, Artificial Sequence
  Description of Artificial Sequence: Synthetic peptide
  Seed: SFLLLLLLQV (MOG_HUMAN)
SRLLLLLLQV

SEQ ID NO: 119602 - protein, 9 aa, Artificial Sequence
  Description of Artificial Sequence: Synthetic peptide
  Seed: LAVLPVLLL (MOG_HUMAN)
LTVLPVLLW

SEQ ID NO: 119603 - protein, 10 aa, Artificial Sequence
  Description of Artificial Sequence: Synthetic peptide
  Seed: LLLLQVSSSY (MOG_HUMAN)
LMLLQVSSSM

SEQ ID NO: 119604 - protein, 9 aa, Artificial Sequence
  Description of Artificial Sequence: Synthetic peptide
  Seed: RIRNVRFSD (MOG_HUMAN)
RMRNVRFSR

SEQ ID NO: 119605 - protein, 10 aa, Artificial Sequence
  Description of Artificial Sequence: Synthetic peptide
  Seed: LLLLQVSSSY (MOG_HUMAN)
LVLLQVSSSF

SEQ ID NO: 119606 - protein, 9 aa, Artificial Sequence
  Description of Artificial Sequence: Synthetic peptide
  Seed: MASLSRPSL (MOG_HUMAN)
MVSLSRPSL

SEQ ID NO: 119607 - protein, 9 aa, Artificial Sequence
  Description of Artificial Sequence: Synthetic peptide
  Seed: WVSPGVLVL (MOG_HUMAN)
WYSPGVLVY

SEQ ID NO: 119608 - protein, 9 aa, Artificial Sequence
  Description of Artificial Sequence: Synthetic peptide
  Seed: TCFFRDHSY (MOG_HUMAN)
TAFFRDHSF

SEQ ID NO: 119609 - protein, 10 aa, Artificial Sequence
  Description of Artificial Sequence: Synthetic peptide
  Seed: LVALIICYNW (MOG_HUMAN)
LAALIICYNW

SEQ ID NO: 119610 - protein, 9 aa, Artificial Sequence
  Description of Artificial Sequence: Synthetic peptide
  Seed: FYWVSPGVL (MOG_HUMAN)
FRWVSPGVL

SEQ ID NO: 119611 - protein, 10 aa, Artificial Sequence
  Description of Artificial Sequence: Synthetic peptide
  Seed: LLLLQVSSSY (MOG_HUMAN)
LQLLQVSSSF

SEQ ID NO: 119612 - protein, 9 aa, Artificial Sequence
  Description of Artificial Sequence: Synthetic peptide
  Seed: HSYQEEAAM (MOG_HUMAN)
HRYQEEAAM

SEQ ID NO: 119613 - protein, 9 aa, Artificial Sequence
  Description of Artificial Sequence: Synthetic peptide
  Seed: LLAVLPVLL (MOG_HUMAN)
LLAVLPVLI

SEQ ID NO: 119614 - protein, 9 aa, Artificial Sequence
  Description of Artificial Sequence: Synthetic peptide
  Seed: RVIGPRHPI (MOG_HUMAN)
RTIGPRHPW

SEQ ID NO: 119615 - protein, 9 aa, Artificial Sequence
  Description of Artificial Sequence: Synthetic peptide
  Seed: AIGEGKVTL (MOG_HUMAN)
AAGEGKVTV

SEQ ID NO: 119616 - protein, 10 aa, Artificial Sequence
  Description of Artificial Sequence: Synthetic peptide
  Seed: NLHRTFDPHF (MOG_HUMAN)
NQHRTFDPHF

SEQ ID NO: 119617 - protein, 11 aa, Artificial Sequence
  Description of Artificial Sequence: Synthetic peptide
  Seed: RTFDPHFLRVP (MOG_HUMAN)
RGFDPHFLRVR

SEQ ID NO: 119618 - protein, 9 aa, Artificial Sequence
  Description of Artificial Sequence: Synthetic peptide
  Seed: FYWVSPGVL (MOG_HUMAN)
FIWVSPGVL

SEQ ID NO: 119619 - protein, 9 aa, Artificial Sequence
  Description of Artificial Sequence: Synthetic peptide
  Seed: RIRNVRFSD (MOG_HUMAN)
RLRNVRFSK

SEQ ID NO: 119620 - protein, 10 aa, Artificial Sequence
  Description of Artificial Sequence: Synthetic peptide
  Seed: RVIGPRHPIR (MOG_HUMAN)
RTIGPRHPIV

SEQ ID NO: 119621 - protein, 10 aa, Artificial Sequence
  Description of Artificial Sequence: Synthetic peptide
  Seed: LPSCLCSFLL (MOG_HUMAN)
LPSCLCSFLW

SEQ ID NO: 119622 - protein, 10 aa, Artificial Sequence
  Description of Artificial Sequence: Synthetic peptide
  Seed: TGMEVGWYRP (MOG_HUMAN)
TIMEVGWYRK

SEQ ID NO: 119623 - protein, 9 aa, Artificial Sequence
  Description of Artificial Sequence: Synthetic peptide
  Seed: IICYNWLHR (MOG_HUMAN)
ITCYNWLHK

SEQ ID NO: 119624 - protein, 10 aa, Artificial Sequence
  Description of Artificial Sequence: Synthetic peptide
  Seed: FSRVVHLYRN (MOG_HUMAN)
FMRVVHLYRK

SEQ ID NO: 119625 - protein, 9 aa, Artificial Sequence
  Description of Artificial Sequence: Synthetic peptide
  Seed: LCSFLLLLL (MOG_HUMAN)
LTSFLLLLW

SEQ ID NO: 119626 - protein, 10 aa, Artificial Sequence
  Description of Artificial Sequence: Synthetic peptide
  Seed: RTFDPHFLRV (MOG_HUMAN)
RKFDPHFLRF

SEQ ID NO: 119627 - protein, 9 aa, Artificial Sequence
  Description of Artificial Sequence: Synthetic peptide
  Seed: SLPSCLCSF (MOG_HUMAN)
SVPSCLCSI

SEQ ID NO: 119628 - protein, 9 aa, Artificial Sequence
  Description of Artificial Sequence: Synthetic peptide
  Seed: RIRNVRFSD (MOG_HUMAN)
RMRNVRFSG

SEQ ID NO: 119629 - protein, 9 aa, Artificial Sequence
  Description of Artificial Sequence: Synthetic peptide
  Seed: SYAGQFRVI (MOG_HUMAN)
SRAGQFRVY

SEQ ID NO: 119630 - protein, 10 aa, Artificial Sequence
  Description of Artificial Sequence: Synthetic peptide
  Seed: HRTFDPHFLR (MOG_HUMAN)
HCTFDPHFLY

SEQ ID NO: 119631 - protein, 11 aa, Artificial Sequence
  Description of Artificial Sequence: Synthetic peptide
  Seed: LHRTFDPHFLR (MOG_HUMAN)
LIRTFDPHFLR

SEQ ID NO: 119632 - protein, 9 aa, Artificial Sequence
  Description of Artificial Sequence: Synthetic peptide
  Seed: FSDEGGFTC (MOG_HUMAN)
FQDEGGFTV

SEQ ID NO: 119633 - protein, 9 aa, Artificial Sequence
  Description of Artificial Sequence: Synthetic peptide
  Seed: LRAEIENLH (MOG_HUMAN)
LRAEIENLL

SEQ ID NO: 119634 - protein, 9 aa, Artificial Sequence
  Description of Artificial Sequence: Synthetic peptide
  Seed: RVIGPRHPI (MOG_HUMAN)
RTIGPRHPG

SEQ ID NO: 119635 - protein, 9 aa, Artificial Sequence
  Description of Artificial Sequence: Synthetic peptide
  Seed: SRPSLPSCL (MOG_HUMAN)
SWPSLPSCF

SEQ ID NO: 119636 - protein, 11 aa, Artificial Sequence
  Description of Artificial Sequence: Synthetic peptide
  Seed: HRTFDPHFLRV (MOG_HUMAN)
HSTFDPHFLRR

SEQ ID NO: 119637 - protein, 10 aa, Artificial Sequence
  Description of Artificial Sequence: Synthetic peptide
  Seed: RTFDPHFLRV (MOG_HUMAN)
RLFDPHFLRD

SEQ ID NO: 119638 - protein, 9 aa, Artificial Sequence
  Description of Artificial Sequence: Synthetic peptide
  Seed: ALVGDEVEL (MOG_HUMAN)
AQVGDEVEI

SEQ ID NO: 119639 - protein, 9 aa, Artificial Sequence
  Description of Artificial Sequence: Synthetic peptide
  Seed: HSYQEEAAM (MOG_HUMAN)
HAYQEEAAI

SEQ ID NO: 119640 - protein, 10 aa, Artificial Sequence
  Description of Artificial Sequence: Synthetic peptide
  Seed: FVIVPVLGPL (MOG_HUMAN)
FAIVPVLGPL

SEQ ID NO: 119641 - protein, 9 aa, Artificial Sequence
  Description of Artificial Sequence: Synthetic peptide
  Seed: IVPVLGPLV (MOG_HUMAN)
IIPVLGPLM

SEQ ID NO: 119642 - protein, 9 aa, Artificial Sequence
  Description of Artificial Sequence: Synthetic peptide
  Seed: RIRNVRFSD (MOG_HUMAN)
RFRNVRFSL

SEQ ID NO: 119643 - protein, 11 aa, Artificial Sequence
  Description of Artificial Sequence: Synthetic peptide
  Seed: RISPGKNATGM (MOG_HUMAN)
RQSPGKNATGW

SEQ ID NO: 119644 - protein, 9 aa, Artificial Sequence
  Description of Artificial Sequence: Synthetic peptide
  Seed: LLLQVSSSY (MOG_HUMAN)
LQLQVSSSA

SEQ ID NO: 119645 - protein, 10 aa, Artificial Sequence
  Description of Artificial Sequence: Synthetic peptide
  Seed: RALVGDEVEL (MOG_HUMAN)
RQLVGDEVEI

SEQ ID NO: 119646 - protein, 10 aa, Artificial Sequence
  Description of Artificial Sequence: Synthetic peptide
  Seed: RTFDPHFLRV (MOG_HUMAN)
RWFDPHFLRR

SEQ ID NO: 119647 - protein, 10 aa, Artificial Sequence
  Description of Artificial Sequence: Synthetic peptide
  Seed: TGMEVGWYRP (MOG_HUMAN)
TMMEVGWYRG

SEQ ID NO: 119648 - protein, 10 aa, Artificial Sequence
  Description of Artificial Sequence: Synthetic peptide
  Seed: FDPHFLRVPC (MOG_HUMAN)
FAPHFLRVPS

SEQ ID NO: 119649 - protein, 9 aa, Artificial Sequence
  Description of Artificial Sequence: Synthetic peptide
  Seed: VIVPVLGPL (MOG_HUMAN)
VAVPVLGPR

SEQ ID NO: 119650 - protein, 9 aa, Artificial Sequence
  Description of Artificial Sequence: Synthetic peptide
  Seed: VLGPLVALI (MOG_HUMAN)
VAGPLVALM

SEQ ID NO: 119651 - protein, 10 aa, Artificial Sequence
  Description of Artificial Sequence: Synthetic peptide
  Seed: LVLLAVLPVL (MOG_HUMAN)
LHLLAVLPVI

SEQ ID NO: 119652 - protein, 9 aa, Artificial Sequence
  Description of Artificial Sequence: Synthetic peptide
  Seed: LQITVGLIF (MOG_HUMAN)
LMITVGLIM

SEQ ID NO: 119653 - protein, 9 aa, Artificial Sequence
  Description of Artificial Sequence: Synthetic peptide
  Seed: LQVSSSYAG (MOG_HUMAN)
LFVSSSYAF

SEQ ID NO: 119654 - protein, 11 aa, Artificial Sequence
  Description of Artificial Sequence: Synthetic peptide
  Seed: RTFDPHFLRVP (MOG_HUMAN)
RMFDPHFLRVF

SEQ ID NO: 119655 - protein, 9 aa, Artificial Sequence
  Description of Artificial Sequence: Synthetic peptide
  Seed: RVPCWKITL (MOG_HUMAN)
RRPCWKITF

SEQ ID NO: 119656 - protein, 11 aa, Artificial Sequence
  Description of Artificial Sequence: Synthetic peptide
  Seed: KDQDGDQAPEY (MOG_HUMAN)
KSQDGDQAPEY

SEQ ID NO: 119657 - protein, 10 aa, Artificial Sequence
  Description of Artificial Sequence: Synthetic peptide
  Seed: RVPCWKITLF (MOG_HUMAN)
RWPCWKITLL

SEQ ID NO: 119658 - protein, 8 aa, Artificial Sequence
  Description of Artificial Sequence: Synthetic peptide
  Seed: GGFTCFFR (MOG_HUMAN)
GSFTCFFR

SEQ ID NO: 119659 - protein, 10 aa, Artificial Sequence
  Description of Artificial Sequence: Synthetic peptide
  Seed: AEIENLHRTF (MOG_HUMAN)
AYIENLHRTF

SEQ ID NO: 119660 - protein, 9 aa, Artificial Sequence
  Description of Artificial Sequence: Synthetic peptide
  Seed: LSRPSLPSC (MOG_HUMAN)
LQRPSLPSI

SEQ ID NO: 119661 - protein, 10 aa, Artificial Sequence
  Description of Artificial Sequence: Synthetic peptide
  Seed: LVLLAVLPVL (MOG_HUMAN)
LYLLAVLPVI

SEQ ID NO: 119662 - protein, 10 aa, Artificial Sequence
  Description of Artificial Sequence: Synthetic peptide
  Seed: FVIVPVLGPL (MOG_HUMAN)
FGIVPVLGPI

SEQ ID NO: 119663 - protein, 9 aa, Artificial Sequence
  Description of Artificial Sequence: Synthetic peptide
  Seed: LQVSSSYAG (MOG_HUMAN)
LHVSSSYAF

SEQ ID NO: 119664 - protein, 9 aa, Artificial Sequence
  Description of Artificial Sequence: Synthetic peptide
  Seed: SRPSLPSCL (MOG_HUMAN)
SRPSLPSCF

SEQ ID NO: 119665 - protein, 10 aa, Artificial Sequence
  Description of Artificial Sequence: Synthetic peptide
  Seed: RIRNVRFSDE (MOG_HUMAN)
RARNVRFSDA

SEQ ID NO: 119666 - protein, 10 aa, Artificial Sequence
  Description of Artificial Sequence: Synthetic peptide
  Seed: LLLQVSSSYA (MOG_HUMAN)
LQLQVSSSYC

SEQ ID NO: 119667 - protein, 10 aa, Artificial Sequence
  Description of Artificial Sequence: Synthetic peptide
  Seed: FDPHFLRVPC (MOG_HUMAN)
FWPHFLRVPL

SEQ ID NO: 119668 - protein, 9 aa, Artificial Sequence
  Description of Artificial Sequence: Synthetic peptide
  Seed: RVPCWKITL (MOG_HUMAN)
RMPCWKITW

SEQ ID NO: 119669 - protein, 10 aa, Artificial Sequence
  Description of Artificial Sequence: Synthetic peptide
  Seed: RIRNVRFSDE (MOG_HUMAN)
RFRNVRFSDS

SEQ ID NO: 119670 - protein, 9 aa, Artificial Sequence
  Description of Artificial Sequence: Synthetic peptide
  Seed: YRPPFSRVV (MOG_HUMAN)
YNPPFSRVM

SEQ ID NO: 119671 - protein, 10 aa, Artificial Sequence
  Description of Artificial Sequence: Synthetic peptide
  Seed: RIRNVRFSDE (MOG_HUMAN)
RIRNVRFSDI

SEQ ID NO: 119672 - protein, 9 aa, Artificial Sequence
  Description of Artificial Sequence: Synthetic peptide
  Seed: FSDEGGFTC (MOG_HUMAN)
FIDEGGFTT

SEQ ID NO: 119673 - protein, 9 aa, Artificial Sequence
  Description of Artificial Sequence: Synthetic peptide
  Seed: YWVSPGVLV (MOG_HUMAN)
YAVSPGVLM

SEQ ID NO: 119674 - protein, 11 aa, Artificial Sequence
  Description of Artificial Sequence: Synthetic peptide
  Seed: QAPEYRGRTEL (MOG_HUMAN)
QPPEYRGRTEM

SEQ ID NO: 119675 - protein, 10 aa, Artificial Sequence
  Description of Artificial Sequence: Synthetic peptide
  Seed: WVSPGVLVLL (MOG_HUMAN)
WTSPGVLVLW

SEQ ID NO: 119676 - protein, 9 aa, Artificial Sequence
  Description of Artificial Sequence: Synthetic peptide
  Seed: LQVSSSYAG (MOG_HUMAN)
LMVSSSYAI

SEQ ID NO: 119677 - protein, 10 aa, Artificial Sequence
  Description of Artificial Sequence: Synthetic peptide
  Seed: RTFDPHFLRV (MOG_HUMAN)
RFFDPHFLRI

SEQ ID NO: 119678 - protein, 9 aa, Artificial Sequence
  Description of Artificial Sequence: Synthetic peptide
  Seed: RIRNVRFSD (MOG_HUMAN)
RWRNVRFSA

SEQ ID NO: 119679 - protein, 11 aa, Artificial Sequence
  Description of Artificial Sequence: Synthetic peptide
  Seed: LIICYNWLHRR (MOG_HUMAN)
LMICYNWLHRR

SEQ ID NO: 119680 - protein, 9 aa, Artificial Sequence
  Description of Artificial Sequence: Synthetic peptide
  Seed: VLPVLLLQI (MOG_HUMAN)
VQPVLLLQV

SEQ ID NO: 119681 - protein, 10 aa, Artificial Sequence
  Description of Artificial Sequence: Synthetic peptide
  Seed: FSDEGGFTCF (MOG_HUMAN)
FNDEGGFTCM

SEQ ID NO: 119682 - protein, 9 aa, Artificial Sequence
  Description of Artificial Sequence: Synthetic peptide
  Seed: HSYQEEAAM (MOG_HUMAN)
HPYQEEAAH

SEQ ID NO: 119683 - protein, 9 aa, Artificial Sequence
  Description of Artificial Sequence: Synthetic peptide
  Seed: LIICYNWLH (MOG_HUMAN)
LMICYNWLR

SEQ ID NO: 119684 - protein, 9 aa, Artificial Sequence
  Description of Artificial Sequence: Synthetic peptide
  Seed: YQEEAAMEL (MOG_HUMAN)
YWEEAAMEI

SEQ ID NO: 119685 - protein, 11 aa, Artificial Sequence
  Description of Artificial Sequence: Synthetic peptide
  Seed: RDHSYQEEAAM (MOG_HUMAN)
RYHSYQEEAAF

SEQ ID NO: 119686 - protein, 9 aa, Artificial Sequence
  Description of Artificial Sequence: Synthetic peptide
  Seed: VSSSYAGQF (MOG_HUMAN)
VMSSYAGQY

SEQ ID NO: 119687 - protein, 10 aa, Artificial Sequence
  Description of Artificial Sequence: Synthetic peptide
  Seed: FSDEGGFTCF (MOG_HUMAN)
FFDEGGFTCY

SEQ ID NO: 119688 - protein, 9 aa, Artificial Sequence
  Description of Artificial Sequence: Synthetic peptide
  Seed: RVPCWKITL (MOG_HUMAN)
RLPCWKITV

SEQ ID NO: 119689 - protein, 9 aa, Artificial Sequence
  Description of Artificial Sequence: Synthetic peptide
  Seed: LAGQFLEEL (MOG_HUMAN)
LRGQFLEEM

SEQ ID NO: 119690 - protein, 9 aa, Artificial Sequence
  Description of Artificial Sequence: Synthetic peptide
  Seed: GEGKVTLRI (MOG_HUMAN)
GEGKVTLRA

SEQ ID NO: 119691 - protein, 9 aa, Artificial Sequence
  Description of Artificial Sequence: Synthetic peptide
  Seed: LCSFLLLLL (MOG_HUMAN)
LASFLLLLW

SEQ ID NO: 119692 - protein, 9 aa, Artificial Sequence
  Description of Artificial Sequence: Synthetic peptide
  Seed: KVEDPFYWV (MOG_HUMAN)
KTEDPFYWV

SEQ ID NO: 119693 - protein, 10 aa, Artificial Sequence
  Description of Artificial Sequence: Synthetic peptide
  Seed: FVIVPVLGPL (MOG_HUMAN)
FDIVPVLGPY

SEQ ID NO: 119694 - protein, 9 aa, Artificial Sequence
  Description of Artificial Sequence: Synthetic peptide
  Seed: GQFRVIGPR (MOG_HUMAN)
GRFRVIGPY

SEQ ID NO: 119695 - protein, 9 aa, Artificial Sequence
  Description of Artificial Sequence: Synthetic peptide
  Seed: VLGPLVALI (MOG_HUMAN)
VSGPLVALV

SEQ ID NO: 119696 - protein, 10 aa, Artificial Sequence
  Description of Artificial Sequence: Synthetic peptide
  Seed: FSDEGGFTCF (MOG_HUMAN)
FCDEGGFTCF

SEQ ID NO: 119697 - protein, 8 aa, Artificial Sequence
  Description of Artificial Sequence: Synthetic peptide
  Seed: FSDEGGFT (MOG_HUMAN)
FSDEGGFM

SEQ ID NO: 119698 - protein, 9 aa, Artificial Sequence
  Description of Artificial Sequence: Synthetic peptide
  Seed: SCLCSFLLL (MOG_HUMAN)
SMLCSFLLA

SEQ ID NO: 119699 - protein, 9 aa, Artificial Sequence
  Description of Artificial Sequence: Synthetic peptide
  Seed: LCSFLLLLL (MOG_HUMAN)
LLSFLLLLI

SEQ ID NO: 119700 - protein, 9 aa, Artificial Sequence
  Description of Artificial Sequence: Synthetic peptide
  Seed: VIVPVLGPL (MOG_HUMAN)
VAVPVLGPV

SEQ ID NO: 119701 - protein, 9 aa, Artificial Sequence
  Description of Artificial Sequence: Synthetic peptide
  Seed: MASLSRPSL (MOG_HUMAN)
MMSLSRPSF

SEQ ID NO: 119702 - protein, 9 aa, Artificial Sequence
  Description of Artificial Sequence: Synthetic peptide
  Seed: GPRHPIRAL (MOG_HUMAN)
GVRHPIRAL

SEQ ID NO: 119703 - protein, 9 aa, Artificial Sequence
  Description of Artificial Sequence: Synthetic peptide
  Seed: ICYNWLHRR (MOG_HUMAN)
ILYNWLHRK

SEQ ID NO: 119704 - protein, 9 aa, Artificial Sequence
  Description of Artificial Sequence: Synthetic peptide
  Seed: YRPPFSRVV (MOG_HUMAN)
YIPPFSRVL

SEQ ID NO: 119705 - protein, 8 aa, Artificial Sequence
  Description of Artificial Sequence: Synthetic peptide
  Seed: GGFTCFFR (MOG_HUMAN)
GMFTCFFR

SEQ ID NO: 119706 - protein, 9 aa, Artificial Sequence
  Description of Artificial Sequence: Synthetic peptide
  Seed: HSYQEEAAM (MOG_HUMAN)
HRYQEEAAF

SEQ ID NO: 119707 - protein, 9 aa, Artificial Sequence
  Description of Artificial Sequence: Synthetic peptide
  Seed: VGDEVELPC (MOG_HUMAN)
VADEVELPL

SEQ ID NO: 119708 - protein, 9 aa, Artificial Sequence
  Description of Artificial Sequence: Synthetic peptide
  Seed: LQVSSSYAG (MOG_HUMAN)
LRVSSSYAL

SEQ ID NO: 119709 - protein, 9 aa, Artificial Sequence
  Description of Artificial Sequence: Synthetic peptide
  Seed: FSDEGGFTC (MOG_HUMAN)
FTDEGGFTT

SEQ ID NO: 119710 - protein, 10 aa, Artificial Sequence
  Description of Artificial Sequence: Synthetic peptide
  Seed: VLLAVLPVLL (MOG_HUMAN)
VMLAVLPVLA

SEQ ID NO: 119711 - protein, 11 aa, Artificial Sequence
  Description of Artificial Sequence: Synthetic peptide
  Seed: RFSDEGGFTCF (MOG_HUMAN)
RTSDEGGFTCW

SEQ ID NO: 119712 - protein, 10 aa, Artificial Sequence
  Description of Artificial Sequence: Synthetic peptide
  Seed: AEIENLHRTF (MOG_HUMAN)
AEIENLHRTW

SEQ ID NO: 119713 - protein, 10 aa, Artificial Sequence
  Description of Artificial Sequence: Synthetic peptide
  Seed: RALVGDEVEL (MOG_HUMAN)
RVLVGDEVEL

SEQ ID NO: 119714 - protein, 9 aa, Artificial Sequence
  Description of Artificial Sequence: Synthetic peptide
  Seed: FSDEGGFTC (MOG_HUMAN)
FSDEGGFTT

SEQ ID NO: 119715 - protein, 9 aa, Artificial Sequence
  Description of Artificial Sequence: Synthetic peptide
  Seed: VSPGVLVLL (MOG_HUMAN)
VMPGVLVLL

SEQ ID NO: 119716 - protein, 10 aa, Artificial Sequence
  Description of Artificial Sequence: Synthetic peptide
  Seed: LLKDAIGEGK (MOG_HUMAN)
LVKDAIGEGF

SEQ ID NO: 119717 - protein, 9 aa, Artificial Sequence
  Description of Artificial Sequence: Synthetic peptide
  Seed: LQITVGLIF (MOG_HUMAN)
LKITVGLIF

SEQ ID NO: 119718 - protein, 10 aa, Artificial Sequence
  Description of Artificial Sequence: Synthetic peptide
  Seed: SSYAGQFRVI (MOG_HUMAN)
SMYAGQFRVF

SEQ ID NO: 119719 - protein, 9 aa, Artificial Sequence
  Description of Artificial Sequence: Synthetic peptide
  Seed: RVIGPRHPI (MOG_HUMAN)
RSIGPRHPY

SEQ ID NO: 119720 - protein, 10 aa, Artificial Sequence
  Description of Artificial Sequence: Synthetic peptide
  Seed: TGMEVGWYRP (MOG_HUMAN)
TVMEVGWYRY

SEQ ID NO: 119721 - protein, 9 aa, Artificial Sequence
  Description of Artificial Sequence: Synthetic peptide
  Seed: TFDPHFLRV (MOG_HUMAN)
TVDPHFLRI

SEQ ID NO: 119722 - protein, 9 aa, Artificial Sequence
  Description of Artificial Sequence: Synthetic peptide
  Seed: RDHSYQEEA (MOG_HUMAN)
RDHSYQEEL

SEQ ID NO: 119723 - protein, 9 aa, Artificial Sequence
  Description of Artificial Sequence: Synthetic peptide
  Seed: LLLQITVGL (MOG_HUMAN)
LMLQITVGV

SEQ ID NO: 119724 - protein, 9 aa, Artificial Sequence
  Description of Artificial Sequence: Synthetic peptide
  Seed: RIRNVRFSD (MOG_HUMAN)
RFRNVRFSC

SEQ ID NO: 119725 - protein, 10 aa, Artificial Sequence
  Description of Artificial Sequence: Synthetic peptide
  Seed: RLAGQFLEEL (MOG_HUMAN)
RVAGQFLEEF

SEQ ID NO: 119726 - protein, 10 aa, Artificial Sequence
  Description of Artificial Sequence: Synthetic peptide
  Seed: AEIENLHRTF (MOG_HUMAN)
AMIENLHRTW

SEQ ID NO: 119727 - protein, 9 aa, Artificial Sequence
  Description of Artificial Sequence: Synthetic peptide
  Seed: IRALVGDEV (MOG_HUMAN)
IHALVGDEV

SEQ ID NO: 119728 - protein, 9 aa, Artificial Sequence
  Description of Artificial Sequence: Synthetic peptide
  Seed: FYWVSPGVL (MOG_HUMAN)
FYWVSPGVM

SEQ ID NO: 119729 - protein, 9 aa, Artificial Sequence
  Description of Artificial Sequence: Synthetic peptide
  Seed: RIRNVRFSD (MOG_HUMAN)
RSRNVRFSQ

SEQ ID NO: 119730 - protein, 9 aa, Artificial Sequence
  Description of Artificial Sequence: Synthetic peptide
  Seed: AGQFLEELR (MOG_HUMAN)
ATQFLEELR

SEQ ID NO: 119731 - protein, 10 aa, Artificial Sequence
  Description of Artificial Sequence: Synthetic peptide
  Seed: LVLLAVLPVL (MOG_HUMAN)
LMLLAVLPVI

SEQ ID NO: 119732 - protein, 9 aa, Artificial Sequence
  Description of Artificial Sequence: Synthetic peptide
  Seed: DQAPEYRGR (MOG_HUMAN)
DVAPEYRGR

SEQ ID NO: 119733 - protein, 10 aa, Artificial Sequence
  Description of Artificial Sequence: Synthetic peptide
  Seed: HRTFDPHFLR (MOG_HUMAN)
HGTFDPHFLY

SEQ ID NO: 119734 - protein, 10 aa, Artificial Sequence
  Description of Artificial Sequence: Synthetic peptide
  Seed: IGPRHPIRAL (MOG_HUMAN)
IRPRHPIRAL

SEQ ID NO: 119735 - protein, 10 aa, Artificial Sequence
  Description of Artificial Sequence: Synthetic peptide
  Seed: SSYAGQFRVI (MOG_HUMAN)
SGYAGQFRVW

SEQ ID NO: 119736 - protein, 11 aa, Artificial Sequence
  Description of Artificial Sequence: Synthetic peptide
  Seed: LHRTFDPHFLR (MOG_HUMAN)
LDRTFDPHFLR

SEQ ID NO: 119737 - protein, 10 aa, Artificial Sequence
  Description of Artificial Sequence: Synthetic peptide
  Seed: CLCSFLLLLL (MOG_HUMAN)
CMCSFLLLLI

SEQ ID NO: 119738 - protein, 9 aa, Artificial Sequence
  Description of Artificial Sequence: Synthetic peptide
  Seed: SSSYAGQFR (MOG_HUMAN)
SVSYAGQFK

SEQ ID NO: 119739 - protein, 9 aa, Artificial Sequence
  Description of Artificial Sequence: Synthetic peptide
  Seed: TFDPHFLRV (MOG_HUMAN)
TSDPHFLRF

SEQ ID NO: 119740 - protein, 9 aa, Artificial Sequence
  Description of Artificial Sequence: Synthetic peptide
  Seed: RVIGPRHPI (MOG_HUMAN)
RQIGPRHPW

SEQ ID NO: 119741 - protein, 10 aa, Artificial Sequence
  Description of Artificial Sequence: Synthetic peptide
  Seed: LLLQVSSSYA (MOG_HUMAN)
LVLQVSSSYI

SEQ ID NO: 119742 - protein, 9 aa, Artificial Sequence
  Description of Artificial Sequence: Synthetic peptide
  Seed: TFDPHFLRV (MOG_HUMAN)
TTDPHFLRY

SEQ ID NO: 119743 - protein, 9 aa, Artificial Sequence
  Description of Artificial Sequence: Synthetic peptide
  Seed: VSPGVLVLL (MOG_HUMAN)
VIPGVLVLL

SEQ ID NO: 119744 - protein, 11 aa, Artificial Sequence
  Description of Artificial Sequence: Synthetic peptide
  Seed: RFSDEGGFTCF (MOG_HUMAN)
RASDEGGFTCF

SEQ ID NO: 119745 - protein, 10 aa, Artificial Sequence
  Description of Artificial Sequence: Synthetic peptide
  Seed: SLPSCLCSFL (MOG_HUMAN)
SVPSCLCSFV

SEQ ID NO: 119746 - protein, 10 aa, Artificial Sequence
  Description of Artificial Sequence: Synthetic peptide
  Seed: FSDEGGFTCF (MOG_HUMAN)
FTDEGGFTCI

SEQ ID NO: 119747 - protein, 9 aa, Artificial Sequence
  Description of Artificial Sequence: Synthetic peptide
  Seed: WVSPGVLVL (MOG_HUMAN)
WPSPGVLVI

SEQ ID NO: 119748 - protein, 10 aa, Artificial Sequence
  Description of Artificial Sequence: Synthetic peptide
  Seed: RLAGQFLEEL (MOG_HUMAN)
RQAGQFLEEM

SEQ ID NO: 119749 - protein, 11 aa, Artificial Sequence
  Description of Artificial Sequence: Synthetic peptide
  Seed: KLRAEIENLHR (MOG_HUMAN)
KIRAEIENLHR

SEQ ID NO: 119750 - protein, 10 aa, Artificial Sequence
  Description of Artificial Sequence: Synthetic peptide
  Seed: ITVGLIFLCL (MOG_HUMAN)
ILVGLIFLCI

SEQ ID NO: 119751 - protein, 10 aa, Artificial Sequence
  Description of Artificial Sequence: Synthetic peptide
  Seed: FVIVPVLGPL (MOG_HUMAN)
FWIVPVLGPY

SEQ ID NO: 119752 - protein, 9 aa, Artificial Sequence
  Description of Artificial Sequence: Synthetic peptide
  Seed: WVSPGVLVL (MOG_HUMAN)
WVSPGVLVI

SEQ ID NO: 119753 - protein, 10 aa, Artificial Sequence
  Description of Artificial Sequence: Synthetic peptide
  Seed: RVIGPRHPIR (MOG_HUMAN)
RTIGPRHPIR

SEQ ID NO: 119754 - protein, 9 aa, Artificial Sequence
  Description of Artificial Sequence: Synthetic peptide
  Seed: TFDPHFLRV (MOG_HUMAN)
TWDPHFLRW

SEQ ID NO: 119755 - protein, 9 aa, Artificial Sequence
  Description of Artificial Sequence: Synthetic peptide
  Seed: IFLCLQYRL (MOG_HUMAN)
IYLCLQYRY

SEQ ID NO: 119756 - protein, 9 aa, Artificial Sequence
  Description of Artificial Sequence: Synthetic peptide
  Seed: IGEGKVTLR (MOG_HUMAN)
ISEGKVTLY

SEQ ID NO: 119757 - protein, 10 aa, Artificial Sequence
  Description of Artificial Sequence: Synthetic peptide
  Seed: SLPSCLCSFL (MOG_HUMAN)
SLPSCLCSFA

SEQ ID NO: 119758 - protein, 10 aa, Artificial Sequence
  Description of Artificial Sequence: Synthetic peptide
  Seed: VLLLQITVGL (MOG_HUMAN)
VYLLQITVGL

SEQ ID NO: 119759 - protein, 9 aa, Artificial Sequence
  Description of Artificial Sequence: Synthetic peptide
  Seed: VLGPLVALI (MOG_HUMAN)
VAGPLVALL

SEQ ID NO: 119760 - protein, 9 aa, Artificial Sequence
  Description of Artificial Sequence: Synthetic peptide
  Seed: LIICYNWLH (MOG_HUMAN)
LSICYNWLK

SEQ ID NO: 119761 - protein, 10 aa, Artificial Sequence
  Description of Artificial Sequence: Synthetic peptide
  Seed: SCLCSFLLLL (MOG_HUMAN)
SGLCSFLLLI

SEQ ID NO: 119762 - protein, 10 aa, Artificial Sequence
  Description of Artificial Sequence: Synthetic peptide
  Seed: FVIVPVLGPL (MOG_HUMAN)
FWIVPVLGPI

SEQ ID NO: 119763 - protein, 10 aa, Artificial Sequence
  Description of Artificial Sequence: Synthetic peptide
  Seed: VPVLGPLVAL (MOG_HUMAN)
VHVLGPLVAV

SEQ ID NO: 119764 - protein, 9 aa, Artificial Sequence
  Description of Artificial Sequence: Synthetic peptide
  Seed: RVPCWKITL (MOG_HUMAN)
RLPCWKITM

SEQ ID NO: 119765 - protein, 9 aa, Artificial Sequence
  Description of Artificial Sequence: Synthetic peptide
  Seed: TVGLIFLCL (MOG_HUMAN)
TLGLIFLCV

SEQ ID NO: 119766 - protein, 9 aa, Artificial Sequence
  Description of Artificial Sequence: Synthetic peptide
  Seed: TCFFRDHSY (MOG_HUMAN)
TSFFRDHSY

SEQ ID NO: 119767 - protein, 9 aa, Artificial Sequence
  Description of Artificial Sequence: Synthetic peptide
  Seed: EGGFTCFFR (MOG_HUMAN)
EVGFTCFFK

SEQ ID NO: 119768 - protein, 9 aa, Artificial Sequence
  Description of Artificial Sequence: Synthetic peptide
  Seed: LLLQITVGL (MOG_HUMAN)
LVLQITVGL

SEQ ID NO: 119769 - protein, 9 aa, Artificial Sequence
  Description of Artificial Sequence: Synthetic peptide
  Seed: LLLQVSSSY (MOG_HUMAN)
LNLQVSSSF

SEQ ID NO: 119770 - protein, 9 aa, Artificial Sequence
  Description of Artificial Sequence: Synthetic peptide
  Seed: VSPGVLVLL (MOG_HUMAN)
VVPGVLVLM

SEQ ID NO: 119771 - protein, 11 aa, Artificial Sequence
  Description of Artificial Sequence: Synthetic peptide
  Seed: VGLIFLCLQYR (MOG_HUMAN)
VYLIFLCLQYR

SEQ ID NO: 119772 - protein, 10 aa, Artificial Sequence
  Description of Artificial Sequence: Synthetic peptide
  Seed: RPPFSRVVHL (MOG_HUMAN)
RGPFSRVVHL

SEQ ID NO: 119773 - protein, 10 aa, Artificial Sequence
  Description of Artificial Sequence: Synthetic peptide
  Seed: FSRVVHLYRN (MOG_HUMAN)
FMRVVHLYRR

SEQ ID NO: 119774 - protein, 10 aa, Artificial Sequence
  Description of Artificial Sequence: Synthetic peptide
  Seed: MEVGWYRPPF (MOG_HUMAN)
MMVGWYRPPM

SEQ ID NO: 119775 - protein, 9 aa, Artificial Sequence
  Description of Artificial Sequence: Synthetic peptide
  Seed: RVIGPRHPI (MOG_HUMAN)
RTIGPRHPR

SEQ ID NO: 119776 - protein, 9 aa, Artificial Sequence
  Description of Artificial Sequence: Synthetic peptide
  Seed: RTFDPHFLR (MOG_HUMAN)
RTFDPHFLA

SEQ ID NO: 119777 - protein, 10 aa, Artificial Sequence
  Description of Artificial Sequence: Synthetic peptide
  Seed: ITLFVIVPVL (MOG_HUMAN)
ILLFVIVPVI

SEQ ID NO: 119778 - protein, 10 aa, Artificial Sequence
  Description of Artificial Sequence: Synthetic peptide
  Seed: SDEGGFTCFF (MOG_HUMAN)
SYEGGFTCFW

SEQ ID NO: 119779 - protein, 8 aa, Artificial Sequence
  Description of Artificial Sequence: Synthetic peptide
  Seed: FSDEGGFT (MOG_HUMAN)
FTDEGGFI

SEQ ID NO: 119780 - protein, 9 aa, Artificial Sequence
  Description of Artificial Sequence: Synthetic peptide
  Seed: ICYNWLHRR (MOG_HUMAN)
IMYNWLHRV

SEQ ID NO: 119781 - protein, 10 aa, Artificial Sequence
  Description of Artificial Sequence: Synthetic peptide
  Seed: LLLLQVSSSY (MOG_HUMAN)
LMLLQVSSSY

SEQ ID NO: 119782 - protein, 9 aa, Artificial Sequence
  Description of Artificial Sequence: Synthetic peptide
  Seed: FYWVSPGVL (MOG_HUMAN)
FYWVSPGVI

SEQ ID NO: 119783 - protein, 9 aa, Artificial Sequence
  Description of Artificial Sequence: Synthetic peptide
  Seed: VIVPVLGPL (MOG_HUMAN)
VMVPVLGPY

SEQ ID NO: 119784 - protein, 10 aa, Artificial Sequence
  Description of Artificial Sequence: Synthetic peptide
  Seed: LLLLQVSSSY (MOG_HUMAN)
LLLLQVSSSF

SEQ ID NO: 119785 - protein, 10 aa, Artificial Sequence
  Description of Artificial Sequence: Synthetic peptide
  Seed: FVIVPVLGPL (MOG_HUMAN)
FMIVPVLGPS

SEQ ID NO: 119786 - protein, 9 aa, Artificial Sequence
  Description of Artificial Sequence: Synthetic peptide
  Seed: GWYRPPFSR (MOG_HUMAN)
GGYRPPFSR

SEQ ID NO: 119787 - protein, 10 aa, Artificial Sequence
  Description of Artificial Sequence: Synthetic peptide
  Seed: VPVLGPLVAL (MOG_HUMAN)
VAVLGPLVAV

SEQ ID NO: 119788 - protein, 9 aa, Artificial Sequence
  Description of Artificial Sequence: Synthetic peptide
  Seed: GWYRPPFSR (MOG_HUMAN)
GYYRPPFSR

SEQ ID NO: 119789 - protein, 10 aa, Artificial Sequence
  Description of Artificial Sequence: Synthetic peptide
  Seed: RIRNVRFSDE (MOG_HUMAN)
RVRNVRFSDL

SEQ ID NO: 119790 - protein, 9 aa, Artificial Sequence
  Description of Artificial Sequence: Synthetic peptide
  Seed: RRLAGQFLE (MOG_HUMAN)
RRLAGQFLI

SEQ ID NO: 119791 - protein, 10 aa, Artificial Sequence
  Description of Artificial Sequence: Synthetic peptide
  Seed: ATGMEVGWYR (MOG_HUMAN)
ARGMEVGWYR

SEQ ID NO: 119792 - protein, 9 aa, Artificial Sequence
  Description of Artificial Sequence: Synthetic peptide
  Seed: WVSPGVLVL (MOG_HUMAN)
WLSPGVLVV

SEQ ID NO: 119793 - protein, 9 aa, Artificial Sequence
  Description of Artificial Sequence: Synthetic peptide
  Seed: CLCSFLLLL (MOG_HUMAN)
CICSFLLLL

SEQ ID NO: 119794 - protein, 9 aa, Artificial Sequence
  Description of Artificial Sequence: Synthetic peptide
  Seed: LSRPSLPSC (MOG_HUMAN)
LVRPSLPSL

SEQ ID NO: 119795 - protein, 9 aa, Artificial Sequence
  Description of Artificial Sequence: Synthetic peptide
  Seed: FLEELRNPF (MOG_HUMAN)
FTEELRNPM

SEQ ID NO: 119796 - protein, 11 aa, Artificial Sequence
  Description of Artificial Sequence: Synthetic peptide
  Seed: RDHSYQEEAAM (MOG_HUMAN)
RTHSYQEEAAF

SEQ ID NO: 119797 - protein, 9 aa, Artificial Sequence
  Description of Artificial Sequence: Synthetic peptide
  Seed: RIRNVRFSD (MOG_HUMAN)
RTRNVRFSH

SEQ ID NO: 119798 - protein, 9 aa, Artificial Sequence
  Description of Artificial Sequence: Synthetic peptide
  Seed: CLCSFLLLL (MOG_HUMAN)
CTCSFLLLK

SEQ ID NO: 119799 - protein, 9 aa, Artificial Sequence
  Description of Artificial Sequence: Synthetic peptide
  Seed: YQEEAAMEL (MOG_HUMAN)
YIEEAAMEY

SEQ ID NO: 119800 - protein, 10 aa, Artificial Sequence
  Description of Artificial Sequence: Synthetic peptide
  Seed: VLLAVLPVLL (MOG_HUMAN)
VFLAVLPVLI

SEQ ID NO: 119801 - protein, 10 aa, Artificial Sequence
  Description of Artificial Sequence: Synthetic peptide
  Seed: LVLLAVLPVL (MOG_HUMAN)
LQLLAVLPVV

SEQ ID NO: 119802 - protein, 9 aa, Artificial Sequence
  Description of Artificial Sequence: Synthetic peptide
  Seed: TFDPHFLRV (MOG_HUMAN)
TDDPHFLRY

SEQ ID NO: 119803 - protein, 9 aa, Artificial Sequence
  Description of Artificial Sequence: Synthetic peptide
  Seed: KLRAEIENL (MOG_HUMAN)
KIRAEIENK

SEQ ID NO: 119804 - protein, 11 aa, Artificial Sequence
  Description of Artificial Sequence: Synthetic peptide
  Seed: HRTFDPHFLRV (MOG_HUMAN)
HMTFDPHFLRF

SEQ ID NO: 119805 - protein, 10 aa, Artificial Sequence
  Description of Artificial Sequence: Synthetic peptide
  Seed: LVLLAVLPVL (MOG_HUMAN)
LGLLAVLPVI

SEQ ID NO: 119806 - protein, 9 aa, Artificial Sequence
  Description of Artificial Sequence: Synthetic peptide
  Seed: SSYAGQFRV (MOG_HUMAN)
SIYAGQFRI

SEQ ID NO: 119807 - protein, 9 aa, Artificial Sequence
  Description of Artificial Sequence: Synthetic peptide
  Seed: RVIGPRHPI (MOG_HUMAN)
RIIGPRHPI

SEQ ID NO: 119808 - protein, 10 aa, Artificial Sequence
  Description of Artificial Sequence: Synthetic peptide
  Seed: LLLQVSSSYA (MOG_HUMAN)
LLLQVSSSYF

SEQ ID NO: 119809 - protein, 10 aa, Artificial Sequence
  Description of Artificial Sequence: Synthetic peptide
  Seed: RTFDPHFLRV (MOG_HUMAN)
RWFDPHFLRI

SEQ ID NO: 119810 - protein, 10 aa, Artificial Sequence
  Description of Artificial Sequence: Synthetic peptide
  Seed: RALVGDEVEL (MOG_HUMAN)
RVLVGDEVEW

SEQ ID NO: 119811 - protein, 9 aa, Artificial Sequence
  Description of Artificial Sequence: Synthetic peptide
  Seed: HSYQEEAAM (MOG_HUMAN)
HLYQEEAAF

SEQ ID NO: 119812 - protein, 10 aa, Artificial Sequence
  Description of Artificial Sequence: Synthetic peptide
  Seed: MEVGWYRPPF (MOG_HUMAN)
MAVGWYRPPF

SEQ ID NO: 119813 - protein, 9 aa, Artificial Sequence
  Description of Artificial Sequence: Synthetic peptide
  Seed: YRPPFSRVV (MOG_HUMAN)
YFPPFSRVF

SEQ ID NO: 119814 - protein, 10 aa, Artificial Sequence
  Description of Artificial Sequence: Synthetic peptide
  Seed: LLLQVSSSYA (MOG_HUMAN)
LMLQVSSSYT

SEQ ID NO: 119815 - protein, 10 aa, Artificial Sequence
  Description of Artificial Sequence: Synthetic peptide
  Seed: LVLLAVLPVL (MOG_HUMAN)
LHLLAVLPVV

SEQ ID NO: 119816 - protein, 11 aa, Artificial Sequence
  Description of Artificial Sequence: Synthetic peptide
  Seed: VLLAVLPVLLL (MOG_HUMAN)
VLLAVLPVLLV

SEQ ID NO: 119817 - protein, 10 aa, Artificial Sequence
  Description of Artificial Sequence: Synthetic peptide
  Seed: YWVSPGVLVL (MOG_HUMAN)
YPVSPGVLVY

SEQ ID NO: 119818 - protein, 9 aa, Artificial Sequence
  Description of Artificial Sequence: Synthetic peptide
  Seed: FLEELRNPF (MOG_HUMAN)
FPEELRNPW

SEQ ID NO: 119819 - protein, 9 aa, Artificial Sequence
  Description of Artificial Sequence: Synthetic peptide
  Seed: SRPSLPSCL (MOG_HUMAN)
SFPSLPSCY

SEQ ID NO: 119820 - protein, 9 aa, Artificial Sequence
  Description of Artificial Sequence: Synthetic peptide
  Seed: RTFDPHFLR (MOG_HUMAN)
RMFDPHFLL

SEQ ID NO: 119821 - protein, 10 aa, Artificial Sequence
  Description of Artificial Sequence: Synthetic peptide
  Seed: FTCFFRDHSY (MOG_HUMAN)
FLCFFRDHSR

SEQ ID NO: 119822 - protein, 10 aa, Artificial Sequence
  Description of Artificial Sequence: Synthetic peptide
  Seed: RIRNVRFSDE (MOG_HUMAN)
RSRNVRFSDI

SEQ ID NO: 119823 - protein, 9 aa, Artificial Sequence
  Description of Artificial Sequence: Synthetic peptide
  Seed: LQVSSSYAG (MOG_HUMAN)
LMVSSSYAM

SEQ ID NO: 119824 - protein, 10 aa, Artificial Sequence
  Description of Artificial Sequence: Synthetic peptide
  Seed: FTCFFRDHSY (MOG_HUMAN)
FHCFFRDHSY

SEQ ID NO: 119825 - protein, 10 aa, Artificial Sequence
  Description of Artificial Sequence: Synthetic peptide
  Seed: FRVIGPRHPI (MOG_HUMAN)
FFVIGPRHPV

SEQ ID NO: 119826 - protein, 9 aa, Artificial Sequence
  Description of Artificial Sequence: Synthetic peptide
  Seed: RIRNVRFSD (MOG_HUMAN)
RIRNVRFSK

SEQ ID NO: 119827 - protein, 9 aa, Artificial Sequence
  Description of Artificial Sequence: Synthetic peptide
  Seed: LAVLPVLLL (MOG_HUMAN)
LPVLPVLLL

SEQ ID NO: 119828 - protein, 10 aa, Artificial Sequence
  Description of Artificial Sequence: Synthetic peptide
  Seed: FDPHFLRVPC (MOG_HUMAN)
FNPHFLRVPF

SEQ ID NO: 119829 - protein, 11 aa, Artificial Sequence
  Description of Artificial Sequence: Synthetic peptide
  Seed: LHRTFDPHFLR (MOG_HUMAN)
LFRTFDPHFLR

SEQ ID NO: 119830 - protein, 9 aa, Artificial Sequence
  Description of Artificial Sequence: Synthetic peptide
  Seed: FSDEGGFTC (MOG_HUMAN)
FWDEGGFTL

SEQ ID NO: 119831 - protein, 9 aa, Artificial Sequence
  Description of Artificial Sequence: Synthetic peptide
  Seed: FSRVVHLYR (MOG_HUMAN)
FQRVVHLYR

SEQ ID NO: 119832 - protein, 11 aa, Artificial Sequence
  Description of Artificial Sequence: Synthetic peptide
  Seed: HSYQEEAAMEL (MOG_HUMAN)
HQYQEEAAMEM

SEQ ID NO: 119833 - protein, 9 aa, Artificial Sequence
  Description of Artificial Sequence: Synthetic peptide
  Seed: LLLQVSSSY (MOG_HUMAN)
LTLQVSSSR

SEQ ID NO: 119834 - protein, 10 aa, Artificial Sequence
  Description of Artificial Sequence: Synthetic peptide
  Seed: FVIVPVLGPL (MOG_HUMAN)
FRIVPVLGPV

SEQ ID NO: 119835 - protein, 10 aa, Artificial Sequence
  Description of Artificial Sequence: Synthetic peptide
  Seed: FDPHFLRVPC (MOG_HUMAN)
FQPHFLRVPV

SEQ ID NO: 119836 - protein, 11 aa, Artificial Sequence
  Description of Artificial Sequence: Synthetic peptide
  Seed: VLVLLAVLPVL (MOG_HUMAN)
VSVLLAVLPVV

SEQ ID NO: 119837 - protein, 9 aa, Artificial Sequence
  Description of Artificial Sequence: Synthetic peptide
  Seed: RVVHLYRNG (MOG_HUMAN)
RVVHLYRNK

SEQ ID NO: 119838 - protein, 11 aa, Artificial Sequence
  Description of Artificial Sequence: Synthetic peptide
  Seed: IRALVGDEVEL (MOG_HUMAN)
IHALVGDEVEL

SEQ ID NO: 119839 - protein, 10 aa, Artificial Sequence
  Description of Artificial Sequence: Synthetic peptide
  Seed: FDPHFLRVPC (MOG_HUMAN)
FRPHFLRVPF

SEQ ID NO: 119840 - protein, 9 aa, Artificial Sequence
  Description of Artificial Sequence: Synthetic peptide
  Seed: RVIGPRHPI (MOG_HUMAN)
RVIGPRHPL

SEQ ID NO: 119841 - protein, 9 aa, Artificial Sequence
  Description of Artificial Sequence: Synthetic peptide
  Seed: RIRNVRFSD (MOG_HUMAN)
RARNVRFSR

SEQ ID NO: 119842 - protein, 10 aa, Artificial Sequence
  Description of Artificial Sequence: Synthetic peptide
  Seed: SLSRPSLPSC (MOG_HUMAN)
SYSRPSLPSV

SEQ ID NO: 119843 - protein, 9 aa, Artificial Sequence
  Description of Artificial Sequence: Synthetic peptide
  Seed: RVPCWKITL (MOG_HUMAN)
RWPCWKITW

SEQ ID NO: 119844 - protein, 11 aa, Artificial Sequence
  Description of Artificial Sequence: Synthetic peptide
  Seed: MELKVEDPFYW (MOG_HUMAN)
MTLKVEDPFYF

SEQ ID NO: 119845 - protein, 10 aa, Artificial Sequence
  Description of Artificial Sequence: Synthetic peptide
  Seed: FLLLLLLQVS (MOG_HUMAN)
FGLLLLLQVV

SEQ ID NO: 119846 - protein, 10 aa, Artificial Sequence
  Description of Artificial Sequence: Synthetic peptide
  Seed: AEIENLHRTF (MOG_HUMAN)
AIIENLHRTW

SEQ ID NO: 119847 - protein, 9 aa, Artificial Sequence
  Description of Artificial Sequence: Synthetic peptide
  Seed: TFDPHFLRV (MOG_HUMAN)
TADPHFLRV

SEQ ID NO: 119848 - protein, 10 aa, Artificial Sequence
  Description of Artificial Sequence: Synthetic peptide
  Seed: VPVLGPLVAL (MOG_HUMAN)
VEVLGPLVAV

SEQ ID NO: 119849 - protein, 10 aa, Artificial Sequence
  Description of Artificial Sequence: Synthetic peptide
  Seed: RTFDPHFLRV (MOG_HUMAN)
RFFDPHFLRS

SEQ ID NO: 119850 - protein, 10 aa, Artificial Sequence
  Description of Artificial Sequence: Synthetic peptide
  Seed: RTFDPHFLRV (MOG_HUMAN)
RRFDPHFLRF

SEQ ID NO: 119851 - protein, 9 aa, Artificial Sequence
  Description of Artificial Sequence: Synthetic peptide
  Seed: IFLCLQYRL (MOG_HUMAN)
IMLCLQYRW

SEQ ID NO: 119852 - protein, 9 aa, Artificial Sequence
  Description of Artificial Sequence: Synthetic peptide
  Seed: TLFVIVPVL (MOG_HUMAN)
TTFVIVPVV

SEQ ID NO: 119853 - protein, 9 aa, Artificial Sequence
  Description of Artificial Sequence: Synthetic peptide
  Seed: TFDPHFLRV (MOG_HUMAN)
TVDPHFLRC

SEQ ID NO: 119854 - protein, 9 aa, Artificial Sequence
  Description of Artificial Sequence: Synthetic peptide
  Seed: LLLQVSSSY (MOG_HUMAN)
LGLQVSSSF

SEQ ID NO: 119855 - protein, 9 aa, Artificial Sequence
  Description of Artificial Sequence: Synthetic peptide
  Seed: LLLQITVGL (MOG_HUMAN)
LVLQITVGR

SEQ ID NO: 119856 - protein, 11 aa, Artificial Sequence
  Description of Artificial Sequence: Synthetic peptide
  Seed: LVLLAVLPVLL (MOG_HUMAN)
LFLLAVLPVLV

SEQ ID NO: 119857 - protein, 9 aa, Artificial Sequence
  Description of Artificial Sequence: Synthetic peptide
  Seed: RRLAGQFLE (MOG_HUMAN)
RRLAGQFLH

SEQ ID NO: 119858 - protein, 10 aa, Artificial Sequence
  Description of Artificial Sequence: Synthetic peptide
  Seed: ITVGLIFLCL (MOG_HUMAN)
ITVGLIFLCW

SEQ ID NO: 119859 - protein, 9 aa, Artificial Sequence
  Description of Artificial Sequence: Synthetic peptide
  Seed: SLPSCLCSF (MOG_HUMAN)
SFPSCLCSM

SEQ ID NO: 119860 - protein, 10 aa, Artificial Sequence
  Description of Artificial Sequence: Synthetic peptide
  Seed: VGDEVELPCR (MOG_HUMAN)
VMDEVELPCY

SEQ ID NO: 119861 - protein, 9 aa, Artificial Sequence
  Description of Artificial Sequence: Synthetic peptide
  Seed: TGMEVGWYR (MOG_HUMAN)
TWMEVGWYR

SEQ ID NO: 119862 - protein, 10 aa, Artificial Sequence
  Description of Artificial Sequence: Synthetic peptide
  Seed: LLQITVGLIF (MOG_HUMAN)
LQQITVGLIF

SEQ ID NO: 119863 - protein, 11 aa, Artificial Sequence
  Description of Artificial Sequence: Synthetic peptide
  Seed: LQVSSSYAGQF (MOG_HUMAN)
LLVSSSYAGQY

SEQ ID NO: 119864 - protein, 10 aa, Artificial Sequence
  Description of Artificial Sequence: Synthetic peptide
  Seed: KITLFVIVPV (MOG_HUMAN)
KATLFVIVPV

SEQ ID NO: 119865 - protein, 10 aa, Artificial Sequence
  Description of Artificial Sequence: Synthetic peptide
  Seed: FDPHFLRVPC (MOG_HUMAN)
FLPHFLRVPM

SEQ ID NO: 119866 - protein, 10 aa, Artificial Sequence
  Description of Artificial Sequence: Synthetic peptide
  Seed: GKLRAEIENL (MOG_HUMAN)
GYLRAEIENV

SEQ ID NO: 119867 - protein, 10 aa, Artificial Sequence
  Description of Artificial Sequence: Synthetic peptide
  Seed: SSYAGQFRVI (MOG_HUMAN)
SKYAGQFRVW

SEQ ID NO: 119868 - protein, 9 aa, Artificial Sequence
  Description of Artificial Sequence: Synthetic peptide
  Seed: KLRAEIENL (MOG_HUMAN)
KYRAEIENA

SEQ ID NO: 119869 - protein, 9 aa, Artificial Sequence
  Description of Artificial Sequence: Synthetic peptide
  Seed: FLEELRNPF (MOG_HUMAN)
FWEELRNPY

SEQ ID NO: 119870 - protein, 10 aa, Artificial Sequence
  Description of Artificial Sequence: Synthetic peptide
  Seed: LVLLAVLPVL (MOG_HUMAN)
LPLLAVLPVI

SEQ ID NO: 119871 - protein, 10 aa, Artificial Sequence
  Description of Artificial Sequence: Synthetic peptide
  Seed: LIICYNWLHR (MOG_HUMAN)
LFICYNWLHR

SEQ ID NO: 119872 - protein, 10 aa, Artificial Sequence
  Description of Artificial Sequence: Synthetic peptide
  Seed: TGMEVGWYRP (MOG_HUMAN)
TVMEVGWYRV

SEQ ID NO: 119873 - protein, 9 aa, Artificial Sequence
  Description of Artificial Sequence: Synthetic peptide
  Seed: VGDEVELPC (MOG_HUMAN)
VLDEVELPL

SEQ ID NO: 119874 - protein, 9 aa, Artificial Sequence
  Description of Artificial Sequence: Synthetic peptide
  Seed: RVPCWKITL (MOG_HUMAN)
RYPCWKITL

SEQ ID NO: 119875 - protein, 9 aa, Artificial Sequence
  Description of Artificial Sequence: Synthetic peptide
  Seed: YQEEAAMEL (MOG_HUMAN)
YKEEAAMEL

SEQ ID NO: 119876 - protein, 9 aa, Artificial Sequence
  Description of Artificial Sequence: Synthetic peptide
  Seed: WVSPGVLVL (MOG_HUMAN)
WPSPGVLVA

SEQ ID NO: 119877 - protein, 10 aa, Artificial Sequence
  Description of Artificial Sequence: Synthetic peptide
  Seed: AVLPVLLLQI (MOG_HUMAN)
ATLPVLLLQV

SEQ ID NO: 119878 - protein, 9 aa, Artificial Sequence
  Description of Artificial Sequence: Synthetic peptide
  Seed: RTFDPHFLR (MOG_HUMAN)
RSFDPHFLL

SEQ ID NO: 119879 - protein, 8 aa, Artificial Sequence
  Description of Artificial Sequence: Synthetic peptide
  Seed: FSDEGGFT (MOG_HUMAN)
FGDEGGFM

SEQ ID NO: 119880 - protein, 9 aa, Artificial Sequence
  Description of Artificial Sequence: Synthetic peptide
  Seed: ITLFVIVPV (MOG_HUMAN)
IVLFVIVPV

SEQ ID NO: 119881 - protein, 9 aa, Artificial Sequence
  Description of Artificial Sequence: Synthetic peptide
  Seed: ICYNWLHRR (MOG_HUMAN)
ILYNWLHRL

SEQ ID NO: 119882 - protein, 10 aa, Artificial Sequence
  Description of Artificial Sequence: Synthetic peptide
  Seed: GLIFLCLQYR (MOG_HUMAN)
GTIFLCLQYR

SEQ ID NO: 119883 - protein, 9 aa, Artificial Sequence
  Description of Artificial Sequence: Synthetic peptide
  Seed: LAGQFLEEL (MOG_HUMAN)
LQGQFLEEY

SEQ ID NO: 119884 - protein, 10 aa, Artificial Sequence
  Description of Artificial Sequence: Synthetic peptide
  Seed: LLQITVGLIF (MOG_HUMAN)
LRQITVGLIY

SEQ ID NO: 119885 - protein, 9 aa, Artificial Sequence
  Description of Artificial Sequence: Synthetic peptide
  Seed: RVIGPRHPI (MOG_HUMAN)
RQIGPRHPF

SEQ ID NO: 119886 - protein, 9 aa, Artificial Sequence
  Description of Artificial Sequence: Synthetic peptide
  Seed: SYAGQFRVI (MOG_HUMAN)
SWAGQFRVL

SEQ ID NO: 119887 - protein, 9 aa, Artificial Sequence
  Description of Artificial Sequence: Synthetic peptide
  Seed: RVPCWKITL (MOG_HUMAN)
RFPCWKITI

SEQ ID NO: 119888 - protein, 10 aa, Artificial Sequence
  Description of Artificial Sequence: Synthetic peptide
  Seed: IGPRHPIRAL (MOG_HUMAN)
ILPRHPIRAF

SEQ ID NO: 119889 - protein, 9 aa, Artificial Sequence
  Description of Artificial Sequence: Synthetic peptide
  Seed: KLRAEIENL (MOG_HUMAN)
KTRAEIENK

SEQ ID NO: 119890 - protein, 10 aa, Artificial Sequence
  Description of Artificial Sequence: Synthetic peptide
  Seed: LQITVGLIFL (MOG_HUMAN)
LLITVGLIFI

SEQ ID NO: 119891 - protein, 9 aa, Artificial Sequence
  Description of Artificial Sequence: Synthetic peptide
  Seed: VLGPLVALI (MOG_HUMAN)
VTGPLVALR

SEQ ID NO: 119892 - protein, 9 aa, Artificial Sequence
  Description of Artificial Sequence: Synthetic peptide
  Seed: VSPGVLVLL (MOG_HUMAN)
VSPGVLVLY

SEQ ID NO: 119893 - protein, 10 aa, Artificial Sequence
  Description of Artificial Sequence: Synthetic peptide
  Seed: VPVLGPLVAL (MOG_HUMAN)
VIVLGPLVAV

SEQ ID NO: 119894 - protein, 10 aa, Artificial Sequence
  Description of Artificial Sequence: Synthetic peptide
  Seed: WVSPGVLVLL (MOG_HUMAN)
WISPGVLVLL

SEQ ID NO: 119895 - protein, 10 aa, Artificial Sequence
  Description of Artificial Sequence: Synthetic peptide
  Seed: FDPHFLRVPC (MOG_HUMAN)
FGPHFLRVPT

SEQ ID NO: 119896 - protein, 10 aa, Artificial Sequence
  Description of Artificial Sequence: Synthetic peptide
  Seed: HRTFDPHFLR (MOG_HUMAN)
HMTFDPHFLK

SEQ ID NO: 119897 - protein, 10 aa, Artificial Sequence
  Description of Artificial Sequence: Synthetic peptide
  Seed: AEIENLHRTF (MOG_HUMAN)
ASIENLHRTW

SEQ ID NO: 119898 - protein, 9 aa, Artificial Sequence
  Description of Artificial Sequence: Synthetic peptide
  Seed: TFDPHFLRV (MOG_HUMAN)
TQDPHFLRL

SEQ ID NO: 119899 - protein, 11 aa, Artificial Sequence
  Description of Artificial Sequence: Synthetic peptide
  Seed: HRTFDPHFLRV (MOG_HUMAN)
HMTFDPHFLRD

SEQ ID NO: 119900 - protein, 9 aa, Artificial Sequence
  Description of Artificial Sequence: Synthetic peptide
  Seed: IRALVGDEV (MOG_HUMAN)
IHALVGDEM

SEQ ID NO: 119901 - protein, 9 aa, Artificial Sequence
  Description of Artificial Sequence: Synthetic peptide
  Seed: RAEIENLHR (MOG_HUMAN)
RSEIENLHY

SEQ ID NO: 119902 - protein, 9 aa, Artificial Sequence
  Description of Artificial Sequence: Synthetic peptide
  Seed: RTFDPHFLR (MOG_HUMAN)
RIFDPHFLV

SEQ ID NO: 119903 - protein, 9 aa, Artificial Sequence
  Description of Artificial Sequence: Synthetic peptide
  Seed: LAGQFLEEL (MOG_HUMAN)
LAGQFLEEM

SEQ ID NO: 119904 - protein, 10 aa, Artificial Sequence
  Description of Artificial Sequence: Synthetic peptide
  Seed: RTFDPHFLRV (MOG_HUMAN)
RLFDPHFLRM

SEQ ID NO: 119905 - protein, 9 aa, Artificial Sequence
  Description of Artificial Sequence: Synthetic peptide
  Seed: ICYNWLHRR (MOG_HUMAN)
IMYNWLHRM

SEQ ID NO: 119906 - protein, 11 aa, Artificial Sequence
  Description of Artificial Sequence: Synthetic peptide
  Seed: VLVLLAVLPVL (MOG_HUMAN)
VPVLLAVLPVV

SEQ ID NO: 119907 - protein, 9 aa, Artificial Sequence
  Description of Artificial Sequence: Synthetic peptide
  Seed: PVLGPLVAL (MOG_HUMAN)
PPLGPLVAL

SEQ ID NO: 119908 - protein, 10 aa, Artificial Sequence
  Description of Artificial Sequence: Synthetic peptide
  Seed: LIFLCLQYRL (MOG_HUMAN)
LVFLCLQYRK

SEQ ID NO: 119909 - protein, 9 aa, Artificial Sequence
  Description of Artificial Sequence: Synthetic peptide
  Seed: RVPCWKITL (MOG_HUMAN)
RRPCWKITY

SEQ ID NO: 119910 - protein, 9 aa, Artificial Sequence
  Description of Artificial Sequence: Synthetic peptide
  Seed: LQVSSSYAG (MOG_HUMAN)
LRVSSSYAM

SEQ ID NO: 119911 - protein, 9 aa, Artificial Sequence
  Description of Artificial Sequence: Synthetic peptide
  Seed: GWYRPPFSR (MOG_HUMAN)
GIYRPPFSK

SEQ ID NO: 119912 - protein, 10 aa, Artificial Sequence
  Description of Artificial Sequence: Synthetic peptide
  Seed: ITLFVIVPVL (MOG_HUMAN)
IMLFVIVPVM

SEQ ID NO: 119913 - protein, 10 aa, Artificial Sequence
  Description of Artificial Sequence: Synthetic peptide
  Seed: FVIVPVLGPL (MOG_HUMAN)
FRIVPVLGPL

SEQ ID NO: 119914 - protein, 10 aa, Artificial Sequence
  Description of Artificial Sequence: Synthetic peptide
  Seed: RVVHLYRNGK (MOG_HUMAN)
RHVHLYRNGK

SEQ ID NO: 119915 - protein, 10 aa, Artificial Sequence
  Description of Artificial Sequence: Synthetic peptide
  Seed: RTFDPHFLRV (MOG_HUMAN)
RIFDPHFLRS

SEQ ID NO: 119916 - protein, 9 aa, Artificial Sequence
  Description of Artificial Sequence: Synthetic peptide
  Seed: RIRNVRFSD (MOG_HUMAN)
RLRNVRFSY

SEQ ID NO: 119917 - protein, 10 aa, Artificial Sequence
  Description of Artificial Sequence: Synthetic peptide
  Seed: AEIENLHRTF (MOG_HUMAN)
ADIENLHRTW

SEQ ID NO: 119918 - protein, 9 aa, Artificial Sequence
  Description of Artificial Sequence: Synthetic peptide
  Seed: SLPSCLCSF (MOG_HUMAN)
SCPSCLCSL

SEQ ID NO: 119919 - protein, 9 aa, Artificial Sequence
  Description of Artificial Sequence: Synthetic peptide
  Seed: LCSFLLLLL (MOG_HUMAN)
LLSFLLLLL

SEQ ID NO: 119920 - protein, 9 aa, Artificial Sequence
  Description of Artificial Sequence: Synthetic peptide
  Seed: MASLSRPSL (MOG_HUMAN)
MISLSRPSF

SEQ ID NO: 119921 - protein, 10 aa, Artificial Sequence
  Description of Artificial Sequence: Synthetic peptide
  Seed: VLLLQITVGL (MOG_HUMAN)
VILLQITVGL

SEQ ID NO: 119922 - protein, 9 aa, Artificial Sequence
  Description of Artificial Sequence: Synthetic peptide
  Seed: FLRVPCWKI (MOG_HUMAN)
FIRVPCWKV

SEQ ID NO: 119923 - protein, 9 aa, Artificial Sequence
  Description of Artificial Sequence: Synthetic peptide
  Seed: VLPVLLLQI (MOG_HUMAN)
VRPVLLLQV

SEQ ID NO: 119924 - protein, 9 aa, Artificial Sequence
  Description of Artificial Sequence: Synthetic peptide
  Seed: VGDEVELPC (MOG_HUMAN)
VSDEVELPF

SEQ ID NO: 119925 - protein, 11 aa, Artificial Sequence
  Description of Artificial Sequence: Synthetic peptide
  Seed: SSSYAGQFRVI (MOG_HUMAN)
SMSYAGQFRVF

SEQ ID NO: 119926 - protein, 9 aa, Artificial Sequence
  Description of Artificial Sequence: Synthetic peptide
  Seed: VGDEVELPC (MOG_HUMAN)
VIDEVELPL

SEQ ID NO: 119927 - protein, 10 aa, Artificial Sequence
  Description of Artificial Sequence: Synthetic peptide
  Seed: FDPHFLRVPC (MOG_HUMAN)
FFPHFLRVPS

SEQ ID NO: 119928 - protein, 9 aa, Artificial Sequence
  Description of Artificial Sequence: Synthetic peptide
  Seed: TFDPHFLRV (MOG_HUMAN)
TIDPHFLRL

SEQ ID NO: 119929 - protein, 9 aa, Artificial Sequence
  Description of Artificial Sequence: Synthetic peptide
  Seed: RVIGPRHPI (MOG_HUMAN)
RWIGPRHPL

SEQ ID NO: 119930 - protein, 9 aa, Artificial Sequence
  Description of Artificial Sequence: Synthetic peptide
  Seed: LVLLAVLPV (MOG_HUMAN)
LLLLAVLPT

SEQ ID NO: 119931 - protein, 9 aa, Artificial Sequence
  Description of Artificial Sequence: Synthetic peptide
  Seed: LHRTFDPHF (MOG_HUMAN)
LMRTFDPHM

SEQ ID NO: 119932 - protein, 10 aa, Artificial Sequence
  Description of Artificial Sequence: Synthetic peptide
  Seed: LVLLAVLPVL (MOG_HUMAN)
LWLLAVLPVI

SEQ ID NO: 119933 - protein, 10 aa, Artificial Sequence
  Description of Artificial Sequence: Synthetic peptide
  Seed: FSDEGGFTCF (MOG_HUMAN)
FFDEGGFTCM

SEQ ID NO: 119934 - protein, 10 aa, Artificial Sequence
  Description of Artificial Sequence: Synthetic peptide
  Seed: HFLRVPCWKI (MOG_HUMAN)
HYLRVPCWKM

SEQ ID NO: 119935 - protein, 11 aa, Artificial Sequence
  Description of Artificial Sequence: Synthetic peptide
  Seed: RIRNVRFSDEG (MOG_HUMAN)
RARNVRFSDEK

SEQ ID NO: 119936 - protein, 9 aa, Artificial Sequence
  Description of Artificial Sequence: Synthetic peptide
  Seed: RIRNVRFSD (MOG_HUMAN)
RWRNVRFSV

SEQ ID NO: 119937 - protein, 10 aa, Artificial Sequence
  Description of Artificial Sequence: Synthetic peptide
  Seed: HRTFDPHFLR (MOG_HUMAN)
HTTFDPHFLR

SEQ ID NO: 119938 - protein, 10 aa, Artificial Sequence
  Description of Artificial Sequence: Synthetic peptide
  Seed: LLLQVSSSYA (MOG_HUMAN)
LALQVSSSYY

SEQ ID NO: 119939 - protein, 9 aa, Artificial Sequence
  Description of Artificial Sequence: Synthetic peptide
  Seed: TCFFRDHSY (MOG_HUMAN)
TPFFRDHSY

SEQ ID NO: 119940 - protein, 9 aa, Artificial Sequence
  Description of Artificial Sequence: Synthetic peptide
  Seed: TGMEVGWYR (MOG_HUMAN)
TMMEVGWYY

SEQ ID NO: 119941 - protein, 10 aa, Artificial Sequence
  Description of Artificial Sequence: Synthetic peptide
  Seed: FRVIGPRHPI (MOG_HUMAN)
FMVIGPRHPA

SEQ ID NO: 119942 - protein, 10 aa, Artificial Sequence
  Description of Artificial Sequence: Synthetic peptide
  Seed: LLQITVGLIF (MOG_HUMAN)
LWQITVGLIY

SEQ ID NO: 119943 - protein, 9 aa, Artificial Sequence
  Description of Artificial Sequence: Synthetic peptide
  Seed: LQITVGLIF (MOG_HUMAN)
LAITVGLIW

SEQ ID NO: 119944 - protein, 10 aa, Artificial Sequence
  Description of Artificial Sequence: Synthetic peptide
  Seed: SLSRPSLPSC (MOG_HUMAN)
SCSRPSLPSA

SEQ ID NO: 119945 - protein, 11 aa, Artificial Sequence
  Description of Artificial Sequence: Synthetic peptide
  Seed: SSSYAGQFRVI (MOG_HUMAN)
SVSYAGQFRVF

SEQ ID NO: 119946 - protein, 10 aa, Artificial Sequence
  Description of Artificial Sequence: Synthetic peptide
  Seed: VLLAVLPVLL (MOG_HUMAN)
VLLAVLPVLI

SEQ ID NO: 119947 - protein, 9 aa, Artificial Sequence
  Description of Artificial Sequence: Synthetic peptide
  Seed: TFDPHFLRV (MOG_HUMAN)
TYDPHFLRA

SEQ ID NO: 119948 - protein, 10 aa, Artificial Sequence
  Description of Artificial Sequence: Synthetic peptide
  Seed: YWVSPGVLVL (MOG_HUMAN)
YYVSPGVLVY

SEQ ID NO: 119949 - protein, 11 aa, Artificial Sequence
  Description of Artificial Sequence: Synthetic peptide
  Seed: RDHSYQEEAAM (MOG_HUMAN)
RDHSYQEEAAF

SEQ ID NO: 119950 - protein, 9 aa, Artificial Sequence
  Description of Artificial Sequence: Synthetic peptide
  Seed: RVIGPRHPI (MOG_HUMAN)
RMIGPRHPI

SEQ ID NO: 119951 - protein, 9 aa, Artificial Sequence
  Description of Artificial Sequence: Synthetic peptide
  Seed: LQITVGLIF (MOG_HUMAN)
LNITVGLIY

SEQ ID NO: 119952 - protein, 9 aa, Artificial Sequence
  Description of Artificial Sequence: Synthetic peptide
  Seed: WVSPGVLVL (MOG_HUMAN)
WHSPGVLVF

SEQ ID NO: 119953 - protein, 9 aa, Artificial Sequence
  Description of Artificial Sequence: Synthetic peptide
  Seed: ITVGLIFLC (MOG_HUMAN)
IVVGLIFLA

SEQ ID NO: 119954 - protein, 8 aa, Artificial Sequence
  Description of Artificial Sequence: Synthetic peptide
  Seed: FYWVSPGV (MOG_HUMAN)
FYWVSPGF

SEQ ID NO: 119955 - protein, 10 aa, Artificial Sequence
  Description of Artificial Sequence: Synthetic peptide
  Seed: RVPCWKITLF (MOG_HUMAN)
RLPCWKITLW

SEQ ID NO: 119956 - protein, 9 aa, Artificial Sequence
  Description of Artificial Sequence: Synthetic peptide
  Seed: FSDEGGFTC (MOG_HUMAN)
FDDEGGFTF

SEQ ID NO: 119957 - protein, 9 aa, Artificial Sequence
  Description of Artificial Sequence: Synthetic peptide
  Seed: LKVEDPFYW (MOG_HUMAN)
LLVEDPFYF

SEQ ID NO: 119958 - protein, 9 aa, Artificial Sequence
  Description of Artificial Sequence: Synthetic peptide
  Seed: LLAVLPVLL (MOG_HUMAN)
LSAVLPVLL

SEQ ID NO: 119959 - protein, 10 aa, Artificial Sequence
  Description of Artificial Sequence: Synthetic peptide
  Seed: FVIVPVLGPL (MOG_HUMAN)
FYIVPVLGPI

SEQ ID NO: 119960 - protein, 10 aa, Artificial Sequence
  Description of Artificial Sequence: Synthetic peptide
  Seed: SCLCSFLLLL (MOG_HUMAN)
SQLCSFLLLI

SEQ ID NO: 119961 - protein, 9 aa, Artificial Sequence
  Description of Artificial Sequence: Synthetic peptide
  Seed: TFDPHFLRV (MOG_HUMAN)
TTDPHFLRV

SEQ ID NO: 119962 - protein, 10 aa, Artificial Sequence
  Description of Artificial Sequence: Synthetic peptide
  Seed: RIRNVRFSDE (MOG_HUMAN)
RIRNVRFSDK

SEQ ID NO: 119963 - protein, 10 aa, Artificial Sequence
  Description of Artificial Sequence: Synthetic peptide
  Seed: VPVLGPLVAL (MOG_HUMAN)
VPVLGPLVAW

SEQ ID NO: 119964 - protein, 9 aa, Artificial Sequence
  Description of Artificial Sequence: Synthetic peptide
  Seed: RTFDPHFLR (MOG_HUMAN)
RPFDPHFLR

SEQ ID NO: 119965 - protein, 10 aa, Artificial Sequence
  Description of Artificial Sequence: Synthetic peptide
  Seed: LVLLAVLPVL (MOG_HUMAN)
LLLLAVLPVI

SEQ ID NO: 119966 - protein, 10 aa, Artificial Sequence
  Description of Artificial Sequence: Synthetic peptide
  Seed: MELKVEDPFY (MOG_HUMAN)
MMLKVEDPFF

SEQ ID NO: 119967 - protein, 8 aa, Artificial Sequence
  Description of Artificial Sequence: Synthetic peptide
  Seed: YAGQFRVI (MOG_HUMAN)
YQGQFRVI

SEQ ID NO: 119968 - protein, 10 aa, Artificial Sequence
  Description of Artificial Sequence: Synthetic peptide
  Seed: SCLCSFLLLL (MOG_HUMAN)
SNLCSFLLLL

SEQ ID NO: 119969 - protein, 9 aa, Artificial Sequence
  Description of Artificial Sequence: Synthetic peptide
  Seed: CLCSFLLLL (MOG_HUMAN)
CTCSFLLLV

SEQ ID NO: 119970 - protein, 9 aa, Artificial Sequence
  Description of Artificial Sequence: Synthetic peptide
  Seed: RTFDPHFLR (MOG_HUMAN)
RLFDPHFLV

SEQ ID NO: 119971 - protein, 10 aa, Artificial Sequence
  Description of Artificial Sequence: Synthetic peptide
  Seed: RTFDPHFLRV (MOG_HUMAN)
RWFDPHFLRE

SEQ ID NO: 119972 - protein, 8 aa, Artificial Sequence
  Description of Artificial Sequence: Synthetic peptide
  Seed: TFDPHFLR (MOG_HUMAN)
TADPHFLY

SEQ ID NO: 119973 - protein, 9 aa, Artificial Sequence
  Description of Artificial Sequence: Synthetic peptide
  Seed: MASLSRPSL (MOG_HUMAN)
MMSLSRPSW

SEQ ID NO: 119974 - protein, 10 aa, Artificial Sequence
  Description of Artificial Sequence: Synthetic peptide
  Seed: SLPSCLCSFL (MOG_HUMAN)
SLPSCLCSFI

SEQ ID NO: 119975 - protein, 10 aa, Artificial Sequence
  Description of Artificial Sequence: Synthetic peptide
  Seed: PFSRVVHLYR (MOG_HUMAN)
PMSRVVHLYR

SEQ ID NO: 119976 - protein, 9 aa, Artificial Sequence
  Description of Artificial Sequence: Synthetic peptide
  Seed: TLRIRNVRF (MOG_HUMAN)
TLRIRNVRM

SEQ ID NO: 119977 - protein, 9 aa, Artificial Sequence
  Description of Artificial Sequence: Synthetic peptide
  Seed: ALIICYNWL (MOG_HUMAN)
AIIICYNWV

SEQ ID NO: 119978 - protein, 9 aa, Artificial Sequence
  Description of Artificial Sequence: Synthetic peptide
  Seed: LQVSSSYAG (MOG_HUMAN)
LNVSSSYAM

SEQ ID NO: 119979 - protein, 11 aa, Artificial Sequence
  Description of Artificial Sequence: Synthetic peptide
  Seed: KLRAEIENLHR (MOG_HUMAN)
KIRAEIENLHK

SEQ ID NO: 119980 - protein, 9 aa, Artificial Sequence
  Description of Artificial Sequence: Synthetic peptide
  Seed: WYRPPFSRV (MOG_HUMAN)
WFRPPFSRL

SEQ ID NO: 119981 - protein, 9 aa, Artificial Sequence
  Description of Artificial Sequence: Synthetic peptide
  Seed: RTFDPHFLR (MOG_HUMAN)
RYFDPHFLR

SEQ ID NO: 119982 - protein, 9 aa, Artificial Sequence
  Description of Artificial Sequence: Synthetic peptide
  Seed: VPCWKITLF (MOG_HUMAN)
VMCWKITLY

SEQ ID NO: 119983 - protein, 9 aa, Artificial Sequence
  Description of Artificial Sequence: Synthetic peptide
  Seed: TLFVIVPVL (MOG_HUMAN)
TMFVIVPVA

SEQ ID NO: 119984 - protein, 9 aa, Artificial Sequence
  Description of Artificial Sequence: Synthetic peptide
  Seed: VIVPVLGPL (MOG_HUMAN)
VAVPVLGPI

SEQ ID NO: 119985 - protein, 10 aa, Artificial Sequence
  Description of Artificial Sequence: Synthetic peptide
  Seed: SCLCSFLLLL (MOG_HUMAN)
SDLCSFLLLL

SEQ ID NO: 119986 - protein, 10 aa, Artificial Sequence
  Description of Artificial Sequence: Synthetic peptide
  Seed: FVIVPVLGPL (MOG_HUMAN)
FMIVPVLGPI

SEQ ID NO: 119987 - protein, 9 aa, Artificial Sequence
  Description of Artificial Sequence: Synthetic peptide
  Seed: TCFFRDHSY (MOG_HUMAN)
TEFFRDHSY

SEQ ID NO: 119988 - protein, 10 aa, Artificial Sequence
  Description of Artificial Sequence: Synthetic peptide
  Seed: LQITVGLIFL (MOG_HUMAN)
LQITVGLIFV

SEQ ID NO: 119989 - protein, 9 aa, Artificial Sequence
  Description of Artificial Sequence: Synthetic peptide
  Seed: RIRNVRFSD (MOG_HUMAN)
RWRNVRFSI

SEQ ID NO: 119990 - protein, 10 aa, Artificial Sequence
  Description of Artificial Sequence: Synthetic peptide
  Seed: AEIENLHRTF (MOG_HUMAN)
ARIENLHRTM

SEQ ID NO: 119991 - protein, 11 aa, Artificial Sequence
  Description of Artificial Sequence: Synthetic peptide
  Seed: DAIGEGKVTLR (MOG_HUMAN)
DIIGEGKVTLK

SEQ ID NO: 119992 - protein, 9 aa, Artificial Sequence
  Description of Artificial Sequence: Synthetic peptide
  Seed: KVTLRIRNV (MOG_HUMAN)
KTTLRIRNK

SEQ ID NO: 119993 - protein, 9 aa, Artificial Sequence
  Description of Artificial Sequence: Synthetic peptide
  Seed: RVIGPRHPI (MOG_HUMAN)
RIIGPRHPW

SEQ ID NO: 119994 - protein, 10 aa, Artificial Sequence
  Description of Artificial Sequence: Synthetic peptide
  Seed: LVLLAVLPVL (MOG_HUMAN)
LELLAVLPVV

SEQ ID NO: 119995 - protein, 9 aa, Artificial Sequence
  Description of Artificial Sequence: Synthetic peptide
  Seed: LQITVGLIF (MOG_HUMAN)
LVITVGLIW

SEQ ID NO: 119996 - protein, 9 aa, Artificial Sequence
  Description of Artificial Sequence: Synthetic peptide
  Seed: VLLAVLPVL (MOG_HUMAN)
VMLAVLPVV

SEQ ID NO: 119997 - protein, 9 aa, Artificial Sequence
  Description of Artificial Sequence: Synthetic peptide
  Seed: MELKVEDPF (MOG_HUMAN)
MMLKVEDPF

SEQ ID NO: 119998 - protein, 9 aa, Artificial Sequence
  Description of Artificial Sequence: Synthetic peptide
  Seed: VLLAVLPVL (MOG_HUMAN)
VQLAVLPVY

SEQ ID NO: 119999 - protein, 10 aa, Artificial Sequence
  Description of Artificial Sequence: Synthetic peptide
  Seed: DAIGEGKVTL (MOG_HUMAN)
DIIGEGKVTW

SEQ ID NO: 120000 - protein, 10 aa, Artificial Sequence
  Description of Artificial Sequence: Synthetic peptide
  Seed: FSDEGGFTCF (MOG_HUMAN)
FPDEGGFTCM

SEQ ID NO: 120001 - protein, 9 aa, Artificial Sequence
  Description of Artificial Sequence: Synthetic peptide
  Seed: LSRPSLPSC (MOG_HUMAN)
LWRPSLPSK

SEQ ID NO: 120002 - protein, 10 aa, Artificial Sequence
  Description of Artificial Sequence: Synthetic peptide
  Seed: LVLLAVLPVL (MOG_HUMAN)
LTLLAVLPVI

SEQ ID NO: 120003 - protein, 9 aa, Artificial Sequence
  Description of Artificial Sequence: Synthetic peptide
  Seed: FYWVSPGVL (MOG_HUMAN)
FMWVSPGVY

SEQ ID NO: 120004 - protein, 9 aa, Artificial Sequence
  Description of Artificial Sequence: Synthetic peptide
  Seed: RTFDPHFLR (MOG_HUMAN)
RFFDPHFLH

SEQ ID NO: 120005 - protein, 9 aa, Artificial Sequence
  Description of Artificial Sequence: Synthetic peptide
  Seed: VSPGVLVLL (MOG_HUMAN)
VVPGVLVLA

SEQ ID NO: 120006 - protein, 11 aa, Artificial Sequence
  Description of Artificial Sequence: Synthetic peptide
  Seed: KLRAEIENLHR (MOG_HUMAN)
KVRAEIENLHK

SEQ ID NO: 120007 - protein, 9 aa, Artificial Sequence
  Description of Artificial Sequence: Synthetic peptide
  Seed: LSRPSLPSC (MOG_HUMAN)
LVRPSLPSW

SEQ ID NO: 120008 - protein, 9 aa, Artificial Sequence
  Description of Artificial Sequence: Synthetic peptide
  Seed: RTFDPHFLR (MOG_HUMAN)
RNFDPHFLF

SEQ ID NO: 120009 - protein, 10 aa, Artificial Sequence
  Description of Artificial Sequence: Synthetic peptide
  Seed: RVPCWKITLF (MOG_HUMAN)
RWPCWKITLF

SEQ ID NO: 120010 - protein, 10 aa, Artificial Sequence
  Description of Artificial Sequence: Synthetic peptide
  Seed: LVLLAVLPVL (MOG_HUMAN)
LFLLAVLPVV

SEQ ID NO: 120011 - protein, 10 aa, Artificial Sequence
  Description of Artificial Sequence: Synthetic peptide
  Seed: RTFDPHFLRV (MOG_HUMAN)
RWFDPHFLRT

SEQ ID NO: 120012 - protein, 9 aa, Artificial Sequence
  Description of Artificial Sequence: Synthetic peptide
  Seed: VLGPLVALI (MOG_HUMAN)
VSGPLVALL

SEQ ID NO: 120013 - protein, 9 aa, Artificial Sequence
  Description of Artificial Sequence: Synthetic peptide
  Seed: RTFDPHFLR (MOG_HUMAN)
RSFDPHFLV

SEQ ID NO: 120014 - protein, 9 aa, Artificial Sequence
  Description of Artificial Sequence: Synthetic peptide
  Seed: VVHLYRNGK (MOG_HUMAN)
VLHLYRNGR

SEQ ID NO: 120015 - protein, 10 aa, Artificial Sequence
  Description of Artificial Sequence: Synthetic peptide
  Seed: SSYAGQFRVI (MOG_HUMAN)
SWYAGQFRVW

SEQ ID NO: 120016 - protein, 11 aa, Artificial Sequence
  Description of Artificial Sequence: Synthetic peptide
  Seed: VLLAVLPVLLL (MOG_HUMAN)
VMLAVLPVLLV

SEQ ID NO: 120017 - protein, 9 aa, Artificial Sequence
  Description of Artificial Sequence: Synthetic peptide
  Seed: FSRVVHLYR (MOG_HUMAN)
FGRVVHLYK

SEQ ID NO: 120018 - protein, 10 aa, Artificial Sequence
  Description of Artificial Sequence: Synthetic peptide
  Seed: VSSSYAGQFR (MOG_HUMAN)
VMSSYAGQFK

SEQ ID NO: 120019 - protein, 10 aa, Artificial Sequence
  Description of Artificial Sequence: Synthetic peptide
  Seed: LIFLCLQYRL (MOG_HUMAN)
LMFLCLQYRL

SEQ ID NO: 120020 - protein, 10 aa, Artificial Sequence
  Description of Artificial Sequence: Synthetic peptide
  Seed: VLLAVLPVLL (MOG_HUMAN)
VMLAVLPVLV

SEQ ID NO: 120021 - protein, 9 aa, Artificial Sequence
  Description of Artificial Sequence: Synthetic peptide
  Seed: LQVSSSYAG (MOG_HUMAN)
LLVSSSYAL

SEQ ID NO: 120022 - protein, 9 aa, Artificial Sequence
  Description of Artificial Sequence: Synthetic peptide
  Seed: WVSPGVLVL (MOG_HUMAN)
WLSPGVLVF

SEQ ID NO: 120023 - protein, 9 aa, Artificial Sequence
  Description of Artificial Sequence: Synthetic peptide
  Seed: CLCSFLLLL (MOG_HUMAN)
CACSFLLLV

SEQ ID NO: 120024 - protein, 10 aa, Artificial Sequence
  Description of Artificial Sequence: Synthetic peptide
  Seed: FSDEGGFTCF (MOG_HUMAN)
FQDEGGFTCM

SEQ ID NO: 120025 - protein, 9 aa, Artificial Sequence
  Description of Artificial Sequence: Synthetic peptide
  Seed: SYAGQFRVI (MOG_HUMAN)
SSAGQFRVL

SEQ ID NO: 120026 - protein, 10 aa, Artificial Sequence
  Description of Artificial Sequence: Synthetic peptide
  Seed: RVVHLYRNGK (MOG_HUMAN)
RKVHLYRNGR

SEQ ID NO: 120027 - protein, 10 aa, Artificial Sequence
  Description of Artificial Sequence: Synthetic peptide
  Seed: LLLLQVSSSY (MOG_HUMAN)
LGLLQVSSSY

SEQ ID NO: 120028 - protein, 9 aa, Artificial Sequence
  Description of Artificial Sequence: Synthetic peptide
  Seed: RIRNVRFSD (MOG_HUMAN)
RVRNVRFSK

SEQ ID NO: 120029 - protein, 10 aa, Artificial Sequence
  Description of Artificial Sequence: Synthetic peptide
  Seed: AEIENLHRTF (MOG_HUMAN)
AIIENLHRTY

SEQ ID NO: 120030 - protein, 9 aa, Artificial Sequence
  Description of Artificial Sequence: Synthetic peptide
  Seed: WVSPGVLVL (MOG_HUMAN)
WHSPGVLVL

SEQ ID NO: 120031 - protein, 9 aa, Artificial Sequence
  Description of Artificial Sequence: Synthetic peptide
  Seed: LSRPSLPSC (MOG_HUMAN)
LGRPSLPSK

SEQ ID NO: 120032 - protein, 10 aa, Artificial Sequence
  Description of Artificial Sequence: Synthetic peptide
  Seed: LLQITVGLIF (MOG_HUMAN)
LNQITVGLIY

SEQ ID NO: 120033 - protein, 9 aa, Artificial Sequence
  Description of Artificial Sequence: Synthetic peptide
  Seed: HSYQEEAAM (MOG_HUMAN)
HHYQEEAAM

SEQ ID NO: 120034 - protein, 9 aa, Artificial Sequence
  Description of Artificial Sequence: Synthetic peptide
  Seed: TFDPHFLRV (MOG_HUMAN)
THDPHFLRM

SEQ ID NO: 120035 - protein, 9 aa, Artificial Sequence
  Description of Artificial Sequence: Synthetic peptide
  Seed: ITVGLIFLC (MOG_HUMAN)
ISVGLIFLW

SEQ ID NO: 120036 - protein, 10 aa, Artificial Sequence
  Description of Artificial Sequence: Synthetic peptide
  Seed: SLSRPSLPSC (MOG_HUMAN)
SRSRPSLPSI

SEQ ID NO: 120037 - protein, 9 aa, Artificial Sequence
  Description of Artificial Sequence: Synthetic peptide
  Seed: LCSFLLLLL (MOG_HUMAN)
LMSFLLLLV

SEQ ID NO: 120038 - protein, 9 aa, Artificial Sequence
  Description of Artificial Sequence: Synthetic peptide
  Seed: IGEGKVTLR (MOG_HUMAN)
IYEGKVTLR

SEQ ID NO: 120039 - protein, 9 aa, Artificial Sequence
  Description of Artificial Sequence: Synthetic peptide
  Seed: FSDEGGFTC (MOG_HUMAN)
FSDEGGFTM

SEQ ID NO: 120040 - protein, 9 aa, Artificial Sequence
  Description of Artificial Sequence: Synthetic peptide
  Seed: LAGQFLEEL (MOG_HUMAN)
LQGQFLEEA

SEQ ID NO: 120041 - protein, 10 aa, Artificial Sequence
  Description of Artificial Sequence: Synthetic peptide
  Seed: VGLIFLCLQY (MOG_HUMAN)
VFLIFLCLQY

SEQ ID NO: 120042 - protein, 9 aa, Artificial Sequence
  Description of Artificial Sequence: Synthetic peptide
  Seed: AIGEGKVTL (MOG_HUMAN)
AAGEGKVTH

SEQ ID NO: 120043 - protein, 10 aa, Artificial Sequence
  Description of Artificial Sequence: Synthetic peptide
  Seed: KNATGMEVGW (MOG_HUMAN)
KWATGMEVGW

SEQ ID NO: 120044 - protein, 10 aa, Artificial Sequence
  Description of Artificial Sequence: Synthetic peptide
  Seed: RLAGQFLEEL (MOG_HUMAN)
RIAGQFLEEV

SEQ ID NO: 120045 - protein, 9 aa, Artificial Sequence
  Description of Artificial Sequence: Synthetic peptide
  Seed: WVSPGVLVL (MOG_HUMAN)
WQSPGVLVW

SEQ ID NO: 120046 - protein, 9 aa, Artificial Sequence
  Description of Artificial Sequence: Synthetic peptide
  Seed: SRPSLPSCL (MOG_HUMAN)
SVPSLPSCL

SEQ ID NO: 120047 - protein, 9 aa, Artificial Sequence
  Description of Artificial Sequence: Synthetic peptide
  Seed: RIRNVRFSD (MOG_HUMAN)
RMRNVRFSC

SEQ ID NO: 120048 - protein, 10 aa, Artificial Sequence
  Description of Artificial Sequence: Synthetic peptide
  Seed: IICYNWLHRR (MOG_HUMAN)
IACYNWLHRR

SEQ ID NO: 120049 - protein, 9 aa, Artificial Sequence
  Description of Artificial Sequence: Synthetic peptide
  Seed: SRPSLPSCL (MOG_HUMAN)
SRPSLPSCY

SEQ ID NO: 120050 - protein, 9 aa, Artificial Sequence
  Description of Artificial Sequence: Synthetic peptide
  Seed: FYWVSPGVL (MOG_HUMAN)
FFWVSPGVW

SEQ ID NO: 120051 - protein, 9 aa, Artificial Sequence
  Description of Artificial Sequence: Synthetic peptide
  Seed: VIVPVLGPL (MOG_HUMAN)
VIVPVLGPA

SEQ ID NO: 120052 - protein, 9 aa, Artificial Sequence
  Description of Artificial Sequence: Synthetic peptide
  Seed: WVSPGVLVL (MOG_HUMAN)
WESPGVLVM

SEQ ID NO: 120053 - protein, 10 aa, Artificial Sequence
  Description of Artificial Sequence: Synthetic peptide
  Seed: SCLCSFLLLL (MOG_HUMAN)
SALCSFLLLI

SEQ ID NO: 120054 - protein, 9 aa, Artificial Sequence
  Description of Artificial Sequence: Synthetic peptide
  Seed: VELPCRISP (MOG_HUMAN)
VELPCRISM

SEQ ID NO: 120055 - protein, 10 aa, Artificial Sequence
  Description of Artificial Sequence: Synthetic peptide
  Seed: RTFDPHFLRV (MOG_HUMAN)
RWFDPHFLRG

SEQ ID NO: 120056 - protein, 10 aa, Artificial Sequence
  Description of Artificial Sequence: Synthetic peptide
  Seed: CLCSFLLLLL (MOG_HUMAN)
CVCSFLLLLL

SEQ ID NO: 120057 - protein, 10 aa, Artificial Sequence
  Description of Artificial Sequence: Synthetic peptide
  Seed: HFLRVPCWKI (MOG_HUMAN)
HYLRVPCWKF

SEQ ID NO: 120058 - protein, 10 aa, Artificial Sequence
  Description of Artificial Sequence: Synthetic peptide
  Seed: RTFDPHFLRV (MOG_HUMAN)
RYFDPHFLRP

SEQ ID NO: 120059 - protein, 10 aa, Artificial Sequence
  Description of Artificial Sequence: Synthetic peptide
  Seed: RTFDPHFLRV (MOG_HUMAN)
RKFDPHFLRM

SEQ ID NO: 120060 - protein, 9 aa, Artificial Sequence
  Description of Artificial Sequence: Synthetic peptide
  Seed: LSRPSLPSC (MOG_HUMAN)
LARPSLPSW

SEQ ID NO: 120061 - protein, 10 aa, Artificial Sequence
  Description of Artificial Sequence: Synthetic peptide
  Seed: LLLQVSSSYA (MOG_HUMAN)
LMLQVSSSYP

SEQ ID NO: 120062 - protein, 10 aa, Artificial Sequence
  Description of Artificial Sequence: Synthetic peptide
  Seed: RTFDPHFLRV (MOG_HUMAN)
RVFDPHFLRY

SEQ ID NO: 120063 - protein, 9 aa, Artificial Sequence
  Description of Artificial Sequence: Synthetic peptide
  Seed: HSYQEEAAM (MOG_HUMAN)
HMYQEEAAF

SEQ ID NO: 120064 - protein, 8 aa, Artificial Sequence
  Description of Artificial Sequence: Synthetic peptide
  Seed: RIRNVRFS (MOG_HUMAN)
RMRNVRFK

SEQ ID NO: 120065 - protein, 9 aa, Artificial Sequence
  Description of Artificial Sequence: Synthetic peptide
  Seed: LIFLCLQYR (MOG_HUMAN)
LSFLCLQYR

SEQ ID NO: 120066 - protein, 9 aa, Artificial Sequence
  Description of Artificial Sequence: Synthetic peptide
  Seed: AEIENLHRT (MOG_HUMAN)
ADIENLHRM

SEQ ID NO: 120067 - protein, 8 aa, Artificial Sequence
  Description of Artificial Sequence: Synthetic peptide
  Seed: IENLHRTF (MOG_HUMAN)
IANLHRTF

SEQ ID NO: 120068 - protein, 9 aa, Artificial Sequence
  Description of Artificial Sequence: Synthetic peptide
  Seed: IGEGKVTLR (MOG_HUMAN)
ILEGKVTLY

SEQ ID NO: 120069 - protein, 10 aa, Artificial Sequence
  Description of Artificial Sequence: Synthetic peptide
  Seed: ITLFVIVPVL (MOG_HUMAN)
IILFVIVPVV

SEQ ID NO: 120070 - protein, 10 aa, Artificial Sequence
  Description of Artificial Sequence: Synthetic peptide
  Seed: HRTFDPHFLR (MOG_HUMAN)
HETFDPHFLY

SEQ ID NO: 120071 - protein, 9 aa, Artificial Sequence
  Description of Artificial Sequence: Synthetic peptide
  Seed: KVTLRIRNV (MOG_HUMAN)
KVTLRIRNK

SEQ ID NO: 120072 - protein, 9 aa, Artificial Sequence
  Description of Artificial Sequence: Synthetic peptide
  Seed: FSRVVHLYR (MOG_HUMAN)
FMRVVHLYR

SEQ ID NO: 120073 - protein, 11 aa, Artificial Sequence
  Description of Artificial Sequence: Synthetic peptide
  Seed: RTFDPHFLRVP (MOG_HUMAN)
RMFDPHFLRVM

SEQ ID NO: 120074 - protein, 10 aa, Artificial Sequence
  Description of Artificial Sequence: Synthetic peptide
  Seed: ITLFVIVPVL (MOG_HUMAN)
IQLFVIVPVV

SEQ ID NO: 120075 - protein, 10 aa, Artificial Sequence
  Description of Artificial Sequence: Synthetic peptide
  Seed: FSDEGGFTCF (MOG_HUMAN)
FMDEGGFTCM

SEQ ID NO: 120076 - protein, 9 aa, Artificial Sequence
  Description of Artificial Sequence: Synthetic peptide
  Seed: SCLCSFLLL (MOG_HUMAN)
STLCSFLLF

SEQ ID NO: 120077 - protein, 9 aa, Artificial Sequence
  Description of Artificial Sequence: Synthetic peptide
  Seed: LQITVGLIF (MOG_HUMAN)
LLITVGLIF

SEQ ID NO: 120078 - protein, 9 aa, Artificial Sequence
  Description of Artificial Sequence: Synthetic peptide
  Seed: KVEDPFYWV (MOG_HUMAN)
KLEDPFYWV

SEQ ID NO: 120079 - protein, 10 aa, Artificial Sequence
  Description of Artificial Sequence: Synthetic peptide
  Seed: RVVHLYRNGK (MOG_HUMAN)
RMVHLYRNGK

SEQ ID NO: 120080 - protein, 9 aa, Artificial Sequence
  Description of Artificial Sequence: Synthetic peptide
  Seed: VGDEVELPC (MOG_HUMAN)
VMDEVELPI

SEQ ID NO: 120081 - protein, 9 aa, Artificial Sequence
  Description of Artificial Sequence: Synthetic peptide
  Seed: LPSCLCSFL (MOG_HUMAN)
LPSCLCSFY

SEQ ID NO: 120082 - protein, 9 aa, Artificial Sequence
  Description of Artificial Sequence: Synthetic peptide
  Seed: RIRNVRFSD (MOG_HUMAN)
RTRNVRFSI

SEQ ID NO: 120083 - protein, 9 aa, Artificial Sequence
  Description of Artificial Sequence: Synthetic peptide
  Seed: FYWVSPGVL (MOG_HUMAN)
FWWVSPGVF

SEQ ID NO: 120084 - protein, 9 aa, Artificial Sequence
  Description of Artificial Sequence: Synthetic peptide
  Seed: ICYNWLHRR (MOG_HUMAN)
IHYNWLHRR

SEQ ID NO: 120085 - protein, 10 aa, Artificial Sequence
  Description of Artificial Sequence: Synthetic peptide
  Seed: AIGEGKVTLR (MOG_HUMAN)
ATGEGKVTLY

SEQ ID NO: 120086 - protein, 9 aa, Artificial Sequence
  Description of Artificial Sequence: Synthetic peptide
  Seed: VLPVLLLQI (MOG_HUMAN)
VAPVLLLQI

SEQ ID NO: 120087 - protein, 11 aa, Artificial Sequence
  Description of Artificial Sequence: Synthetic peptide
  Seed: HSYQEEAAMEL (MOG_HUMAN)
HLYQEEAAMEF

SEQ ID NO: 120088 - protein, 10 aa, Artificial Sequence
  Description of Artificial Sequence: Synthetic peptide
  Seed: SLSRPSLPSC (MOG_HUMAN)
SLSRPSLPSK

SEQ ID NO: 120089 - protein, 10 aa, Artificial Sequence
  Description of Artificial Sequence: Synthetic peptide
  Seed: RDHSYQEEAA (MOG_HUMAN)
REHSYQEEAC

SEQ ID NO: 120090 - protein, 9 aa, Artificial Sequence
  Description of Artificial Sequence: Synthetic peptide
  Seed: MASLSRPSL (MOG_HUMAN)
MSSLSRPSV

SEQ ID NO: 120091 - protein, 9 aa, Artificial Sequence
  Description of Artificial Sequence: Synthetic peptide
  Seed: SSYAGQFRV (MOG_HUMAN)
SNYAGQFRY

SEQ ID NO: 120092 - protein, 9 aa, Artificial Sequence
  Description of Artificial Sequence: Synthetic peptide
  Seed: RVIGPRHPI (MOG_HUMAN)
RPIGPRHPF

SEQ ID NO: 120093 - protein, 10 aa, Artificial Sequence
  Description of Artificial Sequence: Synthetic peptide
  Seed: PPFSRVVHLY (MOG_HUMAN)
PWFSRVVHLY

SEQ ID NO: 120094 - protein, 10 aa, Artificial Sequence
  Description of Artificial Sequence: Synthetic peptide
  Seed: IGPRHPIRAL (MOG_HUMAN)
IGPRHPIRAV

SEQ ID NO: 120095 - protein, 9 aa, Artificial Sequence
  Description of Artificial Sequence: Synthetic peptide
  Seed: VGDEVELPC (MOG_HUMAN)
VLDEVELPI

SEQ ID NO: 120096 - protein, 9 aa, Artificial Sequence
  Description of Artificial Sequence: Synthetic peptide
  Seed: LIFLCLQYR (MOG_HUMAN)
LQFLCLQYK

SEQ ID NO: 120097 - protein, 9 aa, Artificial Sequence
  Description of Artificial Sequence: Synthetic peptide
  Seed: LVLLAVLPV (MOG_HUMAN)
LILLAVLPV

SEQ ID NO: 120098 - protein, 10 aa, Artificial Sequence
  Description of Artificial Sequence: Synthetic peptide
  Seed: YWVSPGVLVL (MOG_HUMAN)
YNVSPGVLVY

SEQ ID NO: 120099 - protein, 9 aa, Artificial Sequence
  Description of Artificial Sequence: Synthetic peptide
  Seed: RTFDPHFLR (MOG_HUMAN)
RSFDPHFLY

SEQ ID NO: 120100 - protein, 9 aa, Artificial Sequence
  Description of Artificial Sequence: Synthetic peptide
  Seed: RIRNVRFSD (MOG_HUMAN)
RSRNVRFST

SEQ ID NO: 120101 - protein, 10 aa, Artificial Sequence
  Description of Artificial Sequence: Synthetic peptide
  Seed: RLRGKLRAEI (MOG_HUMAN)
RMRGKLRAEK

SEQ ID NO: 120102 - protein, 10 aa, Artificial Sequence
  Description of Artificial Sequence: Synthetic peptide
  Seed: YWVSPGVLVL (MOG_HUMAN)
YWVSPGVLVY

SEQ ID NO: 120103 - protein, 11 aa, Artificial Sequence
  Description of Artificial Sequence: Synthetic peptide
  Seed: RDHSYQEEAAM (MOG_HUMAN)
RYHSYQEEAAW

SEQ ID NO: 120104 - protein, 9 aa, Artificial Sequence
  Description of Artificial Sequence: Synthetic peptide
  Seed: RIRNVRFSD (MOG_HUMAN)
RTRNVRFSK

SEQ ID NO: 120105 - protein, 8 aa, Artificial Sequence
  Description of Artificial Sequence: Synthetic peptide
  Seed: RTFDPHFL (MOG_HUMAN)
RRFDPHFL

SEQ ID NO: 120106 - protein, 10 aa, Artificial Sequence
  Description of Artificial Sequence: Synthetic peptide
  Seed: WYRPPFSRVV (MOG_HUMAN)
WYRPPFSRVF

SEQ ID NO: 120107 - protein, 10 aa, Artificial Sequence
  Description of Artificial Sequence: Synthetic peptide
  Seed: YWVSPGVLVL (MOG_HUMAN)
YQVSPGVLVY

SEQ ID NO: 120108 - protein, 9 aa, Artificial Sequence
  Description of Artificial Sequence: Synthetic peptide
  Seed: VIVPVLGPL (MOG_HUMAN)
VSVPVLGPR

SEQ ID NO: 120109 - protein, 9 aa, Artificial Sequence
  Description of Artificial Sequence: Synthetic peptide
  Seed: WVSPGVLVL (MOG_HUMAN)
WWSPGVLVL

SEQ ID NO: 120110 - protein, 10 aa, Artificial Sequence
  Description of Artificial Sequence: Synthetic peptide
  Seed: KITLFVIVPV (MOG_HUMAN)
KTTLFVIVPV

SEQ ID NO: 120111 - protein, 9 aa, Artificial Sequence
  Description of Artificial Sequence: Synthetic peptide
  Seed: DQAPEYRGR (MOG_HUMAN)
DSAPEYRGK

SEQ ID NO: 120112 - protein, 10 aa, Artificial Sequence
  Description of Artificial Sequence: Synthetic peptide
  Seed: FVIVPVLGPL (MOG_HUMAN)
FYIVPVLGPV

SEQ ID NO: 120113 - protein, 10 aa, Artificial Sequence
  Description of Artificial Sequence: Synthetic peptide
  Seed: VSSSYAGQFR (MOG_HUMAN)
VYSSYAGQFR

SEQ ID NO: 120114 - protein, 9 aa, Artificial Sequence
  Description of Artificial Sequence: Synthetic peptide
  Seed: LAVLPVLLL (MOG_HUMAN)
LSVLPVLLY

SEQ ID NO: 120115 - protein, 9 aa, Artificial Sequence
  Description of Artificial Sequence: Synthetic peptide
  Seed: VIVPVLGPL (MOG_HUMAN)
VSVPVLGPF

SEQ ID NO: 120116 - protein, 9 aa, Artificial Sequence
  Description of Artificial Sequence: Synthetic peptide
  Seed: SLPSCLCSF (MOG_HUMAN)
SYPSCLCSI

SEQ ID NO: 120117 - protein, 10 aa, Artificial Sequence
  Description of Artificial Sequence: Synthetic peptide
  Seed: WVSPGVLVLL (MOG_HUMAN)
WTSPGVLVLV

SEQ ID NO: 120118 - protein, 9 aa, Artificial Sequence
  Description of Artificial Sequence: Synthetic peptide
  Seed: RRLAGQFLE (MOG_HUMAN)
RKLAGQFLV

SEQ ID NO: 120119 - protein, 9 aa, Artificial Sequence
  Description of Artificial Sequence: Synthetic peptide
  Seed: YQEEAAMEL (MOG_HUMAN)
YAEEAAMEF

SEQ ID NO: 120120 - protein, 9 aa, Artificial Sequence
  Description of Artificial Sequence: Synthetic peptide
  Seed: DEVELPCRI (MOG_HUMAN)
DEVELPCRW

SEQ ID NO: 120121 - protein, 10 aa, Artificial Sequence
  Description of Artificial Sequence: Synthetic peptide
  Seed: SCLCSFLLLL (MOG_HUMAN)
SYLCSFLLLI

SEQ ID NO: 120122 - protein, 10 aa, Artificial Sequence
  Description of Artificial Sequence: Synthetic peptide
  Seed: IGPRHPIRAL (MOG_HUMAN)
IQPRHPIRAL

SEQ ID NO: 120123 - protein, 11 aa, Artificial Sequence
  Description of Artificial Sequence: Synthetic peptide
  Seed: PPFSRVVHLYR (MOG_HUMAN)
PVFSRVVHLYR

SEQ ID NO: 120124 - protein, 11 aa, Artificial Sequence
  Description of Artificial Sequence: Synthetic peptide
  Seed: VIGPRHPIRAL (MOG_HUMAN)
VKGPRHPIRAL

SEQ ID NO: 120125 - protein, 9 aa, Artificial Sequence
  Description of Artificial Sequence: Synthetic peptide
  Seed: LLAVLPVLL (MOG_HUMAN)
LIAVLPVLI

SEQ ID NO: 120126 - protein, 10 aa, Artificial Sequence
  Description of Artificial Sequence: Synthetic peptide
  Seed: SLSRPSLPSC (MOG_HUMAN)
SQSRPSLPSA

SEQ ID NO: 120127 - protein, 10 aa, Artificial Sequence
  Description of Artificial Sequence: Synthetic peptide
  Seed: VLLAVLPVLL (MOG_HUMAN)
VNLAVLPVLL

SEQ ID NO: 120128 - protein, 9 aa, Artificial Sequence
  Description of Artificial Sequence: Synthetic peptide
  Seed: LHRTFDPHF (MOG_HUMAN)
LMRTFDPHF

SEQ ID NO: 120129 - protein, 10 aa, Artificial Sequence
  Description of Artificial Sequence: Synthetic peptide
  Seed: RTFDPHFLRV (MOG_HUMAN)
RAFDPHFLRI

SEQ ID NO: 120130 - protein, 9 aa, Artificial Sequence
  Description of Artificial Sequence: Synthetic peptide
  Seed: LQYRLRGKL (MOG_HUMAN)
LQYRLRGKM

SEQ ID NO: 120131 - protein, 9 aa, Artificial Sequence
  Description of Artificial Sequence: Synthetic peptide
  Seed: SSYAGQFRV (MOG_HUMAN)
SVYAGQFRR

SEQ ID NO: 120132 - protein, 8 aa, Artificial Sequence
  Description of Artificial Sequence: Synthetic peptide
  Seed: RIRNVRFS (MOG_HUMAN)
RYRNVRFK

SEQ ID NO: 120133 - protein, 10 aa, Artificial Sequence
  Description of Artificial Sequence: Synthetic peptide
  Seed: TGMEVGWYRP (MOG_HUMAN)
TNMEVGWYRR

SEQ ID NO: 120134 - protein, 9 aa, Artificial Sequence
  Description of Artificial Sequence: Synthetic peptide
  Seed: MELKVEDPF (MOG_HUMAN)
MVLKVEDPY

SEQ ID NO: 120135 - protein, 9 aa, Artificial Sequence
  Description of Artificial Sequence: Synthetic peptide
  Seed: RIRNVRFSD (MOG_HUMAN)
RSRNVRFSI

SEQ ID NO: 120136 - protein, 10 aa, Artificial Sequence
  Description of Artificial Sequence: Synthetic peptide
  Seed: SLSRPSLPSC (MOG_HUMAN)
SMSRPSLPSK

SEQ ID NO: 120137 - protein, 11 aa, Artificial Sequence
  Description of Artificial Sequence: Synthetic peptide
  Seed: GVLVLLAVLPV (MOG_HUMAN)
GMLVLLAVLPV

SEQ ID NO: 120138 - protein, 9 aa, Artificial Sequence
  Description of Artificial Sequence: Synthetic peptide
  Seed: TCFFRDHSY (MOG_HUMAN)
TMFFRDHSY

SEQ ID NO: 120139 - protein, 10 aa, Artificial Sequence
  Description of Artificial Sequence: Synthetic peptide
  Seed: TGMEVGWYRP (MOG_HUMAN)
TVMEVGWYRA

SEQ ID NO: 120140 - protein, 10 aa, Artificial Sequence
  Description of Artificial Sequence: Synthetic peptide
  Seed: AEIENLHRTF (MOG_HUMAN)
AEIENLHRTT

SEQ ID NO: 120141 - protein, 10 aa, Artificial Sequence
  Description of Artificial Sequence: Synthetic peptide
  Seed: RVIGPRHPIR (MOG_HUMAN)
RYIGPRHPIR

SEQ ID NO: 120142 - protein, 9 aa, Artificial Sequence
  Description of Artificial Sequence: Synthetic peptide
  Seed: VGDEVELPC (MOG_HUMAN)
VFDEVELPL

SEQ ID NO: 120143 - protein, 10 aa, Artificial Sequence
  Description of Artificial Sequence: Synthetic peptide
  Seed: GLIFLCLQYR (MOG_HUMAN)
GKIFLCLQYR

SEQ ID NO: 120144 - protein, 9 aa, Artificial Sequence
  Description of Artificial Sequence: Synthetic peptide
  Seed: MASLSRPSL (MOG_HUMAN)
MTSLSRPSW

SEQ ID NO: 120145 - protein, 9 aa, Artificial Sequence
  Description of Artificial Sequence: Synthetic peptide
  Seed: LVLLAVLPV (MOG_HUMAN)
LQLLAVLPV

SEQ ID NO: 120146 - protein, 10 aa, Artificial Sequence
  Description of Artificial Sequence: Synthetic peptide
  Seed: RVVHLYRNGK (MOG_HUMAN)
RMVHLYRNGR

SEQ ID NO: 120147 - protein, 9 aa, Artificial Sequence
  Description of Artificial Sequence: Synthetic peptide
  Seed: RVIGPRHPI (MOG_HUMAN)
RPIGPRHPG

SEQ ID NO: 120148 - protein, 10 aa, Artificial Sequence
  Description of Artificial Sequence: Synthetic peptide
  Seed: MEVGWYRPPF (MOG_HUMAN)
MQVGWYRPPM

SEQ ID NO: 120149 - protein, 9 aa, Artificial Sequence
  Description of Artificial Sequence: Synthetic peptide
  Seed: RDHSYQEEA (MOG_HUMAN)
REHSYQEEL

SEQ ID NO: 120150 - protein, 9 aa, Artificial Sequence
  Description of Artificial Sequence: Synthetic peptide
  Seed: YRPPFSRVV (MOG_HUMAN)
YYPPFSRVM

SEQ ID NO: 120151 - protein, 10 aa, Artificial Sequence
  Description of Artificial Sequence: Synthetic peptide
  Seed: ITLFVIVPVL (MOG_HUMAN)
ITLFVIVPVY

SEQ ID NO: 120152 - protein, 9 aa, Artificial Sequence
  Description of Artificial Sequence: Synthetic peptide
  Seed: RVIGPRHPI (MOG_HUMAN)
RVIGPRHPF

SEQ ID NO: 120153 - protein, 10 aa, Artificial Sequence
  Description of Artificial Sequence: Synthetic peptide
  Seed: FTCFFRDHSY (MOG_HUMAN)
FACFFRDHSK

SEQ ID NO: 120154 - protein, 9 aa, Artificial Sequence
  Description of Artificial Sequence: Synthetic peptide
  Seed: MASLSRPSL (MOG_HUMAN)
MVSLSRPSY

SEQ ID NO: 120155 - protein, 9 aa, Artificial Sequence
  Description of Artificial Sequence: Synthetic peptide
  Seed: LAGQFLEEL (MOG_HUMAN)
LIGQFLEEV

SEQ ID NO: 120156 - protein, 9 aa, Artificial Sequence
  Description of Artificial Sequence: Synthetic peptide
  Seed: VGDEVELPC (MOG_HUMAN)
VADEVELPM

SEQ ID NO: 120157 - protein, 9 aa, Artificial Sequence
  Description of Artificial Sequence: Synthetic peptide
  Seed: TGMEVGWYR (MOG_HUMAN)
TTMEVGWYR

SEQ ID NO: 120158 - protein, 9 aa, Artificial Sequence
  Description of Artificial Sequence: Synthetic peptide
  Seed: VLLAVLPVL (MOG_HUMAN)
VILAVLPVV

SEQ ID NO: 120159 - protein, 9 aa, Artificial Sequence
  Description of Artificial Sequence: Synthetic peptide
  Seed: MELKVEDPF (MOG_HUMAN)
MQLKVEDPW

SEQ ID NO: 120160 - protein, 10 aa, Artificial Sequence
  Description of Artificial Sequence: Synthetic peptide
  Seed: RLAGQFLEEL (MOG_HUMAN)
RQAGQFLEEW

SEQ ID NO: 120161 - protein, 9 aa, Artificial Sequence
  Description of Artificial Sequence: Synthetic peptide
  Seed: HFLRVPCWK (MOG_HUMAN)
HMLRVPCWK

SEQ ID NO: 120162 - protein, 9 aa, Artificial Sequence
  Description of Artificial Sequence: Synthetic peptide
  Seed: RVIGPRHPI (MOG_HUMAN)
RMIGPRHPK

SEQ ID NO: 120163 - protein, 11 aa, Artificial Sequence
  Description of Artificial Sequence: Synthetic peptide
  Seed: DAIGEGKVTLR (MOG_HUMAN)
DFIGEGKVTLR

SEQ ID NO: 120164 - protein, 11 aa, Artificial Sequence
  Description of Artificial Sequence: Synthetic peptide
  Seed: KLRAEIENLHR (MOG_HUMAN)
KMRAEIENLHK

SEQ ID NO: 120165 - protein, 10 aa, Artificial Sequence
  Description of Artificial Sequence: Synthetic peptide
  Seed: FRVIGPRHPI (MOG_HUMAN)
FMVIGPRHPL

SEQ ID NO: 120166 - protein, 9 aa, Artificial Sequence
  Description of Artificial Sequence: Synthetic peptide
  Seed: LLLQITVGL (MOG_HUMAN)
LMLQITVGF

SEQ ID NO: 120167 - protein, 9 aa, Artificial Sequence
  Description of Artificial Sequence: Synthetic peptide
  Seed: LLAVLPVLL (MOG_HUMAN)
LLAVLPVLM

SEQ ID NO: 120168 - protein, 9 aa, Artificial Sequence
  Description of Artificial Sequence: Synthetic peptide
  Seed: RTFDPHFLR (MOG_HUMAN)
RIFDPHFLF

SEQ ID NO: 120169 - protein, 9 aa, Artificial Sequence
  Description of Artificial Sequence: Synthetic peptide
  Seed: VPVLGPLVA (MOG_HUMAN)
VSVLGPLVM

SEQ ID NO: 120170 - protein, 9 aa, Artificial Sequence
  Description of Artificial Sequence: Synthetic peptide
  Seed: YRPPFSRVV (MOG_HUMAN)
YTPPFSRVM

SEQ ID NO: 120171 - protein, 9 aa, Artificial Sequence
  Description of Artificial Sequence: Synthetic peptide
  Seed: YQEEAAMEL (MOG_HUMAN)
YMEEAAMET

SEQ ID NO: 120172 - protein, 9 aa, Artificial Sequence
  Description of Artificial Sequence: Synthetic peptide
  Seed: AIGEGKVTL (MOG_HUMAN)
ASGEGKVTF

SEQ ID NO: 120173 - protein, 9 aa, Artificial Sequence
  Description of Artificial Sequence: Synthetic peptide
  Seed: LQVSSSYAG (MOG_HUMAN)
LQVSSSYAA

SEQ ID NO: 120174 - protein, 9 aa, Artificial Sequence
  Description of Artificial Sequence: Synthetic peptide
  Seed: TFDPHFLRV (MOG_HUMAN)
TFDPHFLRA

SEQ ID NO: 120175 - protein, 10 aa, Artificial Sequence
  Description of Artificial Sequence: Synthetic peptide
  Seed: HRTFDPHFLR (MOG_HUMAN)
HPTFDPHFLK

SEQ ID NO: 120176 - protein, 10 aa, Artificial Sequence
  Description of Artificial Sequence: Synthetic peptide
  Seed: FVIVPVLGPL (MOG_HUMAN)
FCIVPVLGPY

SEQ ID NO: 120177 - protein, 10 aa, Artificial Sequence
  Description of Artificial Sequence: Synthetic peptide
  Seed: RTFDPHFLRV (MOG_HUMAN)
RAFDPHFLRH

SEQ ID NO: 120178 - protein, 9 aa, Artificial Sequence
  Description of Artificial Sequence: Synthetic peptide
  Seed: ITLFVIVPV (MOG_HUMAN)
IMLFVIVPM

SEQ ID NO: 120179 - protein, 9 aa, Artificial Sequence
  Description of Artificial Sequence: Synthetic peptide
  Seed: LCSFLLLLL (MOG_HUMAN)
LSSFLLLLF

SEQ ID NO: 120180 - protein, 9 aa, Artificial Sequence
  Description of Artificial Sequence: Synthetic peptide
  Seed: LLLQVSSSY (MOG_HUMAN)
LMLQVSSSM

SEQ ID NO: 120181 - protein, 11 aa, Artificial Sequence
  Description of Artificial Sequence: Synthetic peptide
  Seed: FSDEGGFTCFF (MOG_HUMAN)
FADEGGFTCFL

SEQ ID NO: 120182 - protein, 9 aa, Artificial Sequence
  Description of Artificial Sequence: Synthetic peptide
  Seed: VLGPLVALI (MOG_HUMAN)
VLGPLVALT

SEQ ID NO: 120183 - protein, 10 aa, Artificial Sequence
  Description of Artificial Sequence: Synthetic peptide
  Seed: FDPHFLRVPC (MOG_HUMAN)
FAPHFLRVPV

SEQ ID NO: 120184 - protein, 11 aa, Artificial Sequence
  Description of Artificial Sequence: Synthetic peptide
  Seed: LHRTFDPHFLR (MOG_HUMAN)
LVRTFDPHFLK

SEQ ID NO: 120185 - protein, 11 aa, Artificial Sequence
  Description of Artificial Sequence: Synthetic peptide
  Seed: RFSDEGGFTCF (MOG_HUMAN)
RLSDEGGFTCY

SEQ ID NO: 120186 - protein, 9 aa, Artificial Sequence
  Description of Artificial Sequence: Synthetic peptide
  Seed: YWVSPGVLV (MOG_HUMAN)
YRVSPGVLM

SEQ ID NO: 120187 - protein, 8 aa, Artificial Sequence
  Description of Artificial Sequence: Synthetic peptide
  Seed: FSDEGGFT (MOG_HUMAN)
FTDEGGFF

SEQ ID NO: 120188 - protein, 10 aa, Artificial Sequence
  Description of Artificial Sequence: Synthetic peptide
  Seed: RTFDPHFLRV (MOG_HUMAN)
RAFDPHFLRD

SEQ ID NO: 120189 - protein, 9 aa, Artificial Sequence
  Description of Artificial Sequence: Synthetic peptide
  Seed: RVPCWKITL (MOG_HUMAN)
RLPCWKITR

SEQ ID NO: 120190 - protein, 10 aa, Artificial Sequence
  Description of Artificial Sequence: Synthetic peptide
  Seed: FTCFFRDHSY (MOG_HUMAN)
FMCFFRDHSY

SEQ ID NO: 120191 - protein, 8 aa, Artificial Sequence
  Description of Artificial Sequence: Synthetic peptide
  Seed: YNWLHRRL (MOG_HUMAN)
YQWLHRRI

SEQ ID NO: 120192 - protein, 10 aa, Artificial Sequence
  Description of Artificial Sequence: Synthetic peptide
  Seed: WLHRRLAGQF (MOG_HUMAN)
WQHRRLAGQF

SEQ ID NO: 120193 - protein, 10 aa, Artificial Sequence
  Description of Artificial Sequence: Synthetic peptide
  Seed: HRTFDPHFLR (MOG_HUMAN)
HFTFDPHFLR

SEQ ID NO: 120194 - protein, 10 aa, Artificial Sequence
  Description of Artificial Sequence: Synthetic peptide
  Seed: LLQITVGLIF (MOG_HUMAN)
LIQITVGLIF

SEQ ID NO: 120195 - protein, 11 aa, Artificial Sequence
  Description of Artificial Sequence: Synthetic peptide
  Seed: HSYQEEAAMEL (MOG_HUMAN)
HCYQEEAAMEW

SEQ ID NO: 120196 - protein, 10 aa, Artificial Sequence
  Description of Artificial Sequence: Synthetic peptide
  Seed: FSDEGGFTCF (MOG_HUMAN)
FYDEGGFTCM

SEQ ID NO: 120197 - protein, 9 aa, Artificial Sequence
  Description of Artificial Sequence: Synthetic peptide
  Seed: RIRNVRFSD (MOG_HUMAN)
RFRNVRFST

SEQ ID NO: 120198 - protein, 9 aa, Artificial Sequence
  Description of Artificial Sequence: Synthetic peptide
  Seed: ITLFVIVPV (MOG_HUMAN)
IILFVIVPV

SEQ ID NO: 120199 - protein, 8 aa, Artificial Sequence
  Description of Artificial Sequence: Synthetic peptide
  Seed: VLGPLVAL (MOG_HUMAN)
VQGPLVAV

SEQ ID NO: 120200 - protein, 9 aa, Artificial Sequence
  Description of Artificial Sequence: Synthetic peptide
  Seed: GQFRVIGPR (MOG_HUMAN)
GIFRVIGPK

SEQ ID NO: 120201 - protein, 10 aa, Artificial Sequence
  Description of Artificial Sequence: Synthetic peptide
  Seed: GLIFLCLQYR (MOG_HUMAN)
GGIFLCLQYR

SEQ ID NO: 120202 - protein, 9 aa, Artificial Sequence
  Description of Artificial Sequence: Synthetic peptide
  Seed: HSYQEEAAM (MOG_HUMAN)
HSYQEEAAL

SEQ ID NO: 120203 - protein, 9 aa, Artificial Sequence
  Description of Artificial Sequence: Synthetic peptide
  Seed: LLAVLPVLL (MOG_HUMAN)
LAAVLPVLY

SEQ ID NO: 120204 - protein, 11 aa, Artificial Sequence
  Description of Artificial Sequence: Synthetic peptide
  Seed: VRFSDEGGFTC (MOG_HUMAN)
VRFSDEGGFTY

SEQ ID NO: 120205 - protein, 10 aa, Artificial Sequence
  Description of Artificial Sequence: Synthetic peptide
  Seed: IGPRHPIRAL (MOG_HUMAN)
ILPRHPIRAL

SEQ ID NO: 120206 - protein, 8 aa, Artificial Sequence
  Description of Artificial Sequence: Synthetic peptide
  Seed: FSRVVHLY (MOG_HUMAN)
FSRVVHLM

SEQ ID NO: 120207 - protein, 9 aa, Artificial Sequence
  Description of Artificial Sequence: Synthetic peptide
  Seed: HSYQEEAAM (MOG_HUMAN)
HQYQEEAAL

SEQ ID NO: 120208 - protein, 10 aa, Artificial Sequence
  Description of Artificial Sequence: Synthetic peptide
  Seed: LVLLAVLPVL (MOG_HUMAN)
LVLLAVLPVI

SEQ ID NO: 120209 - protein, 9 aa, Artificial Sequence
  Description of Artificial Sequence: Synthetic peptide
  Seed: TCFFRDHSY (MOG_HUMAN)
TRFFRDHSF

SEQ ID NO: 120210 - protein, 10 aa, Artificial Sequence
  Description of Artificial Sequence: Synthetic peptide
  Seed: FVIVPVLGPL (MOG_HUMAN)
FFIVPVLGPY

SEQ ID NO: 120211 - protein, 10 aa, Artificial Sequence
  Description of Artificial Sequence: Synthetic peptide
  Seed: TGMEVGWYRP (MOG_HUMAN)
TVMEVGWYRE

SEQ ID NO: 120212 - protein, 10 aa, Artificial Sequence
  Description of Artificial Sequence: Synthetic peptide
  Seed: TGMEVGWYRP (MOG_HUMAN)
TFMEVGWYRW

SEQ ID NO: 120213 - protein, 9 aa, Artificial Sequence
  Description of Artificial Sequence: Synthetic peptide
  Seed: RVIGPRHPI (MOG_HUMAN)
RSIGPRHPS

SEQ ID NO: 120214 - protein, 10 aa, Artificial Sequence
  Description of Artificial Sequence: Synthetic peptide
  Seed: LQITVGLIFL (MOG_HUMAN)
LMITVGLIFV

SEQ ID NO: 120215 - protein, 10 aa, Artificial Sequence
  Description of Artificial Sequence: Synthetic peptide
  Seed: FSDEGGFTCF (MOG_HUMAN)
FTDEGGFTCF

SEQ ID NO: 120216 - protein, 9 aa, Artificial Sequence
  Description of Artificial Sequence: Synthetic peptide
  Seed: YRPPFSRVV (MOG_HUMAN)
YVPPFSRVL

SEQ ID NO: 120217 - protein, 10 aa, Artificial Sequence
  Description of Artificial Sequence: Synthetic peptide
  Seed: FTCFFRDHSY (MOG_HUMAN)
FICFFRDHSK

SEQ ID NO: 120218 - protein, 10 aa, Artificial Sequence
  Description of Artificial Sequence: Synthetic peptide
  Seed: VPVLGPLVAL (MOG_HUMAN)
VFVLGPLVAI

SEQ ID NO: 120219 - protein, 9 aa, Artificial Sequence
  Description of Artificial Sequence: Synthetic peptide
  Seed: ALVGDEVEL (MOG_HUMAN)
ATVGDEVEV

SEQ ID NO: 120220 - protein, 10 aa, Artificial Sequence
  Description of Artificial Sequence: Synthetic peptide
  Seed: LSRPSLPSCL (MOG_HUMAN)
LTRPSLPSCK

SEQ ID NO: 120221 - protein, 9 aa, Artificial Sequence
  Description of Artificial Sequence: Synthetic peptide
  Seed: FSDEGGFTC (MOG_HUMAN)
FLDEGGFTA

SEQ ID NO: 120222 - protein, 9 aa, Artificial Sequence
  Description of Artificial Sequence: Synthetic peptide
  Seed: YQEEAAMEL (MOG_HUMAN)
YCEEAAMEF

SEQ ID NO: 120223 - protein, 9 aa, Artificial Sequence
  Description of Artificial Sequence: Synthetic peptide
  Seed: LSRPSLPSC (MOG_HUMAN)
LTRPSLPST

SEQ ID NO: 120224 - protein, 10 aa, Artificial Sequence
  Description of Artificial Sequence: Synthetic peptide
  Seed: RTFDPHFLRV (MOG_HUMAN)
REFDPHFLRF

SEQ ID NO: 120225 - protein, 10 aa, Artificial Sequence
  Description of Artificial Sequence: Synthetic peptide
  Seed: VLLAVLPVLL (MOG_HUMAN)
VMLAVLPVLM

SEQ ID NO: 120226 - protein, 10 aa, Artificial Sequence
  Description of Artificial Sequence: Synthetic peptide
  Seed: FTCFFRDHSY (MOG_HUMAN)
FWCFFRDHSY

SEQ ID NO: 120227 - protein, 10 aa, Artificial Sequence
  Description of Artificial Sequence: Synthetic peptide
  Seed: LIFLCLQYRL (MOG_HUMAN)
LMFLCLQYRR

SEQ ID NO: 120228 - protein, 9 aa, Artificial Sequence
  Description of Artificial Sequence: Synthetic peptide
  Seed: VSPGVLVLL (MOG_HUMAN)
VYPGVLVLL

SEQ ID NO: 120229 - protein, 10 aa, Artificial Sequence
  Description of Artificial Sequence: Synthetic peptide
  Seed: FDPHFLRVPC (MOG_HUMAN)
FAPHFLRVPF

SEQ ID NO: 120230 - protein, 9 aa, Artificial Sequence
  Description of Artificial Sequence: Synthetic peptide
  Seed: LLLQVSSSY (MOG_HUMAN)
LPLQVSSSM

SEQ ID NO: 120231 - protein, 10 aa, Artificial Sequence
  Description of Artificial Sequence: Synthetic peptide
  Seed: FDPHFLRVPC (MOG_HUMAN)
FNPHFLRVPT

SEQ ID NO: 120232 - protein, 9 aa, Artificial Sequence
  Description of Artificial Sequence: Synthetic peptide
  Seed: GPRHPIRAL (MOG_HUMAN)
GPRHPIRAT

SEQ ID NO: 120233 - protein, 11 aa, Artificial Sequence
  Description of Artificial Sequence: Synthetic peptide
  Seed: RDHSYQEEAAM (MOG_HUMAN)
RRHSYQEEAAW

SEQ ID NO: 120234 - protein, 10 aa, Artificial Sequence
  Description of Artificial Sequence: Synthetic peptide
  Seed: FSDEGGFTCF (MOG_HUMAN)
FSDEGGFTCV

SEQ ID NO: 120235 - protein, 11 aa, Artificial Sequence
  Description of Artificial Sequence: Synthetic peptide
  Seed: FVIVPVLGPLV (MOG_HUMAN)
FMIVPVLGPLL

SEQ ID NO: 120236 - protein, 9 aa, Artificial Sequence
  Description of Artificial Sequence: Synthetic peptide
  Seed: VPVLGPLVA (MOG_HUMAN)
VPVLGPLVP

SEQ ID NO: 120237 - protein, 9 aa, Artificial Sequence
  Description of Artificial Sequence: Synthetic peptide
  Seed: LSRPSLPSC (MOG_HUMAN)
LMRPSLPSK

SEQ ID NO: 120238 - protein, 9 aa, Artificial Sequence
  Description of Artificial Sequence: Synthetic peptide
  Seed: HSYQEEAAM (MOG_HUMAN)
HAYQEEAAL

SEQ ID NO: 120239 - protein, 9 aa, Artificial Sequence
  Description of Artificial Sequence: Synthetic peptide
  Seed: RVIGPRHPI (MOG_HUMAN)
RIIGPRHPF

SEQ ID NO: 120240 - protein, 9 aa, Artificial Sequence
  Description of Artificial Sequence: Synthetic peptide
  Seed: VSSSYAGQF (MOG_HUMAN)
VMSSYAGQM

SEQ ID NO: 120241 - protein, 9 aa, Artificial Sequence
  Description of Artificial Sequence: Synthetic peptide
  Seed: FLEELRNPF (MOG_HUMAN)
FPEELRNPH

SEQ ID NO: 120242 - protein, 9 aa, Artificial Sequence
  Description of Artificial Sequence: Synthetic peptide
  Seed: IFLCLQYRL (MOG_HUMAN)
IYLCLQYRI

SEQ ID NO: 120243 - protein, 10 aa, Artificial Sequence
  Description of Artificial Sequence: Synthetic peptide
  Seed: HRTFDPHFLR (MOG_HUMAN)
HHTFDPHFLR

SEQ ID NO: 120244 - protein, 9 aa, Artificial Sequence
  Description of Artificial Sequence: Synthetic peptide
  Seed: IFLCLQYRL (MOG_HUMAN)
IWLCLQYRL

SEQ ID NO: 120245 - protein, 9 aa, Artificial Sequence
  Description of Artificial Sequence: Synthetic peptide
  Seed: AIGEGKVTL (MOG_HUMAN)
AFGEGKVTF

SEQ ID NO: 120246 - protein, 9 aa, Artificial Sequence
  Description of Artificial Sequence: Synthetic peptide
  Seed: VLGPLVALI (MOG_HUMAN)
VSGPLVALM

SEQ ID NO: 120247 - protein, 9 aa, Artificial Sequence
  Description of Artificial Sequence: Synthetic peptide
  Seed: LSRPSLPSC (MOG_HUMAN)
LARPSLPSL

SEQ ID NO: 120248 - protein, 9 aa, Artificial Sequence
  Description of Artificial Sequence: Synthetic peptide
  Seed: VLLAVLPVL (MOG_HUMAN)
VILAVLPVF

SEQ ID NO: 120249 - protein, 10 aa, Artificial Sequence
  Description of Artificial Sequence: Synthetic peptide
  Seed: VLLLQITVGL (MOG_HUMAN)
VELLQITVGV

SEQ ID NO: 120250 - protein, 9 aa, Artificial Sequence
  Description of Artificial Sequence: Synthetic peptide
  Seed: RTFDPHFLR (MOG_HUMAN)
RWFDPHFLH

SEQ ID NO: 120251 - protein, 9 aa, Artificial Sequence
  Description of Artificial Sequence: Synthetic peptide
  Seed: RTFDPHFLR (MOG_HUMAN)
RRFDPHFLF

SEQ ID NO: 120252 - protein, 9 aa, Artificial Sequence
  Description of Artificial Sequence: Synthetic peptide
  Seed: VIVPVLGPL (MOG_HUMAN)
VLVPVLGPL

SEQ ID NO: 120253 - protein, 9 aa, Artificial Sequence
  Description of Artificial Sequence: Synthetic peptide
  Seed: LAVLPVLLL (MOG_HUMAN)
LQVLPVLLF

SEQ ID NO: 120254 - protein, 9 aa, Artificial Sequence
  Description of Artificial Sequence: Synthetic peptide
  Seed: YQEEAAMEL (MOG_HUMAN)
YMEEAAMEY

SEQ ID NO: 120255 - protein, 9 aa, Artificial Sequence
  Description of Artificial Sequence: Synthetic peptide
  Seed: YQEEAAMEL (MOG_HUMAN)
YEEEAAMEP

SEQ ID NO: 120256 - protein, 10 aa, Artificial Sequence
  Description of Artificial Sequence: Synthetic peptide
  Seed: FLLLLLLQVS (MOG_HUMAN)
FQLLLLLQVV

SEQ ID NO: 120257 - protein, 9 aa, Artificial Sequence
  Description of Artificial Sequence: Synthetic peptide
  Seed: MASLSRPSL (MOG_HUMAN)
MMSLSRPSI

SEQ ID NO: 120258 - protein, 10 aa, Artificial Sequence
  Description of Artificial Sequence: Synthetic peptide
  Seed: SSYAGQFRVI (MOG_HUMAN)
SHYAGQFRVW

SEQ ID NO: 120259 - protein, 10 aa, Artificial Sequence
  Description of Artificial Sequence: Synthetic peptide
  Seed: SLSRPSLPSC (MOG_HUMAN)
SKSRPSLPSV

SEQ ID NO: 120260 - protein, 9 aa, Artificial Sequence
  Description of Artificial Sequence: Synthetic peptide
  Seed: SLPSCLCSF (MOG_HUMAN)
SLPSCLCSY

SEQ ID NO: 120261 - protein, 9 aa, Artificial Sequence
  Description of Artificial Sequence: Synthetic peptide
  Seed: LIICYNWLH (MOG_HUMAN)
LFICYNWLR

SEQ ID NO: 120262 - protein, 10 aa, Artificial Sequence
  Description of Artificial Sequence: Synthetic peptide
  Seed: LQITVGLIFL (MOG_HUMAN)
LLITVGLIFV

SEQ ID NO: 120263 - protein, 10 aa, Artificial Sequence
  Description of Artificial Sequence: Synthetic peptide
  Seed: RTFDPHFLRV (MOG_HUMAN)
RYFDPHFLRC

SEQ ID NO: 120264 - protein, 10 aa, Artificial Sequence
  Description of Artificial Sequence: Synthetic peptide
  Seed: FYWVSPGVLV (MOG_HUMAN)
FYWVSPGVLI

SEQ ID NO: 120265 - protein, 10 aa, Artificial Sequence
  Description of Artificial Sequence: Synthetic peptide
  Seed: KVTLRIRNVR (MOG_HUMAN)
KITLRIRNVR

SEQ ID NO: 120266 - protein, 10 aa, Artificial Sequence
  Description of Artificial Sequence: Synthetic peptide
  Seed: RPPFSRVVHL (MOG_HUMAN)
RKPFSRVVHM

SEQ ID NO: 120267 - protein, 10 aa, Artificial Sequence
  Description of Artificial Sequence: Synthetic peptide
  Seed: DEGGFTCFFR (MOG_HUMAN)
DIGGFTCFFR

SEQ ID NO: 120268 - protein, 10 aa, Artificial Sequence
  Description of Artificial Sequence: Synthetic peptide
  Seed: AEIENLHRTF (MOG_HUMAN)
ALIENLHRTF

SEQ ID NO: 120269 - protein, 9 aa, Artificial Sequence
  Description of Artificial Sequence: Synthetic peptide
  Seed: LLLQITVGL (MOG_HUMAN)
LILQITVGR

SEQ ID NO: 120270 - protein, 10 aa, Artificial Sequence
  Description of Artificial Sequence: Synthetic peptide
  Seed: LLLQVSSSYA (MOG_HUMAN)
LQLQVSSSYH

SEQ ID NO: 120271 - protein, 10 aa, Artificial Sequence
  Description of Artificial Sequence: Synthetic peptide
  Seed: VLLLQITVGL (MOG_HUMAN)
VKLLQITVGI

SEQ ID NO: 120272 - protein, 10 aa, Artificial Sequence
  Description of Artificial Sequence: Synthetic peptide
  Seed: ITLFVIVPVL (MOG_HUMAN)
ILLFVIVPVV

SEQ ID NO: 120273 - protein, 10 aa, Artificial Sequence
  Description of Artificial Sequence: Synthetic peptide
  Seed: FVIVPVLGPL (MOG_HUMAN)
FCIVPVLGPV

SEQ ID NO: 120274 - protein, 9 aa, Artificial Sequence
  Description of Artificial Sequence: Synthetic peptide
  Seed: VSPGVLVLL (MOG_HUMAN)
VWPGVLVLW

SEQ ID NO: 120275 - protein, 8 aa, Artificial Sequence
  Description of Artificial Sequence: Synthetic peptide
  Seed: VIGPRHPI (MOG_HUMAN)
VAGPRHPM

SEQ ID NO: 120276 - protein, 9 aa, Artificial Sequence
  Description of Artificial Sequence: Synthetic peptide
  Seed: RVPCWKITL (MOG_HUMAN)
RLPCWKITA

SEQ ID NO: 120277 - protein, 11 aa, Artificial Sequence
  Description of Artificial Sequence: Synthetic peptide
  Seed: RTFDPHFLRVP (MOG_HUMAN)
RMFDPHFLRVC

SEQ ID NO: 120278 - protein, 9 aa, Artificial Sequence
  Description of Artificial Sequence: Synthetic peptide
  Seed: FSDEGGFTC (MOG_HUMAN)
FMDEGGFTL

SEQ ID NO: 120279 - protein, 11 aa, Artificial Sequence
  Description of Artificial Sequence: Synthetic peptide
  Seed: RDHSYQEEAAM (MOG_HUMAN)
RIHSYQEEAAW

SEQ ID NO: 120280 - protein, 10 aa, Artificial Sequence
  Description of Artificial Sequence: Synthetic peptide
  Seed: WVSPGVLVLL (MOG_HUMAN)
WSSPGVLVLF

SEQ ID NO: 120281 - protein, 10 aa, Artificial Sequence
  Description of Artificial Sequence: Synthetic peptide
  Seed: RLAGQFLEEL (MOG_HUMAN)
RQAGQFLEEL

SEQ ID NO: 120282 - protein, 10 aa, Artificial Sequence
  Description of Artificial Sequence: Synthetic peptide
  Seed: RTFDPHFLRV (MOG_HUMAN)
RWFDPHFLRV

SEQ ID NO: 120283 - protein, 10 aa, Artificial Sequence
  Description of Artificial Sequence: Synthetic peptide
  Seed: PPFSRVVHLY (MOG_HUMAN)
PMFSRVVHLY

SEQ ID NO: 120284 - protein, 11 aa, Artificial Sequence
  Description of Artificial Sequence: Synthetic peptide
  Seed: LHRTFDPHFLR (MOG_HUMAN)
LCRTFDPHFLK

SEQ ID NO: 120285 - protein, 9 aa, Artificial Sequence
  Description of Artificial Sequence: Synthetic peptide
  Seed: LQYRLRGKL (MOG_HUMAN)
LQYRLRGKF

SEQ ID NO: 120286 - protein, 9 aa, Artificial Sequence
  Description of Artificial Sequence: Synthetic peptide
  Seed: LAVLPVLLL (MOG_HUMAN)
LGVLPVLLW

SEQ ID NO: 120287 - protein, 10 aa, Artificial Sequence
  Description of Artificial Sequence: Synthetic peptide
  Seed: CLCSFLLLLL (MOG_HUMAN)
CLCSFLLLLA

SEQ ID NO: 120288 - protein, 8 aa, Artificial Sequence
  Description of Artificial Sequence: Synthetic peptide
  Seed: FSDEGGFT (MOG_HUMAN)
FTDEGGFV

SEQ ID NO: 120289 - protein, 9 aa, Artificial Sequence
  Description of Artificial Sequence: Synthetic peptide
  Seed: YQEEAAMEL (MOG_HUMAN)
YPEEAAMEI

SEQ ID NO: 120290 - protein, 10 aa, Artificial Sequence
  Description of Artificial Sequence: Synthetic peptide
  Seed: FSDEGGFTCF (MOG_HUMAN)
FTDEGGFTCW

SEQ ID NO: 120291 - protein, 9 aa, Artificial Sequence
  Description of Artificial Sequence: Synthetic peptide
  Seed: VIVPVLGPL (MOG_HUMAN)
VMVPVLGPT

SEQ ID NO: 120292 - protein, 10 aa, Artificial Sequence
  Description of Artificial Sequence: Synthetic peptide
  Seed: ITVGLIFLCL (MOG_HUMAN)
ISVGLIFLCW

SEQ ID NO: 120293 - protein, 10 aa, Artificial Sequence
  Description of Artificial Sequence: Synthetic peptide
  Seed: SLSRPSLPSC (MOG_HUMAN)
SPSRPSLPSA

SEQ ID NO: 120294 - protein, 9 aa, Artificial Sequence
  Description of Artificial Sequence: Synthetic peptide
  Seed: FYWVSPGVL (MOG_HUMAN)
FQWVSPGVH

SEQ ID NO: 120295 - protein, 9 aa, Artificial Sequence
  Description of Artificial Sequence: Synthetic peptide
  Seed: YRGRTELLK (MOG_HUMAN)
YRGRTELLM

SEQ ID NO: 120296 - protein, 9 aa, Artificial Sequence
  Description of Artificial Sequence: Synthetic peptide
  Seed: RRLAGQFLE (MOG_HUMAN)
RRLAGQFLY

SEQ ID NO: 120297 - protein, 10 aa, Artificial Sequence
  Description of Artificial Sequence: Synthetic peptide
  Seed: RTFDPHFLRV (MOG_HUMAN)
RAFDPHFLRV

SEQ ID NO: 120298 - protein, 10 aa, Artificial Sequence
  Description of Artificial Sequence: Synthetic peptide
  Seed: FDPHFLRVPC (MOG_HUMAN)
FRPHFLRVPV

SEQ ID NO: 120299 - protein, 9 aa, Artificial Sequence
  Description of Artificial Sequence: Synthetic peptide
  Seed: SSYAGQFRV (MOG_HUMAN)
STYAGQFRY

SEQ ID NO: 120300 - protein, 11 aa, Artificial Sequence
  Description of Artificial Sequence: Synthetic peptide
  Seed: NATGMEVGWYR (MOG_HUMAN)
NHTGMEVGWYR

SEQ ID NO: 120301 - protein, 10 aa, Artificial Sequence
  Description of Artificial Sequence: Synthetic peptide
  Seed: SSYAGQFRVI (MOG_HUMAN)
SAYAGQFRVY

SEQ ID NO: 120302 - protein, 10 aa, Artificial Sequence
  Description of Artificial Sequence: Synthetic peptide
  Seed: RDHSYQEEAA (MOG_HUMAN)
REHSYQEEAV

SEQ ID NO: 120303 - protein, 10 aa, Artificial Sequence
  Description of Artificial Sequence: Synthetic peptide
  Seed: FTCFFRDHSY (MOG_HUMAN)
FKCFFRDHSF

SEQ ID NO: 120304 - protein, 9 aa, Artificial Sequence
  Description of Artificial Sequence: Synthetic peptide
  Seed: VGDEVELPC (MOG_HUMAN)
VTDEVELPL

SEQ ID NO: 120305 - protein, 9 aa, Artificial Sequence
  Description of Artificial Sequence: Synthetic peptide
  Seed: LLLQITVGL (MOG_HUMAN)
LTLQITVGL

SEQ ID NO: 120306 - protein, 9 aa, Artificial Sequence
  Description of Artificial Sequence: Synthetic peptide
  Seed: FLCLQYRLR (MOG_HUMAN)
FVCLQYRLR

SEQ ID NO: 120307 - protein, 9 aa, Artificial Sequence
  Description of Artificial Sequence: Synthetic peptide
  Seed: MASLSRPSL (MOG_HUMAN)
MMSLSRPSV

SEQ ID NO: 120308 - protein, 10 aa, Artificial Sequence
  Description of Artificial Sequence: Synthetic peptide
  Seed: IGPRHPIRAL (MOG_HUMAN)
IWPRHPIRAM

SEQ ID NO: 120309 - protein, 10 aa, Artificial Sequence
  Description of Artificial Sequence: Synthetic peptide
  Seed: FDPHFLRVPC (MOG_HUMAN)
FCPHFLRVPA

SEQ ID NO: 120310 - protein, 10 aa, Artificial Sequence
  Description of Artificial Sequence: Synthetic peptide
  Seed: DEGGFTCFFR (MOG_HUMAN)
DMGGFTCFFR

SEQ ID NO: 120311 - protein, 10 aa, Artificial Sequence
  Description of Artificial Sequence: Synthetic peptide
  Seed: ELPCRISPGK (MOG_HUMAN)
EIPCRISPGR

SEQ ID NO: 120312 - protein, 9 aa, Artificial Sequence
  Description of Artificial Sequence: Synthetic peptide
  Seed: VPCWKITLF (MOG_HUMAN)
VPCWKITLL

SEQ ID NO: 120313 - protein, 10 aa, Artificial Sequence
  Description of Artificial Sequence: Synthetic peptide
  Seed: LQITVGLIFL (MOG_HUMAN)
LQITVGLIFM

SEQ ID NO: 120314 - protein, 9 aa, Artificial Sequence
  Description of Artificial Sequence: Synthetic peptide
  Seed: LSRPSLPSC (MOG_HUMAN)
LYRPSLPSA

SEQ ID NO: 120315 - protein, 9 aa, Artificial Sequence
  Description of Artificial Sequence: Synthetic peptide
  Seed: RVIGPRHPI (MOG_HUMAN)
RAIGPRHPY

SEQ ID NO: 120316 - protein, 9 aa, Artificial Sequence
  Description of Artificial Sequence: Synthetic peptide
  Seed: EEAAMELKV (MOG_HUMAN)
EEAAMELKM

SEQ ID NO: 120317 - protein, 10 aa, Artificial Sequence
  Description of Artificial Sequence: Synthetic peptide
  Seed: VLLAVLPVLL (MOG_HUMAN)
VELAVLPVLV

SEQ ID NO: 120318 - protein, 10 aa, Artificial Sequence
  Description of Artificial Sequence: Synthetic peptide
  Seed: RIRNVRFSDE (MOG_HUMAN)
RFRNVRFSDK

SEQ ID NO: 120319 - protein, 9 aa, Artificial Sequence
  Description of Artificial Sequence: Synthetic peptide
  Seed: VSPGVLVLL (MOG_HUMAN)
VQPGVLVLL

SEQ ID NO: 120320 - protein, 10 aa, Artificial Sequence
  Description of Artificial Sequence: Synthetic peptide
  Seed: HRTFDPHFLR (MOG_HUMAN)
HPTFDPHFLY

SEQ ID NO: 120321 - protein, 10 aa, Artificial Sequence
  Description of Artificial Sequence: Synthetic peptide
  Seed: SCLCSFLLLL (MOG_HUMAN)
SFLCSFLLLV

SEQ ID NO: 120322 - protein, 9 aa, Artificial Sequence
  Description of Artificial Sequence: Synthetic peptide
  Seed: FYWVSPGVL (MOG_HUMAN)
FQWVSPGVV

SEQ ID NO: 120323 - protein, 9 aa, Artificial Sequence
  Description of Artificial Sequence: Synthetic peptide
  Seed: WVSPGVLVL (MOG_HUMAN)
WQSPGVLVM

SEQ ID NO: 120324 - protein, 9 aa, Artificial Sequence
  Description of Artificial Sequence: Synthetic peptide
  Seed: SCLCSFLLL (MOG_HUMAN)
SLLCSFLLM

SEQ ID NO: 120325 - protein, 9 aa, Artificial Sequence
  Description of Artificial Sequence: Synthetic peptide
  Seed: RTFDPHFLR (MOG_HUMAN)
RQFDPHFLW

SEQ ID NO: 120326 - protein, 10 aa, Artificial Sequence
  Description of Artificial Sequence: Synthetic peptide
  Seed: IGPRHPIRAL (MOG_HUMAN)
ILPRHPIRAV

SEQ ID NO: 120327 - protein, 10 aa, Artificial Sequence
  Description of Artificial Sequence: Synthetic peptide
  Seed: FVIVPVLGPL (MOG_HUMAN)
FHIVPVLGPI

SEQ ID NO: 120328 - protein, 10 aa, Artificial Sequence
  Description of Artificial Sequence: Synthetic peptide
  Seed: LLAVLPVLLL (MOG_HUMAN)
LLAVLPVLLM

SEQ ID NO: 120329 - protein, 10 aa, Artificial Sequence
  Description of Artificial Sequence: Synthetic peptide
  Seed: LLQITVGLIF (MOG_HUMAN)
LYQITVGLIY

SEQ ID NO: 120330 - protein, 9 aa, Artificial Sequence
  Description of Artificial Sequence: Synthetic peptide
  Seed: SRPSLPSCL (MOG_HUMAN)
STPSLPSCI

SEQ ID NO: 120331 - protein, 9 aa, Artificial Sequence
  Description of Artificial Sequence: Synthetic peptide
  Seed: EYRGRTELL (MOG_HUMAN)
EMRGRTELL

SEQ ID NO: 120332 - protein, 8 aa, Artificial Sequence
  Description of Artificial Sequence: Synthetic peptide
  Seed: LLAVLPVL (MOG_HUMAN)
LQAVLPVV

SEQ ID NO: 120333 - protein, 9 aa, Artificial Sequence
  Description of Artificial Sequence: Synthetic peptide
  Seed: ITLFVIVPV (MOG_HUMAN)
ILLFVIVPL

SEQ ID NO: 120334 - protein, 9 aa, Artificial Sequence
  Description of Artificial Sequence: Synthetic peptide
  Seed: GQFRVIGPR (MOG_HUMAN)
GSFRVIGPK

SEQ ID NO: 120335 - protein, 9 aa, Artificial Sequence
  Description of Artificial Sequence: Synthetic peptide
  Seed: RTFDPHFLR (MOG_HUMAN)
RNFDPHFLY

SEQ ID NO: 120336 - protein, 9 aa, Artificial Sequence
  Description of Artificial Sequence: Synthetic peptide
  Seed: SCLCSFLLL (MOG_HUMAN)
SQLCSFLLL

SEQ ID NO: 120337 - protein, 9 aa, Artificial Sequence
  Description of Artificial Sequence: Synthetic peptide
  Seed: AIGEGKVTL (MOG_HUMAN)
AVGEGKVTF

SEQ ID NO: 120338 - protein, 9 aa, Artificial Sequence
  Description of Artificial Sequence: Synthetic peptide
  Seed: LQYRLRGKL (MOG_HUMAN)
LMYRLRGKY

SEQ ID NO: 120339 - protein, 10 aa, Artificial Sequence
  Description of Artificial Sequence: Synthetic peptide
  Seed: RTFDPHFLRV (MOG_HUMAN)
RWFDPHFLRP

SEQ ID NO: 120340 - protein, 9 aa, Artificial Sequence
  Description of Artificial Sequence: Synthetic peptide
  Seed: LSRPSLPSC (MOG_HUMAN)
LSRPSLPSF

SEQ ID NO: 120341 - protein, 9 aa, Artificial Sequence
  Description of Artificial Sequence: Synthetic peptide
  Seed: LCSFLLLLL (MOG_HUMAN)
LISFLLLLV

SEQ ID NO: 120342 - protein, 10 aa, Artificial Sequence
  Description of Artificial Sequence: Synthetic peptide
  Seed: SLPSCLCSFL (MOG_HUMAN)
SMPSCLCSFL

SEQ ID NO: 120343 - protein, 8 aa, Artificial Sequence
  Description of Artificial Sequence: Synthetic peptide
  Seed: YNWLHRRL (MOG_HUMAN)
YMWLHRRL

SEQ ID NO: 120344 - protein, 10 aa, Artificial Sequence
  Description of Artificial Sequence: Synthetic peptide
  Seed: KNATGMEVGW (MOG_HUMAN)
KAATGMEVGW

SEQ ID NO: 120345 - protein, 10 aa, Artificial Sequence
  Description of Artificial Sequence: Synthetic peptide
  Seed: RIRNVRFSDE (MOG_HUMAN)
RTRNVRFSDI

SEQ ID NO: 120346 - protein, 9 aa, Artificial Sequence
  Description of Artificial Sequence: Synthetic peptide
  Seed: YQEEAAMEL (MOG_HUMAN)
YLEEAAMEL

SEQ ID NO: 120347 - protein, 9 aa, Artificial Sequence
  Description of Artificial Sequence: Synthetic peptide
  Seed: IVPVLGPLV (MOG_HUMAN)
ILPVLGPLV

SEQ ID NO: 120348 - protein, 9 aa, Artificial Sequence
  Description of Artificial Sequence: Synthetic peptide
  Seed: VVHLYRNGK (MOG_HUMAN)
VAHLYRNGR

SEQ ID NO: 120349 - protein, 10 aa, Artificial Sequence
  Description of Artificial Sequence: Synthetic peptide
  Seed: ITVGLIFLCL (MOG_HUMAN)
ILVGLIFLCL

SEQ ID NO: 120350 - protein, 10 aa, Artificial Sequence
  Description of Artificial Sequence: Synthetic peptide
  Seed: IGPRHPIRAL (MOG_HUMAN)
ICPRHPIRAF

SEQ ID NO: 120351 - protein, 10 aa, Artificial Sequence
  Description of Artificial Sequence: Synthetic peptide
  Seed: IGPRHPIRAL (MOG_HUMAN)
ISPRHPIRAI

SEQ ID NO: 120352 - protein, 10 aa, Artificial Sequence
  Description of Artificial Sequence: Synthetic peptide
  Seed: RIRNVRFSDE (MOG_HUMAN)
RVRNVRFSDY

SEQ ID NO: 120353 - protein, 9 aa, Artificial Sequence
  Description of Artificial Sequence: Synthetic peptide
  Seed: HRTFDPHFL (MOG_HUMAN)
HHTFDPHFV

SEQ ID NO: 120354 - protein, 9 aa, Artificial Sequence
  Description of Artificial Sequence: Synthetic peptide
  Seed: MASLSRPSL (MOG_HUMAN)
MRSLSRPSY

SEQ ID NO: 120355 - protein, 9 aa, Artificial Sequence
  Description of Artificial Sequence: Synthetic peptide
  Seed: WYRPPFSRV (MOG_HUMAN)
WYRPPFSRF

SEQ ID NO: 120356 - protein, 10 aa, Artificial Sequence
  Description of Artificial Sequence: Synthetic peptide
  Seed: FDPHFLRVPC (MOG_HUMAN)
FWPHFLRVPI

SEQ ID NO: 120357 - protein, 9 aa, Artificial Sequence
  Description of Artificial Sequence: Synthetic peptide
  Seed: YQEEAAMEL (MOG_HUMAN)
YPEEAAMEF

SEQ ID NO: 120358 - protein, 9 aa, Artificial Sequence
  Description of Artificial Sequence: Synthetic peptide
  Seed: SRPSLPSCL (MOG_HUMAN)
STPSLPSCL

SEQ ID NO: 120359 - protein, 9 aa, Artificial Sequence
  Description of Artificial Sequence: Synthetic peptide
  Seed: MASLSRPSL (MOG_HUMAN)
MASLSRPSF

SEQ ID NO: 120360 - protein, 10 aa, Artificial Sequence
  Description of Artificial Sequence: Synthetic peptide
  Seed: AEIENLHRTF (MOG_HUMAN)
AAIENLHRTF

SEQ ID NO: 120361 - protein, 8 aa, Artificial Sequence
  Description of Artificial Sequence: Synthetic peptide
  Seed: VIGPRHPI (MOG_HUMAN)
VSGPRHPI

SEQ ID NO: 120362 - protein, 9 aa, Artificial Sequence
  Description of Artificial Sequence: Synthetic peptide
  Seed: YQEEAAMEL (MOG_HUMAN)
YYEEAAMEI

SEQ ID NO: 120363 - protein, 9 aa, Artificial Sequence
  Description of Artificial Sequence: Synthetic peptide
  Seed: MASLSRPSL (MOG_HUMAN)
MPSLSRPST

SEQ ID NO: 120364 - protein, 10 aa, Artificial Sequence
  Description of Artificial Sequence: Synthetic peptide
  Seed: RTFDPHFLRV (MOG_HUMAN)
REFDPHFLRV

SEQ ID NO: 120365 - protein, 10 aa, Artificial Sequence
  Description of Artificial Sequence: Synthetic peptide
  Seed: ITVGLIFLCL (MOG_HUMAN)
IQVGLIFLCI

SEQ ID NO: 120366 - protein, 9 aa, Artificial Sequence
  Description of Artificial Sequence: Synthetic peptide
  Seed: AIGEGKVTL (MOG_HUMAN)
AMGEGKVTF

SEQ ID NO: 120367 - protein, 11 aa, Artificial Sequence
  Description of Artificial Sequence: Synthetic peptide
  Seed: HRTFDPHFLRV (MOG_HUMAN)
HMTFDPHFLRQ

SEQ ID NO: 120368 - protein, 10 aa, Artificial Sequence
  Description of Artificial Sequence: Synthetic peptide
  Seed: RIRNVRFSDE (MOG_HUMAN)
RARNVRFSDK

SEQ ID NO: 120369 - protein, 10 aa, Artificial Sequence
  Description of Artificial Sequence: Synthetic peptide
  Seed: ITVGLIFLCL (MOG_HUMAN)
IMVGLIFLCL

SEQ ID NO: 120370 - protein, 10 aa, Artificial Sequence
  Description of Artificial Sequence: Synthetic peptide
  Seed: RTFDPHFLRV (MOG_HUMAN)
RIFDPHFLRG

SEQ ID NO: 120371 - protein, 10 aa, Artificial Sequence
  Description of Artificial Sequence: Synthetic peptide
  Seed: VLLLQITVGL (MOG_HUMAN)
VQLLQITVGL

SEQ ID NO: 120372 - protein, 9 aa, Artificial Sequence
  Description of Artificial Sequence: Synthetic peptide
  Seed: SLPSCLCSF (MOG_HUMAN)
SQPSCLCSM

SEQ ID NO: 120373 - protein, 10 aa, Artificial Sequence
  Description of Artificial Sequence: Synthetic peptide
  Seed: FDPHFLRVPC (MOG_HUMAN)
FEPHFLRVPT

SEQ ID NO: 120374 - protein, 10 aa, Artificial Sequence
  Description of Artificial Sequence: Synthetic peptide
  Seed: FSDEGGFTCF (MOG_HUMAN)
FWDEGGFTCV

SEQ ID NO: 120375 - protein, 9 aa, Artificial Sequence
  Description of Artificial Sequence: Synthetic peptide
  Seed: LIICYNWLH (MOG_HUMAN)
LSICYNWLR

SEQ ID NO: 120376 - protein, 9 aa, Artificial Sequence
  Description of Artificial Sequence: Synthetic peptide
  Seed: VLGPLVALI (MOG_HUMAN)
VMGPLVALT

SEQ ID NO: 120377 - protein, 10 aa, Artificial Sequence
  Description of Artificial Sequence: Synthetic peptide
  Seed: YWVSPGVLVL (MOG_HUMAN)
YVVSPGVLVY

SEQ ID NO: 120378 - protein, 9 aa, Artificial Sequence
  Description of Artificial Sequence: Synthetic peptide
  Seed: LAGQFLEEL (MOG_HUMAN)
LVGQFLEEV

SEQ ID NO: 120379 - protein, 10 aa, Artificial Sequence
  Description of Artificial Sequence: Synthetic peptide
  Seed: FVIVPVLGPL (MOG_HUMAN)
FIIVPVLGPA

SEQ ID NO: 120380 - protein, 11 aa, Artificial Sequence
  Description of Artificial Sequence: Synthetic peptide
  Seed: RTFDPHFLRVP (MOG_HUMAN)
RMFDPHFLRVV

SEQ ID NO: 120381 - protein, 9 aa, Artificial Sequence
  Description of Artificial Sequence: Synthetic peptide
  Seed: LKVEDPFYW (MOG_HUMAN)
LMVEDPFYL

SEQ ID NO: 120382 - protein, 10 aa, Artificial Sequence
  Description of Artificial Sequence: Synthetic peptide
  Seed: RALVGDEVEL (MOG_HUMAN)
RMLVGDEVEF

SEQ ID NO: 120383 - protein, 8 aa, Artificial Sequence
  Description of Artificial Sequence: Synthetic peptide
  Seed: GGFTCFFR (MOG_HUMAN)
GFFTCFFR

SEQ ID NO: 120384 - protein, 8 aa, Artificial Sequence
  Description of Artificial Sequence: Synthetic peptide
  Seed: FSDEGGFT (MOG_HUMAN)
FSDEGGFF

SEQ ID NO: 120385 - protein, 9 aa, Artificial Sequence
  Description of Artificial Sequence: Synthetic peptide
  Seed: VSSSYAGQF (MOG_HUMAN)
VSSSYAGQY

SEQ ID NO: 120386 - protein, 9 aa, Artificial Sequence
  Description of Artificial Sequence: Synthetic peptide
  Seed: WVSPGVLVL (MOG_HUMAN)
WKSPGVLVL

SEQ ID NO: 120387 - protein, 10 aa, Artificial Sequence
  Description of Artificial Sequence: Synthetic peptide
  Seed: LVLLAVLPVL (MOG_HUMAN)
LCLLAVLPVV

SEQ ID NO: 120388 - protein, 9 aa, Artificial Sequence
  Description of Artificial Sequence: Synthetic peptide
  Seed: VGDEVELPC (MOG_HUMAN)
VADEVELPV

SEQ ID NO: 120389 - protein, 9 aa, Artificial Sequence
  Description of Artificial Sequence: Synthetic peptide
  Seed: FYWVSPGVL (MOG_HUMAN)
FVWVSPGVL

SEQ ID NO: 120390 - protein, 9 aa, Artificial Sequence
  Description of Artificial Sequence: Synthetic peptide
  Seed: VSPGVLVLL (MOG_HUMAN)
VTPGVLVLF

SEQ ID NO: 120391 - protein, 10 aa, Artificial Sequence
  Description of Artificial Sequence: Synthetic peptide
  Seed: FYWVSPGVLV (MOG_HUMAN)
FYWVSPGVLY

SEQ ID NO: 120392 - protein, 9 aa, Artificial Sequence
  Description of Artificial Sequence: Synthetic peptide
  Seed: TFDPHFLRV (MOG_HUMAN)
TVDPHFLRL

SEQ ID NO: 120393 - protein, 10 aa, Artificial Sequence
  Description of Artificial Sequence: Synthetic peptide
  Seed: FDPHFLRVPC (MOG_HUMAN)
FWPHFLRVPV

SEQ ID NO: 120394 - protein, 10 aa, Artificial Sequence
  Description of Artificial Sequence: Synthetic peptide
  Seed: RTFDPHFLRV (MOG_HUMAN)
RSFDPHFLRC

SEQ ID NO: 120395 - protein, 9 aa, Artificial Sequence
  Description of Artificial Sequence: Synthetic peptide
  Seed: FLEELRNPF (MOG_HUMAN)
FLEELRNPA

SEQ ID NO: 120396 - protein, 9 aa, Artificial Sequence
  Description of Artificial Sequence: Synthetic peptide
  Seed: LSRPSLPSC (MOG_HUMAN)
LSRPSLPSW

SEQ ID NO: 120397 - protein, 9 aa, Artificial Sequence
  Description of Artificial Sequence: Synthetic peptide
  Seed: ALVGDEVEL (MOG_HUMAN)
AIVGDEVEW

SEQ ID NO: 120398 - protein, 11 aa, Artificial Sequence
  Description of Artificial Sequence: Synthetic peptide
  Seed: GLIFLCLQYRL (MOG_HUMAN)
GLIFLCLQYRV

SEQ ID NO: 120399 - protein, 9 aa, Artificial Sequence
  Description of Artificial Sequence: Synthetic peptide
  Seed: AIGEGKVTL (MOG_HUMAN)
AAGEGKVTM

SEQ ID NO: 120400 - protein, 9 aa, Artificial Sequence
  Description of Artificial Sequence: Synthetic peptide
  Seed: RTFDPHFLR (MOG_HUMAN)
RAFDPHFLF

SEQ ID NO: 120401 - protein, 9 aa, Artificial Sequence
  Description of Artificial Sequence: Synthetic peptide
  Seed: LSRPSLPSC (MOG_HUMAN)
LIRPSLPSY

SEQ ID NO: 120402 - protein, 9 aa, Artificial Sequence
  Description of Artificial Sequence: Synthetic peptide
  Seed: VIVPVLGPL (MOG_HUMAN)
VLVPVLGPV

SEQ ID NO: 120403 - protein, 10 aa, Artificial Sequence
  Description of Artificial Sequence: Synthetic peptide
  Seed: KNATGMEVGW (MOG_HUMAN)
KAATGMEVGF

SEQ ID NO: 120404 - protein, 9 aa, Artificial Sequence
  Description of Artificial Sequence: Synthetic peptide
  Seed: FSDEGGFTC (MOG_HUMAN)
FDDEGGFTV

SEQ ID NO: 120405 - protein, 8 aa, Artificial Sequence
  Description of Artificial Sequence: Synthetic peptide
  Seed: FSRVVHLY (MOG_HUMAN)
FTRVVHLW

SEQ ID NO: 120406 - protein, 9 aa, Artificial Sequence
  Description of Artificial Sequence: Synthetic peptide
  Seed: HSYQEEAAM (MOG_HUMAN)
HAYQEEAAM

SEQ ID NO: 120407 - protein, 9 aa, Artificial Sequence
  Description of Artificial Sequence: Synthetic peptide
  Seed: LIFLCLQYR (MOG_HUMAN)
LMFLCLQYK

SEQ ID NO: 120408 - protein, 10 aa, Artificial Sequence
  Description of Artificial Sequence: Synthetic peptide
  Seed: VLLLQITVGL (MOG_HUMAN)
VNLLQITVGV

SEQ ID NO: 120409 - protein, 9 aa, Artificial Sequence
  Description of Artificial Sequence: Synthetic peptide
  Seed: LQVSSSYAG (MOG_HUMAN)
LLVSSSYAY

SEQ ID NO: 120410 - protein, 11 aa, Artificial Sequence
  Description of Artificial Sequence: Synthetic peptide
  Seed: RFSDEGGFTCF (MOG_HUMAN)
RISDEGGFTCW

SEQ ID NO: 120411 - protein, 9 aa, Artificial Sequence
  Description of Artificial Sequence: Synthetic peptide
  Seed: LLLQITVGL (MOG_HUMAN)
LLLQITVGT

SEQ ID NO: 120412 - protein, 10 aa, Artificial Sequence
  Description of Artificial Sequence: Synthetic peptide
  Seed: RTFDPHFLRV (MOG_HUMAN)
RQFDPHFLRE

SEQ ID NO: 120413 - protein, 9 aa, Artificial Sequence
  Description of Artificial Sequence: Synthetic peptide
  Seed: LQITVGLIF (MOG_HUMAN)
LLITVGLIY

SEQ ID NO: 120414 - protein, 9 aa, Artificial Sequence
  Description of Artificial Sequence: Synthetic peptide
  Seed: FLEELRNPF (MOG_HUMAN)
FPEELRNPF

SEQ ID NO: 120415 - protein, 10 aa, Artificial Sequence
  Description of Artificial Sequence: Synthetic peptide
  Seed: DEGGFTCFFR (MOG_HUMAN)
DSGGFTCFFK

SEQ ID NO: 120416 - protein, 9 aa, Artificial Sequence
  Description of Artificial Sequence: Synthetic peptide
  Seed: VSPGVLVLL (MOG_HUMAN)
VQPGVLVLY

SEQ ID NO: 120417 - protein, 8 aa, Artificial Sequence
  Description of Artificial Sequence: Synthetic peptide
  Seed: VIGPRHPI (MOG_HUMAN)
VAGPRHPI

SEQ ID NO: 120418 - protein, 10 aa, Artificial Sequence
  Description of Artificial Sequence: Synthetic peptide
  Seed: AEIENLHRTF (MOG_HUMAN)
AMIENLHRTY

SEQ ID NO: 120419 - protein, 10 aa, Artificial Sequence
  Description of Artificial Sequence: Synthetic peptide
  Seed: FVIVPVLGPL (MOG_HUMAN)
FAIVPVLGPA

SEQ ID NO: 120420 - protein, 9 aa, Artificial Sequence
  Description of Artificial Sequence: Synthetic peptide
  Seed: WVSPGVLVL (MOG_HUMAN)
WVSPGVLVM

SEQ ID NO: 120421 - protein, 10 aa, Artificial Sequence
  Description of Artificial Sequence: Synthetic peptide
  Seed: SSYAGQFRVI (MOG_HUMAN)
SAYAGQFRVW

SEQ ID NO: 120422 - protein, 10 aa, Artificial Sequence
  Description of Artificial Sequence: Synthetic peptide
  Seed: TGMEVGWYRP (MOG_HUMAN)
TFMEVGWYRE

SEQ ID NO: 120423 - protein, 9 aa, Artificial Sequence
  Description of Artificial Sequence: Synthetic peptide
  Seed: LQITVGLIF (MOG_HUMAN)
LRITVGLIF

SEQ ID NO: 120424 - protein, 10 aa, Artificial Sequence
  Description of Artificial Sequence: Synthetic peptide
  Seed: YWVSPGVLVL (MOG_HUMAN)
YSVSPGVLVY

SEQ ID NO: 120425 - protein, 10 aa, Artificial Sequence
  Description of Artificial Sequence: Synthetic peptide
  Seed: LVLLAVLPVL (MOG_HUMAN)
LDLLAVLPVL

SEQ ID NO: 120426 - protein, 9 aa, Artificial Sequence
  Description of Artificial Sequence: Synthetic peptide
  Seed: VLLAVLPVL (MOG_HUMAN)
VLLAVLPVM

SEQ ID NO: 120427 - protein, 10 aa, Artificial Sequence
  Description of Artificial Sequence: Synthetic peptide
  Seed: FVIVPVLGPL (MOG_HUMAN)
FFIVPVLGPI

SEQ ID NO: 120428 - protein, 10 aa, Artificial Sequence
  Description of Artificial Sequence: Synthetic peptide
  Seed: FDPHFLRVPC (MOG_HUMAN)
FLPHFLRVPI

SEQ ID NO: 120429 - protein, 9 aa, Artificial Sequence
  Description of Artificial Sequence: Synthetic peptide
  Seed: AIGEGKVTL (MOG_HUMAN)
APGEGKVTI

SEQ ID NO: 120430 - protein, 9 aa, Artificial Sequence
  Description of Artificial Sequence: Synthetic peptide
  Seed: TCFFRDHSY (MOG_HUMAN)
TMFFRDHSF

SEQ ID NO: 120431 - protein, 9 aa, Artificial Sequence
  Description of Artificial Sequence: Synthetic peptide
  Seed: MEVGWYRPP (MOG_HUMAN)
MEVGWYRPI

SEQ ID NO: 120432 - protein, 10 aa, Artificial Sequence
  Description of Artificial Sequence: Synthetic peptide
  Seed: KITLFVIVPV (MOG_HUMAN)
KLTLFVIVPA

SEQ ID NO: 120433 - protein, 10 aa, Artificial Sequence
  Description of Artificial Sequence: Synthetic peptide
  Seed: SLSRPSLPSC (MOG_HUMAN)
SFSRPSLPSI

SEQ ID NO: 120434 - protein, 10 aa, Artificial Sequence
  Description of Artificial Sequence: Synthetic peptide
  Seed: LIICYNWLHR (MOG_HUMAN)
LTICYNWLHK

SEQ ID NO: 120435 - protein, 9 aa, Artificial Sequence
  Description of Artificial Sequence: Synthetic peptide
  Seed: VPVLGPLVA (MOG_HUMAN)
VAVLGPLVI

SEQ ID NO: 120436 - protein, 9 aa, Artificial Sequence
  Description of Artificial Sequence: Synthetic peptide
  Seed: MASLSRPSL (MOG_HUMAN)
MASLSRPSY

SEQ ID NO: 120437 - protein, 9 aa, Artificial Sequence
  Description of Artificial Sequence: Synthetic peptide
  Seed: YQEEAAMEL (MOG_HUMAN)
YQEEAAMEW

SEQ ID NO: 120438 - protein, 9 aa, Artificial Sequence
  Description of Artificial Sequence: Synthetic peptide
  Seed: AIGEGKVTL (MOG_HUMAN)
ARGEGKVTV

SEQ ID NO: 120439 - protein, 10 aa, Artificial Sequence
  Description of Artificial Sequence: Synthetic peptide
  Seed: GPRHPIRALV (MOG_HUMAN)
GPRHPIRALI

SEQ ID NO: 120440 - protein, 10 aa, Artificial Sequence
  Description of Artificial Sequence: Synthetic peptide
  Seed: KITLFVIVPV (MOG_HUMAN)
KSTLFVIVPV

SEQ ID NO: 120441 - protein, 9 aa, Artificial Sequence
  Description of Artificial Sequence: Synthetic peptide
  Seed: CSFLLLLLL (MOG_HUMAN)
CSFLLLLLY

SEQ ID NO: 120442 - protein, 10 aa, Artificial Sequence
  Description of Artificial Sequence: Synthetic peptide
  Seed: PVLGPLVALI (MOG_HUMAN)
PLLGPLVALL

SEQ ID NO: 120443 - protein, 11 aa, Artificial Sequence
  Description of Artificial Sequence: Synthetic peptide
  Seed: GLIFLCLQYRL (MOG_HUMAN)
GMIFLCLQYRV

SEQ ID NO: 120444 - protein, 10 aa, Artificial Sequence
  Description of Artificial Sequence: Synthetic peptide
  Seed: RTFDPHFLRV (MOG_HUMAN)
RSFDPHFLRA

SEQ ID NO: 120445 - protein, 9 aa, Artificial Sequence
  Description of Artificial Sequence: Synthetic peptide
  Seed: FYWVSPGVL (MOG_HUMAN)
FKWVSPGVF

SEQ ID NO: 120446 - protein, 10 aa, Artificial Sequence
  Description of Artificial Sequence: Synthetic peptide
  Seed: FTCFFRDHSY (MOG_HUMAN)
FSCFFRDHSW

SEQ ID NO: 120447 - protein, 8 aa, Artificial Sequence
  Description of Artificial Sequence: Synthetic peptide
  Seed: FSDEGGFT (MOG_HUMAN)
FMDEGGFV

SEQ ID NO: 120448 - protein, 9 aa, Artificial Sequence
  Description of Artificial Sequence: Synthetic peptide
  Seed: RIRNVRFSD (MOG_HUMAN)
RMRNVRFSP

SEQ ID NO: 120449 - protein, 9 aa, Artificial Sequence
  Description of Artificial Sequence: Synthetic peptide
  Seed: VLPVLLLQI (MOG_HUMAN)
VAPVLLLQF

SEQ ID NO: 120450 - protein, 10 aa, Artificial Sequence
  Description of Artificial Sequence: Synthetic peptide
  Seed: RIRNVRFSDE (MOG_HUMAN)
RTRNVRFSDT

SEQ ID NO: 120451 - protein, 10 aa, Artificial Sequence
  Description of Artificial Sequence: Synthetic peptide
  Seed: FDPHFLRVPC (MOG_HUMAN)
FGPHFLRVPS

SEQ ID NO: 120452 - protein, 10 aa, Artificial Sequence
  Description of Artificial Sequence: Synthetic peptide
  Seed: LLLQITVGLI (MOG_HUMAN)
LVLQITVGLV

SEQ ID NO: 120453 - protein, 9 aa, Artificial Sequence
  Description of Artificial Sequence: Synthetic peptide
  Seed: AIGEGKVTL (MOG_HUMAN)
ALGEGKVTL

SEQ ID NO: 120454 - protein, 10 aa, Artificial Sequence
  Description of Artificial Sequence: Synthetic peptide
  Seed: SCLCSFLLLL (MOG_HUMAN)
SCLCSFLLLV

SEQ ID NO: 120455 - protein, 9 aa, Artificial Sequence
  Description of Artificial Sequence: Synthetic peptide
  Seed: RDHSYQEEA (MOG_HUMAN)
REHSYQEEM

SEQ ID NO: 120456 - protein, 9 aa, Artificial Sequence
  Description of Artificial Sequence: Synthetic peptide
  Seed: LQYRLRGKL (MOG_HUMAN)
LMYRLRGKM

SEQ ID NO: 120457 - protein, 9 aa, Artificial Sequence
  Description of Artificial Sequence: Synthetic peptide
  Seed: HSYQEEAAM (MOG_HUMAN)
HIYQEEAAF

SEQ ID NO: 120458 - protein, 11 aa, Artificial Sequence
  Description of Artificial Sequence: Synthetic peptide
  Seed: KDQDGDQAPEY (MOG_HUMAN)
KEQDGDQAPEF

SEQ ID NO: 120459 - protein, 9 aa, Artificial Sequence
  Description of Artificial Sequence: Synthetic peptide
  Seed: SRPSLPSCL (MOG_HUMAN)
SIPSLPSCV

SEQ ID NO: 120460 - protein, 9 aa, Artificial Sequence
  Description of Artificial Sequence: Synthetic peptide
  Seed: TFDPHFLRV (MOG_HUMAN)
TLDPHFLRF

SEQ ID NO: 120461 - protein, 10 aa, Artificial Sequence
  Description of Artificial Sequence: Synthetic peptide
  Seed: SSYAGQFRVI (MOG_HUMAN)
SCYAGQFRVF

SEQ ID NO: 120462 - protein, 9 aa, Artificial Sequence
  Description of Artificial Sequence: Synthetic peptide
  Seed: IRALVGDEV (MOG_HUMAN)
IHALVGDEA

SEQ ID NO: 120463 - protein, 9 aa, Artificial Sequence
  Description of Artificial Sequence: Synthetic peptide
  Seed: GLIFLCLQY (MOG_HUMAN)
GQIFLCLQY

SEQ ID NO: 120464 - protein, 11 aa, Artificial Sequence
  Description of Artificial Sequence: Synthetic peptide
  Seed: HSYQEEAAMEL (MOG_HUMAN)
HAYQEEAAMEW

SEQ ID NO: 120465 - protein, 10 aa, Artificial Sequence
  Description of Artificial Sequence: Synthetic peptide
  Seed: LLAVLPVLLL (MOG_HUMAN)
LMAVLPVLLA

SEQ ID NO: 120466 - protein, 9 aa, Artificial Sequence
  Description of Artificial Sequence: Synthetic peptide
  Seed: LLLQITVGL (MOG_HUMAN)
LQLQITVGV

SEQ ID NO: 120467 - protein, 11 aa, Artificial Sequence
  Description of Artificial Sequence: Synthetic peptide
  Seed: FSDEGGFTCFF (MOG_HUMAN)
FSDEGGFTCFW

SEQ ID NO: 120468 - protein, 10 aa, Artificial Sequence
  Description of Artificial Sequence: Synthetic peptide
  Seed: LIFLCLQYRL (MOG_HUMAN)
LMFLCLQYRA

SEQ ID NO: 120469 - protein, 11 aa, Artificial Sequence
  Description of Artificial Sequence: Synthetic peptide
  Seed: FSDEGGFTCFF (MOG_HUMAN)
FLDEGGFTCFY

SEQ ID NO: 120470 - protein, 9 aa, Artificial Sequence
  Description of Artificial Sequence: Synthetic peptide
  Seed: LSRPSLPSC (MOG_HUMAN)
LTRPSLPSL

SEQ ID NO: 120471 - protein, 10 aa, Artificial Sequence
  Description of Artificial Sequence: Synthetic peptide
  Seed: RTFDPHFLRV (MOG_HUMAN)
RYFDPHFLRI

SEQ ID NO: 120472 - protein, 10 aa, Artificial Sequence
  Description of Artificial Sequence: Synthetic peptide
  Seed: PFSRVVHLYR (MOG_HUMAN)
PRSRVVHLYR

SEQ ID NO: 120473 - protein, 10 aa, Artificial Sequence
  Description of Artificial Sequence: Synthetic peptide
  Seed: IFLCLQYRLR (MOG_HUMAN)
IMLCLQYRLR

SEQ ID NO: 120474 - protein, 9 aa, Artificial Sequence
  Description of Artificial Sequence: Synthetic peptide
  Seed: RIRNVRFSD (MOG_HUMAN)
RVRNVRFSD

SEQ ID NO: 120475 - protein, 9 aa, Artificial Sequence
  Description of Artificial Sequence: Synthetic peptide
  Seed: LLLQVSSSY (MOG_HUMAN)
LLLQVSSSF

SEQ ID NO: 120476 - protein, 10 aa, Artificial Sequence
  Description of Artificial Sequence: Synthetic peptide
  Seed: LLLQITVGLI (MOG_HUMAN)
LMLQITVGLV

SEQ ID NO: 120477 - protein, 11 aa, Artificial Sequence
  Description of Artificial Sequence: Synthetic peptide
  Seed: LHRTFDPHFLR (MOG_HUMAN)
LYRTFDPHFLR

SEQ ID NO: 120478 - protein, 11 aa, Artificial Sequence
  Description of Artificial Sequence: Synthetic peptide
  Seed: VPVLGPLVALI (MOG_HUMAN)
VYVLGPLVALV

SEQ ID NO: 120479 - protein, 9 aa, Artificial Sequence
  Description of Artificial Sequence: Synthetic peptide
  Seed: VGDEVELPC (MOG_HUMAN)
VTDEVELPV

SEQ ID NO: 120480 - protein, 10 aa, Artificial Sequence
  Description of Artificial Sequence: Synthetic peptide
  Seed: ITVGLIFLCL (MOG_HUMAN)
IQVGLIFLCL

SEQ ID NO: 120481 - protein, 9 aa, Artificial Sequence
  Description of Artificial Sequence: Synthetic peptide
  Seed: MASLSRPSL (MOG_HUMAN)
MLSLSRPSV

SEQ ID NO: 120482 - protein, 10 aa, Artificial Sequence
  Description of Artificial Sequence: Synthetic peptide
  Seed: VLLAVLPVLL (MOG_HUMAN)
VWLAVLPVLV

SEQ ID NO: 120483 - protein, 9 aa, Artificial Sequence
  Description of Artificial Sequence: Synthetic peptide
  Seed: SLPSCLCSF (MOG_HUMAN)
SLPSCLCSM

SEQ ID NO: 120484 - protein, 10 aa, Artificial Sequence
  Description of Artificial Sequence: Synthetic peptide
  Seed: SLSRPSLPSC (MOG_HUMAN)
SGSRPSLPSI

SEQ ID NO: 120485 - protein, 11 aa, Artificial Sequence
  Description of Artificial Sequence: Synthetic peptide
  Seed: FSDEGGFTCFF (MOG_HUMAN)
FADEGGFTCFW

SEQ ID NO: 120486 - protein, 10 aa, Artificial Sequence
  Description of Artificial Sequence: Synthetic peptide
  Seed: VLLLQITVGL (MOG_HUMAN)
VRLLQITVGL

SEQ ID NO: 120487 - protein, 9 aa, Artificial Sequence
  Description of Artificial Sequence: Synthetic peptide
  Seed: VLLAVLPVL (MOG_HUMAN)
VTLAVLPVL

SEQ ID NO: 120488 - protein, 9 aa, Artificial Sequence
  Description of Artificial Sequence: Synthetic peptide
  Seed: VGDEVELPC (MOG_HUMAN)
VGDEVELPI

SEQ ID NO: 120489 - protein, 10 aa, Artificial Sequence
  Description of Artificial Sequence: Synthetic peptide
  Seed: FSDEGGFTCF (MOG_HUMAN)
FYDEGGFTCI

SEQ ID NO: 120490 - protein, 10 aa, Artificial Sequence
  Description of Artificial Sequence: Synthetic peptide
  Seed: DAIGEGKVTL (MOG_HUMAN)
DAIGEGKVTR

SEQ ID NO: 120491 - protein, 10 aa, Artificial Sequence
  Description of Artificial Sequence: Synthetic peptide
  Seed: LPSCLCSFLL (MOG_HUMAN)
LASCLCSFLW

SEQ ID NO: 120492 - protein, 9 aa, Artificial Sequence
  Description of Artificial Sequence: Synthetic peptide
  Seed: LGPLVALII (MOG_HUMAN)
LAPLVALIM

SEQ ID NO: 120493 - protein, 9 aa, Artificial Sequence
  Description of Artificial Sequence: Synthetic peptide
  Seed: LAVLPVLLL (MOG_HUMAN)
LSVLPVLLW

SEQ ID NO: 120494 - protein, 10 aa, Artificial Sequence
  Description of Artificial Sequence: Synthetic peptide
  Seed: LLLQVSSSYA (MOG_HUMAN)
LMLQVSSSYQ

SEQ ID NO: 120495 - protein, 9 aa, Artificial Sequence
  Description of Artificial Sequence: Synthetic peptide
  Seed: RTFDPHFLR (MOG_HUMAN)
RKFDPHFLY

SEQ ID NO: 120496 - protein, 10 aa, Artificial Sequence
  Description of Artificial Sequence: Synthetic peptide
  Seed: RLAGQFLEEL (MOG_HUMAN)
RLAGQFLEEY

SEQ ID NO: 120497 - protein, 11 aa, Artificial Sequence
  Description of Artificial Sequence: Synthetic peptide
  Seed: RFSDEGGFTCF (MOG_HUMAN)
RQSDEGGFTCV

SEQ ID NO: 120498 - protein, 9 aa, Artificial Sequence
  Description of Artificial Sequence: Synthetic peptide
  Seed: LSRPSLPSC (MOG_HUMAN)
LMRPSLPSW

SEQ ID NO: 120499 - protein, 9 aa, Artificial Sequence
  Description of Artificial Sequence: Synthetic peptide
  Seed: MELKVEDPF (MOG_HUMAN)
MELKVEDPV

SEQ ID NO: 120500 - protein, 9 aa, Artificial Sequence
  Description of Artificial Sequence: Synthetic peptide
  Seed: RIRNVRFSD (MOG_HUMAN)
RGRNVRFSV

SEQ ID NO: 120501 - protein, 9 aa, Artificial Sequence
  Description of Artificial Sequence: Synthetic peptide
  Seed: AIGEGKVTL (MOG_HUMAN)
APGEGKVTL

SEQ ID NO: 120502 - protein, 10 aa, Artificial Sequence
  Description of Artificial Sequence: Synthetic peptide
  Seed: VLLLQITVGL (MOG_HUMAN)
VWLLQITVGI

SEQ ID NO: 120503 - protein, 9 aa, Artificial Sequence
  Description of Artificial Sequence: Synthetic peptide
  Seed: LLAVLPVLL (MOG_HUMAN)
LMAVLPVLL

SEQ ID NO: 120504 - protein, 10 aa, Artificial Sequence
  Description of Artificial Sequence: Synthetic peptide
  Seed: YRPPFSRVVH (MOG_HUMAN)
YRPPFSRVVY

SEQ ID NO: 120505 - protein, 10 aa, Artificial Sequence
  Description of Artificial Sequence: Synthetic peptide
  Seed: RVPCWKITLF (MOG_HUMAN)
RYPCWKITLV

SEQ ID NO: 120506 - protein, 9 aa, Artificial Sequence
  Description of Artificial Sequence: Synthetic peptide
  Seed: GPRHPIRAL (MOG_HUMAN)
GPRHPIRAP

SEQ ID NO: 120507 - protein, 9 aa, Artificial Sequence
  Description of Artificial Sequence: Synthetic peptide
  Seed: YQEEAAMEL (MOG_HUMAN)
YIEEAAMEV

SEQ ID NO: 120508 - protein, 10 aa, Artificial Sequence
  Description of Artificial Sequence: Synthetic peptide
  Seed: RTFDPHFLRV (MOG_HUMAN)
RIFDPHFLRQ

SEQ ID NO: 120509 - protein, 9 aa, Artificial Sequence
  Description of Artificial Sequence: Synthetic peptide
  Seed: VIVPVLGPL (MOG_HUMAN)
VMVPVLGPA

SEQ ID NO: 120510 - protein, 9 aa, Artificial Sequence
  Description of Artificial Sequence: Synthetic peptide
  Seed: VIVPVLGPL (MOG_HUMAN)
VMVPVLGPM

SEQ ID NO: 120511 - protein, 9 aa, Artificial Sequence
  Description of Artificial Sequence: Synthetic peptide
  Seed: RVIGPRHPI (MOG_HUMAN)
RTIGPRHPK

SEQ ID NO: 120512 - protein, 9 aa, Artificial Sequence
  Description of Artificial Sequence: Synthetic peptide
  Seed: VLGPLVALI (MOG_HUMAN)
VMGPLVALI

SEQ ID NO: 120513 - protein, 9 aa, Artificial Sequence
  Description of Artificial Sequence: Synthetic peptide
  Seed: YQEEAAMEL (MOG_HUMAN)
YLEEAAMEI

SEQ ID NO: 120514 - protein, 10 aa, Artificial Sequence
  Description of Artificial Sequence: Synthetic peptide
  Seed: VPVLGPLVAL (MOG_HUMAN)
VVVLGPLVAV

SEQ ID NO: 120515 - protein, 9 aa, Artificial Sequence
  Description of Artificial Sequence: Synthetic peptide
  Seed: VLPVLLLQI (MOG_HUMAN)
VAPVLLLQM

SEQ ID NO: 120516 - protein, 9 aa, Artificial Sequence
  Description of Artificial Sequence: Synthetic peptide
  Seed: SSYAGQFRV (MOG_HUMAN)
SQYAGQFRR

SEQ ID NO: 120517 - protein, 10 aa, Artificial Sequence
  Description of Artificial Sequence: Synthetic peptide
  Seed: SLSRPSLPSC (MOG_HUMAN)
STSRPSLPSS

SEQ ID NO: 120518 - protein, 9 aa, Artificial Sequence
  Description of Artificial Sequence: Synthetic peptide
  Seed: TFDPHFLRV (MOG_HUMAN)
TGDPHFLRL

SEQ ID NO: 120519 - protein, 9 aa, Artificial Sequence
  Description of Artificial Sequence: Synthetic peptide
  Seed: RVIGPRHPI (MOG_HUMAN)
RGIGPRHPY

SEQ ID NO: 120520 - protein, 11 aa, Artificial Sequence
  Description of Artificial Sequence: Synthetic peptide
  Seed: QVSSSYAGQFR (MOG_HUMAN)
QTSSSYAGQFR

SEQ ID NO: 120521 - protein, 9 aa, Artificial Sequence
  Description of Artificial Sequence: Synthetic peptide
  Seed: LAVLPVLLL (MOG_HUMAN)
LTVLPVLLY

SEQ ID NO: 120522 - protein, 9 aa, Artificial Sequence
  Description of Artificial Sequence: Synthetic peptide
  Seed: LLLQVSSSY (MOG_HUMAN)
LVLQVSSSY

SEQ ID NO: 120523 - protein, 9 aa, Artificial Sequence
  Description of Artificial Sequence: Synthetic peptide
  Seed: RIRNVRFSD (MOG_HUMAN)
RFRNVRFSQ

SEQ ID NO: 120524 - protein, 10 aa, Artificial Sequence
  Description of Artificial Sequence: Synthetic peptide
  Seed: FDPHFLRVPC (MOG_HUMAN)
FWPHFLRVPA

SEQ ID NO: 120525 - protein, 10 aa, Artificial Sequence
  Description of Artificial Sequence: Synthetic peptide
  Seed: AVLPVLLLQI (MOG_HUMAN)
AILPVLLLQV

SEQ ID NO: 120526 - protein, 10 aa, Artificial Sequence
  Description of Artificial Sequence: Synthetic peptide
  Seed: WLHRRLAGQF (MOG_HUMAN)
WMHRRLAGQM

SEQ ID NO: 120527 - protein, 9 aa, Artificial Sequence
  Description of Artificial Sequence: Synthetic peptide
  Seed: YRPPFSRVV (MOG_HUMAN)
YWPPFSRVI

SEQ ID NO: 120528 - protein, 9 aa, Artificial Sequence
  Description of Artificial Sequence: Synthetic peptide
  Seed: RVIGPRHPI (MOG_HUMAN)
RLIGPRHPA

SEQ ID NO: 120529 - protein, 10 aa, Artificial Sequence
  Description of Artificial Sequence: Synthetic peptide
  Seed: FVIVPVLGPL (MOG_HUMAN)
FRIVPVLGPA

SEQ ID NO: 120530 - protein, 9 aa, Artificial Sequence
  Description of Artificial Sequence: Synthetic peptide
  Seed: LQITVGLIF (MOG_HUMAN)
LMITVGLII

SEQ ID NO: 120531 - protein, 9 aa, Artificial Sequence
  Description of Artificial Sequence: Synthetic peptide
  Seed: LQITVGLIF (MOG_HUMAN)
LAITVGLIM

SEQ ID NO: 120532 - protein, 9 aa, Artificial Sequence
  Description of Artificial Sequence: Synthetic peptide
  Seed: LLLQITVGL (MOG_HUMAN)
LTLQITVGV

SEQ ID NO: 120533 - protein, 9 aa, Artificial Sequence
  Description of Artificial Sequence: Synthetic peptide
  Seed: RIRNVRFSD (MOG_HUMAN)
RSRNVRFSF

SEQ ID NO: 120534 - protein, 9 aa, Artificial Sequence
  Description of Artificial Sequence: Synthetic peptide
  Seed: ALVGDEVEL (MOG_HUMAN)
AQVGDEVEM

SEQ ID NO: 120535 - protein, 11 aa, Artificial Sequence
  Description of Artificial Sequence: Synthetic peptide
  Seed: RFSDEGGFTCF (MOG_HUMAN)
RQSDEGGFTCI

SEQ ID NO: 120536 - protein, 9 aa, Artificial Sequence
  Description of Artificial Sequence: Synthetic peptide
  Seed: RVPCWKITL (MOG_HUMAN)
RMPCWKITK

SEQ ID NO: 120537 - protein, 9 aa, Artificial Sequence
  Description of Artificial Sequence: Synthetic peptide
  Seed: PVLGPLVAL (MOG_HUMAN)
PALGPLVAY

SEQ ID NO: 120538 - protein, 10 aa, Artificial Sequence
  Description of Artificial Sequence: Synthetic peptide
  Seed: CLCSFLLLLL (MOG_HUMAN)
CMCSFLLLLV

SEQ ID NO: 120539 - protein, 10 aa, Artificial Sequence
  Description of Artificial Sequence: Synthetic peptide
  Seed: FTCFFRDHSY (MOG_HUMAN)
FTCFFRDHSW

SEQ ID NO: 120540 - protein, 9 aa, Artificial Sequence
  Description of Artificial Sequence: Synthetic peptide
  Seed: SSYAGQFRV (MOG_HUMAN)
STYAGQFRI

SEQ ID NO: 120541 - protein, 10 aa, Artificial Sequence
  Description of Artificial Sequence: Synthetic peptide
  Seed: RTFDPHFLRV (MOG_HUMAN)
RYFDPHFLRA

SEQ ID NO: 120542 - protein, 10 aa, Artificial Sequence
  Description of Artificial Sequence: Synthetic peptide
  Seed: YWVSPGVLVL (MOG_HUMAN)
YLVSPGVLVM

SEQ ID NO: 120543 - protein, 9 aa, Artificial Sequence
  Description of Artificial Sequence: Synthetic peptide
  Seed: SSYAGQFRV (MOG_HUMAN)
SSYAGQFRI

SEQ ID NO: 120544 - protein, 10 aa, Artificial Sequence
  Description of Artificial Sequence: Synthetic peptide
  Seed: SLSRPSLPSC (MOG_HUMAN)
SISRPSLPSI

SEQ ID NO: 120545 - protein, 9 aa, Artificial Sequence
  Description of Artificial Sequence: Synthetic peptide
  Seed: RVIGPRHPI (MOG_HUMAN)
RMIGPRHPR

SEQ ID NO: 120546 - protein, 11 aa, Artificial Sequence
  Description of Artificial Sequence: Synthetic peptide
  Seed: RISPGKNATGM (MOG_HUMAN)
RPSPGKNATGC

SEQ ID NO: 120547 - protein, 9 aa, Artificial Sequence
  Description of Artificial Sequence: Synthetic peptide
  Seed: HSYQEEAAM (MOG_HUMAN)
HPYQEEAAW

SEQ ID NO: 120548 - protein, 9 aa, Artificial Sequence
  Description of Artificial Sequence: Synthetic peptide
  Seed: RTFDPHFLR (MOG_HUMAN)
RLFDPHFLY

SEQ ID NO: 120549 - protein, 9 aa, Artificial Sequence
  Description of Artificial Sequence: Synthetic peptide
  Seed: SRPSLPSCL (MOG_HUMAN)
SYPSLPSCM

SEQ ID NO: 120550 - protein, 9 aa, Artificial Sequence
  Description of Artificial Sequence: Synthetic peptide
  Seed: AIGEGKVTL (MOG_HUMAN)
ASGEGKVTI

SEQ ID NO: 120551 - protein, 9 aa, Artificial Sequence
  Description of Artificial Sequence: Synthetic peptide
  Seed: FSDEGGFTC (MOG_HUMAN)
FTDEGGFTC

SEQ ID NO: 120552 - protein, 9 aa, Artificial Sequence
  Description of Artificial Sequence: Synthetic peptide
  Seed: WVSPGVLVL (MOG_HUMAN)
WNSPGVLVY

SEQ ID NO: 120553 - protein, 9 aa, Artificial Sequence
  Description of Artificial Sequence: Synthetic peptide
  Seed: RIRNVRFSD (MOG_HUMAN)
RYRNVRFSE

SEQ ID NO: 120554 - protein, 8 aa, Artificial Sequence
  Description of Artificial Sequence: Synthetic peptide
  Seed: FSDEGGFT (MOG_HUMAN)
FNDEGGFL

SEQ ID NO: 120555 - protein, 9 aa, Artificial Sequence
  Description of Artificial Sequence: Synthetic peptide
  Seed: TFDPHFLRV (MOG_HUMAN)
TWDPHFLRI

SEQ ID NO: 120556 - protein, 10 aa, Artificial Sequence
  Description of Artificial Sequence: Synthetic peptide
  Seed: FTCFFRDHSY (MOG_HUMAN)
FMCFFRDHSR

SEQ ID NO: 120557 - protein, 9 aa, Artificial Sequence
  Description of Artificial Sequence: Synthetic peptide
  Seed: FYWVSPGVL (MOG_HUMAN)
FYWVSPGVV

SEQ ID NO: 120558 - protein, 9 aa, Artificial Sequence
  Description of Artificial Sequence: Synthetic peptide
  Seed: ITVGLIFLC (MOG_HUMAN)
IAVGLIFLV

SEQ ID NO: 120559 - protein, 9 aa, Artificial Sequence
  Description of Artificial Sequence: Synthetic peptide
  Seed: TFDPHFLRV (MOG_HUMAN)
TTDPHFLRI

SEQ ID NO: 120560 - protein, 10 aa, Artificial Sequence
  Description of Artificial Sequence: Synthetic peptide
  Seed: IICYNWLHRR (MOG_HUMAN)
IFCYNWLHRR

SEQ ID NO: 120561 - protein, 10 aa, Artificial Sequence
  Description of Artificial Sequence: Synthetic peptide
  Seed: LIFLCLQYRL (MOG_HUMAN)
LWFLCLQYRK

SEQ ID NO: 120562 - protein, 9 aa, Artificial Sequence
  Description of Artificial Sequence: Synthetic peptide
  Seed: SSYAGQFRV (MOG_HUMAN)
STYAGQFRK

SEQ ID NO: 120563 - protein, 8 aa, Artificial Sequence
  Description of Artificial Sequence: Synthetic peptide
  Seed: TLFVIVPV (MOG_HUMAN)
TQFVIVPI

SEQ ID NO: 120564 - protein, 9 aa, Artificial Sequence
  Description of Artificial Sequence: Synthetic peptide
  Seed: SLPSCLCSF (MOG_HUMAN)
SAPSCLCSM

SEQ ID NO: 120565 - protein, 9 aa, Artificial Sequence
  Description of Artificial Sequence: Synthetic peptide
  Seed: RVIGPRHPI (MOG_HUMAN)
RYIGPRHPV

SEQ ID NO: 120566 - protein, 10 aa, Artificial Sequence
  Description of Artificial Sequence: Synthetic peptide
  Seed: LLLLQVSSSY (MOG_HUMAN)
LPLLQVSSSF

SEQ ID NO: 120567 - protein, 10 aa, Artificial Sequence
  Description of Artificial Sequence: Synthetic peptide
  Seed: LLLLQVSSSY (MOG_HUMAN)
LTLLQVSSSF

SEQ ID NO: 120568 - protein, 11 aa, Artificial Sequence
  Description of Artificial Sequence: Synthetic peptide
  Seed: FSDEGGFTCFF (MOG_HUMAN)
FVDEGGFTCFL

SEQ ID NO: 120569 - protein, 9 aa, Artificial Sequence
  Description of Artificial Sequence: Synthetic peptide
  Seed: RTELLKDAI (MOG_HUMAN)
RQELLKDAI

SEQ ID NO: 120570 - protein, 9 aa, Artificial Sequence
  Description of Artificial Sequence: Synthetic peptide
  Seed: MEVGWYRPP (MOG_HUMAN)
MEVGWYRPF

SEQ ID NO: 120571 - protein, 10 aa, Artificial Sequence
  Description of Artificial Sequence: Synthetic peptide
  Seed: SCLCSFLLLL (MOG_HUMAN)
SSLCSFLLLV

SEQ ID NO: 120572 - protein, 9 aa, Artificial Sequence
  Description of Artificial Sequence: Synthetic peptide
  Seed: FSDEGGFTC (MOG_HUMAN)
FLDEGGFTV

SEQ ID NO: 120573 - protein, 9 aa, Artificial Sequence
  Description of Artificial Sequence: Synthetic peptide
  Seed: FLLLLLLQV (MOG_HUMAN)
FMLLLLLQL

SEQ ID NO: 120574 - protein, 10 aa, Artificial Sequence
  Description of Artificial Sequence: Synthetic peptide
  Seed: RALVGDEVEL (MOG_HUMAN)
RQLVGDEVEV

SEQ ID NO: 120575 - protein, 10 aa, Artificial Sequence
  Description of Artificial Sequence: Synthetic peptide
  Seed: TGMEVGWYRP (MOG_HUMAN)
TVMEVGWYRP

SEQ ID NO: 120576 - protein, 9 aa, Artificial Sequence
  Description of Artificial Sequence: Synthetic peptide
  Seed: ALVGDEVEL (MOG_HUMAN)
ALVGDEVEV

SEQ ID NO: 120577 - protein, 9 aa, Artificial Sequence
  Description of Artificial Sequence: Synthetic peptide
  Seed: VSPGVLVLL (MOG_HUMAN)
VYPGVLVLW

SEQ ID NO: 120578 - protein, 9 aa, Artificial Sequence
  Description of Artificial Sequence: Synthetic peptide
  Seed: RIRNVRFSD (MOG_HUMAN)
RYRNVRFSV

SEQ ID NO: 120579 - protein, 10 aa, Artificial Sequence
  Description of Artificial Sequence: Synthetic peptide
  Seed: LLQITVGLIF (MOG_HUMAN)
LRQITVGLIM

SEQ ID NO: 120580 - protein, 10 aa, Artificial Sequence
  Description of Artificial Sequence: Synthetic peptide
  Seed: WVSPGVLVLL (MOG_HUMAN)
WTSPGVLVLA

SEQ ID NO: 120581 - protein, 10 aa, Artificial Sequence
  Description of Artificial Sequence: Synthetic peptide
  Seed: IGPRHPIRAL (MOG_HUMAN)
IPPRHPIRAI

SEQ ID NO: 120582 - protein, 9 aa, Artificial Sequence
  Description of Artificial Sequence: Synthetic peptide
  Seed: MASLSRPSL (MOG_HUMAN)
MESLSRPSY

SEQ ID NO: 120583 - protein, 11 aa, Artificial Sequence
  Description of Artificial Sequence: Synthetic peptide
  Seed: VIGPRHPIRAL (MOG_HUMAN)
VSGPRHPIRAM

SEQ ID NO: 120584 - protein, 11 aa, Artificial Sequence
  Description of Artificial Sequence: Synthetic peptide
  Seed: FSDEGGFTCFF (MOG_HUMAN)
FVDEGGFTCFF

SEQ ID NO: 120585 - protein, 10 aa, Artificial Sequence
  Description of Artificial Sequence: Synthetic peptide
  Seed: RTFDPHFLRV (MOG_HUMAN)
RMFDPHFLRH

SEQ ID NO: 120586 - protein, 9 aa, Artificial Sequence
  Description of Artificial Sequence: Synthetic peptide
  Seed: RIRNVRFSD (MOG_HUMAN)
RNRNVRFSM

SEQ ID NO: 120587 - protein, 10 aa, Artificial Sequence
  Description of Artificial Sequence: Synthetic peptide
  Seed: VPVLGPLVAL (MOG_HUMAN)
VGVLGPLVAV

SEQ ID NO: 120588 - protein, 11 aa, Artificial Sequence
  Description of Artificial Sequence: Synthetic peptide
  Seed: RDHSYQEEAAM (MOG_HUMAN)
RQHSYQEEAAY

SEQ ID NO: 120589 - protein, 10 aa, Artificial Sequence
  Description of Artificial Sequence: Synthetic peptide
  Seed: LLQITVGLIF (MOG_HUMAN)
LGQITVGLIM

SEQ ID NO: 120590 - protein, 10 aa, Artificial Sequence
  Description of Artificial Sequence: Synthetic peptide
  Seed: HRTFDPHFLR (MOG_HUMAN)
HRTFDPHFLY

SEQ ID NO: 120591 - protein, 9 aa, Artificial Sequence
  Description of Artificial Sequence: Synthetic peptide
  Seed: RIRNVRFSD (MOG_HUMAN)
RSRNVRFSG

SEQ ID NO: 120592 - protein, 9 aa, Artificial Sequence
  Description of Artificial Sequence: Synthetic peptide
  Seed: EYRGRTELL (MOG_HUMAN)
EMRGRTELM

SEQ ID NO: 120593 - protein, 9 aa, Artificial Sequence
  Description of Artificial Sequence: Synthetic peptide
  Seed: WVSPGVLVL (MOG_HUMAN)
WHSPGVLVY

SEQ ID NO: 120594 - protein, 10 aa, Artificial Sequence
  Description of Artificial Sequence: Synthetic peptide
  Seed: LLLQVSSSYA (MOG_HUMAN)
LILQVSSSYF

SEQ ID NO: 120595 - protein, 10 aa, Artificial Sequence
  Description of Artificial Sequence: Synthetic peptide
  Seed: DAIGEGKVTL (MOG_HUMAN)
DSIGEGKVTF

SEQ ID NO: 120596 - protein, 9 aa, Artificial Sequence
  Description of Artificial Sequence: Synthetic peptide
  Seed: FLEELRNPF (MOG_HUMAN)
FYEELRNPI

SEQ ID NO: 120597 - protein, 9 aa, Artificial Sequence
  Description of Artificial Sequence: Synthetic peptide
  Seed: SRPSLPSCL (MOG_HUMAN)
SLPSLPSCI

SEQ ID NO: 120598 - protein, 9 aa, Artificial Sequence
  Description of Artificial Sequence: Synthetic peptide
  Seed: KLRAEIENL (MOG_HUMAN)
KMRAEIENA

SEQ ID NO: 120599 - protein, 9 aa, Artificial Sequence
  Description of Artificial Sequence: Synthetic peptide
  Seed: LQVSSSYAG (MOG_HUMAN)
LQVSSSYAV

SEQ ID NO: 120600 - protein, 10 aa, Artificial Sequence
  Description of Artificial Sequence: Synthetic peptide
  Seed: SDEGGFTCFF (MOG_HUMAN)
SAEGGFTCFW

SEQ ID NO: 120601 - protein, 9 aa, Artificial Sequence
  Description of Artificial Sequence: Synthetic peptide
  Seed: SLPSCLCSF (MOG_HUMAN)
SLPSCLCSL

SEQ ID NO: 120602 - protein, 10 aa, Artificial Sequence
  Description of Artificial Sequence: Synthetic peptide
  Seed: RLAGQFLEEL (MOG_HUMAN)
RQAGQFLEEY

SEQ ID NO: 120603 - protein, 10 aa, Artificial Sequence
  Description of Artificial Sequence: Synthetic peptide
  Seed: RVPCWKITLF (MOG_HUMAN)
RFPCWKITLW

SEQ ID NO: 120604 - protein, 10 aa, Artificial Sequence
  Description of Artificial Sequence: Synthetic peptide
  Seed: FLLLLLLQVS (MOG_HUMAN)
FKLLLLLQVV

SEQ ID NO: 120605 - protein, 11 aa, Artificial Sequence
  Description of Artificial Sequence: Synthetic peptide
  Seed: VIGPRHPIRAL (MOG_HUMAN)
VTGPRHPIRAM

SEQ ID NO: 120606 - protein, 11 aa, Artificial Sequence
  Description of Artificial Sequence: Synthetic peptide
  Seed: RFSDEGGFTCF (MOG_HUMAN)
RESDEGGFTCF

SEQ ID NO: 120607 - protein, 9 aa, Artificial Sequence
  Description of Artificial Sequence: Synthetic peptide
  Seed: VSPGVLVLL (MOG_HUMAN)
VPPGVLVLI

SEQ ID NO: 120608 - protein, 8 aa, Artificial Sequence
  Description of Artificial Sequence: Synthetic peptide
  Seed: YWVSPGVL (MOG_HUMAN)
YYVSPGVL

SEQ ID NO: 120609 - protein, 9 aa, Artificial Sequence
  Description of Artificial Sequence: Synthetic peptide
  Seed: SLPSCLCSF (MOG_HUMAN)
SIPSCLCSY

SEQ ID NO: 120610 - protein, 9 aa, Artificial Sequence
  Description of Artificial Sequence: Synthetic peptide
  Seed: KLRAEIENL (MOG_HUMAN)
KYRAEIENY

SEQ ID NO: 120611 - protein, 9 aa, Artificial Sequence
  Description of Artificial Sequence: Synthetic peptide
  Seed: SLPSCLCSF (MOG_HUMAN)
SMPSCLCSA

SEQ ID NO: 120612 - protein, 9 aa, Artificial Sequence
  Description of Artificial Sequence: Synthetic peptide
  Seed: LPVLLLQIT (MOG_HUMAN)
LPVLLLQIA

SEQ ID NO: 120613 - protein, 9 aa, Artificial Sequence
  Description of Artificial Sequence: Synthetic peptide
  Seed: LVLLAVLPV (MOG_HUMAN)
LQLLAVLPA

SEQ ID NO: 120614 - protein, 9 aa, Artificial Sequence
  Description of Artificial Sequence: Synthetic peptide
  Seed: RDHSYQEEA (MOG_HUMAN)
REHSYQEEA

SEQ ID NO: 120615 - protein, 9 aa, Artificial Sequence
  Description of Artificial Sequence: Synthetic peptide
  Seed: RIRNVRFSD (MOG_HUMAN)
RVRNVRFSE

SEQ ID NO: 120616 - protein, 11 aa, Artificial Sequence
  Description of Artificial Sequence: Synthetic peptide
  Seed: RDHSYQEEAAM (MOG_HUMAN)
RKHSYQEEAAF

SEQ ID NO: 120617 - protein, 10 aa, Artificial Sequence
  Description of Artificial Sequence: Synthetic peptide
  Seed: SCLCSFLLLL (MOG_HUMAN)
SDLCSFLLLV

SEQ ID NO: 120618 - protein, 11 aa, Artificial Sequence
  Description of Artificial Sequence: Synthetic peptide
  Seed: VLVLLAVLPVL (MOG_HUMAN)
VKVLLAVLPVV

SEQ ID NO: 120619 - protein, 10 aa, Artificial Sequence
  Description of Artificial Sequence: Synthetic peptide
  Seed: FVIVPVLGPL (MOG_HUMAN)
FYIVPVLGPA

SEQ ID NO: 120620 - protein, 10 aa, Artificial Sequence
  Description of Artificial Sequence: Synthetic peptide
  Seed: SLPSCLCSFL (MOG_HUMAN)
SQPSCLCSFV

SEQ ID NO: 120621 - protein, 10 aa, Artificial Sequence
  Description of Artificial Sequence: Synthetic peptide
  Seed: HRTFDPHFLR (MOG_HUMAN)
HYTFDPHFLR

SEQ ID NO: 120622 - protein, 9 aa, Artificial Sequence
  Description of Artificial Sequence: Synthetic peptide
  Seed: WYRPPFSRV (MOG_HUMAN)
WWRPPFSRF

SEQ ID NO: 120623 - protein, 10 aa, Artificial Sequence
  Description of Artificial Sequence: Synthetic peptide
  Seed: RVPCWKITLF (MOG_HUMAN)
RTPCWKITLF

SEQ ID NO: 120624 - protein, 10 aa, Artificial Sequence
  Description of Artificial Sequence: Synthetic peptide
  Seed: IGPRHPIRAL (MOG_HUMAN)
IFPRHPIRAM

SEQ ID NO: 120625 - protein, 9 aa, Artificial Sequence
  Description of Artificial Sequence: Synthetic peptide
  Seed: VPVLGPLVA (MOG_HUMAN)
VPVLGPLVL

SEQ ID NO: 120626 - protein, 10 aa, Artificial Sequence
  Description of Artificial Sequence: Synthetic peptide
  Seed: SYQEEAAMEL (MOG_HUMAN)
SWQEEAAMEF

SEQ ID NO: 120627 - protein, 10 aa, Artificial Sequence
  Description of Artificial Sequence: Synthetic peptide
  Seed: RVVHLYRNGK (MOG_HUMAN)
RAVHLYRNGR

SEQ ID NO: 120628 - protein, 10 aa, Artificial Sequence
  Description of Artificial Sequence: Synthetic peptide
  Seed: LVLLAVLPVL (MOG_HUMAN)
LCLLAVLPVI

SEQ ID NO: 120629 - protein, 10 aa, Artificial Sequence
  Description of Artificial Sequence: Synthetic peptide
  Seed: RTFDPHFLRV (MOG_HUMAN)
RTFDPHFLRC

SEQ ID NO: 120630 - protein, 10 aa, Artificial Sequence
  Description of Artificial Sequence: Synthetic peptide
  Seed: LIFLCLQYRL (MOG_HUMAN)
LDFLCLQYRR

SEQ ID NO: 120631 - protein, 10 aa, Artificial Sequence
  Description of Artificial Sequence: Synthetic peptide
  Seed: LLLQVSSSYA (MOG_HUMAN)
LMLQVSSSYR

SEQ ID NO: 120632 - protein, 10 aa, Artificial Sequence
  Description of Artificial Sequence: Synthetic peptide
  Seed: RIRNVRFSDE (MOG_HUMAN)
RWRNVRFSDV

SEQ ID NO: 120633 - protein, 9 aa, Artificial Sequence
  Description of Artificial Sequence: Synthetic peptide
  Seed: SLPSCLCSF (MOG_HUMAN)
SSPSCLCSM

SEQ ID NO: 120634 - protein, 10 aa, Artificial Sequence
  Description of Artificial Sequence: Synthetic peptide
  Seed: RTFDPHFLRV (MOG_HUMAN)
RQFDPHFLRL

SEQ ID NO: 120635 - protein, 9 aa, Artificial Sequence
  Description of Artificial Sequence: Synthetic peptide
  Seed: MEVGWYRPP (MOG_HUMAN)
MEVGWYRPL

SEQ ID NO: 120636 - protein, 8 aa, Artificial Sequence
  Description of Artificial Sequence: Synthetic peptide
  Seed: YNWLHRRL (MOG_HUMAN)
YSWLHRRL

SEQ ID NO: 120637 - protein, 10 aa, Artificial Sequence
  Description of Artificial Sequence: Synthetic peptide
  Seed: AEIENLHRTF (MOG_HUMAN)
AKIENLHRTF

SEQ ID NO: 120638 - protein, 10 aa, Artificial Sequence
  Description of Artificial Sequence: Synthetic peptide
  Seed: LLQITVGLIF (MOG_HUMAN)
LSQITVGLIY

SEQ ID NO: 120639 - protein, 10 aa, Artificial Sequence
  Description of Artificial Sequence: Synthetic peptide
  Seed: TGMEVGWYRP (MOG_HUMAN)
TFMEVGWYRI

SEQ ID NO: 120640 - protein, 9 aa, Artificial Sequence
  Description of Artificial Sequence: Synthetic peptide
  Seed: TCFFRDHSY (MOG_HUMAN)
TQFFRDHSL

SEQ ID NO: 120641 - protein, 9 aa, Artificial Sequence
  Description of Artificial Sequence: Synthetic peptide
  Seed: RIRNVRFSD (MOG_HUMAN)
RARNVRFSI

SEQ ID NO: 120642 - protein, 9 aa, Artificial Sequence
  Description of Artificial Sequence: Synthetic peptide
  Seed: FSDEGGFTC (MOG_HUMAN)
FNDEGGFTF

SEQ ID NO: 120643 - protein, 10 aa, Artificial Sequence
  Description of Artificial Sequence: Synthetic peptide
  Seed: FSDEGGFTCF (MOG_HUMAN)
FYDEGGFTCV

SEQ ID NO: 120644 - protein, 9 aa, Artificial Sequence
  Description of Artificial Sequence: Synthetic peptide
  Seed: CLCSFLLLL (MOG_HUMAN)
CVCSFLLLV

SEQ ID NO: 120645 - protein, 8 aa, Artificial Sequence
  Description of Artificial Sequence: Synthetic peptide
  Seed: TLFVIVPV (MOG_HUMAN)
TMFVIVPV

SEQ ID NO: 120646 - protein, 11 aa, Artificial Sequence
  Description of Artificial Sequence: Synthetic peptide
  Seed: RDHSYQEEAAM (MOG_HUMAN)
RFHSYQEEAAW

SEQ ID NO: 120647 - protein, 9 aa, Artificial Sequence
  Description of Artificial Sequence: Synthetic peptide
  Seed: VLLAVLPVL (MOG_HUMAN)
VTLAVLPVV

SEQ ID NO: 120648 - protein, 9 aa, Artificial Sequence
  Description of Artificial Sequence: Synthetic peptide
  Seed: FSDEGGFTC (MOG_HUMAN)
FTDEGGFTL

SEQ ID NO: 120649 - protein, 10 aa, Artificial Sequence
  Description of Artificial Sequence: Synthetic peptide
  Seed: SLSRPSLPSC (MOG_HUMAN)
SYSRPSLPSI

SEQ ID NO: 120650 - protein, 10 aa, Artificial Sequence
  Description of Artificial Sequence: Synthetic peptide
  Seed: TGMEVGWYRP (MOG_HUMAN)
TSMEVGWYRR

SEQ ID NO: 120651 - protein, 9 aa, Artificial Sequence
  Description of Artificial Sequence: Synthetic peptide
  Seed: LLLQVSSSY (MOG_HUMAN)
LTLQVSSSL

SEQ ID NO: 120652 - protein, 9 aa, Artificial Sequence
  Description of Artificial Sequence: Synthetic peptide
  Seed: LLLQVSSSY (MOG_HUMAN)
LVLQVSSSF

SEQ ID NO: 120653 - protein, 11 aa, Artificial Sequence
  Description of Artificial Sequence: Synthetic peptide
  Seed: KDAIGEGKVTL (MOG_HUMAN)
KEAIGEGKVTC

SEQ ID NO: 120654 - protein, 9 aa, Artificial Sequence
  Description of Artificial Sequence: Synthetic peptide
  Seed: FSDEGGFTC (MOG_HUMAN)
FYDEGGFTI

SEQ ID NO: 120655 - protein, 9 aa, Artificial Sequence
  Description of Artificial Sequence: Synthetic peptide
  Seed: LKDAIGEGK (MOG_HUMAN)
LSDAIGEGY

SEQ ID NO: 120656 - protein, 10 aa, Artificial Sequence
  Description of Artificial Sequence: Synthetic peptide
  Seed: LIFLCLQYRL (MOG_HUMAN)
LVFLCLQYRR

SEQ ID NO: 120657 - protein, 11 aa, Artificial Sequence
  Description of Artificial Sequence: Synthetic peptide
  Seed: SSSYAGQFRVI (MOG_HUMAN)
SLSYAGQFRVF

SEQ ID NO: 120658 - protein, 9 aa, Artificial Sequence
  Description of Artificial Sequence: Synthetic peptide
  Seed: KLRAEIENL (MOG_HUMAN)
KQRAEIENM

SEQ ID NO: 120659 - protein, 9 aa, Artificial Sequence
  Description of Artificial Sequence: Synthetic peptide
  Seed: VELPCRISP (MOG_HUMAN)
VELPCRISL

SEQ ID NO: 120660 - protein, 10 aa, Artificial Sequence
  Description of Artificial Sequence: Synthetic peptide
  Seed: ATGMEVGWYR (MOG_HUMAN)
ALGMEVGWYR

SEQ ID NO: 120661 - protein, 9 aa, Artificial Sequence
  Description of Artificial Sequence: Synthetic peptide
  Seed: FSRVVHLYR (MOG_HUMAN)
FTRVVHLYR

SEQ ID NO: 120662 - protein, 10 aa, Artificial Sequence
  Description of Artificial Sequence: Synthetic peptide
  Seed: LLKDAIGEGK (MOG_HUMAN)
LAKDAIGEGY

SEQ ID NO: 120663 - protein, 10 aa, Artificial Sequence
  Description of Artificial Sequence: Synthetic peptide
  Seed: KITLFVIVPV (MOG_HUMAN)
KHTLFVIVPV

SEQ ID NO: 120664 - protein, 9 aa, Artificial Sequence
  Description of Artificial Sequence: Synthetic peptide
  Seed: RIRNVRFSD (MOG_HUMAN)
RQRNVRFSL

SEQ ID NO: 120665 - protein, 11 aa, Artificial Sequence
  Description of Artificial Sequence: Synthetic peptide
  Seed: PPFSRVVHLYR (MOG_HUMAN)
PIFSRVVHLYR

SEQ ID NO: 120666 - protein, 9 aa, Artificial Sequence
  Description of Artificial Sequence: Synthetic peptide
  Seed: TLRIRNVRF (MOG_HUMAN)
TMRIRNVRI

SEQ ID NO: 120667 - protein, 10 aa, Artificial Sequence
  Description of Artificial Sequence: Synthetic peptide
  Seed: RTFDPHFLRV (MOG_HUMAN)
RIFDPHFLRA

SEQ ID NO: 120668 - protein, 10 aa, Artificial Sequence
  Description of Artificial Sequence: Synthetic peptide
  Seed: YWVSPGVLVL (MOG_HUMAN)
YGVSPGVLVY

SEQ ID NO: 120669 - protein, 9 aa, Artificial Sequence
  Description of Artificial Sequence: Synthetic peptide
  Seed: RIRNVRFSD (MOG_HUMAN)
RIRNVRFSM

SEQ ID NO: 120670 - protein, 10 aa, Artificial Sequence
  Description of Artificial Sequence: Synthetic peptide
  Seed: FDPHFLRVPC (MOG_HUMAN)
FHPHFLRVPV

SEQ ID NO: 120671 - protein, 9 aa, Artificial Sequence
  Description of Artificial Sequence: Synthetic peptide
  Seed: TCFFRDHSY (MOG_HUMAN)
TPFFRDHSL

SEQ ID NO: 120672 - protein, 10 aa, Artificial Sequence
  Description of Artificial Sequence: Synthetic peptide
  Seed: SLPSCLCSFL (MOG_HUMAN)
SMPSCLCSFA

SEQ ID NO: 120673 - protein, 9 aa, Artificial Sequence
  Description of Artificial Sequence: Synthetic peptide
  Seed: SRPSLPSCL (MOG_HUMAN)
SYPSLPSCI

SEQ ID NO: 120674 - protein, 10 aa, Artificial Sequence
  Description of Artificial Sequence: Synthetic peptide
  Seed: LLLQVSSSYA (MOG_HUMAN)
LMLQVSSSYH

SEQ ID NO: 120675 - protein, 10 aa, Artificial Sequence
  Description of Artificial Sequence: Synthetic peptide
  Seed: RIRNVRFSDE (MOG_HUMAN)
RYRNVRFSDA

SEQ ID NO: 120676 - protein, 9 aa, Artificial Sequence
  Description of Artificial Sequence: Synthetic peptide
  Seed: SCLCSFLLL (MOG_HUMAN)
SLLCSFLLL

SEQ ID NO: 120677 - protein, 9 aa, Artificial Sequence
  Description of Artificial Sequence: Synthetic peptide
  Seed: YQEEAAMEL (MOG_HUMAN)
YWEEAAMEM

SEQ ID NO: 120678 - protein, 9 aa, Artificial Sequence
  Description of Artificial Sequence: Synthetic peptide
  Seed: VIVPVLGPL (MOG_HUMAN)
VQVPVLGPM

SEQ ID NO: 120679 - protein, 9 aa, Artificial Sequence
  Description of Artificial Sequence: Synthetic peptide
  Seed: RTFDPHFLR (MOG_HUMAN)
RVFDPHFLH

SEQ ID NO: 120680 - protein, 11 aa, Artificial Sequence
  Description of Artificial Sequence: Synthetic peptide
  Seed: RFSDEGGFTCF (MOG_HUMAN)
RISDEGGFTCM

SEQ ID NO: 120681 - protein, 9 aa, Artificial Sequence
  Description of Artificial Sequence: Synthetic peptide
  Seed: SCLCSFLLL (MOG_HUMAN)
SLLCSFLLI

SEQ ID NO: 120682 - protein, 9 aa, Artificial Sequence
  Description of Artificial Sequence: Synthetic peptide
  Seed: YWVSPGVLV (MOG_HUMAN)
YYVSPGVLW

SEQ ID NO: 120683 - protein, 9 aa, Artificial Sequence
  Description of Artificial Sequence: Synthetic peptide
  Seed: FSDEGGFTC (MOG_HUMAN)
FYDEGGFTL

SEQ ID NO: 120684 - protein, 10 aa, Artificial Sequence
  Description of Artificial Sequence: Synthetic peptide
  Seed: ISPGKNATGM (MOG_HUMAN)
IMPGKNATGL

SEQ ID NO: 120685 - protein, 10 aa, Artificial Sequence
  Description of Artificial Sequence: Synthetic peptide
  Seed: HRTFDPHFLR (MOG_HUMAN)
HLTFDPHFLY

SEQ ID NO: 120686 - protein, 9 aa, Artificial Sequence
  Description of Artificial Sequence: Synthetic peptide
  Seed: RVPCWKITL (MOG_HUMAN)
RMPCWKITY

SEQ ID NO: 120687 - protein, 9 aa, Artificial Sequence
  Description of Artificial Sequence: Synthetic peptide
  Seed: RIRNVRFSD (MOG_HUMAN)
RVRNVRFSP

SEQ ID NO: 120688 - protein, 11 aa, Artificial Sequence
  Description of Artificial Sequence: Synthetic peptide
  Seed: RDHSYQEEAAM (MOG_HUMAN)
RAHSYQEEAAW

SEQ ID NO: 120689 - protein, 10 aa, Artificial Sequence
  Description of Artificial Sequence: Synthetic peptide
  Seed: RVVHLYRNGK (MOG_HUMAN)
RAVHLYRNGK

SEQ ID NO: 120690 - protein, 9 aa, Artificial Sequence
  Description of Artificial Sequence: Synthetic peptide
  Seed: LCSFLLLLL (MOG_HUMAN)
LASFLLLLL

SEQ ID NO: 120691 - protein, 9 aa, Artificial Sequence
  Description of Artificial Sequence: Synthetic peptide
  Seed: VIVPVLGPL (MOG_HUMAN)
VLVPVLGPR

SEQ ID NO: 120692 - protein, 9 aa, Artificial Sequence
  Description of Artificial Sequence: Synthetic peptide
  Seed: RVPCWKITL (MOG_HUMAN)
RAPCWKITF

SEQ ID NO: 120693 - protein, 11 aa, Artificial Sequence
  Description of Artificial Sequence: Synthetic peptide
  Seed: GQFLEELRNPF (MOG_HUMAN)
GQFLEELRNPY

SEQ ID NO: 120694 - protein, 10 aa, Artificial Sequence
  Description of Artificial Sequence: Synthetic peptide
  Seed: RTFDPHFLRV (MOG_HUMAN)
RYFDPHFLRN

SEQ ID NO: 120695 - protein, 10 aa, Artificial Sequence
  Description of Artificial Sequence: Synthetic peptide
  Seed: LQITVGLIFL (MOG_HUMAN)
LKITVGLIFY

SEQ ID NO: 120696 - protein, 10 aa, Artificial Sequence
  Description of Artificial Sequence: Synthetic peptide
  Seed: FDPHFLRVPC (MOG_HUMAN)
FQPHFLRVPI

SEQ ID NO: 120697 - protein, 10 aa, Artificial Sequence
  Description of Artificial Sequence: Synthetic peptide
  Seed: YWVSPGVLVL (MOG_HUMAN)
YRVSPGVLVY

SEQ ID NO: 120698 - protein, 11 aa, Artificial Sequence
  Description of Artificial Sequence: Synthetic peptide
  Seed: FSDEGGFTCFF (MOG_HUMAN)
FMDEGGFTCFY

SEQ ID NO: 120699 - protein, 9 aa, Artificial Sequence
  Description of Artificial Sequence: Synthetic peptide
  Seed: VGDEVELPC (MOG_HUMAN)
VTDEVELPM

SEQ ID NO: 120700 - protein, 11 aa, Artificial Sequence
  Description of Artificial Sequence: Synthetic peptide
  Seed: RDHSYQEEAAM (MOG_HUMAN)
RNHSYQEEAAF

SEQ ID NO: 120701 - protein, 11 aa, Artificial Sequence
  Description of Artificial Sequence: Synthetic peptide
  Seed: RIRNVRFSDEG (MOG_HUMAN)
RTRNVRFSDEV

SEQ ID NO: 120702 - protein, 9 aa, Artificial Sequence
  Description of Artificial Sequence: Synthetic peptide
  Seed: YQEEAAMEL (MOG_HUMAN)
YEEEAAMEM

SEQ ID NO: 120703 - protein, 9 aa, Artificial Sequence
  Description of Artificial Sequence: Synthetic peptide
  Seed: VIVPVLGPL (MOG_HUMAN)
VTVPVLGPY

SEQ ID NO: 120704 - protein, 9 aa, Artificial Sequence
  Description of Artificial Sequence: Synthetic peptide
  Seed: IVPVLGPLV (MOG_HUMAN)
IIPVLGPLV

SEQ ID NO: 120705 - protein, 10 aa, Artificial Sequence
  Description of Artificial Sequence: Synthetic peptide
  Seed: SSYAGQFRVI (MOG_HUMAN)
SAYAGQFRVM

SEQ ID NO: 120706 - protein, 10 aa, Artificial Sequence
  Description of Artificial Sequence: Synthetic peptide
  Seed: HRTFDPHFLR (MOG_HUMAN)
HWTFDPHFLK

SEQ ID NO: 120707 - protein, 9 aa, Artificial Sequence
  Description of Artificial Sequence: Synthetic peptide
  Seed: DQAPEYRGR (MOG_HUMAN)
DAAPEYRGK

SEQ ID NO: 120708 - protein, 10 aa, Artificial Sequence
  Description of Artificial Sequence: Synthetic peptide
  Seed: RPPFSRVVHL (MOG_HUMAN)
RQPFSRVVHM

SEQ ID NO: 120709 - protein, 11 aa, Artificial Sequence
  Description of Artificial Sequence: Synthetic peptide
  Seed: RDHSYQEEAAM (MOG_HUMAN)
RWHSYQEEAAY

SEQ ID NO: 120710 - protein, 9 aa, Artificial Sequence
  Description of Artificial Sequence: Synthetic peptide
  Seed: FLLLLLLQV (MOG_HUMAN)
FVLLLLLQV

SEQ ID NO: 120711 - protein, 9 aa, Artificial Sequence
  Description of Artificial Sequence: Synthetic peptide
  Seed: WVSPGVLVL (MOG_HUMAN)
WMSPGVLVF

SEQ ID NO: 120712 - protein, 10 aa, Artificial Sequence
  Description of Artificial Sequence: Synthetic peptide
  Seed: DAIGEGKVTL (MOG_HUMAN)
DSIGEGKVTK

SEQ ID NO: 120713 - protein, 9 aa, Artificial Sequence
  Description of Artificial Sequence: Synthetic peptide
  Seed: RIRNVRFSD (MOG_HUMAN)
RLRNVRFSP

SEQ ID NO: 120714 - protein, 9 aa, Artificial Sequence
  Description of Artificial Sequence: Synthetic peptide
  Seed: VIVPVLGPL (MOG_HUMAN)
VTVPVLGPV

SEQ ID NO: 120715 - protein, 9 aa, Artificial Sequence
  Description of Artificial Sequence: Synthetic peptide
  Seed: FSDEGGFTC (MOG_HUMAN)
FADEGGFTA

SEQ ID NO: 120716 - protein, 10 aa, Artificial Sequence
  Description of Artificial Sequence: Synthetic peptide
  Seed: FSDEGGFTCF (MOG_HUMAN)
FQDEGGFTCV

SEQ ID NO: 120717 - protein, 10 aa, Artificial Sequence
  Description of Artificial Sequence: Synthetic peptide
  Seed: LIFLCLQYRL (MOG_HUMAN)
LTFLCLQYRR

SEQ ID NO: 120718 - protein, 9 aa, Artificial Sequence
  Description of Artificial Sequence: Synthetic peptide
  Seed: RTFDPHFLR (MOG_HUMAN)
RLFDPHFLL

SEQ ID NO: 120719 - protein, 10 aa, Artificial Sequence
  Description of Artificial Sequence: Synthetic peptide
  Seed: LLLQVSSSYA (MOG_HUMAN)
LILQVSSSYL

SEQ ID NO: 120720 - protein, 11 aa, Artificial Sequence
  Description of Artificial Sequence: Synthetic peptide
  Seed: VRFSDEGGFTC (MOG_HUMAN)
VHFSDEGGFTM

SEQ ID NO: 120721 - protein, 10 aa, Artificial Sequence
  Description of Artificial Sequence: Synthetic peptide
  Seed: SLSRPSLPSC (MOG_HUMAN)
SGSRPSLPSK

SEQ ID NO: 120722 - protein, 11 aa, Artificial Sequence
  Description of Artificial Sequence: Synthetic peptide
  Seed: RAEIENLHRTF (MOG_HUMAN)
RAEIENLHRTW

SEQ ID NO: 120723 - protein, 9 aa, Artificial Sequence
  Description of Artificial Sequence: Synthetic peptide
  Seed: LIICYNWLH (MOG_HUMAN)
LIICYNWLR

SEQ ID NO: 120724 - protein, 10 aa, Artificial Sequence
  Description of Artificial Sequence: Synthetic peptide
  Seed: AVLPVLLLQI (MOG_HUMAN)
AMLPVLLLQA

SEQ ID NO: 120725 - protein, 10 aa, Artificial Sequence
  Description of Artificial Sequence: Synthetic peptide
  Seed: SSYAGQFRVI (MOG_HUMAN)
SNYAGQFRVW

SEQ ID NO: 120726 - protein, 10 aa, Artificial Sequence
  Description of Artificial Sequence: Synthetic peptide
  Seed: FSDEGGFTCF (MOG_HUMAN)
FIDEGGFTCM

SEQ ID NO: 120727 - protein, 9 aa, Artificial Sequence
  Description of Artificial Sequence: Synthetic peptide
  Seed: VLGPLVALI (MOG_HUMAN)
VIGPLVALV

SEQ ID NO: 120728 - protein, 8 aa, Artificial Sequence
  Description of Artificial Sequence: Synthetic peptide
  Seed: FSDEGGFT (MOG_HUMAN)
FADEGGFL

SEQ ID NO: 120729 - protein, 9 aa, Artificial Sequence
  Description of Artificial Sequence: Synthetic peptide
  Seed: YQEEAAMEL (MOG_HUMAN)
YFEEAAMEV

SEQ ID NO: 120730 - protein, 8 aa, Artificial Sequence
  Description of Artificial Sequence: Synthetic peptide
  Seed: YAGQFRVI (MOG_HUMAN)
YSGQFRVM

SEQ ID NO: 120731 - protein, 9 aa, Artificial Sequence
  Description of Artificial Sequence: Synthetic peptide
  Seed: HSYQEEAAM (MOG_HUMAN)
HMYQEEAAY

SEQ ID NO: 120732 - protein, 10 aa, Artificial Sequence
  Description of Artificial Sequence: Synthetic peptide
  Seed: FDPHFLRVPC (MOG_HUMAN)
FPPHFLRVPV

SEQ ID NO: 120733 - protein, 9 aa, Artificial Sequence
  Description of Artificial Sequence: Synthetic peptide
  Seed: TCFFRDHSY (MOG_HUMAN)
TSFFRDHSL

SEQ ID NO: 120734 - protein, 10 aa, Artificial Sequence
  Description of Artificial Sequence: Synthetic peptide
  Seed: RVVHLYRNGK (MOG_HUMAN)
RSVHLYRNGR

SEQ ID NO: 120735 - protein, 9 aa, Artificial Sequence
  Description of Artificial Sequence: Synthetic peptide
  Seed: LQITVGLIF (MOG_HUMAN)
LKITVGLIL

SEQ ID NO: 120736 - protein, 10 aa, Artificial Sequence
  Description of Artificial Sequence: Synthetic peptide
  Seed: RIRNVRFSDE (MOG_HUMAN)
RVRNVRFSDG

SEQ ID NO: 120737 - protein, 10 aa, Artificial Sequence
  Description of Artificial Sequence: Synthetic peptide
  Seed: SFLLLLLLQV (MOG_HUMAN)
SPLLLLLLQV

SEQ ID NO: 120738 - protein, 9 aa, Artificial Sequence
  Description of Artificial Sequence: Synthetic peptide
  Seed: ICYNWLHRR (MOG_HUMAN)
IAYNWLHRR

SEQ ID NO: 120739 - protein, 9 aa, Artificial Sequence
  Description of Artificial Sequence: Synthetic peptide
  Seed: LLLQVSSSY (MOG_HUMAN)
LVLQVSSSM

SEQ ID NO: 120740 - protein, 9 aa, Artificial Sequence
  Description of Artificial Sequence: Synthetic peptide
  Seed: HSYQEEAAM (MOG_HUMAN)
HHYQEEAAF

SEQ ID NO: 120741 - protein, 10 aa, Artificial Sequence
  Description of Artificial Sequence: Synthetic peptide
  Seed: LLQITVGLIF (MOG_HUMAN)
LNQITVGLIM

SEQ ID NO: 120742 - protein, 9 aa, Artificial Sequence
  Description of Artificial Sequence: Synthetic peptide
  Seed: IVPVLGPLV (MOG_HUMAN)
IAPVLGPLM

SEQ ID NO: 120743 - protein, 9 aa, Artificial Sequence
  Description of Artificial Sequence: Synthetic peptide
  Seed: VPCWKITLF (MOG_HUMAN)
VMCWKITLF

SEQ ID NO: 120744 - protein, 9 aa, Artificial Sequence
  Description of Artificial Sequence: Synthetic peptide
  Seed: YRGRTELLK (MOG_HUMAN)
YRGRTELLY

SEQ ID NO: 120745 - protein, 10 aa, Artificial Sequence
  Description of Artificial Sequence: Synthetic peptide
  Seed: IGPRHPIRAL (MOG_HUMAN)
IDPRHPIRAL

SEQ ID NO: 120746 - protein, 11 aa, Artificial Sequence
  Description of Artificial Sequence: Synthetic peptide
  Seed: RTFDPHFLRVP (MOG_HUMAN)
RMFDPHFLRVE

SEQ ID NO: 120747 - protein, 9 aa, Artificial Sequence
  Description of Artificial Sequence: Synthetic peptide
  Seed: VGDEVELPC (MOG_HUMAN)
VMDEVELPM

SEQ ID NO: 120748 - protein, 9 aa, Artificial Sequence
  Description of Artificial Sequence: Synthetic peptide
  Seed: GLIFLCLQY (MOG_HUMAN)
GMIFLCLQF

SEQ ID NO: 120749 - protein, 9 aa, Artificial Sequence
  Description of Artificial Sequence: Synthetic peptide
  Seed: AIGEGKVTL (MOG_HUMAN)
ARGEGKVTM

SEQ ID NO: 120750 - protein, 9 aa, Artificial Sequence
  Description of Artificial Sequence: Synthetic peptide
  Seed: RDHSYQEEA (MOG_HUMAN)
REHSYQEEF

SEQ ID NO: 120751 - protein, 10 aa, Artificial Sequence
  Description of Artificial Sequence: Synthetic peptide
  Seed: RPPFSRVVHL (MOG_HUMAN)
RLPFSRVVHM

SEQ ID NO: 120752 - protein, 10 aa, Artificial Sequence
  Description of Artificial Sequence: Synthetic peptide
  Seed: MELKVEDPFY (MOG_HUMAN)
MMLKVEDPFY

SEQ ID NO: 120753 - protein, 10 aa, Artificial Sequence
  Description of Artificial Sequence: Synthetic peptide
  Seed: KVTLRIRNVR (MOG_HUMAN)
KATLRIRNVR

SEQ ID NO: 120754 - protein, 9 aa, Artificial Sequence
  Description of Artificial Sequence: Synthetic peptide
  Seed: IVPVLGPLV (MOG_HUMAN)
IAPVLGPLI

SEQ ID NO: 120755 - protein, 10 aa, Artificial Sequence
  Description of Artificial Sequence: Synthetic peptide
  Seed: TGMEVGWYRP (MOG_HUMAN)
TFMEVGWYRF

SEQ ID NO: 120756 - protein, 11 aa, Artificial Sequence
  Description of Artificial Sequence: Synthetic peptide
  Seed: SDEGGFTCFFR (MOG_HUMAN)
SYEGGFTCFFR

SEQ ID NO: 120757 - protein, 8 aa, Artificial Sequence
  Description of Artificial Sequence: Synthetic peptide
  Seed: RIRNVRFS (MOG_HUMAN)
RTRNVRFV

SEQ ID NO: 120758 - protein, 11 aa, Artificial Sequence
  Description of Artificial Sequence: Synthetic peptide
  Seed: VIGPRHPIRAL (MOG_HUMAN)
VDGPRHPIRAL

SEQ ID NO: 120759 - protein, 10 aa, Artificial Sequence
  Description of Artificial Sequence: Synthetic peptide
  Seed: FVIVPVLGPL (MOG_HUMAN)
FKIVPVLGPI

SEQ ID NO: 120760 - protein, 11 aa, Artificial Sequence
  Description of Artificial Sequence: Synthetic peptide
  Seed: IGPRHPIRALV (MOG_HUMAN)
IRPRHPIRALM

SEQ ID NO: 120761 - protein, 10 aa, Artificial Sequence
  Description of Artificial Sequence: Synthetic peptide
  Seed: RLAGQFLEEL (MOG_HUMAN)
RTAGQFLEEV

SEQ ID NO: 120762 - protein, 10 aa, Artificial Sequence
  Description of Artificial Sequence: Synthetic peptide
  Seed: WVSPGVLVLL (MOG_HUMAN)
WTSPGVLVLF

SEQ ID NO: 120763 - protein, 10 aa, Artificial Sequence
  Description of Artificial Sequence: Synthetic peptide
  Seed: RTFDPHFLRV (MOG_HUMAN)
RAFDPHFLRP

SEQ ID NO: 120764 - protein, 9 aa, Artificial Sequence
  Description of Artificial Sequence: Synthetic peptide
  Seed: RVIGPRHPI (MOG_HUMAN)
RLIGPRHPI

SEQ ID NO: 120765 - protein, 10 aa, Artificial Sequence
  Description of Artificial Sequence: Synthetic peptide
  Seed: TGMEVGWYRP (MOG_HUMAN)
TFMEVGWYRQ

SEQ ID NO: 120766 - protein, 9 aa, Artificial Sequence
  Description of Artificial Sequence: Synthetic peptide
  Seed: YRPPFSRVV (MOG_HUMAN)
YFPPFSRVW

SEQ ID NO: 120767 - protein, 10 aa, Artificial Sequence
  Description of Artificial Sequence: Synthetic peptide
  Seed: FDPHFLRVPC (MOG_HUMAN)
FPPHFLRVPT

SEQ ID NO: 120768 - protein, 10 aa, Artificial Sequence
  Description of Artificial Sequence: Synthetic peptide
  Seed: RRLAGQFLEE (MOG_HUMAN)
RRLAGQFLEY

SEQ ID NO: 120769 - protein, 9 aa, Artificial Sequence
  Description of Artificial Sequence: Synthetic peptide
  Seed: LQITVGLIF (MOG_HUMAN)
LVITVGLIY

SEQ ID NO: 120770 - protein, 9 aa, Artificial Sequence
  Description of Artificial Sequence: Synthetic peptide
  Seed: ALVGDEVEL (MOG_HUMAN)
AIVGDEVEY

SEQ ID NO: 120771 - protein, 9 aa, Artificial Sequence
  Description of Artificial Sequence: Synthetic peptide
  Seed: RTELLKDAI (MOG_HUMAN)
RTELLKDAW

SEQ ID NO: 120772 - protein, 9 aa, Artificial Sequence
  Description of Artificial Sequence: Synthetic peptide
  Seed: VALIICYNW (MOG_HUMAN)
VTLIICYNF

SEQ ID NO: 120773 - protein, 9 aa, Artificial Sequence
  Description of Artificial Sequence: Synthetic peptide
  Seed: CLCSFLLLL (MOG_HUMAN)
CVCSFLLLI

SEQ ID NO: 120774 - protein, 10 aa, Artificial Sequence
  Description of Artificial Sequence: Synthetic peptide
  Seed: LIICYNWLHR (MOG_HUMAN)
LLICYNWLHK

SEQ ID NO: 120775 - protein, 9 aa, Artificial Sequence
  Description of Artificial Sequence: Synthetic peptide
  Seed: TFDPHFLRV (MOG_HUMAN)
TSDPHFLRL

SEQ ID NO: 120776 - protein, 10 aa, Artificial Sequence
  Description of Artificial Sequence: Synthetic peptide
  Seed: FVIVPVLGPL (MOG_HUMAN)
FFIVPVLGPV

SEQ ID NO: 120777 - protein, 10 aa, Artificial Sequence
  Description of Artificial Sequence: Synthetic peptide
  Seed: VLGPLVALII (MOG_HUMAN)
VLGPLVALIV

SEQ ID NO: 120778 - protein, 8 aa, Artificial Sequence
  Description of Artificial Sequence: Synthetic peptide
  Seed: RTFDPHFL (MOG_HUMAN)
RRFDPHFM

SEQ ID NO: 120779 - protein, 9 aa, Artificial Sequence
  Description of Artificial Sequence: Synthetic peptide
  Seed: LAGQFLEEL (MOG_HUMAN)
LMGQFLEEF

SEQ ID NO: 120780 - protein, 9 aa, Artificial Sequence
  Description of Artificial Sequence: Synthetic peptide
  Seed: VLLAVLPVL (MOG_HUMAN)
VLLAVLPVV

SEQ ID NO: 120781 - protein, 10 aa, Artificial Sequence
  Description of Artificial Sequence: Synthetic peptide
  Seed: RTFDPHFLRV (MOG_HUMAN)
RCFDPHFLRY

SEQ ID NO: 120782 - protein, 9 aa, Artificial Sequence
  Description of Artificial Sequence: Synthetic peptide
  Seed: CLCSFLLLL (MOG_HUMAN)
CQCSFLLLF

SEQ ID NO: 120783 - protein, 9 aa, Artificial Sequence
  Description of Artificial Sequence: Synthetic peptide
  Seed: GPRHPIRAL (MOG_HUMAN)
GPRHPIRAA

SEQ ID NO: 120784 - protein, 10 aa, Artificial Sequence
  Description of Artificial Sequence: Synthetic peptide
  Seed: RVPCWKITLF (MOG_HUMAN)
RMPCWKITLW

SEQ ID NO: 120785 - protein, 9 aa, Artificial Sequence
  Description of Artificial Sequence: Synthetic peptide
  Seed: SSYAGQFRV (MOG_HUMAN)
SMYAGQFRY

SEQ ID NO: 120786 - protein, 11 aa, Artificial Sequence
  Description of Artificial Sequence: Synthetic peptide
  Seed: RFSDEGGFTCF (MOG_HUMAN)
RISDEGGFTCF

SEQ ID NO: 120787 - protein, 9 aa, Artificial Sequence
  Description of Artificial Sequence: Synthetic peptide
  Seed: LGPLVALII (MOG_HUMAN)
LAPLVALIL

SEQ ID NO: 120788 - protein, 9 aa, Artificial Sequence
  Description of Artificial Sequence: Synthetic peptide
  Seed: MASLSRPSL (MOG_HUMAN)
MTSLSRPSL

SEQ ID NO: 120789 - protein, 9 aa, Artificial Sequence
  Description of Artificial Sequence: Synthetic peptide
  Seed: VSSSYAGQF (MOG_HUMAN)
VASSYAGQW

SEQ ID NO: 120790 - protein, 10 aa, Artificial Sequence
  Description of Artificial Sequence: Synthetic peptide
  Seed: TGMEVGWYRP (MOG_HUMAN)
TMMEVGWYRY

SEQ ID NO: 120791 - protein, 10 aa, Artificial Sequence
  Description of Artificial Sequence: Synthetic peptide
  Seed: IGPRHPIRAL (MOG_HUMAN)
IVPRHPIRAF

SEQ ID NO: 120792 - protein, 9 aa, Artificial Sequence
  Description of Artificial Sequence: Synthetic peptide
  Seed: SCLCSFLLL (MOG_HUMAN)
SALCSFLLF

SEQ ID NO: 120793 - protein, 10 aa, Artificial Sequence
  Description of Artificial Sequence: Synthetic peptide
  Seed: RTFDPHFLRV (MOG_HUMAN)
RRFDPHFLRL

SEQ ID NO: 120794 - protein, 10 aa, Artificial Sequence
  Description of Artificial Sequence: Synthetic peptide
  Seed: RVVHLYRNGK (MOG_HUMAN)
RQVHLYRNGK

SEQ ID NO: 120795 - protein, 9 aa, Artificial Sequence
  Description of Artificial Sequence: Synthetic peptide
  Seed: FYWVSPGVL (MOG_HUMAN)
FAWVSPGVV

SEQ ID NO: 120796 - protein, 10 aa, Artificial Sequence
  Description of Artificial Sequence: Synthetic peptide
  Seed: RIRNVRFSDE (MOG_HUMAN)
RMRNVRFSDI

SEQ ID NO: 120797 - protein, 9 aa, Artificial Sequence
  Description of Artificial Sequence: Synthetic peptide
  Seed: RVIGPRHPI (MOG_HUMAN)
RAIGPRHPF

SEQ ID NO: 120798 - protein, 9 aa, Artificial Sequence
  Description of Artificial Sequence: Synthetic peptide
  Seed: ICYNWLHRR (MOG_HUMAN)
ITYNWLHRR

SEQ ID NO: 120799 - protein, 9 aa, Artificial Sequence
  Description of Artificial Sequence: Synthetic peptide
  Seed: AIGEGKVTL (MOG_HUMAN)
ASGEGKVTL

SEQ ID NO: 120800 - protein, 9 aa, Artificial Sequence
  Description of Artificial Sequence: Synthetic peptide
  Seed: RIRNVRFSD (MOG_HUMAN)
RSRNVRFSV

SEQ ID NO: 120801 - protein, 11 aa, Artificial Sequence
  Description of Artificial Sequence: Synthetic peptide
  Seed: HRTFDPHFLRV (MOG_HUMAN)
HMTFDPHFLRI

SEQ ID NO: 120802 - protein, 9 aa, Artificial Sequence
  Description of Artificial Sequence: Synthetic peptide
  Seed: FYWVSPGVL (MOG_HUMAN)
FHWVSPGVM

SEQ ID NO: 120803 - protein, 9 aa, Artificial Sequence
  Description of Artificial Sequence: Synthetic peptide
  Seed: TGMEVGWYR (MOG_HUMAN)
TSMEVGWYY

SEQ ID NO: 120804 - protein, 9 aa, Artificial Sequence
  Description of Artificial Sequence: Synthetic peptide
  Seed: VSSSYAGQF (MOG_HUMAN)
VKSSYAGQY

SEQ ID NO: 120805 - protein, 9 aa, Artificial Sequence
  Description of Artificial Sequence: Synthetic peptide
  Seed: TLRIRNVRF (MOG_HUMAN)
TMRIRNVRV

SEQ ID NO: 120806 - protein, 9 aa, Artificial Sequence
  Description of Artificial Sequence: Synthetic peptide
  Seed: LSRPSLPSC (MOG_HUMAN)
LGRPSLPSW

SEQ ID NO: 120807 - protein, 10 aa, Artificial Sequence
  Description of Artificial Sequence: Synthetic peptide
  Seed: YRPPFSRVVH (MOG_HUMAN)
YYPPFSRVVF

SEQ ID NO: 120808 - protein, 10 aa, Artificial Sequence
  Description of Artificial Sequence: Synthetic peptide
  Seed: RPPFSRVVHL (MOG_HUMAN)
RYPFSRVVHL

SEQ ID NO: 120809 - protein, 9 aa, Artificial Sequence
  Description of Artificial Sequence: Synthetic peptide
  Seed: SRPSLPSCL (MOG_HUMAN)
SAPSLPSCM

SEQ ID NO: 120810 - protein, 10 aa, Artificial Sequence
  Description of Artificial Sequence: Synthetic peptide
  Seed: RTFDPHFLRV (MOG_HUMAN)
RYFDPHFLRK

SEQ ID NO: 120811 - protein, 10 aa, Artificial Sequence
  Description of Artificial Sequence: Synthetic peptide
  Seed: LVLLAVLPVL (MOG_HUMAN)
LWLLAVLPVV

SEQ ID NO: 120812 - protein, 9 aa, Artificial Sequence
  Description of Artificial Sequence: Synthetic peptide
  Seed: FLEELRNPF (MOG_HUMAN)
FLEELRNPL

SEQ ID NO: 120813 - protein, 9 aa, Artificial Sequence
  Description of Artificial Sequence: Synthetic peptide
  Seed: RVIGPRHPI (MOG_HUMAN)
RYIGPRHPW

SEQ ID NO: 120814 - protein, 10 aa, Artificial Sequence
  Description of Artificial Sequence: Synthetic peptide
  Seed: KITLFVIVPV (MOG_HUMAN)
KNTLFVIVPV

SEQ ID NO: 120815 - protein, 9 aa, Artificial Sequence
  Description of Artificial Sequence: Synthetic peptide
  Seed: AIGEGKVTL (MOG_HUMAN)
AIGEGKVTF

SEQ ID NO: 120816 - protein, 9 aa, Artificial Sequence
  Description of Artificial Sequence: Synthetic peptide
  Seed: RRLAGQFLE (MOG_HUMAN)
RRLAGQFLW

SEQ ID NO: 120817 - protein, 10 aa, Artificial Sequence
  Description of Artificial Sequence: Synthetic peptide
  Seed: FRVIGPRHPI (MOG_HUMAN)
FIVIGPRHPV

SEQ ID NO: 120818 - protein, 9 aa, Artificial Sequence
  Description of Artificial Sequence: Synthetic peptide
  Seed: SRPSLPSCL (MOG_HUMAN)
SIPSLPSCL

SEQ ID NO: 120819 - protein, 10 aa, Artificial Sequence
  Description of Artificial Sequence: Synthetic peptide
  Seed: VLLLQITVGL (MOG_HUMAN)
VWLLQITVGV

SEQ ID NO: 120820 - protein, 9 aa, Artificial Sequence
  Description of Artificial Sequence: Synthetic peptide
  Seed: VLLAVLPVL (MOG_HUMAN)
VQLAVLPVI

SEQ ID NO: 120821 - protein, 9 aa, Artificial Sequence
  Description of Artificial Sequence: Synthetic peptide
  Seed: KDQDGDQAP (MOG_HUMAN)
KEQDGDQAC

SEQ ID NO: 120822 - protein, 9 aa, Artificial Sequence
  Description of Artificial Sequence: Synthetic peptide
  Seed: QITVGLIFL (MOG_HUMAN)
QVTVGLIFV

SEQ ID NO: 120823 - protein, 9 aa, Artificial Sequence
  Description of Artificial Sequence: Synthetic peptide
  Seed: FLCLQYRLR (MOG_HUMAN)
FACLQYRLR

SEQ ID NO: 120824 - protein, 9 aa, Artificial Sequence
  Description of Artificial Sequence: Synthetic peptide
  Seed: YQEEAAMEL (MOG_HUMAN)
YQEEAAMEI

SEQ ID NO: 120825 - protein, 10 aa, Artificial Sequence
  Description of Artificial Sequence: Synthetic peptide
  Seed: LIFLCLQYRL (MOG_HUMAN)
LLFLCLQYRV

SEQ ID NO: 120826 - protein, 11 aa, Artificial Sequence
  Description of Artificial Sequence: Synthetic peptide
  Seed: RTFDPHFLRVP (MOG_HUMAN)
RTFDPHFLRVR

SEQ ID NO: 120827 - protein, 10 aa, Artificial Sequence
  Description of Artificial Sequence: Synthetic peptide
  Seed: LLLQVSSSYA (MOG_HUMAN)
LLLQVSSSYI

SEQ ID NO: 120828 - protein, 9 aa, Artificial Sequence
  Description of Artificial Sequence: Synthetic peptide
  Seed: FSDEGGFTC (MOG_HUMAN)
FQDEGGFTF

SEQ ID NO: 120829 - protein, 9 aa, Artificial Sequence
  Description of Artificial Sequence: Synthetic peptide
  Seed: LLLQITVGL (MOG_HUMAN)
LILQITVGI

SEQ ID NO: 120830 - protein, 9 aa, Artificial Sequence
  Description of Artificial Sequence: Synthetic peptide
  Seed: RIRNVRFSD (MOG_HUMAN)
RVRNVRFSQ

SEQ ID NO: 120831 - protein, 9 aa, Artificial Sequence
  Description of Artificial Sequence: Synthetic peptide
  Seed: LSRPSLPSC (MOG_HUMAN)
LPRPSLPSP

SEQ ID NO: 120832 - protein, 10 aa, Artificial Sequence
  Description of Artificial Sequence: Synthetic peptide
  Seed: LLQITVGLIF (MOG_HUMAN)
LPQITVGLIY

SEQ ID NO: 120833 - protein, 10 aa, Artificial Sequence
  Description of Artificial Sequence: Synthetic peptide
  Seed: LLLQVSSSYA (MOG_HUMAN)
LSLQVSSSYY

SEQ ID NO: 120834 - protein, 9 aa, Artificial Sequence
  Description of Artificial Sequence: Synthetic peptide
  Seed: WVSPGVLVL (MOG_HUMAN)
WSSPGVLVM

SEQ ID NO: 120835 - protein, 9 aa, Artificial Sequence
  Description of Artificial Sequence: Synthetic peptide
  Seed: RIRNVRFSD (MOG_HUMAN)
RCRNVRFSK

SEQ ID NO: 120836 - protein, 10 aa, Artificial Sequence
  Description of Artificial Sequence: Synthetic peptide
  Seed: SYQEEAAMEL (MOG_HUMAN)
SYQEEAAMEW

SEQ ID NO: 120837 - protein, 9 aa, Artificial Sequence
  Description of Artificial Sequence: Synthetic peptide
  Seed: LKVEDPFYW (MOG_HUMAN)
LQVEDPFYL

SEQ ID NO: 120838 - protein, 9 aa, Artificial Sequence
  Description of Artificial Sequence: Synthetic peptide
  Seed: TLFVIVPVL (MOG_HUMAN)
TLFVIVPVA

SEQ ID NO: 120839 - protein, 10 aa, Artificial Sequence
  Description of Artificial Sequence: Synthetic peptide
  Seed: RVVHLYRNGK (MOG_HUMAN)
RWVHLYRNGK

SEQ ID NO: 120840 - protein, 9 aa, Artificial Sequence
  Description of Artificial Sequence: Synthetic peptide
  Seed: LSRPSLPSC (MOG_HUMAN)
LVRPSLPSK

SEQ ID NO: 120841 - protein, 10 aa, Artificial Sequence
  Description of Artificial Sequence: Synthetic peptide
  Seed: SLSRPSLPSC (MOG_HUMAN)
SCSRPSLPSV

SEQ ID NO: 120842 - protein, 9 aa, Artificial Sequence
  Description of Artificial Sequence: Synthetic peptide
  Seed: VPCWKITLF (MOG_HUMAN)
VLCWKITLY

SEQ ID NO: 120843 - protein, 10 aa, Artificial Sequence
  Description of Artificial Sequence: Synthetic peptide
  Seed: RTFDPHFLRV (MOG_HUMAN)
RRFDPHFLRM

SEQ ID NO: 120844 - protein, 10 aa, Artificial Sequence
  Description of Artificial Sequence: Synthetic peptide
  Seed: VSSSYAGQFR (MOG_HUMAN)
VISSYAGQFK

SEQ ID NO: 120845 - protein, 9 aa, Artificial Sequence
  Description of Artificial Sequence: Synthetic peptide
  Seed: AIGEGKVTL (MOG_HUMAN)
AVGEGKVTV

SEQ ID NO: 120846 - protein, 8 aa, Artificial Sequence
  Description of Artificial Sequence: Synthetic peptide
  Seed: VPVLGPLV (MOG_HUMAN)
VQVLGPLI

SEQ ID NO: 120847 - protein, 9 aa, Artificial Sequence
  Description of Artificial Sequence: Synthetic peptide
  Seed: WVSPGVLVL (MOG_HUMAN)
WSSPGVLVY

SEQ ID NO: 120848 - protein, 9 aa, Artificial Sequence
  Description of Artificial Sequence: Synthetic peptide
  Seed: RTFDPHFLR (MOG_HUMAN)
RMFDPHFLI

SEQ ID NO: 120849 - protein, 9 aa, Artificial Sequence
  Description of Artificial Sequence: Synthetic peptide
  Seed: KLRAEIENL (MOG_HUMAN)
KRRAEIENF

SEQ ID NO: 120850 - protein, 9 aa, Artificial Sequence
  Description of Artificial Sequence: Synthetic peptide
  Seed: MASLSRPSL (MOG_HUMAN)
MYSLSRPSM

SEQ ID NO: 120851 - protein, 10 aa, Artificial Sequence
  Description of Artificial Sequence: Synthetic peptide
  Seed: RIRNVRFSDE (MOG_HUMAN)
RMRNVRFSDY

SEQ ID NO: 120852 - protein, 9 aa, Artificial Sequence
  Description of Artificial Sequence: Synthetic peptide
  Seed: LSRPSLPSC (MOG_HUMAN)
LIRPSLPSA

SEQ ID NO: 120853 - protein, 9 aa, Artificial Sequence
  Description of Artificial Sequence: Synthetic peptide
  Seed: LLLQITVGL (MOG_HUMAN)
LLLQITVGY

SEQ ID NO: 120854 - protein, 10 aa, Artificial Sequence
  Description of Artificial Sequence: Synthetic peptide
  Seed: VGWYRPPFSR (MOG_HUMAN)
VSWYRPPFSR

SEQ ID NO: 120855 - protein, 10 aa, Artificial Sequence
  Description of Artificial Sequence: Synthetic peptide
  Seed: RVVHLYRNGK (MOG_HUMAN)
RTVHLYRNGA

SEQ ID NO: 120856 - protein, 10 aa, Artificial Sequence
  Description of Artificial Sequence: Synthetic peptide
  Seed: VLLAVLPVLL (MOG_HUMAN)
VILAVLPVLV

SEQ ID NO: 120857 - protein, 10 aa, Artificial Sequence
  Description of Artificial Sequence: Synthetic peptide
  Seed: LLKDAIGEGK (MOG_HUMAN)
LTKDAIGEGK

SEQ ID NO: 120858 - protein, 10 aa, Artificial Sequence
  Description of Artificial Sequence: Synthetic peptide
  Seed: WLHRRLAGQF (MOG_HUMAN)
WMHRRLAGQL

SEQ ID NO: 120859 - protein, 9 aa, Artificial Sequence
  Description of Artificial Sequence: Synthetic peptide
  Seed: YQEEAAMEL (MOG_HUMAN)
YMEEAAMEF

SEQ ID NO: 120860 - protein, 9 aa, Artificial Sequence
  Description of Artificial Sequence: Synthetic peptide
  Seed: FYWVSPGVL (MOG_HUMAN)
FGWVSPGVF

SEQ ID NO: 120861 - protein, 11 aa, Artificial Sequence
  Description of Artificial Sequence: Synthetic peptide
  Seed: LHRTFDPHFLR (MOG_HUMAN)
LRRTFDPHFLR

SEQ ID NO: 120862 - protein, 10 aa, Artificial Sequence
  Description of Artificial Sequence: Synthetic peptide
  Seed: RTFDPHFLRV (MOG_HUMAN)
RAFDPHFLRQ

SEQ ID NO: 120863 - protein, 9 aa, Artificial Sequence
  Description of Artificial Sequence: Synthetic peptide
  Seed: LLAVLPVLL (MOG_HUMAN)
LAAVLPVLF

SEQ ID NO: 120864 - protein, 9 aa, Artificial Sequence
  Description of Artificial Sequence: Synthetic peptide
  Seed: RVPCWKITL (MOG_HUMAN)
RVPCWKITY

SEQ ID NO: 120865 - protein, 8 aa, Artificial Sequence
  Description of Artificial Sequence: Synthetic peptide
  Seed: VLGPLVAL (MOG_HUMAN)
VAGPLVAL

SEQ ID NO: 120866 - protein, 10 aa, Artificial Sequence
  Description of Artificial Sequence: Synthetic peptide
  Seed: LLLQVSSSYA (MOG_HUMAN)
LQLQVSSSYG

SEQ ID NO: 120867 - protein, 10 aa, Artificial Sequence
  Description of Artificial Sequence: Synthetic peptide
  Seed: LLQITVGLIF (MOG_HUMAN)
LWQITVGLIM

SEQ ID NO: 120868 - protein, 10 aa, Artificial Sequence
  Description of Artificial Sequence: Synthetic peptide
  Seed: MEVGWYRPPF (MOG_HUMAN)
MSVGWYRPPY

SEQ ID NO: 120869 - protein, 10 aa, Artificial Sequence
  Description of Artificial Sequence: Synthetic peptide
  Seed: SYQEEAAMEL (MOG_HUMAN)
SYQEEAAMEY

SEQ ID NO: 120870 - protein, 9 aa, Artificial Sequence
  Description of Artificial Sequence: Synthetic peptide
  Seed: VSPGVLVLL (MOG_HUMAN)
VAPGVLVLW

SEQ ID NO: 120871 - protein, 9 aa, Artificial Sequence
  Description of Artificial Sequence: Synthetic peptide
  Seed: ITLFVIVPV (MOG_HUMAN)
IVLFVIVPL

SEQ ID NO: 120872 - protein, 9 aa, Artificial Sequence
  Description of Artificial Sequence: Synthetic peptide
  Seed: WVSPGVLVL (MOG_HUMAN)
WMSPGVLVV

SEQ ID NO: 120873 - protein, 9 aa, Artificial Sequence
  Description of Artificial Sequence: Synthetic peptide
  Seed: RVIGPRHPI (MOG_HUMAN)
RPIGPRHPI

SEQ ID NO: 120874 - protein, 9 aa, Artificial Sequence
  Description of Artificial Sequence: Synthetic peptide
  Seed: IICYNWLHR (MOG_HUMAN)
IFCYNWLHR

SEQ ID NO: 120875 - protein, 9 aa, Artificial Sequence
  Description of Artificial Sequence: Synthetic peptide
  Seed: TFDPHFLRV (MOG_HUMAN)
TFDPHFLRW

SEQ ID NO: 120876 - protein, 9 aa, Artificial Sequence
  Description of Artificial Sequence: Synthetic peptide
  Seed: ICYNWLHRR (MOG_HUMAN)
ISYNWLHRR

SEQ ID NO: 120877 - protein, 9 aa, Artificial Sequence
  Description of Artificial Sequence: Synthetic peptide
  Seed: YRPPFSRVV (MOG_HUMAN)
YGPPFSRVI

SEQ ID NO: 120878 - protein, 9 aa, Artificial Sequence
  Description of Artificial Sequence: Synthetic peptide
  Seed: VEDPFYWVS (MOG_HUMAN)
VEDPFYWVA

SEQ ID NO: 120879 - protein, 10 aa, Artificial Sequence
  Description of Artificial Sequence: Synthetic peptide
  Seed: FDPHFLRVPC (MOG_HUMAN)
FPPHFLRVPS

SEQ ID NO: 120880 - protein, 10 aa, Artificial Sequence
  Description of Artificial Sequence: Synthetic peptide
  Seed: SLSRPSLPSC (MOG_HUMAN)
SHSRPSLPSA

SEQ ID NO: 120881 - protein, 9 aa, Artificial Sequence
  Description of Artificial Sequence: Synthetic peptide
  Seed: YQEEAAMEL (MOG_HUMAN)
YLEEAAMEA

SEQ ID NO: 120882 - protein, 10 aa, Artificial Sequence
  Description of Artificial Sequence: Synthetic peptide
  Seed: SLSRPSLPSC (MOG_HUMAN)
SWSRPSLPSM

SEQ ID NO: 120883 - protein, 10 aa, Artificial Sequence
  Description of Artificial Sequence: Synthetic peptide
  Seed: RTFDPHFLRV (MOG_HUMAN)
RFFDPHFLRR

SEQ ID NO: 120884 - protein, 10 aa, Artificial Sequence
  Description of Artificial Sequence: Synthetic peptide
  Seed: KNATGMEVGW (MOG_HUMAN)
KCATGMEVGW

SEQ ID NO: 120885 - protein, 10 aa, Artificial Sequence
  Description of Artificial Sequence: Synthetic peptide
  Seed: VLLAVLPVLL (MOG_HUMAN)
VRLAVLPVLV

SEQ ID NO: 120886 - protein, 10 aa, Artificial Sequence
  Description of Artificial Sequence: Synthetic peptide
  Seed: VSSSYAGQFR (MOG_HUMAN)
VLSSYAGQFK

SEQ ID NO: 120887 - protein, 9 aa, Artificial Sequence
  Description of Artificial Sequence: Synthetic peptide
  Seed: FSDEGGFTC (MOG_HUMAN)
FTDEGGFTI

SEQ ID NO: 120888 - protein, 9 aa, Artificial Sequence
  Description of Artificial Sequence: Synthetic peptide
  Seed: ALVGDEVEL (MOG_HUMAN)
AQVGDEVEL

SEQ ID NO: 120889 - protein, 9 aa, Artificial Sequence
  Description of Artificial Sequence: Synthetic peptide
  Seed: LSRPSLPSC (MOG_HUMAN)
LFRPSLPSA

SEQ ID NO: 120890 - protein, 9 aa, Artificial Sequence
  Description of Artificial Sequence: Synthetic peptide
  Seed: GWYRPPFSR (MOG_HUMAN)
GSYRPPFSK

SEQ ID NO: 120891 - protein, 10 aa, Artificial Sequence
  Description of Artificial Sequence: Synthetic peptide
  Seed: RTFDPHFLRV (MOG_HUMAN)
RSFDPHFLRF

SEQ ID NO: 120892 - protein, 9 aa, Artificial Sequence
  Description of Artificial Sequence: Synthetic peptide
  Seed: SSSYAGQFR (MOG_HUMAN)
SMSYAGQFR

SEQ ID NO: 120893 - protein, 10 aa, Artificial Sequence
  Description of Artificial Sequence: Synthetic peptide
  Seed: LVLLAVLPVL (MOG_HUMAN)
LGLLAVLPVV

SEQ ID NO: 120894 - protein, 11 aa, Artificial Sequence
  Description of Artificial Sequence: Synthetic peptide
  Seed: RVIGPRHPIRA (MOG_HUMAN)
RQIGPRHPIRR

SEQ ID NO: 120895 - protein, 10 aa, Artificial Sequence
  Description of Artificial Sequence: Synthetic peptide
  Seed: FDPHFLRVPC (MOG_HUMAN)
FQPHFLRVPS

SEQ ID NO: 120896 - protein, 9 aa, Artificial Sequence
  Description of Artificial Sequence: Synthetic peptide
  Seed: LSRPSLPSC (MOG_HUMAN)
LSRPSLPSS

SEQ ID NO: 120897 - protein, 10 aa, Artificial Sequence
  Description of Artificial Sequence: Synthetic peptide
  Seed: TGMEVGWYRP (MOG_HUMAN)
TVMEVGWYRT

SEQ ID NO: 120898 - protein, 9 aa, Artificial Sequence
  Description of Artificial Sequence: Synthetic peptide
  Seed: LHRTFDPHF (MOG_HUMAN)
LKRTFDPHF

SEQ ID NO: 120899 - protein, 9 aa, Artificial Sequence
  Description of Artificial Sequence: Synthetic peptide
  Seed: FLRVPCWKI (MOG_HUMAN)
FMRVPCWKV

SEQ ID NO: 120900 - protein, 9 aa, Artificial Sequence
  Description of Artificial Sequence: Synthetic peptide
  Seed: VLPVLLLQI (MOG_HUMAN)
VAPVLLLQV

SEQ ID NO: 120901 - protein, 11 aa, Artificial Sequence
  Description of Artificial Sequence: Synthetic peptide
  Seed: HRTFDPHFLRV (MOG_HUMAN)
HMTFDPHFLRM

SEQ ID NO: 120902 - protein, 10 aa, Artificial Sequence
  Description of Artificial Sequence: Synthetic peptide
  Seed: FDPHFLRVPC (MOG_HUMAN)
FPPHFLRVPP

SEQ ID NO: 120903 - protein, 8 aa, Artificial Sequence
  Description of Artificial Sequence: Synthetic peptide
  Seed: FSDEGGFT (MOG_HUMAN)
FGDEGGFL

SEQ ID NO: 120904 - protein, 11 aa, Artificial Sequence
  Description of Artificial Sequence: Synthetic peptide
  Seed: RVIGPRHPIRA (MOG_HUMAN)
RVIGPRHPIRR

SEQ ID NO: 120905 - protein, 9 aa, Artificial Sequence
  Description of Artificial Sequence: Synthetic peptide
  Seed: SRPSLPSCL (MOG_HUMAN)
SHPSLPSCL

SEQ ID NO: 120906 - protein, 9 aa, Artificial Sequence
  Description of Artificial Sequence: Synthetic peptide
  Seed: SRPSLPSCL (MOG_HUMAN)
SMPSLPSCM

SEQ ID NO: 120907 - protein, 10 aa, Artificial Sequence
  Description of Artificial Sequence: Synthetic peptide
  Seed: RVVHLYRNGK (MOG_HUMAN)
RIVHLYRNGK

SEQ ID NO: 120908 - protein, 9 aa, Artificial Sequence
  Description of Artificial Sequence: Synthetic peptide
  Seed: YRPPFSRVV (MOG_HUMAN)
YLPPFSRVL

SEQ ID NO: 120909 - protein, 9 aa, Artificial Sequence
  Description of Artificial Sequence: Synthetic peptide
  Seed: SSYAGQFRV (MOG_HUMAN)
SSYAGQFRW

SEQ ID NO: 120910 - protein, 10 aa, Artificial Sequence
  Description of Artificial Sequence: Synthetic peptide
  Seed: FRVIGPRHPI (MOG_HUMAN)
FQVIGPRHPV

SEQ ID NO: 120911 - protein, 9 aa, Artificial Sequence
  Description of Artificial Sequence: Synthetic peptide
  Seed: RVIGPRHPI (MOG_HUMAN)
RQIGPRHPL

SEQ ID NO: 120912 - protein, 9 aa, Artificial Sequence
  Description of Artificial Sequence: Synthetic peptide
  Seed: VLLAVLPVL (MOG_HUMAN)
VALAVLPVM

SEQ ID NO: 120913 - protein, 9 aa, Artificial Sequence
  Description of Artificial Sequence: Synthetic peptide
  Seed: TLFVIVPVL (MOG_HUMAN)
TSFVIVPVY

SEQ ID NO: 120914 - protein, 10 aa, Artificial Sequence
  Description of Artificial Sequence: Synthetic peptide
  Seed: RTFDPHFLRV (MOG_HUMAN)
REFDPHFLRL

SEQ ID NO: 120915 - protein, 9 aa, Artificial Sequence
  Description of Artificial Sequence: Synthetic peptide
  Seed: RVPCWKITL (MOG_HUMAN)
RFPCWKITY

SEQ ID NO: 120916 - protein, 9 aa, Artificial Sequence
  Description of Artificial Sequence: Synthetic peptide
  Seed: AIGEGKVTL (MOG_HUMAN)
AAGEGKVTI

SEQ ID NO: 120917 - protein, 10 aa, Artificial Sequence
  Description of Artificial Sequence: Synthetic peptide
  Seed: FDPHFLRVPC (MOG_HUMAN)
FTPHFLRVPP

SEQ ID NO: 120918 - protein, 9 aa, Artificial Sequence
  Description of Artificial Sequence: Synthetic peptide
  Seed: TLFVIVPVL (MOG_HUMAN)
TSFVIVPVV

SEQ ID NO: 120919 - protein, 9 aa, Artificial Sequence
  Description of Artificial Sequence: Synthetic peptide
  Seed: YRPPFSRVV (MOG_HUMAN)
YQPPFSRVI

SEQ ID NO: 120920 - protein, 10 aa, Artificial Sequence
  Description of Artificial Sequence: Synthetic peptide
  Seed: FDPHFLRVPC (MOG_HUMAN)
FFPHFLRVPL

SEQ ID NO: 120921 - protein, 9 aa, Artificial Sequence
  Description of Artificial Sequence: Synthetic peptide
  Seed: FLLLLLLQV (MOG_HUMAN)
FQLLLLLQA

SEQ ID NO: 120922 - protein, 10 aa, Artificial Sequence
  Description of Artificial Sequence: Synthetic peptide
  Seed: RPPFSRVVHL (MOG_HUMAN)
RSPFSRVVHM

SEQ ID NO: 120923 - protein, 9 aa, Artificial Sequence
  Description of Artificial Sequence: Synthetic peptide
  Seed: LQVSSSYAG (MOG_HUMAN)
LQVSSSYAI

SEQ ID NO: 120924 - protein, 10 aa, Artificial Sequence
  Description of Artificial Sequence: Synthetic peptide
  Seed: KNATGMEVGW (MOG_HUMAN)
KSATGMEVGF

SEQ ID NO: 120925 - protein, 9 aa, Artificial Sequence
  Description of Artificial Sequence: Synthetic peptide
  Seed: SRPSLPSCL (MOG_HUMAN)
SFPSLPSCF

SEQ ID NO: 120926 - protein, 9 aa, Artificial Sequence
  Description of Artificial Sequence: Synthetic peptide
  Seed: TFDPHFLRV (MOG_HUMAN)
TSDPHFLRW

SEQ ID NO: 120927 - protein, 9 aa, Artificial Sequence
  Description of Artificial Sequence: Synthetic peptide
  Seed: RIRNVRFSD (MOG_HUMAN)
RIRNVRFSQ

SEQ ID NO: 120928 - protein, 9 aa, Artificial Sequence
  Description of Artificial Sequence: Synthetic peptide
  Seed: YRPPFSRVV (MOG_HUMAN)
YLPPFSRVV

SEQ ID NO: 120929 - protein, 10 aa, Artificial Sequence
  Description of Artificial Sequence: Synthetic peptide
  Seed: RVVHLYRNGK (MOG_HUMAN)
RGVHLYRNGR

SEQ ID NO: 120930 - protein, 10 aa, Artificial Sequence
  Description of Artificial Sequence: Synthetic peptide
  Seed: TGMEVGWYRP (MOG_HUMAN)
TVMEVGWYRM

SEQ ID NO: 120931 - protein, 10 aa, Artificial Sequence
  Description of Artificial Sequence: Synthetic peptide
  Seed: RVVHLYRNGK (MOG_HUMAN)
RYVHLYRNGR

SEQ ID NO: 120932 - protein, 9 aa, Artificial Sequence
  Description of Artificial Sequence: Synthetic peptide
  Seed: SSYAGQFRV (MOG_HUMAN)
SVYAGQFRI

SEQ ID NO: 120933 - protein, 11 aa, Artificial Sequence
  Description of Artificial Sequence: Synthetic peptide
  Seed: RISPGKNATGM (MOG_HUMAN)
RTSPGKNATGF

SEQ ID NO: 120934 - protein, 10 aa, Artificial Sequence
  Description of Artificial Sequence: Synthetic peptide
  Seed: RTFDPHFLRV (MOG_HUMAN)
RTFDPHFLRH

SEQ ID NO: 120935 - protein, 9 aa, Artificial Sequence
  Description of Artificial Sequence: Synthetic peptide
  Seed: RTFDPHFLR (MOG_HUMAN)
RVFDPHFLM

SEQ ID NO: 120936 - protein, 9 aa, Artificial Sequence
  Description of Artificial Sequence: Synthetic peptide
  Seed: PVLGPLVAL (MOG_HUMAN)
PQLGPLVAY

SEQ ID NO: 120937 - protein, 10 aa, Artificial Sequence
  Description of Artificial Sequence: Synthetic peptide
  Seed: LQYRLRGKLR (MOG_HUMAN)
LFYRLRGKLR

SEQ ID NO: 120938 - protein, 9 aa, Artificial Sequence
  Description of Artificial Sequence: Synthetic peptide
  Seed: IFLCLQYRL (MOG_HUMAN)
IYLCLQYRL

SEQ ID NO: 120939 - protein, 9 aa, Artificial Sequence
  Description of Artificial Sequence: Synthetic peptide
  Seed: SLPSCLCSF (MOG_HUMAN)
SYPSCLCSL

SEQ ID NO: 120940 - protein, 9 aa, Artificial Sequence
  Description of Artificial Sequence: Synthetic peptide
  Seed: TLFVIVPVL (MOG_HUMAN)
TMFVIVPVV

SEQ ID NO: 120941 - protein, 10 aa, Artificial Sequence
  Description of Artificial Sequence: Synthetic peptide
  Seed: SDEGGFTCFF (MOG_HUMAN)
SREGGFTCFW

SEQ ID NO: 120942 - protein, 9 aa, Artificial Sequence
  Description of Artificial Sequence: Synthetic peptide
  Seed: AEIENLHRT (MOG_HUMAN)
AQIENLHRW

SEQ ID NO: 120943 - protein, 9 aa, Artificial Sequence
  Description of Artificial Sequence: Synthetic peptide
  Seed: ICYNWLHRR (MOG_HUMAN)
IFYNWLHRK

SEQ ID NO: 120944 - protein, 10 aa, Artificial Sequence
  Description of Artificial Sequence: Synthetic peptide
  Seed: LLQITVGLIF (MOG_HUMAN)
LYQITVGLIF

SEQ ID NO: 120945 - protein, 9 aa, Artificial Sequence
  Description of Artificial Sequence: Synthetic peptide
  Seed: VLLAVLPVL (MOG_HUMAN)
VSLAVLPVY

SEQ ID NO: 120946 - protein, 9 aa, Artificial Sequence
  Description of Artificial Sequence: Synthetic peptide
  Seed: HSYQEEAAM (MOG_HUMAN)
HVYQEEAAY

SEQ ID NO: 120947 - protein, 11 aa, Artificial Sequence
  Description of Artificial Sequence: Synthetic peptide
  Seed: LHRTFDPHFLR (MOG_HUMAN)
LLRTFDPHFLK

SEQ ID NO: 120948 - protein, 9 aa, Artificial Sequence
  Description of Artificial Sequence: Synthetic peptide
  Seed: WVSPGVLVL (MOG_HUMAN)
WQSPGVLVL

SEQ ID NO: 120949 - protein, 10 aa, Artificial Sequence
  Description of Artificial Sequence: Synthetic peptide
  Seed: FDPHFLRVPC (MOG_HUMAN)
FNPHFLRVPL

SEQ ID NO: 120950 - protein, 9 aa, Artificial Sequence
  Description of Artificial Sequence: Synthetic peptide
  Seed: LAVLPVLLL (MOG_HUMAN)
LSVLPVLLM

SEQ ID NO: 120951 - protein, 9 aa, Artificial Sequence
  Description of Artificial Sequence: Synthetic peptide
  Seed: AIGEGKVTL (MOG_HUMAN)
AVGEGKVTY

SEQ ID NO: 120952 - protein, 9 aa, Artificial Sequence
  Description of Artificial Sequence: Synthetic peptide
  Seed: SRPSLPSCL (MOG_HUMAN)
SGPSLPSCM

SEQ ID NO: 120953 - protein, 9 aa, Artificial Sequence
  Description of Artificial Sequence: Synthetic peptide
  Seed: FSDEGGFTC (MOG_HUMAN)
FYDEGGFTF

SEQ ID NO: 120954 - protein, 10 aa, Artificial Sequence
  Description of Artificial Sequence: Synthetic peptide
  Seed: SSYAGQFRVI (MOG_HUMAN)
STYAGQFRVF

SEQ ID NO: 120955 - protein, 9 aa, Artificial Sequence
  Description of Artificial Sequence: Synthetic peptide
  Seed: AIGEGKVTL (MOG_HUMAN)
ALGEGKVTI

SEQ ID NO: 120956 - protein, 9 aa, Artificial Sequence
  Description of Artificial Sequence: Synthetic peptide
  Seed: WVSPGVLVL (MOG_HUMAN)
WRSPGVLVV

SEQ ID NO: 120957 - protein, 10 aa, Artificial Sequence
  Description of Artificial Sequence: Synthetic peptide
  Seed: DAIGEGKVTL (MOG_HUMAN)
DIIGEGKVTR

SEQ ID NO: 120958 - protein, 9 aa, Artificial Sequence
  Description of Artificial Sequence: Synthetic peptide
  Seed: KDQDGDQAP (MOG_HUMAN)
KEQDGDQAL

SEQ ID NO: 120959 - protein, 10 aa, Artificial Sequence
  Description of Artificial Sequence: Synthetic peptide
  Seed: RALVGDEVEL (MOG_HUMAN)
RQLVGDEVEF

SEQ ID NO: 120960 - protein, 9 aa, Artificial Sequence
  Description of Artificial Sequence: Synthetic peptide
  Seed: IFLCLQYRL (MOG_HUMAN)
IWLCLQYRF

SEQ ID NO: 120961 - protein, 10 aa, Artificial Sequence
  Description of Artificial Sequence: Synthetic peptide
  Seed: MEVGWYRPPF (MOG_HUMAN)
MPVGWYRPPY

SEQ ID NO: 120962 - protein, 9 aa, Artificial Sequence
  Description of Artificial Sequence: Synthetic peptide
  Seed: GQFRVIGPR (MOG_HUMAN)
GLFRVIGPK

SEQ ID NO: 120963 - protein, 9 aa, Artificial Sequence
  Description of Artificial Sequence: Synthetic peptide
  Seed: RTFDPHFLR (MOG_HUMAN)
RGFDPHFLY

SEQ ID NO: 120964 - protein, 10 aa, Artificial Sequence
  Description of Artificial Sequence: Synthetic peptide
  Seed: YWVSPGVLVL (MOG_HUMAN)
YMVSPGVLVV

SEQ ID NO: 120965 - protein, 11 aa, Artificial Sequence
  Description of Artificial Sequence: Synthetic peptide
  Seed: VLVLLAVLPVL (MOG_HUMAN)
VFVLLAVLPVV

SEQ ID NO: 120966 - protein, 8 aa, Artificial Sequence
  Description of Artificial Sequence: Synthetic peptide
  Seed: FSDEGGFT (MOG_HUMAN)
FGDEGGFF

SEQ ID NO: 120967 - protein, 9 aa, Artificial Sequence
  Description of Artificial Sequence: Synthetic peptide
  Seed: LSRPSLPSC (MOG_HUMAN)
LSRPSLPSK

SEQ ID NO: 120968 - protein, 9 aa, Artificial Sequence
  Description of Artificial Sequence: Synthetic peptide
  Seed: WYRPPFSRV (MOG_HUMAN)
WYRPPFSRI

SEQ ID NO: 120969 - protein, 10 aa, Artificial Sequence
  Description of Artificial Sequence: Synthetic peptide
  Seed: FDPHFLRVPC (MOG_HUMAN)
FDPHFLRVPS

SEQ ID NO: 120970 - protein, 10 aa, Artificial Sequence
  Description of Artificial Sequence: Synthetic peptide
  Seed: YWVSPGVLVL (MOG_HUMAN)
YNVSPGVLVF

SEQ ID NO: 120971 - protein, 9 aa, Artificial Sequence
  Description of Artificial Sequence: Synthetic peptide
  Seed: LIFLCLQYR (MOG_HUMAN)
LMFLCLQYR

SEQ ID NO: 120972 - protein, 9 aa, Artificial Sequence
  Description of Artificial Sequence: Synthetic peptide
  Seed: WVSPGVLVL (MOG_HUMAN)
WLSPGVLVL

SEQ ID NO: 120973 - protein, 10 aa, Artificial Sequence
  Description of Artificial Sequence: Synthetic peptide
  Seed: FDPHFLRVPC (MOG_HUMAN)
FSPHFLRVPI

SEQ ID NO: 120974 - protein, 11 aa, Artificial Sequence
  Description of Artificial Sequence: Synthetic peptide
  Seed: HSYQEEAAMEL (MOG_HUMAN)
HAYQEEAAMEM

SEQ ID NO: 120975 - protein, 9 aa, Artificial Sequence
  Description of Artificial Sequence: Synthetic peptide
  Seed: KLRAEIENL (MOG_HUMAN)
KARAEIENM

SEQ ID NO: 120976 - protein, 10 aa, Artificial Sequence
  Description of Artificial Sequence: Synthetic peptide
  Seed: IGPRHPIRAL (MOG_HUMAN)
IPPRHPIRAF

SEQ ID NO: 120977 - protein, 9 aa, Artificial Sequence
  Description of Artificial Sequence: Synthetic peptide
  Seed: RVPCWKITL (MOG_HUMAN)
RWPCWKITL

SEQ ID NO: 120978 - protein, 9 aa, Artificial Sequence
  Description of Artificial Sequence: Synthetic peptide
  Seed: WVSPGVLVL (MOG_HUMAN)
WKSPGVLVY

SEQ ID NO: 120979 - protein, 10 aa, Artificial Sequence
  Description of Artificial Sequence: Synthetic peptide
  Seed: WYRPPFSRVV (MOG_HUMAN)
WYRPPFSRVL

SEQ ID NO: 120980 - protein, 10 aa, Artificial Sequence
  Description of Artificial Sequence: Synthetic peptide
  Seed: LLLLQVSSSY (MOG_HUMAN)
LHLLQVSSSY

SEQ ID NO: 120981 - protein, 9 aa, Artificial Sequence
  Description of Artificial Sequence: Synthetic peptide
  Seed: VSPGVLVLL (MOG_HUMAN)
VMPGVLVLY

SEQ ID NO: 120982 - protein, 9 aa, Artificial Sequence
  Description of Artificial Sequence: Synthetic peptide
  Seed: VLGPLVALI (MOG_HUMAN)
VVGPLVALM

SEQ ID NO: 120983 - protein, 8 aa, Artificial Sequence
  Description of Artificial Sequence: Synthetic peptide
  Seed: YAGQFRVI (MOG_HUMAN)
YAGQFRVF

SEQ ID NO: 120984 - protein, 10 aa, Artificial Sequence
  Description of Artificial Sequence: Synthetic peptide
  Seed: LLQITVGLIF (MOG_HUMAN)
LAQITVGLIY

SEQ ID NO: 120985 - protein, 9 aa, Artificial Sequence
  Description of Artificial Sequence: Synthetic peptide
  Seed: RIRNVRFSD (MOG_HUMAN)
RMRNVRFSY

SEQ ID NO: 120986 - protein, 9 aa, Artificial Sequence
  Description of Artificial Sequence: Synthetic peptide
  Seed: MASLSRPSL (MOG_HUMAN)
MRSLSRPSM

SEQ ID NO: 120987 - protein, 9 aa, Artificial Sequence
  Description of Artificial Sequence: Synthetic peptide
  Seed: RTFDPHFLR (MOG_HUMAN)
RTFDPHFLF

SEQ ID NO: 120988 - protein, 10 aa, Artificial Sequence
  Description of Artificial Sequence: Synthetic peptide
  Seed: VPVLGPLVAL (MOG_HUMAN)
VMVLGPLVAV

SEQ ID NO: 120989 - protein, 9 aa, Artificial Sequence
  Description of Artificial Sequence: Synthetic peptide
  Seed: FYWVSPGVL (MOG_HUMAN)
FGWVSPGVM

SEQ ID NO: 120990 - protein, 9 aa, Artificial Sequence
  Description of Artificial Sequence: Synthetic peptide
  Seed: VTLRIRNVR (MOG_HUMAN)
VYLRIRNVR

SEQ ID NO: 120991 - protein, 11 aa, Artificial Sequence
  Description of Artificial Sequence: Synthetic peptide
  Seed: RTFDPHFLRVP (MOG_HUMAN)
RWFDPHFLRVK

SEQ ID NO: 120992 - protein, 9 aa, Artificial Sequence
  Description of Artificial Sequence: Synthetic peptide
  Seed: FYWVSPGVL (MOG_HUMAN)
FAWVSPGVY

SEQ ID NO: 120993 - protein, 10 aa, Artificial Sequence
  Description of Artificial Sequence: Synthetic peptide
  Seed: SCLCSFLLLL (MOG_HUMAN)
SMLCSFLLLV

SEQ ID NO: 120994 - protein, 9 aa, Artificial Sequence
  Description of Artificial Sequence: Synthetic peptide
  Seed: EGGFTCFFR (MOG_HUMAN)
ESGFTCFFK

SEQ ID NO: 120995 - protein, 10 aa, Artificial Sequence
  Description of Artificial Sequence: Synthetic peptide
  Seed: SLSRPSLPSC (MOG_HUMAN)
SISRPSLPSK

SEQ ID NO: 120996 - protein, 11 aa, Artificial Sequence
  Description of Artificial Sequence: Synthetic peptide
  Seed: FSDEGGFTCFF (MOG_HUMAN)
FVDEGGFTCFV

SEQ ID NO: 120997 - protein, 9 aa, Artificial Sequence
  Description of Artificial Sequence: Synthetic peptide
  Seed: SRPSLPSCL (MOG_HUMAN)
SYPSLPSCY

SEQ ID NO: 120998 - protein, 9 aa, Artificial Sequence
  Description of Artificial Sequence: Synthetic peptide
  Seed: RVVHLYRNG (MOG_HUMAN)
RTVHLYRNA

SEQ ID NO: 120999 - protein, 8 aa, Artificial Sequence
  Description of Artificial Sequence: Synthetic peptide
  Seed: VSPGVLVL (MOG_HUMAN)
VAPGVLVL

SEQ ID NO: 121000 - protein, 10 aa, Artificial Sequence
  Description of Artificial Sequence: Synthetic peptide
  Seed: LLQITVGLIF (MOG_HUMAN)
LIQITVGLIM

SEQ ID NO: 121001 - protein, 9 aa, Artificial Sequence
  Description of Artificial Sequence: Synthetic peptide
  Seed: LLLQITVGL (MOG_HUMAN)
LTLQITVGK

SEQ ID NO: 121002 - protein, 9 aa, Artificial Sequence
  Description of Artificial Sequence: Synthetic peptide
  Seed: FSDEGGFTC (MOG_HUMAN)
FMDEGGFTF

SEQ ID NO: 121003 - protein, 10 aa, Artificial Sequence
  Description of Artificial Sequence: Synthetic peptide
  Seed: AEIENLHRTF (MOG_HUMAN)
AQIENLHRTV

SEQ ID NO: 121004 - protein, 9 aa, Artificial Sequence
  Description of Artificial Sequence: Synthetic peptide
  Seed: GEGKVTLRI (MOG_HUMAN)
GEGKVTLRW

SEQ ID NO: 121005 - protein, 9 aa, Artificial Sequence
  Description of Artificial Sequence: Synthetic peptide
  Seed: MELKVEDPF (MOG_HUMAN)
MQLKVEDPF

SEQ ID NO: 121006 - protein, 9 aa, Artificial Sequence
  Description of Artificial Sequence: Synthetic peptide
  Seed: LAGQFLEEL (MOG_HUMAN)
LPGQFLEEL

SEQ ID NO: 121007 - protein, 9 aa, Artificial Sequence
  Description of Artificial Sequence: Synthetic peptide
  Seed: RRLAGQFLE (MOG_HUMAN)
RRLAGQFLR

SEQ ID NO: 121008 - protein, 9 aa, Artificial Sequence
  Description of Artificial Sequence: Synthetic peptide
  Seed: KLRAEIENL (MOG_HUMAN)
KSRAEIENY

SEQ ID NO: 121009 - protein, 9 aa, Artificial Sequence
  Description of Artificial Sequence: Synthetic peptide
  Seed: VSPGVLVLL (MOG_HUMAN)
VSPGVLVLF

SEQ ID NO: 121010 - protein, 10 aa, Artificial Sequence
  Description of Artificial Sequence: Synthetic peptide
  Seed: IGPRHPIRAL (MOG_HUMAN)
IEPRHPIRAI

SEQ ID NO: 121011 - protein, 10 aa, Artificial Sequence
  Description of Artificial Sequence: Synthetic peptide
  Seed: LLLLQVSSSY (MOG_HUMAN)
LYLLQVSSSY

SEQ ID NO: 121012 - protein, 9 aa, Artificial Sequence
  Description of Artificial Sequence: Synthetic peptide
  Seed: KDAIGEGKV (MOG_HUMAN)
KEAIGEGKM

SEQ ID NO: 121013 - protein, 9 aa, Artificial Sequence
  Description of Artificial Sequence: Synthetic peptide
  Seed: FSDEGGFTC (MOG_HUMAN)
FFDEGGFTA

SEQ ID NO: 121014 - protein, 10 aa, Artificial Sequence
  Description of Artificial Sequence: Synthetic peptide
  Seed: FVIVPVLGPL (MOG_HUMAN)
FCIVPVLGPL

SEQ ID NO: 121015 - protein, 10 aa, Artificial Sequence
  Description of Artificial Sequence: Synthetic peptide
  Seed: VSSSYAGQFR (MOG_HUMAN)
VISSYAGQFR

SEQ ID NO: 121016 - protein, 9 aa, Artificial Sequence
  Description of Artificial Sequence: Synthetic peptide
  Seed: ALVGDEVEL (MOG_HUMAN)
AVVGDEVEL

SEQ ID NO: 121017 - protein, 10 aa, Artificial Sequence
  Description of Artificial Sequence: Synthetic peptide
  Seed: DEGGFTCFFR (MOG_HUMAN)
DSGGFTCFFR

SEQ ID NO: 121018 - protein, 9 aa, Artificial Sequence
  Description of Artificial Sequence: Synthetic peptide
  Seed: FYWVSPGVL (MOG_HUMAN)
FAWVSPGVW

SEQ ID NO: 121019 - protein, 9 aa, Artificial Sequence
  Description of Artificial Sequence: Synthetic peptide
  Seed: MASLSRPSL (MOG_HUMAN)
MLSLSRPSL

SEQ ID NO: 121020 - protein, 11 aa, Artificial Sequence
  Description of Artificial Sequence: Synthetic peptide
  Seed: FYWVSPGVLVL (MOG_HUMAN)
FYWVSPGVLVW

SEQ ID NO: 121021 - protein, 9 aa, Artificial Sequence
  Description of Artificial Sequence: Synthetic peptide
  Seed: TGMEVGWYR (MOG_HUMAN)
TIMEVGWYR

SEQ ID NO: 121022 - protein, 9 aa, Artificial Sequence
  Description of Artificial Sequence: Synthetic peptide
  Seed: FLCLQYRLR (MOG_HUMAN)
FFCLQYRLR

SEQ ID NO: 121023 - protein, 9 aa, Artificial Sequence
  Description of Artificial Sequence: Synthetic peptide
  Seed: LPSCLCSFL (MOG_HUMAN)
LPSCLCSFV

SEQ ID NO: 121024 - protein, 8 aa, Artificial Sequence
  Description of Artificial Sequence: Synthetic peptide
  Seed: VIGPRHPI (MOG_HUMAN)
VSGPRHPL

SEQ ID NO: 121025 - protein, 11 aa, Artificial Sequence
  Description of Artificial Sequence: Synthetic peptide
  Seed: LQVSSSYAGQF (MOG_HUMAN)
LMVSSSYAGQY

SEQ ID NO: 121026 - protein, 10 aa, Artificial Sequence
  Description of Artificial Sequence: Synthetic peptide
  Seed: WLHRRLAGQF (MOG_HUMAN)
WMHRRLAGQY

SEQ ID NO: 121027 - protein, 10 aa, Artificial Sequence
  Description of Artificial Sequence: Synthetic peptide
  Seed: TGMEVGWYRP (MOG_HUMAN)
TTMEVGWYRK

SEQ ID NO: 121028 - protein, 10 aa, Artificial Sequence
  Description of Artificial Sequence: Synthetic peptide
  Seed: FDPHFLRVPC (MOG_HUMAN)
FVPHFLRVPM

SEQ ID NO: 121029 - protein, 11 aa, Artificial Sequence
  Description of Artificial Sequence: Synthetic peptide
  Seed: VIGPRHPIRAL (MOG_HUMAN)
VWGPRHPIRAM

SEQ ID NO: 121030 - protein, 10 aa, Artificial Sequence
  Description of Artificial Sequence: Synthetic peptide
  Seed: VLLAVLPVLL (MOG_HUMAN)
VKLAVLPVLV

SEQ ID NO: 121031 - protein, 10 aa, Artificial Sequence
  Description of Artificial Sequence: Synthetic peptide
  Seed: GLIFLCLQYR (MOG_HUMAN)
GDIFLCLQYR

SEQ ID NO: 121032 - protein, 10 aa, Artificial Sequence
  Description of Artificial Sequence: Synthetic peptide
  Seed: FVIVPVLGPL (MOG_HUMAN)
FTIVPVLGPT

SEQ ID NO: 121033 - protein, 9 aa, Artificial Sequence
  Description of Artificial Sequence: Synthetic peptide
  Seed: ITVGLIFLC (MOG_HUMAN)
ITVGLIFLA

SEQ ID NO: 121034 - protein, 9 aa, Artificial Sequence
  Description of Artificial Sequence: Synthetic peptide
  Seed: VIVPVLGPL (MOG_HUMAN)
VAVPVLGPY

SEQ ID NO: 121035 - protein, 9 aa, Artificial Sequence
  Description of Artificial Sequence: Synthetic peptide
  Seed: YQEEAAMEL (MOG_HUMAN)
YVEEAAMEI

SEQ ID NO: 121036 - protein, 9 aa, Artificial Sequence
  Description of Artificial Sequence: Synthetic peptide
  Seed: SCLCSFLLL (MOG_HUMAN)
SALCSFLLL

SEQ ID NO: 121037 - protein, 10 aa, Artificial Sequence
  Description of Artificial Sequence: Synthetic peptide
  Seed: SLSRPSLPSC (MOG_HUMAN)
STSRPSLPSL

SEQ ID NO: 121038 - protein, 11 aa, Artificial Sequence
  Description of Artificial Sequence: Synthetic peptide
  Seed: LHRTFDPHFLR (MOG_HUMAN)
LGRTFDPHFLR

SEQ ID NO: 121039 - protein, 10 aa, Artificial Sequence
  Description of Artificial Sequence: Synthetic peptide
  Seed: WVSPGVLVLL (MOG_HUMAN)
WASPGVLVLI

SEQ ID NO: 121040 - protein, 8 aa, Artificial Sequence
  Description of Artificial Sequence: Synthetic peptide
  Seed: FSDEGGFT (MOG_HUMAN)
FWDEGGFL

SEQ ID NO: 121041 - protein, 9 aa, Artificial Sequence
  Description of Artificial Sequence: Synthetic peptide
  Seed: YRGRTELLK (MOG_HUMAN)
YRGRTELLL

SEQ ID NO: 121042 - protein, 9 aa, Artificial Sequence
  Description of Artificial Sequence: Synthetic peptide
  Seed: WVSPGVLVL (MOG_HUMAN)
WSSPGVLVF

SEQ ID NO: 121043 - protein, 9 aa, Artificial Sequence
  Description of Artificial Sequence: Synthetic peptide
  Seed: AIGEGKVTL (MOG_HUMAN)
AFGEGKVTY

SEQ ID NO: 121044 - protein, 9 aa, Artificial Sequence
  Description of Artificial Sequence: Synthetic peptide
  Seed: LSRPSLPSC (MOG_HUMAN)
LFRPSLPSK

SEQ ID NO: 121045 - protein, 9 aa, Artificial Sequence
  Description of Artificial Sequence: Synthetic peptide
  Seed: VRFSDEGGF (MOG_HUMAN)
VQFSDEGGM

SEQ ID NO: 121046 - protein, 10 aa, Artificial Sequence
  Description of Artificial Sequence: Synthetic peptide
  Seed: RTFDPHFLRV (MOG_HUMAN)
RLFDPHFLRS

SEQ ID NO: 121047 - protein, 9 aa, Artificial Sequence
  Description of Artificial Sequence: Synthetic peptide
  Seed: KLRAEIENL (MOG_HUMAN)
KLRAEIENI

SEQ ID NO: 121048 - protein, 10 aa, Artificial Sequence
  Description of Artificial Sequence: Synthetic peptide
  Seed: FSDEGGFTCF (MOG_HUMAN)
FWDEGGFTCL

SEQ ID NO: 121049 - protein, 9 aa, Artificial Sequence
  Description of Artificial Sequence: Synthetic peptide
  Seed: AIGEGKVTL (MOG_HUMAN)
AVGEGKVTM

SEQ ID NO: 121050 - protein, 9 aa, Artificial Sequence
  Description of Artificial Sequence: Synthetic peptide
  Seed: VSPGVLVLL (MOG_HUMAN)
VGPGVLVLM

SEQ ID NO: 121051 - protein, 10 aa, Artificial Sequence
  Description of Artificial Sequence: Synthetic peptide
  Seed: SLSRPSLPSC (MOG_HUMAN)
SRSRPSLPSA

SEQ ID NO: 121052 - protein, 9 aa, Artificial Sequence
  Description of Artificial Sequence: Synthetic peptide
  Seed: RIRNVRFSD (MOG_HUMAN)
RNRNVRFSL

SEQ ID NO: 121053 - protein, 9 aa, Artificial Sequence
  Description of Artificial Sequence: Synthetic peptide
  Seed: EGGFTCFFR (MOG_HUMAN)
EMGFTCFFR

SEQ ID NO: 121054 - protein, 9 aa, Artificial Sequence
  Description of Artificial Sequence: Synthetic peptide
  Seed: VLLAVLPVL (MOG_HUMAN)
VTLAVLPVY

SEQ ID NO: 121055 - protein, 9 aa, Artificial Sequence
  Description of Artificial Sequence: Synthetic peptide
  Seed: HFLRVPCWK (MOG_HUMAN)
HALRVPCWR

SEQ ID NO: 121056 - protein, 9 aa, Artificial Sequence
  Description of Artificial Sequence: Synthetic peptide
  Seed: KLRAEIENL (MOG_HUMAN)
KMRAEIENK

SEQ ID NO: 121057 - protein, 9 aa, Artificial Sequence
  Description of Artificial Sequence: Synthetic peptide
  Seed: EEAAMELKV (MOG_HUMAN)
EEAAMELKI

SEQ ID NO: 121058 - protein, 10 aa, Artificial Sequence
  Description of Artificial Sequence: Synthetic peptide
  Seed: FVIVPVLGPL (MOG_HUMAN)
FHIVPVLGPL

SEQ ID NO: 121059 - protein, 9 aa, Artificial Sequence
  Description of Artificial Sequence: Synthetic peptide
  Seed: SRPSLPSCL (MOG_HUMAN)
SFPSLPSCL

SEQ ID NO: 121060 - protein, 10 aa, Artificial Sequence
  Description of Artificial Sequence: Synthetic peptide
  Seed: LLQITVGLIF (MOG_HUMAN)
LDQITVGLIM

SEQ ID NO: 121061 - protein, 10 aa, Artificial Sequence
  Description of Artificial Sequence: Synthetic peptide
  Seed: TGMEVGWYRP (MOG_HUMAN)
TMMEVGWYRL

SEQ ID NO: 121062 - protein, 9 aa, Artificial Sequence
  Description of Artificial Sequence: Synthetic peptide
  Seed: VSPGVLVLL (MOG_HUMAN)
VIPGVLVLV

SEQ ID NO: 121063 - protein, 8 aa, Artificial Sequence
  Description of Artificial Sequence: Synthetic peptide
  Seed: VLGPLVAL (MOG_HUMAN)
VAGPLVAI

SEQ ID NO: 121064 - protein, 9 aa, Artificial Sequence
  Description of Artificial Sequence: Synthetic peptide
  Seed: LQVSSSYAG (MOG_HUMAN)
LQVSSSYAH

SEQ ID NO: 121065 - protein, 10 aa, Artificial Sequence
  Description of Artificial Sequence: Synthetic peptide
  Seed: YWVSPGVLVL (MOG_HUMAN)
YRVSPGVLVL

SEQ ID NO: 121066 - protein, 10 aa, Artificial Sequence
  Description of Artificial Sequence: Synthetic peptide
  Seed: SCLCSFLLLL (MOG_HUMAN)
SGLCSFLLLL

SEQ ID NO: 121067 - protein, 9 aa, Artificial Sequence
  Description of Artificial Sequence: Synthetic peptide
  Seed: KLRAEIENL (MOG_HUMAN)
KLRAEIENV

SEQ ID NO: 121068 - protein, 11 aa, Artificial Sequence
  Description of Artificial Sequence: Synthetic peptide
  Seed: VIGPRHPIRAL (MOG_HUMAN)
VQGPRHPIRAM

SEQ ID NO: 121069 - protein, 9 aa, Artificial Sequence
  Description of Artificial Sequence: Synthetic peptide
  Seed: ICYNWLHRR (MOG_HUMAN)
IQYNWLHRK

SEQ ID NO: 121070 - protein, 8 aa, Artificial Sequence
  Description of Artificial Sequence: Synthetic peptide
  Seed: CFFRDHSY (MOG_HUMAN)
CYFRDHSM

SEQ ID NO: 121071 - protein, 9 aa, Artificial Sequence
  Description of Artificial Sequence: Synthetic peptide
  Seed: LLLQVSSSY (MOG_HUMAN)
LLLQVSSSW

SEQ ID NO: 121072 - protein, 9 aa, Artificial Sequence
  Description of Artificial Sequence: Synthetic peptide
  Seed: LQVSSSYAG (MOG_HUMAN)
LNVSSSYAF

SEQ ID NO: 121073 - protein, 8 aa, Artificial Sequence
  Description of Artificial Sequence: Synthetic peptide
  Seed: LLAVLPVL (MOG_HUMAN)
LMAVLPVV

SEQ ID NO: 121074 - protein, 9 aa, Artificial Sequence
  Description of Artificial Sequence: Synthetic peptide
  Seed: RVPCWKITL (MOG_HUMAN)
RAPCWKITW

SEQ ID NO: 121075 - protein, 9 aa, Artificial Sequence
  Description of Artificial Sequence: Synthetic peptide
  Seed: MASLSRPSL (MOG_HUMAN)
MYSLSRPSF

SEQ ID NO: 121076 - protein, 8 aa, Artificial Sequence
  Description of Artificial Sequence: Synthetic peptide
  Seed: VLGPLVAL (MOG_HUMAN)
VAGPLVAY

SEQ ID NO: 121077 - protein, 9 aa, Artificial Sequence
  Description of Artificial Sequence: Synthetic peptide
  Seed: LHRRLAGQF (MOG_HUMAN)
LQRRLAGQY

SEQ ID NO: 121078 - protein, 9 aa, Artificial Sequence
  Description of Artificial Sequence: Synthetic peptide
  Seed: HSYQEEAAM (MOG_HUMAN)
HNYQEEAAF

SEQ ID NO: 121079 - protein, 9 aa, Artificial Sequence
  Description of Artificial Sequence: Synthetic peptide
  Seed: SYAGQFRVI (MOG_HUMAN)
SFAGQFRVM

SEQ ID NO: 121080 - protein, 9 aa, Artificial Sequence
  Description of Artificial Sequence: Synthetic peptide
  Seed: FYWVSPGVL (MOG_HUMAN)
FMWVSPGVL

SEQ ID NO: 121081 - protein, 9 aa, Artificial Sequence
  Description of Artificial Sequence: Synthetic peptide
  Seed: VPVLGPLVA (MOG_HUMAN)
VPVLGPLVI

SEQ ID NO: 121082 - protein, 11 aa, Artificial Sequence
  Description of Artificial Sequence: Synthetic peptide
  Seed: RISPGKNATGM (MOG_HUMAN)
RQSPGKNATGF

SEQ ID NO: 121083 - protein, 9 aa, Artificial Sequence
  Description of Artificial Sequence: Synthetic peptide
  Seed: RVVHLYRNG (MOG_HUMAN)
RSVHLYRNA

SEQ ID NO: 121084 - protein, 9 aa, Artificial Sequence
  Description of Artificial Sequence: Synthetic peptide
  Seed: FSDEGGFTC (MOG_HUMAN)
FMDEGGFTT

SEQ ID NO: 121085 - protein, 8 aa, Artificial Sequence
  Description of Artificial Sequence: Synthetic peptide
  Seed: SSYAGQFR (MOG_HUMAN)
SFYAGQFR

SEQ ID NO: 121086 - protein, 9 aa, Artificial Sequence
  Description of Artificial Sequence: Synthetic peptide
  Seed: LQITVGLIF (MOG_HUMAN)
LTITVGLIY

SEQ ID NO: 121087 - protein, 10 aa, Artificial Sequence
  Description of Artificial Sequence: Synthetic peptide
  Seed: DEGGFTCFFR (MOG_HUMAN)
DYGGFTCFFR

SEQ ID NO: 121088 - protein, 9 aa, Artificial Sequence
  Description of Artificial Sequence: Synthetic peptide
  Seed: GLIFLCLQY (MOG_HUMAN)
GFIFLCLQY

SEQ ID NO: 121089 - protein, 10 aa, Artificial Sequence
  Description of Artificial Sequence: Synthetic peptide
  Seed: KITLFVIVPV (MOG_HUMAN)
KMTLFVIVPL

SEQ ID NO: 121090 - protein, 10 aa, Artificial Sequence
  Description of Artificial Sequence: Synthetic peptide
  Seed: VGLIFLCLQY (MOG_HUMAN)
VMLIFLCLQY

SEQ ID NO: 121091 - protein, 10 aa, Artificial Sequence
  Description of Artificial Sequence: Synthetic peptide
  Seed: AEIENLHRTF (MOG_HUMAN)
AYIENLHRTY

SEQ ID NO: 121092 - protein, 10 aa, Artificial Sequence
  Description of Artificial Sequence: Synthetic peptide
  Seed: SSYAGQFRVI (MOG_HUMAN)
SFYAGQFRVW

SEQ ID NO: 121093 - protein, 9 aa, Artificial Sequence
  Description of Artificial Sequence: Synthetic peptide
  Seed: TGMEVGWYR (MOG_HUMAN)
TNMEVGWYR

SEQ ID NO: 121094 - protein, 9 aa, Artificial Sequence
  Description of Artificial Sequence: Synthetic peptide
  Seed: TLFVIVPVL (MOG_HUMAN)
TMFVIVPVL

SEQ ID NO: 121095 - protein, 10 aa, Artificial Sequence
  Description of Artificial Sequence: Synthetic peptide
  Seed: FDPHFLRVPC (MOG_HUMAN)
FDPHFLRVPL

SEQ ID NO: 121096 - protein, 10 aa, Artificial Sequence
  Description of Artificial Sequence: Synthetic peptide
  Seed: TGMEVGWYRP (MOG_HUMAN)
TYMEVGWYRK

SEQ ID NO: 121097 - protein, 8 aa, Artificial Sequence
  Description of Artificial Sequence: Synthetic peptide
  Seed: VIGPRHPI (MOG_HUMAN)
VTGPRHPL

SEQ ID NO: 121098 - protein, 9 aa, Artificial Sequence
  Description of Artificial Sequence: Synthetic peptide
  Seed: LLQITVGLI (MOG_HUMAN)
LLQITVGLV

SEQ ID NO: 121099 - protein, 10 aa, Artificial Sequence
  Description of Artificial Sequence: Synthetic peptide
  Seed: KNATGMEVGW (MOG_HUMAN)
KVATGMEVGW

SEQ ID NO: 121100 - protein, 9 aa, Artificial Sequence
  Description of Artificial Sequence: Synthetic peptide
  Seed: LSRPSLPSC (MOG_HUMAN)
LSRPSLPST

SEQ ID NO: 121101 - protein, 9 aa, Artificial Sequence
  Description of Artificial Sequence: Synthetic peptide
  Seed: SSYAGQFRV (MOG_HUMAN)
SNYAGQFRW

SEQ ID NO: 121102 - protein, 9 aa, Artificial Sequence
  Description of Artificial Sequence: Synthetic peptide
  Seed: YRPPFSRVV (MOG_HUMAN)
YWPPFSRVV

SEQ ID NO: 121103 - protein, 10 aa, Artificial Sequence
  Description of Artificial Sequence: Synthetic peptide
  Seed: SCLCSFLLLL (MOG_HUMAN)
SELCSFLLLV

SEQ ID NO: 121104 - protein, 10 aa, Artificial Sequence
  Description of Artificial Sequence: Synthetic peptide
  Seed: KNATGMEVGW (MOG_HUMAN)
KPATGMEVGW

SEQ ID NO: 121105 - protein, 9 aa, Artificial Sequence
  Description of Artificial Sequence: Synthetic peptide
  Seed: RIRNVRFSD (MOG_HUMAN)
RSRNVRFSY

SEQ ID NO: 121106 - protein, 9 aa, Artificial Sequence
  Description of Artificial Sequence: Synthetic peptide
  Seed: CLCSFLLLL (MOG_HUMAN)
CMCSFLLLM

SEQ ID NO: 121107 - protein, 10 aa, Artificial Sequence
  Description of Artificial Sequence: Synthetic peptide
  Seed: SLSRPSLPSC (MOG_HUMAN)
SLSRPSLPSV

SEQ ID NO: 121108 - protein, 9 aa, Artificial Sequence
  Description of Artificial Sequence: Synthetic peptide
  Seed: TFDPHFLRV (MOG_HUMAN)
TCDPHFLRL

SEQ ID NO: 121109 - protein, 10 aa, Artificial Sequence
  Description of Artificial Sequence: Synthetic peptide
  Seed: FSDEGGFTCF (MOG_HUMAN)
FTDEGGFTCY

SEQ ID NO: 121110 - protein, 10 aa, Artificial Sequence
  Description of Artificial Sequence: Synthetic peptide
  Seed: RVVHLYRNGK (MOG_HUMAN)
RQVHLYRNGR

SEQ ID NO: 121111 - protein, 9 aa, Artificial Sequence
  Description of Artificial Sequence: Synthetic peptide
  Seed: FSDEGGFTC (MOG_HUMAN)
FLDEGGFTY

SEQ ID NO: 121112 - protein, 9 aa, Artificial Sequence
  Description of Artificial Sequence: Synthetic peptide
  Seed: RIRNVRFSD (MOG_HUMAN)
RARNVRFSV

SEQ ID NO: 121113 - protein, 9 aa, Artificial Sequence
  Description of Artificial Sequence: Synthetic peptide
  Seed: RIRNVRFSD (MOG_HUMAN)
RFRNVRFSN

SEQ ID NO: 121114 - protein, 9 aa, Artificial Sequence
  Description of Artificial Sequence: Synthetic peptide
  Seed: DQAPEYRGR (MOG_HUMAN)
DAAPEYRGR

SEQ ID NO: 121115 - protein, 9 aa, Artificial Sequence
  Description of Artificial Sequence: Synthetic peptide
  Seed: LCSFLLLLL (MOG_HUMAN)
LASFLLLLF

SEQ ID NO: 121116 - protein, 10 aa, Artificial Sequence
  Description of Artificial Sequence: Synthetic peptide
  Seed: VLLLQITVGL (MOG_HUMAN)
VMLLQITVGI

SEQ ID NO: 121117 - protein, 9 aa, Artificial Sequence
  Description of Artificial Sequence: Synthetic peptide
  Seed: LAVLPVLLL (MOG_HUMAN)
LSVLPVLLF

SEQ ID NO: 121118 - protein, 9 aa, Artificial Sequence
  Description of Artificial Sequence: Synthetic peptide
  Seed: WYRPPFSRV (MOG_HUMAN)
WYRPPFSRY

SEQ ID NO: 121119 - protein, 9 aa, Artificial Sequence
  Description of Artificial Sequence: Synthetic peptide
  Seed: LQVSSSYAG (MOG_HUMAN)
LIVSSSYAF

SEQ ID NO: 121120 - protein, 9 aa, Artificial Sequence
  Description of Artificial Sequence: Synthetic peptide
  Seed: VGDEVELPC (MOG_HUMAN)
VMDEVELPL

SEQ ID NO: 121121 - protein, 9 aa, Artificial Sequence
  Description of Artificial Sequence: Synthetic peptide
  Seed: YQEEAAMEL (MOG_HUMAN)
YKEEAAMEY

SEQ ID NO: 121122 - protein, 9 aa, Artificial Sequence
  Description of Artificial Sequence: Synthetic peptide
  Seed: YRPPFSRVV (MOG_HUMAN)
YFPPFSRVA

SEQ ID NO: 121123 - protein, 10 aa, Artificial Sequence
  Description of Artificial Sequence: Synthetic peptide
  Seed: KITLFVIVPV (MOG_HUMAN)
KKTLFVIVPV

SEQ ID NO: 121124 - protein, 9 aa, Artificial Sequence
  Description of Artificial Sequence: Synthetic peptide
  Seed: AEIENLHRT (MOG_HUMAN)
AEIENLHRW

SEQ ID NO: 121125 - protein, 9 aa, Artificial Sequence
  Description of Artificial Sequence: Synthetic peptide
  Seed: FYWVSPGVL (MOG_HUMAN)
FTWVSPGVV

SEQ ID NO: 121126 - protein, 10 aa, Artificial Sequence
  Description of Artificial Sequence: Synthetic peptide
  Seed: LLQITVGLIF (MOG_HUMAN)
LCQITVGLIY

SEQ ID NO: 121127 - protein, 10 aa, Artificial Sequence
  Description of Artificial Sequence: Synthetic peptide
  Seed: LLQITVGLIF (MOG_HUMAN)
LYQITVGLIM

SEQ ID NO: 121128 - protein, 10 aa, Artificial Sequence
  Description of Artificial Sequence: Synthetic peptide
  Seed: LIFLCLQYRL (MOG_HUMAN)
LSFLCLQYRR

SEQ ID NO: 121129 - protein, 9 aa, Artificial Sequence
  Description of Artificial Sequence: Synthetic peptide
  Seed: VLLAVLPVL (MOG_HUMAN)
VQLAVLPVF

SEQ ID NO: 121130 - protein, 10 aa, Artificial Sequence
  Description of Artificial Sequence: Synthetic peptide
  Seed: LVLLAVLPVL (MOG_HUMAN)
LNLLAVLPVL

SEQ ID NO: 121131 - protein, 9 aa, Artificial Sequence
  Description of Artificial Sequence: Synthetic peptide
  Seed: LQITVGLIF (MOG_HUMAN)
LWITVGLIY

SEQ ID NO: 121132 - protein, 10 aa, Artificial Sequence
  Description of Artificial Sequence: Synthetic peptide
  Seed: RVIGPRHPIR (MOG_HUMAN)
RLIGPRHPIK

SEQ ID NO: 121133 - protein, 10 aa, Artificial Sequence
  Description of Artificial Sequence: Synthetic peptide
  Seed: RVPCWKITLF (MOG_HUMAN)
RVPCWKITLY

SEQ ID NO: 121134 - protein, 10 aa, Artificial Sequence
  Description of Artificial Sequence: Synthetic peptide
  Seed: AGQFRVIGPR (MOG_HUMAN)
AFQFRVIGPR

SEQ ID NO: 121135 - protein, 10 aa, Artificial Sequence
  Description of Artificial Sequence: Synthetic peptide
  Seed: RVVHLYRNGK (MOG_HUMAN)
RTVHLYRNGR

SEQ ID NO: 121136 - protein, 10 aa, Artificial Sequence
  Description of Artificial Sequence: Synthetic peptide
  Seed: RIRNVRFSDE (MOG_HUMAN)
RVRNVRFSDV

SEQ ID NO: 121137 - protein, 11 aa, Artificial Sequence
  Description of Artificial Sequence: Synthetic peptide
  Seed: VIGPRHPIRAL (MOG_HUMAN)
VVGPRHPIRAM

SEQ ID NO: 121138 - protein, 10 aa, Artificial Sequence
  Description of Artificial Sequence: Synthetic peptide
  Seed: LIFLCLQYRL (MOG_HUMAN)
LKFLCLQYRR

SEQ ID NO: 121139 - protein, 9 aa, Artificial Sequence
  Description of Artificial Sequence: Synthetic peptide
  Seed: KVTLRIRNV (MOG_HUMAN)
KTTLRIRNA

SEQ ID NO: 121140 - protein, 9 aa, Artificial Sequence
  Description of Artificial Sequence: Synthetic peptide
  Seed: LLLQVSSSY (MOG_HUMAN)
LSLQVSSSL

SEQ ID NO: 121141 - protein, 10 aa, Artificial Sequence
  Description of Artificial Sequence: Synthetic peptide
  Seed: FDPHFLRVPC (MOG_HUMAN)
FIPHFLRVPL

SEQ ID NO: 121142 - protein, 8 aa, Artificial Sequence
  Description of Artificial Sequence: Synthetic peptide
  Seed: FSDEGGFT (MOG_HUMAN)
FADEGGFM

SEQ ID NO: 121143 - protein, 10 aa, Artificial Sequence
  Description of Artificial Sequence: Synthetic peptide
  Seed: ITLFVIVPVL (MOG_HUMAN)
IYLFVIVPVL

SEQ ID NO: 121144 - protein, 10 aa, Artificial Sequence
  Description of Artificial Sequence: Synthetic peptide
  Seed: FDPHFLRVPC (MOG_HUMAN)
FIPHFLRVPM

SEQ ID NO: 121145 - protein, 9 aa, Artificial Sequence
  Description of Artificial Sequence: Synthetic peptide
  Seed: FSDEGGFTC (MOG_HUMAN)
FIDEGGFTV

SEQ ID NO: 121146 - protein, 10 aa, Artificial Sequence
  Description of Artificial Sequence: Synthetic peptide
  Seed: RTFDPHFLRV (MOG_HUMAN)
RMFDPHFLRG

SEQ ID NO: 121147 - protein, 11 aa, Artificial Sequence
  Description of Artificial Sequence: Synthetic peptide
  Seed: RDHSYQEEAAM (MOG_HUMAN)
REHSYQEEAAF

SEQ ID NO: 121148 - protein, 11 aa, Artificial Sequence
  Description of Artificial Sequence: Synthetic peptide
  Seed: RDHSYQEEAAM (MOG_HUMAN)
REHSYQEEAAA

SEQ ID NO: 121149 - protein, 9 aa, Artificial Sequence
  Description of Artificial Sequence: Synthetic peptide
  Seed: CLCSFLLLL (MOG_HUMAN)
CLCSFLLLV

SEQ ID NO: 121150 - protein, 9 aa, Artificial Sequence
  Description of Artificial Sequence: Synthetic peptide
  Seed: ICYNWLHRR (MOG_HUMAN)
IMYNWLHRK

SEQ ID NO: 121151 - protein, 9 aa, Artificial Sequence
  Description of Artificial Sequence: Synthetic peptide
  Seed: TFDPHFLRV (MOG_HUMAN)
TLDPHFLRC

SEQ ID NO: 121152 - protein, 9 aa, Artificial Sequence
  Description of Artificial Sequence: Synthetic peptide
  Seed: RRLAGQFLE (MOG_HUMAN)
RKLAGQFLF

SEQ ID NO: 121153 - protein, 9 aa, Artificial Sequence
  Description of Artificial Sequence: Synthetic peptide
  Seed: AGQFLEELR (MOG_HUMAN)
AFQFLEELR

SEQ ID NO: 121154 - protein, 9 aa, Artificial Sequence
  Description of Artificial Sequence: Synthetic peptide
  Seed: FSDEGGFTC (MOG_HUMAN)
FGDEGGFTI

SEQ ID NO: 121155 - protein, 11 aa, Artificial Sequence
  Description of Artificial Sequence: Synthetic peptide
  Seed: ELLKDAIGEGK (MOG_HUMAN)
ETLKDAIGEGR

SEQ ID NO: 121156 - protein, 9 aa, Artificial Sequence
  Description of Artificial Sequence: Synthetic peptide
  Seed: RIRNVRFSD (MOG_HUMAN)
RIRNVRFSI

SEQ ID NO: 121157 - protein, 9 aa, Artificial Sequence
  Description of Artificial Sequence: Synthetic peptide
  Seed: LVLLAVLPV (MOG_HUMAN)
LLLLAVLPL

SEQ ID NO: 121158 - protein, 10 aa, Artificial Sequence
  Description of Artificial Sequence: Synthetic peptide
  Seed: RPPFSRVVHL (MOG_HUMAN)
RDPFSRVVHM

SEQ ID NO: 121159 - protein, 10 aa, Artificial Sequence
  Description of Artificial Sequence: Synthetic peptide
  Seed: IGPRHPIRAL (MOG_HUMAN)
IVPRHPIRAM

SEQ ID NO: 121160 - protein, 8 aa, Artificial Sequence
  Description of Artificial Sequence: Synthetic peptide
  Seed: RIRNVRFS (MOG_HUMAN)
RTRNVRFK

SEQ ID NO: 121161 - protein, 10 aa, Artificial Sequence
  Description of Artificial Sequence: Synthetic peptide
  Seed: FDPHFLRVPC (MOG_HUMAN)
FRPHFLRVPL

SEQ ID NO: 121162 - protein, 9 aa, Artificial Sequence
  Description of Artificial Sequence: Synthetic peptide
  Seed: FLEELRNPF (MOG_HUMAN)
FMEELRNPL

SEQ ID NO: 121163 - protein, 11 aa, Artificial Sequence
  Description of Artificial Sequence: Synthetic peptide
  Seed: RFSDEGGFTCF (MOG_HUMAN)
RSSDEGGFTCL

SEQ ID NO: 121164 - protein, 10 aa, Artificial Sequence
  Description of Artificial Sequence: Synthetic peptide
  Seed: RPPFSRVVHL (MOG_HUMAN)
RAPFSRVVHM

SEQ ID NO: 121165 - protein, 9 aa, Artificial Sequence
  Description of Artificial Sequence: Synthetic peptide
  Seed: LPSCLCSFL (MOG_HUMAN)
LASCLCSFW

SEQ ID NO: 121166 - protein, 11 aa, Artificial Sequence
  Description of Artificial Sequence: Synthetic peptide
  Seed: RTFDPHFLRVP (MOG_HUMAN)
RMFDPHFLRVR

SEQ ID NO: 121167 - protein, 9 aa, Artificial Sequence
  Description of Artificial Sequence: Synthetic peptide
  Seed: LSRPSLPSC (MOG_HUMAN)
LPRPSLPSM

SEQ ID NO: 121168 - protein, 10 aa, Artificial Sequence
  Description of Artificial Sequence: Synthetic peptide
  Seed: FRVIGPRHPI (MOG_HUMAN)
FDVIGPRHPI

SEQ ID NO: 121169 - protein, 10 aa, Artificial Sequence
  Description of Artificial Sequence: Synthetic peptide
  Seed: PHFLRVPCWK (MOG_HUMAN)
PRFLRVPCWR

SEQ ID NO: 121170 - protein, 9 aa, Artificial Sequence
  Description of Artificial Sequence: Synthetic peptide
  Seed: YWVSPGVLV (MOG_HUMAN)
YQVSPGVLL

SEQ ID NO: 121171 - protein, 10 aa, Artificial Sequence
  Description of Artificial Sequence: Synthetic peptide
  Seed: RTFDPHFLRV (MOG_HUMAN)
RLFDPHFLRF

SEQ ID NO: 121172 - protein, 10 aa, Artificial Sequence
  Description of Artificial Sequence: Synthetic peptide
  Seed: SCLCSFLLLL (MOG_HUMAN)
SVLCSFLLLA

SEQ ID NO: 121173 - protein, 9 aa, Artificial Sequence
  Description of Artificial Sequence: Synthetic peptide
  Seed: GQFRVIGPR (MOG_HUMAN)
GRFRVIGPK

SEQ ID NO: 121174 - protein, 10 aa, Artificial Sequence
  Description of Artificial Sequence: Synthetic peptide
  Seed: DAIGEGKVTL (MOG_HUMAN)
DAIGEGKVTY

SEQ ID NO: 121175 - protein, 11 aa, Artificial Sequence
  Description of Artificial Sequence: Synthetic peptide
  Seed: DAIGEGKVTLR (MOG_HUMAN)
DSIGEGKVTLK

SEQ ID NO: 121176 - protein, 8 aa, Artificial Sequence
  Description of Artificial Sequence: Synthetic peptide
  Seed: FSDEGGFT (MOG_HUMAN)
FMDEGGFI

SEQ ID NO: 121177 - protein, 9 aa, Artificial Sequence
  Description of Artificial Sequence: Synthetic peptide
  Seed: LQITVGLIF (MOG_HUMAN)
LEITVGLIM

SEQ ID NO: 121178 - protein, 10 aa, Artificial Sequence
  Description of Artificial Sequence: Synthetic peptide
  Seed: VGDEVELPCR (MOG_HUMAN)
VTDEVELPCY

SEQ ID NO: 121179 - protein, 11 aa, Artificial Sequence
  Description of Artificial Sequence: Synthetic peptide
  Seed: RISPGKNATGM (MOG_HUMAN)
RQSPGKNATGI

SEQ ID NO: 121180 - protein, 10 aa, Artificial Sequence
  Description of Artificial Sequence: Synthetic peptide
  Seed: RVIGPRHPIR (MOG_HUMAN)
RSIGPRHPIR

SEQ ID NO: 121181 - protein, 9 aa, Artificial Sequence
  Description of Artificial Sequence: Synthetic peptide
  Seed: IFLCLQYRL (MOG_HUMAN)
IYLCLQYRM

SEQ ID NO: 121182 - protein, 10 aa, Artificial Sequence
  Description of Artificial Sequence: Synthetic peptide
  Seed: RIRNVRFSDE (MOG_HUMAN)
RYRNVRFSDI

SEQ ID NO: 121183 - protein, 9 aa, Artificial Sequence
  Description of Artificial Sequence: Synthetic peptide
  Seed: LLLQVSSSY (MOG_HUMAN)
LILQVSSSY

SEQ ID NO: 121184 - protein, 9 aa, Artificial Sequence
  Description of Artificial Sequence: Synthetic peptide
  Seed: LQITVGLIF (MOG_HUMAN)
LKITVGLIY

SEQ ID NO: 121185 - protein, 10 aa, Artificial Sequence
  Description of Artificial Sequence: Synthetic peptide
  Seed: SFLLLLLLQV (MOG_HUMAN)
SDLLLLLLQV

SEQ ID NO: 121186 - protein, 9 aa, Artificial Sequence
  Description of Artificial Sequence: Synthetic peptide
  Seed: RRLAGQFLE (MOG_HUMAN)
RRLAGQFLC

SEQ ID NO: 121187 - protein, 10 aa, Artificial Sequence
  Description of Artificial Sequence: Synthetic peptide
  Seed: RALVGDEVEL (MOG_HUMAN)
RTLVGDEVEW

SEQ ID NO: 121188 - protein, 9 aa, Artificial Sequence
  Description of Artificial Sequence: Synthetic peptide
  Seed: GWYRPPFSR (MOG_HUMAN)
GMYRPPFSR

SEQ ID NO: 121189 - protein, 9 aa, Artificial Sequence
  Description of Artificial Sequence: Synthetic peptide
  Seed: SDEGGFTCF (MOG_HUMAN)
SEEGGFTCL

SEQ ID NO: 121190 - protein, 9 aa, Artificial Sequence
  Description of Artificial Sequence: Synthetic peptide
  Seed: LVLLAVLPV (MOG_HUMAN)
LLLLAVLPV

SEQ ID NO: 121191 - protein, 10 aa, Artificial Sequence
  Description of Artificial Sequence: Synthetic peptide
  Seed: LIFLCLQYRL (MOG_HUMAN)
LYFLCLQYRK

SEQ ID NO: 121192 - protein, 9 aa, Artificial Sequence
  Description of Artificial Sequence: Synthetic peptide
  Seed: FSDEGGFTC (MOG_HUMAN)
FSDEGGFTA

SEQ ID NO: 121193 - protein, 10 aa, Artificial Sequence
  Description of Artificial Sequence: Synthetic peptide
  Seed: ATGMEVGWYR (MOG_HUMAN)
AGGMEVGWYK

SEQ ID NO: 121194 - protein, 11 aa, Artificial Sequence
  Description of Artificial Sequence: Synthetic peptide
  Seed: FLRVPCWKITL (MOG_HUMAN)
FMRVPCWKITV

SEQ ID NO: 121195 - protein, 11 aa, Artificial Sequence
  Description of Artificial Sequence: Synthetic peptide
  Seed: MELKVEDPFYW (MOG_HUMAN)
MSLKVEDPFYW

SEQ ID NO: 121196 - protein, 10 aa, Artificial Sequence
  Description of Artificial Sequence: Synthetic peptide
  Seed: RTFDPHFLRV (MOG_HUMAN)
RQFDPHFLRQ

SEQ ID NO: 121197 - protein, 10 aa, Artificial Sequence
  Description of Artificial Sequence: Synthetic peptide
  Seed: FVIVPVLGPL (MOG_HUMAN)
FTIVPVLGPF

SEQ ID NO: 121198 - protein, 9 aa, Artificial Sequence
  Description of Artificial Sequence: Synthetic peptide
  Seed: GQFRVIGPR (MOG_HUMAN)
GRFRVIGPI

SEQ ID NO: 121199 - protein, 10 aa, Artificial Sequence
  Description of Artificial Sequence: Synthetic peptide
  Seed: RTFDPHFLRV (MOG_HUMAN)
RTFDPHFLRL

SEQ ID NO: 121200 - protein, 10 aa, Artificial Sequence
  Description of Artificial Sequence: Synthetic peptide
  Seed: WLHRRLAGQF (MOG_HUMAN)
WPHRRLAGQL

SEQ ID NO: 121201 - protein, 9 aa, Artificial Sequence
  Description of Artificial Sequence: Synthetic peptide
  Seed: TFDPHFLRV (MOG_HUMAN)
TYDPHFLRC

SEQ ID NO: 121202 - protein, 9 aa, Artificial Sequence
  Description of Artificial Sequence: Synthetic peptide
  Seed: KLRAEIENL (MOG_HUMAN)
KARAEIENF

SEQ ID NO: 121203 - protein, 9 aa, Artificial Sequence
  Description of Artificial Sequence: Synthetic peptide
  Seed: LKVEDPFYW (MOG_HUMAN)
LSVEDPFYM

SEQ ID NO: 121204 - protein, 10 aa, Artificial Sequence
  Description of Artificial Sequence: Synthetic peptide
  Seed: ATGMEVGWYR (MOG_HUMAN)
AEGMEVGWYK

SEQ ID NO: 121205 - protein, 9 aa, Artificial Sequence
  Description of Artificial Sequence: Synthetic peptide
  Seed: YQEEAAMEL (MOG_HUMAN)
YKEEAAMEF

SEQ ID NO: 121206 - protein, 10 aa, Artificial Sequence
  Description of Artificial Sequence: Synthetic peptide
  Seed: AEIENLHRTF (MOG_HUMAN)
AQIENLHRTF

SEQ ID NO: 121207 - protein, 9 aa, Artificial Sequence
  Description of Artificial Sequence: Synthetic peptide
  Seed: LAVLPVLLL (MOG_HUMAN)
LAVLPVLLF

SEQ ID NO: 121208 - protein, 9 aa, Artificial Sequence
  Description of Artificial Sequence: Synthetic peptide
  Seed: EGGFTCFFR (MOG_HUMAN)
EIGFTCFFK

SEQ ID NO: 121209 - protein, 10 aa, Artificial Sequence
  Description of Artificial Sequence: Synthetic peptide
  Seed: HRTFDPHFLR (MOG_HUMAN)
HFTFDPHFLY

SEQ ID NO: 121210 - protein, 10 aa, Artificial Sequence
  Description of Artificial Sequence: Synthetic peptide
  Seed: VLLAVLPVLL (MOG_HUMAN)
VMLAVLPVLL

SEQ ID NO: 121211 - protein, 11 aa, Artificial Sequence
  Description of Artificial Sequence: Synthetic peptide
  Seed: RIRNVRFSDEG (MOG_HUMAN)
RTRNVRFSDEK

SEQ ID NO: 121212 - protein, 10 aa, Artificial Sequence
  Description of Artificial Sequence: Synthetic peptide
  Seed: VLLAVLPVLL (MOG_HUMAN)
VYLAVLPVLM

SEQ ID NO: 121213 - protein, 9 aa, Artificial Sequence
  Description of Artificial Sequence: Synthetic peptide
  Seed: VGDEVELPC (MOG_HUMAN)
VGDEVELPF

SEQ ID NO: 121214 - protein, 10 aa, Artificial Sequence
  Description of Artificial Sequence: Synthetic peptide
  Seed: FVIVPVLGPL (MOG_HUMAN)
FWIVPVLGPV

SEQ ID NO: 121215 - protein, 10 aa, Artificial Sequence
  Description of Artificial Sequence: Synthetic peptide
  Seed: FVIVPVLGPL (MOG_HUMAN)
FVIVPVLGPV

SEQ ID NO: 121216 - protein, 9 aa, Artificial Sequence
  Description of Artificial Sequence: Synthetic peptide
  Seed: FLEELRNPF (MOG_HUMAN)
FFEELRNPL

SEQ ID NO: 121217 - protein, 10 aa, Artificial Sequence
  Description of Artificial Sequence: Synthetic peptide
  Seed: VTLRIRNVRF (MOG_HUMAN)
VALRIRNVRW

SEQ ID NO: 121218 - protein, 10 aa, Artificial Sequence
  Description of Artificial Sequence: Synthetic peptide
  Seed: LVLLAVLPVL (MOG_HUMAN)
LWLLAVLPVL

SEQ ID NO: 121219 - protein, 10 aa, Artificial Sequence
  Description of Artificial Sequence: Synthetic peptide
  Seed: VLLAVLPVLL (MOG_HUMAN)
VSLAVLPVLL

SEQ ID NO: 121220 - protein, 9 aa, Artificial Sequence
  Description of Artificial Sequence: Synthetic peptide
  Seed: KLRAEIENL (MOG_HUMAN)
KLRAEIENW

SEQ ID NO: 121221 - protein, 10 aa, Artificial Sequence
  Description of Artificial Sequence: Synthetic peptide
  Seed: LLLQVSSSYA (MOG_HUMAN)
LQLQVSSSYT

SEQ ID NO: 121222 - protein, 11 aa, Artificial Sequence
  Description of Artificial Sequence: Synthetic peptide
  Seed: KDQDGDQAPEY (MOG_HUMAN)
KQQDGDQAPEY

SEQ ID NO: 121223 - protein, 9 aa, Artificial Sequence
  Description of Artificial Sequence: Synthetic peptide
  Seed: YRLRGKLRA (MOG_HUMAN)
YRLRGKLRF

SEQ ID NO: 121224 - protein, 10 aa, Artificial Sequence
  Description of Artificial Sequence: Synthetic peptide
  Seed: RTFDPHFLRV (MOG_HUMAN)
RGFDPHFLRY

SEQ ID NO: 121225 - protein, 10 aa, Artificial Sequence
  Description of Artificial Sequence: Synthetic peptide
  Seed: GLIFLCLQYR (MOG_HUMAN)
GSIFLCLQYK

SEQ ID NO: 121226 - protein, 9 aa, Artificial Sequence
  Description of Artificial Sequence: Synthetic peptide
  Seed: LRAEIENLH (MOG_HUMAN)
LRAEIENLM

SEQ ID NO: 121227 - protein, 11 aa, Artificial Sequence
  Description of Artificial Sequence: Synthetic peptide
  Seed: RTFDPHFLRVP (MOG_HUMAN)
RMFDPHFLRVY

SEQ ID NO: 121228 - protein, 9 aa, Artificial Sequence
  Description of Artificial Sequence: Synthetic peptide
  Seed: LLQVSSSYA (MOG_HUMAN)
LLQVSSSYL

SEQ ID NO: 121229 - protein, 9 aa, Artificial Sequence
  Description of Artificial Sequence: Synthetic peptide
  Seed: FSDEGGFTC (MOG_HUMAN)
FEDEGGFTM

SEQ ID NO: 121230 - protein, 10 aa, Artificial Sequence
  Description of Artificial Sequence: Synthetic peptide
  Seed: VGWYRPPFSR (MOG_HUMAN)
VTWYRPPFSK

SEQ ID NO: 121231 - protein, 11 aa, Artificial Sequence
  Description of Artificial Sequence: Synthetic peptide
  Seed: RFSDEGGFTCF (MOG_HUMAN)
RWSDEGGFTCY

SEQ ID NO: 121232 - protein, 10 aa, Artificial Sequence
  Description of Artificial Sequence: Synthetic peptide
  Seed: IGPRHPIRAL (MOG_HUMAN)
IEPRHPIRAM

SEQ ID NO: 121233 - protein, 9 aa, Artificial Sequence
  Description of Artificial Sequence: Synthetic peptide
  Seed: LKVEDPFYW (MOG_HUMAN)
LTVEDPFYY

SEQ ID NO: 121234 - protein, 11 aa, Artificial Sequence
  Description of Artificial Sequence: Synthetic peptide
  Seed: RDHSYQEEAAM (MOG_HUMAN)
RFHSYQEEAAY

SEQ ID NO: 121235 - protein, 9 aa, Artificial Sequence
  Description of Artificial Sequence: Synthetic peptide
  Seed: LSRPSLPSC (MOG_HUMAN)
LIRPSLPSM

SEQ ID NO: 121236 - protein, 10 aa, Artificial Sequence
  Description of Artificial Sequence: Synthetic peptide
  Seed: ELPCRISPGK (MOG_HUMAN)
ETPCRISPGK

SEQ ID NO: 121237 - protein, 10 aa, Artificial Sequence
  Description of Artificial Sequence: Synthetic peptide
  Seed: FDPHFLRVPC (MOG_HUMAN)
FHPHFLRVPA

SEQ ID NO: 121238 - protein, 9 aa, Artificial Sequence
  Description of Artificial Sequence: Synthetic peptide
  Seed: LLLQVSSSY (MOG_HUMAN)
LMLQVSSSR

SEQ ID NO: 121239 - protein, 9 aa, Artificial Sequence
  Description of Artificial Sequence: Synthetic peptide
  Seed: YRPPFSRVV (MOG_HUMAN)
YVPPFSRVV

SEQ ID NO: 121240 - protein, 9 aa, Artificial Sequence
  Description of Artificial Sequence: Synthetic peptide
  Seed: RIRNVRFSD (MOG_HUMAN)
RQRNVRFSV

SEQ ID NO: 121241 - protein, 9 aa, Artificial Sequence
  Description of Artificial Sequence: Synthetic peptide
  Seed: IVPVLGPLV (MOG_HUMAN)
IPPVLGPLI

SEQ ID NO: 121242 - protein, 10 aa, Artificial Sequence
  Description of Artificial Sequence: Synthetic peptide
  Seed: IGPRHPIRAL (MOG_HUMAN)
IMPRHPIRAM

SEQ ID NO: 121243 - protein, 10 aa, Artificial Sequence
  Description of Artificial Sequence: Synthetic peptide
  Seed: FDPHFLRVPC (MOG_HUMAN)
FPPHFLRVPF

SEQ ID NO: 121244 - protein, 10 aa, Artificial Sequence
  Description of Artificial Sequence: Synthetic peptide
  Seed: SLSRPSLPSC (MOG_HUMAN)
STSRPSLPSI

SEQ ID NO: 121245 - protein, 9 aa, Artificial Sequence
  Description of Artificial Sequence: Synthetic peptide
  Seed: RVIGPRHPI (MOG_HUMAN)
RLIGPRHPW

SEQ ID NO: 121246 - protein, 9 aa, Artificial Sequence
  Description of Artificial Sequence: Synthetic peptide
  Seed: SSYAGQFRV (MOG_HUMAN)
SVYAGQFRV

SEQ ID NO: 121247 - protein, 9 aa, Artificial Sequence
  Description of Artificial Sequence: Synthetic peptide
  Seed: LPCRISPGK (MOG_HUMAN)
LVCRISPGK

SEQ ID NO: 121248 - protein, 9 aa, Artificial Sequence
  Description of Artificial Sequence: Synthetic peptide
  Seed: HSYQEEAAM (MOG_HUMAN)
HLYQEEAAM

SEQ ID NO: 121249 - protein, 11 aa, Artificial Sequence
  Description of Artificial Sequence: Synthetic peptide
  Seed: RDHSYQEEAAM (MOG_HUMAN)
RPHSYQEEAAF

SEQ ID NO: 121250 - protein, 9 aa, Artificial Sequence
  Description of Artificial Sequence: Synthetic peptide
  Seed: LQVSSSYAG (MOG_HUMAN)
LGVSSSYAF

SEQ ID NO: 121251 - protein, 10 aa, Artificial Sequence
  Description of Artificial Sequence: Synthetic peptide
  Seed: AEIENLHRTF (MOG_HUMAN)
AAIENLHRTW

SEQ ID NO: 121252 - protein, 9 aa, Artificial Sequence
  Description of Artificial Sequence: Synthetic peptide
  Seed: LSRPSLPSC (MOG_HUMAN)
LARPSLPSA

SEQ ID NO: 121253 - protein, 11 aa, Artificial Sequence
  Description of Artificial Sequence: Synthetic peptide
  Seed: PPFSRVVHLYR (MOG_HUMAN)
PRFSRVVHLYR

SEQ ID NO: 121254 - protein, 10 aa, Artificial Sequence
  Description of Artificial Sequence: Synthetic peptide
  Seed: KITLFVIVPV (MOG_HUMAN)
KVTLFVIVPV

SEQ ID NO: 121255 - protein, 9 aa, Artificial Sequence
  Description of Artificial Sequence: Synthetic peptide
  Seed: RIRNVRFSD (MOG_HUMAN)
RGRNVRFSM

SEQ ID NO: 121256 - protein, 10 aa, Artificial Sequence
  Description of Artificial Sequence: Synthetic peptide
  Seed: LIFLCLQYRL (MOG_HUMAN)
LLFLCLQYRI

SEQ ID NO: 121257 - protein, 10 aa, Artificial Sequence
  Description of Artificial Sequence: Synthetic peptide
  Seed: FVIVPVLGPL (MOG_HUMAN)
FEIVPVLGPY

SEQ ID NO: 121258 - protein, 10 aa, Artificial Sequence
  Description of Artificial Sequence: Synthetic peptide
  Seed: AGQFRVIGPR (MOG_HUMAN)
AVQFRVIGPR

SEQ ID NO: 121259 - protein, 9 aa, Artificial Sequence
  Description of Artificial Sequence: Synthetic peptide
  Seed: FLEELRNPF (MOG_HUMAN)
FIEELRNPF

SEQ ID NO: 121260 - protein, 10 aa, Artificial Sequence
  Description of Artificial Sequence: Synthetic peptide
  Seed: IGPRHPIRAL (MOG_HUMAN)
IAPRHPIRAM

SEQ ID NO: 121261 - protein, 9 aa, Artificial Sequence
  Description of Artificial Sequence: Synthetic peptide
  Seed: RIRNVRFSD (MOG_HUMAN)
RGRNVRFSA

SEQ ID NO: 121262 - protein, 9 aa, Artificial Sequence
  Description of Artificial Sequence: Synthetic peptide
  Seed: VGDEVELPC (MOG_HUMAN)
VYDEVELPM

SEQ ID NO: 121263 - protein, 10 aa, Artificial Sequence
  Description of Artificial Sequence: Synthetic peptide
  Seed: LLLQVSSSYA (MOG_HUMAN)
LQLQVSSSYA

SEQ ID NO: 121264 - protein, 10 aa, Artificial Sequence
  Description of Artificial Sequence: Synthetic peptide
  Seed: HFLRVPCWKI (MOG_HUMAN)
HYLRVPCWKW

SEQ ID NO: 121265 - protein, 10 aa, Artificial Sequence
  Description of Artificial Sequence: Synthetic peptide
  Seed: RTFDPHFLRV (MOG_HUMAN)
RIFDPHFLRM

SEQ ID NO: 121266 - protein, 9 aa, Artificial Sequence
  Description of Artificial Sequence: Synthetic peptide
  Seed: AIGEGKVTL (MOG_HUMAN)
AMGEGKVTI

SEQ ID NO: 121267 - protein, 10 aa, Artificial Sequence
  Description of Artificial Sequence: Synthetic peptide
  Seed: VLLAVLPVLL (MOG_HUMAN)
VDLAVLPVLL

SEQ ID NO: 121268 - protein, 9 aa, Artificial Sequence
  Description of Artificial Sequence: Synthetic peptide
  Seed: LLAVLPVLL (MOG_HUMAN)
LMAVLPVLF

SEQ ID NO: 121269 - protein, 10 aa, Artificial Sequence
  Description of Artificial Sequence: Synthetic peptide
  Seed: SLSRPSLPSC (MOG_HUMAN)
SFSRPSLPSL

SEQ ID NO: 121270 - protein, 9 aa, Artificial Sequence
  Description of Artificial Sequence: Synthetic peptide
  Seed: SLPSCLCSF (MOG_HUMAN)
SYPSCLCSV

SEQ ID NO: 121271 - protein, 9 aa, Artificial Sequence
  Description of Artificial Sequence: Synthetic peptide
  Seed: RVPCWKITL (MOG_HUMAN)
RYPCWKITY

SEQ ID NO: 121272 - protein, 10 aa, Artificial Sequence
  Description of Artificial Sequence: Synthetic peptide
  Seed: AGQFRVIGPR (MOG_HUMAN)
AYQFRVIGPR

SEQ ID NO: 121273 - protein, 10 aa, Artificial Sequence
  Description of Artificial Sequence: Synthetic peptide
  Seed: FRVIGPRHPI (MOG_HUMAN)
FMVIGPRHPI

SEQ ID NO: 121274 - protein, 10 aa, Artificial Sequence
  Description of Artificial Sequence: Synthetic peptide
  Seed: FLLLLLLQVS (MOG_HUMAN)
FMLLLLLQVV

SEQ ID NO: 121275 - protein, 9 aa, Artificial Sequence
  Description of Artificial Sequence: Synthetic peptide
  Seed: YWVSPGVLV (MOG_HUMAN)
YYVSPGVLV

SEQ ID NO: 121276 - protein, 9 aa, Artificial Sequence
  Description of Artificial Sequence: Synthetic peptide
  Seed: VSSSYAGQF (MOG_HUMAN)
VKSSYAGQM

SEQ ID NO: 121277 - protein, 10 aa, Artificial Sequence
  Description of Artificial Sequence: Synthetic peptide
  Seed: LLLQVSSSYA (MOG_HUMAN)
LKLQVSSSYV

SEQ ID NO: 121278 - protein, 9 aa, Artificial Sequence
  Description of Artificial Sequence: Synthetic peptide
  Seed: LLLQVSSSY (MOG_HUMAN)
LYLQVSSSF

SEQ ID NO: 121279 - protein, 11 aa, Artificial Sequence
  Description of Artificial Sequence: Synthetic peptide
  Seed: RDHSYQEEAAM (MOG_HUMAN)
RPHSYQEEAAY

SEQ ID NO: 121280 - protein, 9 aa, Artificial Sequence
  Description of Artificial Sequence: Synthetic peptide
  Seed: FSDEGGFTC (MOG_HUMAN)
FTDEGGFTK

SEQ ID NO: 121281 - protein, 10 aa, Artificial Sequence
  Description of Artificial Sequence: Synthetic peptide
  Seed: TGMEVGWYRP (MOG_HUMAN)
TRMEVGWYRR

SEQ ID NO: 121282 - protein, 9 aa, Artificial Sequence
  Description of Artificial Sequence: Synthetic peptide
  Seed: KLRAEIENL (MOG_HUMAN)
KTRAEIENV

SEQ ID NO: 121283 - protein, 11 aa, Artificial Sequence
  Description of Artificial Sequence: Synthetic peptide
  Seed: RFSDEGGFTCF (MOG_HUMAN)
RASDEGGFTCM

SEQ ID NO: 121284 - protein, 11 aa, Artificial Sequence
  Description of Artificial Sequence: Synthetic peptide
  Seed: RRLAGQFLEEL (MOG_HUMAN)
RMLAGQFLEEV

SEQ ID NO: 121285 - protein, 9 aa, Artificial Sequence
  Description of Artificial Sequence: Synthetic peptide
  Seed: WVSPGVLVL (MOG_HUMAN)
WASPGVLVH

SEQ ID NO: 121286 - protein, 10 aa, Artificial Sequence
  Description of Artificial Sequence: Synthetic peptide
  Seed: FDPHFLRVPC (MOG_HUMAN)
FHPHFLRVPI

SEQ ID NO: 121287 - protein, 9 aa, Artificial Sequence
  Description of Artificial Sequence: Synthetic peptide
  Seed: MASLSRPSL (MOG_HUMAN)
MKSLSRPSF

SEQ ID NO: 121288 - protein, 9 aa, Artificial Sequence
  Description of Artificial Sequence: Synthetic peptide
  Seed: FSDEGGFTC (MOG_HUMAN)
FVDEGGFTL

SEQ ID NO: 121289 - protein, 10 aa, Artificial Sequence
  Description of Artificial Sequence: Synthetic peptide
  Seed: TGMEVGWYRP (MOG_HUMAN)
TFMEVGWYRT

SEQ ID NO: 121290 - protein, 10 aa, Artificial Sequence
  Description of Artificial Sequence: Synthetic peptide
  Seed: DAIGEGKVTL (MOG_HUMAN)
DMIGEGKVTW

SEQ ID NO: 121291 - protein, 9 aa, Artificial Sequence
  Description of Artificial Sequence: Synthetic peptide
  Seed: RVPCWKITL (MOG_HUMAN)
RVPCWKITR

SEQ ID NO: 121292 - protein, 10 aa, Artificial Sequence
  Description of Artificial Sequence: Synthetic peptide
  Seed: KNATGMEVGW (MOG_HUMAN)
KLATGMEVGW

SEQ ID NO: 121293 - protein, 10 aa, Artificial Sequence
  Description of Artificial Sequence: Synthetic peptide
  Seed: RTFDPHFLRV (MOG_HUMAN)
RMFDPHFLRR

SEQ ID NO: 121294 - protein, 10 aa, Artificial Sequence
  Description of Artificial Sequence: Synthetic peptide
  Seed: FSDEGGFTCF (MOG_HUMAN)
FQDEGGFTCF

SEQ ID NO: 121295 - protein, 9 aa, Artificial Sequence
  Description of Artificial Sequence: Synthetic peptide
  Seed: SLPSCLCSF (MOG_HUMAN)
STPSCLCSY

SEQ ID NO: 121296 - protein, 9 aa, Artificial Sequence
  Description of Artificial Sequence: Synthetic peptide
  Seed: HRRLAGQFL (MOG_HUMAN)
HHRLAGQFL

SEQ ID NO: 121297 - protein, 9 aa, Artificial Sequence
  Description of Artificial Sequence: Synthetic peptide
  Seed: YRPPFSRVV (MOG_HUMAN)
YHPPFSRVL

SEQ ID NO: 121298 - protein, 11 aa, Artificial Sequence
  Description of Artificial Sequence: Synthetic peptide
  Seed: HRTFDPHFLRV (MOG_HUMAN)
HMTFDPHFLRV

SEQ ID NO: 121299 - protein, 10 aa, Artificial Sequence
  Description of Artificial Sequence: Synthetic peptide
  Seed: RTFDPHFLRV (MOG_HUMAN)
RFFDPHFLRT

SEQ ID NO: 121300 - protein, 9 aa, Artificial Sequence
  Description of Artificial Sequence: Synthetic peptide
  Seed: FYWVSPGVL (MOG_HUMAN)
FSWVSPGVM

SEQ ID NO: 121301 - protein, 9 aa, Artificial Sequence
  Description of Artificial Sequence: Synthetic peptide
  Seed: RIRNVRFSD (MOG_HUMAN)
RWRNVRFSL

SEQ ID NO: 121302 - protein, 10 aa, Artificial Sequence
  Description of Artificial Sequence: Synthetic peptide
  Seed: SSYAGQFRVI (MOG_HUMAN)
SFYAGQFRVF

SEQ ID NO: 121303 - protein, 10 aa, Artificial Sequence
  Description of Artificial Sequence: Synthetic peptide
  Seed: LLLQVSSSYA (MOG_HUMAN)
LQLQVSSSYF

SEQ ID NO: 121304 - protein, 10 aa, Artificial Sequence
  Description of Artificial Sequence: Synthetic peptide
  Seed: VGWYRPPFSR (MOG_HUMAN)
VFWYRPPFSK

SEQ ID NO: 121305 - protein, 9 aa, Artificial Sequence
  Description of Artificial Sequence: Synthetic peptide
  Seed: RVPCWKITL (MOG_HUMAN)
RLPCWKITL

SEQ ID NO: 121306 - protein, 10 aa, Artificial Sequence
  Description of Artificial Sequence: Synthetic peptide
  Seed: FVIVPVLGPL (MOG_HUMAN)
FNIVPVLGPI

SEQ ID NO: 121307 - protein, 10 aa, Artificial Sequence
  Description of Artificial Sequence: Synthetic peptide
  Seed: FVIVPVLGPL (MOG_HUMAN)
FLIVPVLGPA

SEQ ID NO: 121308 - protein, 9 aa, Artificial Sequence
  Description of Artificial Sequence: Synthetic peptide
  Seed: LLLQITVGL (MOG_HUMAN)
LMLQITVGY

SEQ ID NO: 121309 - protein, 10 aa, Artificial Sequence
  Description of Artificial Sequence: Synthetic peptide
  Seed: FDPHFLRVPC (MOG_HUMAN)
FKPHFLRVPS

SEQ ID NO: 121310 - protein, 9 aa, Artificial Sequence
  Description of Artificial Sequence: Synthetic peptide
  Seed: LQITVGLIF (MOG_HUMAN)
LRITVGLIY

SEQ ID NO: 121311 - protein, 11 aa, Artificial Sequence
  Description of Artificial Sequence: Synthetic peptide
  Seed: RDHSYQEEAAM (MOG_HUMAN)
RIHSYQEEAAY

SEQ ID NO: 121312 - protein, 9 aa, Artificial Sequence
  Description of Artificial Sequence: Synthetic peptide
  Seed: AEIENLHRT (MOG_HUMAN)
AEIENLHRL

SEQ ID NO: 121313 - protein, 9 aa, Artificial Sequence
  Description of Artificial Sequence: Synthetic peptide
  Seed: LLLQVSSSY (MOG_HUMAN)
LHLQVSSSM

SEQ ID NO: 121314 - protein, 11 aa, Artificial Sequence
  Description of Artificial Sequence: Synthetic peptide
  Seed: RTFDPHFLRVP (MOG_HUMAN)
RVFDPHFLRVK

SEQ ID NO: 121315 - protein, 10 aa, Artificial Sequence
  Description of Artificial Sequence: Synthetic peptide
  Seed: RVPCWKITLF (MOG_HUMAN)
RYPCWKITLY

SEQ ID NO: 121316 - protein, 9 aa, Artificial Sequence
  Description of Artificial Sequence: Synthetic peptide
  Seed: SYAGQFRVI (MOG_HUMAN)
SWAGQFRVY

SEQ ID NO: 121317 - protein, 9 aa, Artificial Sequence
  Description of Artificial Sequence: Synthetic peptide
  Seed: RIRNVRFSD (MOG_HUMAN)
RVRNVRFSL

SEQ ID NO: 121318 - protein, 9 aa, Artificial Sequence
  Description of Artificial Sequence: Synthetic peptide
  Seed: FLLLLLLQV (MOG_HUMAN)
FMLLLLLQI

SEQ ID NO: 121319 - protein, 10 aa, Artificial Sequence
  Description of Artificial Sequence: Synthetic peptide
  Seed: HRTFDPHFLR (MOG_HUMAN)
HTTFDPHFLY

SEQ ID NO: 121320 - protein, 9 aa, Artificial Sequence
  Description of Artificial Sequence: Synthetic peptide
  Seed: SSYAGQFRV (MOG_HUMAN)
SIYAGQFRA

SEQ ID NO: 121321 - protein, 10 aa, Artificial Sequence
  Description of Artificial Sequence: Synthetic peptide
  Seed: RIRNVRFSDE (MOG_HUMAN)
RVRNVRFSDM

SEQ ID NO: 121322 - protein, 9 aa, Artificial Sequence
  Description of Artificial Sequence: Synthetic peptide
  Seed: FLEELRNPF (MOG_HUMAN)
FWEELRNPL

SEQ ID NO: 121323 - protein, 9 aa, Artificial Sequence
  Description of Artificial Sequence: Synthetic peptide
  Seed: RVIGPRHPI (MOG_HUMAN)
RFIGPRHPF

SEQ ID NO: 121324 - protein, 11 aa, Artificial Sequence
  Description of Artificial Sequence: Synthetic peptide
  Seed: KDQDGDQAPEY (MOG_HUMAN)
KEQDGDQAPEW

SEQ ID NO: 121325 - protein, 9 aa, Artificial Sequence
  Description of Artificial Sequence: Synthetic peptide
  Seed: IFLCLQYRL (MOG_HUMAN)
IWLCLQYRW

SEQ ID NO: 121326 - protein, 10 aa, Artificial Sequence
  Description of Artificial Sequence: Synthetic peptide
  Seed: WVSPGVLVLL (MOG_HUMAN)
WVSPGVLVLM

SEQ ID NO: 121327 - protein, 9 aa, Artificial Sequence
  Description of Artificial Sequence: Synthetic peptide
  Seed: HFLRVPCWK (MOG_HUMAN)
HSLRVPCWR

SEQ ID NO: 121328 - protein, 10 aa, Artificial Sequence
  Description of Artificial Sequence: Synthetic peptide
  Seed: FDPHFLRVPC (MOG_HUMAN)
FTPHFLRVPF

SEQ ID NO: 121329 - protein, 11 aa, Artificial Sequence
  Description of Artificial Sequence: Synthetic peptide
  Seed: HSYQEEAAMEL (MOG_HUMAN)
HQYQEEAAMEL

SEQ ID NO: 121330 - protein, 9 aa, Artificial Sequence
  Description of Artificial Sequence: Synthetic peptide
  Seed: KDQDGDQAP (MOG_HUMAN)
KEQDGDQAM

SEQ ID NO: 121331 - protein, 9 aa, Artificial Sequence
  Description of Artificial Sequence: Synthetic peptide
  Seed: HSYQEEAAM (MOG_HUMAN)
HFYQEEAAF

SEQ ID NO: 121332 - protein, 9 aa, Artificial Sequence
  Description of Artificial Sequence: Synthetic peptide
  Seed: VLPVLLLQI (MOG_HUMAN)
VYPVLLLQW

SEQ ID NO: 121333 - protein, 10 aa, Artificial Sequence
  Description of Artificial Sequence: Synthetic peptide
  Seed: IGPRHPIRAL (MOG_HUMAN)
INPRHPIRAM

SEQ ID NO: 121334 - protein, 9 aa, Artificial Sequence
  Description of Artificial Sequence: Synthetic peptide
  Seed: ICYNWLHRR (MOG_HUMAN)
ILYNWLHRI

SEQ ID NO: 121335 - protein, 9 aa, Artificial Sequence
  Description of Artificial Sequence: Synthetic peptide
  Seed: LLQVSSSYA (MOG_HUMAN)
LMQVSSSYA

SEQ ID NO: 121336 - protein, 11 aa, Artificial Sequence
  Description of Artificial Sequence: Synthetic peptide
  Seed: RFSDEGGFTCF (MOG_HUMAN)
RWSDEGGFTCF

SEQ ID NO: 121337 - protein, 10 aa, Artificial Sequence
  Description of Artificial Sequence: Synthetic peptide
  Seed: RALVGDEVEL (MOG_HUMAN)
RMLVGDEVEL

SEQ ID NO: 121338 - protein, 9 aa, Artificial Sequence
  Description of Artificial Sequence: Synthetic peptide
  Seed: FLLLLLLQV (MOG_HUMAN)
FALLLLLQV

SEQ ID NO: 121339 - protein, 9 aa, Artificial Sequence
  Description of Artificial Sequence: Synthetic peptide
  Seed: LLLQITVGL (MOG_HUMAN)
LVLQITVGV

SEQ ID NO: 121340 - protein, 9 aa, Artificial Sequence
  Description of Artificial Sequence: Synthetic peptide
  Seed: TGMEVGWYR (MOG_HUMAN)
TQMEVGWYK

SEQ ID NO: 121341 - protein, 9 aa, Artificial Sequence
  Description of Artificial Sequence: Synthetic peptide
  Seed: LAGQFLEEL (MOG_HUMAN)
LRGQFLEEF

SEQ ID NO: 121342 - protein, 10 aa, Artificial Sequence
  Description of Artificial Sequence: Synthetic peptide
  Seed: DEGGFTCFFR (MOG_HUMAN)
DLGGFTCFFK

SEQ ID NO: 121343 - protein, 10 aa, Artificial Sequence
  Description of Artificial Sequence: Synthetic peptide
  Seed: SSYAGQFRVI (MOG_HUMAN)
SVYAGQFRVW

SEQ ID NO: 121344 - protein, 9 aa, Artificial Sequence
  Description of Artificial Sequence: Synthetic peptide
  Seed: FYWVSPGVL (MOG_HUMAN)
FNWVSPGVF

SEQ ID NO: 121345 - protein, 10 aa, Artificial Sequence
  Description of Artificial Sequence: Synthetic peptide
  Seed: FSDEGGFTCF (MOG_HUMAN)
FADEGGFTCV

SEQ ID NO: 121346 - protein, 9 aa, Artificial Sequence
  Description of Artificial Sequence: Synthetic peptide
  Seed: IICYNWLHR (MOG_HUMAN)
IYCYNWLHR

SEQ ID NO: 121347 - protein, 9 aa, Artificial Sequence
  Description of Artificial Sequence: Synthetic peptide
  Seed: KVEDPFYWV (MOG_HUMAN)
KMEDPFYWV

SEQ ID NO: 121348 - protein, 9 aa, Artificial Sequence
  Description of Artificial Sequence: Synthetic peptide
  Seed: YQEEAAMEL (MOG_HUMAN)
YREEAAMEF

SEQ ID NO: 121349 - protein, 9 aa, Artificial Sequence
  Description of Artificial Sequence: Synthetic peptide
  Seed: ICYNWLHRR (MOG_HUMAN)
IIYNWLHRR

SEQ ID NO: 121350 - protein, 9 aa, Artificial Sequence
  Description of Artificial Sequence: Synthetic peptide
  Seed: LSRPSLPSC (MOG_HUMAN)
LTRPSLPSR

SEQ ID NO: 121351 - protein, 10 aa, Artificial Sequence
  Description of Artificial Sequence: Synthetic peptide
  Seed: FDPHFLRVPC (MOG_HUMAN)
FRPHFLRVPA

SEQ ID NO: 121352 - protein, 10 aa, Artificial Sequence
  Description of Artificial Sequence: Synthetic peptide
  Seed: RIRNVRFSDE (MOG_HUMAN)
RLRNVRFSDA

SEQ ID NO: 121353 - protein, 9 aa, Artificial Sequence
  Description of Artificial Sequence: Synthetic peptide
  Seed: ALIICYNWL (MOG_HUMAN)
AMIICYNWI

SEQ ID NO: 121354 - protein, 9 aa, Artificial Sequence
  Description of Artificial Sequence: Synthetic peptide
  Seed: MASLSRPSL (MOG_HUMAN)
MYSLSRPSI

SEQ ID NO: 121355 - protein, 10 aa, Artificial Sequence
  Description of Artificial Sequence: Synthetic peptide
  Seed: RALVGDEVEL (MOG_HUMAN)
RILVGDEVEL

SEQ ID NO: 121356 - protein, 9 aa, Artificial Sequence
  Description of Artificial Sequence: Synthetic peptide
  Seed: RVPCWKITL (MOG_HUMAN)
RFPCWKITL

SEQ ID NO: 121357 - protein, 9 aa, Artificial Sequence
  Description of Artificial Sequence: Synthetic peptide
  Seed: AIGEGKVTL (MOG_HUMAN)
AQGEGKVTL

SEQ ID NO: 121358 - protein, 9 aa, Artificial Sequence
  Description of Artificial Sequence: Synthetic peptide
  Seed: VTLRIRNVR (MOG_HUMAN)
VVLRIRNVR

SEQ ID NO: 121359 - protein, 9 aa, Artificial Sequence
  Description of Artificial Sequence: Synthetic peptide
  Seed: RTFDPHFLR (MOG_HUMAN)
RIFDPHFLM

SEQ ID NO: 121360 - protein, 10 aa, Artificial Sequence
  Description of Artificial Sequence: Synthetic peptide
  Seed: RVPCWKITLF (MOG_HUMAN)
RYPCWKITLW

SEQ ID NO: 121361 - protein, 10 aa, Artificial Sequence
  Description of Artificial Sequence: Synthetic peptide
  Seed: SDEGGFTCFF (MOG_HUMAN)
SWEGGFTCFW

SEQ ID NO: 121362 - protein, 10 aa, Artificial Sequence
  Description of Artificial Sequence: Synthetic peptide
  Seed: RALVGDEVEL (MOG_HUMAN)
RFLVGDEVEL

SEQ ID NO: 121363 - protein, 10 aa, Artificial Sequence
  Description of Artificial Sequence: Synthetic peptide
  Seed: RVVHLYRNGK (MOG_HUMAN)
RPVHLYRNGR

SEQ ID NO: 121364 - protein, 9 aa, Artificial Sequence
  Description of Artificial Sequence: Synthetic peptide
  Seed: VLGPLVALI (MOG_HUMAN)
VQGPLVALI

SEQ ID NO: 121365 - protein, 9 aa, Artificial Sequence
  Description of Artificial Sequence: Synthetic peptide
  Seed: CSFLLLLLL (MOG_HUMAN)
CTFLLLLLF

SEQ ID NO: 121366 - protein, 10 aa, Artificial Sequence
  Description of Artificial Sequence: Synthetic peptide
  Seed: YWVSPGVLVL (MOG_HUMAN)
YQVSPGVLVM

SEQ ID NO: 121367 - protein, 10 aa, Artificial Sequence
  Description of Artificial Sequence: Synthetic peptide
  Seed: RTFDPHFLRV (MOG_HUMAN)
REFDPHFLRI

SEQ ID NO: 121368 - protein, 10 aa, Artificial Sequence
  Description of Artificial Sequence: Synthetic peptide
  Seed: IGPRHPIRAL (MOG_HUMAN)
IQPRHPIRAF

SEQ ID NO: 121369 - protein, 10 aa, Artificial Sequence
  Description of Artificial Sequence: Synthetic peptide
  Seed: DEGGFTCFFR (MOG_HUMAN)
DWGGFTCFFR

SEQ ID NO: 121370 - protein, 9 aa, Artificial Sequence
  Description of Artificial Sequence: Synthetic peptide
  Seed: LLQVSSSYA (MOG_HUMAN)
LVQVSSSYV

SEQ ID NO: 121371 - protein, 9 aa, Artificial Sequence
  Description of Artificial Sequence: Synthetic peptide
  Seed: CLCSFLLLL (MOG_HUMAN)
CTCSFLLLW

SEQ ID NO: 121372 - protein, 10 aa, Artificial Sequence
  Description of Artificial Sequence: Synthetic peptide
  Seed: IICYNWLHRR (MOG_HUMAN)
ILCYNWLHRR

SEQ ID NO: 121373 - protein, 11 aa, Artificial Sequence
  Description of Artificial Sequence: Synthetic peptide
  Seed: FSDEGGFTCFF (MOG_HUMAN)
FSDEGGFTCFM

SEQ ID NO: 121374 - protein, 10 aa, Artificial Sequence
  Description of Artificial Sequence: Synthetic peptide
  Seed: SLSRPSLPSC (MOG_HUMAN)
STSRPSLPSA

SEQ ID NO: 121375 - protein, 9 aa, Artificial Sequence
  Description of Artificial Sequence: Synthetic peptide
  Seed: CWKITLFVI (MOG_HUMAN)
CYKITLFVI

SEQ ID NO: 121376 - protein, 10 aa, Artificial Sequence
  Description of Artificial Sequence: Synthetic peptide
  Seed: FSDEGGFTCF (MOG_HUMAN)
FEDEGGFTCL

SEQ ID NO: 121377 - protein, 9 aa, Artificial Sequence
  Description of Artificial Sequence: Synthetic peptide
  Seed: FYWVSPGVL (MOG_HUMAN)
FIWVSPGVF

SEQ ID NO: 121378 - protein, 10 aa, Artificial Sequence
  Description of Artificial Sequence: Synthetic peptide
  Seed: TGMEVGWYRP (MOG_HUMAN)
TMMEVGWYRF

SEQ ID NO: 121379 - protein, 10 aa, Artificial Sequence
  Description of Artificial Sequence: Synthetic peptide
  Seed: RVPCWKITLF (MOG_HUMAN)
RTPCWKITLW

SEQ ID NO: 121380 - protein, 10 aa, Artificial Sequence
  Description of Artificial Sequence: Synthetic peptide
  Seed: SSYAGQFRVI (MOG_HUMAN)
SVYAGQFRVY

SEQ ID NO: 121381 - protein, 9 aa, Artificial Sequence
  Description of Artificial Sequence: Synthetic peptide
  Seed: WVSPGVLVL (MOG_HUMAN)
WFSPGVLVL

SEQ ID NO: 121382 - protein, 10 aa, Artificial Sequence
  Description of Artificial Sequence: Synthetic peptide
  Seed: FTCFFRDHSY (MOG_HUMAN)
FTCFFRDHSK

SEQ ID NO: 121383 - protein, 9 aa, Artificial Sequence
  Description of Artificial Sequence: Synthetic peptide
  Seed: HSYQEEAAM (MOG_HUMAN)
HPYQEEAAV

SEQ ID NO: 121384 - protein, 10 aa, Artificial Sequence
  Description of Artificial Sequence: Synthetic peptide
  Seed: SCLCSFLLLL (MOG_HUMAN)
SNLCSFLLLV

SEQ ID NO: 121385 - protein, 9 aa, Artificial Sequence
  Description of Artificial Sequence: Synthetic peptide
  Seed: VLGPLVALI (MOG_HUMAN)
VAGPLVALI

SEQ ID NO: 121386 - protein, 9 aa, Artificial Sequence
  Description of Artificial Sequence: Synthetic peptide
  Seed: GQFRVIGPR (MOG_HUMAN)
GAFRVIGPK

SEQ ID NO: 121387 - protein, 9 aa, Artificial Sequence
  Description of Artificial Sequence: Synthetic peptide
  Seed: FYWVSPGVL (MOG_HUMAN)
FQWVSPGVW

SEQ ID NO: 121388 - protein, 10 aa, Artificial Sequence
  Description of Artificial Sequence: Synthetic peptide
  Seed: VLLLQITVGL (MOG_HUMAN)
VLLLQITVGI

SEQ ID NO: 121389 - protein, 11 aa, Artificial Sequence
  Description of Artificial Sequence: Synthetic peptide
  Seed: RDHSYQEEAAM (MOG_HUMAN)
RVHSYQEEAAY

SEQ ID NO: 121390 - protein, 10 aa, Artificial Sequence
  Description of Artificial Sequence: Synthetic peptide
  Seed: ATGMEVGWYR (MOG_HUMAN)
AIGMEVGWYK

SEQ ID NO: 121391 - protein, 10 aa, Artificial Sequence
  Description of Artificial Sequence: Synthetic peptide
  Seed: YWVSPGVLVL (MOG_HUMAN)
YFVSPGVLVW

SEQ ID NO: 121392 - protein, 9 aa, Artificial Sequence
  Description of Artificial Sequence: Synthetic peptide
  Seed: YWVSPGVLV (MOG_HUMAN)
YYVSPGVLY

SEQ ID NO: 121393 - protein, 11 aa, Artificial Sequence
  Description of Artificial Sequence: Synthetic peptide
  Seed: RDHSYQEEAAM (MOG_HUMAN)
RCHSYQEEAAY

SEQ ID NO: 121394 - protein, 9 aa, Artificial Sequence
  Description of Artificial Sequence: Synthetic peptide
  Seed: TCFFRDHSY (MOG_HUMAN)
TRFFRDHSY

SEQ ID NO: 121395 - protein, 9 aa, Artificial Sequence
  Description of Artificial Sequence: Synthetic peptide
  Seed: LAVLPVLLL (MOG_HUMAN)
LTVLPVLLI

SEQ ID NO: 121396 - protein, 9 aa, Artificial Sequence
  Description of Artificial Sequence: Synthetic peptide
  Seed: SLPSCLCSF (MOG_HUMAN)
SVPSCLCSL

SEQ ID NO: 121397 - protein, 9 aa, Artificial Sequence
  Description of Artificial Sequence: Synthetic peptide
  Seed: FSDEGGFTC (MOG_HUMAN)
FVDEGGFTW

SEQ ID NO: 121398 - protein, 9 aa, Artificial Sequence
  Description of Artificial Sequence: Synthetic peptide
  Seed: TFDPHFLRV (MOG_HUMAN)
TIDPHFLRV

SEQ ID NO: 121399 - protein, 10 aa, Artificial Sequence
  Description of Artificial Sequence: Synthetic peptide
  Seed: RALVGDEVEL (MOG_HUMAN)
RFLVGDEVEV

SEQ ID NO: 121400 - protein, 9 aa, Artificial Sequence
  Description of Artificial Sequence: Synthetic peptide
  Seed: KVEDPFYWV (MOG_HUMAN)
KIEDPFYWL

SEQ ID NO: 121401 - protein, 8 aa, Artificial Sequence
  Description of Artificial Sequence: Synthetic peptide
  Seed: KVEDPFYW (MOG_HUMAN)
KSEDPFYW

SEQ ID NO: 121402 - protein, 9 aa, Artificial Sequence
  Description of Artificial Sequence: Synthetic peptide
  Seed: SRPSLPSCL (MOG_HUMAN)
SMPSLPSCF

SEQ ID NO: 121403 - protein, 8 aa, Artificial Sequence
  Description of Artificial Sequence: Synthetic peptide
  Seed: RIRNVRFS (MOG_HUMAN)
RVRNVRFL

SEQ ID NO: 121404 - protein, 9 aa, Artificial Sequence
  Description of Artificial Sequence: Synthetic peptide
  Seed: RTFDPHFLR (MOG_HUMAN)
RQFDPHFLF

SEQ ID NO: 121405 - protein, 10 aa, Artificial Sequence
  Description of Artificial Sequence: Synthetic peptide
  Seed: LLLLQVSSSY (MOG_HUMAN)
LELLQVSSSF

SEQ ID NO: 121406 - protein, 10 aa, Artificial Sequence
  Description of Artificial Sequence: Synthetic peptide
  Seed: AVLPVLLLQI (MOG_HUMAN)
AQLPVLLLQV

SEQ ID NO: 121407 - protein, 10 aa, Artificial Sequence
  Description of Artificial Sequence: Synthetic peptide
  Seed: LLLQVSSSYA (MOG_HUMAN)
LSLQVSSSYF

SEQ ID NO: 121408 - protein, 9 aa, Artificial Sequence
  Description of Artificial Sequence: Synthetic peptide
  Seed: SLPSCLCSF (MOG_HUMAN)
SMPSCLCSY

SEQ ID NO: 121409 - protein, 8 aa, Artificial Sequence
  Description of Artificial Sequence: Synthetic peptide
  Seed: TFDPHFLR (MOG_HUMAN)
TLDPHFLY

SEQ ID NO: 121410 - protein, 9 aa, Artificial Sequence
  Description of Artificial Sequence: Synthetic peptide
  Seed: VSPGVLVLL (MOG_HUMAN)
VTPGVLVLV

SEQ ID NO: 121411 - protein, 10 aa, Artificial Sequence
  Description of Artificial Sequence: Synthetic peptide
  Seed: GLIFLCLQYR (MOG_HUMAN)
GMIFLCLQYK

SEQ ID NO: 121412 - protein, 10 aa, Artificial Sequence
  Description of Artificial Sequence: Synthetic peptide
  Seed: SCLCSFLLLL (MOG_HUMAN)
SLLCSFLLLM

SEQ ID NO: 121413 - protein, 10 aa, Artificial Sequence
  Description of Artificial Sequence: Synthetic peptide
  Seed: SCLCSFLLLL (MOG_HUMAN)
SHLCSFLLLI

SEQ ID NO: 121414 - protein, 9 aa, Artificial Sequence
  Description of Artificial Sequence: Synthetic peptide
  Seed: FSDEGGFTC (MOG_HUMAN)
FGDEGGFTA

SEQ ID NO: 121415 - protein, 10 aa, Artificial Sequence
  Description of Artificial Sequence: Synthetic peptide
  Seed: VSSSYAGQFR (MOG_HUMAN)
VTSSYAGQFY

SEQ ID NO: 121416 - protein, 9 aa, Artificial Sequence
  Description of Artificial Sequence: Synthetic peptide
  Seed: LQYRLRGKL (MOG_HUMAN)
LLYRLRGKY

SEQ ID NO: 121417 - protein, 9 aa, Artificial Sequence
  Description of Artificial Sequence: Synthetic peptide
  Seed: MASLSRPSL (MOG_HUMAN)
MPSLSRPSF

SEQ ID NO: 121418 - protein, 9 aa, Artificial Sequence
  Description of Artificial Sequence: Synthetic peptide
  Seed: FSDEGGFTC (MOG_HUMAN)
FRDEGGFTL

SEQ ID NO: 121419 - protein, 10 aa, Artificial Sequence
  Description of Artificial Sequence: Synthetic peptide
  Seed: SLSRPSLPSC (MOG_HUMAN)
SNSRPSLPSI

SEQ ID NO: 121420 - protein, 9 aa, Artificial Sequence
  Description of Artificial Sequence: Synthetic peptide
  Seed: ICYNWLHRR (MOG_HUMAN)
IVYNWLHRK

SEQ ID NO: 121421 - protein, 9 aa, Artificial Sequence
  Description of Artificial Sequence: Synthetic peptide
  Seed: RVIGPRHPI (MOG_HUMAN)
RMIGPRHPY

SEQ ID NO: 121422 - protein, 9 aa, Artificial Sequence
  Description of Artificial Sequence: Synthetic peptide
  Seed: RVIGPRHPI (MOG_HUMAN)
RAIGPRHPL

SEQ ID NO: 121423 - protein, 9 aa, Artificial Sequence
  Description of Artificial Sequence: Synthetic peptide
  Seed: FYWVSPGVL (MOG_HUMAN)
FMWVSPGVH

SEQ ID NO: 121424 - protein, 10 aa, Artificial Sequence
  Description of Artificial Sequence: Synthetic peptide
  Seed: GLIFLCLQYR (MOG_HUMAN)
GWIFLCLQYR

SEQ ID NO: 121425 - protein, 9 aa, Artificial Sequence
  Description of Artificial Sequence: Synthetic peptide
  Seed: YQEEAAMEL (MOG_HUMAN)
YAEEAAMEV

SEQ ID NO: 121426 - protein, 9 aa, Artificial Sequence
  Description of Artificial Sequence: Synthetic peptide
  Seed: VTLRIRNVR (MOG_HUMAN)
VFLRIRNVR

SEQ ID NO: 121427 - protein, 10 aa, Artificial Sequence
  Description of Artificial Sequence: Synthetic peptide
  Seed: HFLRVPCWKI (MOG_HUMAN)
HYLRVPCWKL

SEQ ID NO: 121428 - protein, 9 aa, Artificial Sequence
  Description of Artificial Sequence: Synthetic peptide
  Seed: VSSSYAGQF (MOG_HUMAN)
VTSSYAGQF

SEQ ID NO: 121429 - protein, 10 aa, Artificial Sequence
  Description of Artificial Sequence: Synthetic peptide
  Seed: KVTLRIRNVR (MOG_HUMAN)
KMTLRIRNVR

SEQ ID NO: 121430 - protein, 9 aa, Artificial Sequence
  Description of Artificial Sequence: Synthetic peptide
  Seed: RIRNVRFSD (MOG_HUMAN)
RFRNVRFSI

SEQ ID NO: 121431 - protein, 10 aa, Artificial Sequence
  Description of Artificial Sequence: Synthetic peptide
  Seed: SLSRPSLPSC (MOG_HUMAN)
SQSRPSLPSV

SEQ ID NO: 121432 - protein, 10 aa, Artificial Sequence
  Description of Artificial Sequence: Synthetic peptide
  Seed: RVPCWKITLF (MOG_HUMAN)
RMPCWKITLY

SEQ ID NO: 121433 - protein, 9 aa, Artificial Sequence
  Description of Artificial Sequence: Synthetic peptide
  Seed: FLEELRNPF (MOG_HUMAN)
FLEELRNPY

SEQ ID NO: 121434 - protein, 9 aa, Artificial Sequence
  Description of Artificial Sequence: Synthetic peptide
  Seed: LQITVGLIF (MOG_HUMAN)
LHITVGLIY

SEQ ID NO: 121435 - protein, 11 aa, Artificial Sequence
  Description of Artificial Sequence: Synthetic peptide
  Seed: FSDEGGFTCFF (MOG_HUMAN)
FCDEGGFTCFL

SEQ ID NO: 121436 - protein, 9 aa, Artificial Sequence
  Description of Artificial Sequence: Synthetic peptide
  Seed: YQEEAAMEL (MOG_HUMAN)
YWEEAAMEF

SEQ ID NO: 121437 - protein, 11 aa, Artificial Sequence
  Description of Artificial Sequence: Synthetic peptide
  Seed: LIICYNWLHRR (MOG_HUMAN)
LSICYNWLHRR

SEQ ID NO: 121438 - protein, 10 aa, Artificial Sequence
  Description of Artificial Sequence: Synthetic peptide
  Seed: RTFDPHFLRV (MOG_HUMAN)
RTFDPHFLRA

SEQ ID NO: 121439 - protein, 9 aa, Artificial Sequence
  Description of Artificial Sequence: Synthetic peptide
  Seed: RVIGPRHPI (MOG_HUMAN)
RQIGPRHPK

SEQ ID NO: 121440 - protein, 9 aa, Artificial Sequence
  Description of Artificial Sequence: Synthetic peptide
  Seed: AIGEGKVTL (MOG_HUMAN)
AEGEGKVTL

SEQ ID NO: 121441 - protein, 9 aa, Artificial Sequence
  Description of Artificial Sequence: Synthetic peptide
  Seed: FSDEGGFTC (MOG_HUMAN)
FIDEGGFTI

SEQ ID NO: 121442 - protein, 11 aa, Artificial Sequence
  Description of Artificial Sequence: Synthetic peptide
  Seed: RRLAGQFLEEL (MOG_HUMAN)
RRLAGQFLEER

SEQ ID NO: 121443 - protein, 9 aa, Artificial Sequence
  Description of Artificial Sequence: Synthetic peptide
  Seed: MASLSRPSL (MOG_HUMAN)
MGSLSRPSW

SEQ ID NO: 121444 - protein, 9 aa, Artificial Sequence
  Description of Artificial Sequence: Synthetic peptide
  Seed: LCSFLLLLL (MOG_HUMAN)
LVSFLLLLV

SEQ ID NO: 121445 - protein, 9 aa, Artificial Sequence
  Description of Artificial Sequence: Synthetic peptide
  Seed: RIRNVRFSD (MOG_HUMAN)
RWRNVRFST

SEQ ID NO: 121446 - protein, 9 aa, Artificial Sequence
  Description of Artificial Sequence: Synthetic peptide
  Seed: DQAPEYRGR (MOG_HUMAN)
DLAPEYRGR

SEQ ID NO: 121447 - protein, 10 aa, Artificial Sequence
  Description of Artificial Sequence: Synthetic peptide
  Seed: FDPHFLRVPC (MOG_HUMAN)
FDPHFLRVPI

SEQ ID NO: 121448 - protein, 9 aa, Artificial Sequence
  Description of Artificial Sequence: Synthetic peptide
  Seed: VLLAVLPVL (MOG_HUMAN)
VVLAVLPVI

SEQ ID NO: 121449 - protein, 11 aa, Artificial Sequence
  Description of Artificial Sequence: Synthetic peptide
  Seed: RTFDPHFLRVP (MOG_HUMAN)
RMFDPHFLRVH

SEQ ID NO: 121450 - protein, 9 aa, Artificial Sequence
  Description of Artificial Sequence: Synthetic peptide
  Seed: RTFDPHFLR (MOG_HUMAN)
RVFDPHFLL

SEQ ID NO: 121451 - protein, 9 aa, Artificial Sequence
  Description of Artificial Sequence: Synthetic peptide
  Seed: VIVPVLGPL (MOG_HUMAN)
VLVPVLGPT

SEQ ID NO: 121452 - protein, 9 aa, Artificial Sequence
  Description of Artificial Sequence: Synthetic peptide
  Seed: WVSPGVLVL (MOG_HUMAN)
WVSPGVLVY

SEQ ID NO: 121453 - protein, 9 aa, Artificial Sequence
  Description of Artificial Sequence: Synthetic peptide
  Seed: KVEDPFYWV (MOG_HUMAN)
KMEDPFYWI

SEQ ID NO: 121454 - protein, 9 aa, Artificial Sequence
  Description of Artificial Sequence: Synthetic peptide
  Seed: AIGEGKVTL (MOG_HUMAN)
ALGEGKVTY

SEQ ID NO: 121455 - protein, 10 aa, Artificial Sequence
  Description of Artificial Sequence: Synthetic peptide
  Seed: AEIENLHRTF (MOG_HUMAN)
AQIENLHRTM

SEQ ID NO: 121456 - protein, 10 aa, Artificial Sequence
  Description of Artificial Sequence: Synthetic peptide
  Seed: KVTLRIRNVR (MOG_HUMAN)
KKTLRIRNVR

SEQ ID NO: 121457 - protein, 9 aa, Artificial Sequence
  Description of Artificial Sequence: Synthetic peptide
  Seed: YRPPFSRVV (MOG_HUMAN)
YMPPFSRVV

SEQ ID NO: 121458 - protein, 10 aa, Artificial Sequence
  Description of Artificial Sequence: Synthetic peptide
  Seed: RTFDPHFLRV (MOG_HUMAN)
RSFDPHFLRW

SEQ ID NO: 121459 - protein, 10 aa, Artificial Sequence
  Description of Artificial Sequence: Synthetic peptide
  Seed: KITLFVIVPV (MOG_HUMAN)
KETLFVIVPV

SEQ ID NO: 121460 - protein, 10 aa, Artificial Sequence
  Description of Artificial Sequence: Synthetic peptide
  Seed: RTFDPHFLRV (MOG_HUMAN)
RMFDPHFLRQ

SEQ ID NO: 121461 - protein, 11 aa, Artificial Sequence
  Description of Artificial Sequence: Synthetic peptide
  Seed: RVIGPRHPIRA (MOG_HUMAN)
RYIGPRHPIRR

SEQ ID NO: 121462 - protein, 9 aa, Artificial Sequence
  Description of Artificial Sequence: Synthetic peptide
  Seed: VIVPVLGPL (MOG_HUMAN)
VGVPVLGPY

SEQ ID NO: 121463 - protein, 9 aa, Artificial Sequence
  Description of Artificial Sequence: Synthetic peptide
  Seed: VGDEVELPC (MOG_HUMAN)
VTDEVELPF

SEQ ID NO: 121464 - protein, 9 aa, Artificial Sequence
  Description of Artificial Sequence: Synthetic peptide
  Seed: VLLAVLPVL (MOG_HUMAN)
VMLAVLPVW

SEQ ID NO: 121465 - protein, 10 aa, Artificial Sequence
  Description of Artificial Sequence: Synthetic peptide
  Seed: LLLQVSSSYA (MOG_HUMAN)
LMLQVSSSYS

SEQ ID NO: 121466 - protein, 10 aa, Artificial Sequence
  Description of Artificial Sequence: Synthetic peptide
  Seed: KITLFVIVPV (MOG_HUMAN)
KQTLFVIVPV

SEQ ID NO: 121467 - protein, 10 aa, Artificial Sequence
  Description of Artificial Sequence: Synthetic peptide
  Seed: LSRPSLPSCL (MOG_HUMAN)
LSRPSLPSCF

SEQ ID NO: 121468 - protein, 10 aa, Artificial Sequence
  Description of Artificial Sequence: Synthetic peptide
  Seed: RVVHLYRNGK (MOG_HUMAN)
RWVHLYRNGR

SEQ ID NO: 121469 - protein, 10 aa, Artificial Sequence
  Description of Artificial Sequence: Synthetic peptide
  Seed: SYQEEAAMEL (MOG_HUMAN)
SFQEEAAMEF

SEQ ID NO: 121470 - protein, 9 aa, Artificial Sequence
  Description of Artificial Sequence: Synthetic peptide
  Seed: LSRPSLPSC (MOG_HUMAN)
LTRPSLPSK

SEQ ID NO: 121471 - protein, 11 aa, Artificial Sequence
  Description of Artificial Sequence: Synthetic peptide
  Seed: VLVLLAVLPVL (MOG_HUMAN)
VIVLLAVLPVV

SEQ ID NO: 121472 - protein, 10 aa, Artificial Sequence
  Description of Artificial Sequence: Synthetic peptide
  Seed: DAIGEGKVTL (MOG_HUMAN)
DTIGEGKVTF

SEQ ID NO: 121473 - protein, 9 aa, Artificial Sequence
  Description of Artificial Sequence: Synthetic peptide
  Seed: DEGGFTCFF (MOG_HUMAN)
DEGGFTCFY

SEQ ID NO: 121474 - protein, 9 aa, Artificial Sequence
  Description of Artificial Sequence: Synthetic peptide
  Seed: RPSLPSCLC (MOG_HUMAN)
RPSLPSCLF

SEQ ID NO: 121475 - protein, 10 aa, Artificial Sequence
  Description of Artificial Sequence: Synthetic peptide
  Seed: RTFDPHFLRV (MOG_HUMAN)
RWFDPHFLRW

SEQ ID NO: 121476 - protein, 10 aa, Artificial Sequence
  Description of Artificial Sequence: Synthetic peptide
  Seed: SSYAGQFRVI (MOG_HUMAN)
SEYAGQFRVF

SEQ ID NO: 121477 - protein, 11 aa, Artificial Sequence
  Description of Artificial Sequence: Synthetic peptide
  Seed: RRLAGQFLEEL (MOG_HUMAN)
RLLAGQFLEEV

SEQ ID NO: 121478 - protein, 10 aa, Artificial Sequence
  Description of Artificial Sequence: Synthetic peptide
  Seed: LVLLAVLPVL (MOG_HUMAN)
LALLAVLPVL

SEQ ID NO: 121479 - protein, 9 aa, Artificial Sequence
  Description of Artificial Sequence: Synthetic peptide
  Seed: VIVPVLGPL (MOG_HUMAN)
VMVPVLGPR

SEQ ID NO: 121480 - protein, 10 aa, Artificial Sequence
  Description of Artificial Sequence: Synthetic peptide
  Seed: VLLLQITVGL (MOG_HUMAN)
VMLLQITVGV

SEQ ID NO: 121481 - protein, 9 aa, Artificial Sequence
  Description of Artificial Sequence: Synthetic peptide
  Seed: LIFLCLQYR (MOG_HUMAN)
LIFLCLQYK

SEQ ID NO: 121482 - protein, 11 aa, Artificial Sequence
  Description of Artificial Sequence: Synthetic peptide
  Seed: RLAGQFLEELR (MOG_HUMAN)
RMAGQFLEELV

SEQ ID NO: 121483 - protein, 10 aa, Artificial Sequence
  Description of Artificial Sequence: Synthetic peptide
  Seed: LVLLAVLPVL (MOG_HUMAN)
LKLLAVLPVL

SEQ ID NO: 121484 - protein, 10 aa, Artificial Sequence
  Description of Artificial Sequence: Synthetic peptide
  Seed: AIGEGKVTLR (MOG_HUMAN)
ASGEGKVTLY

SEQ ID NO: 121485 - protein, 9 aa, Artificial Sequence
  Description of Artificial Sequence: Synthetic peptide
  Seed: CWKITLFVI (MOG_HUMAN)
CYKITLFVF

SEQ ID NO: 121486 - protein, 11 aa, Artificial Sequence
  Description of Artificial Sequence: Synthetic peptide
  Seed: HSYQEEAAMEL (MOG_HUMAN)
HMYQEEAAMEW

SEQ ID NO: 121487 - protein, 11 aa, Artificial Sequence
  Description of Artificial Sequence: Synthetic peptide
  Seed: RFSDEGGFTCF (MOG_HUMAN)
RQSDEGGFTCL

SEQ ID NO: 121488 - protein, 10 aa, Artificial Sequence
  Description of Artificial Sequence: Synthetic peptide
  Seed: HRTFDPHFLR (MOG_HUMAN)
HSTFDPHFLR

SEQ ID NO: 121489 - protein, 9 aa, Artificial Sequence
  Description of Artificial Sequence: Synthetic peptide
  Seed: MELKVEDPF (MOG_HUMAN)
MLLKVEDPF

SEQ ID NO: 121490 - protein, 10 aa, Artificial Sequence
  Description of Artificial Sequence: Synthetic peptide
  Seed: RVIGPRHPIR (MOG_HUMAN)
RYIGPRHPIK

SEQ ID NO: 121491 - protein, 9 aa, Artificial Sequence
  Description of Artificial Sequence: Synthetic peptide
  Seed: RIRNVRFSD (MOG_HUMAN)
RNRNVRFSK

SEQ ID NO: 121492 - protein, 8 aa, Artificial Sequence
  Description of Artificial Sequence: Synthetic peptide
  Seed: LLQVSSSY (MOG_HUMAN)
LQQVSSSM

SEQ ID NO: 121493 - protein, 9 aa, Artificial Sequence
  Description of Artificial Sequence: Synthetic peptide
  Seed: MASLSRPSL (MOG_HUMAN)
MQSLSRPSI

SEQ ID NO: 121494 - protein, 9 aa, Artificial Sequence
  Description of Artificial Sequence: Synthetic peptide
  Seed: LLLQITVGL (MOG_HUMAN)
LSLQITVGV

SEQ ID NO: 121495 - protein, 9 aa, Artificial Sequence
  Description of Artificial Sequence: Synthetic peptide
  Seed: TFDPHFLRV (MOG_HUMAN)
TDDPHFLRM

SEQ ID NO: 121496 - protein, 9 aa, Artificial Sequence
  Description of Artificial Sequence: Synthetic peptide
  Seed: RVIGPRHPI (MOG_HUMAN)
RGIGPRHPK

SEQ ID NO: 121497 - protein, 10 aa, Artificial Sequence
  Description of Artificial Sequence: Synthetic peptide
  Seed: SSYAGQFRVI (MOG_HUMAN)
SRYAGQFRVF

SEQ ID NO: 121498 - protein, 9 aa, Artificial Sequence
  Description of Artificial Sequence: Synthetic peptide
  Seed: MELKVEDPF (MOG_HUMAN)
MALKVEDPF

SEQ ID NO: 121499 - protein, 11 aa, Artificial Sequence
  Description of Artificial Sequence: Synthetic peptide
  Seed: LHRTFDPHFLR (MOG_HUMAN)
LWRTFDPHFLR

SEQ ID NO: 121500 - protein, 9 aa, Artificial Sequence
  Description of Artificial Sequence: Synthetic peptide
  Seed: FSDEGGFTC (MOG_HUMAN)
FCDEGGFTV

SEQ ID NO: 121501 - protein, 9 aa, Artificial Sequence
  Description of Artificial Sequence: Synthetic peptide
  Seed: KDQDGDQAP (MOG_HUMAN)
KEQDGDQAP

SEQ ID NO: 121502 - protein, 10 aa, Artificial Sequence
  Description of Artificial Sequence: Synthetic peptide
  Seed: SLPSCLCSFL (MOG_HUMAN)
SVPSCLCSFI

SEQ ID NO: 121503 - protein, 8 aa, Artificial Sequence
  Description of Artificial Sequence: Synthetic peptide
  Seed: FSRVVHLY (MOG_HUMAN)
FARVVHLF

SEQ ID NO: 121504 - protein, 9 aa, Artificial Sequence
  Description of Artificial Sequence: Synthetic peptide
  Seed: GVLVLLAVL (MOG_HUMAN)
GMLVLLAVV

SEQ ID NO: 121505 - protein, 9 aa, Artificial Sequence
  Description of Artificial Sequence: Synthetic peptide
  Seed: VTLRIRNVR (MOG_HUMAN)
VALRIRNVR

SEQ ID NO: 121506 - protein, 10 aa, Artificial Sequence
  Description of Artificial Sequence: Synthetic peptide
  Seed: LLLLQVSSSY (MOG_HUMAN)
LFLLQVSSSF

SEQ ID NO: 121507 - protein, 10 aa, Artificial Sequence
  Description of Artificial Sequence: Synthetic peptide
  Seed: KNATGMEVGW (MOG_HUMAN)
KGATGMEVGW

SEQ ID NO: 121508 - protein, 11 aa, Artificial Sequence
  Description of Artificial Sequence: Synthetic peptide
  Seed: QVSSSYAGQFR (MOG_HUMAN)
QVSSSYAGQFK

SEQ ID NO: 121509 - protein, 11 aa, Artificial Sequence
  Description of Artificial Sequence: Synthetic peptide
  Seed: RRLAGQFLEEL (MOG_HUMAN)
RRLAGQFLEEI

SEQ ID NO: 121510 - protein, 9 aa, Artificial Sequence
  Description of Artificial Sequence: Synthetic peptide
  Seed: YRGRTELLK (MOG_HUMAN)
YRGRTELLF

SEQ ID NO: 121511 - protein, 9 aa, Artificial Sequence
  Description of Artificial Sequence: Synthetic peptide
  Seed: WVSPGVLVL (MOG_HUMAN)
WTSPGVLVL

SEQ ID NO: 121512 - protein, 9 aa, Artificial Sequence
  Description of Artificial Sequence: Synthetic peptide
  Seed: LPSCLCSFL (MOG_HUMAN)
LASCLCSFF

SEQ ID NO: 121513 - protein, 10 aa, Artificial Sequence
  Description of Artificial Sequence: Synthetic peptide
  Seed: RTFDPHFLRV (MOG_HUMAN)
RKFDPHFLRL

SEQ ID NO: 121514 - protein, 10 aa, Artificial Sequence
  Description of Artificial Sequence: Synthetic peptide
  Seed: FVIVPVLGPL (MOG_HUMAN)
FWIVPVLGPL

SEQ ID NO: 121515 - protein, 10 aa, Artificial Sequence
  Description of Artificial Sequence: Synthetic peptide
  Seed: LLLQVSSSYA (MOG_HUMAN)
LQLQVSSSYQ

SEQ ID NO: 121516 - protein, 10 aa, Artificial Sequence
  Description of Artificial Sequence: Synthetic peptide
  Seed: LLAVLPVLLL (MOG_HUMAN)
LMAVLPVLLL

SEQ ID NO: 121517 - protein, 10 aa, Artificial Sequence
  Description of Artificial Sequence: Synthetic peptide
  Seed: LLLQVSSSYA (MOG_HUMAN)
LQLQVSSSYD

SEQ ID NO: 121518 - protein, 10 aa, Artificial Sequence
  Description of Artificial Sequence: Synthetic peptide
  Seed: SCLCSFLLLL (MOG_HUMAN)
SELCSFLLLI

SEQ ID NO: 121519 - protein, 8 aa, Artificial Sequence
  Description of Artificial Sequence: Synthetic peptide
  Seed: YWVSPGVL (MOG_HUMAN)
YYVSPGVM

SEQ ID NO: 121520 - protein, 11 aa, Artificial Sequence
  Description of Artificial Sequence: Synthetic peptide
  Seed: EVGWYRPPFSR (MOG_HUMAN)
EYGWYRPPFSR

SEQ ID NO: 121521 - protein, 11 aa, Artificial Sequence
  Description of Artificial Sequence: Synthetic peptide
  Seed: RPSLPSCLCSF (MOG_HUMAN)
RSSLPSCLCSW

SEQ ID NO: 121522 - protein, 10 aa, Artificial Sequence
  Description of Artificial Sequence: Synthetic peptide
  Seed: FTCFFRDHSY (MOG_HUMAN)
FLCFFRDHSY

SEQ ID NO: 121523 - protein, 9 aa, Artificial Sequence
  Description of Artificial Sequence: Synthetic peptide
  Seed: YQEEAAMEL (MOG_HUMAN)
YVEEAAMEM

SEQ ID NO: 121524 - protein, 9 aa, Artificial Sequence
  Description of Artificial Sequence: Synthetic peptide
  Seed: MASLSRPSL (MOG_HUMAN)
MISLSRPSY

SEQ ID NO: 121525 - protein, 10 aa, Artificial Sequence
  Description of Artificial Sequence: Synthetic peptide
  Seed: IFLCLQYRLR (MOG_HUMAN)
IVLCLQYRLR

SEQ ID NO: 121526 - protein, 10 aa, Artificial Sequence
  Description of Artificial Sequence: Synthetic peptide
  Seed: RLRGKLRAEI (MOG_HUMAN)
RVRGKLRAEV

SEQ ID NO: 121527 - protein, 10 aa, Artificial Sequence
  Description of Artificial Sequence: Synthetic peptide
  Seed: RPPFSRVVHL (MOG_HUMAN)
RWPFSRVVHL

SEQ ID NO: 121528 - protein, 11 aa, Artificial Sequence
  Description of Artificial Sequence: Synthetic peptide
  Seed: HRTFDPHFLRV (MOG_HUMAN)
HNTFDPHFLRR

SEQ ID NO: 121529 - protein, 9 aa, Artificial Sequence
  Description of Artificial Sequence: Synthetic peptide
  Seed: PVLGPLVAL (MOG_HUMAN)
PPLGPLVAA

SEQ ID NO: 121530 - protein, 9 aa, Artificial Sequence
  Description of Artificial Sequence: Synthetic peptide
  Seed: VPVLGPLVA (MOG_HUMAN)
VAVLGPLVV

SEQ ID NO: 121531 - protein, 11 aa, Artificial Sequence
  Description of Artificial Sequence: Synthetic peptide
  Seed: VIGPRHPIRAL (MOG_HUMAN)
VIGPRHPIRAM

SEQ ID NO: 121532 - protein, 10 aa, Artificial Sequence
  Description of Artificial Sequence: Synthetic peptide
  Seed: FDPHFLRVPC (MOG_HUMAN)
FKPHFLRVPF

SEQ ID NO: 121533 - protein, 11 aa, Artificial Sequence
  Description of Artificial Sequence: Synthetic peptide
  Seed: FSDEGGFTCFF (MOG_HUMAN)
FWDEGGFTCFL

SEQ ID NO: 121534 - protein, 9 aa, Artificial Sequence
  Description of Artificial Sequence: Synthetic peptide
  Seed: LIICYNWLH (MOG_HUMAN)
LAICYNWLK

SEQ ID NO: 121535 - protein, 9 aa, Artificial Sequence
  Description of Artificial Sequence: Synthetic peptide
  Seed: SSYAGQFRV (MOG_HUMAN)
SSYAGQFRY

SEQ ID NO: 121536 - protein, 9 aa, Artificial Sequence
  Description of Artificial Sequence: Synthetic peptide
  Seed: RVVHLYRNG (MOG_HUMAN)
RVVHLYRNA

SEQ ID NO: 121537 - protein, 9 aa, Artificial Sequence
  Description of Artificial Sequence: Synthetic peptide
  Seed: FSRVVHLYR (MOG_HUMAN)
FWRVVHLYR

SEQ ID NO: 121538 - protein, 9 aa, Artificial Sequence
  Description of Artificial Sequence: Synthetic peptide
  Seed: KLRAEIENL (MOG_HUMAN)
KRRAEIENY

SEQ ID NO: 121539 - protein, 11 aa, Artificial Sequence
  Description of Artificial Sequence: Synthetic peptide
  Seed: VIGPRHPIRAL (MOG_HUMAN)
VTGPRHPIRAL

SEQ ID NO: 121540 - protein, 9 aa, Artificial Sequence
  Description of Artificial Sequence: Synthetic peptide
  Seed: RTFDPHFLR (MOG_HUMAN)
RIFDPHFLH

SEQ ID NO: 121541 - protein, 10 aa, Artificial Sequence
  Description of Artificial Sequence: Synthetic peptide
  Seed: RPPFSRVVHL (MOG_HUMAN)
RQPFSRVVHL

SEQ ID NO: 121542 - protein, 9 aa, Artificial Sequence
  Description of Artificial Sequence: Synthetic peptide
  Seed: FYWVSPGVL (MOG_HUMAN)
FMWVSPGVF

SEQ ID NO: 121543 - protein, 8 aa, Artificial Sequence
  Description of Artificial Sequence: Synthetic peptide
  Seed: FSDEGGFT (MOG_HUMAN)
FADEGGFV

SEQ ID NO: 121544 - protein, 10 aa, Artificial Sequence
  Description of Artificial Sequence: Synthetic peptide
  Seed: FVIVPVLGPL (MOG_HUMAN)
FPIVPVLGPA

SEQ ID NO: 121545 - protein, 9 aa, Artificial Sequence
  Description of Artificial Sequence: Synthetic peptide
  Seed: VGDEVELPC (MOG_HUMAN)
VSDEVELPV

SEQ ID NO: 121546 - protein, 9 aa, Artificial Sequence
  Description of Artificial Sequence: Synthetic peptide
  Seed: RTFDPHFLR (MOG_HUMAN)
RIFDPHFLW

SEQ ID NO: 121547 - protein, 9 aa, Artificial Sequence
  Description of Artificial Sequence: Synthetic peptide
  Seed: TFDPHFLRV (MOG_HUMAN)
TSDPHFLRY

SEQ ID NO: 121548 - protein, 10 aa, Artificial Sequence
  Description of Artificial Sequence: Synthetic peptide
  Seed: LLQITVGLIF (MOG_HUMAN)
LLQITVGLIY

SEQ ID NO: 121549 - protein, 9 aa, Artificial Sequence
  Description of Artificial Sequence: Synthetic peptide
  Seed: HSYQEEAAM (MOG_HUMAN)
HQYQEEAAH

SEQ ID NO: 121550 - protein, 9 aa, Artificial Sequence
  Description of Artificial Sequence: Synthetic peptide
  Seed: HSYQEEAAM (MOG_HUMAN)
HTYQEEAAW

SEQ ID NO: 121551 - protein, 9 aa, Artificial Sequence
  Description of Artificial Sequence: Synthetic peptide
  Seed: TCFFRDHSY (MOG_HUMAN)
TSFFRDHSF

SEQ ID NO: 121552 - protein, 11 aa, Artificial Sequence
  Description of Artificial Sequence: Synthetic peptide
  Seed: DAIGEGKVTLR (MOG_HUMAN)
DGIGEGKVTLR

SEQ ID NO: 121553 - protein, 9 aa, Artificial Sequence
  Description of Artificial Sequence: Synthetic peptide
  Seed: LLLQVSSSY (MOG_HUMAN)
LGLQVSSSY

SEQ ID NO: 121554 - protein, 8 aa, Artificial Sequence
  Description of Artificial Sequence: Synthetic peptide
  Seed: LLQVSSSY (MOG_HUMAN)
LMQVSSSY

SEQ ID NO: 121555 - protein, 11 aa, Artificial Sequence
  Description of Artificial Sequence: Synthetic peptide
  Seed: LIICYNWLHRR (MOG_HUMAN)
LYICYNWLHRR

SEQ ID NO: 121556 - protein, 11 aa, Artificial Sequence
  Description of Artificial Sequence: Synthetic peptide
  Seed: RISPGKNATGM (MOG_HUMAN)
RQSPGKNATGM

SEQ ID NO: 121557 - protein, 9 aa, Artificial Sequence
  Description of Artificial Sequence: Synthetic peptide
  Seed: LRAEIENLH (MOG_HUMAN)
LRAEIENLF

SEQ ID NO: 121558 - protein, 10 aa, Artificial Sequence
  Description of Artificial Sequence: Synthetic peptide
  Seed: RTFDPHFLRV (MOG_HUMAN)
RAFDPHFLRA

SEQ ID NO: 121559 - protein, 9 aa, Artificial Sequence
  Description of Artificial Sequence: Synthetic peptide
  Seed: RTFDPHFLR (MOG_HUMAN)
RIFDPHFLR

SEQ ID NO: 121560 - protein, 9 aa, Artificial Sequence
  Description of Artificial Sequence: Synthetic peptide
  Seed: GQFRVIGPR (MOG_HUMAN)
GIFRVIGPR

SEQ ID NO: 121561 - protein, 9 aa, Artificial Sequence
  Description of Artificial Sequence: Synthetic peptide
  Seed: MASLSRPSL (MOG_HUMAN)
MMSLSRPSL

SEQ ID NO: 121562 - protein, 10 aa, Artificial Sequence
  Description of Artificial Sequence: Synthetic peptide
  Seed: YWVSPGVLVL (MOG_HUMAN)
YPVSPGVLVF

SEQ ID NO: 121563 - protein, 9 aa, Artificial Sequence
  Description of Artificial Sequence: Synthetic peptide
  Seed: WVSPGVLVL (MOG_HUMAN)
WYSPGVLVM

SEQ ID NO: 121564 - protein, 9 aa, Artificial Sequence
  Description of Artificial Sequence: Synthetic peptide
  Seed: VLPVLLLQI (MOG_HUMAN)
VRPVLLLQM

SEQ ID NO: 121565 - protein, 10 aa, Artificial Sequence
  Description of Artificial Sequence: Synthetic peptide
  Seed: FLLLLLLQVS (MOG_HUMAN)
FDLLLLLQVV

SEQ ID NO: 121566 - protein, 9 aa, Artificial Sequence
  Description of Artificial Sequence: Synthetic peptide
  Seed: VSPGVLVLL (MOG_HUMAN)
VLPGVLVLV

SEQ ID NO: 121567 - protein, 10 aa, Artificial Sequence
  Description of Artificial Sequence: Synthetic peptide
  Seed: AEIENLHRTF (MOG_HUMAN)
ARIENLHRTY

SEQ ID NO: 121568 - protein, 11 aa, Artificial Sequence
  Description of Artificial Sequence: Synthetic peptide
  Seed: RFSDEGGFTCF (MOG_HUMAN)
RQSDEGGFTCW

SEQ ID NO: 121569 - protein, 9 aa, Artificial Sequence
  Description of Artificial Sequence: Synthetic peptide
  Seed: SYAGQFRVI (MOG_HUMAN)
SRAGQFRVL

SEQ ID NO: 121570 - protein, 9 aa, Artificial Sequence
  Description of Artificial Sequence: Synthetic peptide
  Seed: LLLQVSSSY (MOG_HUMAN)
LKLQVSSSI

SEQ ID NO: 121571 - protein, 9 aa, Artificial Sequence
  Description of Artificial Sequence: Synthetic peptide
  Seed: WVSPGVLVL (MOG_HUMAN)
WWSPGVLVF

SEQ ID NO: 121572 - protein, 9 aa, Artificial Sequence
  Description of Artificial Sequence: Synthetic peptide
  Seed: SLPSCLCSF (MOG_HUMAN)
SKPSCLCSY

SEQ ID NO: 121573 - protein, 10 aa, Artificial Sequence
  Description of Artificial Sequence: Synthetic peptide
  Seed: RVPCWKITLF (MOG_HUMAN)
RMPCWKITLF

SEQ ID NO: 121574 - protein, 9 aa, Artificial Sequence
  Description of Artificial Sequence: Synthetic peptide
  Seed: FSDEGGFTC (MOG_HUMAN)
FADEGGFTW

SEQ ID NO: 121575 - protein, 10 aa, Artificial Sequence
  Description of Artificial Sequence: Synthetic peptide
  Seed: SLSRPSLPSC (MOG_HUMAN)
SVSRPSLPSV

SEQ ID NO: 121576 - protein, 9 aa, Artificial Sequence
  Description of Artificial Sequence: Synthetic peptide
  Seed: TCFFRDHSY (MOG_HUMAN)
TQFFRDHSM

SEQ ID NO: 121577 - protein, 9 aa, Artificial Sequence
  Description of Artificial Sequence: Synthetic peptide
  Seed: SSYAGQFRV (MOG_HUMAN)
SLYAGQFRS

SEQ ID NO: 121578 - protein, 10 aa, Artificial Sequence
  Description of Artificial Sequence: Synthetic peptide
  Seed: SSYAGQFRVI (MOG_HUMAN)
SPYAGQFRVW

SEQ ID NO: 121579 - protein, 10 aa, Artificial Sequence
  Description of Artificial Sequence: Synthetic peptide
  Seed: KVTLRIRNVR (MOG_HUMAN)
KDTLRIRNVR

SEQ ID NO: 121580 - protein, 11 aa, Artificial Sequence
  Description of Artificial Sequence: Synthetic peptide
  Seed: RTFDPHFLRVP (MOG_HUMAN)
RSFDPHFLRVK

SEQ ID NO: 121581 - protein, 9 aa, Artificial Sequence
  Description of Artificial Sequence: Synthetic peptide
  Seed: SSYAGQFRV (MOG_HUMAN)
SMYAGQFRS

SEQ ID NO: 121582 - protein, 10 aa, Artificial Sequence
  Description of Artificial Sequence: Synthetic peptide
  Seed: LIICYNWLHR (MOG_HUMAN)
LGICYNWLHR

SEQ ID NO: 121583 - protein, 9 aa, Artificial Sequence
  Description of Artificial Sequence: Synthetic peptide
  Seed: ICYNWLHRR (MOG_HUMAN)
ITYNWLHRK

SEQ ID NO: 121584 - protein, 9 aa, Artificial Sequence
  Description of Artificial Sequence: Synthetic peptide
  Seed: RIRNVRFSD (MOG_HUMAN)
RYRNVRFSR

SEQ ID NO: 121585 - protein, 11 aa, Artificial Sequence
  Description of Artificial Sequence: Synthetic peptide
  Seed: RVIGPRHPIRA (MOG_HUMAN)
RMIGPRHPIRR

SEQ ID NO: 121586 - protein, 9 aa, Artificial Sequence
  Description of Artificial Sequence: Synthetic peptide
  Seed: AIGEGKVTL (MOG_HUMAN)
AQGEGKVTF

SEQ ID NO: 121587 - protein, 9 aa, Artificial Sequence
  Description of Artificial Sequence: Synthetic peptide
  Seed: VSPGVLVLL (MOG_HUMAN)
VLPGVLVLA

SEQ ID NO: 121588 - protein, 10 aa, Artificial Sequence
  Description of Artificial Sequence: Synthetic peptide
  Seed: FVIVPVLGPL (MOG_HUMAN)
FSIVPVLGPF

SEQ ID NO: 121589 - protein, 10 aa, Artificial Sequence
  Description of Artificial Sequence: Synthetic peptide
  Seed: ATGMEVGWYR (MOG_HUMAN)
ATGMEVGWYY

SEQ ID NO: 121590 - protein, 10 aa, Artificial Sequence
  Description of Artificial Sequence: Synthetic peptide
  Seed: YWVSPGVLVL (MOG_HUMAN)
YTVSPGVLVF

SEQ ID NO: 121591 - protein, 9 aa, Artificial Sequence
  Description of Artificial Sequence: Synthetic peptide
  Seed: SSYAGQFRV (MOG_HUMAN)
SVYAGQFRK

SEQ ID NO: 121592 - protein, 9 aa, Artificial Sequence
  Description of Artificial Sequence: Synthetic peptide
  Seed: YQEEAAMEL (MOG_HUMAN)
YIEEAAMEL

SEQ ID NO: 121593 - protein, 9 aa, Artificial Sequence
  Description of Artificial Sequence: Synthetic peptide
  Seed: KLRAEIENL (MOG_HUMAN)
KQRAEIENK

SEQ ID NO: 121594 - protein, 9 aa, Artificial Sequence
  Description of Artificial Sequence: Synthetic peptide
  Seed: TGMEVGWYR (MOG_HUMAN)
TVMEVGWYY

SEQ ID NO: 121595 - protein, 9 aa, Artificial Sequence
  Description of Artificial Sequence: Synthetic peptide
  Seed: RVPCWKITL (MOG_HUMAN)
RMPCWKITA

SEQ ID NO: 121596 - protein, 10 aa, Artificial Sequence
  Description of Artificial Sequence: Synthetic peptide
  Seed: CLCSFLLLLL (MOG_HUMAN)
CMCSFLLLLM

SEQ ID NO: 121597 - protein, 11 aa, Artificial Sequence
  Description of Artificial Sequence: Synthetic peptide
  Seed: VIGPRHPIRAL (MOG_HUMAN)
VYGPRHPIRAM

SEQ ID NO: 121598 - protein, 9 aa, Artificial Sequence
  Description of Artificial Sequence: Synthetic peptide
  Seed: CLCSFLLLL (MOG_HUMAN)
CMCSFLLLV

SEQ ID NO: 121599 - protein, 9 aa, Artificial Sequence
  Description of Artificial Sequence: Synthetic peptide
  Seed: TFDPHFLRV (MOG_HUMAN)
TADPHFLRF

SEQ ID NO: 121600 - protein, 10 aa, Artificial Sequence
  Description of Artificial Sequence: Synthetic peptide
  Seed: KITLFVIVPV (MOG_HUMAN)
KMTLFVIVPM

SEQ ID NO: 121601 - protein, 9 aa, Artificial Sequence
  Description of Artificial Sequence: Synthetic peptide
  Seed: YQEEAAMEL (MOG_HUMAN)
YLEEAAMEY

SEQ ID NO: 121602 - protein, 9 aa, Artificial Sequence
  Description of Artificial Sequence: Synthetic peptide
  Seed: RVIGPRHPI (MOG_HUMAN)
RMIGPRHPA

SEQ ID NO: 121603 - protein, 10 aa, Artificial Sequence
  Description of Artificial Sequence: Synthetic peptide
  Seed: MELKVEDPFY (MOG_HUMAN)
MELKVEDPFW

SEQ ID NO: 121604 - protein, 8 aa, Artificial Sequence
  Description of Artificial Sequence: Synthetic peptide
  Seed: RIRNVRFS (MOG_HUMAN)
RTRNVRFM

SEQ ID NO: 121605 - protein, 9 aa, Artificial Sequence
  Description of Artificial Sequence: Synthetic peptide
  Seed: TFDPHFLRV (MOG_HUMAN)
TTDPHFLRK

SEQ ID NO: 121606 - protein, 9 aa, Artificial Sequence
  Description of Artificial Sequence: Synthetic peptide
  Seed: TFDPHFLRV (MOG_HUMAN)
TSDPHFLRC

SEQ ID NO: 121607 - protein, 10 aa, Artificial Sequence
  Description of Artificial Sequence: Synthetic peptide
  Seed: KVTLRIRNVR (MOG_HUMAN)
KYTLRIRNVR

SEQ ID NO: 121608 - protein, 9 aa, Artificial Sequence
  Description of Artificial Sequence: Synthetic peptide
  Seed: RVIGPRHPI (MOG_HUMAN)
RVIGPRHPR

SEQ ID NO: 121609 - protein, 10 aa, Artificial Sequence
  Description of Artificial Sequence: Synthetic peptide
  Seed: RLAGQFLEEL (MOG_HUMAN)
RMAGQFLEEY

SEQ ID NO: 121610 - protein, 9 aa, Artificial Sequence
  Description of Artificial Sequence: Synthetic peptide
  Seed: ICYNWLHRR (MOG_HUMAN)
IWYNWLHRK

SEQ ID NO: 121611 - protein, 10 aa, Artificial Sequence
  Description of Artificial Sequence: Synthetic peptide
  Seed: LLQITVGLIF (MOG_HUMAN)
LTQITVGLIF

SEQ ID NO: 121612 - protein, 9 aa, Artificial Sequence
  Description of Artificial Sequence: Synthetic peptide
  Seed: RVIGPRHPI (MOG_HUMAN)
RFIGPRHPI

SEQ ID NO: 121613 - protein, 9 aa, Artificial Sequence
  Description of Artificial Sequence: Synthetic peptide
  Seed: SCLCSFLLL (MOG_HUMAN)
STLCSFLLL

SEQ ID NO: 121614 - protein, 10 aa, Artificial Sequence
  Description of Artificial Sequence: Synthetic peptide
  Seed: SLSRPSLPSC (MOG_HUMAN)
SKSRPSLPSA

SEQ ID NO: 121615 - protein, 11 aa, Artificial Sequence
  Description of Artificial Sequence: Synthetic peptide
  Seed: HSYQEEAAMEL (MOG_HUMAN)
HMYQEEAAMEF

SEQ ID NO: 121616 - protein, 10 aa, Artificial Sequence
  Description of Artificial Sequence: Synthetic peptide
  Seed: FLLLLLLQVS (MOG_HUMAN)
FILLLLLQVV

SEQ ID NO: 121617 - protein, 9 aa, Artificial Sequence
  Description of Artificial Sequence: Synthetic peptide
  Seed: HSYQEEAAM (MOG_HUMAN)
HEYQEEAAM

SEQ ID NO: 121618 - protein, 9 aa, Artificial Sequence
  Description of Artificial Sequence: Synthetic peptide
  Seed: TFDPHFLRV (MOG_HUMAN)
TNDPHFLRY

SEQ ID NO: 121619 - protein, 9 aa, Artificial Sequence
  Description of Artificial Sequence: Synthetic peptide
  Seed: WVSPGVLVL (MOG_HUMAN)
WGSPGVLVY

SEQ ID NO: 121620 - protein, 9 aa, Artificial Sequence
  Description of Artificial Sequence: Synthetic peptide
  Seed: YRPPFSRVV (MOG_HUMAN)
YKPPFSRVF

SEQ ID NO: 121621 - protein, 9 aa, Artificial Sequence
  Description of Artificial Sequence: Synthetic peptide
  Seed: DQAPEYRGR (MOG_HUMAN)
DVAPEYRGY

SEQ ID NO: 121622 - protein, 9 aa, Artificial Sequence
  Description of Artificial Sequence: Synthetic peptide
  Seed: RIRNVRFSD (MOG_HUMAN)
RSRNVRFSS

SEQ ID NO: 121623 - protein, 9 aa, Artificial Sequence
  Description of Artificial Sequence: Synthetic peptide
  Seed: HSYQEEAAM (MOG_HUMAN)
HPYQEEAAM

SEQ ID NO: 121624 - protein, 10 aa, Artificial Sequence
  Description of Artificial Sequence: Synthetic peptide
  Seed: KNATGMEVGW (MOG_HUMAN)
KSATGMEVGY

SEQ ID NO: 121625 - protein, 9 aa, Artificial Sequence
  Description of Artificial Sequence: Synthetic peptide
  Seed: LCSFLLLLL (MOG_HUMAN)
LMSFLLLLA

SEQ ID NO: 121626 - protein, 11 aa, Artificial Sequence
  Description of Artificial Sequence: Synthetic peptide
  Seed: KDQDGDQAPEY (MOG_HUMAN)
KAQDGDQAPEY

SEQ ID NO: 121627 - protein, 10 aa, Artificial Sequence
  Description of Artificial Sequence: Synthetic peptide
  Seed: WVSPGVLVLL (MOG_HUMAN)
WISPGVLVLA

SEQ ID NO: 121628 - protein, 10 aa, Artificial Sequence
  Description of Artificial Sequence: Synthetic peptide
  Seed: SLSRPSLPSC (MOG_HUMAN)
SYSRPSLPSL

SEQ ID NO: 121629 - protein, 10 aa, Artificial Sequence
  Description of Artificial Sequence: Synthetic peptide
  Seed: FLLLLLLQVS (MOG_HUMAN)
FLLLLLLQVV

SEQ ID NO: 121630 - protein, 10 aa, Artificial Sequence
  Description of Artificial Sequence: Synthetic peptide
  Seed: FDPHFLRVPC (MOG_HUMAN)
FWPHFLRVPS

SEQ ID NO: 121631 - protein, 10 aa, Artificial Sequence
  Description of Artificial Sequence: Synthetic peptide
  Seed: VGWYRPPFSR (MOG_HUMAN)
VQWYRPPFSR

SEQ ID NO: 121632 - protein, 9 aa, Artificial Sequence
  Description of Artificial Sequence: Synthetic peptide
  Seed: YQEEAAMEL (MOG_HUMAN)
YNEEAAMEL

SEQ ID NO: 121633 - protein, 9 aa, Artificial Sequence
  Description of Artificial Sequence: Synthetic peptide
  Seed: YRPPFSRVV (MOG_HUMAN)
YMPPFSRVF

SEQ ID NO: 121634 - protein, 11 aa, Artificial Sequence
  Description of Artificial Sequence: Synthetic peptide
  Seed: LHRTFDPHFLR (MOG_HUMAN)
LWRTFDPHFLK

SEQ ID NO: 121635 - protein, 9 aa, Artificial Sequence
  Description of Artificial Sequence: Synthetic peptide
  Seed: IGEGKVTLR (MOG_HUMAN)
ISEGKVTLM

SEQ ID NO: 121636 - protein, 9 aa, Artificial Sequence
  Description of Artificial Sequence: Synthetic peptide
  Seed: VSPGVLVLL (MOG_HUMAN)
VFPGVLVLY

SEQ ID NO: 121637 - protein, 9 aa, Artificial Sequence
  Description of Artificial Sequence: Synthetic peptide
  Seed: WVSPGVLVL (MOG_HUMAN)
WKSPGVLVF

SEQ ID NO: 121638 - protein, 10 aa, Artificial Sequence
  Description of Artificial Sequence: Synthetic peptide
  Seed: RTFDPHFLRV (MOG_HUMAN)
RSFDPHFLRY

SEQ ID NO: 121639 - protein, 9 aa, Artificial Sequence
  Description of Artificial Sequence: Synthetic peptide
  Seed: GWYRPPFSR (MOG_HUMAN)
GQYRPPFSR

SEQ ID NO: 121640 - protein, 9 aa, Artificial Sequence
  Description of Artificial Sequence: Synthetic peptide
  Seed: TFDPHFLRV (MOG_HUMAN)
TSDPHFLRV

SEQ ID NO: 121641 - protein, 9 aa, Artificial Sequence
  Description of Artificial Sequence: Synthetic peptide
  Seed: MASLSRPSL (MOG_HUMAN)
MRSLSRPSF

SEQ ID NO: 121642 - protein, 9 aa, Artificial Sequence
  Description of Artificial Sequence: Synthetic peptide
  Seed: IGEGKVTLR (MOG_HUMAN)
ITEGKVTLY

SEQ ID NO: 121643 - protein, 9 aa, Artificial Sequence
  Description of Artificial Sequence: Synthetic peptide
  Seed: TFDPHFLRV (MOG_HUMAN)
TWDPHFLRM

SEQ ID NO: 121644 - protein, 9 aa, Artificial Sequence
  Description of Artificial Sequence: Synthetic peptide
  Seed: EEAAMELKV (MOG_HUMAN)
EQAAMELKV

SEQ ID NO: 121645 - protein, 11 aa, Artificial Sequence
  Description of Artificial Sequence: Synthetic peptide
  Seed: ATGMEVGWYRP (MOG_HUMAN)
ARGMEVGWYRR

SEQ ID NO: 121646 - protein, 10 aa, Artificial Sequence
  Description of Artificial Sequence: Synthetic peptide
  Seed: FTCFFRDHSY (MOG_HUMAN)
FACFFRDHSL

SEQ ID NO: 121647 - protein, 9 aa, Artificial Sequence
  Description of Artificial Sequence: Synthetic peptide
  Seed: GQFRVIGPR (MOG_HUMAN)
GVFRVIGPR

SEQ ID NO: 121648 - protein, 10 aa, Artificial Sequence
  Description of Artificial Sequence: Synthetic peptide
  Seed: IGPRHPIRAL (MOG_HUMAN)
ITPRHPIRAI

SEQ ID NO: 121649 - protein, 10 aa, Artificial Sequence
  Description of Artificial Sequence: Synthetic peptide
  Seed: GLIFLCLQYR (MOG_HUMAN)
GQIFLCLQYR

SEQ ID NO: 121650 - protein, 9 aa, Artificial Sequence
  Description of Artificial Sequence: Synthetic peptide
  Seed: VLLAVLPVL (MOG_HUMAN)
VLLAVLPVY

SEQ ID NO: 121651 - protein, 9 aa, Artificial Sequence
  Description of Artificial Sequence: Synthetic peptide
  Seed: VALIICYNW (MOG_HUMAN)
VTLIICYNW

SEQ ID NO: 121652 - protein, 10 aa, Artificial Sequence
  Description of Artificial Sequence: Synthetic peptide
  Seed: RIRNVRFSDE (MOG_HUMAN)
RIRNVRFSDY

SEQ ID NO: 121653 - protein, 9 aa, Artificial Sequence
  Description of Artificial Sequence: Synthetic peptide
  Seed: LSRPSLPSC (MOG_HUMAN)
LLRPSLPSK

SEQ ID NO: 121654 - protein, 9 aa, Artificial Sequence
  Description of Artificial Sequence: Synthetic peptide
  Seed: FSRVVHLYR (MOG_HUMAN)
FARVVHLYK

SEQ ID NO: 121655 - protein, 9 aa, Artificial Sequence
  Description of Artificial Sequence: Synthetic peptide
  Seed: VSPGVLVLL (MOG_HUMAN)
VQPGVLVLF

SEQ ID NO: 121656 - protein, 8 aa, Artificial Sequence
  Description of Artificial Sequence: Synthetic peptide
  Seed: YAGQFRVI (MOG_HUMAN)
YSGQFRVY

SEQ ID NO: 121657 - protein, 9 aa, Artificial Sequence
  Description of Artificial Sequence: Synthetic peptide
  Seed: SRPSLPSCL (MOG_HUMAN)
SLPSLPSCF

SEQ ID NO: 121658 - protein, 10 aa, Artificial Sequence
  Description of Artificial Sequence: Synthetic peptide
  Seed: IGPRHPIRAL (MOG_HUMAN)
IKPRHPIRAV

SEQ ID NO: 121659 - protein, 9 aa, Artificial Sequence
  Description of Artificial Sequence: Synthetic peptide
  Seed: LQVSSSYAG (MOG_HUMAN)
LAVSSSYAF

SEQ ID NO: 121660 - protein, 10 aa, Artificial Sequence
  Description of Artificial Sequence: Synthetic peptide
  Seed: LLLQVSSSYA (MOG_HUMAN)
LLLQVSSSYL

SEQ ID NO: 121661 - protein, 10 aa, Artificial Sequence
  Description of Artificial Sequence: Synthetic peptide
  Seed: RLRGKLRAEI (MOG_HUMAN)
RYRGKLRAEA

SEQ ID NO: 121662 - protein, 9 aa, Artificial Sequence
  Description of Artificial Sequence: Synthetic peptide
  Seed: FYWVSPGVL (MOG_HUMAN)
FHWVSPGVY

SEQ ID NO: 121663 - protein, 10 aa, Artificial Sequence
  Description of Artificial Sequence: Synthetic peptide
  Seed: VSSSYAGQFR (MOG_HUMAN)
VSSSYAGQFK

SEQ ID NO: 121664 - protein, 10 aa, Artificial Sequence
  Description of Artificial Sequence: Synthetic peptide
  Seed: FDPHFLRVPC (MOG_HUMAN)
FVPHFLRVPL

SEQ ID NO: 121665 - protein, 9 aa, Artificial Sequence
  Description of Artificial Sequence: Synthetic peptide
  Seed: MASLSRPSL (MOG_HUMAN)
MSSLSRPSL

SEQ ID NO: 121666 - protein, 10 aa, Artificial Sequence
  Description of Artificial Sequence: Synthetic peptide
  Seed: PVLGPLVALI (MOG_HUMAN)
PSLGPLVALV

SEQ ID NO: 121667 - protein, 9 aa, Artificial Sequence
  Description of Artificial Sequence: Synthetic peptide
  Seed: GLIFLCLQY (MOG_HUMAN)
GYIFLCLQY

SEQ ID NO: 121668 - protein, 11 aa, Artificial Sequence
  Description of Artificial Sequence: Synthetic peptide
  Seed: RLAGQFLEELR (MOG_HUMAN)
RLAGQFLEELV

SEQ ID NO: 121669 - protein, 9 aa, Artificial Sequence
  Description of Artificial Sequence: Synthetic peptide
  Seed: ICYNWLHRR (MOG_HUMAN)
IYYNWLHRR

SEQ ID NO: 121670 - protein, 10 aa, Artificial Sequence
  Description of Artificial Sequence: Synthetic peptide
  Seed: LVLLAVLPVL (MOG_HUMAN)
LFLLAVLPVI

SEQ ID NO: 121671 - protein, 11 aa, Artificial Sequence
  Description of Artificial Sequence: Synthetic peptide
  Seed: LHRTFDPHFLR (MOG_HUMAN)
LPRTFDPHFLR

SEQ ID NO: 121672 - protein, 11 aa, Artificial Sequence
  Description of Artificial Sequence: Synthetic peptide
  Seed: RDHSYQEEAAM (MOG_HUMAN)
RMHSYQEEAAF

SEQ ID NO: 121673 - protein, 10 aa, Artificial Sequence
  Description of Artificial Sequence: Synthetic peptide
  Seed: VLLAVLPVLL (MOG_HUMAN)
VYLAVLPVLI

SEQ ID NO: 121674 - protein, 10 aa, Artificial Sequence
  Description of Artificial Sequence: Synthetic peptide
  Seed: RTFDPHFLRV (MOG_HUMAN)
RMFDPHFLRW

SEQ ID NO: 121675 - protein, 9 aa, Artificial Sequence
  Description of Artificial Sequence: Synthetic peptide
  Seed: VPCWKITLF (MOG_HUMAN)
VPCWKITLM

SEQ ID NO: 121676 - protein, 10 aa, Artificial Sequence
  Description of Artificial Sequence: Synthetic peptide
  Seed: AVLPVLLLQI (MOG_HUMAN)
AYLPVLLLQV

SEQ ID NO: 121677 - protein, 9 aa, Artificial Sequence
  Description of Artificial Sequence: Synthetic peptide
  Seed: LLLQVSSSY (MOG_HUMAN)
LNLQVSSSY

SEQ ID NO: 121678 - protein, 9 aa, Artificial Sequence
  Description of Artificial Sequence: Synthetic peptide
  Seed: LLLQITVGL (MOG_HUMAN)
LQLQITVGM

SEQ ID NO: 121679 - protein, 10 aa, Artificial Sequence
  Description of Artificial Sequence: Synthetic peptide
  Seed: TGMEVGWYRP (MOG_HUMAN)
TVMEVGWYRW

SEQ ID NO: 121680 - protein, 9 aa, Artificial Sequence
  Description of Artificial Sequence: Synthetic peptide
  Seed: LHRTFDPHF (MOG_HUMAN)
LQRTFDPHL

SEQ ID NO: 121681 - protein, 10 aa, Artificial Sequence
  Description of Artificial Sequence: Synthetic peptide
  Seed: RTFDPHFLRV (MOG_HUMAN)
RQFDPHFLRV

SEQ ID NO: 121682 - protein, 10 aa, Artificial Sequence
  Description of Artificial Sequence: Synthetic peptide
  Seed: FSDEGGFTCF (MOG_HUMAN)
FLDEGGFTCY

SEQ ID NO: 121683 - protein, 9 aa, Artificial Sequence
  Description of Artificial Sequence: Synthetic peptide
  Seed: RVIGPRHPI (MOG_HUMAN)
RIIGPRHPV

SEQ ID NO: 121684 - protein, 10 aa, Artificial Sequence
  Description of Artificial Sequence: Synthetic peptide
  Seed: SLSRPSLPSC (MOG_HUMAN)
SHSRPSLPSI

SEQ ID NO: 121685 - protein, 10 aa, Artificial Sequence
  Description of Artificial Sequence: Synthetic peptide
  Seed: RLAGQFLEEL (MOG_HUMAN)
RMAGQFLEEA

SEQ ID NO: 121686 - protein, 9 aa, Artificial Sequence
  Description of Artificial Sequence: Synthetic peptide
  Seed: FLEELRNPF (MOG_HUMAN)
FPEELRNPL

SEQ ID NO: 121687 - protein, 9 aa, Artificial Sequence
  Description of Artificial Sequence: Synthetic peptide
  Seed: VSPGVLVLL (MOG_HUMAN)
VRPGVLVLF

SEQ ID NO: 121688 - protein, 10 aa, Artificial Sequence
  Description of Artificial Sequence: Synthetic peptide
  Seed: RPPFSRVVHL (MOG_HUMAN)
RVPFSRVVHL

SEQ ID NO: 121689 - protein, 9 aa, Artificial Sequence
  Description of Artificial Sequence: Synthetic peptide
  Seed: GQFRVIGPR (MOG_HUMAN)
GFFRVIGPR

SEQ ID NO: 121690 - protein, 10 aa, Artificial Sequence
  Description of Artificial Sequence: Synthetic peptide
  Seed: LVLLAVLPVL (MOG_HUMAN)
LQLLAVLPVI

SEQ ID NO: 121691 - protein, 10 aa, Artificial Sequence
  Description of Artificial Sequence: Synthetic peptide
  Seed: IGPRHPIRAL (MOG_HUMAN)
IHPRHPIRAI

SEQ ID NO: 121692 - protein, 11 aa, Artificial Sequence
  Description of Artificial Sequence: Synthetic peptide
  Seed: RFSDEGGFTCF (MOG_HUMAN)
RYSDEGGFTCW

SEQ ID NO: 121693 - protein, 9 aa, Artificial Sequence
  Description of Artificial Sequence: Synthetic peptide
  Seed: VSPGVLVLL (MOG_HUMAN)
VYPGVLVLI

SEQ ID NO: 121694 - protein, 10 aa, Artificial Sequence
  Description of Artificial Sequence: Synthetic peptide
  Seed: FDPHFLRVPC (MOG_HUMAN)
FKPHFLRVPP

SEQ ID NO: 121695 - protein, 11 aa, Artificial Sequence
  Description of Artificial Sequence: Synthetic peptide
  Seed: RFSDEGGFTCF (MOG_HUMAN)
RMSDEGGFTCI

SEQ ID NO: 121696 - protein, 10 aa, Artificial Sequence
  Description of Artificial Sequence: Synthetic peptide
  Seed: FRVIGPRHPI (MOG_HUMAN)
FHVIGPRHPV

SEQ ID NO: 121697 - protein, 9 aa, Artificial Sequence
  Description of Artificial Sequence: Synthetic peptide
  Seed: VIVPVLGPL (MOG_HUMAN)
VVVPVLGPA

SEQ ID NO: 121698 - protein, 9 aa, Artificial Sequence
  Description of Artificial Sequence: Synthetic peptide
  Seed: EGGFTCFFR (MOG_HUMAN)
ETGFTCFFR

SEQ ID NO: 121699 - protein, 9 aa, Artificial Sequence
  Description of Artificial Sequence: Synthetic peptide
  Seed: MEVGWYRPP (MOG_HUMAN)
MEVGWYRPM

SEQ ID NO: 121700 - protein, 10 aa, Artificial Sequence
  Description of Artificial Sequence: Synthetic peptide
  Seed: VGLIFLCLQY (MOG_HUMAN)
VYLIFLCLQY

SEQ ID NO: 121701 - protein, 10 aa, Artificial Sequence
  Description of Artificial Sequence: Synthetic peptide
  Seed: VLLLQITVGL (MOG_HUMAN)
VALLQITVGL

SEQ ID NO: 121702 - protein, 9 aa, Artificial Sequence
  Description of Artificial Sequence: Synthetic peptide
  Seed: VSPGVLVLL (MOG_HUMAN)
VTPGVLVLY

SEQ ID NO: 121703 - protein, 10 aa, Artificial Sequence
  Description of Artificial Sequence: Synthetic peptide
  Seed: SCLCSFLLLL (MOG_HUMAN)
SFLCSFLLLL

SEQ ID NO: 121704 - protein, 10 aa, Artificial Sequence
  Description of Artificial Sequence: Synthetic peptide
  Seed: FDPHFLRVPC (MOG_HUMAN)
FNPHFLRVPA

SEQ ID NO: 121705 - protein, 10 aa, Artificial Sequence
  Description of Artificial Sequence: Synthetic peptide
  Seed: FRVIGPRHPI (MOG_HUMAN)
FDVIGPRHPV

SEQ ID NO: 121706 - protein, 10 aa, Artificial Sequence
  Description of Artificial Sequence: Synthetic peptide
  Seed: RVPCWKITLF (MOG_HUMAN)
RTPCWKITLY

SEQ ID NO: 121707 - protein, 10 aa, Artificial Sequence
  Description of Artificial Sequence: Synthetic peptide
  Seed: VGWYRPPFSR (MOG_HUMAN)
VRWYRPPFSR

SEQ ID NO: 121708 - protein, 10 aa, Artificial Sequence
  Description of Artificial Sequence: Synthetic peptide
  Seed: AEIENLHRTF (MOG_HUMAN)
ASIENLHRTF

SEQ ID NO: 121709 - protein, 10 aa, Artificial Sequence
  Description of Artificial Sequence: Synthetic peptide
  Seed: RVIGPRHPIR (MOG_HUMAN)
RQIGPRHPIK

SEQ ID NO: 121710 - protein, 8 aa, Artificial Sequence
  Description of Artificial Sequence: Synthetic peptide
  Seed: FSDEGGFT (MOG_HUMAN)
FGDEGGFV

SEQ ID NO: 121711 - protein, 10 aa, Artificial Sequence
  Description of Artificial Sequence: Synthetic peptide
  Seed: VLLLQITVGL (MOG_HUMAN)
VYLLQITVGV

SEQ ID NO: 121712 - protein, 10 aa, Artificial Sequence
  Description of Artificial Sequence: Synthetic peptide
  Seed: YWVSPGVLVL (MOG_HUMAN)
YSVSPGVLVF

SEQ ID NO: 121713 - protein, 9 aa, Artificial Sequence
  Description of Artificial Sequence: Synthetic peptide
  Seed: SLPSCLCSF (MOG_HUMAN)
STPSCLCSV

SEQ ID NO: 121714 - protein, 11 aa, Artificial Sequence
  Description of Artificial Sequence: Synthetic peptide
  Seed: YRLRGKLRAEI (MOG_HUMAN)
YRLRGKLRAEL

SEQ ID NO: 121715 - protein, 9 aa, Artificial Sequence
  Description of Artificial Sequence: Synthetic peptide
  Seed: WVSPGVLVL (MOG_HUMAN)
WISPGVLVI

SEQ ID NO: 121716 - protein, 9 aa, Artificial Sequence
  Description of Artificial Sequence: Synthetic peptide
  Seed: RIRNVRFSD (MOG_HUMAN)
RMRNVRFSL

SEQ ID NO: 121717 - protein, 10 aa, Artificial Sequence
  Description of Artificial Sequence: Synthetic peptide
  Seed: PFSRVVHLYR (MOG_HUMAN)
PHSRVVHLYR

SEQ ID NO: 121718 - protein, 9 aa, Artificial Sequence
  Description of Artificial Sequence: Synthetic peptide
  Seed: RPSLPSCLC (MOG_HUMAN)
RPSLPSCLA

SEQ ID NO: 121719 - protein, 9 aa, Artificial Sequence
  Description of Artificial Sequence: Synthetic peptide
  Seed: IGEGKVTLR (MOG_HUMAN)
ISEGKVTLF

SEQ ID NO: 121720 - protein, 9 aa, Artificial Sequence
  Description of Artificial Sequence: Synthetic peptide
  Seed: SLPSCLCSF (MOG_HUMAN)
SAPSCLCSY

SEQ ID NO: 121721 - protein, 10 aa, Artificial Sequence
  Description of Artificial Sequence: Synthetic peptide
  Seed: SCLCSFLLLL (MOG_HUMAN)
SDLCSFLLLI

SEQ ID NO: 121722 - protein, 10 aa, Artificial Sequence
  Description of Artificial Sequence: Synthetic peptide
  Seed: KVTLRIRNVR (MOG_HUMAN)
KRTLRIRNVR

SEQ ID NO: 121723 - protein, 9 aa, Artificial Sequence
  Description of Artificial Sequence: Synthetic peptide
  Seed: EVGWYRPPF (MOG_HUMAN)
ETGWYRPPR

SEQ ID NO: 121724 - protein, 9 aa, Artificial Sequence
  Description of Artificial Sequence: Synthetic peptide
  Seed: VIVPVLGPL (MOG_HUMAN)
VQVPVLGPA

SEQ ID NO: 121725 - protein, 10 aa, Artificial Sequence
  Description of Artificial Sequence: Synthetic peptide
  Seed: LQITVGLIFL (MOG_HUMAN)
LVITVGLIFI

SEQ ID NO: 121726 - protein, 10 aa, Artificial Sequence
  Description of Artificial Sequence: Synthetic peptide
  Seed: RLAGQFLEEL (MOG_HUMAN)
RVAGQFLEEL

SEQ ID NO: 121727 - protein, 9 aa, Artificial Sequence
  Description of Artificial Sequence: Synthetic peptide
  Seed: VELPCRISP (MOG_HUMAN)
VELPCRISA

SEQ ID NO: 121728 - protein, 10 aa, Artificial Sequence
  Description of Artificial Sequence: Synthetic peptide
  Seed: SCLCSFLLLL (MOG_HUMAN)
SRLCSFLLLV

SEQ ID NO: 121729 - protein, 11 aa, Artificial Sequence
  Description of Artificial Sequence: Synthetic peptide
  Seed: RFSDEGGFTCF (MOG_HUMAN)
RLSDEGGFTCL

SEQ ID NO: 121730 - protein, 10 aa, Artificial Sequence
  Description of Artificial Sequence: Synthetic peptide
  Seed: LLQITVGLIF (MOG_HUMAN)
LEQITVGLIM

SEQ ID NO: 121731 - protein, 10 aa, Artificial Sequence
  Description of Artificial Sequence: Synthetic peptide
  Seed: SPGVLVLLAV (MOG_HUMAN)
SPGVLVLLAM

SEQ ID NO: 121732 - protein, 11 aa, Artificial Sequence
  Description of Artificial Sequence: Synthetic peptide
  Seed: HRTFDPHFLRV (MOG_HUMAN)
HYTFDPHFLRR

SEQ ID NO: 121733 - protein, 9 aa, Artificial Sequence
  Description of Artificial Sequence: Synthetic peptide
  Seed: LSRPSLPSC (MOG_HUMAN)
LQRPSLPSY

SEQ ID NO: 121734 - protein, 9 aa, Artificial Sequence
  Description of Artificial Sequence: Synthetic peptide
  Seed: TFDPHFLRV (MOG_HUMAN)
TRDPHFLRY

SEQ ID NO: 121735 - protein, 9 aa, Artificial Sequence
  Description of Artificial Sequence: Synthetic peptide
  Seed: LAVLPVLLL (MOG_HUMAN)
LMVLPVLLF

SEQ ID NO: 121736 - protein, 10 aa, Artificial Sequence
  Description of Artificial Sequence: Synthetic peptide
  Seed: SCLCSFLLLL (MOG_HUMAN)
SRLCSFLLLL

SEQ ID NO: 121737 - protein, 9 aa, Artificial Sequence
  Description of Artificial Sequence: Synthetic peptide
  Seed: YQEEAAMEL (MOG_HUMAN)
YYEEAAMEV

SEQ ID NO: 121738 - protein, 10 aa, Artificial Sequence
  Description of Artificial Sequence: Synthetic peptide
  Seed: FSDEGGFTCF (MOG_HUMAN)
FLDEGGFTCM

SEQ ID NO: 121739 - protein, 10 aa, Artificial Sequence
  Description of Artificial Sequence: Synthetic peptide
  Seed: SCLCSFLLLL (MOG_HUMAN)
SWLCSFLLLV

SEQ ID NO: 121740 - protein, 9 aa, Artificial Sequence
  Description of Artificial Sequence: Synthetic peptide
  Seed: FYWVSPGVL (MOG_HUMAN)
FIWVSPGVY

SEQ ID NO: 121741 - protein, 10 aa, Artificial Sequence
  Description of Artificial Sequence: Synthetic peptide
  Seed: VLLAVLPVLL (MOG_HUMAN)
VQLAVLPVLL

SEQ ID NO: 121742 - protein, 9 aa, Artificial Sequence
  Description of Artificial Sequence: Synthetic peptide
  Seed: LLQVSSSYA (MOG_HUMAN)
LLQVSSSYI

SEQ ID NO: 121743 - protein, 9 aa, Artificial Sequence
  Description of Artificial Sequence: Synthetic peptide
  Seed: SSYAGQFRV (MOG_HUMAN)
SIYAGQFRR

SEQ ID NO: 121744 - protein, 9 aa, Artificial Sequence
  Description of Artificial Sequence: Synthetic peptide
  Seed: YWVSPGVLV (MOG_HUMAN)
YFVSPGVLM

SEQ ID NO: 121745 - protein, 9 aa, Artificial Sequence
  Description of Artificial Sequence: Synthetic peptide
  Seed: FLLLLLLQV (MOG_HUMAN)
FMLLLLLQA

SEQ ID NO: 121746 - protein, 10 aa, Artificial Sequence
  Description of Artificial Sequence: Synthetic peptide
  Seed: RLAGQFLEEL (MOG_HUMAN)
RMAGQFLEEV

SEQ ID NO: 121747 - protein, 8 aa, Artificial Sequence
  Description of Artificial Sequence: Synthetic peptide
  Seed: AVLPVLLL (MOG_HUMAN)
AQLPVLLV

SEQ ID NO: 121748 - protein, 10 aa, Artificial Sequence
  Description of Artificial Sequence: Synthetic peptide
  Seed: FVIVPVLGPL (MOG_HUMAN)
FNIVPVLGPA

SEQ ID NO: 121749 - protein, 10 aa, Artificial Sequence
  Description of Artificial Sequence: Synthetic peptide
  Seed: KITLFVIVPV (MOG_HUMAN)
KLTLFVIVPL

SEQ ID NO: 121750 - protein, 9 aa, Artificial Sequence
  Description of Artificial Sequence: Synthetic peptide
  Seed: IICYNWLHR (MOG_HUMAN)
ISCYNWLHR

SEQ ID NO: 121751 - protein, 9 aa, Artificial Sequence
  Description of Artificial Sequence: Synthetic peptide
  Seed: VSSSYAGQF (MOG_HUMAN)
VASSYAGQL

SEQ ID NO: 121752 - protein, 10 aa, Artificial Sequence
  Description of Artificial Sequence: Synthetic peptide
  Seed: ATGMEVGWYR (MOG_HUMAN)
AQGMEVGWYR

SEQ ID NO: 121753 - protein, 9 aa, Artificial Sequence
  Description of Artificial Sequence: Synthetic peptide
  Seed: RVPCWKITL (MOG_HUMAN)
RPPCWKITL

SEQ ID NO: 121754 - protein, 9 aa, Artificial Sequence
  Description of Artificial Sequence: Synthetic peptide
  Seed: RPPFSRVVH (MOG_HUMAN)
RPPFSRVVL

SEQ ID NO: 121755 - protein, 9 aa, Artificial Sequence
  Description of Artificial Sequence: Synthetic peptide
  Seed: VIVPVLGPL (MOG_HUMAN)
VAVPVLGPM

SEQ ID NO: 121756 - protein, 10 aa, Artificial Sequence
  Description of Artificial Sequence: Synthetic peptide
  Seed: FSDEGGFTCF (MOG_HUMAN)
FTDEGGFTCL

SEQ ID NO: 121757 - protein, 9 aa, Artificial Sequence
  Description of Artificial Sequence: Synthetic peptide
  Seed: HSYQEEAAM (MOG_HUMAN)
HKYQEEAAY

SEQ ID NO: 121758 - protein, 10 aa, Artificial Sequence
  Description of Artificial Sequence: Synthetic peptide
  Seed: FVIVPVLGPL (MOG_HUMAN)
FPIVPVLGPY

SEQ ID NO: 121759 - protein, 10 aa, Artificial Sequence
  Description of Artificial Sequence: Synthetic peptide
  Seed: GKLRAEIENL (MOG_HUMAN)
GLLRAEIENV

SEQ ID NO: 121760 - protein, 9 aa, Artificial Sequence
  Description of Artificial Sequence: Synthetic peptide
  Seed: CSFLLLLLL (MOG_HUMAN)
CSFLLLLLW

SEQ ID NO: 121761 - protein, 9 aa, Artificial Sequence
  Description of Artificial Sequence: Synthetic peptide
  Seed: LSRPSLPSC (MOG_HUMAN)
LIRPSLPSL

SEQ ID NO: 121762 - protein, 9 aa, Artificial Sequence
  Description of Artificial Sequence: Synthetic peptide
  Seed: RTFDPHFLR (MOG_HUMAN)
RAFDPHFLW

SEQ ID NO: 121763 - protein, 9 aa, Artificial Sequence
  Description of Artificial Sequence: Synthetic peptide
  Seed: VSPGVLVLL (MOG_HUMAN)
VAPGVLVLY

SEQ ID NO: 121764 - protein, 11 aa, Artificial Sequence
  Description of Artificial Sequence: Synthetic peptide
  Seed: RFSDEGGFTCF (MOG_HUMAN)
RGSDEGGFTCW

SEQ ID NO: 121765 - protein, 10 aa, Artificial Sequence
  Description of Artificial Sequence: Synthetic peptide
  Seed: VSSSYAGQFR (MOG_HUMAN)
VTSSYAGQFK

SEQ ID NO: 121766 - protein, 10 aa, Artificial Sequence
  Description of Artificial Sequence: Synthetic peptide
  Seed: SSYAGQFRVI (MOG_HUMAN)
STYAGQFRVL

SEQ ID NO: 121767 - protein, 10 aa, Artificial Sequence
  Description of Artificial Sequence: Synthetic peptide
  Seed: LVLLAVLPVL (MOG_HUMAN)
LLLLAVLPVV

SEQ ID NO: 121768 - protein, 8 aa, Artificial Sequence
  Description of Artificial Sequence: Synthetic peptide
  Seed: YWVSPGVL (MOG_HUMAN)
YYVSPGVF

SEQ ID NO: 121769 - protein, 9 aa, Artificial Sequence
  Description of Artificial Sequence: Synthetic peptide
  Seed: SDEGGFTCF (MOG_HUMAN)
SMEGGFTCY

SEQ ID NO: 121770 - protein, 9 aa, Artificial Sequence
  Description of Artificial Sequence: Synthetic peptide
  Seed: TFDPHFLRV (MOG_HUMAN)
TGDPHFLRY

SEQ ID NO: 121771 - protein, 9 aa, Artificial Sequence
  Description of Artificial Sequence: Synthetic peptide
  Seed: TFDPHFLRV (MOG_HUMAN)
TRDPHFLRM

SEQ ID NO: 121772 - protein, 9 aa, Artificial Sequence
  Description of Artificial Sequence: Synthetic peptide
  Seed: SSYAGQFRV (MOG_HUMAN)
SLYAGQFRI

SEQ ID NO: 121773 - protein, 9 aa, Artificial Sequence
  Description of Artificial Sequence: Synthetic peptide
  Seed: FSDEGGFTC (MOG_HUMAN)
FVDEGGFTI

SEQ ID NO: 121774 - protein, 11 aa, Artificial Sequence
  Description of Artificial Sequence: Synthetic peptide
  Seed: HRTFDPHFLRV (MOG_HUMAN)
HMTFDPHFLRL

SEQ ID NO: 121775 - protein, 8 aa, Artificial Sequence
  Description of Artificial Sequence: Synthetic peptide
  Seed: RIRNVRFS (MOG_HUMAN)
RARNVRFK

SEQ ID NO: 121776 - protein, 9 aa, Artificial Sequence
  Description of Artificial Sequence: Synthetic peptide
  Seed: FSRVVHLYR (MOG_HUMAN)
FTRVVHLYK

SEQ ID NO: 121777 - protein, 11 aa, Artificial Sequence
  Description of Artificial Sequence: Synthetic peptide
  Seed: KDQDGDQAPEY (MOG_HUMAN)
KTQDGDQAPEY

SEQ ID NO: 121778 - protein, 10 aa, Artificial Sequence
  Description of Artificial Sequence: Synthetic peptide
  Seed: RLAGQFLEEL (MOG_HUMAN)
RTAGQFLEEW

SEQ ID NO: 121779 - protein, 10 aa, Artificial Sequence
  Description of Artificial Sequence: Synthetic peptide
  Seed: SLPSCLCSFL (MOG_HUMAN)
SIPSCLCSFV

SEQ ID NO: 121780 - protein, 9 aa, Artificial Sequence
  Description of Artificial Sequence: Synthetic peptide
  Seed: LLAVLPVLL (MOG_HUMAN)
LIAVLPVLL

SEQ ID NO: 121781 - protein, 9 aa, Artificial Sequence
  Description of Artificial Sequence: Synthetic peptide
  Seed: IVPVLGPLV (MOG_HUMAN)
ILPVLGPLI

SEQ ID NO: 121782 - protein, 10 aa, Artificial Sequence
  Description of Artificial Sequence: Synthetic peptide
  Seed: RVPCWKITLF (MOG_HUMAN)
RFPCWKITLM

SEQ ID NO: 121783 - protein, 10 aa, Artificial Sequence
  Description of Artificial Sequence: Synthetic peptide
  Seed: RTFDPHFLRV (MOG_HUMAN)
RVFDPHFLRE

SEQ ID NO: 121784 - protein, 10 aa, Artificial Sequence
  Description of Artificial Sequence: Synthetic peptide
  Seed: WVSPGVLVLL (MOG_HUMAN)
WSSPGVLVLV

SEQ ID NO: 121785 - protein, 9 aa, Artificial Sequence
  Description of Artificial Sequence: Synthetic peptide
  Seed: LAVLPVLLL (MOG_HUMAN)
LLVLPVLLL

SEQ ID NO: 121786 - protein, 9 aa, Artificial Sequence
  Description of Artificial Sequence: Synthetic peptide
  Seed: LQYRLRGKL (MOG_HUMAN)
LKYRLRGKY

SEQ ID NO: 121787 - protein, 10 aa, Artificial Sequence
  Description of Artificial Sequence: Synthetic peptide
  Seed: ITLFVIVPVL (MOG_HUMAN)
ILLFVIVPVM

SEQ ID NO: 121788 - protein, 8 aa, Artificial Sequence
  Description of Artificial Sequence: Synthetic peptide
  Seed: RTFDPHFL (MOG_HUMAN)
RTFDPHFW

SEQ ID NO: 121789 - protein, 10 aa, Artificial Sequence
  Description of Artificial Sequence: Synthetic peptide
  Seed: RTFDPHFLRV (MOG_HUMAN)
RHFDPHFLRM

SEQ ID NO: 121790 - protein, 9 aa, Artificial Sequence
  Description of Artificial Sequence: Synthetic peptide
  Seed: HFLRVPCWK (MOG_HUMAN)
HILRVPCWK

SEQ ID NO: 121791 - protein, 9 aa, Artificial Sequence
  Description of Artificial Sequence: Synthetic peptide
  Seed: ITLFVIVPV (MOG_HUMAN)
ITLFVIVPI

SEQ ID NO: 121792 - protein, 9 aa, Artificial Sequence
  Description of Artificial Sequence: Synthetic peptide
  Seed: FLRVPCWKI (MOG_HUMAN)
FLRVPCWKA

SEQ ID NO: 121793 - protein, 9 aa, Artificial Sequence
  Description of Artificial Sequence: Synthetic peptide
  Seed: FSRVVHLYR (MOG_HUMAN)
FFRVVHLYR

SEQ ID NO: 121794 - protein, 10 aa, Artificial Sequence
  Description of Artificial Sequence: Synthetic peptide
  Seed: LIICYNWLHR (MOG_HUMAN)
LRICYNWLHR

SEQ ID NO: 121795 - protein, 9 aa, Artificial Sequence
  Description of Artificial Sequence: Synthetic peptide
  Seed: ITLFVIVPV (MOG_HUMAN)
ILLFVIVPI

SEQ ID NO: 121796 - protein, 10 aa, Artificial Sequence
  Description of Artificial Sequence: Synthetic peptide
  Seed: KVTLRIRNVR (MOG_HUMAN)
KCTLRIRNVR

SEQ ID NO: 121797 - protein, 10 aa, Artificial Sequence
  Description of Artificial Sequence: Synthetic peptide
  Seed: FDPHFLRVPC (MOG_HUMAN)
FDPHFLRVPP

SEQ ID NO: 121798 - protein, 9 aa, Artificial Sequence
  Description of Artificial Sequence: Synthetic peptide
  Seed: LSRPSLPSC (MOG_HUMAN)
LVRPSLPSA

SEQ ID NO: 121799 - protein, 9 aa, Artificial Sequence
  Description of Artificial Sequence: Synthetic peptide
  Seed: YQEEAAMEL (MOG_HUMAN)
YTEEAAMEV

SEQ ID NO: 121800 - protein, 11 aa, Artificial Sequence
  Description of Artificial Sequence: Synthetic peptide
  Seed: NATGMEVGWYR (MOG_HUMAN)
NITGMEVGWYR

SEQ ID NO: 121801 - protein, 9 aa, Artificial Sequence
  Description of Artificial Sequence: Synthetic peptide
  Seed: FSDEGGFTC (MOG_HUMAN)
FKDEGGFTL

SEQ ID NO: 121802 - protein, 9 aa, Artificial Sequence
  Description of Artificial Sequence: Synthetic peptide
  Seed: FYWVSPGVL (MOG_HUMAN)
FIWVSPGVM

SEQ ID NO: 121803 - protein, 9 aa, Artificial Sequence
  Description of Artificial Sequence: Synthetic peptide
  Seed: FLEELRNPF (MOG_HUMAN)
FYEELRNPV

SEQ ID NO: 121804 - protein, 9 aa, Artificial Sequence
  Description of Artificial Sequence: Synthetic peptide
  Seed: GVLVLLAVL (MOG_HUMAN)
GQLVLLAVV

SEQ ID NO: 121805 - protein, 9 aa, Artificial Sequence
  Description of Artificial Sequence: Synthetic peptide
  Seed: LLLQVSSSY (MOG_HUMAN)
LALQVSSSI

SEQ ID NO: 121806 - protein, 11 aa, Artificial Sequence
  Description of Artificial Sequence: Synthetic peptide
  Seed: RFSDEGGFTCF (MOG_HUMAN)
RSSDEGGFTCW

SEQ ID NO: 121807 - protein, 9 aa, Artificial Sequence
  Description of Artificial Sequence: Synthetic peptide
  Seed: FYWVSPGVL (MOG_HUMAN)
FFWVSPGVY

SEQ ID NO: 121808 - protein, 8 aa, Artificial Sequence
  Description of Artificial Sequence: Synthetic peptide
  Seed: RIRNVRFS (MOG_HUMAN)
RTRNVRFL

SEQ ID NO: 121809 - protein, 10 aa, Artificial Sequence
  Description of Artificial Sequence: Synthetic peptide
  Seed: RTFDPHFLRV (MOG_HUMAN)
RSFDPHFLRN

SEQ ID NO: 121810 - protein, 9 aa, Artificial Sequence
  Description of Artificial Sequence: Synthetic peptide
  Seed: LAVLPVLLL (MOG_HUMAN)
LAVLPVLLY

SEQ ID NO: 121811 - protein, 10 aa, Artificial Sequence
  Description of Artificial Sequence: Synthetic peptide
  Seed: PFSRVVHLYR (MOG_HUMAN)
PLSRVVHLYR

SEQ ID NO: 121812 - protein, 9 aa, Artificial Sequence
  Description of Artificial Sequence: Synthetic peptide
  Seed: RVIGPRHPI (MOG_HUMAN)
RTIGPRHPI

SEQ ID NO: 121813 - protein, 10 aa, Artificial Sequence
  Description of Artificial Sequence: Synthetic peptide
  Seed: RTFDPHFLRV (MOG_HUMAN)
RWFDPHFLRS

SEQ ID NO: 121814 - protein, 9 aa, Artificial Sequence
  Description of Artificial Sequence: Synthetic peptide
  Seed: YRPPFSRVV (MOG_HUMAN)
YYPPFSRVV

SEQ ID NO: 121815 - protein, 11 aa, Artificial Sequence
  Description of Artificial Sequence: Synthetic peptide
  Seed: RFSDEGGFTCF (MOG_HUMAN)
RQSDEGGFTCF

SEQ ID NO: 121816 - protein, 9 aa, Artificial Sequence
  Description of Artificial Sequence: Synthetic peptide
  Seed: LAGQFLEEL (MOG_HUMAN)
LLGQFLEEI

SEQ ID NO: 121817 - protein, 9 aa, Artificial Sequence
  Description of Artificial Sequence: Synthetic peptide
  Seed: LLLQVSSSY (MOG_HUMAN)
LLLQVSSSR

SEQ ID NO: 121818 - protein, 10 aa, Artificial Sequence
  Description of Artificial Sequence: Synthetic peptide
  Seed: VLLLQITVGL (MOG_HUMAN)
VVLLQITVGV

SEQ ID NO: 121819 - protein, 9 aa, Artificial Sequence
  Description of Artificial Sequence: Synthetic peptide
  Seed: LAGQFLEEL (MOG_HUMAN)
LVGQFLEEW

SEQ ID NO: 121820 - protein, 9 aa, Artificial Sequence
  Description of Artificial Sequence: Synthetic peptide
  Seed: MASLSRPSL (MOG_HUMAN)
MYSLSRPSL

SEQ ID NO: 121821 - protein, 10 aa, Artificial Sequence
  Description of Artificial Sequence: Synthetic peptide
  Seed: VPVLGPLVAL (MOG_HUMAN)
VSVLGPLVAV

SEQ ID NO: 121822 - protein, 9 aa, Artificial Sequence
  Description of Artificial Sequence: Synthetic peptide
  Seed: KLRAEIENL (MOG_HUMAN)
KARAEIENK

SEQ ID NO: 121823 - protein, 10 aa, Artificial Sequence
  Description of Artificial Sequence: Synthetic peptide
  Seed: FDPHFLRVPC (MOG_HUMAN)
FIPHFLRVPF

SEQ ID NO: 121824 - protein, 9 aa, Artificial Sequence
  Description of Artificial Sequence: Synthetic peptide
  Seed: GPRHPIRAL (MOG_HUMAN)
GPRHPIRAI

SEQ ID NO: 121825 - protein, 10 aa, Artificial Sequence
  Description of Artificial Sequence: Synthetic peptide
  Seed: SYQEEAAMEL (MOG_HUMAN)
SYQEEAAMEF

SEQ ID NO: 121826 - protein, 9 aa, Artificial Sequence
  Description of Artificial Sequence: Synthetic peptide
  Seed: FSDEGGFTC (MOG_HUMAN)
FPDEGGFTL

SEQ ID NO: 121827 - protein, 9 aa, Artificial Sequence
  Description of Artificial Sequence: Synthetic peptide
  Seed: AIGEGKVTL (MOG_HUMAN)
ATGEGKVTF

SEQ ID NO: 121828 - protein, 11 aa, Artificial Sequence
  Description of Artificial Sequence: Synthetic peptide
  Seed: LHRTFDPHFLR (MOG_HUMAN)
LMRTFDPHFLK

SEQ ID NO: 121829 - protein, 9 aa, Artificial Sequence
  Description of Artificial Sequence: Synthetic peptide
  Seed: TCFFRDHSY (MOG_HUMAN)
TMFFRDHSM

SEQ ID NO: 121830 - protein, 10 aa, Artificial Sequence
  Description of Artificial Sequence: Synthetic peptide
  Seed: KVTLRIRNVR (MOG_HUMAN)
KHTLRIRNVR

SEQ ID NO: 121831 - protein, 9 aa, Artificial Sequence
  Description of Artificial Sequence: Synthetic peptide
  Seed: FYWVSPGVL (MOG_HUMAN)
FMWVSPGVW

SEQ ID NO: 121832 - protein, 10 aa, Artificial Sequence
  Description of Artificial Sequence: Synthetic peptide
  Seed: SLSRPSLPSC (MOG_HUMAN)
SVSRPSLPSI

SEQ ID NO: 121833 - protein, 9 aa, Artificial Sequence
  Description of Artificial Sequence: Synthetic peptide
  Seed: VLLAVLPVL (MOG_HUMAN)
VMLAVLPVR

SEQ ID NO: 121834 - protein, 10 aa, Artificial Sequence
  Description of Artificial Sequence: Synthetic peptide
  Seed: RTFDPHFLRV (MOG_HUMAN)
RFFDPHFLRG

SEQ ID NO: 121835 - protein, 10 aa, Artificial Sequence
  Description of Artificial Sequence: Synthetic peptide
  Seed: SFLLLLLLQV (MOG_HUMAN)
SQLLLLLLQV

SEQ ID NO: 121836 - protein, 11 aa, Artificial Sequence
  Description of Artificial Sequence: Synthetic peptide
  Seed: RDHSYQEEAAM (MOG_HUMAN)
RHHSYQEEAAF

SEQ ID NO: 121837 - protein, 9 aa, Artificial Sequence
  Description of Artificial Sequence: Synthetic peptide
  Seed: MASLSRPSL (MOG_HUMAN)
MPSLSRPSA

SEQ ID NO: 121838 - protein, 10 aa, Artificial Sequence
  Description of Artificial Sequence: Synthetic peptide
  Seed: RVPCWKITLF (MOG_HUMAN)
RQPCWKITLY

SEQ ID NO: 121839 - protein, 9 aa, Artificial Sequence
  Description of Artificial Sequence: Synthetic peptide
  Seed: LKDAIGEGK (MOG_HUMAN)
LVDAIGEGY

SEQ ID NO: 121840 - protein, 11 aa, Artificial Sequence
  Description of Artificial Sequence: Synthetic peptide
  Seed: VIGPRHPIRAL (MOG_HUMAN)
VNGPRHPIRAL

SEQ ID NO: 121841 - protein, 9 aa, Artificial Sequence
  Description of Artificial Sequence: Synthetic peptide
  Seed: KLRAEIENL (MOG_HUMAN)
KVRAEIENF

SEQ ID NO: 121842 - protein, 9 aa, Artificial Sequence
  Description of Artificial Sequence: Synthetic peptide
  Seed: HSYQEEAAM (MOG_HUMAN)
HLYQEEAAY

SEQ ID NO: 121843 - protein, 9 aa, Artificial Sequence
  Description of Artificial Sequence: Synthetic peptide
  Seed: YWVSPGVLV (MOG_HUMAN)
YWVSPGVLM

SEQ ID NO: 121844 - protein, 10 aa, Artificial Sequence
  Description of Artificial Sequence: Synthetic peptide
  Seed: FVIVPVLGPL (MOG_HUMAN)
FAIVPVLGPF

SEQ ID NO: 121845 - protein, 9 aa, Artificial Sequence
  Description of Artificial Sequence: Synthetic peptide
  Seed: MELKVEDPF (MOG_HUMAN)
MELKVEDPA

SEQ ID NO: 121846 - protein, 10 aa, Artificial Sequence
  Description of Artificial Sequence: Synthetic peptide
  Seed: VLGPLVALII (MOG_HUMAN)
VLGPLVALIL

SEQ ID NO: 121847 - protein, 10 aa, Artificial Sequence
  Description of Artificial Sequence: Synthetic peptide
  Seed: LIFLCLQYRL (MOG_HUMAN)
LVFLCLQYRV

SEQ ID NO: 121848 - protein, 10 aa, Artificial Sequence
  Description of Artificial Sequence: Synthetic peptide
  Seed: IGPRHPIRAL (MOG_HUMAN)
IAPRHPIRAL

SEQ ID NO: 121849 - protein, 9 aa, Artificial Sequence
  Description of Artificial Sequence: Synthetic peptide
  Seed: KLRAEIENL (MOG_HUMAN)
KMRAEIENL

SEQ ID NO: 121850 - protein, 9 aa, Artificial Sequence
  Description of Artificial Sequence: Synthetic peptide
  Seed: FLLLLLLQV (MOG_HUMAN)
FILLLLLQL

SEQ ID NO: 121851 - protein, 11 aa, Artificial Sequence
  Description of Artificial Sequence: Synthetic peptide
  Seed: ATGMEVGWYRP (MOG_HUMAN)
AMGMEVGWYRR

SEQ ID NO: 121852 - protein, 9 aa, Artificial Sequence
  Description of Artificial Sequence: Synthetic peptide
  Seed: RTFDPHFLR (MOG_HUMAN)
RQFDPHFLM

SEQ ID NO: 121853 - protein, 10 aa, Artificial Sequence
  Description of Artificial Sequence: Synthetic peptide
  Seed: VPVLGPLVAL (MOG_HUMAN)
VRVLGPLVAV

SEQ ID NO: 121854 - protein, 9 aa, Artificial Sequence
  Description of Artificial Sequence: Synthetic peptide
  Seed: FYWVSPGVL (MOG_HUMAN)
FLWVSPGVM

SEQ ID NO: 121855 - protein, 8 aa, Artificial Sequence
  Description of Artificial Sequence: Synthetic peptide
  Seed: VIGPRHPI (MOG_HUMAN)
VAGPRHPV

SEQ ID NO: 121856 - protein, 10 aa, Artificial Sequence
  Description of Artificial Sequence: Synthetic peptide
  Seed: LLLLQVSSSY (MOG_HUMAN)
LWLLQVSSSY

SEQ ID NO: 121857 - protein, 9 aa, Artificial Sequence
  Description of Artificial Sequence: Synthetic peptide
  Seed: VIVPVLGPL (MOG_HUMAN)
VSVPVLGPY

SEQ ID NO: 121858 - protein, 10 aa, Artificial Sequence
  Description of Artificial Sequence: Synthetic peptide
  Seed: VGWYRPPFSR (MOG_HUMAN)
VTWYRPPFSR

SEQ ID NO: 121859 - protein, 9 aa, Artificial Sequence
  Description of Artificial Sequence: Synthetic peptide
  Seed: TFDPHFLRV (MOG_HUMAN)
TEDPHFLRL

SEQ ID NO: 121860 - protein, 10 aa, Artificial Sequence
  Description of Artificial Sequence: Synthetic peptide
  Seed: FTCFFRDHSY (MOG_HUMAN)
FICFFRDHSY

SEQ ID NO: 121861 - protein, 9 aa, Artificial Sequence
  Description of Artificial Sequence: Synthetic peptide
  Seed: LQVSSSYAG (MOG_HUMAN)
LMVSSSYAF

SEQ ID NO: 121862 - protein, 9 aa, Artificial Sequence
  Description of Artificial Sequence: Synthetic peptide
  Seed: KLRAEIENL (MOG_HUMAN)
KTRAEIENM

SEQ ID NO: 121863 - protein, 11 aa, Artificial Sequence
  Description of Artificial Sequence: Synthetic peptide
  Seed: DAIGEGKVTLR (MOG_HUMAN)
DTIGEGKVTLY

SEQ ID NO: 121864 - protein, 11 aa, Artificial Sequence
  Description of Artificial Sequence: Synthetic peptide
  Seed: LLLLLQVSSSY (MOG_HUMAN)
LQLLLQVSSSY

SEQ ID NO: 121865 - protein, 10 aa, Artificial Sequence
  Description of Artificial Sequence: Synthetic peptide
  Seed: FDPHFLRVPC (MOG_HUMAN)
FFPHFLRVPV

SEQ ID NO: 121866 - protein, 11 aa, Artificial Sequence
  Description of Artificial Sequence: Synthetic peptide
  Seed: SSSYAGQFRVI (MOG_HUMAN)
SASYAGQFRVF

SEQ ID NO: 121867 - protein, 10 aa, Artificial Sequence
  Description of Artificial Sequence: Synthetic peptide
  Seed: IGPRHPIRAL (MOG_HUMAN)
IKPRHPIRAF

SEQ ID NO: 121868 - protein, 10 aa, Artificial Sequence
  Description of Artificial Sequence: Synthetic peptide
  Seed: VLLLQITVGL (MOG_HUMAN)
VCLLQITVGL

SEQ ID NO: 121869 - protein, 11 aa, Artificial Sequence
  Description of Artificial Sequence: Synthetic peptide
  Seed: FSDEGGFTCFF (MOG_HUMAN)
FADEGGFTCFI

SEQ ID NO: 121870 - protein, 9 aa, Artificial Sequence
  Description of Artificial Sequence: Synthetic peptide
  Seed: TLFVIVPVL (MOG_HUMAN)
TIFVIVPVV

SEQ ID NO: 121871 - protein, 10 aa, Artificial Sequence
  Description of Artificial Sequence: Synthetic peptide
  Seed: RRLAGQFLEE (MOG_HUMAN)
RRLAGQFLEW

SEQ ID NO: 121872 - protein, 10 aa, Artificial Sequence
  Description of Artificial Sequence: Synthetic peptide
  Seed: AEIENLHRTF (MOG_HUMAN)
AHIENLHRTF

SEQ ID NO: 121873 - protein, 10 aa, Artificial Sequence
  Description of Artificial Sequence: Synthetic peptide
  Seed: IFLCLQYRLR (MOG_HUMAN)
IYLCLQYRLK

SEQ ID NO: 121874 - protein, 10 aa, Artificial Sequence
  Description of Artificial Sequence: Synthetic peptide
  Seed: LLQITVGLIF (MOG_HUMAN)
LVQITVGLIY

SEQ ID NO: 121875 - protein, 10 aa, Artificial Sequence
  Description of Artificial Sequence: Synthetic peptide
  Seed: SCLCSFLLLL (MOG_HUMAN)
SMLCSFLLLL

SEQ ID NO: 121876 - protein, 9 aa, Artificial Sequence
  Description of Artificial Sequence: Synthetic peptide
  Seed: YRPPFSRVV (MOG_HUMAN)
YLPPFSRVM

SEQ ID NO: 121877 - protein, 9 aa, Artificial Sequence
  Description of Artificial Sequence: Synthetic peptide
  Seed: LAGQFLEEL (MOG_HUMAN)
LLGQFLEEY

SEQ ID NO: 121878 - protein, 10 aa, Artificial Sequence
  Description of Artificial Sequence: Synthetic peptide
  Seed: SCLCSFLLLL (MOG_HUMAN)
SPLCSFLLLL

SEQ ID NO: 121879 - protein, 9 aa, Artificial Sequence
  Description of Artificial Sequence: Synthetic peptide
  Seed: LKVEDPFYW (MOG_HUMAN)
LQVEDPFYM

SEQ ID NO: 121880 - protein, 9 aa, Artificial Sequence
  Description of Artificial Sequence: Synthetic peptide
  Seed: VSPGVLVLL (MOG_HUMAN)
VMPGVLVLA

SEQ ID NO: 121881 - protein, 9 aa, Artificial Sequence
  Description of Artificial Sequence: Synthetic peptide
  Seed: CSFLLLLLL (MOG_HUMAN)
CLFLLLLLV

SEQ ID NO: 121882 - protein, 11 aa, Artificial Sequence
  Description of Artificial Sequence: Synthetic peptide
  Seed: FSDEGGFTCFF (MOG_HUMAN)
FIDEGGFTCFM

SEQ ID NO: 121883 - protein, 9 aa, Artificial Sequence
  Description of Artificial Sequence: Synthetic peptide
  Seed: RTFDPHFLR (MOG_HUMAN)
RYFDPHFLY

SEQ ID NO: 121884 - protein, 10 aa, Artificial Sequence
  Description of Artificial Sequence: Synthetic peptide
  Seed: VLLLQITVGL (MOG_HUMAN)
VILLQITVGI

SEQ ID NO: 121885 - protein, 9 aa, Artificial Sequence
  Description of Artificial Sequence: Synthetic peptide
  Seed: VIVPVLGPL (MOG_HUMAN)
VQVPVLGPF

SEQ ID NO: 121886 - protein, 9 aa, Artificial Sequence
  Description of Artificial Sequence: Synthetic peptide
  Seed: MASLSRPSL (MOG_HUMAN)
MKSLSRPSY

SEQ ID NO: 121887 - protein, 9 aa, Artificial Sequence
  Description of Artificial Sequence: Synthetic peptide
  Seed: TFDPHFLRV (MOG_HUMAN)
TYDPHFLRV

SEQ ID NO: 121888 - protein, 9 aa, Artificial Sequence
  Description of Artificial Sequence: Synthetic peptide
  Seed: WVSPGVLVL (MOG_HUMAN)
WTSPGVLVV

SEQ ID NO: 121889 - protein, 10 aa, Artificial Sequence
  Description of Artificial Sequence: Synthetic peptide
  Seed: ELPCRISPGK (MOG_HUMAN)
EAPCRISPGR

SEQ ID NO: 121890 - protein, 9 aa, Artificial Sequence
  Description of Artificial Sequence: Synthetic peptide
  Seed: ICYNWLHRR (MOG_HUMAN)
IYYNWLHRK

SEQ ID NO: 121891 - protein, 9 aa, Artificial Sequence
  Description of Artificial Sequence: Synthetic peptide
  Seed: FSRVVHLYR (MOG_HUMAN)
FWRVVHLYK

SEQ ID NO: 121892 - protein, 9 aa, Artificial Sequence
  Description of Artificial Sequence: Synthetic peptide
  Seed: RIRNVRFSD (MOG_HUMAN)
RTRNVRFSC

SEQ ID NO: 121893 - protein, 9 aa, Artificial Sequence
  Description of Artificial Sequence: Synthetic peptide
  Seed: LLLQITVGL (MOG_HUMAN)
LMLQITVGL

SEQ ID NO: 121894 - protein, 9 aa, Artificial Sequence
  Description of Artificial Sequence: Synthetic peptide
  Seed: RIRNVRFSD (MOG_HUMAN)
RLRNVRFSN

SEQ ID NO: 121895 - protein, 10 aa, Artificial Sequence
  Description of Artificial Sequence: Synthetic peptide
  Seed: FSDEGGFTCF (MOG_HUMAN)
FNDEGGFTCY

SEQ ID NO: 121896 - protein, 11 aa, Artificial Sequence
  Description of Artificial Sequence: Synthetic peptide
  Seed: HSYQEEAAMEL (MOG_HUMAN)
HGYQEEAAMEW

SEQ ID NO: 121897 - protein, 9 aa, Artificial Sequence
  Description of Artificial Sequence: Synthetic peptide
  Seed: RIRNVRFSD (MOG_HUMAN)
RMRNVRFSM

SEQ ID NO: 121898 - protein, 9 aa, Artificial Sequence
  Description of Artificial Sequence: Synthetic peptide
  Seed: MASLSRPSL (MOG_HUMAN)
MVSLSRPSM

SEQ ID NO: 121899 - protein, 9 aa, Artificial Sequence
  Description of Artificial Sequence: Synthetic peptide
  Seed: HSYQEEAAM (MOG_HUMAN)
HHYQEEAAY

SEQ ID NO: 121900 - protein, 9 aa, Artificial Sequence
  Description of Artificial Sequence: Synthetic peptide
  Seed: AGQFLEELR (MOG_HUMAN)
ATQFLEELY

SEQ ID NO: 121901 - protein, 11 aa, Artificial Sequence
  Description of Artificial Sequence: Synthetic peptide
  Seed: RTFDPHFLRVP (MOG_HUMAN)
RVFDPHFLRVR

SEQ ID NO: 121902 - protein, 9 aa, Artificial Sequence
  Description of Artificial Sequence: Synthetic peptide
  Seed: RIRNVRFSD (MOG_HUMAN)
RYRNVRFSK

SEQ ID NO: 121903 - protein, 9 aa, Artificial Sequence
  Description of Artificial Sequence: Synthetic peptide
  Seed: VIVPVLGPL (MOG_HUMAN)
VLVPVLGPI

SEQ ID NO: 121904 - protein, 11 aa, Artificial Sequence
  Description of Artificial Sequence: Synthetic peptide
  Seed: FSDEGGFTCFF (MOG_HUMAN)
FIDEGGFTCFV

SEQ ID NO: 121905 - protein, 10 aa, Artificial Sequence
  Description of Artificial Sequence: Synthetic peptide
  Seed: APEYRGRTEL (MOG_HUMAN)
AEEYRGRTEL

SEQ ID NO: 121906 - protein, 8 aa, Artificial Sequence
  Description of Artificial Sequence: Synthetic peptide
  Seed: RTFDPHFL (MOG_HUMAN)
RSFDPHFF

SEQ ID NO: 121907 - protein, 8 aa, Artificial Sequence
  Description of Artificial Sequence: Synthetic peptide
  Seed: GGFTCFFR (MOG_HUMAN)
GVFTCFFR

SEQ ID NO: 121908 - protein, 9 aa, Artificial Sequence
  Description of Artificial Sequence: Synthetic peptide
  Seed: YQEEAAMEL (MOG_HUMAN)
YCEEAAMEL

SEQ ID NO: 121909 - protein, 9 aa, Artificial Sequence
  Description of Artificial Sequence: Synthetic peptide
  Seed: HSYQEEAAM (MOG_HUMAN)
HMYQEEAAW

SEQ ID NO: 121910 - protein, 9 aa, Artificial Sequence
  Description of Artificial Sequence: Synthetic peptide
  Seed: RIRNVRFSD (MOG_HUMAN)
RLRNVRFST

SEQ ID NO: 121911 - protein, 9 aa, Artificial Sequence
  Description of Artificial Sequence: Synthetic peptide
  Seed: RTFDPHFLR (MOG_HUMAN)
RMFDPHFLM

SEQ ID NO: 121912 - protein, 10 aa, Artificial Sequence
  Description of Artificial Sequence: Synthetic peptide
  Seed: LLLQVSSSYA (MOG_HUMAN)
LQLQVSSSYI

SEQ ID NO: 121913 - protein, 11 aa, Artificial Sequence
  Description of Artificial Sequence: Synthetic peptide
  Seed: RPSLPSCLCSF (MOG_HUMAN)
RPSLPSCLCSV

SEQ ID NO: 121914 - protein, 10 aa, Artificial Sequence
  Description of Artificial Sequence: Synthetic peptide
  Seed: LLAVLPVLLL (MOG_HUMAN)
LMAVLPVLLI

SEQ ID NO: 121915 - protein, 9 aa, Artificial Sequence
  Description of Artificial Sequence: Synthetic peptide
  Seed: VIVPVLGPL (MOG_HUMAN)
VLVPVLGPY

SEQ ID NO: 121916 - protein, 11 aa, Artificial Sequence
  Description of Artificial Sequence: Synthetic peptide
  Seed: FSDEGGFTCFF (MOG_HUMAN)
FLDEGGFTCFF

SEQ ID NO: 121917 - protein, 9 aa, Artificial Sequence
  Description of Artificial Sequence: Synthetic peptide
  Seed: SSYAGQFRV (MOG_HUMAN)
SYYAGQFRY

SEQ ID NO: 121918 - protein, 8 aa, Artificial Sequence
  Description of Artificial Sequence: Synthetic peptide
  Seed: RIRNVRFS (MOG_HUMAN)
RVRNVRFA

SEQ ID NO: 121919 - protein, 10 aa, Artificial Sequence
  Description of Artificial Sequence: Synthetic peptide
  Seed: SLSRPSLPSC (MOG_HUMAN)
SHSRPSLPSL

SEQ ID NO: 121920 - protein, 9 aa, Artificial Sequence
  Description of Artificial Sequence: Synthetic peptide
  Seed: FSDEGGFTC (MOG_HUMAN)
FWDEGGFTY

SEQ ID NO: 121921 - protein, 9 aa, Artificial Sequence
  Description of Artificial Sequence: Synthetic peptide
  Seed: VLLAVLPVL (MOG_HUMAN)
VQLAVLPVV

SEQ ID NO: 121922 - protein, 9 aa, Artificial Sequence
  Description of Artificial Sequence: Synthetic peptide
  Seed: RVIGPRHPI (MOG_HUMAN)
RYIGPRHPI

SEQ ID NO: 121923 - protein, 11 aa, Artificial Sequence
  Description of Artificial Sequence: Synthetic peptide
  Seed: RTFDPHFLRVP (MOG_HUMAN)
RIFDPHFLRVK

SEQ ID NO: 121924 - protein, 9 aa, Artificial Sequence
  Description of Artificial Sequence: Synthetic peptide
  Seed: ICYNWLHRR (MOG_HUMAN)
IIYNWLHRL

SEQ ID NO: 121925 - protein, 10 aa, Artificial Sequence
  Description of Artificial Sequence: Synthetic peptide
  Seed: KITLFVIVPV (MOG_HUMAN)
KYTLFVIVPV

SEQ ID NO: 121926 - protein, 11 aa, Artificial Sequence
  Description of Artificial Sequence: Synthetic peptide
  Seed: LQVSSSYAGQF (MOG_HUMAN)
LQVSSSYAGQY

SEQ ID NO: 121927 - protein, 9 aa, Artificial Sequence
  Description of Artificial Sequence: Synthetic peptide
  Seed: VGDEVELPC (MOG_HUMAN)
VGDEVELPL

SEQ ID NO: 121928 - protein, 10 aa, Artificial Sequence
  Description of Artificial Sequence: Synthetic peptide
  Seed: FSDEGGFTCF (MOG_HUMAN)
FADEGGFTCI

SEQ ID NO: 121929 - protein, 10 aa, Artificial Sequence
  Description of Artificial Sequence: Synthetic peptide
  Seed: RIRNVRFSDE (MOG_HUMAN)
RTRNVRFSDG

SEQ ID NO: 121930 - protein, 9 aa, Artificial Sequence
  Description of Artificial Sequence: Synthetic peptide
  Seed: SCLCSFLLL (MOG_HUMAN)
SLLCSFLLV

SEQ ID NO: 121931 - protein, 10 aa, Artificial Sequence
  Description of Artificial Sequence: Synthetic peptide
  Seed: LLLQVSSSYA (MOG_HUMAN)
LMLQVSSSYW

SEQ ID NO: 121932 - protein, 10 aa, Artificial Sequence
  Description of Artificial Sequence: Synthetic peptide
  Seed: RRLAGQFLEE (MOG_HUMAN)
RRLAGQFLER

SEQ ID NO: 121933 - protein, 9 aa, Artificial Sequence
  Description of Artificial Sequence: Synthetic peptide
  Seed: VLLAVLPVL (MOG_HUMAN)
VLLAVLPVI

SEQ ID NO: 121934 - protein, 10 aa, Artificial Sequence
  Description of Artificial Sequence: Synthetic peptide
  Seed: RTFDPHFLRV (MOG_HUMAN)
RFFDPHFLRM

SEQ ID NO: 121935 - protein, 9 aa, Artificial Sequence
  Description of Artificial Sequence: Synthetic peptide
  Seed: LQITVGLIF (MOG_HUMAN)
LQITVGLIV

SEQ ID NO: 121936 - protein, 9 aa, Artificial Sequence
  Description of Artificial Sequence: Synthetic peptide
  Seed: TCFFRDHSY (MOG_HUMAN)
THFFRDHSF

SEQ ID NO: 121937 - protein, 10 aa, Artificial Sequence
  Description of Artificial Sequence: Synthetic peptide
  Seed: FDPHFLRVPC (MOG_HUMAN)
FKPHFLRVPT

SEQ ID NO: 121938 - protein, 10 aa, Artificial Sequence
  Description of Artificial Sequence: Synthetic peptide
  Seed: RIRNVRFSDE (MOG_HUMAN)
RVRNVRFSDT

SEQ ID NO: 121939 - protein, 10 aa, Artificial Sequence
  Description of Artificial Sequence: Synthetic peptide
  Seed: TGMEVGWYRP (MOG_HUMAN)
TMMEVGWYRK

SEQ ID NO: 121940 - protein, 9 aa, Artificial Sequence
  Description of Artificial Sequence: Synthetic peptide
  Seed: VSPGVLVLL (MOG_HUMAN)
VFPGVLVLW

SEQ ID NO: 121941 - protein, 9 aa, Artificial Sequence
  Description of Artificial Sequence: Synthetic peptide
  Seed: LAGQFLEEL (MOG_HUMAN)
LQGQFLEEI

SEQ ID NO: 121942 - protein, 9 aa, Artificial Sequence
  Description of Artificial Sequence: Synthetic peptide
  Seed: YRPPFSRVV (MOG_HUMAN)
YGPPFSRVL

SEQ ID NO: 121943 - protein, 9 aa, Artificial Sequence
  Description of Artificial Sequence: Synthetic peptide
  Seed: RRLAGQFLE (MOG_HUMAN)
RQLAGQFLI

SEQ ID NO: 121944 - protein, 9 aa, Artificial Sequence
  Description of Artificial Sequence: Synthetic peptide
  Seed: FLLLLLLQV (MOG_HUMAN)
FLLLLLLQT

SEQ ID NO: 121945 - protein, 9 aa, Artificial Sequence
  Description of Artificial Sequence: Synthetic peptide
  Seed: SLPSCLCSF (MOG_HUMAN)
SGPSCLCSM

SEQ ID NO: 121946 - protein, 9 aa, Artificial Sequence
  Description of Artificial Sequence: Synthetic peptide
  Seed: YRPPFSRVV (MOG_HUMAN)
YQPPFSRVV

SEQ ID NO: 121947 - protein, 9 aa, Artificial Sequence
  Description of Artificial Sequence: Synthetic peptide
  Seed: IVPVLGPLV (MOG_HUMAN)
IGPVLGPLL

SEQ ID NO: 121948 - protein, 9 aa, Artificial Sequence
  Description of Artificial Sequence: Synthetic peptide
  Seed: YQEEAAMEL (MOG_HUMAN)
YLEEAAMEV

SEQ ID NO: 121949 - protein, 10 aa, Artificial Sequence
  Description of Artificial Sequence: Synthetic peptide
  Seed: TGMEVGWYRP (MOG_HUMAN)
TMMEVGWYRS

SEQ ID NO: 121950 - protein, 9 aa, Artificial Sequence
  Description of Artificial Sequence: Synthetic peptide
  Seed: LLLQITVGL (MOG_HUMAN)
LLLQITVGR

SEQ ID NO: 121951 - protein, 9 aa, Artificial Sequence
  Description of Artificial Sequence: Synthetic peptide
  Seed: TFDPHFLRV (MOG_HUMAN)
THDPHFLRL

SEQ ID NO: 121952 - protein, 10 aa, Artificial Sequence
  Description of Artificial Sequence: Synthetic peptide
  Seed: SDEGGFTCFF (MOG_HUMAN)
SGEGGFTCFW

SEQ ID NO: 121953 - protein, 8 aa, Artificial Sequence
  Description of Artificial Sequence: Synthetic peptide
  Seed: RIRNVRFS (MOG_HUMAN)
RIRNVRFK

SEQ ID NO: 121954 - protein, 10 aa, Artificial Sequence
  Description of Artificial Sequence: Synthetic peptide
  Seed: LLLQVSSSYA (MOG_HUMAN)
LTLQVSSSYF

SEQ ID NO: 121955 - protein, 9 aa, Artificial Sequence
  Description of Artificial Sequence: Synthetic peptide
  Seed: SRPSLPSCL (MOG_HUMAN)
SMPSLPSCL

SEQ ID NO: 121956 - protein, 9 aa, Artificial Sequence
  Description of Artificial Sequence: Synthetic peptide
  Seed: RIRNVRFSD (MOG_HUMAN)
RMRNVRFSE

SEQ ID NO: 121957 - protein, 9 aa, Artificial Sequence
  Description of Artificial Sequence: Synthetic peptide
  Seed: LLAVLPVLL (MOG_HUMAN)
LLAVLPVLV

SEQ ID NO: 121958 - protein, 8 aa, Artificial Sequence
  Description of Artificial Sequence: Synthetic peptide
  Seed: KVEDPFYW (MOG_HUMAN)
KTEDPFYW

SEQ ID NO: 121959 - protein, 11 aa, Artificial Sequence
  Description of Artificial Sequence: Synthetic peptide
  Seed: DAIGEGKVTLR (MOG_HUMAN)
DFIGEGKVTLK

SEQ ID NO: 121960 - protein, 10 aa, Artificial Sequence
  Description of Artificial Sequence: Synthetic peptide
  Seed: RTFDPHFLRV (MOG_HUMAN)
RGFDPHFLRR

SEQ ID NO: 121961 - protein, 10 aa, Artificial Sequence
  Description of Artificial Sequence: Synthetic peptide
  Seed: RTFDPHFLRV (MOG_HUMAN)
RIFDPHFLRD

SEQ ID NO: 121962 - protein, 11 aa, Artificial Sequence
  Description of Artificial Sequence: Synthetic peptide
  Seed: LIICYNWLHRR (MOG_HUMAN)
LFICYNWLHRR

SEQ ID NO: 121963 - protein, 10 aa, Artificial Sequence
  Description of Artificial Sequence: Synthetic peptide
  Seed: RTFDPHFLRV (MOG_HUMAN)
RWFDPHFLRF

SEQ ID NO: 121964 - protein, 9 aa, Artificial Sequence
  Description of Artificial Sequence: Synthetic peptide
  Seed: ALVGDEVEL (MOG_HUMAN)
AAVGDEVEY

SEQ ID NO: 121965 - protein, 9 aa, Artificial Sequence
  Description of Artificial Sequence: Synthetic peptide
  Seed: KLRAEIENL (MOG_HUMAN)
KQRAEIENI

SEQ ID NO: 121966 - protein, 10 aa, Artificial Sequence
  Description of Artificial Sequence: Synthetic peptide
  Seed: CLCSFLLLLL (MOG_HUMAN)
CMCSFLLLLR

SEQ ID NO: 121967 - protein, 9 aa, Artificial Sequence
  Description of Artificial Sequence: Synthetic peptide
  Seed: HRTFDPHFL (MOG_HUMAN)
HQTFDPHFL

SEQ ID NO: 121968 - protein, 10 aa, Artificial Sequence
  Description of Artificial Sequence: Synthetic peptide
  Seed: RVIGPRHPIR (MOG_HUMAN)
RQIGPRHPIR

SEQ ID NO: 121969 - protein, 10 aa, Artificial Sequence
  Description of Artificial Sequence: Synthetic peptide
  Seed: RPPFSRVVHL (MOG_HUMAN)
RCPFSRVVHL

SEQ ID NO: 121970 - protein, 10 aa, Artificial Sequence
  Description of Artificial Sequence: Synthetic peptide
  Seed: FSDEGGFTCF (MOG_HUMAN)
FGDEGGFTCV

SEQ ID NO: 121971 - protein, 9 aa, Artificial Sequence
  Description of Artificial Sequence: Synthetic peptide
  Seed: VPVLGPLVA (MOG_HUMAN)
VSVLGPLVL

SEQ ID NO: 121972 - protein, 9 aa, Artificial Sequence
  Description of Artificial Sequence: Synthetic peptide
  Seed: LLLQVSSSY (MOG_HUMAN)
LSLQVSSSM

SEQ ID NO: 121973 - protein, 11 aa, Artificial Sequence
  Description of Artificial Sequence: Synthetic peptide
  Seed: RIRNVRFSDEG (MOG_HUMAN)
RSRNVRFSDEA

SEQ ID NO: 121974 - protein, 9 aa, Artificial Sequence
  Description of Artificial Sequence: Synthetic peptide
  Seed: RTFDPHFLR (MOG_HUMAN)
RTFDPHFLI

SEQ ID NO: 121975 - protein, 9 aa, Artificial Sequence
  Description of Artificial Sequence: Synthetic peptide
  Seed: AIGEGKVTL (MOG_HUMAN)
ASGEGKVTV

SEQ ID NO: 121976 - protein, 9 aa, Artificial Sequence
  Description of Artificial Sequence: Synthetic peptide
  Seed: LAGQFLEEL (MOG_HUMAN)
LPGQFLEEM

SEQ ID NO: 121977 - protein, 10 aa, Artificial Sequence
  Description of Artificial Sequence: Synthetic peptide
  Seed: IGPRHPIRAL (MOG_HUMAN)
IGPRHPIRAF

SEQ ID NO: 121978 - protein, 11 aa, Artificial Sequence
  Description of Artificial Sequence: Synthetic peptide
  Seed: LHRTFDPHFLR (MOG_HUMAN)
LARTFDPHFLK

SEQ ID NO: 121979 - protein, 9 aa, Artificial Sequence
  Description of Artificial Sequence: Synthetic peptide
  Seed: LLLQITVGL (MOG_HUMAN)
LTLQITVGR

SEQ ID NO: 121980 - protein, 10 aa, Artificial Sequence
  Description of Artificial Sequence: Synthetic peptide
  Seed: LLQITVGLIF (MOG_HUMAN)
LDQITVGLIF

SEQ ID NO: 121981 - protein, 9 aa, Artificial Sequence
  Description of Artificial Sequence: Synthetic peptide
  Seed: FSRVVHLYR (MOG_HUMAN)
FVRVVHLYR

SEQ ID NO: 121982 - protein, 10 aa, Artificial Sequence
  Description of Artificial Sequence: Synthetic peptide
  Seed: VLLLQITVGL (MOG_HUMAN)
VHLLQITVGV

SEQ ID NO: 121983 - protein, 8 aa, Artificial Sequence
  Description of Artificial Sequence: Synthetic peptide
  Seed: FSDEGGFT (MOG_HUMAN)
FLDEGGFL

SEQ ID NO: 121984 - protein, 10 aa, Artificial Sequence
  Description of Artificial Sequence: Synthetic peptide
  Seed: VLLLQITVGL (MOG_HUMAN)
VDLLQITVGI

SEQ ID NO: 121985 - protein, 10 aa, Artificial Sequence
  Description of Artificial Sequence: Synthetic peptide
  Seed: RTFDPHFLRV (MOG_HUMAN)
RFFDPHFLRH

SEQ ID NO: 121986 - protein, 9 aa, Artificial Sequence
  Description of Artificial Sequence: Synthetic peptide
  Seed: VGDEVELPC (MOG_HUMAN)
VCDEVELPL

SEQ ID NO: 121987 - protein, 9 aa, Artificial Sequence
  Description of Artificial Sequence: Synthetic peptide
  Seed: LIFLCLQYR (MOG_HUMAN)
LAFLCLQYR

SEQ ID NO: 121988 - protein, 10 aa, Artificial Sequence
  Description of Artificial Sequence: Synthetic peptide
  Seed: FVIVPVLGPL (MOG_HUMAN)
FVIVPVLGPK

SEQ ID NO: 121989 - protein, 10 aa, Artificial Sequence
  Description of Artificial Sequence: Synthetic peptide
  Seed: VLLLQITVGL (MOG_HUMAN)
VPLLQITVGV

SEQ ID NO: 121990 - protein, 10 aa, Artificial Sequence
  Description of Artificial Sequence: Synthetic peptide
  Seed: FSDEGGFTCF (MOG_HUMAN)
FYDEGGFTCY

SEQ ID NO: 121991 - protein, 11 aa, Artificial Sequence
  Description of Artificial Sequence: Synthetic peptide
  Seed: RTFDPHFLRVP (MOG_HUMAN)
RYFDPHFLRVK

SEQ ID NO: 121992 - protein, 10 aa, Artificial Sequence
  Description of Artificial Sequence: Synthetic peptide
  Seed: RTFDPHFLRV (MOG_HUMAN)
RIFDPHFLRR

SEQ ID NO: 121993 - protein, 11 aa, Artificial Sequence
  Description of Artificial Sequence: Synthetic peptide
  Seed: RISPGKNATGM (MOG_HUMAN)
RLSPGKNATGL

SEQ ID NO: 121994 - protein, 10 aa, Artificial Sequence
  Description of Artificial Sequence: Synthetic peptide
  Seed: IICYNWLHRR (MOG_HUMAN)
IVCYNWLHRR

SEQ ID NO: 121995 - protein, 8 aa, Artificial Sequence
  Description of Artificial Sequence: Synthetic peptide
  Seed: RTFDPHFL (MOG_HUMAN)
RRFDPHFY

SEQ ID NO: 121996 - protein, 9 aa, Artificial Sequence
  Description of Artificial Sequence: Synthetic peptide
  Seed: WVSPGVLVL (MOG_HUMAN)
WMSPGVLVI

SEQ ID NO: 121997 - protein, 9 aa, Artificial Sequence
  Description of Artificial Sequence: Synthetic peptide
  Seed: CLCSFLLLL (MOG_HUMAN)
CQCSFLLLY

SEQ ID NO: 121998 - protein, 11 aa, Artificial Sequence
  Description of Artificial Sequence: Synthetic peptide
  Seed: HRTFDPHFLRV (MOG_HUMAN)
HMTFDPHFLRY

SEQ ID NO: 121999 - protein, 10 aa, Artificial Sequence
  Description of Artificial Sequence: Synthetic peptide
  Seed: RVIGPRHPIR (MOG_HUMAN)
RGIGPRHPIR

SEQ ID NO: 122000 - protein, 10 aa, Artificial Sequence
  Description of Artificial Sequence: Synthetic peptide
  Seed: GLIFLCLQYR (MOG_HUMAN)
GTIFLCLQYK

SEQ ID NO: 122001 - protein, 9 aa, Artificial Sequence
  Description of Artificial Sequence: Synthetic peptide
  Seed: RVPCWKITL (MOG_HUMAN)
RWPCWKITF

SEQ ID NO: 122002 - protein, 9 aa, Artificial Sequence
  Description of Artificial Sequence: Synthetic peptide
  Seed: FYWVSPGVL (MOG_HUMAN)
FFWVSPGVF

SEQ ID NO: 122003 - protein, 9 aa, Artificial Sequence
  Description of Artificial Sequence: Synthetic peptide
  Seed: ITVGLIFLC (MOG_HUMAN)
IAVGLIFLI

SEQ ID NO: 122004 - protein, 10 aa, Artificial Sequence
  Description of Artificial Sequence: Synthetic peptide
  Seed: IFLCLQYRLR (MOG_HUMAN)
ITLCLQYRLR

SEQ ID NO: 122005 - protein, 10 aa, Artificial Sequence
  Description of Artificial Sequence: Synthetic peptide
  Seed: RTFDPHFLRV (MOG_HUMAN)
RAFDPHFLRN

SEQ ID NO: 122006 - protein, 10 aa, Artificial Sequence
  Description of Artificial Sequence: Synthetic peptide
  Seed: SCLCSFLLLL (MOG_HUMAN)
SILCSFLLLV

SEQ ID NO: 122007 - protein, 9 aa, Artificial Sequence
  Description of Artificial Sequence: Synthetic peptide
  Seed: LKVEDPFYW (MOG_HUMAN)
LQVEDPFYV

SEQ ID NO: 122008 - protein, 9 aa, Artificial Sequence
  Description of Artificial Sequence: Synthetic peptide
  Seed: FYWVSPGVL (MOG_HUMAN)
FQWVSPGVA

SEQ ID NO: 122009 - protein, 10 aa, Artificial Sequence
  Description of Artificial Sequence: Synthetic peptide
  Seed: ISPGKNATGM (MOG_HUMAN)
IAPGKNATGL

SEQ ID NO: 122010 - protein, 10 aa, Artificial Sequence
  Description of Artificial Sequence: Synthetic peptide
  Seed: IGPRHPIRAL (MOG_HUMAN)
IRPRHPIRAI

SEQ ID NO: 122011 - protein, 10 aa, Artificial Sequence
  Description of Artificial Sequence: Synthetic peptide
  Seed: TGMEVGWYRP (MOG_HUMAN)
TFMEVGWYRR

SEQ ID NO: 122012 - protein, 10 aa, Artificial Sequence
  Description of Artificial Sequence: Synthetic peptide
  Seed: SDEGGFTCFF (MOG_HUMAN)
SQEGGFTCFW

SEQ ID NO: 122013 - protein, 9 aa, Artificial Sequence
  Description of Artificial Sequence: Synthetic peptide
  Seed: RVPCWKITL (MOG_HUMAN)
RQPCWKITW

SEQ ID NO: 122014 - protein, 10 aa, Artificial Sequence
  Description of Artificial Sequence: Synthetic peptide
  Seed: RLAGQFLEEL (MOG_HUMAN)
RMAGQFLEER

SEQ ID NO: 122015 - protein, 9 aa, Artificial Sequence
  Description of Artificial Sequence: Synthetic peptide
  Seed: RIRNVRFSD (MOG_HUMAN)
RNRNVRFSV

SEQ ID NO: 122016 - protein, 10 aa, Artificial Sequence
  Description of Artificial Sequence: Synthetic peptide
  Seed: VGWYRPPFSR (MOG_HUMAN)
VVWYRPPFSR

SEQ ID NO: 122017 - protein, 9 aa, Artificial Sequence
  Description of Artificial Sequence: Synthetic peptide
  Seed: VGDEVELPC (MOG_HUMAN)
VIDEVELPF

SEQ ID NO: 122018 - protein, 11 aa, Artificial Sequence
  Description of Artificial Sequence: Synthetic peptide
  Seed: SDEGGFTCFFR (MOG_HUMAN)
SMEGGFTCFFR

SEQ ID NO: 122019 - protein, 10 aa, Artificial Sequence
  Description of Artificial Sequence: Synthetic peptide
  Seed: LLQITVGLIF (MOG_HUMAN)
LKQITVGLIY

SEQ ID NO: 122020 - protein, 9 aa, Artificial Sequence
  Description of Artificial Sequence: Synthetic peptide
  Seed: VLGPLVALI (MOG_HUMAN)
VVGPLVALA

SEQ ID NO: 122021 - protein, 10 aa, Artificial Sequence
  Description of Artificial Sequence: Synthetic peptide
  Seed: SCLCSFLLLL (MOG_HUMAN)
SQLCSFLLLM

SEQ ID NO: 122022 - protein, 10 aa, Artificial Sequence
  Description of Artificial Sequence: Synthetic peptide
  Seed: KNATGMEVGW (MOG_HUMAN)
KMATGMEVGW

SEQ ID NO: 122023 - protein, 9 aa, Artificial Sequence
  Description of Artificial Sequence: Synthetic peptide
  Seed: LIICYNWLH (MOG_HUMAN)
LMICYNWLK

SEQ ID NO: 122024 - protein, 10 aa, Artificial Sequence
  Description of Artificial Sequence: Synthetic peptide
  Seed: ATGMEVGWYR (MOG_HUMAN)
ADGMEVGWYR

SEQ ID NO: 122025 - protein, 11 aa, Artificial Sequence
  Description of Artificial Sequence: Synthetic peptide
  Seed: LHRTFDPHFLR (MOG_HUMAN)
LERTFDPHFLK

SEQ ID NO: 122026 - protein, 10 aa, Artificial Sequence
  Description of Artificial Sequence: Synthetic peptide
  Seed: RTFDPHFLRV (MOG_HUMAN)
RFFDPHFLRP

SEQ ID NO: 122027 - protein, 9 aa, Artificial Sequence
  Description of Artificial Sequence: Synthetic peptide
  Seed: TFDPHFLRV (MOG_HUMAN)
TSDPHFLRI

SEQ ID NO: 122028 - protein, 10 aa, Artificial Sequence
  Description of Artificial Sequence: Synthetic peptide
  Seed: FDPHFLRVPC (MOG_HUMAN)
FCPHFLRVPT

SEQ ID NO: 122029 - protein, 9 aa, Artificial Sequence
  Description of Artificial Sequence: Synthetic peptide
  Seed: LSRPSLPSC (MOG_HUMAN)
LTRPSLPSI

SEQ ID NO: 122030 - protein, 10 aa, Artificial Sequence
  Description of Artificial Sequence: Synthetic peptide
  Seed: SSYAGQFRVI (MOG_HUMAN)
SEYAGQFRVW

SEQ ID NO: 122031 - protein, 10 aa, Artificial Sequence
  Description of Artificial Sequence: Synthetic peptide
  Seed: RVIGPRHPIR (MOG_HUMAN)
RMIGPRHPIK

SEQ ID NO: 122032 - protein, 9 aa, Artificial Sequence
  Description of Artificial Sequence: Synthetic peptide
  Seed: YQEEAAMEL (MOG_HUMAN)
YLEEAAMEM

SEQ ID NO: 122033 - protein, 10 aa, Artificial Sequence
  Description of Artificial Sequence: Synthetic peptide
  Seed: YQEEAAMELK (MOG_HUMAN)
YAEEAAMELY

SEQ ID NO: 122034 - protein, 9 aa, Artificial Sequence
  Description of Artificial Sequence: Synthetic peptide
  Seed: YQEEAAMEL (MOG_HUMAN)
YGEEAAMEI

SEQ ID NO: 122035 - protein, 9 aa, Artificial Sequence
  Description of Artificial Sequence: Synthetic peptide
  Seed: FSDEGGFTC (MOG_HUMAN)
FMDEGGFTM

SEQ ID NO: 122036 - protein, 10 aa, Artificial Sequence
  Description of Artificial Sequence: Synthetic peptide
  Seed: IGPRHPIRAL (MOG_HUMAN)
IFPRHPIRAV

SEQ ID NO: 122037 - protein, 10 aa, Artificial Sequence
  Description of Artificial Sequence: Synthetic peptide
  Seed: LLLQVSSSYA (MOG_HUMAN)
LQLQVSSSYK

SEQ ID NO: 122038 - protein, 10 aa, Artificial Sequence
  Description of Artificial Sequence: Synthetic peptide
  Seed: YWVSPGVLVL (MOG_HUMAN)
YYVSPGVLVM

SEQ ID NO: 122039 - protein, 10 aa, Artificial Sequence
  Description of Artificial Sequence: Synthetic peptide
  Seed: FVIVPVLGPL (MOG_HUMAN)
FQIVPVLGPM

SEQ ID NO: 122040 - protein, 10 aa, Artificial Sequence
  Description of Artificial Sequence: Synthetic peptide
  Seed: LIFLCLQYRL (MOG_HUMAN)
LAFLCLQYRK

SEQ ID NO: 122041 - protein, 10 aa, Artificial Sequence
  Description of Artificial Sequence: Synthetic peptide
  Seed: FDPHFLRVPC (MOG_HUMAN)
FWPHFLRVPF

SEQ ID NO: 122042 - protein, 10 aa, Artificial Sequence
  Description of Artificial Sequence: Synthetic peptide
  Seed: VLLLQITVGL (MOG_HUMAN)
VALLQITVGV

SEQ ID NO: 122043 - protein, 10 aa, Artificial Sequence
  Description of Artificial Sequence: Synthetic peptide
  Seed: SCLCSFLLLL (MOG_HUMAN)
SFLCSFLLLI

SEQ ID NO: 122044 - protein, 10 aa, Artificial Sequence
  Description of Artificial Sequence: Synthetic peptide
  Seed: RALVGDEVEL (MOG_HUMAN)
RLLVGDEVEI

SEQ ID NO: 122045 - protein, 10 aa, Artificial Sequence
  Description of Artificial Sequence: Synthetic peptide
  Seed: HRTFDPHFLR (MOG_HUMAN)
HDTFDPHFLR

SEQ ID NO: 122046 - protein, 11 aa, Artificial Sequence
  Description of Artificial Sequence: Synthetic peptide
  Seed: MELKVEDPFYW (MOG_HUMAN)
MVLKVEDPFYW

SEQ ID NO: 122047 - protein, 9 aa, Artificial Sequence
  Description of Artificial Sequence: Synthetic peptide
  Seed: WVSPGVLVL (MOG_HUMAN)
WASPGVLVI

SEQ ID NO: 122048 - protein, 10 aa, Artificial Sequence
  Description of Artificial Sequence: Synthetic peptide
  Seed: RTFDPHFLRV (MOG_HUMAN)
RHFDPHFLRF

SEQ ID NO: 122049 - protein, 9 aa, Artificial Sequence
  Description of Artificial Sequence: Synthetic peptide
  Seed: AEIENLHRT (MOG_HUMAN)
AEIENLHRI

SEQ ID NO: 122050 - protein, 10 aa, Artificial Sequence
  Description of Artificial Sequence: Synthetic peptide
  Seed: RIRNVRFSDE (MOG_HUMAN)
RVRNVRFSDI

SEQ ID NO: 122051 - protein, 10 aa, Artificial Sequence
  Description of Artificial Sequence: Synthetic peptide
  Seed: FDPHFLRVPC (MOG_HUMAN)
FIPHFLRVPS

SEQ ID NO: 122052 - protein, 9 aa, Artificial Sequence
  Description of Artificial Sequence: Synthetic peptide
  Seed: GLIFLCLQY (MOG_HUMAN)
GKIFLCLQY

SEQ ID NO: 122053 - protein, 9 aa, Artificial Sequence
  Description of Artificial Sequence: Synthetic peptide
  Seed: VELPCRISP (MOG_HUMAN)
VELPCRIST

SEQ ID NO: 122054 - protein, 10 aa, Artificial Sequence
  Description of Artificial Sequence: Synthetic peptide
  Seed: YWVSPGVLVL (MOG_HUMAN)
YCVSPGVLVY

SEQ ID NO: 122055 - protein, 10 aa, Artificial Sequence
  Description of Artificial Sequence: Synthetic peptide
  Seed: LLQITVGLIF (MOG_HUMAN)
LAQITVGLIM

SEQ ID NO: 122056 - protein, 9 aa, Artificial Sequence
  Description of Artificial Sequence: Synthetic peptide
  Seed: ITVGLIFLC (MOG_HUMAN)
ITVGLIFLI

SEQ ID NO: 122057 - protein, 11 aa, Artificial Sequence
  Description of Artificial Sequence: Synthetic peptide
  Seed: RPSLPSCLCSF (MOG_HUMAN)
RASLPSCLCSF

SEQ ID NO: 122058 - protein, 9 aa, Artificial Sequence
  Description of Artificial Sequence: Synthetic peptide
  Seed: TFDPHFLRV (MOG_HUMAN)
TTDPHFLRW

SEQ ID NO: 122059 - protein, 10 aa, Artificial Sequence
  Description of Artificial Sequence: Synthetic peptide
  Seed: ATGMEVGWYR (MOG_HUMAN)
APGMEVGWYK

SEQ ID NO: 122060 - protein, 10 aa, Artificial Sequence
  Description of Artificial Sequence: Synthetic peptide
  Seed: RIRNVRFSDE (MOG_HUMAN)
RSRNVRFSDM

SEQ ID NO: 122061 - protein, 10 aa, Artificial Sequence
  Description of Artificial Sequence: Synthetic peptide
  Seed: FSRVVHLYRN (MOG_HUMAN)
FLRVVHLYRR

SEQ ID NO: 122062 - protein, 9 aa, Artificial Sequence
  Description of Artificial Sequence: Synthetic peptide
  Seed: LQITVGLIF (MOG_HUMAN)
LQITVGLIM

SEQ ID NO: 122063 - protein, 10 aa, Artificial Sequence
  Description of Artificial Sequence: Synthetic peptide
  Seed: RVIGPRHPIR (MOG_HUMAN)
RTIGPRHPII

SEQ ID NO: 122064 - protein, 9 aa, Artificial Sequence
  Description of Artificial Sequence: Synthetic peptide
  Seed: VGDEVELPC (MOG_HUMAN)
VGDEVELPV

SEQ ID NO: 122065 - protein, 8 aa, Artificial Sequence
  Description of Artificial Sequence: Synthetic peptide
  Seed: FSDEGGFT (MOG_HUMAN)
FSDEGGFL

SEQ ID NO: 122066 - protein, 10 aa, Artificial Sequence
  Description of Artificial Sequence: Synthetic peptide
  Seed: LIFLCLQYRL (MOG_HUMAN)
LQFLCLQYRV

SEQ ID NO: 122067 - protein, 9 aa, Artificial Sequence
  Description of Artificial Sequence: Synthetic peptide
  Seed: HSYQEEAAM (MOG_HUMAN)
HMYQEEAAM

SEQ ID NO: 122068 - protein, 9 aa, Artificial Sequence
  Description of Artificial Sequence: Synthetic peptide
  Seed: TFDPHFLRV (MOG_HUMAN)
TGDPHFLRF

SEQ ID NO: 122069 - protein, 9 aa, Artificial Sequence
  Description of Artificial Sequence: Synthetic peptide
  Seed: TFDPHFLRV (MOG_HUMAN)
TGDPHFLRV

SEQ ID NO: 122070 - protein, 10 aa, Artificial Sequence
  Description of Artificial Sequence: Synthetic peptide
  Seed: FTCFFRDHSY (MOG_HUMAN)
FQCFFRDHSF

SEQ ID NO: 122071 - protein, 9 aa, Artificial Sequence
  Description of Artificial Sequence: Synthetic peptide
  Seed: TFDPHFLRV (MOG_HUMAN)
TFDPHFLRF

SEQ ID NO: 122072 - protein, 9 aa, Artificial Sequence
  Description of Artificial Sequence: Synthetic peptide
  Seed: GLIFLCLQY (MOG_HUMAN)
GVIFLCLQY

SEQ ID NO: 122073 - protein, 9 aa, Artificial Sequence
  Description of Artificial Sequence: Synthetic peptide
  Seed: VLLAVLPVL (MOG_HUMAN)
VQLAVLPVA

SEQ ID NO: 122074 - protein, 9 aa, Artificial Sequence
  Description of Artificial Sequence: Synthetic peptide
  Seed: SYAGQFRVI (MOG_HUMAN)
SYAGQFRVY

SEQ ID NO: 122075 - protein, 10 aa, Artificial Sequence
  Description of Artificial Sequence: Synthetic peptide
  Seed: IGPRHPIRAL (MOG_HUMAN)
ICPRHPIRAL

SEQ ID NO: 122076 - protein, 9 aa, Artificial Sequence
  Description of Artificial Sequence: Synthetic peptide
  Seed: VSPGVLVLL (MOG_HUMAN)
VQPGVLVLA

SEQ ID NO: 122077 - protein, 9 aa, Artificial Sequence
  Description of Artificial Sequence: Synthetic peptide
  Seed: SSYAGQFRV (MOG_HUMAN)
SVYAGQFRL

SEQ ID NO: 122078 - protein, 10 aa, Artificial Sequence
  Description of Artificial Sequence: Synthetic peptide
  Seed: FSDEGGFTCF (MOG_HUMAN)
FNDEGGFTCV

SEQ ID NO: 122079 - protein, 9 aa, Artificial Sequence
  Description of Artificial Sequence: Synthetic peptide
  Seed: LLQVSSSYA (MOG_HUMAN)
LMQVSSSYI

SEQ ID NO: 122080 - protein, 10 aa, Artificial Sequence
  Description of Artificial Sequence: Synthetic peptide
  Seed: LLLQVSSSYA (MOG_HUMAN)
LMLQVSSSYG

SEQ ID NO: 122081 - protein, 9 aa, Artificial Sequence
  Description of Artificial Sequence: Synthetic peptide
  Seed: RVIGPRHPI (MOG_HUMAN)
REIGPRHPY

SEQ ID NO: 122082 - protein, 9 aa, Artificial Sequence
  Description of Artificial Sequence: Synthetic peptide
  Seed: HSYQEEAAM (MOG_HUMAN)
HKYQEEAAF

SEQ ID NO: 122083 - protein, 9 aa, Artificial Sequence
  Description of Artificial Sequence: Synthetic peptide
  Seed: TGMEVGWYR (MOG_HUMAN)
TYMEVGWYK

SEQ ID NO: 122084 - protein, 9 aa, Artificial Sequence
  Description of Artificial Sequence: Synthetic peptide
  Seed: LLLQITVGL (MOG_HUMAN)
LILQITVGV

SEQ ID NO: 122085 - protein, 11 aa, Artificial Sequence
  Description of Artificial Sequence: Synthetic peptide
  Seed: RVIGPRHPIRA (MOG_HUMAN)
RAIGPRHPIRR

SEQ ID NO: 122086 - protein, 8 aa, Artificial Sequence
  Description of Artificial Sequence: Synthetic peptide
  Seed: GGFTCFFR (MOG_HUMAN)
GTFTCFFR

SEQ ID NO: 122087 - protein, 9 aa, Artificial Sequence
  Description of Artificial Sequence: Synthetic peptide
  Seed: RIRNVRFSD (MOG_HUMAN)
RMRNVRFSI

SEQ ID NO: 122088 - protein, 10 aa, Artificial Sequence
  Description of Artificial Sequence: Synthetic peptide
  Seed: FTCFFRDHSY (MOG_HUMAN)
FMCFFRDHSF

SEQ ID NO: 122089 - protein, 8 aa, Artificial Sequence
  Description of Artificial Sequence: Synthetic peptide
  Seed: FSDEGGFT (MOG_HUMAN)
FIDEGGFF

SEQ ID NO: 122090 - protein, 9 aa, Artificial Sequence
  Description of Artificial Sequence: Synthetic peptide
  Seed: ITVGLIFLC (MOG_HUMAN)
ITVGLIFLL

SEQ ID NO: 122091 - protein, 10 aa, Artificial Sequence
  Description of Artificial Sequence: Synthetic peptide
  Seed: WLHRRLAGQF (MOG_HUMAN)
WQHRRLAGQY

SEQ ID NO: 122092 - protein, 10 aa, Artificial Sequence
  Description of Artificial Sequence: Synthetic peptide
  Seed: SDEGGFTCFF (MOG_HUMAN)
SKEGGFTCFW

SEQ ID NO: 122093 - protein, 9 aa, Artificial Sequence
  Description of Artificial Sequence: Synthetic peptide
  Seed: FYWVSPGVL (MOG_HUMAN)
FKWVSPGVL

SEQ ID NO: 122094 - protein, 9 aa, Artificial Sequence
  Description of Artificial Sequence: Synthetic peptide
  Seed: CLCSFLLLL (MOG_HUMAN)
CTCSFLLLF

SEQ ID NO: 122095 - protein, 9 aa, Artificial Sequence
  Description of Artificial Sequence: Synthetic peptide
  Seed: LLLQITVGL (MOG_HUMAN)
LLLQITVGM

SEQ ID NO: 122096 - protein, 10 aa, Artificial Sequence
  Description of Artificial Sequence: Synthetic peptide
  Seed: FSRVVHLYRN (MOG_HUMAN)
FFRVVHLYRR

SEQ ID NO: 122097 - protein, 10 aa, Artificial Sequence
  Description of Artificial Sequence: Synthetic peptide
  Seed: FVIVPVLGPL (MOG_HUMAN)
FLIVPVLGPI

SEQ ID NO: 122098 - protein, 9 aa, Artificial Sequence
  Description of Artificial Sequence: Synthetic peptide
  Seed: TFDPHFLRV (MOG_HUMAN)
TDDPHFLRL

SEQ ID NO: 122099 - protein, 9 aa, Artificial Sequence
  Description of Artificial Sequence: Synthetic peptide
  Seed: RIRNVRFSD (MOG_HUMAN)
RFRNVRFSA

SEQ ID NO: 122100 - protein, 9 aa, Artificial Sequence
  Description of Artificial Sequence: Synthetic peptide
  Seed: KLRAEIENL (MOG_HUMAN)
KQRAEIENY

SEQ ID NO: 122101 - protein, 9 aa, Artificial Sequence
  Description of Artificial Sequence: Synthetic peptide
  Seed: LQITVGLIF (MOG_HUMAN)
LMITVGLIF

SEQ ID NO: 122102 - protein, 11 aa, Artificial Sequence
  Description of Artificial Sequence: Synthetic peptide
  Seed: YAGQFRVIGPR (MOG_HUMAN)
YTGQFRVIGPR

SEQ ID NO: 122103 - protein, 10 aa, Artificial Sequence
  Description of Artificial Sequence: Synthetic peptide
  Seed: RTFDPHFLRV (MOG_HUMAN)
RAFDPHFLRY

SEQ ID NO: 122104 - protein, 9 aa, Artificial Sequence
  Description of Artificial Sequence: Synthetic peptide
  Seed: LLLQVSSSY (MOG_HUMAN)
LILQVSSSW

SEQ ID NO: 122105 - protein, 9 aa, Artificial Sequence
  Description of Artificial Sequence: Synthetic peptide
  Seed: VGDEVELPC (MOG_HUMAN)
VCDEVELPV

SEQ ID NO: 122106 - protein, 10 aa, Artificial Sequence
  Description of Artificial Sequence: Synthetic peptide
  Seed: FDPHFLRVPC (MOG_HUMAN)
FLPHFLRVPP

SEQ ID NO: 122107 - protein, 9 aa, Artificial Sequence
  Description of Artificial Sequence: Synthetic peptide
  Seed: IFLCLQYRL (MOG_HUMAN)
IQLCLQYRF

SEQ ID NO: 122108 - protein, 9 aa, Artificial Sequence
  Description of Artificial Sequence: Synthetic peptide
  Seed: FSDEGGFTC (MOG_HUMAN)
FWDEGGFTF

SEQ ID NO: 122109 - protein, 10 aa, Artificial Sequence
  Description of Artificial Sequence: Synthetic peptide
  Seed: FDPHFLRVPC (MOG_HUMAN)
FRPHFLRVPS

SEQ ID NO: 122110 - protein, 9 aa, Artificial Sequence
  Description of Artificial Sequence: Synthetic peptide
  Seed: YRPPFSRVV (MOG_HUMAN)
YFPPFSRVL

SEQ ID NO: 122111 - protein, 9 aa, Artificial Sequence
  Description of Artificial Sequence: Synthetic peptide
  Seed: SSYAGQFRV (MOG_HUMAN)
SIYAGQFRK

SEQ ID NO: 122112 - protein, 9 aa, Artificial Sequence
  Description of Artificial Sequence: Synthetic peptide
  Seed: LSRPSLPSC (MOG_HUMAN)
LSRPSLPSR

SEQ ID NO: 122113 - protein, 10 aa, Artificial Sequence
  Description of Artificial Sequence: Synthetic peptide
  Seed: LLLQVSSSYA (MOG_HUMAN)
LQLQVSSSYV

SEQ ID NO: 122114 - protein, 10 aa, Artificial Sequence
  Description of Artificial Sequence: Synthetic peptide
  Seed: RTFDPHFLRV (MOG_HUMAN)
RVFDPHFLRN

SEQ ID NO: 122115 - protein, 11 aa, Artificial Sequence
  Description of Artificial Sequence: Synthetic peptide
  Seed: VRFSDEGGFTC (MOG_HUMAN)
VHFSDEGGFTC

SEQ ID NO: 122116 - protein, 9 aa, Artificial Sequence
  Description of Artificial Sequence: Synthetic peptide
  Seed: SSYAGQFRV (MOG_HUMAN)
STYAGQFRL

SEQ ID NO: 122117 - protein, 9 aa, Artificial Sequence
  Description of Artificial Sequence: Synthetic peptide
  Seed: LSRPSLPSC (MOG_HUMAN)
LSRPSLPSV

SEQ ID NO: 122118 - protein, 9 aa, Artificial Sequence
  Description of Artificial Sequence: Synthetic peptide
  Seed: RVIGPRHPI (MOG_HUMAN)
RFIGPRHPV

SEQ ID NO: 122119 - protein, 9 aa, Artificial Sequence
  Description of Artificial Sequence: Synthetic peptide
  Seed: LAGQFLEEL (MOG_HUMAN)
LMGQFLEEA

SEQ ID NO: 122120 - protein, 10 aa, Artificial Sequence
  Description of Artificial Sequence: Synthetic peptide
  Seed: SLSRPSLPSC (MOG_HUMAN)
SQSRPSLPSK

SEQ ID NO: 122121 - protein, 11 aa, Artificial Sequence
  Description of Artificial Sequence: Synthetic peptide
  Seed: RFSDEGGFTCF (MOG_HUMAN)
RASDEGGFTCH

SEQ ID NO: 122122 - protein, 9 aa, Artificial Sequence
  Description of Artificial Sequence: Synthetic peptide
  Seed: RIRNVRFSD (MOG_HUMAN)
RFRNVRFSE

SEQ ID NO: 122123 - protein, 9 aa, Artificial Sequence
  Description of Artificial Sequence: Synthetic peptide
  Seed: VSPGVLVLL (MOG_HUMAN)
VWPGVLVLL

SEQ ID NO: 122124 - protein, 9 aa, Artificial Sequence
  Description of Artificial Sequence: Synthetic peptide
  Seed: HSYQEEAAM (MOG_HUMAN)
HAYQEEAAV

SEQ ID NO: 122125 - protein, 8 aa, Artificial Sequence
  Description of Artificial Sequence: Synthetic peptide
  Seed: IENLHRTF (MOG_HUMAN)
IENLHRTI

SEQ ID NO: 122126 - protein, 10 aa, Artificial Sequence
  Description of Artificial Sequence: Synthetic peptide
  Seed: FDPHFLRVPC (MOG_HUMAN)
FWPHFLRVPT

SEQ ID NO: 122127 - protein, 11 aa, Artificial Sequence
  Description of Artificial Sequence: Synthetic peptide
  Seed: NATGMEVGWYR (MOG_HUMAN)
NYTGMEVGWYR

SEQ ID NO: 122128 - protein, 10 aa, Artificial Sequence
  Description of Artificial Sequence: Synthetic peptide
  Seed: RTFDPHFLRV (MOG_HUMAN)
RQFDPHFLRH

SEQ ID NO: 122129 - protein, 9 aa, Artificial Sequence
  Description of Artificial Sequence: Synthetic peptide
  Seed: VGDEVELPC (MOG_HUMAN)
VNDEVELPF

SEQ ID NO: 122130 - protein, 9 aa, Artificial Sequence
  Description of Artificial Sequence: Synthetic peptide
  Seed: RVIGPRHPI (MOG_HUMAN)
RFIGPRHPY

SEQ ID NO: 122131 - protein, 9 aa, Artificial Sequence
  Description of Artificial Sequence: Synthetic peptide
  Seed: FSDEGGFTC (MOG_HUMAN)
FFDEGGFTI

SEQ ID NO: 122132 - protein, 10 aa, Artificial Sequence
  Description of Artificial Sequence: Synthetic peptide
  Seed: IGPRHPIRAL (MOG_HUMAN)
IVPRHPIRAL

SEQ ID NO: 122133 - protein, 9 aa, Artificial Sequence
  Description of Artificial Sequence: Synthetic peptide
  Seed: LLLQITVGL (MOG_HUMAN)
LQLQITVGL

SEQ ID NO: 122134 - protein, 9 aa, Artificial Sequence
  Description of Artificial Sequence: Synthetic peptide
  Seed: GWYRPPFSR (MOG_HUMAN)
GVYRPPFSK

SEQ ID NO: 122135 - protein, 10 aa, Artificial Sequence
  Description of Artificial Sequence: Synthetic peptide
  Seed: VIVPVLGPLV (MOG_HUMAN)
VLVPVLGPLV

SEQ ID NO: 122136 - protein, 10 aa, Artificial Sequence
  Description of Artificial Sequence: Synthetic peptide
  Seed: SDEGGFTCFF (MOG_HUMAN)
SHEGGFTCFW

SEQ ID NO: 122137 - protein, 9 aa, Artificial Sequence
  Description of Artificial Sequence: Synthetic peptide
  Seed: KLRAEIENL (MOG_HUMAN)
KFRAEIENY

SEQ ID NO: 122138 - protein, 10 aa, Artificial Sequence
  Description of Artificial Sequence: Synthetic peptide
  Seed: LLAVLPVLLL (MOG_HUMAN)
LMAVLPVLLV

SEQ ID NO: 122139 - protein, 9 aa, Artificial Sequence
  Description of Artificial Sequence: Synthetic peptide
  Seed: RVPCWKITL (MOG_HUMAN)
RSPCWKITV

SEQ ID NO: 122140 - protein, 8 aa, Artificial Sequence
  Description of Artificial Sequence: Synthetic peptide
  Seed: DEVELPCR (MOG_HUMAN)
DEVELPCY

SEQ ID NO: 122141 - protein, 9 aa, Artificial Sequence
  Description of Artificial Sequence: Synthetic peptide
  Seed: YRPPFSRVV (MOG_HUMAN)
YSPPFSRVY

SEQ ID NO: 122142 - protein, 9 aa, Artificial Sequence
  Description of Artificial Sequence: Synthetic peptide
  Seed: RVIGPRHPI (MOG_HUMAN)
RQIGPRHPM

SEQ ID NO: 122143 - protein, 10 aa, Artificial Sequence
  Description of Artificial Sequence: Synthetic peptide
  Seed: ITLFVIVPVL (MOG_HUMAN)
IRLFVIVPVV

SEQ ID NO: 122144 - protein, 11 aa, Artificial Sequence
  Description of Artificial Sequence: Synthetic peptide
  Seed: RTFDPHFLRVP (MOG_HUMAN)
RWFDPHFLRVR

SEQ ID NO: 122145 - protein, 11 aa, Artificial Sequence
  Description of Artificial Sequence: Synthetic peptide
  Seed: RDHSYQEEAAM (MOG_HUMAN)
RNHSYQEEAAW

SEQ ID NO: 122146 - protein, 10 aa, Artificial Sequence
  Description of Artificial Sequence: Synthetic peptide
  Seed: RTFDPHFLRV (MOG_HUMAN)
RVFDPHFLRC

SEQ ID NO: 122147 - protein, 9 aa, Artificial Sequence
  Description of Artificial Sequence: Synthetic peptide
  Seed: VEDPFYWVS (MOG_HUMAN)
VEDPFYWVM

SEQ ID NO: 122148 - protein, 10 aa, Artificial Sequence
  Description of Artificial Sequence: Synthetic peptide
  Seed: KITLFVIVPV (MOG_HUMAN)
KLTLFVIVPM

SEQ ID NO: 122149 - protein, 10 aa, Artificial Sequence
  Description of Artificial Sequence: Synthetic peptide
  Seed: LQYRLRGKLR (MOG_HUMAN)
LMYRLRGKLR

SEQ ID NO: 122150 - protein, 10 aa, Artificial Sequence
  Description of Artificial Sequence: Synthetic peptide
  Seed: FVIVPVLGPL (MOG_HUMAN)
FHIVPVLGPY

SEQ ID NO: 122151 - protein, 11 aa, Artificial Sequence
  Description of Artificial Sequence: Synthetic peptide
  Seed: VLVLLAVLPVL (MOG_HUMAN)
VNVLLAVLPVV

SEQ ID NO: 122152 - protein, 10 aa, Artificial Sequence
  Description of Artificial Sequence: Synthetic peptide
  Seed: RIRNVRFSDE (MOG_HUMAN)
RIRNVRFSDL

SEQ ID NO: 122153 - protein, 11 aa, Artificial Sequence
  Description of Artificial Sequence: Synthetic peptide
  Seed: RVPCWKITLFV (MOG_HUMAN)
RMPCWKITLFI

SEQ ID NO: 122154 - protein, 11 aa, Artificial Sequence
  Description of Artificial Sequence: Synthetic peptide
  Seed: HRTFDPHFLRV (MOG_HUMAN)
HVTFDPHFLRK

SEQ ID NO: 122155 - protein, 10 aa, Artificial Sequence
  Description of Artificial Sequence: Synthetic peptide
  Seed: FRVIGPRHPI (MOG_HUMAN)
FNVIGPRHPV

SEQ ID NO: 122156 - protein, 9 aa, Artificial Sequence
  Description of Artificial Sequence: Synthetic peptide
  Seed: HFLRVPCWK (MOG_HUMAN)
HVLRVPCWK

SEQ ID NO: 122157 - protein, 10 aa, Artificial Sequence
  Description of Artificial Sequence: Synthetic peptide
  Seed: LQITVGLIFL (MOG_HUMAN)
LKITVGLIFF

SEQ ID NO: 122158 - protein, 9 aa, Artificial Sequence
  Description of Artificial Sequence: Synthetic peptide
  Seed: RIRNVRFSD (MOG_HUMAN)
RFRNVRFSR

SEQ ID NO: 122159 - protein, 10 aa, Artificial Sequence
  Description of Artificial Sequence: Synthetic peptide
  Seed: LLLQVSSSYA (MOG_HUMAN)
LQLQVSSSYE

SEQ ID NO: 122160 - protein, 9 aa, Artificial Sequence
  Description of Artificial Sequence: Synthetic peptide
  Seed: VLLAVLPVL (MOG_HUMAN)
VALAVLPVY

SEQ ID NO: 122161 - protein, 10 aa, Artificial Sequence
  Description of Artificial Sequence: Synthetic peptide
  Seed: RALVGDEVEL (MOG_HUMAN)
RQLVGDEVEW

SEQ ID NO: 122162 - protein, 9 aa, Artificial Sequence
  Description of Artificial Sequence: Synthetic peptide
  Seed: MELKVEDPF (MOG_HUMAN)
MQLKVEDPM

SEQ ID NO: 122163 - protein, 10 aa, Artificial Sequence
  Description of Artificial Sequence: Synthetic peptide
  Seed: IGPRHPIRAL (MOG_HUMAN)
IAPRHPIRAI

SEQ ID NO: 122164 - protein, 10 aa, Artificial Sequence
  Description of Artificial Sequence: Synthetic peptide
  Seed: FSDEGGFTCF (MOG_HUMAN)
FMDEGGFTCF

SEQ ID NO: 122165 - protein, 9 aa, Artificial Sequence
  Description of Artificial Sequence: Synthetic peptide
  Seed: SSYAGQFRV (MOG_HUMAN)
SSYAGQFRK

SEQ ID NO: 122166 - protein, 11 aa, Artificial Sequence
  Description of Artificial Sequence: Synthetic peptide
  Seed: RISPGKNATGM (MOG_HUMAN)
RISPGKNATGW

SEQ ID NO: 122167 - protein, 9 aa, Artificial Sequence
  Description of Artificial Sequence: Synthetic peptide
  Seed: LQITVGLIF (MOG_HUMAN)
LVITVGLIF

SEQ ID NO: 122168 - protein, 11 aa, Artificial Sequence
  Description of Artificial Sequence: Synthetic peptide
  Seed: HSYQEEAAMEL (MOG_HUMAN)
HAYQEEAAMEY

SEQ ID NO: 122169 - protein, 9 aa, Artificial Sequence
  Description of Artificial Sequence: Synthetic peptide
  Seed: RVIGPRHPI (MOG_HUMAN)
RTIGPRHPT

SEQ ID NO: 122170 - protein, 9 aa, Artificial Sequence
  Description of Artificial Sequence: Synthetic peptide
  Seed: LLLQVSSSY (MOG_HUMAN)
LQLQVSSSH

SEQ ID NO: 122171 - protein, 9 aa, Artificial Sequence
  Description of Artificial Sequence: Synthetic peptide
  Seed: CLCSFLLLL (MOG_HUMAN)
CICSFLLLR

SEQ ID NO: 122172 - protein, 9 aa, Artificial Sequence
  Description of Artificial Sequence: Synthetic peptide
  Seed: MASLSRPSL (MOG_HUMAN)
MWSLSRPSL

SEQ ID NO: 122173 - protein, 10 aa, Artificial Sequence
  Description of Artificial Sequence: Synthetic peptide
  Seed: RIRNVRFSDE (MOG_HUMAN)
RTRNVRFSDK

SEQ ID NO: 122174 - protein, 11 aa, Artificial Sequence
  Description of Artificial Sequence: Synthetic peptide
  Seed: LLLQITVGLIF (MOG_HUMAN)
LRLQITVGLIF

SEQ ID NO: 122175 - protein, 10 aa, Artificial Sequence
  Description of Artificial Sequence: Synthetic peptide
  Seed: VPVLGPLVAL (MOG_HUMAN)
VNVLGPLVAV

SEQ ID NO: 122176 - protein, 9 aa, Artificial Sequence
  Description of Artificial Sequence: Synthetic peptide
  Seed: TLFVIVPVL (MOG_HUMAN)
TLFVIVPVF

SEQ ID NO: 122177 - protein, 11 aa, Artificial Sequence
  Description of Artificial Sequence: Synthetic peptide
  Seed: RVIGPRHPIRA (MOG_HUMAN)
RFIGPRHPIRR

SEQ ID NO: 122178 - protein, 11 aa, Artificial Sequence
  Description of Artificial Sequence: Synthetic peptide
  Seed: LHRTFDPHFLR (MOG_HUMAN)
LTRTFDPHFLK

SEQ ID NO: 122179 - protein, 10 aa, Artificial Sequence
  Description of Artificial Sequence: Synthetic peptide
  Seed: YWVSPGVLVL (MOG_HUMAN)
YAVSPGVLVL

SEQ ID NO: 122180 - protein, 9 aa, Artificial Sequence
  Description of Artificial Sequence: Synthetic peptide
  Seed: LLLQVSSSY (MOG_HUMAN)
LMLQVSSSI

SEQ ID NO: 122181 - protein, 10 aa, Artificial Sequence
  Description of Artificial Sequence: Synthetic peptide
  Seed: FTCFFRDHSY (MOG_HUMAN)
FTCFFRDHSR

SEQ ID NO: 122182 - protein, 9 aa, Artificial Sequence
  Description of Artificial Sequence: Synthetic peptide
  Seed: SRPSLPSCL (MOG_HUMAN)
SLPSLPSCM

SEQ ID NO: 122183 - protein, 9 aa, Artificial Sequence
  Description of Artificial Sequence: Synthetic peptide
  Seed: TFDPHFLRV (MOG_HUMAN)
TWDPHFLRC

SEQ ID NO: 122184 - protein, 10 aa, Artificial Sequence
  Description of Artificial Sequence: Synthetic peptide
  Seed: FVIVPVLGPL (MOG_HUMAN)
FIIVPVLGPV

SEQ ID NO: 122185 - protein, 9 aa, Artificial Sequence
  Description of Artificial Sequence: Synthetic peptide
  Seed: RIRNVRFSD (MOG_HUMAN)
RTRNVRFSR

SEQ ID NO: 122186 - protein, 9 aa, Artificial Sequence
  Description of Artificial Sequence: Synthetic peptide
  Seed: VPVLGPLVA (MOG_HUMAN)
VPVLGPLVW

SEQ ID NO: 122187 - protein, 10 aa, Artificial Sequence
  Description of Artificial Sequence: Synthetic peptide
  Seed: DAIGEGKVTL (MOG_HUMAN)
DTIGEGKVTR

SEQ ID NO: 122188 - protein, 10 aa, Artificial Sequence
  Description of Artificial Sequence: Synthetic peptide
  Seed: RIRNVRFSDE (MOG_HUMAN)
RTRNVRFSDS

SEQ ID NO: 122189 - protein, 9 aa, Artificial Sequence
  Description of Artificial Sequence: Synthetic peptide
  Seed: RTFDPHFLR (MOG_HUMAN)
RTFDPHFLV

SEQ ID NO: 122190 - protein, 9 aa, Artificial Sequence
  Description of Artificial Sequence: Synthetic peptide
  Seed: LIICYNWLH (MOG_HUMAN)
LLICYNWLR

SEQ ID NO: 122191 - protein, 9 aa, Artificial Sequence
  Description of Artificial Sequence: Synthetic peptide
  Seed: RIRNVRFSD (MOG_HUMAN)
RMRNVRFSF

SEQ ID NO: 122192 - protein, 10 aa, Artificial Sequence
  Description of Artificial Sequence: Synthetic peptide
  Seed: VGWYRPPFSR (MOG_HUMAN)
VLWYRPPFSK

SEQ ID NO: 122193 - protein, 9 aa, Artificial Sequence
  Description of Artificial Sequence: Synthetic peptide
  Seed: VSPGVLVLL (MOG_HUMAN)
VMPGVLVLF

SEQ ID NO: 122194 - protein, 10 aa, Artificial Sequence
  Description of Artificial Sequence: Synthetic peptide
  Seed: IGPRHPIRAL (MOG_HUMAN)
INPRHPIRAV

SEQ ID NO: 122195 - protein, 9 aa, Artificial Sequence
  Description of Artificial Sequence: Synthetic peptide
  Seed: VLLAVLPVL (MOG_HUMAN)
VALAVLPVL

SEQ ID NO: 122196 - protein, 10 aa, Artificial Sequence
  Description of Artificial Sequence: Synthetic peptide
  Seed: RTFDPHFLRV (MOG_HUMAN)
RSFDPHFLRK

SEQ ID NO: 122197 - protein, 11 aa, Artificial Sequence
  Description of Artificial Sequence: Synthetic peptide
  Seed: LHRTFDPHFLR (MOG_HUMAN)
LERTFDPHFLR

SEQ ID NO: 122198 - protein, 10 aa, Artificial Sequence
  Description of Artificial Sequence: Synthetic peptide
  Seed: RIRNVRFSDE (MOG_HUMAN)
RIRNVRFSDV

SEQ ID NO: 122199 - protein, 9 aa, Artificial Sequence
  Description of Artificial Sequence: Synthetic peptide
  Seed: RVPCWKITL (MOG_HUMAN)
RWPCWKITY

SEQ ID NO: 122200 - protein, 9 aa, Artificial Sequence
  Description of Artificial Sequence: Synthetic peptide
  Seed: VLGPLVALI (MOG_HUMAN)
VMGPLVALR

SEQ ID NO: 122201 - protein, 9 aa, Artificial Sequence
  Description of Artificial Sequence: Synthetic peptide
  Seed: LQVSSSYAG (MOG_HUMAN)
LVVSSSYAY

SEQ ID NO: 122202 - protein, 9 aa, Artificial Sequence
  Description of Artificial Sequence: Synthetic peptide
  Seed: WYRPPFSRV (MOG_HUMAN)
WWRPPFSRM

SEQ ID NO: 122203 - protein, 10 aa, Artificial Sequence
  Description of Artificial Sequence: Synthetic peptide
  Seed: RVPCWKITLF (MOG_HUMAN)
RQPCWKITLF

SEQ ID NO: 122204 - protein, 10 aa, Artificial Sequence
  Description of Artificial Sequence: Synthetic peptide
  Seed: FSDEGGFTCF (MOG_HUMAN)
FFDEGGFTCI

SEQ ID NO: 122205 - protein, 10 aa, Artificial Sequence
  Description of Artificial Sequence: Synthetic peptide
  Seed: FDPHFLRVPC (MOG_HUMAN)
FIPHFLRVPA

SEQ ID NO: 122206 - protein, 10 aa, Artificial Sequence
  Description of Artificial Sequence: Synthetic peptide
  Seed: SLSRPSLPSC (MOG_HUMAN)
SYSRPSLPSS

SEQ ID NO: 122207 - protein, 9 aa, Artificial Sequence
  Description of Artificial Sequence: Synthetic peptide
  Seed: KVEDPFYWV (MOG_HUMAN)
KLEDPFYWL

SEQ ID NO: 122208 - protein, 11 aa, Artificial Sequence
  Description of Artificial Sequence: Synthetic peptide
  Seed: LHRTFDPHFLR (MOG_HUMAN)
LKRTFDPHFLR

SEQ ID NO: 122209 - protein, 9 aa, Artificial Sequence
  Description of Artificial Sequence: Synthetic peptide
  Seed: FSDEGGFTC (MOG_HUMAN)
FSDEGGFTY

SEQ ID NO: 122210 - protein, 10 aa, Artificial Sequence
  Description of Artificial Sequence: Synthetic peptide
  Seed: MEVGWYRPPF (MOG_HUMAN)
MQVGWYRPPY

SEQ ID NO: 122211 - protein, 9 aa, Artificial Sequence
  Description of Artificial Sequence: Synthetic peptide
  Seed: GWYRPPFSR (MOG_HUMAN)
GQYRPPFSK

SEQ ID NO: 122212 - protein, 9 aa, Artificial Sequence
  Description of Artificial Sequence: Synthetic peptide
  Seed: TCFFRDHSY (MOG_HUMAN)
TSFFRDHSV

SEQ ID NO: 122213 - protein, 9 aa, Artificial Sequence
  Description of Artificial Sequence: Synthetic peptide
  Seed: LPSCLCSFL (MOG_HUMAN)
LPSCLCSFA

SEQ ID NO: 122214 - protein, 10 aa, Artificial Sequence
  Description of Artificial Sequence: Synthetic peptide
  Seed: RTFDPHFLRV (MOG_HUMAN)
RAFDPHFLRC

SEQ ID NO: 122215 - protein, 9 aa, Artificial Sequence
  Description of Artificial Sequence: Synthetic peptide
  Seed: YQEEAAMEL (MOG_HUMAN)
YSEEAAMEV

SEQ ID NO: 122216 - protein, 9 aa, Artificial Sequence
  Description of Artificial Sequence: Synthetic peptide
  Seed: MASLSRPSL (MOG_HUMAN)
MSSLSRPSY

SEQ ID NO: 122217 - protein, 10 aa, Artificial Sequence
  Description of Artificial Sequence: Synthetic peptide
  Seed: RTFDPHFLRV (MOG_HUMAN)
RLFDPHFLRR

SEQ ID NO: 122218 - protein, 10 aa, Artificial Sequence
  Description of Artificial Sequence: Synthetic peptide
  Seed: RLAGQFLEEL (MOG_HUMAN)
RQAGQFLEEF

SEQ ID NO: 122219 - protein, 9 aa, Artificial Sequence
  Description of Artificial Sequence: Synthetic peptide
  Seed: AIGEGKVTL (MOG_HUMAN)
AFGEGKVTM

SEQ ID NO: 122220 - protein, 9 aa, Artificial Sequence
  Description of Artificial Sequence: Synthetic peptide
  Seed: LSRPSLPSC (MOG_HUMAN)
LIRPSLPSK

SEQ ID NO: 122221 - protein, 10 aa, Artificial Sequence
  Description of Artificial Sequence: Synthetic peptide
  Seed: FVIVPVLGPL (MOG_HUMAN)
FTIVPVLGPR

SEQ ID NO: 122222 - protein, 10 aa, Artificial Sequence
  Description of Artificial Sequence: Synthetic peptide
  Seed: LIFLCLQYRL (MOG_HUMAN)
LMFLCLQYRV

SEQ ID NO: 122223 - protein, 9 aa, Artificial Sequence
  Description of Artificial Sequence: Synthetic peptide
  Seed: RIRNVRFSD (MOG_HUMAN)
RIRNVRFSL

SEQ ID NO: 122224 - protein, 9 aa, Artificial Sequence
  Description of Artificial Sequence: Synthetic peptide
  Seed: EEAAMELKV (MOG_HUMAN)
EEAAMELKA

SEQ ID NO: 122225 - protein, 10 aa, Artificial Sequence
  Description of Artificial Sequence: Synthetic peptide
  Seed: RIRNVRFSDE (MOG_HUMAN)
RARNVRFSDV

SEQ ID NO: 122226 - protein, 9 aa, Artificial Sequence
  Description of Artificial Sequence: Synthetic peptide
  Seed: SSYAGQFRV (MOG_HUMAN)
SQYAGQFRV

SEQ ID NO: 122227 - protein, 9 aa, Artificial Sequence
  Description of Artificial Sequence: Synthetic peptide
  Seed: LKDAIGEGK (MOG_HUMAN)
LLDAIGEGY

SEQ ID NO: 122228 - protein, 10 aa, Artificial Sequence
  Description of Artificial Sequence: Synthetic peptide
  Seed: FVIVPVLGPL (MOG_HUMAN)
FGIVPVLGPV

SEQ ID NO: 122229 - protein, 10 aa, Artificial Sequence
  Description of Artificial Sequence: Synthetic peptide
  Seed: SLSRPSLPSC (MOG_HUMAN)
SASRPSLPSK

SEQ ID NO: 122230 - protein, 11 aa, Artificial Sequence
  Description of Artificial Sequence: Synthetic peptide
  Seed: RFSDEGGFTCF (MOG_HUMAN)
RYSDEGGFTCY

SEQ ID NO: 122231 - protein, 10 aa, Artificial Sequence
  Description of Artificial Sequence: Synthetic peptide
  Seed: FDPHFLRVPC (MOG_HUMAN)
FNPHFLRVPS

SEQ ID NO: 122232 - protein, 9 aa, Artificial Sequence
  Description of Artificial Sequence: Synthetic peptide
  Seed: RPPFSRVVH (MOG_HUMAN)
RPPFSRVVF

SEQ ID NO: 122233 - protein, 10 aa, Artificial Sequence
  Description of Artificial Sequence: Synthetic peptide
  Seed: AIGEGKVTLR (MOG_HUMAN)
ATGEGKVTLR

SEQ ID NO: 122234 - protein, 10 aa, Artificial Sequence
  Description of Artificial Sequence: Synthetic peptide
  Seed: IICYNWLHRR (MOG_HUMAN)
IGCYNWLHRR

SEQ ID NO: 122235 - protein, 10 aa, Artificial Sequence
  Description of Artificial Sequence: Synthetic peptide
  Seed: LLLQVSSSYA (MOG_HUMAN)
LQLQVSSSYP

SEQ ID NO: 122236 - protein, 9 aa, Artificial Sequence
  Description of Artificial Sequence: Synthetic peptide
  Seed: FSDEGGFTC (MOG_HUMAN)
FTDEGGFTY

SEQ ID NO: 122237 - protein, 9 aa, Artificial Sequence
  Description of Artificial Sequence: Synthetic peptide
  Seed: LLLQVSSSY (MOG_HUMAN)
LMLQVSSSW

SEQ ID NO: 122238 - protein, 10 aa, Artificial Sequence
  Description of Artificial Sequence: Synthetic peptide
  Seed: RALVGDEVEL (MOG_HUMAN)
RVLVGDEVEF

SEQ ID NO: 122239 - protein, 8 aa, Artificial Sequence
  Description of Artificial Sequence: Synthetic peptide
  Seed: TELLKDAI (MOG_HUMAN)
TELLKDAY

SEQ ID NO: 122240 - protein, 10 aa, Artificial Sequence
  Description of Artificial Sequence: Synthetic peptide
  Seed: SCLCSFLLLL (MOG_HUMAN)
SLLCSFLLLT

SEQ ID NO: 122241 - protein, 10 aa, Artificial Sequence
  Description of Artificial Sequence: Synthetic peptide
  Seed: VLLLQITVGL (MOG_HUMAN)
VGLLQITVGL

SEQ ID NO: 122242 - protein, 9 aa, Artificial Sequence
  Description of Artificial Sequence: Synthetic peptide
  Seed: VSPGVLVLL (MOG_HUMAN)
VLPGVLVLL

SEQ ID NO: 122243 - protein, 9 aa, Artificial Sequence
  Description of Artificial Sequence: Synthetic peptide
  Seed: LKVEDPFYW (MOG_HUMAN)
LSVEDPFYY

SEQ ID NO: 122244 - protein, 9 aa, Artificial Sequence
  Description of Artificial Sequence: Synthetic peptide
  Seed: VSPGVLVLL (MOG_HUMAN)
VPPGVLVLY

SEQ ID NO: 122245 - protein, 10 aa, Artificial Sequence
  Description of Artificial Sequence: Synthetic peptide
  Seed: FDPHFLRVPC (MOG_HUMAN)
FMPHFLRVPF

SEQ ID NO: 122246 - protein, 9 aa, Artificial Sequence
  Description of Artificial Sequence: Synthetic peptide
  Seed: HSYQEEAAM (MOG_HUMAN)
HVYQEEAAL

SEQ ID NO: 122247 - protein, 9 aa, Artificial Sequence
  Description of Artificial Sequence: Synthetic peptide
  Seed: LSRPSLPSC (MOG_HUMAN)
LTRPSLPSV

SEQ ID NO: 122248 - protein, 10 aa, Artificial Sequence
  Description of Artificial Sequence: Synthetic peptide
  Seed: PVLGPLVALI (MOG_HUMAN)
PLLGPLVALV

SEQ ID NO: 122249 - protein, 9 aa, Artificial Sequence
  Description of Artificial Sequence: Synthetic peptide
  Seed: RVIGPRHPI (MOG_HUMAN)
RSIGPRHPM

SEQ ID NO: 122250 - protein, 9 aa, Artificial Sequence
  Description of Artificial Sequence: Synthetic peptide
  Seed: RDHSYQEEA (MOG_HUMAN)
RDHSYQEEF

SEQ ID NO: 122251 - protein, 9 aa, Artificial Sequence
  Description of Artificial Sequence: Synthetic peptide
  Seed: LLAVLPVLL (MOG_HUMAN)
LSAVLPVLV

SEQ ID NO: 122252 - protein, 9 aa, Artificial Sequence
  Description of Artificial Sequence: Synthetic peptide
  Seed: RVIGPRHPI (MOG_HUMAN)
RLIGPRHPR

SEQ ID NO: 122253 - protein, 10 aa, Artificial Sequence
  Description of Artificial Sequence: Synthetic peptide
  Seed: RVVHLYRNGK (MOG_HUMAN)
RGVHLYRNGK

SEQ ID NO: 122254 - protein, 11 aa, Artificial Sequence
  Description of Artificial Sequence: Synthetic peptide
  Seed: VLVLLAVLPVL (MOG_HUMAN)
VHVLLAVLPVV

SEQ ID NO: 122255 - protein, 9 aa, Artificial Sequence
  Description of Artificial Sequence: Synthetic peptide
  Seed: KVTLRIRNV (MOG_HUMAN)
KMTLRIRNV

SEQ ID NO: 122256 - protein, 9 aa, Artificial Sequence
  Description of Artificial Sequence: Synthetic peptide
  Seed: HSYQEEAAM (MOG_HUMAN)
HMYQEEAAI

SEQ ID NO: 122257 - protein, 9 aa, Artificial Sequence
  Description of Artificial Sequence: Synthetic peptide
  Seed: HRTFDPHFL (MOG_HUMAN)
HRTFDPHFM

SEQ ID NO: 122258 - protein, 10 aa, Artificial Sequence
  Description of Artificial Sequence: Synthetic peptide
  Seed: ATGMEVGWYR (MOG_HUMAN)
AWGMEVGWYR

SEQ ID NO: 122259 - protein, 10 aa, Artificial Sequence
  Description of Artificial Sequence: Synthetic peptide
  Seed: TGMEVGWYRP (MOG_HUMAN)
TFMEVGWYRV

SEQ ID NO: 122260 - protein, 9 aa, Artificial Sequence
  Description of Artificial Sequence: Synthetic peptide
  Seed: FSDEGGFTC (MOG_HUMAN)
FGDEGGFTL

SEQ ID NO: 122261 - protein, 10 aa, Artificial Sequence
  Description of Artificial Sequence: Synthetic peptide
  Seed: SCLCSFLLLL (MOG_HUMAN)
SKLCSFLLLI

SEQ ID NO: 122262 - protein, 8 aa, Artificial Sequence
  Description of Artificial Sequence: Synthetic peptide
  Seed: FSDEGGFT (MOG_HUMAN)
FNDEGGFM

SEQ ID NO: 122263 - protein, 10 aa, Artificial Sequence
  Description of Artificial Sequence: Synthetic peptide
  Seed: IFLCLQYRLR (MOG_HUMAN)
IMLCLQYRLK

SEQ ID NO: 122264 - protein, 9 aa, Artificial Sequence
  Description of Artificial Sequence: Synthetic peptide
  Seed: YRPPFSRVV (MOG_HUMAN)
YHPPFSRVI

SEQ ID NO: 122265 - protein, 11 aa, Artificial Sequence
  Description of Artificial Sequence: Synthetic peptide
  Seed: LQVSSSYAGQF (MOG_HUMAN)
LTVSSSYAGQY

SEQ ID NO: 122266 - protein, 10 aa, Artificial Sequence
  Description of Artificial Sequence: Synthetic peptide
  Seed: FTCFFRDHSY (MOG_HUMAN)
FSCFFRDHSM

SEQ ID NO: 122267 - protein, 10 aa, Artificial Sequence
  Description of Artificial Sequence: Synthetic peptide
  Seed: LIFLCLQYRL (MOG_HUMAN)
LRFLCLQYRR

SEQ ID NO: 122268 - protein, 10 aa, Artificial Sequence
  Description of Artificial Sequence: Synthetic peptide
  Seed: AEIENLHRTF (MOG_HUMAN)
AQIENLHRTW

SEQ ID NO: 122269 - protein, 11 aa, Artificial Sequence
  Description of Artificial Sequence: Synthetic peptide
  Seed: DQDGDQAPEYR (MOG_HUMAN)
DTDGDQAPEYY

SEQ ID NO: 122270 - protein, 10 aa, Artificial Sequence
  Description of Artificial Sequence: Synthetic peptide
  Seed: LLQITVGLIF (MOG_HUMAN)
LCQITVGLIF

SEQ ID NO: 122271 - protein, 9 aa, Artificial Sequence
  Description of Artificial Sequence: Synthetic peptide
  Seed: MASLSRPSL (MOG_HUMAN)
MVSLSRPSF

SEQ ID NO: 122272 - protein, 9 aa, Artificial Sequence
  Description of Artificial Sequence: Synthetic peptide
  Seed: LSRPSLPSC (MOG_HUMAN)
LPRPSLPSG

SEQ ID NO: 122273 - protein, 9 aa, Artificial Sequence
  Description of Artificial Sequence: Synthetic peptide
  Seed: YRPPFSRVV (MOG_HUMAN)
YVPPFSRVM

SEQ ID NO: 122274 - protein, 10 aa, Artificial Sequence
  Description of Artificial Sequence: Synthetic peptide
  Seed: AGQFRVIGPR (MOG_HUMAN)
ASQFRVIGPR

SEQ ID NO: 122275 - protein, 9 aa, Artificial Sequence
  Description of Artificial Sequence: Synthetic peptide
  Seed: FSDEGGFTC (MOG_HUMAN)
FVDEGGFTT

SEQ ID NO: 122276 - protein, 10 aa, Artificial Sequence
  Description of Artificial Sequence: Synthetic peptide
  Seed: RTFDPHFLRV (MOG_HUMAN)
RLFDPHFLRI

SEQ ID NO: 122277 - protein, 10 aa, Artificial Sequence
  Description of Artificial Sequence: Synthetic peptide
  Seed: IGPRHPIRAL (MOG_HUMAN)
IMPRHPIRAI

SEQ ID NO: 122278 - protein, 10 aa, Artificial Sequence
  Description of Artificial Sequence: Synthetic peptide
  Seed: LLQITVGLIF (MOG_HUMAN)
LKQITVGLIF

SEQ ID NO: 122279 - protein, 10 aa, Artificial Sequence
  Description of Artificial Sequence: Synthetic peptide
  Seed: YQEEAAMELK (MOG_HUMAN)
YVEEAAMELY

SEQ ID NO: 122280 - protein, 9 aa, Artificial Sequence
  Description of Artificial Sequence: Synthetic peptide
  Seed: SPGKNATGM (MOG_HUMAN)
SPGKNATGL

SEQ ID NO: 122281 - protein, 9 aa, Artificial Sequence
  Description of Artificial Sequence: Synthetic peptide
  Seed: LCSFLLLLL (MOG_HUMAN)
LISFLLLLL

SEQ ID NO: 122282 - protein, 9 aa, Artificial Sequence
  Description of Artificial Sequence: Synthetic peptide
  Seed: TLFVIVPVL (MOG_HUMAN)
TLFVIVPVY

SEQ ID NO: 122283 - protein, 9 aa, Artificial Sequence
  Description of Artificial Sequence: Synthetic peptide
  Seed: MASLSRPSL (MOG_HUMAN)
MKSLSRPSL

SEQ ID NO: 122284 - protein, 10 aa, Artificial Sequence
  Description of Artificial Sequence: Synthetic peptide
  Seed: RIRNVRFSDE (MOG_HUMAN)
RTRNVRFSDM

SEQ ID NO: 122285 - protein, 9 aa, Artificial Sequence
  Description of Artificial Sequence: Synthetic peptide
  Seed: WVSPGVLVL (MOG_HUMAN)
WHSPGVLVA

SEQ ID NO: 122286 - protein, 8 aa, Artificial Sequence
  Description of Artificial Sequence: Synthetic peptide
  Seed: VLGPLVAL (MOG_HUMAN)
VTGPLVAL

SEQ ID NO: 122287 - protein, 9 aa, Artificial Sequence
  Description of Artificial Sequence: Synthetic peptide
  Seed: SSYAGQFRV (MOG_HUMAN)
SQYAGQFRM

SEQ ID NO: 122288 - protein, 9 aa, Artificial Sequence
  Description of Artificial Sequence: Synthetic peptide
  Seed: IVPVLGPLV (MOG_HUMAN)
ILPVLGPLL

SEQ ID NO: 122289 - protein, 10 aa, Artificial Sequence
  Description of Artificial Sequence: Synthetic peptide
  Seed: FTCFFRDHSY (MOG_HUMAN)
FSCFFRDHSK

SEQ ID NO: 122290 - protein, 10 aa, Artificial Sequence
  Description of Artificial Sequence: Synthetic peptide
  Seed: LIICYNWLHR (MOG_HUMAN)
LMICYNWLHK

SEQ ID NO: 122291 - protein, 11 aa, Artificial Sequence
  Description of Artificial Sequence: Synthetic peptide
  Seed: HSYQEEAAMEL (MOG_HUMAN)
HSYQEEAAMEW

SEQ ID NO: 122292 - protein, 9 aa, Artificial Sequence
  Description of Artificial Sequence: Synthetic peptide
  Seed: ITLFVIVPV (MOG_HUMAN)
IILFVIVPA

SEQ ID NO: 122293 - protein, 9 aa, Artificial Sequence
  Description of Artificial Sequence: Synthetic peptide
  Seed: LSRPSLPSC (MOG_HUMAN)
LTRPSLPSA

SEQ ID NO: 122294 - protein, 9 aa, Artificial Sequence
  Description of Artificial Sequence: Synthetic peptide
  Seed: VPVLGPLVA (MOG_HUMAN)
VTVLGPLVL

SEQ ID NO: 122295 - protein, 10 aa, Artificial Sequence
  Description of Artificial Sequence: Synthetic peptide
  Seed: LVLLAVLPVL (MOG_HUMAN)
LPLLAVLPVV

SEQ ID NO: 122296 - protein, 10 aa, Artificial Sequence
  Description of Artificial Sequence: Synthetic peptide
  Seed: LIICYNWLHR (MOG_HUMAN)
LLICYNWLHR

SEQ ID NO: 122297 - protein, 8 aa, Artificial Sequence
  Description of Artificial Sequence: Synthetic peptide
  Seed: YAGQFRVI (MOG_HUMAN)
YSGQFRVF

SEQ ID NO: 122298 - protein, 9 aa, Artificial Sequence
  Description of Artificial Sequence: Synthetic peptide
  Seed: VGDEVELPC (MOG_HUMAN)
VADEVELPC

SEQ ID NO: 122299 - protein, 9 aa, Artificial Sequence
  Description of Artificial Sequence: Synthetic peptide
  Seed: IVPVLGPLV (MOG_HUMAN)
ITPVLGPLL

SEQ ID NO: 122300 - protein, 9 aa, Artificial Sequence
  Description of Artificial Sequence: Synthetic peptide
  Seed: MASLSRPSL (MOG_HUMAN)
MQSLSRPSH

SEQ ID NO: 122301 - protein, 8 aa, Artificial Sequence
  Description of Artificial Sequence: Synthetic peptide
  Seed: FSDEGGFT (MOG_HUMAN)
FMDEGGFF

SEQ ID NO: 122302 - protein, 9 aa, Artificial Sequence
  Description of Artificial Sequence: Synthetic peptide
  Seed: LAVLPVLLL (MOG_HUMAN)
LPVLPVLLM

SEQ ID NO: 122303 - protein, 9 aa, Artificial Sequence
  Description of Artificial Sequence: Synthetic peptide
  Seed: RVIGPRHPI (MOG_HUMAN)
RAIGPRHPR

SEQ ID NO: 122304 - protein, 11 aa, Artificial Sequence
  Description of Artificial Sequence: Synthetic peptide
  Seed: RLAGQFLEELR (MOG_HUMAN)
RLAGQFLEELK

SEQ ID NO: 122305 - protein, 11 aa, Artificial Sequence
  Description of Artificial Sequence: Synthetic peptide
  Seed: LHRTFDPHFLR (MOG_HUMAN)
LSRTFDPHFLR

SEQ ID NO: 122306 - protein, 9 aa, Artificial Sequence
  Description of Artificial Sequence: Synthetic peptide
  Seed: RIRNVRFSD (MOG_HUMAN)
RWRNVRFSF

SEQ ID NO: 122307 - protein, 9 aa, Artificial Sequence
  Description of Artificial Sequence: Synthetic peptide
  Seed: FLEELRNPF (MOG_HUMAN)
FLEELRNPI

SEQ ID NO: 122308 - protein, 10 aa, Artificial Sequence
  Description of Artificial Sequence: Synthetic peptide
  Seed: TGMEVGWYRP (MOG_HUMAN)
TVMEVGWYRQ

SEQ ID NO: 122309 - protein, 9 aa, Artificial Sequence
  Description of Artificial Sequence: Synthetic peptide
  Seed: VGDEVELPC (MOG_HUMAN)
VADEVELPA

SEQ ID NO: 122310 - protein, 9 aa, Artificial Sequence
  Description of Artificial Sequence: Synthetic peptide
  Seed: RIRNVRFSD (MOG_HUMAN)
RIRNVRFSV

SEQ ID NO: 122311 - protein, 9 aa, Artificial Sequence
  Description of Artificial Sequence: Synthetic peptide
  Seed: YRPPFSRVV (MOG_HUMAN)
YWPPFSRVM

SEQ ID NO: 122312 - protein, 9 aa, Artificial Sequence
  Description of Artificial Sequence: Synthetic peptide
  Seed: WVSPGVLVL (MOG_HUMAN)
WTSPGVLVM

SEQ ID NO: 122313 - protein, 10 aa, Artificial Sequence
  Description of Artificial Sequence: Synthetic peptide
  Seed: LVLLAVLPVL (MOG_HUMAN)
LDLLAVLPVI

SEQ ID NO: 122314 - protein, 9 aa, Artificial Sequence
  Description of Artificial Sequence: Synthetic peptide
  Seed: LSRPSLPSC (MOG_HUMAN)
LSRPSLPSA

SEQ ID NO: 122315 - protein, 8 aa, Artificial Sequence
  Description of Artificial Sequence: Synthetic peptide
  Seed: YNWLHRRL (MOG_HUMAN)
YAWLHRRF

SEQ ID NO: 122316 - protein, 10 aa, Artificial Sequence
  Description of Artificial Sequence: Synthetic peptide
  Seed: FTCFFRDHSY (MOG_HUMAN)
FKCFFRDHSY

SEQ ID NO: 122317 - protein, 9 aa, Artificial Sequence
  Description of Artificial Sequence: Synthetic peptide
  Seed: FLLLLLLQV (MOG_HUMAN)
FMLLLLLQT

SEQ ID NO: 122318 - protein, 9 aa, Artificial Sequence
  Description of Artificial Sequence: Synthetic peptide
  Seed: RVIGPRHPI (MOG_HUMAN)
RPIGPRHPV

SEQ ID NO: 122319 - protein, 11 aa, Artificial Sequence
  Description of Artificial Sequence: Synthetic peptide
  Seed: KDQDGDQAPEY (MOG_HUMAN)
KMQDGDQAPEF

SEQ ID NO: 122320 - protein, 10 aa, Artificial Sequence
  Description of Artificial Sequence: Synthetic peptide
  Seed: SLSRPSLPSC (MOG_HUMAN)
SCSRPSLPSK

SEQ ID NO: 122321 - protein, 9 aa, Artificial Sequence
  Description of Artificial Sequence: Synthetic peptide
  Seed: YQEEAAMEL (MOG_HUMAN)
YGEEAAMEL

SEQ ID NO: 122322 - protein, 10 aa, Artificial Sequence
  Description of Artificial Sequence: Synthetic peptide
  Seed: RTFDPHFLRV (MOG_HUMAN)
RAFDPHFLRT

SEQ ID NO: 122323 - protein, 10 aa, Artificial Sequence
  Description of Artificial Sequence: Synthetic peptide
  Seed: GLIFLCLQYR (MOG_HUMAN)
GRIFLCLQYR

SEQ ID NO: 122324 - protein, 8 aa, Artificial Sequence
  Description of Artificial Sequence: Synthetic peptide
  Seed: RTFDPHFL (MOG_HUMAN)
RRFDPHFF

SEQ ID NO: 122325 - protein, 9 aa, Artificial Sequence
  Description of Artificial Sequence: Synthetic peptide
  Seed: RVIGPRHPI (MOG_HUMAN)
RSIGPRHPR

SEQ ID NO: 122326 - protein, 9 aa, Artificial Sequence
  Description of Artificial Sequence: Synthetic peptide
  Seed: WVSPGVLVL (MOG_HUMAN)
WTSPGVLVF

SEQ ID NO: 122327 - protein, 9 aa, Artificial Sequence
  Description of Artificial Sequence: Synthetic peptide
  Seed: RIRNVRFSD (MOG_HUMAN)
RTRNVRFSS

SEQ ID NO: 122328 - protein, 9 aa, Artificial Sequence
  Description of Artificial Sequence: Synthetic peptide
  Seed: WYRPPFSRV (MOG_HUMAN)
WFRPPFSRF

SEQ ID NO: 122329 - protein, 10 aa, Artificial Sequence
  Description of Artificial Sequence: Synthetic peptide
  Seed: RPPFSRVVHL (MOG_HUMAN)
RIPFSRVVHL

SEQ ID NO: 122330 - protein, 10 aa, Artificial Sequence
  Description of Artificial Sequence: Synthetic peptide
  Seed: LLQITVGLIF (MOG_HUMAN)
LAQITVGLIF

SEQ ID NO: 122331 - protein, 10 aa, Artificial Sequence
  Description of Artificial Sequence: Synthetic peptide
  Seed: IGPRHPIRAL (MOG_HUMAN)
ITPRHPIRAF

SEQ ID NO: 122332 - protein, 10 aa, Artificial Sequence
  Description of Artificial Sequence: Synthetic peptide
  Seed: LIICYNWLHR (MOG_HUMAN)
LYICYNWLHR

SEQ ID NO: 122333 - protein, 10 aa, Artificial Sequence
  Description of Artificial Sequence: Synthetic peptide
  Seed: LVLLAVLPVL (MOG_HUMAN)
LTLLAVLPVL

SEQ ID NO: 122334 - protein, 9 aa, Artificial Sequence
  Description of Artificial Sequence: Synthetic peptide
  Seed: TGMEVGWYR (MOG_HUMAN)
TLMEVGWYV

SEQ ID NO: 122335 - protein, 10 aa, Artificial Sequence
  Description of Artificial Sequence: Synthetic peptide
  Seed: MEVGWYRPPF (MOG_HUMAN)
MTVGWYRPPY

SEQ ID NO: 122336 - protein, 11 aa, Artificial Sequence
  Description of Artificial Sequence: Synthetic peptide
  Seed: RDHSYQEEAAM (MOG_HUMAN)
RGHSYQEEAAF

SEQ ID NO: 122337 - protein, 9 aa, Artificial Sequence
  Description of Artificial Sequence: Synthetic peptide
  Seed: FSRVVHLYR (MOG_HUMAN)
FIRVVHLYR

SEQ ID NO: 122338 - protein, 10 aa, Artificial Sequence
  Description of Artificial Sequence: Synthetic peptide
  Seed: FDPHFLRVPC (MOG_HUMAN)
FLPHFLRVPT

SEQ ID NO: 122339 - protein, 10 aa, Artificial Sequence
  Description of Artificial Sequence: Synthetic peptide
  Seed: AVLPVLLLQI (MOG_HUMAN)
AMLPVLLLQI

SEQ ID NO: 122340 - protein, 9 aa, Artificial Sequence
  Description of Artificial Sequence: Synthetic peptide
  Seed: VSSSYAGQF (MOG_HUMAN)
VMSSYAGQF

SEQ ID NO: 122341 - protein, 9 aa, Artificial Sequence
  Description of Artificial Sequence: Synthetic peptide
  Seed: ITLFVIVPV (MOG_HUMAN)
IMLFVIVPV

SEQ ID NO: 122342 - protein, 10 aa, Artificial Sequence
  Description of Artificial Sequence: Synthetic peptide
  Seed: FDPHFLRVPC (MOG_HUMAN)
FQPHFLRVPT

SEQ ID NO: 122343 - protein, 10 aa, Artificial Sequence
  Description of Artificial Sequence: Synthetic peptide
  Seed: FRVIGPRHPI (MOG_HUMAN)
FGVIGPRHPI

SEQ ID NO: 122344 - protein, 10 aa, Artificial Sequence
  Description of Artificial Sequence: Synthetic peptide
  Seed: RPPFSRVVHL (MOG_HUMAN)
RFPFSRVVHM

SEQ ID NO: 122345 - protein, 11 aa, Artificial Sequence
  Description of Artificial Sequence: Synthetic peptide
  Seed: RVIGPRHPIRA (MOG_HUMAN)
RSIGPRHPIRR

SEQ ID NO: 122346 - protein, 11 aa, Artificial Sequence
  Description of Artificial Sequence: Synthetic peptide
  Seed: KDAIGEGKVTL (MOG_HUMAN)
KEAIGEGKVTM

SEQ ID NO: 122347 - protein, 8 aa, Artificial Sequence
  Description of Artificial Sequence: Synthetic peptide
  Seed: RTFDPHFL (MOG_HUMAN)
RSFDPHFY

SEQ ID NO: 122348 - protein, 9 aa, Artificial Sequence
  Description of Artificial Sequence: Synthetic peptide
  Seed: HSYQEEAAM (MOG_HUMAN)
HPYQEEAAA

SEQ ID NO: 122349 - protein, 9 aa, Artificial Sequence
  Description of Artificial Sequence: Synthetic peptide
  Seed: LQVSSSYAG (MOG_HUMAN)
LIVSSSYAM

SEQ ID NO: 122350 - protein, 9 aa, Artificial Sequence
  Description of Artificial Sequence: Synthetic peptide
  Seed: YQEEAAMEL (MOG_HUMAN)
YREEAAMEL

SEQ ID NO: 122351 - protein, 9 aa, Artificial Sequence
  Description of Artificial Sequence: Synthetic peptide
  Seed: AIGEGKVTL (MOG_HUMAN)
AMGEGKVTV

SEQ ID NO: 122352 - protein, 10 aa, Artificial Sequence
  Description of Artificial Sequence: Synthetic peptide
  Seed: FDPHFLRVPC (MOG_HUMAN)
FCPHFLRVPF

SEQ ID NO: 122353 - protein, 9 aa, Artificial Sequence
  Description of Artificial Sequence: Synthetic peptide
  Seed: TGMEVGWYR (MOG_HUMAN)
TQMEVGWYR

SEQ ID NO: 122354 - protein, 10 aa, Artificial Sequence
  Description of Artificial Sequence: Synthetic peptide
  Seed: RDHSYQEEAA (MOG_HUMAN)
REHSYQEEAT

SEQ ID NO: 122355 - protein, 9 aa, Artificial Sequence
  Description of Artificial Sequence: Synthetic peptide
  Seed: AEIENLHRT (MOG_HUMAN)
AEIENLHRF

SEQ ID NO: 122356 - protein, 10 aa, Artificial Sequence
  Description of Artificial Sequence: Synthetic peptide
  Seed: FYWVSPGVLV (MOG_HUMAN)
FSWVSPGVLF

SEQ ID NO: 122357 - protein, 9 aa, Artificial Sequence
  Description of Artificial Sequence: Synthetic peptide
  Seed: ALVGDEVEL (MOG_HUMAN)
ALVGDEVEF

SEQ ID NO: 122358 - protein, 9 aa, Artificial Sequence
  Description of Artificial Sequence: Synthetic peptide
  Seed: RVPCWKITL (MOG_HUMAN)
RIPCWKITK

SEQ ID NO: 122359 - protein, 9 aa, Artificial Sequence
  Description of Artificial Sequence: Synthetic peptide
  Seed: SCLCSFLLL (MOG_HUMAN)
STLCSFLLW

SEQ ID NO: 122360 - protein, 9 aa, Artificial Sequence
  Description of Artificial Sequence: Synthetic peptide
  Seed: RTFDPHFLR (MOG_HUMAN)
REFDPHFLY

SEQ ID NO: 122361 - protein, 9 aa, Artificial Sequence
  Description of Artificial Sequence: Synthetic peptide
  Seed: MASLSRPSL (MOG_HUMAN)
MPSLSRPSC

SEQ ID NO: 122362 - protein, 10 aa, Artificial Sequence
  Description of Artificial Sequence: Synthetic peptide
  Seed: RTFDPHFLRV (MOG_HUMAN)
RQFDPHFLRF

SEQ ID NO: 122363 - protein, 10 aa, Artificial Sequence
  Description of Artificial Sequence: Synthetic peptide
  Seed: FSRVVHLYRN (MOG_HUMAN)
FFRVVHLYRK

SEQ ID NO: 122364 - protein, 10 aa, Artificial Sequence
  Description of Artificial Sequence: Synthetic peptide
  Seed: SCLCSFLLLL (MOG_HUMAN)
SLLCSFLLLL

SEQ ID NO: 122365 - protein, 10 aa, Artificial Sequence
  Description of Artificial Sequence: Synthetic peptide
  Seed: LSRPSLPSCL (MOG_HUMAN)
LVRPSLPSCW

SEQ ID NO: 122366 - protein, 10 aa, Artificial Sequence
  Description of Artificial Sequence: Synthetic peptide
  Seed: FLLLLLLQVS (MOG_HUMAN)
FPLLLLLQVV

SEQ ID NO: 122367 - protein, 10 aa, Artificial Sequence
  Description of Artificial Sequence: Synthetic peptide
  Seed: SFLLLLLLQV (MOG_HUMAN)
STLLLLLLQV

SEQ ID NO: 122368 - protein, 10 aa, Artificial Sequence
  Description of Artificial Sequence: Synthetic peptide
  Seed: FDPHFLRVPC (MOG_HUMAN)
FQPHFLRVPL

SEQ ID NO: 122369 - protein, 10 aa, Artificial Sequence
  Description of Artificial Sequence: Synthetic peptide
  Seed: AIGEGKVTLR (MOG_HUMAN)
AAGEGKVTLF

SEQ ID NO: 122370 - protein, 9 aa, Artificial Sequence
  Description of Artificial Sequence: Synthetic peptide
  Seed: RVIGPRHPI (MOG_HUMAN)
RNIGPRHPK

SEQ ID NO: 122371 - protein, 10 aa, Artificial Sequence
  Description of Artificial Sequence: Synthetic peptide
  Seed: HRTFDPHFLR (MOG_HUMAN)
HKTFDPHFLY

SEQ ID NO: 122372 - protein, 9 aa, Artificial Sequence
  Description of Artificial Sequence: Synthetic peptide
  Seed: FSDEGGFTC (MOG_HUMAN)
FCDEGGFTL

SEQ ID NO: 122373 - protein, 9 aa, Artificial Sequence
  Description of Artificial Sequence: Synthetic peptide
  Seed: KVTLRIRNV (MOG_HUMAN)
KTTLRIRNV

SEQ ID NO: 122374 - protein, 10 aa, Artificial Sequence
  Description of Artificial Sequence: Synthetic peptide
  Seed: LSRPSLPSCL (MOG_HUMAN)
LARPSLPSCW

SEQ ID NO: 122375 - protein, 9 aa, Artificial Sequence
  Description of Artificial Sequence: Synthetic peptide
  Seed: LSRPSLPSC (MOG_HUMAN)
LYRPSLPSV

SEQ ID NO: 122376 - protein, 11 aa, Artificial Sequence
  Description of Artificial Sequence: Synthetic peptide
  Seed: VPVLGPLVALI (MOG_HUMAN)
VMVLGPLVALV

SEQ ID NO: 122377 - protein, 10 aa, Artificial Sequence
  Description of Artificial Sequence: Synthetic peptide
  Seed: RTFDPHFLRV (MOG_HUMAN)
RMFDPHFLRA

SEQ ID NO: 122378 - protein, 9 aa, Artificial Sequence
  Description of Artificial Sequence: Synthetic peptide
  Seed: RVPCWKITL (MOG_HUMAN)
RQPCWKITF

SEQ ID NO: 122379 - protein, 11 aa, Artificial Sequence
  Description of Artificial Sequence: Synthetic peptide
  Seed: RTFDPHFLRVP (MOG_HUMAN)
RMFDPHFLRVI

SEQ ID NO: 122380 - protein, 10 aa, Artificial Sequence
  Description of Artificial Sequence: Synthetic peptide
  Seed: IGPRHPIRAL (MOG_HUMAN)
ISPRHPIRAF

SEQ ID NO: 122381 - protein, 10 aa, Artificial Sequence
  Description of Artificial Sequence: Synthetic peptide
  Seed: WYRPPFSRVV (MOG_HUMAN)
WFRPPFSRVF

SEQ ID NO: 122382 - protein, 10 aa, Artificial Sequence
  Description of Artificial Sequence: Synthetic peptide
  Seed: MEVGWYRPPF (MOG_HUMAN)
MHVGWYRPPF

SEQ ID NO: 122383 - protein, 10 aa, Artificial Sequence
  Description of Artificial Sequence: Synthetic peptide
  Seed: ATGMEVGWYR (MOG_HUMAN)
AMGMEVGWYK

SEQ ID NO: 122384 - protein, 9 aa, Artificial Sequence
  Description of Artificial Sequence: Synthetic peptide
  Seed: AIGEGKVTL (MOG_HUMAN)
AYGEGKVTF

SEQ ID NO: 122385 - protein, 9 aa, Artificial Sequence
  Description of Artificial Sequence: Synthetic peptide
  Seed: TFDPHFLRV (MOG_HUMAN)
TIDPHFLRF

SEQ ID NO: 122386 - protein, 9 aa, Artificial Sequence
  Description of Artificial Sequence: Synthetic peptide
  Seed: LVLLAVLPV (MOG_HUMAN)
LALLAVLPV

SEQ ID NO: 122387 - protein, 9 aa, Artificial Sequence
  Description of Artificial Sequence: Synthetic peptide
  Seed: LSRPSLPSC (MOG_HUMAN)
LVRPSLPSM

SEQ ID NO: 122388 - protein, 9 aa, Artificial Sequence
  Description of Artificial Sequence: Synthetic peptide
  Seed: VLGPLVALI (MOG_HUMAN)
VIGPLVALL

SEQ ID NO: 122389 - protein, 9 aa, Artificial Sequence
  Description of Artificial Sequence: Synthetic peptide
  Seed: VLGPLVALI (MOG_HUMAN)
VLGPLVALM

SEQ ID NO: 122390 - protein, 9 aa, Artificial Sequence
  Description of Artificial Sequence: Synthetic peptide
  Seed: KLRAEIENL (MOG_HUMAN)
KIRAEIENY

SEQ ID NO: 122391 - protein, 10 aa, Artificial Sequence
  Description of Artificial Sequence: Synthetic peptide
  Seed: RRLAGQFLEE (MOG_HUMAN)
RRLAGQFLEI

SEQ ID NO: 122392 - protein, 9 aa, Artificial Sequence
  Description of Artificial Sequence: Synthetic peptide
  Seed: VLLAVLPVL (MOG_HUMAN)
VILAVLPVL

SEQ ID NO: 122393 - protein, 9 aa, Artificial Sequence
  Description of Artificial Sequence: Synthetic peptide
  Seed: ICYNWLHRR (MOG_HUMAN)
ISYNWLHRK

SEQ ID NO: 122394 - protein, 10 aa, Artificial Sequence
  Description of Artificial Sequence: Synthetic peptide
  Seed: HFLRVPCWKI (MOG_HUMAN)
HWLRVPCWKF

SEQ ID NO: 122395 - protein, 9 aa, Artificial Sequence
  Description of Artificial Sequence: Synthetic peptide
  Seed: IICYNWLHR (MOG_HUMAN)
ISCYNWLHK

SEQ ID NO: 122396 - protein, 9 aa, Artificial Sequence
  Description of Artificial Sequence: Synthetic peptide
  Seed: TLFVIVPVL (MOG_HUMAN)
TAFVIVPVV

SEQ ID NO: 122397 - protein, 9 aa, Artificial Sequence
  Description of Artificial Sequence: Synthetic peptide
  Seed: KLRAEIENL (MOG_HUMAN)
KIRAEIENF

SEQ ID NO: 122398 - protein, 9 aa, Artificial Sequence
  Description of Artificial Sequence: Synthetic peptide
  Seed: TFDPHFLRV (MOG_HUMAN)
THDPHFLRY

SEQ ID NO: 122399 - protein, 11 aa, Artificial Sequence
  Description of Artificial Sequence: Synthetic peptide
  Seed: VIGPRHPIRAL (MOG_HUMAN)
VRGPRHPIRAM

SEQ ID NO: 122400 - protein, 11 aa, Artificial Sequence
  Description of Artificial Sequence: Synthetic peptide
  Seed: HSYQEEAAMEL (MOG_HUMAN)
HQYQEEAAMEI

SEQ ID NO: 122401 - protein, 9 aa, Artificial Sequence
  Description of Artificial Sequence: Synthetic peptide
  Seed: VSPGVLVLL (MOG_HUMAN)
VTPGVLVLL

SEQ ID NO: 122402 - protein, 11 aa, Artificial Sequence
  Description of Artificial Sequence: Synthetic peptide
  Seed: RDHSYQEEAAM (MOG_HUMAN)
RDHSYQEEAAY

SEQ ID NO: 122403 - protein, 9 aa, Artificial Sequence
  Description of Artificial Sequence: Synthetic peptide
  Seed: WVSPGVLVL (MOG_HUMAN)
WQSPGVLVY

SEQ ID NO: 122404 - protein, 9 aa, Artificial Sequence
  Description of Artificial Sequence: Synthetic peptide
  Seed: CLCSFLLLL (MOG_HUMAN)
CSCSFLLLL

SEQ ID NO: 122405 - protein, 9 aa, Artificial Sequence
  Description of Artificial Sequence: Synthetic peptide
  Seed: KVEDPFYWV (MOG_HUMAN)
KLEDPFYWT

SEQ ID NO: 122406 - protein, 9 aa, Artificial Sequence
  Description of Artificial Sequence: Synthetic peptide
  Seed: MASLSRPSL (MOG_HUMAN)
MLSLSRPSF

SEQ ID NO: 122407 - protein, 8 aa, Artificial Sequence
  Description of Artificial Sequence: Synthetic peptide
  Seed: FSDEGGFT (MOG_HUMAN)
FADEGGFI

SEQ ID NO: 122408 - protein, 9 aa, Artificial Sequence
  Description of Artificial Sequence: Synthetic peptide
  Seed: ITVGLIFLC (MOG_HUMAN)
IAVGLIFLF

SEQ ID NO: 122409 - protein, 10 aa, Artificial Sequence
  Description of Artificial Sequence: Synthetic peptide
  Seed: SLSRPSLPSC (MOG_HUMAN)
SWSRPSLPSA

SEQ ID NO: 122410 - protein, 10 aa, Artificial Sequence
  Description of Artificial Sequence: Synthetic peptide
  Seed: SLSRPSLPSC (MOG_HUMAN)
SISRPSLPSL

SEQ ID NO: 122411 - protein, 10 aa, Artificial Sequence
  Description of Artificial Sequence: Synthetic peptide
  Seed: KVTLRIRNVR (MOG_HUMAN)
KFTLRIRNVR

SEQ ID NO: 122412 - protein, 11 aa, Artificial Sequence
  Description of Artificial Sequence: Synthetic peptide
  Seed: RIRNVRFSDEG (MOG_HUMAN)
RFRNVRFSDEK

SEQ ID NO: 122413 - protein, 10 aa, Artificial Sequence
  Description of Artificial Sequence: Synthetic peptide
  Seed: SFLLLLLLQV (MOG_HUMAN)
SELLLLLLQV

SEQ ID NO: 122414 - protein, 9 aa, Artificial Sequence
  Description of Artificial Sequence: Synthetic peptide
  Seed: GEGKVTLRI (MOG_HUMAN)
GQGKVTLRI

SEQ ID NO: 122415 - protein, 9 aa, Artificial Sequence
  Description of Artificial Sequence: Synthetic peptide
  Seed: KLRAEIENL (MOG_HUMAN)
KSRAEIENK

SEQ ID NO: 122416 - protein, 10 aa, Artificial Sequence
  Description of Artificial Sequence: Synthetic peptide
  Seed: LIFLCLQYRL (MOG_HUMAN)
LLFLCLQYRK

SEQ ID NO: 122417 - protein, 9 aa, Artificial Sequence
  Description of Artificial Sequence: Synthetic peptide
  Seed: LQVSSSYAG (MOG_HUMAN)
LKVSSSYAI

SEQ ID NO: 122418 - protein, 10 aa, Artificial Sequence
  Description of Artificial Sequence: Synthetic peptide
  Seed: IGPRHPIRAL (MOG_HUMAN)
IRPRHPIRAA

SEQ ID NO: 122419 - protein, 9 aa, Artificial Sequence
  Description of Artificial Sequence: Synthetic peptide
  Seed: WVSPGVLVL (MOG_HUMAN)
WFSPGVLVF

SEQ ID NO: 122420 - protein, 9 aa, Artificial Sequence
  Description of Artificial Sequence: Synthetic peptide
  Seed: EGGFTCFFR (MOG_HUMAN)
EAGFTCFFR

SEQ ID NO: 122421 - protein, 9 aa, Artificial Sequence
  Description of Artificial Sequence: Synthetic peptide
  Seed: SSSYAGQFR (MOG_HUMAN)
SSSYAGQFY

SEQ ID NO: 122422 - protein, 9 aa, Artificial Sequence
  Description of Artificial Sequence: Synthetic peptide
  Seed: YQEEAAMEL (MOG_HUMAN)
YEEEAAMEF

SEQ ID NO: 122423 - protein, 9 aa, Artificial Sequence
  Description of Artificial Sequence: Synthetic peptide
  Seed: LQITVGLIF (MOG_HUMAN)
LQITVGLIL

SEQ ID NO: 122424 - protein, 9 aa, Artificial Sequence
  Description of Artificial Sequence: Synthetic peptide
  Seed: RIRNVRFSD (MOG_HUMAN)
RSRNVRFSR

SEQ ID NO: 122425 - protein, 9 aa, Artificial Sequence
  Description of Artificial Sequence: Synthetic peptide
  Seed: TFDPHFLRV (MOG_HUMAN)
TVDPHFLRM

SEQ ID NO: 122426 - protein, 11 aa, Artificial Sequence
  Description of Artificial Sequence: Synthetic peptide
  Seed: YWVSPGVLVLL (MOG_HUMAN)
YYVSPGVLVLF

SEQ ID NO: 122427 - protein, 11 aa, Artificial Sequence
  Description of Artificial Sequence: Synthetic peptide
  Seed: SSSYAGQFRVI (MOG_HUMAN)
SKSYAGQFRVF

SEQ ID NO: 122428 - protein, 11 aa, Artificial Sequence
  Description of Artificial Sequence: Synthetic peptide
  Seed: HSYQEEAAMEL (MOG_HUMAN)
HQYQEEAAMEW

SEQ ID NO: 122429 - protein, 9 aa, Artificial Sequence
  Description of Artificial Sequence: Synthetic peptide
  Seed: IGEGKVTLR (MOG_HUMAN)
IVEGKVTLY

SEQ ID NO: 122430 - protein, 10 aa, Artificial Sequence
  Description of Artificial Sequence: Synthetic peptide
  Seed: IGPRHPIRAL (MOG_HUMAN)
IDPRHPIRAM

SEQ ID NO: 122431 - protein, 9 aa, Artificial Sequence
  Description of Artificial Sequence: Synthetic peptide
  Seed: GLIFLCLQY (MOG_HUMAN)
GTIFLCLQY

SEQ ID NO: 122432 - protein, 9 aa, Artificial Sequence
  Description of Artificial Sequence: Synthetic peptide
  Seed: ICYNWLHRR (MOG_HUMAN)
ITYNWLHRY

SEQ ID NO: 122433 - protein, 9 aa, Artificial Sequence
  Description of Artificial Sequence: Synthetic peptide
  Seed: SSSYAGQFR (MOG_HUMAN)
SQSYAGQFK

SEQ ID NO: 122434 - protein, 10 aa, Artificial Sequence
  Description of Artificial Sequence: Synthetic peptide
  Seed: EYRGRTELLK (MOG_HUMAN)
EMRGRTELLR

SEQ ID NO: 122435 - protein, 10 aa, Artificial Sequence
  Description of Artificial Sequence: Synthetic peptide
  Seed: FVIVPVLGPL (MOG_HUMAN)
FQIVPVLGPL

SEQ ID NO: 122436 - protein, 10 aa, Artificial Sequence
  Description of Artificial Sequence: Synthetic peptide
  Seed: VLLAVLPVLL (MOG_HUMAN)
VVLAVLPVLV

SEQ ID NO: 122437 - protein, 10 aa, Artificial Sequence
  Description of Artificial Sequence: Synthetic peptide
  Seed: LLLQVSSSYA (MOG_HUMAN)
LNLQVSSSYV

SEQ ID NO: 122438 - protein, 9 aa, Artificial Sequence
  Description of Artificial Sequence: Synthetic peptide
  Seed: RVPCWKITL (MOG_HUMAN)
RYPCWKITV

SEQ ID NO: 122439 - protein, 9 aa, Artificial Sequence
  Description of Artificial Sequence: Synthetic peptide
  Seed: FYWVSPGVL (MOG_HUMAN)
FVWVSPGVM

SEQ ID NO: 122440 - protein, 11 aa, Artificial Sequence
  Description of Artificial Sequence: Synthetic peptide
  Seed: DAIGEGKVTLR (MOG_HUMAN)
DTIGEGKVTLK

SEQ ID NO: 122441 - protein, 9 aa, Artificial Sequence
  Description of Artificial Sequence: Synthetic peptide
  Seed: FLLLLLLQV (MOG_HUMAN)
FVLLLLLQI

SEQ ID NO: 122442 - protein, 10 aa, Artificial Sequence
  Description of Artificial Sequence: Synthetic peptide
  Seed: DAIGEGKVTL (MOG_HUMAN)
DIIGEGKVTY

SEQ ID NO: 122443 - protein, 9 aa, Artificial Sequence
  Description of Artificial Sequence: Synthetic peptide
  Seed: KLRAEIENL (MOG_HUMAN)
KMRAEIENW

SEQ ID NO: 122444 - protein, 10 aa, Artificial Sequence
  Description of Artificial Sequence: Synthetic peptide
  Seed: AVLPVLLLQI (MOG_HUMAN)
AMLPVLLLQM

SEQ ID NO: 122445 - protein, 10 aa, Artificial Sequence
  Description of Artificial Sequence: Synthetic peptide
  Seed: AGQFRVIGPR (MOG_HUMAN)
AQQFRVIGPR

SEQ ID NO: 122446 - protein, 10 aa, Artificial Sequence
  Description of Artificial Sequence: Synthetic peptide
  Seed: LLLQVSSSYA (MOG_HUMAN)
LCLQVSSSYV

SEQ ID NO: 122447 - protein, 9 aa, Artificial Sequence
  Description of Artificial Sequence: Synthetic peptide
  Seed: WVSPGVLVL (MOG_HUMAN)
WVSPGVLVV

SEQ ID NO: 122448 - protein, 10 aa, Artificial Sequence
  Description of Artificial Sequence: Synthetic peptide
  Seed: AEIENLHRTF (MOG_HUMAN)
AEIENLHRTI

SEQ ID NO: 122449 - protein, 10 aa, Artificial Sequence
  Description of Artificial Sequence: Synthetic peptide
  Seed: TGMEVGWYRP (MOG_HUMAN)
TFMEVGWYRN

SEQ ID NO: 122450 - protein, 9 aa, Artificial Sequence
  Description of Artificial Sequence: Synthetic peptide
  Seed: SLPSCLCSF (MOG_HUMAN)
SYPSCLCSW

SEQ ID NO: 122451 - protein, 11 aa, Artificial Sequence
  Description of Artificial Sequence: Synthetic peptide
  Seed: VIGPRHPIRAL (MOG_HUMAN)
VSGPRHPIRAL

SEQ ID NO: 122452 - protein, 10 aa, Artificial Sequence
  Description of Artificial Sequence: Synthetic peptide
  Seed: ITVGLIFLCL (MOG_HUMAN)
IMVGLIFLCV

SEQ ID NO: 122453 - protein, 9 aa, Artificial Sequence
  Description of Artificial Sequence: Synthetic peptide
  Seed: RVPCWKITL (MOG_HUMAN)
RPPCWKITV

SEQ ID NO: 122454 - protein, 11 aa, Artificial Sequence
  Description of Artificial Sequence: Synthetic peptide
  Seed: RPSLPSCLCSF (MOG_HUMAN)
RVSLPSCLCSW

SEQ ID NO: 122455 - protein, 9 aa, Artificial Sequence
  Description of Artificial Sequence: Synthetic peptide
  Seed: YQEEAAMEL (MOG_HUMAN)
YSEEAAMEM

SEQ ID NO: 122456 - protein, 9 aa, Artificial Sequence
  Description of Artificial Sequence: Synthetic peptide
  Seed: RVPCWKITL (MOG_HUMAN)
RFPCWKITM

SEQ ID NO: 122457 - protein, 10 aa, Artificial Sequence
  Description of Artificial Sequence: Synthetic peptide
  Seed: CLCSFLLLLL (MOG_HUMAN)
CLCSFLLLLI

SEQ ID NO: 122458 - protein, 10 aa, Artificial Sequence
  Description of Artificial Sequence: Synthetic peptide
  Seed: FVIVPVLGPL (MOG_HUMAN)
FEIVPVLGPV

SEQ ID NO: 122459 - protein, 10 aa, Artificial Sequence
  Description of Artificial Sequence: Synthetic peptide
  Seed: LLLQVSSSYA (MOG_HUMAN)
LILQVSSSYV

SEQ ID NO: 122460 - protein, 10 aa, Artificial Sequence
  Description of Artificial Sequence: Synthetic peptide
  Seed: FDPHFLRVPC (MOG_HUMAN)
FHPHFLRVPS

SEQ ID NO: 122461 - protein, 9 aa, Artificial Sequence
  Description of Artificial Sequence: Synthetic peptide
  Seed: RIRNVRFSD (MOG_HUMAN)
RVRNVRFSY

SEQ ID NO: 122462 - protein, 9 aa, Artificial Sequence
  Description of Artificial Sequence: Synthetic peptide
  Seed: VTLRIRNVR (MOG_HUMAN)
VMLRIRNVR

SEQ ID NO: 122463 - protein, 8 aa, Artificial Sequence
  Description of Artificial Sequence: Synthetic peptide
  Seed: TFDPHFLR (MOG_HUMAN)
TTDPHFLY

SEQ ID NO: 122464 - protein, 9 aa, Artificial Sequence
  Description of Artificial Sequence: Synthetic peptide
  Seed: VLGPLVALI (MOG_HUMAN)
VLGPLVALR

SEQ ID NO: 122465 - protein, 9 aa, Artificial Sequence
  Description of Artificial Sequence: Synthetic peptide
  Seed: FYWVSPGVL (MOG_HUMAN)
FRWVSPGVM

SEQ ID NO: 122466 - protein, 10 aa, Artificial Sequence
  Description of Artificial Sequence: Synthetic peptide
  Seed: RTFDPHFLRV (MOG_HUMAN)
RLFDPHFLRH

SEQ ID NO: 122467 - protein, 9 aa, Artificial Sequence
  Description of Artificial Sequence: Synthetic peptide
  Seed: AIGEGKVTL (MOG_HUMAN)
APGEGKVTF

SEQ ID NO: 122468 - protein, 8 aa, Artificial Sequence
  Description of Artificial Sequence: Synthetic peptide
  Seed: YAGQFRVI (MOG_HUMAN)
YTGQFRVL

SEQ ID NO: 122469 - protein, 10 aa, Artificial Sequence
  Description of Artificial Sequence: Synthetic peptide
  Seed: LQITVGLIFL (MOG_HUMAN)
LMITVGLIFY

SEQ ID NO: 122470 - protein, 9 aa, Artificial Sequence
  Description of Artificial Sequence: Synthetic peptide
  Seed: HSYQEEAAM (MOG_HUMAN)
HFYQEEAAY

SEQ ID NO: 122471 - protein, 9 aa, Artificial Sequence
  Description of Artificial Sequence: Synthetic peptide
  Seed: RIRNVRFSD (MOG_HUMAN)
RVRNVRFSV

SEQ ID NO: 122472 - protein, 10 aa, Artificial Sequence
  Description of Artificial Sequence: Synthetic peptide
  Seed: FDPHFLRVPC (MOG_HUMAN)
FAPHFLRVPP

SEQ ID NO: 122473 - protein, 9 aa, Artificial Sequence
  Description of Artificial Sequence: Synthetic peptide
  Seed: LLLQITVGL (MOG_HUMAN)
LILQITVGF

SEQ ID NO: 122474 - protein, 9 aa, Artificial Sequence
  Description of Artificial Sequence: Synthetic peptide
  Seed: VIVPVLGPL (MOG_HUMAN)
VTVPVLGPF

SEQ ID NO: 122475 - protein, 11 aa, Artificial Sequence
  Description of Artificial Sequence: Synthetic peptide
  Seed: VIGPRHPIRAL (MOG_HUMAN)
VGGPRHPIRAM

SEQ ID NO: 122476 - protein, 10 aa, Artificial Sequence
  Description of Artificial Sequence: Synthetic peptide
  Seed: FVIVPVLGPL (MOG_HUMAN)
FQIVPVLGPV

SEQ ID NO: 122477 - protein, 9 aa, Artificial Sequence
  Description of Artificial Sequence: Synthetic peptide
  Seed: LLLQITVGL (MOG_HUMAN)
LLLQITVGV

SEQ ID NO: 122478 - protein, 10 aa, Artificial Sequence
  Description of Artificial Sequence: Synthetic peptide
  Seed: VIVPVLGPLV (MOG_HUMAN)
VTVPVLGPLV

SEQ ID NO: 122479 - protein, 9 aa, Artificial Sequence
  Description of Artificial Sequence: Synthetic peptide
  Seed: YWVSPGVLV (MOG_HUMAN)
YFVSPGVLW

SEQ ID NO: 122480 - protein, 9 aa, Artificial Sequence
  Description of Artificial Sequence: Synthetic peptide
  Seed: HSYQEEAAM (MOG_HUMAN)
HHYQEEAAI

SEQ ID NO: 122481 - protein, 9 aa, Artificial Sequence
  Description of Artificial Sequence: Synthetic peptide
  Seed: LLQVSSSYA (MOG_HUMAN)
LIQVSSSYV

SEQ ID NO: 122482 - protein, 11 aa, Artificial Sequence
  Description of Artificial Sequence: Synthetic peptide
  Seed: KLRAEIENLHR (MOG_HUMAN)
KVRAEIENLHR

SEQ ID NO: 122483 - protein, 11 aa, Artificial Sequence
  Description of Artificial Sequence: Synthetic peptide
  Seed: SDEGGFTCFFR (MOG_HUMAN)
SQEGGFTCFFR

SEQ ID NO: 122484 - protein, 10 aa, Artificial Sequence
  Description of Artificial Sequence: Synthetic peptide
  Seed: RLAGQFLEEL (MOG_HUMAN)
RLAGQFLEEI

SEQ ID NO: 122485 - protein, 9 aa, Artificial Sequence
  Description of Artificial Sequence: Synthetic peptide
  Seed: YRPPFSRVV (MOG_HUMAN)
YIPPFSRVI

SEQ ID NO: 122486 - protein, 9 aa, Artificial Sequence
  Description of Artificial Sequence: Synthetic peptide
  Seed: ICYNWLHRR (MOG_HUMAN)
IQYNWLHRR

SEQ ID NO: 122487 - protein, 11 aa, Artificial Sequence
  Description of Artificial Sequence: Synthetic peptide
  Seed: EVGWYRPPFSR (MOG_HUMAN)
EFGWYRPPFSR

SEQ ID NO: 122488 - protein, 9 aa, Artificial Sequence
  Description of Artificial Sequence: Synthetic peptide
  Seed: HSYQEEAAM (MOG_HUMAN)
HQYQEEAAW

SEQ ID NO: 122489 - protein, 11 aa, Artificial Sequence
  Description of Artificial Sequence: Synthetic peptide
  Seed: KDQDGDQAPEY (MOG_HUMAN)
KQQDGDQAPEF

SEQ ID NO: 122490 - protein, 9 aa, Artificial Sequence
  Description of Artificial Sequence: Synthetic peptide
  Seed: FSDEGGFTC (MOG_HUMAN)
FVDEGGFTY

SEQ ID NO: 122491 - protein, 9 aa, Artificial Sequence
  Description of Artificial Sequence: Synthetic peptide
  Seed: LLLQITVGL (MOG_HUMAN)
LQLQITVGY

SEQ ID NO: 122492 - protein, 9 aa, Artificial Sequence
  Description of Artificial Sequence: Synthetic peptide
  Seed: YWVSPGVLV (MOG_HUMAN)
YWVSPGVLY

SEQ ID NO: 122493 - protein, 10 aa, Artificial Sequence
  Description of Artificial Sequence: Synthetic peptide
  Seed: FDPHFLRVPC (MOG_HUMAN)
FAPHFLRVPI

SEQ ID NO: 122494 - protein, 9 aa, Artificial Sequence
  Description of Artificial Sequence: Synthetic peptide
  Seed: YQEEAAMEL (MOG_HUMAN)
YLEEAAMEW

SEQ ID NO: 122495 - protein, 9 aa, Artificial Sequence
  Description of Artificial Sequence: Synthetic peptide
  Seed: SRPSLPSCL (MOG_HUMAN)
SVPSLPSCV

SEQ ID NO: 122496 - protein, 10 aa, Artificial Sequence
  Description of Artificial Sequence: Synthetic peptide
  Seed: AEIENLHRTF (MOG_HUMAN)
AEIENLHRTY

SEQ ID NO: 122497 - protein, 9 aa, Artificial Sequence
  Description of Artificial Sequence: Synthetic peptide
  Seed: IGEGKVTLR (MOG_HUMAN)
IAEGKVTLF

SEQ ID NO: 122498 - protein, 11 aa, Artificial Sequence
  Description of Artificial Sequence: Synthetic peptide
  Seed: RISPGKNATGM (MOG_HUMAN)
RASPGKNATGY

SEQ ID NO: 122499 - protein, 10 aa, Artificial Sequence
  Description of Artificial Sequence: Synthetic peptide
  Seed: SCLCSFLLLL (MOG_HUMAN)
SQLCSFLLLV

SEQ ID NO: 122500 - protein, 10 aa, Artificial Sequence
  Description of Artificial Sequence: Synthetic peptide
  Seed: FDPHFLRVPC (MOG_HUMAN)
FCPHFLRVPV

SEQ ID NO: 122501 - protein, 10 aa, Artificial Sequence
  Description of Artificial Sequence: Synthetic peptide
  Seed: RIRNVRFSDE (MOG_HUMAN)
RTRNVRFSDP

SEQ ID NO: 122502 - protein, 9 aa, Artificial Sequence
  Description of Artificial Sequence: Synthetic peptide
  Seed: LLAVLPVLL (MOG_HUMAN)
LMAVLPVLR

SEQ ID NO: 122503 - protein, 9 aa, Artificial Sequence
  Description of Artificial Sequence: Synthetic peptide
  Seed: RDHSYQEEA (MOG_HUMAN)
REHSYQEET

SEQ ID NO: 122504 - protein, 10 aa, Artificial Sequence
  Description of Artificial Sequence: Synthetic peptide
  Seed: DEGGFTCFFR (MOG_HUMAN)
DAGGFTCFFR

SEQ ID NO: 122505 - protein, 9 aa, Artificial Sequence
  Description of Artificial Sequence: Synthetic peptide
  Seed: RPSLPSCLC (MOG_HUMAN)
RPSLPSCLM

SEQ ID NO: 122506 - protein, 9 aa, Artificial Sequence
  Description of Artificial Sequence: Synthetic peptide
  Seed: TFDPHFLRV (MOG_HUMAN)
TMDPHFLRA

SEQ ID NO: 122507 - protein, 9 aa, Artificial Sequence
  Description of Artificial Sequence: Synthetic peptide
  Seed: LQITVGLIF (MOG_HUMAN)
LTITVGLIW

SEQ ID NO: 122508 - protein, 10 aa, Artificial Sequence
  Description of Artificial Sequence: Synthetic peptide
  Seed: YWVSPGVLVL (MOG_HUMAN)
YWVSPGVLVF

SEQ ID NO: 122509 - protein, 9 aa, Artificial Sequence
  Description of Artificial Sequence: Synthetic peptide
  Seed: LLLQVSSSY (MOG_HUMAN)
LTLQVSSSW

SEQ ID NO: 122510 - protein, 9 aa, Artificial Sequence
  Description of Artificial Sequence: Synthetic peptide
  Seed: KLRAEIENL (MOG_HUMAN)
KTRAEIENA

SEQ ID NO: 122511 - protein, 9 aa, Artificial Sequence
  Description of Artificial Sequence: Synthetic peptide
  Seed: RVIGPRHPI (MOG_HUMAN)
RFIGPRHPK

SEQ ID NO: 122512 - protein, 11 aa, Artificial Sequence
  Description of Artificial Sequence: Synthetic peptide
  Seed: VIGPRHPIRAL (MOG_HUMAN)
VVGPRHPIRAL

SEQ ID NO: 122513 - protein, 9 aa, Artificial Sequence
  Description of Artificial Sequence: Synthetic peptide
  Seed: VIVPVLGPL (MOG_HUMAN)
VQVPVLGPI

SEQ ID NO: 122514 - protein, 11 aa, Artificial Sequence
  Description of Artificial Sequence: Synthetic peptide
  Seed: RTFDPHFLRVP (MOG_HUMAN)
RLFDPHFLRVR

SEQ ID NO: 122515 - protein, 9 aa, Artificial Sequence
  Description of Artificial Sequence: Synthetic peptide
  Seed: FLEELRNPF (MOG_HUMAN)
FVEELRNPM

SEQ ID NO: 122516 - protein, 9 aa, Artificial Sequence
  Description of Artificial Sequence: Synthetic peptide
  Seed: CLCSFLLLL (MOG_HUMAN)
CMCSFLLLR

SEQ ID NO: 122517 - protein, 9 aa, Artificial Sequence
  Description of Artificial Sequence: Synthetic peptide
  Seed: TCFFRDHSY (MOG_HUMAN)
TAFFRDHSM

SEQ ID NO: 122518 - protein, 10 aa, Artificial Sequence
  Description of Artificial Sequence: Synthetic peptide
  Seed: LQITVGLIFL (MOG_HUMAN)
LMITVGLIFA

SEQ ID NO: 122519 - protein, 10 aa, Artificial Sequence
  Description of Artificial Sequence: Synthetic peptide
  Seed: RPPFSRVVHL (MOG_HUMAN)
RYPFSRVVHM

SEQ ID NO: 122520 - protein, 9 aa, Artificial Sequence
  Description of Artificial Sequence: Synthetic peptide
  Seed: ITLFVIVPV (MOG_HUMAN)
IVLFVIVPI

SEQ ID NO: 122521 - protein, 10 aa, Artificial Sequence
  Description of Artificial Sequence: Synthetic peptide
  Seed: LLLLQVSSSY (MOG_HUMAN)
LVLLQVSSSY

SEQ ID NO: 122522 - protein, 11 aa, Artificial Sequence
  Description of Artificial Sequence: Synthetic peptide
  Seed: HRTFDPHFLRV (MOG_HUMAN)
HMTFDPHFLRC

SEQ ID NO: 122523 - protein, 10 aa, Artificial Sequence
  Description of Artificial Sequence: Synthetic peptide
  Seed: WVSPGVLVLL (MOG_HUMAN)
WISPGVLVLI

SEQ ID NO: 122524 - protein, 9 aa, Artificial Sequence
  Description of Artificial Sequence: Synthetic peptide
  Seed: TFDPHFLRV (MOG_HUMAN)
TRDPHFLRV

SEQ ID NO: 122525 - protein, 9 aa, Artificial Sequence
  Description of Artificial Sequence: Synthetic peptide
  Seed: AIGEGKVTL (MOG_HUMAN)
ALGEGKVTW

SEQ ID NO: 122526 - protein, 9 aa, Artificial Sequence
  Description of Artificial Sequence: Synthetic peptide
  Seed: TGMEVGWYR (MOG_HUMAN)
TMMEVGWYK

SEQ ID NO: 122527 - protein, 9 aa, Artificial Sequence
  Description of Artificial Sequence: Synthetic peptide
  Seed: TFDPHFLRV (MOG_HUMAN)
TADPHFLRM

SEQ ID NO: 122528 - protein, 9 aa, Artificial Sequence
  Description of Artificial Sequence: Synthetic peptide
  Seed: YQEEAAMEL (MOG_HUMAN)
YMEEAAMEV

SEQ ID NO: 122529 - protein, 9 aa, Artificial Sequence
  Description of Artificial Sequence: Synthetic peptide
  Seed: SSYAGQFRV (MOG_HUMAN)
SLYAGQFRW

SEQ ID NO: 122530 - protein, 11 aa, Artificial Sequence
  Description of Artificial Sequence: Synthetic peptide
  Seed: RDHSYQEEAAM (MOG_HUMAN)
RAHSYQEEAAF

SEQ ID NO: 122531 - protein, 10 aa, Artificial Sequence
  Description of Artificial Sequence: Synthetic peptide
  Seed: FDPHFLRVPC (MOG_HUMAN)
FNPHFLRVPM

SEQ ID NO: 122532 - protein, 10 aa, Artificial Sequence
  Description of Artificial Sequence: Synthetic peptide
  Seed: PVLGPLVALI (MOG_HUMAN)
PFLGPLVALL

SEQ ID NO: 122533 - protein, 10 aa, Artificial Sequence
  Description of Artificial Sequence: Synthetic peptide
  Seed: WVSPGVLVLL (MOG_HUMAN)
WLSPGVLVLT

SEQ ID NO: 122534 - protein, 9 aa, Artificial Sequence
  Description of Artificial Sequence: Synthetic peptide
  Seed: KLRAEIENL (MOG_HUMAN)
KTRAEIENW

SEQ ID NO: 122535 - protein, 9 aa, Artificial Sequence
  Description of Artificial Sequence: Synthetic peptide
  Seed: YRLRGKLRA (MOG_HUMAN)
YRLRGKLRM

SEQ ID NO: 122536 - protein, 10 aa, Artificial Sequence
  Description of Artificial Sequence: Synthetic peptide
  Seed: WVSPGVLVLL (MOG_HUMAN)
WLSPGVLVLM

SEQ ID NO: 122537 - protein, 10 aa, Artificial Sequence
  Description of Artificial Sequence: Synthetic peptide
  Seed: FDPHFLRVPC (MOG_HUMAN)
FFPHFLRVPF

SEQ ID NO: 122538 - protein, 10 aa, Artificial Sequence
  Description of Artificial Sequence: Synthetic peptide
  Seed: LLLQVSSSYA (MOG_HUMAN)
LMLQVSSSYC

SEQ ID NO: 122539 - protein, 10 aa, Artificial Sequence
  Description of Artificial Sequence: Synthetic peptide
  Seed: HRTFDPHFLR (MOG_HUMAN)
HSTFDPHFLK

SEQ ID NO: 122540 - protein, 9 aa, Artificial Sequence
  Description of Artificial Sequence: Synthetic peptide
  Seed: VRFSDEGGF (MOG_HUMAN)
VMFSDEGGF

SEQ ID NO: 122541 - protein, 10 aa, Artificial Sequence
  Description of Artificial Sequence: Synthetic peptide
  Seed: RTFDPHFLRV (MOG_HUMAN)
RNFDPHFLRY

SEQ ID NO: 122542 - protein, 11 aa, Artificial Sequence
  Description of Artificial Sequence: Synthetic peptide
  Seed: RTFDPHFLRVP (MOG_HUMAN)
RMFDPHFLRVN

SEQ ID NO: 122543 - protein, 11 aa, Artificial Sequence
  Description of Artificial Sequence: Synthetic peptide
  Seed: RDHSYQEEAAM (MOG_HUMAN)
RKHSYQEEAAW

SEQ ID NO: 122544 - protein, 10 aa, Artificial Sequence
  Description of Artificial Sequence: Synthetic peptide
  Seed: RIRNVRFSDE (MOG_HUMAN)
RTRNVRFSDV

SEQ ID NO: 122545 - protein, 9 aa, Artificial Sequence
  Description of Artificial Sequence: Synthetic peptide
  Seed: VGDEVELPC (MOG_HUMAN)
VADEVELPI

SEQ ID NO: 122546 - protein, 10 aa, Artificial Sequence
  Description of Artificial Sequence: Synthetic peptide
  Seed: HRTFDPHFLR (MOG_HUMAN)
HNTFDPHFLK

SEQ ID NO: 122547 - protein, 10 aa, Artificial Sequence
  Description of Artificial Sequence: Synthetic peptide
  Seed: RTFDPHFLRV (MOG_HUMAN)
RRFDPHFLRY

SEQ ID NO: 122548 - protein, 10 aa, Artificial Sequence
  Description of Artificial Sequence: Synthetic peptide
  Seed: FDPHFLRVPC (MOG_HUMAN)
FPPHFLRVPI

SEQ ID NO: 122549 - protein, 9 aa, Artificial Sequence
  Description of Artificial Sequence: Synthetic peptide
  Seed: MASLSRPSL (MOG_HUMAN)
MNSLSRPSF

SEQ ID NO: 122550 - protein, 10 aa, Artificial Sequence
  Description of Artificial Sequence: Synthetic peptide
  Seed: YWVSPGVLVL (MOG_HUMAN)
YAVSPGVLVM

SEQ ID NO: 122551 - protein, 9 aa, Artificial Sequence
  Description of Artificial Sequence: Synthetic peptide
  Seed: RTFDPHFLR (MOG_HUMAN)
RLFDPHFLK

SEQ ID NO: 122552 - protein, 9 aa, Artificial Sequence
  Description of Artificial Sequence: Synthetic peptide
  Seed: SCLCSFLLL (MOG_HUMAN)
SVLCSFLLL

SEQ ID NO: 122553 - protein, 9 aa, Artificial Sequence
  Description of Artificial Sequence: Synthetic peptide
  Seed: VLPVLLLQI (MOG_HUMAN)
VMPVLLLQA

SEQ ID NO: 122554 - protein, 8 aa, Artificial Sequence
  Description of Artificial Sequence: Synthetic peptide
  Seed: VPVLGPLV (MOG_HUMAN)
VPVLGPLI

SEQ ID NO: 122555 - protein, 10 aa, Artificial Sequence
  Description of Artificial Sequence: Synthetic peptide
  Seed: RVVHLYRNGK (MOG_HUMAN)
REVHLYRNGR

SEQ ID NO: 122556 - protein, 10 aa, Artificial Sequence
  Description of Artificial Sequence: Synthetic peptide
  Seed: VLLLQITVGL (MOG_HUMAN)
VKLLQITVGL

SEQ ID NO: 122557 - protein, 9 aa, Artificial Sequence
  Description of Artificial Sequence: Synthetic peptide
  Seed: KVTLRIRNV (MOG_HUMAN)
KATLRIRNL

SEQ ID NO: 122558 - protein, 9 aa, Artificial Sequence
  Description of Artificial Sequence: Synthetic peptide
  Seed: VSSSYAGQF (MOG_HUMAN)
VTSSYAGQM

SEQ ID NO: 122559 - protein, 10 aa, Artificial Sequence
  Description of Artificial Sequence: Synthetic peptide
  Seed: FLLLLLLQVS (MOG_HUMAN)
FFLLLLLQVV

SEQ ID NO: 122560 - protein, 10 aa, Artificial Sequence
  Description of Artificial Sequence: Synthetic peptide
  Seed: AVLPVLLLQI (MOG_HUMAN)
AFLPVLLLQV

SEQ ID NO: 122561 - protein, 10 aa, Artificial Sequence
  Description of Artificial Sequence: Synthetic peptide
  Seed: YRPPFSRVVH (MOG_HUMAN)
YYPPFSRVVY

SEQ ID NO: 122562 - protein, 9 aa, Artificial Sequence
  Description of Artificial Sequence: Synthetic peptide
  Seed: FLEELRNPF (MOG_HUMAN)
FPEELRNPM

SEQ ID NO: 122563 - protein, 10 aa, Artificial Sequence
  Description of Artificial Sequence: Synthetic peptide
  Seed: LVLLAVLPVL (MOG_HUMAN)
LFLLAVLPVA

SEQ ID NO: 122564 - protein, 9 aa, Artificial Sequence
  Description of Artificial Sequence: Synthetic peptide
  Seed: YQEEAAMEL (MOG_HUMAN)
YTEEAAMEL

SEQ ID NO: 122565 - protein, 10 aa, Artificial Sequence
  Description of Artificial Sequence: Synthetic peptide
  Seed: LQITVGLIFL (MOG_HUMAN)
LQITVGLIFH

SEQ ID NO: 122566 - protein, 10 aa, Artificial Sequence
  Description of Artificial Sequence: Synthetic peptide
  Seed: HRTFDPHFLR (MOG_HUMAN)
HWTFDPHFLR

SEQ ID NO: 122567 - protein, 10 aa, Artificial Sequence
  Description of Artificial Sequence: Synthetic peptide
  Seed: RTFDPHFLRV (MOG_HUMAN)
RTFDPHFLRP

SEQ ID NO: 122568 - protein, 9 aa, Artificial Sequence
  Description of Artificial Sequence: Synthetic peptide
  Seed: VTLRIRNVR (MOG_HUMAN)
VQLRIRNVR

SEQ ID NO: 122569 - protein, 9 aa, Artificial Sequence
  Description of Artificial Sequence: Synthetic peptide
  Seed: KLRAEIENL (MOG_HUMAN)
KIRAEIENV

SEQ ID NO: 122570 - protein, 9 aa, Artificial Sequence
  Description of Artificial Sequence: Synthetic peptide
  Seed: LSRPSLPSC (MOG_HUMAN)
LVRPSLPSV

SEQ ID NO: 122571 - protein, 9 aa, Artificial Sequence
  Description of Artificial Sequence: Synthetic peptide
  Seed: AIGEGKVTL (MOG_HUMAN)
ATGEGKVTV

SEQ ID NO: 122572 - protein, 11 aa, Artificial Sequence
  Description of Artificial Sequence: Synthetic peptide
  Seed: SPGKNATGMEV (MOG_HUMAN)
SPGKNATGMEL

SEQ ID NO: 122573 - protein, 9 aa, Artificial Sequence
  Description of Artificial Sequence: Synthetic peptide
  Seed: LQITVGLIF (MOG_HUMAN)
LHITVGLIM

SEQ ID NO: 122574 - protein, 11 aa, Artificial Sequence
  Description of Artificial Sequence: Synthetic peptide
  Seed: LHRTFDPHFLR (MOG_HUMAN)
LKRTFDPHFLK

SEQ ID NO: 122575 - protein, 9 aa, Artificial Sequence
  Description of Artificial Sequence: Synthetic peptide
  Seed: TFDPHFLRV (MOG_HUMAN)
TADPHFLRA

SEQ ID NO: 122576 - protein, 9 aa, Artificial Sequence
  Description of Artificial Sequence: Synthetic peptide
  Seed: LSRPSLPSC (MOG_HUMAN)
LTRPSLPSW

SEQ ID NO: 122577 - protein, 10 aa, Artificial Sequence
  Description of Artificial Sequence: Synthetic peptide
  Seed: RTFDPHFLRV (MOG_HUMAN)
RSFDPHFLRR

SEQ ID NO: 122578 - protein, 10 aa, Artificial Sequence
  Description of Artificial Sequence: Synthetic peptide
  Seed: SLSRPSLPSC (MOG_HUMAN)
SVSRPSLPSK

SEQ ID NO: 122579 - protein, 10 aa, Artificial Sequence
  Description of Artificial Sequence: Synthetic peptide
  Seed: RVIGPRHPIR (MOG_HUMAN)
RVIGPRHPIK

SEQ ID NO: 122580 - protein, 9 aa, Artificial Sequence
  Description of Artificial Sequence: Synthetic peptide
  Seed: SSYAGQFRV (MOG_HUMAN)
SMYAGQFRT

SEQ ID NO: 122581 - protein, 9 aa, Artificial Sequence
  Description of Artificial Sequence: Synthetic peptide
  Seed: VIVPVLGPL (MOG_HUMAN)
VVVPVLGPF

SEQ ID NO: 122582 - protein, 10 aa, Artificial Sequence
  Description of Artificial Sequence: Synthetic peptide
  Seed: LLKDAIGEGK (MOG_HUMAN)
LAKDAIGEGM

SEQ ID NO: 122583 - protein, 11 aa, Artificial Sequence
  Description of Artificial Sequence: Synthetic peptide
  Seed: QAPEYRGRTEL (MOG_HUMAN)
QPPEYRGRTEL

SEQ ID NO: 122584 - protein, 10 aa, Artificial Sequence
  Description of Artificial Sequence: Synthetic peptide
  Seed: FSDEGGFTCF (MOG_HUMAN)
FLDEGGFTCI

SEQ ID NO: 122585 - protein, 10 aa, Artificial Sequence
  Description of Artificial Sequence: Synthetic peptide
  Seed: LLQITVGLIF (MOG_HUMAN)
LHQITVGLIF

SEQ ID NO: 122586 - protein, 9 aa, Artificial Sequence
  Description of Artificial Sequence: Synthetic peptide
  Seed: LHRTFDPHF (MOG_HUMAN)
LHRTFDPHY

SEQ ID NO: 122587 - protein, 9 aa, Artificial Sequence
  Description of Artificial Sequence: Synthetic peptide
  Seed: LIFLCLQYR (MOG_HUMAN)
LVFLCLQYK

SEQ ID NO: 122588 - protein, 9 aa, Artificial Sequence
  Description of Artificial Sequence: Synthetic peptide
  Seed: RIRNVRFSD (MOG_HUMAN)
RGRNVRFSK

SEQ ID NO: 122589 - protein, 10 aa, Artificial Sequence
  Description of Artificial Sequence: Synthetic peptide
  Seed: TGMEVGWYRP (MOG_HUMAN)
TVMEVGWYRR

SEQ ID NO: 122590 - protein, 9 aa, Artificial Sequence
  Description of Artificial Sequence: Synthetic peptide
  Seed: WVSPGVLVL (MOG_HUMAN)
WLSPGVLVY

SEQ ID NO: 122591 - protein, 9 aa, Artificial Sequence
  Description of Artificial Sequence: Synthetic peptide
  Seed: VLGPLVALI (MOG_HUMAN)
VQGPLVALW

SEQ ID NO: 122592 - protein, 10 aa, Artificial Sequence
  Description of Artificial Sequence: Synthetic peptide
  Seed: SDEGGFTCFF (MOG_HUMAN)
SMEGGFTCFW

SEQ ID NO: 122593 - protein, 11 aa, Artificial Sequence
  Description of Artificial Sequence: Synthetic peptide
  Seed: VLVLLAVLPVL (MOG_HUMAN)
VEVLLAVLPVV

SEQ ID NO: 122594 - protein, 9 aa, Artificial Sequence
  Description of Artificial Sequence: Synthetic peptide
  Seed: LIICYNWLH (MOG_HUMAN)
LQICYNWLK

SEQ ID NO: 122595 - protein, 11 aa, Artificial Sequence
  Description of Artificial Sequence: Synthetic peptide
  Seed: RTFDPHFLRVP (MOG_HUMAN)
RSFDPHFLRVR

SEQ ID NO: 122596 - protein, 9 aa, Artificial Sequence
  Description of Artificial Sequence: Synthetic peptide
  Seed: AIGEGKVTL (MOG_HUMAN)
AIGEGKVTM

SEQ ID NO: 122597 - protein, 9 aa, Artificial Sequence
  Description of Artificial Sequence: Synthetic peptide
  Seed: ITLFVIVPV (MOG_HUMAN)
ILLFVIVPM

SEQ ID NO: 122598 - protein, 10 aa, Artificial Sequence
  Description of Artificial Sequence: Synthetic peptide
  Seed: RTFDPHFLRV (MOG_HUMAN)
RMFDPHFLRS

SEQ ID NO: 122599 - protein, 10 aa, Artificial Sequence
  Description of Artificial Sequence: Synthetic peptide
  Seed: PVLGPLVALI (MOG_HUMAN)
PYLGPLVALV

SEQ ID NO: 122600 - protein, 9 aa, Artificial Sequence
  Description of Artificial Sequence: Synthetic peptide
  Seed: LCSFLLLLL (MOG_HUMAN)
LSSFLLLLW

SEQ ID NO: 122601 - protein, 9 aa, Artificial Sequence
  Description of Artificial Sequence: Synthetic peptide
  Seed: VSPGVLVLL (MOG_HUMAN)
VTPGVLVLW

SEQ ID NO: 122602 - protein, 10 aa, Artificial Sequence
  Description of Artificial Sequence: Synthetic peptide
  Seed: ATGMEVGWYR (MOG_HUMAN)
AQGMEVGWYK

SEQ ID NO: 122603 - protein, 11 aa, Artificial Sequence
  Description of Artificial Sequence: Synthetic peptide
  Seed: RVPCWKITLFV (MOG_HUMAN)
RLPCWKITLFV

SEQ ID NO: 122604 - protein, 9 aa, Artificial Sequence
  Description of Artificial Sequence: Synthetic peptide
  Seed: TGMEVGWYR (MOG_HUMAN)
TPMEVGWYR

SEQ ID NO: 122605 - protein, 11 aa, Artificial Sequence
  Description of Artificial Sequence: Synthetic peptide
  Seed: KDQDGDQAPEY (MOG_HUMAN)
KAQDGDQAPEF

SEQ ID NO: 122606 - protein, 9 aa, Artificial Sequence
  Description of Artificial Sequence: Synthetic peptide
  Seed: FSDEGGFTC (MOG_HUMAN)
FADEGGFTF

SEQ ID NO: 122607 - protein, 9 aa, Artificial Sequence
  Description of Artificial Sequence: Synthetic peptide
  Seed: VSPGVLVLL (MOG_HUMAN)
VMPGVLVLM

SEQ ID NO: 122608 - protein, 9 aa, Artificial Sequence
  Description of Artificial Sequence: Synthetic peptide
  Seed: SRPSLPSCL (MOG_HUMAN)
SWPSLPSCL

SEQ ID NO: 122609 - protein, 10 aa, Artificial Sequence
  Description of Artificial Sequence: Synthetic peptide
  Seed: FTCFFRDHSY (MOG_HUMAN)
FVCFFRDHSY

SEQ ID NO: 122610 - protein, 9 aa, Artificial Sequence
  Description of Artificial Sequence: Synthetic peptide
  Seed: FSDEGGFTC (MOG_HUMAN)
FLDEGGFTL

SEQ ID NO: 122611 - protein, 9 aa, Artificial Sequence
  Description of Artificial Sequence: Synthetic peptide
  Seed: VSPGVLVLL (MOG_HUMAN)
VSPGVLVLI

SEQ ID NO: 122612 - protein, 10 aa, Artificial Sequence
  Description of Artificial Sequence: Synthetic peptide
  Seed: LLLQITVGLI (MOG_HUMAN)
LMLQITVGLA

SEQ ID NO: 122613 - protein, 9 aa, Artificial Sequence
  Description of Artificial Sequence: Synthetic peptide
  Seed: LLLQVSSSY (MOG_HUMAN)
LALQVSSSF

SEQ ID NO: 122614 - protein, 10 aa, Artificial Sequence
  Description of Artificial Sequence: Synthetic peptide
  Seed: SCLCSFLLLL (MOG_HUMAN)
SLLCSFLLLV

SEQ ID NO: 122615 - protein, 10 aa, Artificial Sequence
  Description of Artificial Sequence: Synthetic peptide
  Seed: LLLQVSSSYA (MOG_HUMAN)
LRLQVSSSYV

SEQ ID NO: 122616 - protein, 10 aa, Artificial Sequence
  Description of Artificial Sequence: Synthetic peptide
  Seed: FSDEGGFTCF (MOG_HUMAN)
FSDEGGFTCW

SEQ ID NO: 122617 - protein, 10 aa, Artificial Sequence
  Description of Artificial Sequence: Synthetic peptide
  Seed: FRVIGPRHPI (MOG_HUMAN)
FPVIGPRHPV

SEQ ID NO: 122618 - protein, 9 aa, Artificial Sequence
  Description of Artificial Sequence: Synthetic peptide
  Seed: VPVLGPLVA (MOG_HUMAN)
VPVLGPLVY

SEQ ID NO: 122619 - protein, 9 aa, Artificial Sequence
  Description of Artificial Sequence: Synthetic peptide
  Seed: ITVGLIFLC (MOG_HUMAN)
IGVGLIFLW

SEQ ID NO: 122620 - protein, 10 aa, Artificial Sequence
  Description of Artificial Sequence: Synthetic peptide
  Seed: SLSRPSLPSC (MOG_HUMAN)
SSSRPSLPSV

SEQ ID NO: 122621 - protein, 9 aa, Artificial Sequence
  Description of Artificial Sequence: Synthetic peptide
  Seed: FYWVSPGVL (MOG_HUMAN)
FKWVSPGVM

SEQ ID NO: 122622 - protein, 9 aa, Artificial Sequence
  Description of Artificial Sequence: Synthetic peptide
  Seed: VIVPVLGPL (MOG_HUMAN)
VLVPVLGPF

SEQ ID NO: 122623 - protein, 8 aa, Artificial Sequence
  Description of Artificial Sequence: Synthetic peptide
  Seed: FSDEGGFT (MOG_HUMAN)
FLDEGGFV

SEQ ID NO: 122624 - protein, 11 aa, Artificial Sequence
  Description of Artificial Sequence: Synthetic peptide
  Seed: VIGPRHPIRAL (MOG_HUMAN)
VPGPRHPIRAM

SEQ ID NO: 122625 - protein, 10 aa, Artificial Sequence
  Description of Artificial Sequence: Synthetic peptide
  Seed: ITLFVIVPVL (MOG_HUMAN)
IHLFVIVPVV

SEQ ID NO: 122626 - protein, 9 aa, Artificial Sequence
  Description of Artificial Sequence: Synthetic peptide
  Seed: LQVSSSYAG (MOG_HUMAN)
LRVSSSYAY

SEQ ID NO: 122627 - protein, 9 aa, Artificial Sequence
  Description of Artificial Sequence: Synthetic peptide
  Seed: FSDEGGFTC (MOG_HUMAN)
FCDEGGFTF

SEQ ID NO: 122628 - protein, 9 aa, Artificial Sequence
  Description of Artificial Sequence: Synthetic peptide
  Seed: MELKVEDPF (MOG_HUMAN)
MALKVEDPY

SEQ ID NO: 122629 - protein, 11 aa, Artificial Sequence
  Description of Artificial Sequence: Synthetic peptide
  Seed: HRTFDPHFLRV (MOG_HUMAN)
HMTFDPHFLRN

SEQ ID NO: 122630 - protein, 9 aa, Artificial Sequence
  Description of Artificial Sequence: Synthetic peptide
  Seed: YRPPFSRVV (MOG_HUMAN)
YAPPFSRVY

SEQ ID NO: 122631 - protein, 9 aa, Artificial Sequence
  Description of Artificial Sequence: Synthetic peptide
  Seed: FLRVPCWKI (MOG_HUMAN)
FMRVPCWKL

SEQ ID NO: 122632 - protein, 10 aa, Artificial Sequence
  Description of Artificial Sequence: Synthetic peptide
  Seed: LVLLAVLPVL (MOG_HUMAN)
LCLLAVLPVL

SEQ ID NO: 122633 - protein, 10 aa, Artificial Sequence
  Description of Artificial Sequence: Synthetic peptide
  Seed: RLAGQFLEEL (MOG_HUMAN)
RMAGQFLEEL

SEQ ID NO: 122634 - protein, 10 aa, Artificial Sequence
  Description of Artificial Sequence: Synthetic peptide
  Seed: FRVIGPRHPI (MOG_HUMAN)
FMVIGPRHPV

SEQ ID NO: 122635 - protein, 9 aa, Artificial Sequence
  Description of Artificial Sequence: Synthetic peptide
  Seed: TELLKDAIG (MOG_HUMAN)
TELLKDAIA

SEQ ID NO: 122636 - protein, 10 aa, Artificial Sequence
  Description of Artificial Sequence: Synthetic peptide
  Seed: FRVIGPRHPI (MOG_HUMAN)
FEVIGPRHPV

SEQ ID NO: 122637 - protein, 10 aa, Artificial Sequence
  Description of Artificial Sequence: Synthetic peptide
  Seed: RLAGQFLEEL (MOG_HUMAN)
RIAGQFLEEW

SEQ ID NO: 122638 - protein, 9 aa, Artificial Sequence
  Description of Artificial Sequence: Synthetic peptide
  Seed: VSSSYAGQF (MOG_HUMAN)
VSSSYAGQM

SEQ ID NO: 122639 - protein, 9 aa, Artificial Sequence
  Description of Artificial Sequence: Synthetic peptide
  Seed: YRPPFSRVV (MOG_HUMAN)
YPPPFSRVL

SEQ ID NO: 122640 - protein, 9 aa, Artificial Sequence
  Description of Artificial Sequence: Synthetic peptide
  Seed: HSYQEEAAM (MOG_HUMAN)
HSYQEEAAW

SEQ ID NO: 122641 - protein, 11 aa, Artificial Sequence
  Description of Artificial Sequence: Synthetic peptide
  Seed: DAIGEGKVTLR (MOG_HUMAN)
DLIGEGKVTLK

SEQ ID NO: 122642 - protein, 10 aa, Artificial Sequence
  Description of Artificial Sequence: Synthetic peptide
  Seed: FDPHFLRVPC (MOG_HUMAN)
FYPHFLRVPF

SEQ ID NO: 122643 - protein, 10 aa, Artificial Sequence
  Description of Artificial Sequence: Synthetic peptide
  Seed: RIRNVRFSDE (MOG_HUMAN)
RTRNVRFSDL

SEQ ID NO: 122644 - protein, 11 aa, Artificial Sequence
  Description of Artificial Sequence: Synthetic peptide
  Seed: FSDEGGFTCFF (MOG_HUMAN)
FYDEGGFTCFL

SEQ ID NO: 122645 - protein, 10 aa, Artificial Sequence
  Description of Artificial Sequence: Synthetic peptide
  Seed: YWVSPGVLVL (MOG_HUMAN)
YQVSPGVLVF

SEQ ID NO: 122646 - protein, 9 aa, Artificial Sequence
  Description of Artificial Sequence: Synthetic peptide
  Seed: RVIGPRHPI (MOG_HUMAN)
RYIGPRHPY

SEQ ID NO: 122647 - protein, 10 aa, Artificial Sequence
  Description of Artificial Sequence: Synthetic peptide
  Seed: LLLQITVGLI (MOG_HUMAN)
LLLQITVGLL

SEQ ID NO: 122648 - protein, 10 aa, Artificial Sequence
  Description of Artificial Sequence: Synthetic peptide
  Seed: RTFDPHFLRV (MOG_HUMAN)
REFDPHFLRM

SEQ ID NO: 122649 - protein, 10 aa, Artificial Sequence
  Description of Artificial Sequence: Synthetic peptide
  Seed: MEVGWYRPPF (MOG_HUMAN)
MIVGWYRPPF

SEQ ID NO: 122650 - protein, 8 aa, Artificial Sequence
  Description of Artificial Sequence: Synthetic peptide
  Seed: VIGPRHPI (MOG_HUMAN)
VAGPRHPL

SEQ ID NO: 122651 - protein, 9 aa, Artificial Sequence
  Description of Artificial Sequence: Synthetic peptide
  Seed: HSYQEEAAM (MOG_HUMAN)
HTYQEEAAL

SEQ ID NO: 122652 - protein, 10 aa, Artificial Sequence
  Description of Artificial Sequence: Synthetic peptide
  Seed: VIVPVLGPLV (MOG_HUMAN)
VMVPVLGPLL

SEQ ID NO: 122653 - protein, 8 aa, Artificial Sequence
  Description of Artificial Sequence: Synthetic peptide
  Seed: VLGPLVAL (MOG_HUMAN)
VLGPLVAV

SEQ ID NO: 122654 - protein, 10 aa, Artificial Sequence
  Description of Artificial Sequence: Synthetic peptide
  Seed: LSRPSLPSCL (MOG_HUMAN)
LSRPSLPSCY

SEQ ID NO: 122655 - protein, 9 aa, Artificial Sequence
  Description of Artificial Sequence: Synthetic peptide
  Seed: LLAVLPVLL (MOG_HUMAN)
LMAVLPVLI

SEQ ID NO: 122656 - protein, 9 aa, Artificial Sequence
  Description of Artificial Sequence: Synthetic peptide
  Seed: MASLSRPSL (MOG_HUMAN)
MASLSRPSI

SEQ ID NO: 122657 - protein, 10 aa, Artificial Sequence
  Description of Artificial Sequence: Synthetic peptide
  Seed: SFLLLLLLQV (MOG_HUMAN)
SVLLLLLLQV

SEQ ID NO: 122658 - protein, 9 aa, Artificial Sequence
  Description of Artificial Sequence: Synthetic peptide
  Seed: LAGQFLEEL (MOG_HUMAN)
LTGQFLEEV

SEQ ID NO: 122659 - protein, 9 aa, Artificial Sequence
  Description of Artificial Sequence: Synthetic peptide
  Seed: SDEGGFTCF (MOG_HUMAN)
SLEGGFTCY

SEQ ID NO: 122660 - protein, 11 aa, Artificial Sequence
  Description of Artificial Sequence: Synthetic peptide
  Seed: LLLLLQVSSSY (MOG_HUMAN)
LQLLLQVSSSF

SEQ ID NO: 122661 - protein, 10 aa, Artificial Sequence
  Description of Artificial Sequence: Synthetic peptide
  Seed: DEGGFTCFFR (MOG_HUMAN)
DVGGFTCFFR

SEQ ID NO: 122662 - protein, 10 aa, Artificial Sequence
  Description of Artificial Sequence: Synthetic peptide
  Seed: IGPRHPIRAL (MOG_HUMAN)
IIPRHPIRAF

SEQ ID NO: 122663 - protein, 10 aa, Artificial Sequence
  Description of Artificial Sequence: Synthetic peptide
  Seed: SCLCSFLLLL (MOG_HUMAN)
SVLCSFLLLI

SEQ ID NO: 122664 - protein, 10 aa, Artificial Sequence
  Description of Artificial Sequence: Synthetic peptide
  Seed: TGMEVGWYRP (MOG_HUMAN)
TFMEVGWYRS

SEQ ID NO: 122665 - protein, 9 aa, Artificial Sequence
  Description of Artificial Sequence: Synthetic peptide
  Seed: YRPPFSRVV (MOG_HUMAN)
YSPPFSRVL

SEQ ID NO: 122666 - protein, 9 aa, Artificial Sequence
  Description of Artificial Sequence: Synthetic peptide
  Seed: GQFRVIGPR (MOG_HUMAN)
GMFRVIGPK

SEQ ID NO: 122667 - protein, 10 aa, Artificial Sequence
  Description of Artificial Sequence: Synthetic peptide
  Seed: YQEEAAMELK (MOG_HUMAN)
YTEEAAMELY

SEQ ID NO: 122668 - protein, 10 aa, Artificial Sequence
  Description of Artificial Sequence: Synthetic peptide
  Seed: VLLLQITVGL (MOG_HUMAN)
VELLQITVGL

SEQ ID NO: 122669 - protein, 10 aa, Artificial Sequence
  Description of Artificial Sequence: Synthetic peptide
  Seed: PPFSRVVHLY (MOG_HUMAN)
PFFSRVVHLY

SEQ ID NO: 122670 - protein, 10 aa, Artificial Sequence
  Description of Artificial Sequence: Synthetic peptide
  Seed: RTFDPHFLRV (MOG_HUMAN)
RYFDPHFLRD

SEQ ID NO: 122671 - protein, 10 aa, Artificial Sequence
  Description of Artificial Sequence: Synthetic peptide
  Seed: LLKDAIGEGK (MOG_HUMAN)
LVKDAIGEGY

SEQ ID NO: 122672 - protein, 9 aa, Artificial Sequence
  Description of Artificial Sequence: Synthetic peptide
  Seed: YQEEAAMEL (MOG_HUMAN)
YVEEAAMEV

SEQ ID NO: 122673 - protein, 9 aa, Artificial Sequence
  Description of Artificial Sequence: Synthetic peptide
  Seed: LLLQVSSSY (MOG_HUMAN)
LYLQVSSSY

SEQ ID NO: 122674 - protein, 9 aa, Artificial Sequence
  Description of Artificial Sequence: Synthetic peptide
  Seed: RVVHLYRNG (MOG_HUMAN)
RMVHLYRNK

SEQ ID NO: 122675 - protein, 10 aa, Artificial Sequence
  Description of Artificial Sequence: Synthetic peptide
  Seed: FTCFFRDHSY (MOG_HUMAN)
FPCFFRDHSY

SEQ ID NO: 122676 - protein, 11 aa, Artificial Sequence
  Description of Artificial Sequence: Synthetic peptide
  Seed: RLAGQFLEELR (MOG_HUMAN)
RMAGQFLEELL

SEQ ID NO: 122677 - protein, 10 aa, Artificial Sequence
  Description of Artificial Sequence: Synthetic peptide
  Seed: RTFDPHFLRV (MOG_HUMAN)
RVFDPHFLRS

SEQ ID NO: 122678 - protein, 10 aa, Artificial Sequence
  Description of Artificial Sequence: Synthetic peptide
  Seed: VLLLQITVGL (MOG_HUMAN)
VVLLQITVGL

SEQ ID NO: 122679 - protein, 10 aa, Artificial Sequence
  Description of Artificial Sequence: Synthetic peptide
  Seed: RALVGDEVEL (MOG_HUMAN)
RMLVGDEVEM

SEQ ID NO: 122680 - protein, 10 aa, Artificial Sequence
  Description of Artificial Sequence: Synthetic peptide
  Seed: RTFDPHFLRV (MOG_HUMAN)
RYFDPHFLRH

SEQ ID NO: 122681 - protein, 9 aa, Artificial Sequence
  Description of Artificial Sequence: Synthetic peptide
  Seed: YQEEAAMEL (MOG_HUMAN)
YHEEAAMEM

SEQ ID NO: 122682 - protein, 10 aa, Artificial Sequence
  Description of Artificial Sequence: Synthetic peptide
  Seed: GPRHPIRALV (MOG_HUMAN)
GPRHPIRALF

SEQ ID NO: 122683 - protein, 9 aa, Artificial Sequence
  Description of Artificial Sequence: Synthetic peptide
  Seed: SCLCSFLLL (MOG_HUMAN)
SILCSFLLL

SEQ ID NO: 122684 - protein, 10 aa, Artificial Sequence
  Description of Artificial Sequence: Synthetic peptide
  Seed: VIVPVLGPLV (MOG_HUMAN)
VMVPVLGPLV

SEQ ID NO: 122685 - protein, 10 aa, Artificial Sequence
  Description of Artificial Sequence: Synthetic peptide
  Seed: SSYAGQFRVI (MOG_HUMAN)
SQYAGQFRVF

SEQ ID NO: 122686 - protein, 9 aa, Artificial Sequence
  Description of Artificial Sequence: Synthetic peptide
  Seed: IICYNWLHR (MOG_HUMAN)
IMCYNWLHR

SEQ ID NO: 122687 - protein, 9 aa, Artificial Sequence
  Description of Artificial Sequence: Synthetic peptide
  Seed: VIVPVLGPL (MOG_HUMAN)
VSVPVLGPM

SEQ ID NO: 122688 - protein, 9 aa, Artificial Sequence
  Description of Artificial Sequence: Synthetic peptide
  Seed: LLLQVSSSY (MOG_HUMAN)
LKLQVSSSY

SEQ ID NO: 122689 - protein, 10 aa, Artificial Sequence
  Description of Artificial Sequence: Synthetic peptide
  Seed: LSRPSLPSCL (MOG_HUMAN)
LTRPSLPSCF

SEQ ID NO: 122690 - protein, 9 aa, Artificial Sequence
  Description of Artificial Sequence: Synthetic peptide
  Seed: WVSPGVLVL (MOG_HUMAN)
WPSPGVLVH

SEQ ID NO: 122691 - protein, 9 aa, Artificial Sequence
  Description of Artificial Sequence: Synthetic peptide
  Seed: FLEELRNPF (MOG_HUMAN)
FTEELRNPL

SEQ ID NO: 122692 - protein, 9 aa, Artificial Sequence
  Description of Artificial Sequence: Synthetic peptide
  Seed: SSYAGQFRV (MOG_HUMAN)
SQYAGQFRW

SEQ ID NO: 122693 - protein, 9 aa, Artificial Sequence
  Description of Artificial Sequence: Synthetic peptide
  Seed: FSDEGGFTC (MOG_HUMAN)
FQDEGGFTM

SEQ ID NO: 122694 - protein, 9 aa, Artificial Sequence
  Description of Artificial Sequence: Synthetic peptide
  Seed: LVLLAVLPV (MOG_HUMAN)
LLLLAVLPA

SEQ ID NO: 122695 - protein, 11 aa, Artificial Sequence
  Description of Artificial Sequence: Synthetic peptide
  Seed: FSDEGGFTCFF (MOG_HUMAN)
FSDEGGFTCFY

SEQ ID NO: 122696 - protein, 10 aa, Artificial Sequence
  Description of Artificial Sequence: Synthetic peptide
  Seed: SLSRPSLPSC (MOG_HUMAN)
SSSRPSLPSA

SEQ ID NO: 122697 - protein, 9 aa, Artificial Sequence
  Description of Artificial Sequence: Synthetic peptide
  Seed: RVIGPRHPI (MOG_HUMAN)
RIIGPRHPM

SEQ ID NO: 122698 - protein, 9 aa, Artificial Sequence
  Description of Artificial Sequence: Synthetic peptide
  Seed: RVPCWKITL (MOG_HUMAN)
RMPCWKITR

SEQ ID NO: 122699 - protein, 10 aa, Artificial Sequence
  Description of Artificial Sequence: Synthetic peptide
  Seed: FDPHFLRVPC (MOG_HUMAN)
FCPHFLRVPI

SEQ ID NO: 122700 - protein, 9 aa, Artificial Sequence
  Description of Artificial Sequence: Synthetic peptide
  Seed: YWVSPGVLV (MOG_HUMAN)
YRVSPGVLY

SEQ ID NO: 122701 - protein, 9 aa, Artificial Sequence
  Description of Artificial Sequence: Synthetic peptide
  Seed: KDAIGEGKV (MOG_HUMAN)
KEAIGEGKV

SEQ ID NO: 122702 - protein, 10 aa, Artificial Sequence
  Description of Artificial Sequence: Synthetic peptide
  Seed: LQITVGLIFL (MOG_HUMAN)
LQITVGLIFW

SEQ ID NO: 122703 - protein, 9 aa, Artificial Sequence
  Description of Artificial Sequence: Synthetic peptide
  Seed: RVIGPRHPI (MOG_HUMAN)
RFIGPRHPL

SEQ ID NO: 122704 - protein, 10 aa, Artificial Sequence
  Description of Artificial Sequence: Synthetic peptide
  Seed: RTFDPHFLRV (MOG_HUMAN)
RLFDPHFLRW

SEQ ID NO: 122705 - protein, 10 aa, Artificial Sequence
  Description of Artificial Sequence: Synthetic peptide
  Seed: SSYAGQFRVI (MOG_HUMAN)
SQYAGQFRVW

SEQ ID NO: 122706 - protein, 9 aa, Artificial Sequence
  Description of Artificial Sequence: Synthetic peptide
  Seed: IGEGKVTLR (MOG_HUMAN)
ITEGKVTLR

SEQ ID NO: 122707 - protein, 10 aa, Artificial Sequence
  Description of Artificial Sequence: Synthetic peptide
  Seed: LVLLAVLPVL (MOG_HUMAN)
LPLLAVLPVL

SEQ ID NO: 122708 - protein, 9 aa, Artificial Sequence
  Description of Artificial Sequence: Synthetic peptide
  Seed: KVTLRIRNV (MOG_HUMAN)
KLTLRIRNV

SEQ ID NO: 122709 - protein, 9 aa, Artificial Sequence
  Description of Artificial Sequence: Synthetic peptide
  Seed: VSPGVLVLL (MOG_HUMAN)
VRPGVLVLY

SEQ ID NO: 122710 - protein, 8 aa, Artificial Sequence
  Description of Artificial Sequence: Synthetic peptide
  Seed: LLAVLPVL (MOG_HUMAN)
LQAVLPVL

SEQ ID NO: 122711 - protein, 10 aa, Artificial Sequence
  Description of Artificial Sequence: Synthetic peptide
  Seed: VLLAVLPVLL (MOG_HUMAN)
VQLAVLPVLV

SEQ ID NO: 122712 - protein, 10 aa, Artificial Sequence
  Description of Artificial Sequence: Synthetic peptide
  Seed: YWVSPGVLVL (MOG_HUMAN)
YVVSPGVLVF

SEQ ID NO: 122713 - protein, 9 aa, Artificial Sequence
  Description of Artificial Sequence: Synthetic peptide
  Seed: KLRAEIENL (MOG_HUMAN)
KVRAEIENW

SEQ ID NO: 122714 - protein, 10 aa, Artificial Sequence
  Description of Artificial Sequence: Synthetic peptide
  Seed: SSYAGQFRVI (MOG_HUMAN)
SSYAGQFRVW

SEQ ID NO: 122715 - protein, 9 aa, Artificial Sequence
  Description of Artificial Sequence: Synthetic peptide
  Seed: VGDEVELPC (MOG_HUMAN)
VNDEVELPL

SEQ ID NO: 122716 - protein, 9 aa, Artificial Sequence
  Description of Artificial Sequence: Synthetic peptide
  Seed: LAGQFLEEL (MOG_HUMAN)
LVGQFLEEA

SEQ ID NO: 122717 - protein, 10 aa, Artificial Sequence
  Description of Artificial Sequence: Synthetic peptide
  Seed: VSSSYAGQFR (MOG_HUMAN)
VASSYAGQFR

SEQ ID NO: 122718 - protein, 9 aa, Artificial Sequence
  Description of Artificial Sequence: Synthetic peptide
  Seed: SLPSCLCSF (MOG_HUMAN)
SMPSCLCSM

SEQ ID NO: 122719 - protein, 10 aa, Artificial Sequence
  Description of Artificial Sequence: Synthetic peptide
  Seed: RLRGKLRAEI (MOG_HUMAN)
RSRGKLRAEV

SEQ ID NO: 122720 - protein, 10 aa, Artificial Sequence
  Description of Artificial Sequence: Synthetic peptide
  Seed: YWVSPGVLVL (MOG_HUMAN)
YYVSPGVLVF

SEQ ID NO: 122721 - protein, 9 aa, Artificial Sequence
  Description of Artificial Sequence: Synthetic peptide
  Seed: WVSPGVLVL (MOG_HUMAN)
WMSPGVLVW

SEQ ID NO: 122722 - protein, 11 aa, Artificial Sequence
  Description of Artificial Sequence: Synthetic peptide
  Seed: LQVSSSYAGQF (MOG_HUMAN)
LTVSSSYAGQW

SEQ ID NO: 122723 - protein, 11 aa, Artificial Sequence
  Description of Artificial Sequence: Synthetic peptide
  Seed: RVIGPRHPIRA (MOG_HUMAN)
RTIGPRHPIRR

SEQ ID NO: 122724 - protein, 9 aa, Artificial Sequence
  Description of Artificial Sequence: Synthetic peptide
  Seed: TGMEVGWYR (MOG_HUMAN)
TLMEVGWYK

SEQ ID NO: 122725 - protein, 9 aa, Artificial Sequence
  Description of Artificial Sequence: Synthetic peptide
  Seed: VSPGVLVLL (MOG_HUMAN)
VPPGVLVLV

SEQ ID NO: 122726 - protein, 10 aa, Artificial Sequence
  Description of Artificial Sequence: Synthetic peptide
  Seed: LIICYNWLHR (MOG_HUMAN)
LWICYNWLHR

SEQ ID NO: 122727 - protein, 9 aa, Artificial Sequence
  Description of Artificial Sequence: Synthetic peptide
  Seed: FLEELRNPF (MOG_HUMAN)
FMEELRNPF

SEQ ID NO: 122728 - protein, 10 aa, Artificial Sequence
  Description of Artificial Sequence: Synthetic peptide
  Seed: FDPHFLRVPC (MOG_HUMAN)
FMPHFLRVPV

SEQ ID NO: 122729 - protein, 10 aa, Artificial Sequence
  Description of Artificial Sequence: Synthetic peptide
  Seed: AEIENLHRTF (MOG_HUMAN)
AEIENLHRTV

SEQ ID NO: 122730 - protein, 9 aa, Artificial Sequence
  Description of Artificial Sequence: Synthetic peptide
  Seed: DGDQAPEYR (MOG_HUMAN)
DMDQAPEYY

SEQ ID NO: 122731 - protein, 9 aa, Artificial Sequence
  Description of Artificial Sequence: Synthetic peptide
  Seed: EGGFTCFFR (MOG_HUMAN)
EYGFTCFFR

SEQ ID NO: 122732 - protein, 9 aa, Artificial Sequence
  Description of Artificial Sequence: Synthetic peptide
  Seed: LHRTFDPHF (MOG_HUMAN)
LMRTFDPHY

SEQ ID NO: 122733 - protein, 9 aa, Artificial Sequence
  Description of Artificial Sequence: Synthetic peptide
  Seed: YQEEAAMEL (MOG_HUMAN)
YHEEAAMEF

SEQ ID NO: 122734 - protein, 8 aa, Artificial Sequence
  Description of Artificial Sequence: Synthetic peptide
  Seed: AVLPVLLL (MOG_HUMAN)
AQLPVLLI

SEQ ID NO: 122735 - protein, 9 aa, Artificial Sequence
  Description of Artificial Sequence: Synthetic peptide
  Seed: LQVSSSYAG (MOG_HUMAN)
LTVSSSYAM

SEQ ID NO: 122736 - protein, 10 aa, Artificial Sequence
  Description of Artificial Sequence: Synthetic peptide
  Seed: MEVGWYRPPF (MOG_HUMAN)
MHVGWYRPPY

SEQ ID NO: 122737 - protein, 9 aa, Artificial Sequence
  Description of Artificial Sequence: Synthetic peptide
  Seed: RVIGPRHPI (MOG_HUMAN)
RPIGPRHPA

SEQ ID NO: 122738 - protein, 10 aa, Artificial Sequence
  Description of Artificial Sequence: Synthetic peptide
  Seed: LVLLAVLPVL (MOG_HUMAN)
LELLAVLPVL

SEQ ID NO: 122739 - protein, 9 aa, Artificial Sequence
  Description of Artificial Sequence: Synthetic peptide
  Seed: RIRNVRFSD (MOG_HUMAN)
RTRNVRFSA

SEQ ID NO: 122740 - protein, 10 aa, Artificial Sequence
  Description of Artificial Sequence: Synthetic peptide
  Seed: FRVIGPRHPI (MOG_HUMAN)
FYVIGPRHPI

SEQ ID NO: 122741 - protein, 9 aa, Artificial Sequence
  Description of Artificial Sequence: Synthetic peptide
  Seed: YQEEAAMEL (MOG_HUMAN)
YFEEAAMEF

SEQ ID NO: 122742 - protein, 11 aa, Artificial Sequence
  Description of Artificial Sequence: Synthetic peptide
  Seed: FSDEGGFTCFF (MOG_HUMAN)
FADEGGFTCFV

SEQ ID NO: 122743 - protein, 9 aa, Artificial Sequence
  Description of Artificial Sequence: Synthetic peptide
  Seed: LKVEDPFYW (MOG_HUMAN)
LTVEDPFYW

SEQ ID NO: 122744 - protein, 10 aa, Artificial Sequence
  Description of Artificial Sequence: Synthetic peptide
  Seed: RTFDPHFLRV (MOG_HUMAN)
RSFDPHFLRV

SEQ ID NO: 122745 - protein, 10 aa, Artificial Sequence
  Description of Artificial Sequence: Synthetic peptide
  Seed: RTFDPHFLRV (MOG_HUMAN)
RFFDPHFLRK

SEQ ID NO: 122746 - protein, 10 aa, Artificial Sequence
  Description of Artificial Sequence: Synthetic peptide
  Seed: LLLQVSSSYA (MOG_HUMAN)
LILQVSSSYY

SEQ ID NO: 122747 - protein, 10 aa, Artificial Sequence
  Description of Artificial Sequence: Synthetic peptide
  Seed: LLLQVSSSYA (MOG_HUMAN)
LPLQVSSSYV

SEQ ID NO: 122748 - protein, 9 aa, Artificial Sequence
  Description of Artificial Sequence: Synthetic peptide
  Seed: TFDPHFLRV (MOG_HUMAN)
TMDPHFLRW

SEQ ID NO: 122749 - protein, 9 aa, Artificial Sequence
  Description of Artificial Sequence: Synthetic peptide
  Seed: FLLLLLLQV (MOG_HUMAN)
FTLLLLLQL

SEQ ID NO: 122750 - protein, 9 aa, Artificial Sequence
  Description of Artificial Sequence: Synthetic peptide
  Seed: TFDPHFLRV (MOG_HUMAN)
TPDPHFLRM

SEQ ID NO: 122751 - protein, 9 aa, Artificial Sequence
  Description of Artificial Sequence: Synthetic peptide
  Seed: TFDPHFLRV (MOG_HUMAN)
TLDPHFLRW

SEQ ID NO: 122752 - protein, 9 aa, Artificial Sequence
  Description of Artificial Sequence: Synthetic peptide
  Seed: RIRNVRFSD (MOG_HUMAN)
RNRNVRFSA

SEQ ID NO: 122753 - protein, 9 aa, Artificial Sequence
  Description of Artificial Sequence: Synthetic peptide
  Seed: FYWVSPGVL (MOG_HUMAN)
FFWVSPGVV

SEQ ID NO: 122754 - protein, 9 aa, Artificial Sequence
  Description of Artificial Sequence: Synthetic peptide
  Seed: RPPFSRVVH (MOG_HUMAN)
RPPFSRVVV

SEQ ID NO: 122755 - protein, 10 aa, Artificial Sequence
  Description of Artificial Sequence: Synthetic peptide
  Seed: FDPHFLRVPC (MOG_HUMAN)
FYPHFLRVPT

SEQ ID NO: 122756 - protein, 9 aa, Artificial Sequence
  Description of Artificial Sequence: Synthetic peptide
  Seed: VPVLGPLVA (MOG_HUMAN)
VAVLGPLVW

SEQ ID NO: 122757 - protein, 9 aa, Artificial Sequence
  Description of Artificial Sequence: Synthetic peptide
  Seed: SYAGQFRVI (MOG_HUMAN)
SYAGQFRVM

SEQ ID NO: 122758 - protein, 10 aa, Artificial Sequence
  Description of Artificial Sequence: Synthetic peptide
  Seed: MELKVEDPFY (MOG_HUMAN)
MQLKVEDPFF

SEQ ID NO: 122759 - protein, 10 aa, Artificial Sequence
  Description of Artificial Sequence: Synthetic peptide
  Seed: AEIENLHRTF (MOG_HUMAN)
ASIENLHRTY

SEQ ID NO: 122760 - protein, 10 aa, Artificial Sequence
  Description of Artificial Sequence: Synthetic peptide
  Seed: FSDEGGFTCF (MOG_HUMAN)
FCDEGGFTCM

SEQ ID NO: 122761 - protein, 10 aa, Artificial Sequence
  Description of Artificial Sequence: Synthetic peptide
  Seed: HRTFDPHFLR (MOG_HUMAN)
HSTFDPHFLY

SEQ ID NO: 122762 - protein, 10 aa, Artificial Sequence
  Description of Artificial Sequence: Synthetic peptide
  Seed: VLGPLVALII (MOG_HUMAN)
VMGPLVALIL

SEQ ID NO: 122763 - protein, 10 aa, Artificial Sequence
  Description of Artificial Sequence: Synthetic peptide
  Seed: ATGMEVGWYR (MOG_HUMAN)
ASGMEVGWYK

SEQ ID NO: 122764 - protein, 9 aa, Artificial Sequence
  Description of Artificial Sequence: Synthetic peptide
  Seed: VSPGVLVLL (MOG_HUMAN)
VYPGVLVLF

SEQ ID NO: 122765 - protein, 9 aa, Artificial Sequence
  Description of Artificial Sequence: Synthetic peptide
  Seed: RRLAGQFLE (MOG_HUMAN)
RRLAGQFLL

SEQ ID NO: 122766 - protein, 10 aa, Artificial Sequence
  Description of Artificial Sequence: Synthetic peptide
  Seed: ITLFVIVPVL (MOG_HUMAN)
ITLFVIVPVV

SEQ ID NO: 122767 - protein, 10 aa, Artificial Sequence
  Description of Artificial Sequence: Synthetic peptide
  Seed: YQEEAAMELK (MOG_HUMAN)
YLEEAAMELY

SEQ ID NO: 122768 - protein, 10 aa, Artificial Sequence
  Description of Artificial Sequence: Synthetic peptide
  Seed: LLLQVSSSYA (MOG_HUMAN)
LFLQVSSSYL

SEQ ID NO: 122769 - protein, 9 aa, Artificial Sequence
  Description of Artificial Sequence: Synthetic peptide
  Seed: LLLQITVGL (MOG_HUMAN)
LLLQITVGI

SEQ ID NO: 122770 - protein, 10 aa, Artificial Sequence
  Description of Artificial Sequence: Synthetic peptide
  Seed: SYQEEAAMEL (MOG_HUMAN)
SYQEEAAMEM

SEQ ID NO: 122771 - protein, 9 aa, Artificial Sequence
  Description of Artificial Sequence: Synthetic peptide
  Seed: RVPCWKITL (MOG_HUMAN)
RIPCWKITF

SEQ ID NO: 122772 - protein, 9 aa, Artificial Sequence
  Description of Artificial Sequence: Synthetic peptide
  Seed: FSRVVHLYR (MOG_HUMAN)
FGRVVHLYR

SEQ ID NO: 122773 - protein, 9 aa, Artificial Sequence
  Description of Artificial Sequence: Synthetic peptide
  Seed: MASLSRPSL (MOG_HUMAN)
MGSLSRPSY

SEQ ID NO: 122774 - protein, 10 aa, Artificial Sequence
  Description of Artificial Sequence: Synthetic peptide
  Seed: LLQITVGLIF (MOG_HUMAN)
LGQITVGLIY

SEQ ID NO: 122775 - protein, 9 aa, Artificial Sequence
  Description of Artificial Sequence: Synthetic peptide
  Seed: RIRNVRFSD (MOG_HUMAN)
RFRNVRFSS

SEQ ID NO: 122776 - protein, 9 aa, Artificial Sequence
  Description of Artificial Sequence: Synthetic peptide
  Seed: DEVELPCRI (MOG_HUMAN)
DEVELPCRM

SEQ ID NO: 122777 - protein, 10 aa, Artificial Sequence
  Description of Artificial Sequence: Synthetic peptide
  Seed: SLSRPSLPSC (MOG_HUMAN)
SRSRPSLPSM

SEQ ID NO: 122778 - protein, 9 aa, Artificial Sequence
  Description of Artificial Sequence: Synthetic peptide
  Seed: IVPVLGPLV (MOG_HUMAN)
IAPVLGPLY

SEQ ID NO: 122779 - protein, 9 aa, Artificial Sequence
  Description of Artificial Sequence: Synthetic peptide
  Seed: HRTFDPHFL (MOG_HUMAN)
HRTFDPHFF

SEQ ID NO: 122780 - protein, 9 aa, Artificial Sequence
  Description of Artificial Sequence: Synthetic peptide
  Seed: VLGPLVALI (MOG_HUMAN)
VIGPLVALA

SEQ ID NO: 122781 - protein, 9 aa, Artificial Sequence
  Description of Artificial Sequence: Synthetic peptide
  Seed: LAGQFLEEL (MOG_HUMAN)
LLGQFLEEF

SEQ ID NO: 122782 - protein, 9 aa, Artificial Sequence
  Description of Artificial Sequence: Synthetic peptide
  Seed: FSDEGGFTC (MOG_HUMAN)
FNDEGGFTM

SEQ ID NO: 122783 - protein, 10 aa, Artificial Sequence
  Description of Artificial Sequence: Synthetic peptide
  Seed: WVSPGVLVLL (MOG_HUMAN)
WISPGVLVLM

SEQ ID NO: 122784 - protein, 11 aa, Artificial Sequence
  Description of Artificial Sequence: Synthetic peptide
  Seed: LHRTFDPHFLR (MOG_HUMAN)
LIRTFDPHFLK

SEQ ID NO: 122785 - protein, 9 aa, Artificial Sequence
  Description of Artificial Sequence: Synthetic peptide
  Seed: RIRNVRFSD (MOG_HUMAN)
RLRNVRFSA

SEQ ID NO: 122786 - protein, 10 aa, Artificial Sequence
  Description of Artificial Sequence: Synthetic peptide
  Seed: YWVSPGVLVL (MOG_HUMAN)
YKVSPGVLVY

SEQ ID NO: 122787 - protein, 11 aa, Artificial Sequence
  Description of Artificial Sequence: Synthetic peptide
  Seed: KDQDGDQAPEY (MOG_HUMAN)
KVQDGDQAPEY

SEQ ID NO: 122788 - protein, 10 aa, Artificial Sequence
  Description of Artificial Sequence: Synthetic peptide
  Seed: RLRGKLRAEI (MOG_HUMAN)
RTRGKLRAEM

SEQ ID NO: 122789 - protein, 9 aa, Artificial Sequence
  Description of Artificial Sequence: Synthetic peptide
  Seed: SLPSCLCSF (MOG_HUMAN)
SQPSCLCSY

SEQ ID NO: 122790 - protein, 10 aa, Artificial Sequence
  Description of Artificial Sequence: Synthetic peptide
  Seed: TGMEVGWYRP (MOG_HUMAN)
TQMEVGWYRR

SEQ ID NO: 122791 - protein, 9 aa, Artificial Sequence
  Description of Artificial Sequence: Synthetic peptide
  Seed: MASLSRPSL (MOG_HUMAN)
MHSLSRPSL

SEQ ID NO: 122792 - protein, 9 aa, Artificial Sequence
  Description of Artificial Sequence: Synthetic peptide
  Seed: FLLLLLLQV (MOG_HUMAN)
FQLLLLLQL

SEQ ID NO: 122793 - protein, 11 aa, Artificial Sequence
  Description of Artificial Sequence: Synthetic peptide
  Seed: HSYQEEAAMEL (MOG_HUMAN)
HTYQEEAAMEY

SEQ ID NO: 122794 - protein, 9 aa, Artificial Sequence
  Description of Artificial Sequence: Synthetic peptide
  Seed: TFDPHFLRV (MOG_HUMAN)
TYDPHFLRY

SEQ ID NO: 122795 - protein, 11 aa, Artificial Sequence
  Description of Artificial Sequence: Synthetic peptide
  Seed: RIRNVRFSDEG (MOG_HUMAN)
RSRNVRFSDEK

SEQ ID NO: 122796 - protein, 10 aa, Artificial Sequence
  Description of Artificial Sequence: Synthetic peptide
  Seed: SLSRPSLPSC (MOG_HUMAN)
SISRPSLPSV

SEQ ID NO: 122797 - protein, 9 aa, Artificial Sequence
  Description of Artificial Sequence: Synthetic peptide
  Seed: RVPCWKITL (MOG_HUMAN)
RMPCWKITI

SEQ ID NO: 122798 - protein, 10 aa, Artificial Sequence
  Description of Artificial Sequence: Synthetic peptide
  Seed: RTFDPHFLRV (MOG_HUMAN)
RQFDPHFLRM

SEQ ID NO: 122799 - protein, 9 aa, Artificial Sequence
  Description of Artificial Sequence: Synthetic peptide
  Seed: RRLAGQFLE (MOG_HUMAN)
RMLAGQFLL

SEQ ID NO: 122800 - protein, 9 aa, Artificial Sequence
  Description of Artificial Sequence: Synthetic peptide
  Seed: RIRNVRFSD (MOG_HUMAN)
RIRNVRFSC

SEQ ID NO: 122801 - protein, 10 aa, Artificial Sequence
  Description of Artificial Sequence: Synthetic peptide
  Seed: RTFDPHFLRV (MOG_HUMAN)
RMFDPHFLRT

SEQ ID NO: 122802 - protein, 9 aa, Artificial Sequence
  Description of Artificial Sequence: Synthetic peptide
  Seed: RTFDPHFLR (MOG_HUMAN)
RSFDPHFLK

SEQ ID NO: 122803 - protein, 10 aa, Artificial Sequence
  Description of Artificial Sequence: Synthetic peptide
  Seed: VGWYRPPFSR (MOG_HUMAN)
VNWYRPPFSR

SEQ ID NO: 122804 - protein, 9 aa, Artificial Sequence
  Description of Artificial Sequence: Synthetic peptide
  Seed: HSYQEEAAM (MOG_HUMAN)
HNYQEEAAY

SEQ ID NO: 122805 - protein, 9 aa, Artificial Sequence
  Description of Artificial Sequence: Synthetic peptide
  Seed: SRPSLPSCL (MOG_HUMAN)
SQPSLPSCF

SEQ ID NO: 122806 - protein, 10 aa, Artificial Sequence
  Description of Artificial Sequence: Synthetic peptide
  Seed: YWVSPGVLVL (MOG_HUMAN)
YDVSPGVLVF

SEQ ID NO: 122807 - protein, 10 aa, Artificial Sequence
  Description of Artificial Sequence: Synthetic peptide
  Seed: RTFDPHFLRV (MOG_HUMAN)
RNFDPHFLRW

SEQ ID NO: 122808 - protein, 9 aa, Artificial Sequence
  Description of Artificial Sequence: Synthetic peptide
  Seed: RTFDPHFLR (MOG_HUMAN)
RVFDPHFLW

SEQ ID NO: 122809 - protein, 9 aa, Artificial Sequence
  Description of Artificial Sequence: Synthetic peptide
  Seed: FLRVPCWKI (MOG_HUMAN)
FMRVPCWKA

SEQ ID NO: 122810 - protein, 9 aa, Artificial Sequence
  Description of Artificial Sequence: Synthetic peptide
  Seed: TFDPHFLRV (MOG_HUMAN)
TADPHFLRT

SEQ ID NO: 122811 - protein, 10 aa, Artificial Sequence
  Description of Artificial Sequence: Synthetic peptide
  Seed: ATGMEVGWYR (MOG_HUMAN)
ANGMEVGWYR

SEQ ID NO: 122812 - protein, 10 aa, Artificial Sequence
  Description of Artificial Sequence: Synthetic peptide
  Seed: GLIFLCLQYR (MOG_HUMAN)
GCIFLCLQYR

SEQ ID NO: 122813 - protein, 10 aa, Artificial Sequence
  Description of Artificial Sequence: Synthetic peptide
  Seed: ITVGLIFLCL (MOG_HUMAN)
ISVGLIFLCF

SEQ ID NO: 122814 - protein, 10 aa, Artificial Sequence
  Description of Artificial Sequence: Synthetic peptide
  Seed: IGPRHPIRAL (MOG_HUMAN)
IHPRHPIRAM

SEQ ID NO: 122815 - protein, 9 aa, Artificial Sequence
  Description of Artificial Sequence: Synthetic peptide
  Seed: SCLCSFLLL (MOG_HUMAN)
STLCSFLLV

SEQ ID NO: 122816 - protein, 9 aa, Artificial Sequence
  Description of Artificial Sequence: Synthetic peptide
  Seed: FYWVSPGVL (MOG_HUMAN)
FMWVSPGVM

SEQ ID NO: 122817 - protein, 9 aa, Artificial Sequence
  Description of Artificial Sequence: Synthetic peptide
  Seed: TFDPHFLRV (MOG_HUMAN)
TIDPHFLRC

SEQ ID NO: 122818 - protein, 9 aa, Artificial Sequence
  Description of Artificial Sequence: Synthetic peptide
  Seed: FYWVSPGVL (MOG_HUMAN)
FSWVSPGVY

SEQ ID NO: 122819 - protein, 9 aa, Artificial Sequence
  Description of Artificial Sequence: Synthetic peptide
  Seed: AIGEGKVTL (MOG_HUMAN)
AIGEGKVTY

SEQ ID NO: 122820 - protein, 10 aa, Artificial Sequence
  Description of Artificial Sequence: Synthetic peptide
  Seed: VLLLQITVGL (MOG_HUMAN)
VQLLQITVGV

SEQ ID NO: 122821 - protein, 9 aa, Artificial Sequence
  Description of Artificial Sequence: Synthetic peptide
  Seed: TGMEVGWYR (MOG_HUMAN)
TSMEVGWYK

SEQ ID NO: 122822 - protein, 10 aa, Artificial Sequence
  Description of Artificial Sequence: Synthetic peptide
  Seed: SSSYAGQFRV (MOG_HUMAN)
STSYAGQFRV

SEQ ID NO: 122823 - protein, 9 aa, Artificial Sequence
  Description of Artificial Sequence: Synthetic peptide
  Seed: TCFFRDHSY (MOG_HUMAN)
TKFFRDHSF

SEQ ID NO: 122824 - protein, 11 aa, Artificial Sequence
  Description of Artificial Sequence: Synthetic peptide
  Seed: VIGPRHPIRAL (MOG_HUMAN)
VKGPRHPIRAM

SEQ ID NO: 122825 - protein, 9 aa, Artificial Sequence
  Description of Artificial Sequence: Synthetic peptide
  Seed: TFDPHFLRV (MOG_HUMAN)
TNDPHFLRI

SEQ ID NO: 122826 - protein, 10 aa, Artificial Sequence
  Description of Artificial Sequence: Synthetic peptide
  Seed: RVVHLYRNGK (MOG_HUMAN)
RIVHLYRNGR

SEQ ID NO: 122827 - protein, 9 aa, Artificial Sequence
  Description of Artificial Sequence: Synthetic peptide
  Seed: FSDEGGFTC (MOG_HUMAN)
FSDEGGFTF

SEQ ID NO: 122828 - protein, 10 aa, Artificial Sequence
  Description of Artificial Sequence: Synthetic peptide
  Seed: VIVPVLGPLV (MOG_HUMAN)
VMVPVLGPLA

SEQ ID NO: 122829 - protein, 11 aa, Artificial Sequence
  Description of Artificial Sequence: Synthetic peptide
  Seed: LHRTFDPHFLR (MOG_HUMAN)
LPRTFDPHFLK

SEQ ID NO: 122830 - protein, 9 aa, Artificial Sequence
  Description of Artificial Sequence: Synthetic peptide
  Seed: FSDEGGFTC (MOG_HUMAN)
FWDEGGFTC

SEQ ID NO: 122831 - protein, 9 aa, Artificial Sequence
  Description of Artificial Sequence: Synthetic peptide
  Seed: RVPCWKITL (MOG_HUMAN)
RYPCWKITI

SEQ ID NO: 122832 - protein, 9 aa, Artificial Sequence
  Description of Artificial Sequence: Synthetic peptide
  Seed: SSYAGQFRV (MOG_HUMAN)
SAYAGQFRM

SEQ ID NO: 122833 - protein, 11 aa, Artificial Sequence
  Description of Artificial Sequence: Synthetic peptide
  Seed: KDAIGEGKVTL (MOG_HUMAN)
KEAIGEGKVTL

SEQ ID NO: 122834 - protein, 9 aa, Artificial Sequence
  Description of Artificial Sequence: Synthetic peptide
  Seed: FYWVSPGVL (MOG_HUMAN)
FRWVSPGVF

SEQ ID NO: 122835 - protein, 9 aa, Artificial Sequence
  Description of Artificial Sequence: Synthetic peptide
  Seed: VLLAVLPVL (MOG_HUMAN)
VVLAVLPVL

SEQ ID NO: 122836 - protein, 9 aa, Artificial Sequence
  Description of Artificial Sequence: Synthetic peptide
  Seed: FSRVVHLYR (MOG_HUMAN)
FSRVVHLYA

SEQ ID NO: 122837 - protein, 10 aa, Artificial Sequence
  Description of Artificial Sequence: Synthetic peptide
  Seed: DEGGFTCFFR (MOG_HUMAN)
DVGGFTCFFK

SEQ ID NO: 122838 - protein, 10 aa, Artificial Sequence
  Description of Artificial Sequence: Synthetic peptide
  Seed: VGWYRPPFSR (MOG_HUMAN)
VYWYRPPFSR

SEQ ID NO: 122839 - protein, 9 aa, Artificial Sequence
  Description of Artificial Sequence: Synthetic peptide
  Seed: ICYNWLHRR (MOG_HUMAN)
ILYNWLHRY

SEQ ID NO: 122840 - protein, 9 aa, Artificial Sequence
  Description of Artificial Sequence: Synthetic peptide
  Seed: FSDEGGFTC (MOG_HUMAN)
FIDEGGFTY

SEQ ID NO: 122841 - protein, 10 aa, Artificial Sequence
  Description of Artificial Sequence: Synthetic peptide
  Seed: RVIGPRHPIR (MOG_HUMAN)
RIIGPRHPIR

SEQ ID NO: 122842 - protein, 9 aa, Artificial Sequence
  Description of Artificial Sequence: Synthetic peptide
  Seed: FYWVSPGVL (MOG_HUMAN)
FTWVSPGVF

SEQ ID NO: 122843 - protein, 10 aa, Artificial Sequence
  Description of Artificial Sequence: Synthetic peptide
  Seed: LLLLQVSSSY (MOG_HUMAN)
LRLLQVSSSY

SEQ ID NO: 122844 - protein, 10 aa, Artificial Sequence
  Description of Artificial Sequence: Synthetic peptide
  Seed: FLLLLLLQVS (MOG_HUMAN)
FMLLLLLQVL

SEQ ID NO: 122845 - protein, 9 aa, Artificial Sequence
  Description of Artificial Sequence: Synthetic peptide
  Seed: HSYQEEAAM (MOG_HUMAN)
HGYQEEAAY

SEQ ID NO: 122846 - protein, 9 aa, Artificial Sequence
  Description of Artificial Sequence: Synthetic peptide
  Seed: GQFRVIGPR (MOG_HUMAN)
GYFRVIGPR

SEQ ID NO: 122847 - protein, 9 aa, Artificial Sequence
  Description of Artificial Sequence: Synthetic peptide
  Seed: RAEIENLHR (MOG_HUMAN)
RTEIENLHY

SEQ ID NO: 122848 - protein, 9 aa, Artificial Sequence
  Description of Artificial Sequence: Synthetic peptide
  Seed: HSYQEEAAM (MOG_HUMAN)
HLYQEEAAL

SEQ ID NO: 122849 - protein, 10 aa, Artificial Sequence
  Description of Artificial Sequence: Synthetic peptide
  Seed: HRTFDPHFLR (MOG_HUMAN)
HATFDPHFLY

SEQ ID NO: 122850 - protein, 11 aa, Artificial Sequence
  Description of Artificial Sequence: Synthetic peptide
  Seed: SSSYAGQFRVI (MOG_HUMAN)
SPSYAGQFRVF

SEQ ID NO: 122851 - protein, 10 aa, Artificial Sequence
  Description of Artificial Sequence: Synthetic peptide
  Seed: FVIVPVLGPL (MOG_HUMAN)
FTIVPVLGPA

SEQ ID NO: 122852 - protein, 10 aa, Artificial Sequence
  Description of Artificial Sequence: Synthetic peptide
  Seed: LIICYNWLHR (MOG_HUMAN)
LSICYNWLHR

SEQ ID NO: 122853 - protein, 9 aa, Artificial Sequence
  Description of Artificial Sequence: Synthetic peptide
  Seed: SSYAGQFRV (MOG_HUMAN)
SLYAGQFRV

SEQ ID NO: 122854 - protein, 9 aa, Artificial Sequence
  Description of Artificial Sequence: Synthetic peptide
  Seed: HSYQEEAAM (MOG_HUMAN)
HIYQEEAAY

SEQ ID NO: 122855 - protein, 10 aa, Artificial Sequence
  Description of Artificial Sequence: Synthetic peptide
  Seed: YWVSPGVLVL (MOG_HUMAN)
YVVSPGVLVM

SEQ ID NO: 122856 - protein, 9 aa, Artificial Sequence
  Description of Artificial Sequence: Synthetic peptide
  Seed: FSRVVHLYR (MOG_HUMAN)
FVRVVHLYK

SEQ ID NO: 122857 - protein, 9 aa, Artificial Sequence
  Description of Artificial Sequence: Synthetic peptide
  Seed: YRPPFSRVV (MOG_HUMAN)
YGPPFSRVV

SEQ ID NO: 122858 - protein, 9 aa, Artificial Sequence
  Description of Artificial Sequence: Synthetic peptide
  Seed: VGDEVELPC (MOG_HUMAN)
VFDEVELPI

SEQ ID NO: 122859 - protein, 10 aa, Artificial Sequence
  Description of Artificial Sequence: Synthetic peptide
  Seed: RPPFSRVVHL (MOG_HUMAN)
REPFSRVVHM

SEQ ID NO: 122860 - protein, 10 aa, Artificial Sequence
  Description of Artificial Sequence: Synthetic peptide
  Seed: RPPFSRVVHL (MOG_HUMAN)
RVPFSRVVHM

SEQ ID NO: 122861 - protein, 10 aa, Artificial Sequence
  Description of Artificial Sequence: Synthetic peptide
  Seed: YWVSPGVLVL (MOG_HUMAN)
YMVSPGVLVA

SEQ ID NO: 122862 - protein, 9 aa, Artificial Sequence
  Description of Artificial Sequence: Synthetic peptide
  Seed: IICYNWLHR (MOG_HUMAN)
ILCYNWLHR

SEQ ID NO: 122863 - protein, 10 aa, Artificial Sequence
  Description of Artificial Sequence: Synthetic peptide
  Seed: IGPRHPIRAL (MOG_HUMAN)
INPRHPIRAF

SEQ ID NO: 122864 - protein, 9 aa, Artificial Sequence
  Description of Artificial Sequence: Synthetic peptide
  Seed: GWYRPPFSR (MOG_HUMAN)
GLYRPPFSR

SEQ ID NO: 122865 - protein, 10 aa, Artificial Sequence
  Description of Artificial Sequence: Synthetic peptide
  Seed: ITLFVIVPVL (MOG_HUMAN)
IVLFVIVPVV

SEQ ID NO: 122866 - protein, 9 aa, Artificial Sequence
  Description of Artificial Sequence: Synthetic peptide
  Seed: LPVLLLQIT (MOG_HUMAN)
LPVLLLQIL

SEQ ID NO: 122867 - protein, 10 aa, Artificial Sequence
  Description of Artificial Sequence: Synthetic peptide
  Seed: RLRGKLRAEI (MOG_HUMAN)
RTRGKLRAEY

SEQ ID NO: 122868 - protein, 9 aa, Artificial Sequence
  Description of Artificial Sequence: Synthetic peptide
  Seed: LLAVLPVLL (MOG_HUMAN)
LMAVLPVLM

SEQ ID NO: 122869 - protein, 9 aa, Artificial Sequence
  Description of Artificial Sequence: Synthetic peptide
  Seed: RIRNVRFSD (MOG_HUMAN)
RQRNVRFSK

SEQ ID NO: 122870 - protein, 11 aa, Artificial Sequence
  Description of Artificial Sequence: Synthetic peptide
  Seed: RIRNVRFSDEG (MOG_HUMAN)
RVRNVRFSDEA

SEQ ID NO: 122871 - protein, 9 aa, Artificial Sequence
  Description of Artificial Sequence: Synthetic peptide
  Seed: TFDPHFLRV (MOG_HUMAN)
TYDPHFLRW

SEQ ID NO: 122872 - protein, 10 aa, Artificial Sequence
  Description of Artificial Sequence: Synthetic peptide
  Seed: RTFDPHFLRV (MOG_HUMAN)
RMFDPHFLRI

SEQ ID NO: 122873 - protein, 10 aa, Artificial Sequence
  Description of Artificial Sequence: Synthetic peptide
  Seed: SLPSCLCSFL (MOG_HUMAN)
SLPSCLCSFM

SEQ ID NO: 122874 - protein, 11 aa, Artificial Sequence
  Description of Artificial Sequence: Synthetic peptide
  Seed: HSYQEEAAMEL (MOG_HUMAN)
HLYQEEAAMEL

SEQ ID NO: 122875 - protein, 10 aa, Artificial Sequence
  Description of Artificial Sequence: Synthetic peptide
  Seed: YWVSPGVLVL (MOG_HUMAN)
YTVSPGVLVL

SEQ ID NO: 122876 - protein, 10 aa, Artificial Sequence
  Description of Artificial Sequence: Synthetic peptide
  Seed: FRVIGPRHPI (MOG_HUMAN)
FFVIGPRHPI

SEQ ID NO: 122877 - protein, 9 aa, Artificial Sequence
  Description of Artificial Sequence: Synthetic peptide
  Seed: SSYAGQFRV (MOG_HUMAN)
SLYAGQFRM

SEQ ID NO: 122878 - protein, 10 aa, Artificial Sequence
  Description of Artificial Sequence: Synthetic peptide
  Seed: RTFDPHFLRV (MOG_HUMAN)
RIFDPHFLRE

SEQ ID NO: 122879 - protein, 9 aa, Artificial Sequence
  Description of Artificial Sequence: Synthetic peptide
  Seed: RVIGPRHPI (MOG_HUMAN)
RQIGPRHPV

SEQ ID NO: 122880 - protein, 11 aa, Artificial Sequence
  Description of Artificial Sequence: Synthetic peptide
  Seed: DAIGEGKVTLR (MOG_HUMAN)
DMIGEGKVTLR

SEQ ID NO: 122881 - protein, 11 aa, Artificial Sequence
  Description of Artificial Sequence: Synthetic peptide
  Seed: LHRTFDPHFLR (MOG_HUMAN)
LQRTFDPHFLR

SEQ ID NO: 122882 - protein, 9 aa, Artificial Sequence
  Description of Artificial Sequence: Synthetic peptide
  Seed: YRPPFSRVV (MOG_HUMAN)
YYPPFSRVI

SEQ ID NO: 122883 - protein, 9 aa, Artificial Sequence
  Description of Artificial Sequence: Synthetic peptide
  Seed: SSYAGQFRV (MOG_HUMAN)
SGYAGQFRW

SEQ ID NO: 122884 - protein, 10 aa, Artificial Sequence
  Description of Artificial Sequence: Synthetic peptide
  Seed: VLLAVLPVLL (MOG_HUMAN)
VMLAVLPVLI

SEQ ID NO: 122885 - protein, 9 aa, Artificial Sequence
  Description of Artificial Sequence: Synthetic peptide
  Seed: SCLCSFLLL (MOG_HUMAN)
SMLCSFLLI

SEQ ID NO: 122886 - protein, 10 aa, Artificial Sequence
  Description of Artificial Sequence: Synthetic peptide
  Seed: FDPHFLRVPC (MOG_HUMAN)
FPPHFLRVPM

SEQ ID NO: 122887 - protein, 11 aa, Artificial Sequence
  Description of Artificial Sequence: Synthetic peptide
  Seed: HSYQEEAAMEL (MOG_HUMAN)
HSYQEEAAMEF

SEQ ID NO: 122888 - protein, 10 aa, Artificial Sequence
  Description of Artificial Sequence: Synthetic peptide
  Seed: SLSRPSLPSC (MOG_HUMAN)
SRSRPSLPSS

SEQ ID NO: 122889 - protein, 10 aa, Artificial Sequence
  Description of Artificial Sequence: Synthetic peptide
  Seed: LLLLQVSSSY (MOG_HUMAN)
LQLLQVSSSM

SEQ ID NO: 122890 - protein, 10 aa, Artificial Sequence
  Description of Artificial Sequence: Synthetic peptide
  Seed: FSDEGGFTCF (MOG_HUMAN)
FGDEGGFTCL

SEQ ID NO: 122891 - protein, 9 aa, Artificial Sequence
  Description of Artificial Sequence: Synthetic peptide
  Seed: LQVSSSYAG (MOG_HUMAN)
LLVSSSYAF

SEQ ID NO: 122892 - protein, 9 aa, Artificial Sequence
  Description of Artificial Sequence: Synthetic peptide
  Seed: FYWVSPGVL (MOG_HUMAN)
FWWVSPGVL

SEQ ID NO: 122893 - protein, 10 aa, Artificial Sequence
  Description of Artificial Sequence: Synthetic peptide
  Seed: VLLLQITVGL (MOG_HUMAN)
VCLLQITVGI

SEQ ID NO: 122894 - protein, 10 aa, Artificial Sequence
  Description of Artificial Sequence: Synthetic peptide
  Seed: RTFDPHFLRV (MOG_HUMAN)
RMFDPHFLRN

SEQ ID NO: 122895 - protein, 10 aa, Artificial Sequence
  Description of Artificial Sequence: Synthetic peptide
  Seed: SLSRPSLPSC (MOG_HUMAN)
SFSRPSLPSK

SEQ ID NO: 122896 - protein, 9 aa, Artificial Sequence
  Description of Artificial Sequence: Synthetic peptide
  Seed: YQEEAAMEL (MOG_HUMAN)
YLEEAAMEF

SEQ ID NO: 122897 - protein, 8 aa, Artificial Sequence
  Description of Artificial Sequence: Synthetic peptide
  Seed: RIRNVRFS (MOG_HUMAN)
RVRNVRFY

SEQ ID NO: 122898 - protein, 10 aa, Artificial Sequence
  Description of Artificial Sequence: Synthetic peptide
  Seed: VGWYRPPFSR (MOG_HUMAN)
VYWYRPPFSK

SEQ ID NO: 122899 - protein, 9 aa, Artificial Sequence
  Description of Artificial Sequence: Synthetic peptide
  Seed: YQEEAAMEL (MOG_HUMAN)
YAEEAAMEI

SEQ ID NO: 122900 - protein, 10 aa, Artificial Sequence
  Description of Artificial Sequence: Synthetic peptide
  Seed: ITVGLIFLCL (MOG_HUMAN)
IMVGLIFLCI

SEQ ID NO: 122901 - protein, 8 aa, Artificial Sequence
  Description of Artificial Sequence: Synthetic peptide
  Seed: YNWLHRRL (MOG_HUMAN)
YAWLHRRM

SEQ ID NO: 122902 - protein, 11 aa, Artificial Sequence
  Description of Artificial Sequence: Synthetic peptide
  Seed: RDHSYQEEAAM (MOG_HUMAN)
RMHSYQEEAAY

SEQ ID NO: 122903 - protein, 10 aa, Artificial Sequence
  Description of Artificial Sequence: Synthetic peptide
  Seed: RLRGKLRAEI (MOG_HUMAN)
RTRGKLRAEK

SEQ ID NO: 122904 - protein, 10 aa, Artificial Sequence
  Description of Artificial Sequence: Synthetic peptide
  Seed: DAIGEGKVTL (MOG_HUMAN)
DMIGEGKVTK

SEQ ID NO: 122905 - protein, 10 aa, Artificial Sequence
  Description of Artificial Sequence: Synthetic peptide
  Seed: FDPHFLRVPC (MOG_HUMAN)
FSPHFLRVPT

SEQ ID NO: 122906 - protein, 9 aa, Artificial Sequence
  Description of Artificial Sequence: Synthetic peptide
  Seed: LAVLPVLLL (MOG_HUMAN)
LMVLPVLLY

SEQ ID NO: 122907 - protein, 9 aa, Artificial Sequence
  Description of Artificial Sequence: Synthetic peptide
  Seed: FYWVSPGVL (MOG_HUMAN)
FNWVSPGVY

SEQ ID NO: 122908 - protein, 10 aa, Artificial Sequence
  Description of Artificial Sequence: Synthetic peptide
  Seed: RPPFSRVVHL (MOG_HUMAN)
RCPFSRVVHM

SEQ ID NO: 122909 - protein, 9 aa, Artificial Sequence
  Description of Artificial Sequence: Synthetic peptide
  Seed: RVIGPRHPI (MOG_HUMAN)
RLIGPRHPL

SEQ ID NO: 122910 - protein, 9 aa, Artificial Sequence
  Description of Artificial Sequence: Synthetic peptide
  Seed: LIFLCLQYR (MOG_HUMAN)
LLFLCLQYR

SEQ ID NO: 122911 - protein, 9 aa, Artificial Sequence
  Description of Artificial Sequence: Synthetic peptide
  Seed: LIICYNWLH (MOG_HUMAN)
LWICYNWLR

SEQ ID NO: 122912 - protein, 9 aa, Artificial Sequence
  Description of Artificial Sequence: Synthetic peptide
  Seed: IFLCLQYRL (MOG_HUMAN)
IFLCLQYRW

SEQ ID NO: 122913 - protein, 10 aa, Artificial Sequence
  Description of Artificial Sequence: Synthetic peptide
  Seed: APEYRGRTEL (MOG_HUMAN)
AWEYRGRTEL

SEQ ID NO: 122914 - protein, 9 aa, Artificial Sequence
  Description of Artificial Sequence: Synthetic peptide
  Seed: VLGPLVALI (MOG_HUMAN)
VTGPLVALL

SEQ ID NO: 122915 - protein, 10 aa, Artificial Sequence
  Description of Artificial Sequence: Synthetic peptide
  Seed: RTFDPHFLRV (MOG_HUMAN)
RSFDPHFLRL

SEQ ID NO: 122916 - protein, 11 aa, Artificial Sequence
  Description of Artificial Sequence: Synthetic peptide
  Seed: VLVLLAVLPVL (MOG_HUMAN)
VGVLLAVLPVV

SEQ ID NO: 122917 - protein, 9 aa, Artificial Sequence
  Description of Artificial Sequence: Synthetic peptide
  Seed: SRPSLPSCL (MOG_HUMAN)
SYPSLPSCF

SEQ ID NO: 122918 - protein, 9 aa, Artificial Sequence
  Description of Artificial Sequence: Synthetic peptide
  Seed: FSDEGGFTC (MOG_HUMAN)
FADEGGFTT

SEQ ID NO: 122919 - protein, 9 aa, Artificial Sequence
  Description of Artificial Sequence: Synthetic peptide
  Seed: FSDEGGFTC (MOG_HUMAN)
FQDEGGFTL

SEQ ID NO: 122920 - protein, 10 aa, Artificial Sequence
  Description of Artificial Sequence: Synthetic peptide
  Seed: LLLQVSSSYA (MOG_HUMAN)
LMLQVSSSYV

SEQ ID NO: 122921 - protein, 9 aa, Artificial Sequence
  Description of Artificial Sequence: Synthetic peptide
  Seed: HFLRVPCWK (MOG_HUMAN)
HVLRVPCWR

SEQ ID NO: 122922 - protein, 10 aa, Artificial Sequence
  Description of Artificial Sequence: Synthetic peptide
  Seed: LIICYNWLHR (MOG_HUMAN)
LAICYNWLHK

SEQ ID NO: 122923 - protein, 9 aa, Artificial Sequence
  Description of Artificial Sequence: Synthetic peptide
  Seed: SRPSLPSCL (MOG_HUMAN)
SSPSLPSCM

SEQ ID NO: 122924 - protein, 9 aa, Artificial Sequence
  Description of Artificial Sequence: Synthetic peptide
  Seed: LQITVGLIF (MOG_HUMAN)
LSITVGLIY

SEQ ID NO: 122925 - protein, 10 aa, Artificial Sequence
  Description of Artificial Sequence: Synthetic peptide
  Seed: RTFDPHFLRV (MOG_HUMAN)
RMFDPHFLRM

SEQ ID NO: 122926 - protein, 9 aa, Artificial Sequence
  Description of Artificial Sequence: Synthetic peptide
  Seed: LKDAIGEGK (MOG_HUMAN)
LTDAIGEGY

SEQ ID NO: 122927 - protein, 9 aa, Artificial Sequence
  Description of Artificial Sequence: Synthetic peptide
  Seed: LLLQVSSSY (MOG_HUMAN)
LWLQVSSSY

SEQ ID NO: 122928 - protein, 9 aa, Artificial Sequence
  Description of Artificial Sequence: Synthetic peptide
  Seed: IGEGKVTLR (MOG_HUMAN)
IVEGKVTLR

SEQ ID NO: 122929 - protein, 9 aa, Artificial Sequence
  Description of Artificial Sequence: Synthetic peptide
  Seed: FSDEGGFTC (MOG_HUMAN)
FYDEGGFTC

SEQ ID NO: 122930 - protein, 11 aa, Artificial Sequence
  Description of Artificial Sequence: Synthetic peptide
  Seed: RISPGKNATGM (MOG_HUMAN)
RPSPGKNATGF

SEQ ID NO: 122931 - protein, 10 aa, Artificial Sequence
  Description of Artificial Sequence: Synthetic peptide
  Seed: IGPRHPIRAL (MOG_HUMAN)
IHPRHPIRAV

SEQ ID NO: 122932 - protein, 10 aa, Artificial Sequence
  Description of Artificial Sequence: Synthetic peptide
  Seed: YWVSPGVLVL (MOG_HUMAN)
YWVSPGVLVM

SEQ ID NO: 122933 - protein, 10 aa, Artificial Sequence
  Description of Artificial Sequence: Synthetic peptide
  Seed: IGPRHPIRAL (MOG_HUMAN)
ICPRHPIRAM

SEQ ID NO: 122934 - protein, 9 aa, Artificial Sequence
  Description of Artificial Sequence: Synthetic peptide
  Seed: AEIENLHRT (MOG_HUMAN)
AEIENLHRY

SEQ ID NO: 122935 - protein, 9 aa, Artificial Sequence
  Description of Artificial Sequence: Synthetic peptide
  Seed: VIVPVLGPL (MOG_HUMAN)
VIVPVLGPF

SEQ ID NO: 122936 - protein, 9 aa, Artificial Sequence
  Description of Artificial Sequence: Synthetic peptide
  Seed: RTFDPHFLR (MOG_HUMAN)
RCFDPHFLY

SEQ ID NO: 122937 - protein, 9 aa, Artificial Sequence
  Description of Artificial Sequence: Synthetic peptide
  Seed: TLFVIVPVL (MOG_HUMAN)
TPFVIVPVY

SEQ ID NO: 122938 - protein, 9 aa, Artificial Sequence
  Description of Artificial Sequence: Synthetic peptide
  Seed: RTFDPHFLR (MOG_HUMAN)
RMFDPHFLF

SEQ ID NO: 122939 - protein, 9 aa, Artificial Sequence
  Description of Artificial Sequence: Synthetic peptide
  Seed: YWVSPGVLV (MOG_HUMAN)
YWVSPGVLI

SEQ ID NO: 122940 - protein, 9 aa, Artificial Sequence
  Description of Artificial Sequence: Synthetic peptide
  Seed: VLGPLVALI (MOG_HUMAN)
VVGPLVALL

SEQ ID NO: 122941 - protein, 9 aa, Artificial Sequence
  Description of Artificial Sequence: Synthetic peptide
  Seed: DQAPEYRGR (MOG_HUMAN)
DFAPEYRGR

SEQ ID NO: 122942 - protein, 9 aa, Artificial Sequence
  Description of Artificial Sequence: Synthetic peptide
  Seed: FYWVSPGVL (MOG_HUMAN)
FFWVSPGVM

SEQ ID NO: 122943 - protein, 9 aa, Artificial Sequence
  Description of Artificial Sequence: Synthetic peptide
  Seed: KVEDPFYWV (MOG_HUMAN)
KLEDPFYWM

SEQ ID NO: 122944 - protein, 9 aa, Artificial Sequence
  Description of Artificial Sequence: Synthetic peptide
  Seed: MASLSRPSL (MOG_HUMAN)
MMSLSRPSM

SEQ ID NO: 122945 - protein, 9 aa, Artificial Sequence
  Description of Artificial Sequence: Synthetic peptide
  Seed: LSRPSLPSC (MOG_HUMAN)
LPRPSLPST

SEQ ID NO: 122946 - protein, 9 aa, Artificial Sequence
  Description of Artificial Sequence: Synthetic peptide
  Seed: LLLQVSSSY (MOG_HUMAN)
LRLQVSSSM

SEQ ID NO: 122947 - protein, 11 aa, Artificial Sequence
  Description of Artificial Sequence: Synthetic peptide
  Seed: RFSDEGGFTCF (MOG_HUMAN)
RTSDEGGFTCY

SEQ ID NO: 122948 - protein, 10 aa, Artificial Sequence
  Description of Artificial Sequence: Synthetic peptide
  Seed: LLAVLPVLLL (MOG_HUMAN)
LLAVLPVLLI

SEQ ID NO: 122949 - protein, 9 aa, Artificial Sequence
  Description of Artificial Sequence: Synthetic peptide
  Seed: FYWVSPGVL (MOG_HUMAN)
FAWVSPGVH

SEQ ID NO: 122950 - protein, 9 aa, Artificial Sequence
  Description of Artificial Sequence: Synthetic peptide
  Seed: FLEELRNPF (MOG_HUMAN)
FIEELRNPY

SEQ ID NO: 122951 - protein, 10 aa, Artificial Sequence
  Description of Artificial Sequence: Synthetic peptide
  Seed: KITLFVIVPV (MOG_HUMAN)
KLTLFVIVPI

SEQ ID NO: 122952 - protein, 9 aa, Artificial Sequence
  Description of Artificial Sequence: Synthetic peptide
  Seed: SCLCSFLLL (MOG_HUMAN)
SQLCSFLLV

SEQ ID NO: 122953 - protein, 10 aa, Artificial Sequence
  Description of Artificial Sequence: Synthetic peptide
  Seed: SFLLLLLLQV (MOG_HUMAN)
SGLLLLLLQV

SEQ ID NO: 122954 - protein, 9 aa, Artificial Sequence
  Description of Artificial Sequence: Synthetic peptide
  Seed: RIRNVRFSD (MOG_HUMAN)
RQRNVRFSI

SEQ ID NO: 122955 - protein, 9 aa, Artificial Sequence
  Description of Artificial Sequence: Synthetic peptide
  Seed: LSRPSLPSC (MOG_HUMAN)
LIRPSLPSV

SEQ ID NO: 122956 - protein, 11 aa, Artificial Sequence
  Description of Artificial Sequence: Synthetic peptide
  Seed: NATGMEVGWYR (MOG_HUMAN)
NKTGMEVGWYR

SEQ ID NO: 122957 - protein, 9 aa, Artificial Sequence
  Description of Artificial Sequence: Synthetic peptide
  Seed: RIRNVRFSD (MOG_HUMAN)
RMRNVRFSQ

SEQ ID NO: 122958 - protein, 10 aa, Artificial Sequence
  Description of Artificial Sequence: Synthetic peptide
  Seed: LLLQVSSSYA (MOG_HUMAN)
LFLQVSSSYV

SEQ ID NO: 122959 - protein, 9 aa, Artificial Sequence
  Description of Artificial Sequence: Synthetic peptide
  Seed: RVVHLYRNG (MOG_HUMAN)
RIVHLYRNK

SEQ ID NO: 122960 - protein, 11 aa, Artificial Sequence
  Description of Artificial Sequence: Synthetic peptide
  Seed: RPSLPSCLCSF (MOG_HUMAN)
RPSLPSCLCSI

SEQ ID NO: 122961 - protein, 10 aa, Artificial Sequence
  Description of Artificial Sequence: Synthetic peptide
  Seed: VLLAVLPVLL (MOG_HUMAN)
VDLAVLPVLV

SEQ ID NO: 122962 - protein, 9 aa, Artificial Sequence
  Description of Artificial Sequence: Synthetic peptide
  Seed: IRALVGDEV (MOG_HUMAN)
IHALVGDEF

SEQ ID NO: 122963 - protein, 10 aa, Artificial Sequence
  Description of Artificial Sequence: Synthetic peptide
  Seed: HRTFDPHFLR (MOG_HUMAN)
HRTFDPHFLK

SEQ ID NO: 122964 - protein, 9 aa, Artificial Sequence
  Description of Artificial Sequence: Synthetic peptide
  Seed: LIFLCLQYR (MOG_HUMAN)
LFFLCLQYR

SEQ ID NO: 122965 - protein, 9 aa, Artificial Sequence
  Description of Artificial Sequence: Synthetic peptide
  Seed: SLPSCLCSF (MOG_HUMAN)
SIPSCLCSI

SEQ ID NO: 122966 - protein, 9 aa, Artificial Sequence
  Description of Artificial Sequence: Synthetic peptide
  Seed: LAVLPVLLL (MOG_HUMAN)
LSVLPVLLI

SEQ ID NO: 122967 - protein, 10 aa, Artificial Sequence
  Description of Artificial Sequence: Synthetic peptide
  Seed: RTFDPHFLRV (MOG_HUMAN)
RQFDPHFLRR

SEQ ID NO: 122968 - protein, 10 aa, Artificial Sequence
  Description of Artificial Sequence: Synthetic peptide
  Seed: RTFDPHFLRV (MOG_HUMAN)
RMFDPHFLRP

SEQ ID NO: 122969 - protein, 10 aa, Artificial Sequence
  Description of Artificial Sequence: Synthetic peptide
  Seed: RVPCWKITLF (MOG_HUMAN)
RWPCWKITLI

SEQ ID NO: 122970 - protein, 9 aa, Artificial Sequence
  Description of Artificial Sequence: Synthetic peptide
  Seed: MASLSRPSL (MOG_HUMAN)
MPSLSRPSP

SEQ ID NO: 122971 - protein, 9 aa, Artificial Sequence
  Description of Artificial Sequence: Synthetic peptide
  Seed: LLLQITVGL (MOG_HUMAN)
LALQITVGY

SEQ ID NO: 122972 - protein, 9 aa, Artificial Sequence
  Description of Artificial Sequence: Synthetic peptide
  Seed: VSPGVLVLL (MOG_HUMAN)
VFPGVLVLL

SEQ ID NO: 122973 - protein, 9 aa, Artificial Sequence
  Description of Artificial Sequence: Synthetic peptide
  Seed: LQITVGLIF (MOG_HUMAN)
LKITVGLII

SEQ ID NO: 122974 - protein, 10 aa, Artificial Sequence
  Description of Artificial Sequence: Synthetic peptide
  Seed: RTFDPHFLRV (MOG_HUMAN)
RTFDPHFLRR

SEQ ID NO: 122975 - protein, 9 aa, Artificial Sequence
  Description of Artificial Sequence: Synthetic peptide
  Seed: TCFFRDHSY (MOG_HUMAN)
TIFFRDHSY

SEQ ID NO: 122976 - protein, 9 aa, Artificial Sequence
  Description of Artificial Sequence: Synthetic peptide
  Seed: RVPCWKITL (MOG_HUMAN)
RAPCWKITY

SEQ ID NO: 122977 - protein, 9 aa, Artificial Sequence
  Description of Artificial Sequence: Synthetic peptide
  Seed: SRPSLPSCL (MOG_HUMAN)
SCPSLPSCL

SEQ ID NO: 122978 - protein, 9 aa, Artificial Sequence
  Description of Artificial Sequence: Synthetic peptide
  Seed: YWVSPGVLV (MOG_HUMAN)
YYVSPGVLF

SEQ ID NO: 122979 - protein, 9 aa, Artificial Sequence
  Description of Artificial Sequence: Synthetic peptide
  Seed: LIFLCLQYR (MOG_HUMAN)
LNFLCLQYR

SEQ ID NO: 122980 - protein, 9 aa, Artificial Sequence
  Description of Artificial Sequence: Synthetic peptide
  Seed: MASLSRPSL (MOG_HUMAN)
MHSLSRPSY

SEQ ID NO: 122981 - protein, 9 aa, Artificial Sequence
  Description of Artificial Sequence: Synthetic peptide
  Seed: FYWVSPGVL (MOG_HUMAN)
FWWVSPGVY

SEQ ID NO: 122982 - protein, 11 aa, Artificial Sequence
  Description of Artificial Sequence: Synthetic peptide
  Seed: FSDEGGFTCFF (MOG_HUMAN)
FIDEGGFTCFY

SEQ ID NO: 122983 - protein, 10 aa, Artificial Sequence
  Description of Artificial Sequence: Synthetic peptide
  Seed: SCLCSFLLLL (MOG_HUMAN)
SVLCSFLLLL

SEQ ID NO: 122984 - protein, 9 aa, Artificial Sequence
  Description of Artificial Sequence: Synthetic peptide
  Seed: YRPPFSRVV (MOG_HUMAN)
YYPPFSRVL

SEQ ID NO: 122985 - protein, 10 aa, Artificial Sequence
  Description of Artificial Sequence: Synthetic peptide
  Seed: LLLQVSSSYA (MOG_HUMAN)
LYLQVSSSYV

SEQ ID NO: 122986 - protein, 11 aa, Artificial Sequence
  Description of Artificial Sequence: Synthetic peptide
  Seed: NATGMEVGWYR (MOG_HUMAN)
NVTGMEVGWYR

SEQ ID NO: 122987 - protein, 10 aa, Artificial Sequence
  Description of Artificial Sequence: Synthetic peptide
  Seed: SSYAGQFRVI (MOG_HUMAN)
SYYAGQFRVW

SEQ ID NO: 122988 - protein, 11 aa, Artificial Sequence
  Description of Artificial Sequence: Synthetic peptide
  Seed: RFSDEGGFTCF (MOG_HUMAN)
RLSDEGGFTCV

SEQ ID NO: 122989 - protein, 9 aa, Artificial Sequence
  Description of Artificial Sequence: Synthetic peptide
  Seed: TLFVIVPVL (MOG_HUMAN)
TRFVIVPVM

SEQ ID NO: 122990 - protein, 9 aa, Artificial Sequence
  Description of Artificial Sequence: Synthetic peptide
  Seed: WVSPGVLVL (MOG_HUMAN)
WRSPGVLVI

SEQ ID NO: 122991 - protein, 9 aa, Artificial Sequence
  Description of Artificial Sequence: Synthetic peptide
  Seed: SLPSCLCSF (MOG_HUMAN)
SIPSCLCSV

SEQ ID NO: 122992 - protein, 9 aa, Artificial Sequence
  Description of Artificial Sequence: Synthetic peptide
  Seed: GQFRVIGPR (MOG_HUMAN)
GRFRVIGPM

SEQ ID NO: 122993 - protein, 10 aa, Artificial Sequence
  Description of Artificial Sequence: Synthetic peptide
  Seed: SCLCSFLLLL (MOG_HUMAN)
SSLCSFLLLI

SEQ ID NO: 122994 - protein, 8 aa, Artificial Sequence
  Description of Artificial Sequence: Synthetic peptide
  Seed: FSDEGGFT (MOG_HUMAN)
FMDEGGFM

SEQ ID NO: 122995 - protein, 9 aa, Artificial Sequence
  Description of Artificial Sequence: Synthetic peptide
  Seed: YQEEAAMEL (MOG_HUMAN)
YCEEAAMEM

SEQ ID NO: 122996 - protein, 9 aa, Artificial Sequence
  Description of Artificial Sequence: Synthetic peptide
  Seed: SSYAGQFRV (MOG_HUMAN)
SQYAGQFRA

SEQ ID NO: 122997 - protein, 11 aa, Artificial Sequence
  Description of Artificial Sequence: Synthetic peptide
  Seed: RVIGPRHPIRA (MOG_HUMAN)
RTIGPRHPIRK

SEQ ID NO: 122998 - protein, 10 aa, Artificial Sequence
  Description of Artificial Sequence: Synthetic peptide
  Seed: LIICYNWLHR (MOG_HUMAN)
LYICYNWLHK

SEQ ID NO: 122999 - protein, 9 aa, Artificial Sequence
  Description of Artificial Sequence: Synthetic peptide
  Seed: TFDPHFLRV (MOG_HUMAN)
TNDPHFLRV

SEQ ID NO: 123000 - protein, 9 aa, Artificial Sequence
  Description of Artificial Sequence: Synthetic peptide
  Seed: VSPGVLVLL (MOG_HUMAN)
VMPGVLVLV

SEQ ID NO: 123001 - protein, 10 aa, Artificial Sequence
  Description of Artificial Sequence: Synthetic peptide
  Seed: SLSRPSLPSC (MOG_HUMAN)
SCSRPSLPSL

SEQ ID NO: 123002 - protein, 9 aa, Artificial Sequence
  Description of Artificial Sequence: Synthetic peptide
  Seed: TLRIRNVRF (MOG_HUMAN)
TMRIRNVRY

SEQ ID NO: 123003 - protein, 9 aa, Artificial Sequence
  Description of Artificial Sequence: Synthetic peptide
  Seed: VLGPLVALI (MOG_HUMAN)
VTGPLVALV

SEQ ID NO: 123004 - protein, 9 aa, Artificial Sequence
  Description of Artificial Sequence: Synthetic peptide
  Seed: WVSPGVLVL (MOG_HUMAN)
WYSPGVLVL

SEQ ID NO: 123005 - protein, 10 aa, Artificial Sequence
  Description of Artificial Sequence: Synthetic peptide
  Seed: FLLLLLLQVS (MOG_HUMAN)
FMLLLLLQVI

SEQ ID NO: 123006 - protein, 9 aa, Artificial Sequence
  Description of Artificial Sequence: Synthetic peptide
  Seed: RVVHLYRNG (MOG_HUMAN)
RSVHLYRNK

SEQ ID NO: 123007 - protein, 10 aa, Artificial Sequence
  Description of Artificial Sequence: Synthetic peptide
  Seed: SSYAGQFRVI (MOG_HUMAN)
SAYAGQFRVL

SEQ ID NO: 123008 - protein, 10 aa, Artificial Sequence
  Description of Artificial Sequence: Synthetic peptide
  Seed: ICYNWLHRRL (MOG_HUMAN)
IYYNWLHRRI

SEQ ID NO: 123009 - protein, 9 aa, Artificial Sequence
  Description of Artificial Sequence: Synthetic peptide
  Seed: LVLLAVLPV (MOG_HUMAN)
LQLLAVLPL

SEQ ID NO: 123010 - protein, 9 aa, Artificial Sequence
  Description of Artificial Sequence: Synthetic peptide
  Seed: LQITVGLIF (MOG_HUMAN)
LQITVGLIA

SEQ ID NO: 123011 - protein, 9 aa, Artificial Sequence
  Description of Artificial Sequence: Synthetic peptide
  Seed: LLLQITVGL (MOG_HUMAN)
LQLQITVGI

SEQ ID NO: 123012 - protein, 9 aa, Artificial Sequence
  Description of Artificial Sequence: Synthetic peptide
  Seed: ICYNWLHRR (MOG_HUMAN)
IPYNWLHRR

SEQ ID NO: 123013 - protein, 10 aa, Artificial Sequence
  Description of Artificial Sequence: Synthetic peptide
  Seed: RTFDPHFLRV (MOG_HUMAN)
RSFDPHFLRT

SEQ ID NO: 123014 - protein, 10 aa, Artificial Sequence
  Description of Artificial Sequence: Synthetic peptide
  Seed: LIFLCLQYRL (MOG_HUMAN)
LFFLCLQYRK

SEQ ID NO: 123015 - protein, 10 aa, Artificial Sequence
  Description of Artificial Sequence: Synthetic peptide
  Seed: MEVGWYRPPF (MOG_HUMAN)
MMVGWYRPPY

SEQ ID NO: 123016 - protein, 9 aa, Artificial Sequence
  Description of Artificial Sequence: Synthetic peptide
  Seed: VSSSYAGQF (MOG_HUMAN)
VLSSYAGQF

SEQ ID NO: 123017 - protein, 10 aa, Artificial Sequence
  Description of Artificial Sequence: Synthetic peptide
  Seed: RIRNVRFSDE (MOG_HUMAN)
RWRNVRFSDI

SEQ ID NO: 123018 - protein, 10 aa, Artificial Sequence
  Description of Artificial Sequence: Synthetic peptide
  Seed: YWVSPGVLVL (MOG_HUMAN)
YLVSPGVLVL

SEQ ID NO: 123019 - protein, 8 aa, Artificial Sequence
  Description of Artificial Sequence: Synthetic peptide
  Seed: IENLHRTF (MOG_HUMAN)
IQNLHRTY

SEQ ID NO: 123020 - protein, 9 aa, Artificial Sequence
  Description of Artificial Sequence: Synthetic peptide
  Seed: TFDPHFLRV (MOG_HUMAN)
TLDPHFLRL

SEQ ID NO: 123021 - protein, 9 aa, Artificial Sequence
  Description of Artificial Sequence: Synthetic peptide
  Seed: VIVPVLGPL (MOG_HUMAN)
VPVPVLGPY

SEQ ID NO: 123022 - protein, 9 aa, Artificial Sequence
  Description of Artificial Sequence: Synthetic peptide
  Seed: SLPSCLCSF (MOG_HUMAN)
SQPSCLCSF

SEQ ID NO: 123023 - protein, 10 aa, Artificial Sequence
  Description of Artificial Sequence: Synthetic peptide
  Seed: RIRNVRFSDE (MOG_HUMAN)
RSRNVRFSDV

SEQ ID NO: 123024 - protein, 8 aa, Artificial Sequence
  Description of Artificial Sequence: Synthetic peptide
  Seed: VPVLGPLV (MOG_HUMAN)
VQVLGPLV

SEQ ID NO: 123025 - protein, 9 aa, Artificial Sequence
  Description of Artificial Sequence: Synthetic peptide
  Seed: RIRNVRFSD (MOG_HUMAN)
RIRNVRFSS

SEQ ID NO: 123026 - protein, 10 aa, Artificial Sequence
  Description of Artificial Sequence: Synthetic peptide
  Seed: ITLFVIVPVL (MOG_HUMAN)
ITLFVIVPVW

SEQ ID NO: 123027 - protein, 11 aa, Artificial Sequence
  Description of Artificial Sequence: Synthetic peptide
  Seed: RFSDEGGFTCF (MOG_HUMAN)
RISDEGGFTCL

SEQ ID NO: 123028 - protein, 10 aa, Artificial Sequence
  Description of Artificial Sequence: Synthetic peptide
  Seed: RALVGDEVEL (MOG_HUMAN)
RSLVGDEVEW

SEQ ID NO: 123029 - protein, 9 aa, Artificial Sequence
  Description of Artificial Sequence: Synthetic peptide
  Seed: LQITVGLIF (MOG_HUMAN)
LEITVGLIF

SEQ ID NO: 123030 - protein, 9 aa, Artificial Sequence
  Description of Artificial Sequence: Synthetic peptide
  Seed: MASLSRPSL (MOG_HUMAN)
MFSLSRPSF

SEQ ID NO: 123031 - protein, 9 aa, Artificial Sequence
  Description of Artificial Sequence: Synthetic peptide
  Seed: LLLQVSSSY (MOG_HUMAN)
LFLQVSSSY

SEQ ID NO: 123032 - protein, 9 aa, Artificial Sequence
  Description of Artificial Sequence: Synthetic peptide
  Seed: VELPCRISP (MOG_HUMAN)
VELPCRISV

SEQ ID NO: 123033 - protein, 9 aa, Artificial Sequence
  Description of Artificial Sequence: Synthetic peptide
  Seed: ALIICYNWL (MOG_HUMAN)
ALIICYNWV

SEQ ID NO: 123034 - protein, 10 aa, Artificial Sequence
  Description of Artificial Sequence: Synthetic peptide
  Seed: VGWYRPPFSR (MOG_HUMAN)
VLWYRPPFSR

SEQ ID NO: 123035 - protein, 10 aa, Artificial Sequence
  Description of Artificial Sequence: Synthetic peptide
  Seed: LSRPSLPSCL (MOG_HUMAN)
LVRPSLPSCK

SEQ ID NO: 123036 - protein, 10 aa, Artificial Sequence
  Description of Artificial Sequence: Synthetic peptide
  Seed: RVVHLYRNGK (MOG_HUMAN)
RVVHLYRNGR

SEQ ID NO: 123037 - protein, 10 aa, Artificial Sequence
  Description of Artificial Sequence: Synthetic peptide
  Seed: AEIENLHRTF (MOG_HUMAN)
AEIENLHRTL

SEQ ID NO: 123038 - protein, 10 aa, Artificial Sequence
  Description of Artificial Sequence: Synthetic peptide
  Seed: LLLQITVGLI (MOG_HUMAN)
LMLQITVGLL

SEQ ID NO: 123039 - protein, 9 aa, Artificial Sequence
  Description of Artificial Sequence: Synthetic peptide
  Seed: LSRPSLPSC (MOG_HUMAN)
LLRPSLPSW

SEQ ID NO: 123040 - protein, 11 aa, Artificial Sequence
  Description of Artificial Sequence: Synthetic peptide
  Seed: PPFSRVVHLYR (MOG_HUMAN)
PMFSRVVHLYR

SEQ ID NO: 123041 - protein, 10 aa, Artificial Sequence
  Description of Artificial Sequence: Synthetic peptide
  Seed: SCLCSFLLLL (MOG_HUMAN)
SILCSFLLLL

SEQ ID NO: 123042 - protein, 9 aa, Artificial Sequence
  Description of Artificial Sequence: Synthetic peptide
  Seed: VLGPLVALI (MOG_HUMAN)
VAGPLVALY

SEQ ID NO: 123043 - protein, 8 aa, Artificial Sequence
  Description of Artificial Sequence: Synthetic peptide
  Seed: TFDPHFLR (MOG_HUMAN)
TADPHFLL

SEQ ID NO: 123044 - protein, 9 aa, Artificial Sequence
  Description of Artificial Sequence: Synthetic peptide
  Seed: FSRVVHLYR (MOG_HUMAN)
FARVVHLYR

SEQ ID NO: 123045 - protein, 9 aa, Artificial Sequence
  Description of Artificial Sequence: Synthetic peptide
  Seed: LQVSSSYAG (MOG_HUMAN)
LKVSSSYAV

SEQ ID NO: 123046 - protein, 9 aa, Artificial Sequence
  Description of Artificial Sequence: Synthetic peptide
  Seed: SLPSCLCSF (MOG_HUMAN)
STPSCLCSL

SEQ ID NO: 123047 - protein, 10 aa, Artificial Sequence
  Description of Artificial Sequence: Synthetic peptide
  Seed: LLLLQVSSSY (MOG_HUMAN)
LYLLQVSSSF

SEQ ID NO: 123048 - protein, 8 aa, Artificial Sequence
  Description of Artificial Sequence: Synthetic peptide
  Seed: FSDEGGFT (MOG_HUMAN)
FNDEGGFI

SEQ ID NO: 123049 - protein, 10 aa, Artificial Sequence
  Description of Artificial Sequence: Synthetic peptide
  Seed: SYQEEAAMEL (MOG_HUMAN)
SYQEEAAMEI

SEQ ID NO: 123050 - protein, 9 aa, Artificial Sequence
  Description of Artificial Sequence: Synthetic peptide
  Seed: GLIFLCLQY (MOG_HUMAN)
GQIFLCLQF

SEQ ID NO: 123051 - protein, 9 aa, Artificial Sequence
  Description of Artificial Sequence: Synthetic peptide
  Seed: TFDPHFLRV (MOG_HUMAN)
TMDPHFLRF

SEQ ID NO: 123052 - protein, 9 aa, Artificial Sequence
  Description of Artificial Sequence: Synthetic peptide
  Seed: ALVGDEVEL (MOG_HUMAN)
AAVGDEVEF

SEQ ID NO: 123053 - protein, 10 aa, Artificial Sequence
  Description of Artificial Sequence: Synthetic peptide
  Seed: FSDEGGFTCF (MOG_HUMAN)
FQDEGGFTCY

SEQ ID NO: 123054 - protein, 9 aa, Artificial Sequence
  Description of Artificial Sequence: Synthetic peptide
  Seed: RVIGPRHPI (MOG_HUMAN)
RAIGPRHPM

SEQ ID NO: 123055 - protein, 9 aa, Artificial Sequence
  Description of Artificial Sequence: Synthetic peptide
  Seed: RPPFSRVVH (MOG_HUMAN)
RPPFSRVVA

SEQ ID NO: 123056 - protein, 9 aa, Artificial Sequence
  Description of Artificial Sequence: Synthetic peptide
  Seed: FYWVSPGVL (MOG_HUMAN)
FRWVSPGVY

SEQ ID NO: 123057 - protein, 10 aa, Artificial Sequence
  Description of Artificial Sequence: Synthetic peptide
  Seed: TGMEVGWYRP (MOG_HUMAN)
TFMEVGWYRK

SEQ ID NO: 123058 - protein, 10 aa, Artificial Sequence
  Description of Artificial Sequence: Synthetic peptide
  Seed: ATGMEVGWYR (MOG_HUMAN)
ARGMEVGWYK

SEQ ID NO: 123059 - protein, 10 aa, Artificial Sequence
  Description of Artificial Sequence: Synthetic peptide
  Seed: PVLGPLVALI (MOG_HUMAN)
PKLGPLVALV

SEQ ID NO: 123060 - protein, 10 aa, Artificial Sequence
  Description of Artificial Sequence: Synthetic peptide
  Seed: RTFDPHFLRV (MOG_HUMAN)
RAFDPHFLRR

SEQ ID NO: 123061 - protein, 11 aa, Artificial Sequence
  Description of Artificial Sequence: Synthetic peptide
  Seed: FSDEGGFTCFF (MOG_HUMAN)
FIDEGGFTCFF

SEQ ID NO: 123062 - protein, 10 aa, Artificial Sequence
  Description of Artificial Sequence: Synthetic peptide
  Seed: RALVGDEVEL (MOG_HUMAN)
RMLVGDEVEV

SEQ ID NO: 123063 - protein, 9 aa, Artificial Sequence
  Description of Artificial Sequence: Synthetic peptide
  Seed: HFLRVPCWK (MOG_HUMAN)
HALRVPCWK

SEQ ID NO: 123064 - protein, 9 aa, Artificial Sequence
  Description of Artificial Sequence: Synthetic peptide
  Seed: RVIGPRHPI (MOG_HUMAN)
RPIGPRHPP

SEQ ID NO: 123065 - protein, 11 aa, Artificial Sequence
  Description of Artificial Sequence: Synthetic peptide
  Seed: RFSDEGGFTCF (MOG_HUMAN)
RMSDEGGFTCY

SEQ ID NO: 123066 - protein, 9 aa, Artificial Sequence
  Description of Artificial Sequence: Synthetic peptide
  Seed: WVSPGVLVL (MOG_HUMAN)
WKSPGVLVI

SEQ ID NO: 123067 - protein, 8 aa, Artificial Sequence
  Description of Artificial Sequence: Synthetic peptide
  Seed: FYWVSPGV (MOG_HUMAN)
FYWVSPGM

SEQ ID NO: 123068 - protein, 10 aa, Artificial Sequence
  Description of Artificial Sequence: Synthetic peptide
  Seed: WVSPGVLVLL (MOG_HUMAN)
WQSPGVLVLL

SEQ ID NO: 123069 - protein, 10 aa, Artificial Sequence
  Description of Artificial Sequence: Synthetic peptide
  Seed: IGPRHPIRAL (MOG_HUMAN)
IPPRHPIRAV

SEQ ID NO: 123070 - protein, 10 aa, Artificial Sequence
  Description of Artificial Sequence: Synthetic peptide
  Seed: WYRPPFSRVV (MOG_HUMAN)
WFRPPFSRVL

SEQ ID NO: 123071 - protein, 9 aa, Artificial Sequence
  Description of Artificial Sequence: Synthetic peptide
  Seed: RIRNVRFSD (MOG_HUMAN)
RIRNVRFSR

SEQ ID NO: 123072 - protein, 9 aa, Artificial Sequence
  Description of Artificial Sequence: Synthetic peptide
  Seed: YRPPFSRVV (MOG_HUMAN)
YGPPFSRVM

SEQ ID NO: 123073 - protein, 9 aa, Artificial Sequence
  Description of Artificial Sequence: Synthetic peptide
  Seed: VLGPLVALI (MOG_HUMAN)
VMGPLVALV

SEQ ID NO: 123074 - protein, 9 aa, Artificial Sequence
  Description of Artificial Sequence: Synthetic peptide
  Seed: LQVSSSYAG (MOG_HUMAN)
LTVSSSYAY

SEQ ID NO: 123075 - protein, 9 aa, Artificial Sequence
  Description of Artificial Sequence: Synthetic peptide
  Seed: RVIGPRHPI (MOG_HUMAN)
RIIGPRHPY

SEQ ID NO: 123076 - protein, 10 aa, Artificial Sequence
  Description of Artificial Sequence: Synthetic peptide
  Seed: LLLLQVSSSY (MOG_HUMAN)
LGLLQVSSSF

SEQ ID NO: 123077 - protein, 9 aa, Artificial Sequence
  Description of Artificial Sequence: Synthetic peptide
  Seed: TCFFRDHSY (MOG_HUMAN)
TTFFRDHSM

SEQ ID NO: 123078 - protein, 10 aa, Artificial Sequence
  Description of Artificial Sequence: Synthetic peptide
  Seed: GPRHPIRALV (MOG_HUMAN)
GPRHPIRALL

SEQ ID NO: 123079 - protein, 9 aa, Artificial Sequence
  Description of Artificial Sequence: Synthetic peptide
  Seed: VLLAVLPVL (MOG_HUMAN)
VMLAVLPVY

SEQ ID NO: 123080 - protein, 9 aa, Artificial Sequence
  Description of Artificial Sequence: Synthetic peptide
  Seed: LQVSSSYAG (MOG_HUMAN)
LAVSSSYAL

SEQ ID NO: 123081 - protein, 10 aa, Artificial Sequence
  Description of Artificial Sequence: Synthetic peptide
  Seed: RLAGQFLEEL (MOG_HUMAN)
RMAGQFLEEI

SEQ ID NO: 123082 - protein, 9 aa, Artificial Sequence
  Description of Artificial Sequence: Synthetic peptide
  Seed: FLEELRNPF (MOG_HUMAN)
FMEELRNPI

SEQ ID NO: 123083 - protein, 11 aa, Artificial Sequence
  Description of Artificial Sequence: Synthetic peptide
  Seed: SDEGGFTCFFR (MOG_HUMAN)
STEGGFTCFFR

SEQ ID NO: 123084 - protein, 10 aa, Artificial Sequence
  Description of Artificial Sequence: Synthetic peptide
  Seed: LLLQVSSSYA (MOG_HUMAN)
LQLQVSSSYS

SEQ ID NO: 123085 - protein, 9 aa, Artificial Sequence
  Description of Artificial Sequence: Synthetic peptide
  Seed: VSSSYAGQF (MOG_HUMAN)
VTSSYAGQY

SEQ ID NO: 123086 - protein, 10 aa, Artificial Sequence
  Description of Artificial Sequence: Synthetic peptide
  Seed: DEGGFTCFFR (MOG_HUMAN)
DIGGFTCFFK

SEQ ID NO: 123087 - protein, 11 aa, Artificial Sequence
  Description of Artificial Sequence: Synthetic peptide
  Seed: VRFSDEGGFTC (MOG_HUMAN)
VHFSDEGGFTW

SEQ ID NO: 123088 - protein, 10 aa, Artificial Sequence
  Description of Artificial Sequence: Synthetic peptide
  Seed: LLLQVSSSYA (MOG_HUMAN)
LVLQVSSSYV

SEQ ID NO: 123089 - protein, 11 aa, Artificial Sequence
  Description of Artificial Sequence: Synthetic peptide
  Seed: VLVLLAVLPVL (MOG_HUMAN)
VAVLLAVLPVV

SEQ ID NO: 123090 - protein, 8 aa, Artificial Sequence
  Description of Artificial Sequence: Synthetic peptide
  Seed: VIGPRHPI (MOG_HUMAN)
VSGPRHPF

SEQ ID NO: 123091 - protein, 9 aa, Artificial Sequence
  Description of Artificial Sequence: Synthetic peptide
  Seed: RVPCWKITL (MOG_HUMAN)
RRPCWKITM

SEQ ID NO: 123092 - protein, 10 aa, Artificial Sequence
  Description of Artificial Sequence: Synthetic peptide
  Seed: LLLQVSSSYA (MOG_HUMAN)
LLLQVSSSYM

SEQ ID NO: 123093 - protein, 9 aa, Artificial Sequence
  Description of Artificial Sequence: Synthetic peptide
  Seed: LSRPSLPSC (MOG_HUMAN)
LIRPSLPSW

SEQ ID NO: 123094 - protein, 9 aa, Artificial Sequence
  Description of Artificial Sequence: Synthetic peptide
  Seed: VLGPLVALI (MOG_HUMAN)
VTGPLVALF

SEQ ID NO: 123095 - protein, 11 aa, Artificial Sequence
  Description of Artificial Sequence: Synthetic peptide
  Seed: SDEGGFTCFFR (MOG_HUMAN)
SIEGGFTCFFR

SEQ ID NO: 123096 - protein, 9 aa, Artificial Sequence
  Description of Artificial Sequence: Synthetic peptide
  Seed: LHRTFDPHF (MOG_HUMAN)
LQRTFDPHM

SEQ ID NO: 123097 - protein, 11 aa, Artificial Sequence
  Description of Artificial Sequence: Synthetic peptide
  Seed: VRFSDEGGFTC (MOG_HUMAN)
VYFSDEGGFTF

SEQ ID NO: 123098 - protein, 9 aa, Artificial Sequence
  Description of Artificial Sequence: Synthetic peptide
  Seed: KLRAEIENL (MOG_HUMAN)
KSRAEIENV

SEQ ID NO: 123099 - protein, 10 aa, Artificial Sequence
  Description of Artificial Sequence: Synthetic peptide
  Seed: RVVHLYRNGK (MOG_HUMAN)
RLVHLYRNGK

SEQ ID NO: 123100 - protein, 9 aa, Artificial Sequence
  Description of Artificial Sequence: Synthetic peptide
  Seed: VSPGVLVLL (MOG_HUMAN)
VTPGVLVLR

SEQ ID NO: 123101 - protein, 11 aa, Artificial Sequence
  Description of Artificial Sequence: Synthetic peptide
  Seed: VRFSDEGGFTC (MOG_HUMAN)
VRFSDEGGFTF

SEQ ID NO: 123102 - protein, 9 aa, Artificial Sequence
  Description of Artificial Sequence: Synthetic peptide
  Seed: VLGPLVALI (MOG_HUMAN)
VRGPLVALL

SEQ ID NO: 123103 - protein, 9 aa, Artificial Sequence
  Description of Artificial Sequence: Synthetic peptide
  Seed: KLRAEIENL (MOG_HUMAN)
KTRAEIENF

SEQ ID NO: 123104 - protein, 10 aa, Artificial Sequence
  Description of Artificial Sequence: Synthetic peptide
  Seed: FTCFFRDHSY (MOG_HUMAN)
FACFFRDHSY

SEQ ID NO: 123105 - protein, 10 aa, Artificial Sequence
  Description of Artificial Sequence: Synthetic peptide
  Seed: DEGGFTCFFR (MOG_HUMAN)
DTGGFTCFFK

SEQ ID NO: 123106 - protein, 9 aa, Artificial Sequence
  Description of Artificial Sequence: Synthetic peptide
  Seed: RIRNVRFSD (MOG_HUMAN)
RLRNVRFSQ

SEQ ID NO: 123107 - protein, 10 aa, Artificial Sequence
  Description of Artificial Sequence: Synthetic peptide
  Seed: FDPHFLRVPC (MOG_HUMAN)
FMPHFLRVPM

SEQ ID NO: 123108 - protein, 10 aa, Artificial Sequence
  Description of Artificial Sequence: Synthetic peptide
  Seed: FRVIGPRHPI (MOG_HUMAN)
FCVIGPRHPI

SEQ ID NO: 123109 - protein, 10 aa, Artificial Sequence
  Description of Artificial Sequence: Synthetic peptide
  Seed: SSYAGQFRVI (MOG_HUMAN)
SWYAGQFRVL

SEQ ID NO: 123110 - protein, 9 aa, Artificial Sequence
  Description of Artificial Sequence: Synthetic peptide
  Seed: VPVLGPLVA (MOG_HUMAN)
VAVLGPLVY

SEQ ID NO: 123111 - protein, 9 aa, Artificial Sequence
  Description of Artificial Sequence: Synthetic peptide
  Seed: SSYAGQFRV (MOG_HUMAN)
SIYAGQFRY

SEQ ID NO: 123112 - protein, 10 aa, Artificial Sequence
  Description of Artificial Sequence: Synthetic peptide
  Seed: WVSPGVLVLL (MOG_HUMAN)
WVSPGVLVLI

SEQ ID NO: 123113 - protein, 9 aa, Artificial Sequence
  Description of Artificial Sequence: Synthetic peptide
  Seed: GEGKVTLRI (MOG_HUMAN)
GEGKVTLRL

SEQ ID NO: 123114 - protein, 9 aa, Artificial Sequence
  Description of Artificial Sequence: Synthetic peptide
  Seed: YRPPFSRVV (MOG_HUMAN)
YSPPFSRVV

SEQ ID NO: 123115 - protein, 10 aa, Artificial Sequence
  Description of Artificial Sequence: Synthetic peptide
  Seed: APEYRGRTEL (MOG_HUMAN)
APEYRGRTEF

SEQ ID NO: 123116 - protein, 9 aa, Artificial Sequence
  Description of Artificial Sequence: Synthetic peptide
  Seed: ICYNWLHRR (MOG_HUMAN)
IIYNWLHRK

SEQ ID NO: 123117 - protein, 10 aa, Artificial Sequence
  Description of Artificial Sequence: Synthetic peptide
  Seed: LPVLLLQITV (MOG_HUMAN)
LPVLLLQITA

SEQ ID NO: 123118 - protein, 10 aa, Artificial Sequence
  Description of Artificial Sequence: Synthetic peptide
  Seed: ITLFVIVPVL (MOG_HUMAN)
ITLFVIVPVF

SEQ ID NO: 123119 - protein, 9 aa, Artificial Sequence
  Description of Artificial Sequence: Synthetic peptide
  Seed: VGDEVELPC (MOG_HUMAN)
VLDEVELPM

SEQ ID NO: 123120 - protein, 9 aa, Artificial Sequence
  Description of Artificial Sequence: Synthetic peptide
  Seed: KVTLRIRNV (MOG_HUMAN)
KSTLRIRNA

SEQ ID NO: 123121 - protein, 10 aa, Artificial Sequence
  Description of Artificial Sequence: Synthetic peptide
  Seed: VTLRIRNVRF (MOG_HUMAN)
VSLRIRNVRW

SEQ ID NO: 123122 - protein, 9 aa, Artificial Sequence
  Description of Artificial Sequence: Synthetic peptide
  Seed: KLRAEIENL (MOG_HUMAN)
KVRAEIENL

SEQ ID NO: 123123 - protein, 10 aa, Artificial Sequence
  Description of Artificial Sequence: Synthetic peptide
  Seed: MEVGWYRPPF (MOG_HUMAN)
MEVGWYRPPY

SEQ ID NO: 123124 - protein, 9 aa, Artificial Sequence
  Description of Artificial Sequence: Synthetic peptide
  Seed: SRPSLPSCL (MOG_HUMAN)
SWPSLPSCY

SEQ ID NO: 123125 - protein, 9 aa, Artificial Sequence
  Description of Artificial Sequence: Synthetic peptide
  Seed: LVLLAVLPV (MOG_HUMAN)
LQLLAVLPI

SEQ ID NO: 123126 - protein, 8 aa, Artificial Sequence
  Description of Artificial Sequence: Synthetic peptide
  Seed: VPVLGPLV (MOG_HUMAN)
VQVLGPLL

SEQ ID NO: 123127 - protein, 9 aa, Artificial Sequence
  Description of Artificial Sequence: Synthetic peptide
  Seed: LQYRLRGKL (MOG_HUMAN)
LLYRLRGKF

SEQ ID NO: 123128 - protein, 9 aa, Artificial Sequence
  Description of Artificial Sequence: Synthetic peptide
  Seed: LQITVGLIF (MOG_HUMAN)
LQITVGLIY

SEQ ID NO: 123129 - protein, 10 aa, Artificial Sequence
  Description of Artificial Sequence: Synthetic peptide
  Seed: RTFDPHFLRV (MOG_HUMAN)
RRFDPHFLRW

SEQ ID NO: 123130 - protein, 9 aa, Artificial Sequence
  Description of Artificial Sequence: Synthetic peptide
  Seed: SLPSCLCSF (MOG_HUMAN)
SAPSCLCSI

SEQ ID NO: 123131 - protein, 9 aa, Artificial Sequence
  Description of Artificial Sequence: Synthetic peptide
  Seed: FLLLLLLQV (MOG_HUMAN)
FTLLLLLQR

SEQ ID NO: 123132 - protein, 9 aa, Artificial Sequence
  Description of Artificial Sequence: Synthetic peptide
  Seed: VLPVLLLQI (MOG_HUMAN)
VRPVLLLQL

SEQ ID NO: 123133 - protein, 9 aa, Artificial Sequence
  Description of Artificial Sequence: Synthetic peptide
  Seed: MASLSRPSL (MOG_HUMAN)
MKSLSRPSM

SEQ ID NO: 123134 - protein, 10 aa, Artificial Sequence
  Description of Artificial Sequence: Synthetic peptide
  Seed: VLVLLAVLPV (MOG_HUMAN)
VMVLLAVLPV

SEQ ID NO: 123135 - protein, 9 aa, Artificial Sequence
  Description of Artificial Sequence: Synthetic peptide
  Seed: RIRNVRFSD (MOG_HUMAN)
RWRNVRFSK

SEQ ID NO: 123136 - protein, 9 aa, Artificial Sequence
  Description of Artificial Sequence: Synthetic peptide
  Seed: SCLCSFLLL (MOG_HUMAN)
SALCSFLLW

SEQ ID NO: 123137 - protein, 10 aa, Artificial Sequence
  Description of Artificial Sequence: Synthetic peptide
  Seed: LIFLCLQYRL (MOG_HUMAN)
LLFLCLQYRL

SEQ ID NO: 123138 - protein, 9 aa, Artificial Sequence
  Description of Artificial Sequence: Synthetic peptide
  Seed: GLIFLCLQY (MOG_HUMAN)
GMIFLCLQY

SEQ ID NO: 123139 - protein, 10 aa, Artificial Sequence
  Description of Artificial Sequence: Synthetic peptide
  Seed: RTFDPHFLRV (MOG_HUMAN)
RTFDPHFLRG

SEQ ID NO: 123140 - protein, 9 aa, Artificial Sequence
  Description of Artificial Sequence: Synthetic peptide
  Seed: SCLCSFLLL (MOG_HUMAN)
SMLCSFLLV

SEQ ID NO: 123141 - protein, 11 aa, Artificial Sequence
  Description of Artificial Sequence: Synthetic peptide
  Seed: DAIGEGKVTLR (MOG_HUMAN)
DWIGEGKVTLR

SEQ ID NO: 123142 - protein, 11 aa, Artificial Sequence
  Description of Artificial Sequence: Synthetic peptide
  Seed: RTFDPHFLRVP (MOG_HUMAN)
RAFDPHFLRVR

SEQ ID NO: 123143 - protein, 10 aa, Artificial Sequence
  Description of Artificial Sequence: Synthetic peptide
  Seed: LLLQVSSSYA (MOG_HUMAN)
LQLQVSSSYY

SEQ ID NO: 123144 - protein, 9 aa, Artificial Sequence
  Description of Artificial Sequence: Synthetic peptide
  Seed: YRPPFSRVV (MOG_HUMAN)
YRPPFSRVY

SEQ ID NO: 123145 - protein, 10 aa, Artificial Sequence
  Description of Artificial Sequence: Synthetic peptide
  Seed: GLIFLCLQYR (MOG_HUMAN)
GIIFLCLQYR

SEQ ID NO: 123146 - protein, 11 aa, Artificial Sequence
  Description of Artificial Sequence: Synthetic peptide
  Seed: VIGPRHPIRAL (MOG_HUMAN)
VRGPRHPIRAL

SEQ ID NO: 123147 - protein, 9 aa, Artificial Sequence
  Description of Artificial Sequence: Synthetic peptide
  Seed: GVLVLLAVL (MOG_HUMAN)
GLLVLLAVV

SEQ ID NO: 123148 - protein, 10 aa, Artificial Sequence
  Description of Artificial Sequence: Synthetic peptide
  Seed: HRTFDPHFLR (MOG_HUMAN)
HRTFDPHFLM

SEQ ID NO: 123149 - protein, 10 aa, Artificial Sequence
  Description of Artificial Sequence: Synthetic peptide
  Seed: ELPCRISPGK (MOG_HUMAN)
EVPCRISPGR

SEQ ID NO: 123150 - protein, 9 aa, Artificial Sequence
  Description of Artificial Sequence: Synthetic peptide
  Seed: VLPVLLLQI (MOG_HUMAN)
VTPVLLLQL

SEQ ID NO: 123151 - protein, 10 aa, Artificial Sequence
  Description of Artificial Sequence: Synthetic peptide
  Seed: FSDEGGFTCF (MOG_HUMAN)
FFDEGGFTCV

SEQ ID NO: 123152 - protein, 9 aa, Artificial Sequence
  Description of Artificial Sequence: Synthetic peptide
  Seed: RTFDPHFLR (MOG_HUMAN)
RNFDPHFLK

SEQ ID NO: 123153 - protein, 11 aa, Artificial Sequence
  Description of Artificial Sequence: Synthetic peptide
  Seed: RFSDEGGFTCF (MOG_HUMAN)
RQSDEGGFTCM

SEQ ID NO: 123154 - protein, 11 aa, Artificial Sequence
  Description of Artificial Sequence: Synthetic peptide
  Seed: NATGMEVGWYR (MOG_HUMAN)
NTTGMEVGWYR

SEQ ID NO: 123155 - protein, 11 aa, Artificial Sequence
  Description of Artificial Sequence: Synthetic peptide
  Seed: NATGMEVGWYR (MOG_HUMAN)
NTTGMEVGWYK

SEQ ID NO: 123156 - protein, 9 aa, Artificial Sequence
  Description of Artificial Sequence: Synthetic peptide
  Seed: DEVELPCRI (MOG_HUMAN)
DEVELPCRF

SEQ ID NO: 123157 - protein, 10 aa, Artificial Sequence
  Description of Artificial Sequence: Synthetic peptide
  Seed: VIVPVLGPLV (MOG_HUMAN)
VLVPVLGPLL

SEQ ID NO: 123158 - protein, 10 aa, Artificial Sequence
  Description of Artificial Sequence: Synthetic peptide
  Seed: LIICYNWLHR (MOG_HUMAN)
LMICYNWLHR

SEQ ID NO: 123159 - protein, 9 aa, Artificial Sequence
  Description of Artificial Sequence: Synthetic peptide
  Seed: KLRAEIENL (MOG_HUMAN)
KTRAEIENL

SEQ ID NO: 123160 - protein, 9 aa, Artificial Sequence
  Description of Artificial Sequence: Synthetic peptide
  Seed: LQYRLRGKL (MOG_HUMAN)
LMYRLRGKF

SEQ ID NO: 123161 - protein, 9 aa, Artificial Sequence
  Description of Artificial Sequence: Synthetic peptide
  Seed: RPSLPSCLC (MOG_HUMAN)
RPSLPSCLL

SEQ ID NO: 123162 - protein, 10 aa, Artificial Sequence
  Description of Artificial Sequence: Synthetic peptide
  Seed: MELKVEDPFY (MOG_HUMAN)
MFLKVEDPFY

SEQ ID NO: 123163 - protein, 11 aa, Artificial Sequence
  Description of Artificial Sequence: Synthetic peptide
  Seed: RPSLPSCLCSF (MOG_HUMAN)
RPSLPSCLCSL

SEQ ID NO: 123164 - protein, 10 aa, Artificial Sequence
  Description of Artificial Sequence: Synthetic peptide
  Seed: FDPHFLRVPC (MOG_HUMAN)
FHPHFLRVPL

SEQ ID NO: 123165 - protein, 11 aa, Artificial Sequence
  Description of Artificial Sequence: Synthetic peptide
  Seed: VIGPRHPIRAL (MOG_HUMAN)
VCGPRHPIRAL

SEQ ID NO: 123166 - protein, 9 aa, Artificial Sequence
  Description of Artificial Sequence: Synthetic peptide
  Seed: YQEEAAMEL (MOG_HUMAN)
YREEAAMEM

SEQ ID NO: 123167 - protein, 9 aa, Artificial Sequence
  Description of Artificial Sequence: Synthetic peptide
  Seed: WVSPGVLVL (MOG_HUMAN)
WQSPGVLVV

SEQ ID NO: 123168 - protein, 9 aa, Artificial Sequence
  Description of Artificial Sequence: Synthetic peptide
  Seed: SYAGQFRVI (MOG_HUMAN)
SWAGQFRVF

SEQ ID NO: 123169 - protein, 11 aa, Artificial Sequence
  Description of Artificial Sequence: Synthetic peptide
  Seed: LHRTFDPHFLR (MOG_HUMAN)
LCRTFDPHFLR

SEQ ID NO: 123170 - protein, 10 aa, Artificial Sequence
  Description of Artificial Sequence: Synthetic peptide
  Seed: RTFDPHFLRV (MOG_HUMAN)
RFFDPHFLRE

SEQ ID NO: 123171 - protein, 11 aa, Artificial Sequence
  Description of Artificial Sequence: Synthetic peptide
  Seed: LHRTFDPHFLR (MOG_HUMAN)
LQRTFDPHFLK

SEQ ID NO: 123172 - protein, 9 aa, Artificial Sequence
  Description of Artificial Sequence: Synthetic peptide
  Seed: VIVPVLGPL (MOG_HUMAN)
VMVPVLGPF

SEQ ID NO: 123173 - protein, 9 aa, Artificial Sequence
  Description of Artificial Sequence: Synthetic peptide
  Seed: LLAVLPVLL (MOG_HUMAN)
LIAVLPVLV

SEQ ID NO: 123174 - protein, 10 aa, Artificial Sequence
  Description of Artificial Sequence: Synthetic peptide
  Seed: LLLLQVSSSY (MOG_HUMAN)
LNLLQVSSSF

SEQ ID NO: 123175 - protein, 10 aa, Artificial Sequence
  Description of Artificial Sequence: Synthetic peptide
  Seed: FVIVPVLGPL (MOG_HUMAN)
FKIVPVLGPY

SEQ ID NO: 123176 - protein, 9 aa, Artificial Sequence
  Description of Artificial Sequence: Synthetic peptide
  Seed: ITLFVIVPV (MOG_HUMAN)
IQLFVIVPV

SEQ ID NO: 123177 - protein, 11 aa, Artificial Sequence
  Description of Artificial Sequence: Synthetic peptide
  Seed: SSSYAGQFRVI (MOG_HUMAN)
SDSYAGQFRVF

SEQ ID NO: 123178 - protein, 10 aa, Artificial Sequence
  Description of Artificial Sequence: Synthetic peptide
  Seed: TGMEVGWYRP (MOG_HUMAN)
TFMEVGWYRY

SEQ ID NO: 123179 - protein, 11 aa, Artificial Sequence
  Description of Artificial Sequence: Synthetic peptide
  Seed: VIGPRHPIRAL (MOG_HUMAN)
VEGPRHPIRAL

SEQ ID NO: 123180 - protein, 9 aa, Artificial Sequence
  Description of Artificial Sequence: Synthetic peptide
  Seed: AEIENLHRT (MOG_HUMAN)
AEIENLHRC

SEQ ID NO: 123181 - protein, 10 aa, Artificial Sequence
  Description of Artificial Sequence: Synthetic peptide
  Seed: YRPPFSRVVH (MOG_HUMAN)
YRPPFSRVVF

SEQ ID NO: 123182 - protein, 9 aa, Artificial Sequence
  Description of Artificial Sequence: Synthetic peptide
  Seed: VIGPRHPIR (MOG_HUMAN)
VMGPRHPIR

SEQ ID NO: 123183 - protein, 9 aa, Artificial Sequence
  Description of Artificial Sequence: Synthetic peptide
  Seed: RIRNVRFSD (MOG_HUMAN)
RLRNVRFSG

SEQ ID NO: 123184 - protein, 10 aa, Artificial Sequence
  Description of Artificial Sequence: Synthetic peptide
  Seed: YWVSPGVLVL (MOG_HUMAN)
YYVSPGVLVW

SEQ ID NO: 123185 - protein, 9 aa, Artificial Sequence
  Description of Artificial Sequence: Synthetic peptide
  Seed: KVEDPFYWV (MOG_HUMAN)
KLEDPFYWA

SEQ ID NO: 123186 - protein, 8 aa, Artificial Sequence
  Description of Artificial Sequence: Synthetic peptide
  Seed: TFDPHFLR (MOG_HUMAN)
TIDPHFLY

SEQ ID NO: 123187 - protein, 10 aa, Artificial Sequence
  Description of Artificial Sequence: Synthetic peptide
  Seed: SLSRPSLPSC (MOG_HUMAN)
SASRPSLPSA

SEQ ID NO: 123188 - protein, 9 aa, Artificial Sequence
  Description of Artificial Sequence: Synthetic peptide
  Seed: MASLSRPSL (MOG_HUMAN)
MQSLSRPSV

SEQ ID NO: 123189 - protein, 9 aa, Artificial Sequence
  Description of Artificial Sequence: Synthetic peptide
  Seed: FLLLLLLQV (MOG_HUMAN)
FVLLLLLQL

SEQ ID NO: 123190 - protein, 10 aa, Artificial Sequence
  Description of Artificial Sequence: Synthetic peptide
  Seed: QEEAAMELKV (MOG_HUMAN)
QEEAAMELKY

SEQ ID NO: 123191 - protein, 10 aa, Artificial Sequence
  Description of Artificial Sequence: Synthetic peptide
  Seed: FVIVPVLGPL (MOG_HUMAN)
FLIVPVLGPT

SEQ ID NO: 123192 - protein, 10 aa, Artificial Sequence
  Description of Artificial Sequence: Synthetic peptide
  Seed: RTFDPHFLRV (MOG_HUMAN)
RLFDPHFLRT

SEQ ID NO: 123193 - protein, 9 aa, Artificial Sequence
  Description of Artificial Sequence: Synthetic peptide
  Seed: SSSYAGQFR (MOG_HUMAN)
SLSYAGQFK

SEQ ID NO: 123194 - protein, 9 aa, Artificial Sequence
  Description of Artificial Sequence: Synthetic peptide
  Seed: IRALVGDEV (MOG_HUMAN)
IQALVGDEL

SEQ ID NO: 123195 - protein, 10 aa, Artificial Sequence
  Description of Artificial Sequence: Synthetic peptide
  Seed: FSRVVHLYRN (MOG_HUMAN)
FSRVVHLYRR

SEQ ID NO: 123196 - protein, 10 aa, Artificial Sequence
  Description of Artificial Sequence: Synthetic peptide
  Seed: RVVHLYRNGK (MOG_HUMAN)
REVHLYRNGK

SEQ ID NO: 123197 - protein, 9 aa, Artificial Sequence
  Description of Artificial Sequence: Synthetic peptide
  Seed: LCSFLLLLL (MOG_HUMAN)
LMSFLLLLM

SEQ ID NO: 123198 - protein, 9 aa, Artificial Sequence
  Description of Artificial Sequence: Synthetic peptide
  Seed: CLCSFLLLL (MOG_HUMAN)
CMCSFLLLF

SEQ ID NO: 123199 - protein, 10 aa, Artificial Sequence
  Description of Artificial Sequence: Synthetic peptide
  Seed: DAIGEGKVTL (MOG_HUMAN)
DVIGEGKVTY

SEQ ID NO: 123200 - protein, 11 aa, Artificial Sequence
  Description of Artificial Sequence: Synthetic peptide
  Seed: DAIGEGKVTLR (MOG_HUMAN)
DVIGEGKVTLR

SEQ ID NO: 123201 - protein, 9 aa, Artificial Sequence
  Description of Artificial Sequence: Synthetic peptide
  Seed: LSRPSLPSC (MOG_HUMAN)
LARPSLPSI

SEQ ID NO: 123202 - protein, 9 aa, Artificial Sequence
  Description of Artificial Sequence: Synthetic peptide
  Seed: FLEELRNPF (MOG_HUMAN)
FLEELRNPM

SEQ ID NO: 123203 - protein, 9 aa, Artificial Sequence
  Description of Artificial Sequence: Synthetic peptide
  Seed: HRRLAGQFL (MOG_HUMAN)
HHRLAGQFI

SEQ ID NO: 123204 - protein, 9 aa, Artificial Sequence
  Description of Artificial Sequence: Synthetic peptide
  Seed: WVSPGVLVL (MOG_HUMAN)
WVSPGVLVA

SEQ ID NO: 123205 - protein, 10 aa, Artificial Sequence
  Description of Artificial Sequence: Synthetic peptide
  Seed: IICYNWLHRR (MOG_HUMAN)
IYCYNWLHRK

SEQ ID NO: 123206 - protein, 10 aa, Artificial Sequence
  Description of Artificial Sequence: Synthetic peptide
  Seed: RIRNVRFSDE (MOG_HUMAN)
RSRNVRFSDK

SEQ ID NO: 123207 - protein, 9 aa, Artificial Sequence
  Description of Artificial Sequence: Synthetic peptide
  Seed: ITLFVIVPV (MOG_HUMAN)
IILFVIVPI

SEQ ID NO: 123208 - protein, 9 aa, Artificial Sequence
  Description of Artificial Sequence: Synthetic peptide
  Seed: YRPPFSRVV (MOG_HUMAN)
YHPPFSRVF

SEQ ID NO: 123209 - protein, 10 aa, Artificial Sequence
  Description of Artificial Sequence: Synthetic peptide
  Seed: FDPHFLRVPC (MOG_HUMAN)
FGPHFLRVPI

SEQ ID NO: 123210 - protein, 9 aa, Artificial Sequence
  Description of Artificial Sequence: Synthetic peptide
  Seed: YRPPFSRVV (MOG_HUMAN)
YMPPFSRVY

SEQ ID NO: 123211 - protein, 10 aa, Artificial Sequence
  Description of Artificial Sequence: Synthetic peptide
  Seed: IGPRHPIRAL (MOG_HUMAN)
IHPRHPIRAL

SEQ ID NO: 123212 - protein, 10 aa, Artificial Sequence
  Description of Artificial Sequence: Synthetic peptide
  Seed: RIRNVRFSDE (MOG_HUMAN)
RYRNVRFSDV

SEQ ID NO: 123213 - protein, 9 aa, Artificial Sequence
  Description of Artificial Sequence: Synthetic peptide
  Seed: VPVLGPLVA (MOG_HUMAN)
VPVLGPLVM

SEQ ID NO: 123214 - protein, 10 aa, Artificial Sequence
  Description of Artificial Sequence: Synthetic peptide
  Seed: GLIFLCLQYR (MOG_HUMAN)
GFIFLCLQYR

SEQ ID NO: 123215 - protein, 10 aa, Artificial Sequence
  Description of Artificial Sequence: Synthetic peptide
  Seed: DEGGFTCFFR (MOG_HUMAN)
DYGGFTCFFK

SEQ ID NO: 123216 - protein, 9 aa, Artificial Sequence
  Description of Artificial Sequence: Synthetic peptide
  Seed: RIRNVRFSD (MOG_HUMAN)
RVRNVRFSR

SEQ ID NO: 123217 - protein, 9 aa, Artificial Sequence
  Description of Artificial Sequence: Synthetic peptide
  Seed: KDQDGDQAP (MOG_HUMAN)
KEQDGDQAA

SEQ ID NO: 123218 - protein, 9 aa, Artificial Sequence
  Description of Artificial Sequence: Synthetic peptide
  Seed: RIRNVRFSD (MOG_HUMAN)
RYRNVRFSN

SEQ ID NO: 123219 - protein, 8 aa, Artificial Sequence
  Description of Artificial Sequence: Synthetic peptide
  Seed: VIGPRHPI (MOG_HUMAN)
VSGPRHPY

SEQ ID NO: 123220 - protein, 10 aa, Artificial Sequence
  Description of Artificial Sequence: Synthetic peptide
  Seed: RTFDPHFLRV (MOG_HUMAN)
RYFDPHFLRY

SEQ ID NO: 123221 - protein, 8 aa, Artificial Sequence
  Description of Artificial Sequence: Synthetic peptide
  Seed: IENLHRTF (MOG_HUMAN)
IDNLHRTL

SEQ ID NO: 123222 - protein, 9 aa, Artificial Sequence
  Description of Artificial Sequence: Synthetic peptide
  Seed: AIGEGKVTL (MOG_HUMAN)
AYGEGKVTM

SEQ ID NO: 123223 - protein, 9 aa, Artificial Sequence
  Description of Artificial Sequence: Synthetic peptide
  Seed: VTLRIRNVR (MOG_HUMAN)
VLLRIRNVR

SEQ ID NO: 123224 - protein, 10 aa, Artificial Sequence
  Description of Artificial Sequence: Synthetic peptide
  Seed: FSDEGGFTCF (MOG_HUMAN)
FPDEGGFTCW

SEQ ID NO: 123225 - protein, 10 aa, Artificial Sequence
  Description of Artificial Sequence: Synthetic peptide
  Seed: FVIVPVLGPL (MOG_HUMAN)
FLIVPVLGPY

SEQ ID NO: 123226 - protein, 10 aa, Artificial Sequence
  Description of Artificial Sequence: Synthetic peptide
  Seed: GLIFLCLQYR (MOG_HUMAN)
GRIFLCLQYK

SEQ ID NO: 123227 - protein, 10 aa, Artificial Sequence
  Description of Artificial Sequence: Synthetic peptide
  Seed: CLCSFLLLLL (MOG_HUMAN)
CLCSFLLLLV

SEQ ID NO: 123228 - protein, 9 aa, Artificial Sequence
  Description of Artificial Sequence: Synthetic peptide
  Seed: RVIGPRHPI (MOG_HUMAN)
RIIGPRHPL

SEQ ID NO: 123229 - protein, 10 aa, Artificial Sequence
  Description of Artificial Sequence: Synthetic peptide
  Seed: RPPFSRVVHL (MOG_HUMAN)
RGPFSRVVHM

SEQ ID NO: 123230 - protein, 9 aa, Artificial Sequence
  Description of Artificial Sequence: Synthetic peptide
  Seed: VPVLGPLVA (MOG_HUMAN)
VPVLGPLVV

SEQ ID NO: 123231 - protein, 9 aa, Artificial Sequence
  Description of Artificial Sequence: Synthetic peptide
  Seed: TCFFRDHSY (MOG_HUMAN)
TMFFRDHSL

SEQ ID NO: 123232 - protein, 10 aa, Artificial Sequence
  Description of Artificial Sequence: Synthetic peptide
  Seed: AEIENLHRTF (MOG_HUMAN)
ATIENLHRTW

SEQ ID NO: 123233 - protein, 9 aa, Artificial Sequence
  Description of Artificial Sequence: Synthetic peptide
  Seed: LLLQVSSSY (MOG_HUMAN)
LHLQVSSSY

SEQ ID NO: 123234 - protein, 9 aa, Artificial Sequence
  Description of Artificial Sequence: Synthetic peptide
  Seed: SSYAGQFRV (MOG_HUMAN)
SLYAGQFRA

SEQ ID NO: 123235 - protein, 9 aa, Artificial Sequence
  Description of Artificial Sequence: Synthetic peptide
  Seed: LQVSSSYAG (MOG_HUMAN)
LQVSSSYAF

SEQ ID NO: 123236 - protein, 10 aa, Artificial Sequence
  Description of Artificial Sequence: Synthetic peptide
  Seed: FDPHFLRVPC (MOG_HUMAN)
FCPHFLRVPM

SEQ ID NO: 123237 - protein, 9 aa, Artificial Sequence
  Description of Artificial Sequence: Synthetic peptide
  Seed: VALIICYNW (MOG_HUMAN)
VSLIICYNW

SEQ ID NO: 123238 - protein, 9 aa, Artificial Sequence
  Description of Artificial Sequence: Synthetic peptide
  Seed: IICYNWLHR (MOG_HUMAN)
IACYNWLHR

SEQ ID NO: 123239 - protein, 9 aa, Artificial Sequence
  Description of Artificial Sequence: Synthetic peptide
  Seed: TGMEVGWYR (MOG_HUMAN)
TTMEVGWYY

SEQ ID NO: 123240 - protein, 9 aa, Artificial Sequence
  Description of Artificial Sequence: Synthetic peptide
  Seed: YQEEAAMEL (MOG_HUMAN)
YQEEAAMEY

SEQ ID NO: 123241 - protein, 9 aa, Artificial Sequence
  Description of Artificial Sequence: Synthetic peptide
  Seed: FSDEGGFTC (MOG_HUMAN)
FNDEGGFTV

SEQ ID NO: 123242 - protein, 10 aa, Artificial Sequence
  Description of Artificial Sequence: Synthetic peptide
  Seed: SLSRPSLPSC (MOG_HUMAN)
SASRPSLPSL

SEQ ID NO: 123243 - protein, 9 aa, Artificial Sequence
  Description of Artificial Sequence: Synthetic peptide
  Seed: RVIGPRHPI (MOG_HUMAN)
RVIGPRHPA

SEQ ID NO: 123244 - protein, 9 aa, Artificial Sequence
  Description of Artificial Sequence: Synthetic peptide
  Seed: LQITVGLIF (MOG_HUMAN)
LAITVGLIF

SEQ ID NO: 123245 - protein, 9 aa, Artificial Sequence
  Description of Artificial Sequence: Synthetic peptide
  Seed: DQAPEYRGR (MOG_HUMAN)
DWAPEYRGR

SEQ ID NO: 123246 - protein, 10 aa, Artificial Sequence
  Description of Artificial Sequence: Synthetic peptide
  Seed: VSSSYAGQFR (MOG_HUMAN)
VQSSYAGQFR

SEQ ID NO: 123247 - protein, 9 aa, Artificial Sequence
  Description of Artificial Sequence: Synthetic peptide
  Seed: TFDPHFLRV (MOG_HUMAN)
TADPHFLRY

SEQ ID NO: 123248 - protein, 9 aa, Artificial Sequence
  Description of Artificial Sequence: Synthetic peptide
  Seed: LAVLPVLLL (MOG_HUMAN)
LMVLPVLLI

SEQ ID NO: 123249 - protein, 9 aa, Artificial Sequence
  Description of Artificial Sequence: Synthetic peptide
  Seed: ITLFVIVPV (MOG_HUMAN)
ISLFVIVPV

SEQ ID NO: 123250 - protein, 10 aa, Artificial Sequence
  Description of Artificial Sequence: Synthetic peptide
  Seed: GPRHPIRALV (MOG_HUMAN)
GYRHPIRALL

SEQ ID NO: 123251 - protein, 10 aa, Artificial Sequence
  Description of Artificial Sequence: Synthetic peptide
  Seed: SCLCSFLLLL (MOG_HUMAN)
SKLCSFLLLV

SEQ ID NO: 123252 - protein, 9 aa, Artificial Sequence
  Description of Artificial Sequence: Synthetic peptide
  Seed: DGDQAPEYR (MOG_HUMAN)
DLDQAPEYY

SEQ ID NO: 123253 - protein, 9 aa, Artificial Sequence
  Description of Artificial Sequence: Synthetic peptide
  Seed: SSYAGQFRV (MOG_HUMAN)
SMYAGQFRL

SEQ ID NO: 123254 - protein, 10 aa, Artificial Sequence
  Description of Artificial Sequence: Synthetic peptide
  Seed: RTFDPHFLRV (MOG_HUMAN)
RVFDPHFLRA

SEQ ID NO: 123255 - protein, 9 aa, Artificial Sequence
  Description of Artificial Sequence: Synthetic peptide
  Seed: LLLQVSSSY (MOG_HUMAN)
LTLQVSSSM

SEQ ID NO: 123256 - protein, 9 aa, Artificial Sequence
  Description of Artificial Sequence: Synthetic peptide
  Seed: LQVSSSYAG (MOG_HUMAN)
LEVSSSYAY

SEQ ID NO: 123257 - protein, 9 aa, Artificial Sequence
  Description of Artificial Sequence: Synthetic peptide
  Seed: MASLSRPSL (MOG_HUMAN)
MESLSRPSF

SEQ ID NO: 123258 - protein, 11 aa, Artificial Sequence
  Description of Artificial Sequence: Synthetic peptide
  Seed: RFSDEGGFTCF (MOG_HUMAN)
RYSDEGGFTCL

SEQ ID NO: 123259 - protein, 11 aa, Artificial Sequence
  Description of Artificial Sequence: Synthetic peptide
  Seed: NATGMEVGWYR (MOG_HUMAN)
NATGMEVGWYK

SEQ ID NO: 123260 - protein, 9 aa, Artificial Sequence
  Description of Artificial Sequence: Synthetic peptide
  Seed: KLRAEIENL (MOG_HUMAN)
KIRAEIENI

SEQ ID NO: 123261 - protein, 10 aa, Artificial Sequence
  Description of Artificial Sequence: Synthetic peptide
  Seed: LIICYNWLHR (MOG_HUMAN)
LAICYNWLHR

SEQ ID NO: 123262 - protein, 10 aa, Artificial Sequence
  Description of Artificial Sequence: Synthetic peptide
  Seed: RLAGQFLEEL (MOG_HUMAN)
RIAGQFLEEL

SEQ ID NO: 123263 - protein, 10 aa, Artificial Sequence
  Description of Artificial Sequence: Synthetic peptide
  Seed: KNATGMEVGW (MOG_HUMAN)
KTATGMEVGW

SEQ ID NO: 123264 - protein, 10 aa, Artificial Sequence
  Description of Artificial Sequence: Synthetic peptide
  Seed: VPVLGPLVAL (MOG_HUMAN)
VFVLGPLVAV

SEQ ID NO: 123265 - protein, 9 aa, Artificial Sequence
  Description of Artificial Sequence: Synthetic peptide
  Seed: VLGPLVALI (MOG_HUMAN)
VVGPLVALR

SEQ ID NO: 123266 - protein, 9 aa, Artificial Sequence
  Description of Artificial Sequence: Synthetic peptide
  Seed: VSPGVLVLL (MOG_HUMAN)
VSPGVLVLM

SEQ ID NO: 123267 - protein, 10 aa, Artificial Sequence
  Description of Artificial Sequence: Synthetic peptide
  Seed: YQEEAAMELK (MOG_HUMAN)
YIEEAAMELY

SEQ ID NO: 123268 - protein, 9 aa, Artificial Sequence
  Description of Artificial Sequence: Synthetic peptide
  Seed: SLPSCLCSF (MOG_HUMAN)
SYPSCLCSF

SEQ ID NO: 123269 - protein, 10 aa, Artificial Sequence
  Description of Artificial Sequence: Synthetic peptide
  Seed: SFLLLLLLQV (MOG_HUMAN)
SNLLLLLLQV

SEQ ID NO: 123270 - protein, 10 aa, Artificial Sequence
  Description of Artificial Sequence: Synthetic peptide
  Seed: KITLFVIVPV (MOG_HUMAN)
KDTLFVIVPV

SEQ ID NO: 123271 - protein, 9 aa, Artificial Sequence
  Description of Artificial Sequence: Synthetic peptide
  Seed: GEGKVTLRI (MOG_HUMAN)
GEGKVTLRF

SEQ ID NO: 123272 - protein, 9 aa, Artificial Sequence
  Description of Artificial Sequence: Synthetic peptide
  Seed: RIRNVRFSD (MOG_HUMAN)
RIRNVRFSY

SEQ ID NO: 123273 - protein, 9 aa, Artificial Sequence
  Description of Artificial Sequence: Synthetic peptide
  Seed: SLPSCLCSF (MOG_HUMAN)
SLPSCLCSA

SEQ ID NO: 123274 - protein, 9 aa, Artificial Sequence
  Description of Artificial Sequence: Synthetic peptide
  Seed: SLPSCLCSF (MOG_HUMAN)
SAPSCLCSF

SEQ ID NO: 123275 - protein, 9 aa, Artificial Sequence
  Description of Artificial Sequence: Synthetic peptide
  Seed: VGDEVELPC (MOG_HUMAN)
VNDEVELPI

SEQ ID NO: 123276 - protein, 9 aa, Artificial Sequence
  Description of Artificial Sequence: Synthetic peptide
  Seed: RVPCWKITL (MOG_HUMAN)
RVPCWKITK

SEQ ID NO: 123277 - protein, 9 aa, Artificial Sequence
  Description of Artificial Sequence: Synthetic peptide
  Seed: TFDPHFLRV (MOG_HUMAN)
TQDPHFLRF

SEQ ID NO: 123278 - protein, 9 aa, Artificial Sequence
  Description of Artificial Sequence: Synthetic peptide
  Seed: LLLQITVGL (MOG_HUMAN)
LMLQITVGA

SEQ ID NO: 123279 - protein, 10 aa, Artificial Sequence
  Description of Artificial Sequence: Synthetic peptide
  Seed: FLLLLLLQVS (MOG_HUMAN)
FWLLLLLQVV

SEQ ID NO: 123280 - protein, 9 aa, Artificial Sequence
  Description of Artificial Sequence: Synthetic peptide
  Seed: RTFDPHFLR (MOG_HUMAN)
RWFDPHFLR

SEQ ID NO: 123281 - protein, 9 aa, Artificial Sequence
  Description of Artificial Sequence: Synthetic peptide
  Seed: LSRPSLPSC (MOG_HUMAN)
LMRPSLPSV

SEQ ID NO: 123282 - protein, 9 aa, Artificial Sequence
  Description of Artificial Sequence: Synthetic peptide
  Seed: SSYAGQFRV (MOG_HUMAN)
SAYAGQFRV

SEQ ID NO: 123283 - protein, 10 aa, Artificial Sequence
  Description of Artificial Sequence: Synthetic peptide
  Seed: SSYAGQFRVI (MOG_HUMAN)
STYAGQFRVM

SEQ ID NO: 123284 - protein, 11 aa, Artificial Sequence
  Description of Artificial Sequence: Synthetic peptide
  Seed: FSDEGGFTCFF (MOG_HUMAN)
FFDEGGFTCFL

SEQ ID NO: 123285 - protein, 10 aa, Artificial Sequence
  Description of Artificial Sequence: Synthetic peptide
  Seed: WVSPGVLVLL (MOG_HUMAN)
WASPGVLVLW

SEQ ID NO: 123286 - protein, 9 aa, Artificial Sequence
  Description of Artificial Sequence: Synthetic peptide
  Seed: LQITVGLIF (MOG_HUMAN)
LFITVGLIY

SEQ ID NO: 123287 - protein, 9 aa, Artificial Sequence
  Description of Artificial Sequence: Synthetic peptide
  Seed: ITLFVIVPV (MOG_HUMAN)
IALFVIVPV

SEQ ID NO: 123288 - protein, 10 aa, Artificial Sequence
  Description of Artificial Sequence: Synthetic peptide
  Seed: ITLFVIVPVL (MOG_HUMAN)
ILLFVIVPVT

SEQ ID NO: 123289 - protein, 10 aa, Artificial Sequence
  Description of Artificial Sequence: Synthetic peptide
  Seed: LVLLAVLPVL (MOG_HUMAN)
LNLLAVLPVI

SEQ ID NO: 123290 - protein, 9 aa, Artificial Sequence
  Description of Artificial Sequence: Synthetic peptide
  Seed: VRFSDEGGF (MOG_HUMAN)
VQFSDEGGY

SEQ ID NO: 123291 - protein, 11 aa, Artificial Sequence
  Description of Artificial Sequence: Synthetic peptide
  Seed: DAIGEGKVTLR (MOG_HUMAN)
DAIGEGKVTLK

SEQ ID NO: 123292 - protein, 9 aa, Artificial Sequence
  Description of Artificial Sequence: Synthetic peptide
  Seed: VGDEVELPC (MOG_HUMAN)
VVDEVELPM

SEQ ID NO: 123293 - protein, 9 aa, Artificial Sequence
  Description of Artificial Sequence: Synthetic peptide
  Seed: LSRPSLPSC (MOG_HUMAN)
LMRPSLPSA

SEQ ID NO: 123294 - protein, 9 aa, Artificial Sequence
  Description of Artificial Sequence: Synthetic peptide
  Seed: HFLRVPCWK (MOG_HUMAN)
HQLRVPCWR

SEQ ID NO: 123295 - protein, 10 aa, Artificial Sequence
  Description of Artificial Sequence: Synthetic peptide
  Seed: IGPRHPIRAL (MOG_HUMAN)
INPRHPIRAL

SEQ ID NO: 123296 - protein, 10 aa, Artificial Sequence
  Description of Artificial Sequence: Synthetic peptide
  Seed: LQYRLRGKLR (MOG_HUMAN)
LTYRLRGKLR

SEQ ID NO: 123297 - protein, 10 aa, Artificial Sequence
  Description of Artificial Sequence: Synthetic peptide
  Seed: IFLCLQYRLR (MOG_HUMAN)
IALCLQYRLR

SEQ ID NO: 123298 - protein, 9 aa, Artificial Sequence
  Description of Artificial Sequence: Synthetic peptide
  Seed: LHRRLAGQF (MOG_HUMAN)
LQRRLAGQM

SEQ ID NO: 123299 - protein, 11 aa, Artificial Sequence
  Description of Artificial Sequence: Synthetic peptide
  Seed: HRTFDPHFLRV (MOG_HUMAN)
HMTFDPHFLRK

SEQ ID NO: 123300 - protein, 10 aa, Artificial Sequence
  Description of Artificial Sequence: Synthetic peptide
  Seed: FSDEGGFTCF (MOG_HUMAN)
FLDEGGFTCF

SEQ ID NO: 123301 - protein, 9 aa, Artificial Sequence
  Description of Artificial Sequence: Synthetic peptide
  Seed: ICYNWLHRR (MOG_HUMAN)
IGYNWLHRR

SEQ ID NO: 123302 - protein, 10 aa, Artificial Sequence
  Description of Artificial Sequence: Synthetic peptide
  Seed: KITLFVIVPV (MOG_HUMAN)
KMTLFVIVPV

SEQ ID NO: 123303 - protein, 10 aa, Artificial Sequence
  Description of Artificial Sequence: Synthetic peptide
  Seed: LVLLAVLPVL (MOG_HUMAN)
LSLLAVLPVV

SEQ ID NO: 123304 - protein, 10 aa, Artificial Sequence
  Description of Artificial Sequence: Synthetic peptide
  Seed: RTFDPHFLRV (MOG_HUMAN)
RLFDPHFLRK

SEQ ID NO: 123305 - protein, 11 aa, Artificial Sequence
  Description of Artificial Sequence: Synthetic peptide
  Seed: VIGPRHPIRAL (MOG_HUMAN)
VWGPRHPIRAL

SEQ ID NO: 123306 - protein, 9 aa, Artificial Sequence
  Description of Artificial Sequence: Synthetic peptide
  Seed: MELKVEDPF (MOG_HUMAN)
MMLKVEDPM

SEQ ID NO: 123307 - protein, 11 aa, Artificial Sequence
  Description of Artificial Sequence: Synthetic peptide
  Seed: RVPCWKITLFV (MOG_HUMAN)
RMPCWKITLFL

SEQ ID NO: 123308 - protein, 9 aa, Artificial Sequence
  Description of Artificial Sequence: Synthetic peptide
  Seed: ITLFVIVPV (MOG_HUMAN)
IQLFVIVPI

SEQ ID NO: 123309 - protein, 9 aa, Artificial Sequence
  Description of Artificial Sequence: Synthetic peptide
  Seed: VIVPVLGPL (MOG_HUMAN)
VSVPVLGPL

SEQ ID NO: 123310 - protein, 9 aa, Artificial Sequence
  Description of Artificial Sequence: Synthetic peptide
  Seed: TLFVIVPVL (MOG_HUMAN)
TAFVIVPVF

SEQ ID NO: 123311 - protein, 9 aa, Artificial Sequence
  Description of Artificial Sequence: Synthetic peptide
  Seed: SSYAGQFRV (MOG_HUMAN)
SQYAGQFRY

SEQ ID NO: 123312 - protein, 9 aa, Artificial Sequence
  Description of Artificial Sequence: Synthetic peptide
  Seed: MASLSRPSL (MOG_HUMAN)
MSSLSRPSM

SEQ ID NO: 123313 - protein, 10 aa, Artificial Sequence
  Description of Artificial Sequence: Synthetic peptide
  Seed: RTFDPHFLRV (MOG_HUMAN)
RIFDPHFLRI

SEQ ID NO: 123314 - protein, 11 aa, Artificial Sequence
  Description of Artificial Sequence: Synthetic peptide
  Seed: RAEIENLHRTF (MOG_HUMAN)
RVEIENLHRTW

SEQ ID NO: 123315 - protein, 9 aa, Artificial Sequence
  Description of Artificial Sequence: Synthetic peptide
  Seed: RTFDPHFLR (MOG_HUMAN)
RWFDPHFLY

SEQ ID NO: 123316 - protein, 9 aa, Artificial Sequence
  Description of Artificial Sequence: Synthetic peptide
  Seed: ICYNWLHRR (MOG_HUMAN)
IAYNWLHRK

SEQ ID NO: 123317 - protein, 10 aa, Artificial Sequence
  Description of Artificial Sequence: Synthetic peptide
  Seed: RRLAGQFLEE (MOG_HUMAN)
RRLAGQFLEL

SEQ ID NO: 123318 - protein, 10 aa, Artificial Sequence
  Description of Artificial Sequence: Synthetic peptide
  Seed: LLLLQVSSSY (MOG_HUMAN)
LILLQVSSSY

SEQ ID NO: 123319 - protein, 8 aa, Artificial Sequence
  Description of Artificial Sequence: Synthetic peptide
  Seed: TLFVIVPV (MOG_HUMAN)
TQFVIVPV

SEQ ID NO: 123320 - protein, 9 aa, Artificial Sequence
  Description of Artificial Sequence: Synthetic peptide
  Seed: LKVEDPFYW (MOG_HUMAN)
LTVEDPFYF

SEQ ID NO: 123321 - protein, 11 aa, Artificial Sequence
  Description of Artificial Sequence: Synthetic peptide
  Seed: RDHSYQEEAAM (MOG_HUMAN)
REHSYQEEAAY

SEQ ID NO: 123322 - protein, 9 aa, Artificial Sequence
  Description of Artificial Sequence: Synthetic peptide
  Seed: SSSYAGQFR (MOG_HUMAN)
SISYAGQFR

SEQ ID NO: 123323 - protein, 9 aa, Artificial Sequence
  Description of Artificial Sequence: Synthetic peptide
  Seed: SLPSCLCSF (MOG_HUMAN)
SIPSCLCSM

SEQ ID NO: 123324 - protein, 9 aa, Artificial Sequence
  Description of Artificial Sequence: Synthetic peptide
  Seed: VLGPLVALI (MOG_HUMAN)
VLGPLVALL

SEQ ID NO: 123325 - protein, 9 aa, Artificial Sequence
  Description of Artificial Sequence: Synthetic peptide
  Seed: RIRNVRFSD (MOG_HUMAN)
RYRNVRFSQ

SEQ ID NO: 123326 - protein, 10 aa, Artificial Sequence
  Description of Artificial Sequence: Synthetic peptide
  Seed: IGPRHPIRAL (MOG_HUMAN)
IFPRHPIRAL

SEQ ID NO: 123327 - protein, 10 aa, Artificial Sequence
  Description of Artificial Sequence: Synthetic peptide
  Seed: ITVGLIFLCL (MOG_HUMAN)
ITVGLIFLCV

SEQ ID NO: 123328 - protein, 10 aa, Artificial Sequence
  Description of Artificial Sequence: Synthetic peptide
  Seed: SLSRPSLPSC (MOG_HUMAN)
SDSRPSLPSV

SEQ ID NO: 123329 - protein, 9 aa, Artificial Sequence
  Description of Artificial Sequence: Synthetic peptide
  Seed: PVLGPLVAL (MOG_HUMAN)
PMLGPLVAY

SEQ ID NO: 123330 - protein, 10 aa, Artificial Sequence
  Description of Artificial Sequence: Synthetic peptide
  Seed: FVIVPVLGPL (MOG_HUMAN)
FKIVPVLGPL

SEQ ID NO: 123331 - protein, 10 aa, Artificial Sequence
  Description of Artificial Sequence: Synthetic peptide
  Seed: FDPHFLRVPC (MOG_HUMAN)
FLPHFLRVPF

SEQ ID NO: 123332 - protein, 9 aa, Artificial Sequence
  Description of Artificial Sequence: Synthetic peptide
  Seed: EEAAMELKV (MOG_HUMAN)
EEAAMELKY

SEQ ID NO: 123333 - protein, 9 aa, Artificial Sequence
  Description of Artificial Sequence: Synthetic peptide
  Seed: RVIGPRHPI (MOG_HUMAN)
RMIGPRHPW

SEQ ID NO: 123334 - protein, 10 aa, Artificial Sequence
  Description of Artificial Sequence: Synthetic peptide
  Seed: SCLCSFLLLL (MOG_HUMAN)
STLCSFLLLI

SEQ ID NO: 123335 - protein, 10 aa, Artificial Sequence
  Description of Artificial Sequence: Synthetic peptide
  Seed: RPPFSRVVHL (MOG_HUMAN)
RKPFSRVVHL

SEQ ID NO: 123336 - protein, 9 aa, Artificial Sequence
  Description of Artificial Sequence: Synthetic peptide
  Seed: SSYAGQFRV (MOG_HUMAN)
SLYAGQFRT

SEQ ID NO: 123337 - protein, 9 aa, Artificial Sequence
  Description of Artificial Sequence: Synthetic peptide
  Seed: HSYQEEAAM (MOG_HUMAN)
HPYQEEAAF

SEQ ID NO: 123338 - protein, 11 aa, Artificial Sequence
  Description of Artificial Sequence: Synthetic peptide
  Seed: RIRNVRFSDEG (MOG_HUMAN)
RSRNVRFSDEV

SEQ ID NO: 123339 - protein, 11 aa, Artificial Sequence
  Description of Artificial Sequence: Synthetic peptide
  Seed: RVIGPRHPIRA (MOG_HUMAN)
RIIGPRHPIRR

SEQ ID NO: 123340 - protein, 9 aa, Artificial Sequence
  Description of Artificial Sequence: Synthetic peptide
  Seed: RVPCWKITL (MOG_HUMAN)
RSPCWKITF

SEQ ID NO: 123341 - protein, 9 aa, Artificial Sequence
  Description of Artificial Sequence: Synthetic peptide
  Seed: VIVPVLGPL (MOG_HUMAN)
VAVPVLGPL

SEQ ID NO: 123342 - protein, 10 aa, Artificial Sequence
  Description of Artificial Sequence: Synthetic peptide
  Seed: LQYRLRGKLR (MOG_HUMAN)
LSYRLRGKLR

SEQ ID NO: 123343 - protein, 9 aa, Artificial Sequence
  Description of Artificial Sequence: Synthetic peptide
  Seed: MELKVEDPF (MOG_HUMAN)
MELKVEDPW

SEQ ID NO: 123344 - protein, 9 aa, Artificial Sequence
  Description of Artificial Sequence: Synthetic peptide
  Seed: WVSPGVLVL (MOG_HUMAN)
WRSPGVLVY

SEQ ID NO: 123345 - protein, 9 aa, Artificial Sequence
  Description of Artificial Sequence: Synthetic peptide
  Seed: LLLQVSSSY (MOG_HUMAN)
LSLQVSSSV

SEQ ID NO: 123346 - protein, 10 aa, Artificial Sequence
  Description of Artificial Sequence: Synthetic peptide
  Seed: FVIVPVLGPL (MOG_HUMAN)
FGIVPVLGPA

SEQ ID NO: 123347 - protein, 10 aa, Artificial Sequence
  Description of Artificial Sequence: Synthetic peptide
  Seed: GLIFLCLQYR (MOG_HUMAN)
GPIFLCLQYR

SEQ ID NO: 123348 - protein, 9 aa, Artificial Sequence
  Description of Artificial Sequence: Synthetic peptide
  Seed: AIGEGKVTL (MOG_HUMAN)
AMGEGKVTA

SEQ ID NO: 123349 - protein, 10 aa, Artificial Sequence
  Description of Artificial Sequence: Synthetic peptide
  Seed: SCLCSFLLLL (MOG_HUMAN)
STLCSFLLLV

SEQ ID NO: 123350 - protein, 9 aa, Artificial Sequence
  Description of Artificial Sequence: Synthetic peptide
  Seed: ALVGDEVEL (MOG_HUMAN)
AVVGDEVEY

SEQ ID NO: 123351 - protein, 9 aa, Artificial Sequence
  Description of Artificial Sequence: Synthetic peptide
  Seed: YRPPFSRVV (MOG_HUMAN)
YTPPFSRVV

SEQ ID NO: 123352 - protein, 9 aa, Artificial Sequence
  Description of Artificial Sequence: Synthetic peptide
  Seed: KLRAEIENL (MOG_HUMAN)
KVRAEIENA

SEQ ID NO: 123353 - protein, 9 aa, Artificial Sequence
  Description of Artificial Sequence: Synthetic peptide
  Seed: SSSYAGQFR (MOG_HUMAN)
SYSYAGQFR

SEQ ID NO: 123354 - protein, 11 aa, Artificial Sequence
  Description of Artificial Sequence: Synthetic peptide
  Seed: HRTFDPHFLRV (MOG_HUMAN)
HITFDPHFLRR

SEQ ID NO: 123355 - protein, 9 aa, Artificial Sequence
  Description of Artificial Sequence: Synthetic peptide
  Seed: TCFFRDHSY (MOG_HUMAN)
TVFFRDHSY

SEQ ID NO: 123356 - protein, 10 aa, Artificial Sequence
  Description of Artificial Sequence: Synthetic peptide
  Seed: IICYNWLHRR (MOG_HUMAN)
IWCYNWLHRR

SEQ ID NO: 123357 - protein, 10 aa, Artificial Sequence
  Description of Artificial Sequence: Synthetic peptide
  Seed: DEGGFTCFFR (MOG_HUMAN)
DAGGFTCFFK

SEQ ID NO: 123358 - protein, 9 aa, Artificial Sequence
  Description of Artificial Sequence: Synthetic peptide
  Seed: VSPGVLVLL (MOG_HUMAN)
VYPGVLVLM

SEQ ID NO: 123359 - protein, 9 aa, Artificial Sequence
  Description of Artificial Sequence: Synthetic peptide
  Seed: LQVSSSYAG (MOG_HUMAN)
LGVSSSYAY

SEQ ID NO: 123360 - protein, 10 aa, Artificial Sequence
  Description of Artificial Sequence: Synthetic peptide
  Seed: KITLFVIVPV (MOG_HUMAN)
KQTLFVIVPL

SEQ ID NO: 123361 - protein, 10 aa, Artificial Sequence
  Description of Artificial Sequence: Synthetic peptide
  Seed: LLLQITVGLI (MOG_HUMAN)
LMLQITVGLI

SEQ ID NO: 123362 - protein, 9 aa, Artificial Sequence
  Description of Artificial Sequence: Synthetic peptide
  Seed: CLCSFLLLL (MOG_HUMAN)
CLCSFLLLM

SEQ ID NO: 123363 - protein, 10 aa, Artificial Sequence
  Description of Artificial Sequence: Synthetic peptide
  Seed: RLAGQFLEEL (MOG_HUMAN)
RLAGQFLEEF

SEQ ID NO: 123364 - protein, 10 aa, Artificial Sequence
  Description of Artificial Sequence: Synthetic peptide
  Seed: VLLAVLPVLL (MOG_HUMAN)
VNLAVLPVLV

SEQ ID NO: 123365 - protein, 9 aa, Artificial Sequence
  Description of Artificial Sequence: Synthetic peptide
  Seed: FLLLLLLQV (MOG_HUMAN)
FILLLLLQA

SEQ ID NO: 123366 - protein, 9 aa, Artificial Sequence
  Description of Artificial Sequence: Synthetic peptide
  Seed: TFDPHFLRV (MOG_HUMAN)
TTDPHFLRC

SEQ ID NO: 123367 - protein, 8 aa, Artificial Sequence
  Description of Artificial Sequence: Synthetic peptide
  Seed: TFDPHFLR (MOG_HUMAN)
TSDPHFLY

SEQ ID NO: 123368 - protein, 11 aa, Artificial Sequence
  Description of Artificial Sequence: Synthetic peptide
  Seed: RTFDPHFLRVP (MOG_HUMAN)
RTFDPHFLRVK

SEQ ID NO: 123369 - protein, 10 aa, Artificial Sequence
  Description of Artificial Sequence: Synthetic peptide
  Seed: FDPHFLRVPC (MOG_HUMAN)
FYPHFLRVPP

SEQ ID NO: 123370 - protein, 9 aa, Artificial Sequence
  Description of Artificial Sequence: Synthetic peptide
  Seed: LLAVLPVLL (MOG_HUMAN)
LLAVLPVLR

SEQ ID NO: 123371 - protein, 9 aa, Artificial Sequence
  Description of Artificial Sequence: Synthetic peptide
  Seed: LQITVGLIF (MOG_HUMAN)
LQITVGLII

SEQ ID NO: 123372 - protein, 9 aa, Artificial Sequence
  Description of Artificial Sequence: Synthetic peptide
  Seed: VLPVLLLQI (MOG_HUMAN)
VMPVLLLQL

SEQ ID NO: 123373 - protein, 10 aa, Artificial Sequence
  Description of Artificial Sequence: Synthetic peptide
  Seed: VLLLQITVGL (MOG_HUMAN)
VVLLQITVGI

SEQ ID NO: 123374 - protein, 9 aa, Artificial Sequence
  Description of Artificial Sequence: Synthetic peptide
  Seed: TFDPHFLRV (MOG_HUMAN)
TLDPHFLRV

SEQ ID NO: 123375 - protein, 10 aa, Artificial Sequence
  Description of Artificial Sequence: Synthetic peptide
  Seed: VPVLGPLVAL (MOG_HUMAN)
VLVLGPLVAV

SEQ ID NO: 123376 - protein, 10 aa, Artificial Sequence
  Description of Artificial Sequence: Synthetic peptide
  Seed: RTFDPHFLRV (MOG_HUMAN)
RQFDPHFLRA

SEQ ID NO: 123377 - protein, 10 aa, Artificial Sequence
  Description of Artificial Sequence: Synthetic peptide
  Seed: DAIGEGKVTL (MOG_HUMAN)
DTIGEGKVTK

SEQ ID NO: 123378 - protein, 10 aa, Artificial Sequence
  Description of Artificial Sequence: Synthetic peptide
  Seed: LLLQVSSSYA (MOG_HUMAN)
LLLQVSSSYY

SEQ ID NO: 123379 - protein, 10 aa, Artificial Sequence
  Description of Artificial Sequence: Synthetic peptide
  Seed: FSRVVHLYRN (MOG_HUMAN)
FVRVVHLYRR

SEQ ID NO: 123380 - protein, 9 aa, Artificial Sequence
  Description of Artificial Sequence: Synthetic peptide
  Seed: FYWVSPGVL (MOG_HUMAN)
FKWVSPGVI

SEQ ID NO: 123381 - protein, 9 aa, Artificial Sequence
  Description of Artificial Sequence: Synthetic peptide
  Seed: WVSPGVLVL (MOG_HUMAN)
WASPGVLVV

SEQ ID NO: 123382 - protein, 10 aa, Artificial Sequence
  Description of Artificial Sequence: Synthetic peptide
  Seed: ITLFVIVPVL (MOG_HUMAN)
IMLFVIVPVV

SEQ ID NO: 123383 - protein, 10 aa, Artificial Sequence
  Description of Artificial Sequence: Synthetic peptide
  Seed: SCLCSFLLLL (MOG_HUMAN)
SWLCSFLLLL

SEQ ID NO: 123384 - protein, 10 aa, Artificial Sequence
  Description of Artificial Sequence: Synthetic peptide
  Seed: GLIFLCLQYR (MOG_HUMAN)
GNIFLCLQYR

SEQ ID NO: 123385 - protein, 10 aa, Artificial Sequence
  Description of Artificial Sequence: Synthetic peptide
  Seed: SLSRPSLPSC (MOG_HUMAN)
SESRPSLPSA

SEQ ID NO: 123386 - protein, 9 aa, Artificial Sequence
  Description of Artificial Sequence: Synthetic peptide
  Seed: AIGEGKVTL (MOG_HUMAN)
ARGEGKVTY

SEQ ID NO: 123387 - protein, 9 aa, Artificial Sequence
  Description of Artificial Sequence: Synthetic peptide
  Seed: RVPCWKITL (MOG_HUMAN)
RVPCWKITF

SEQ ID NO: 123388 - protein, 9 aa, Artificial Sequence
  Description of Artificial Sequence: Synthetic peptide
  Seed: TFDPHFLRV (MOG_HUMAN)
TQDPHFLRM

SEQ ID NO: 123389 - protein, 9 aa, Artificial Sequence
  Description of Artificial Sequence: Synthetic peptide
  Seed: FLLLLLLQV (MOG_HUMAN)
FLLLLLLQA

SEQ ID NO: 123390 - protein, 10 aa, Artificial Sequence
  Description of Artificial Sequence: Synthetic peptide
  Seed: RTFDPHFLRV (MOG_HUMAN)
RFFDPHFLRN

SEQ ID NO: 123391 - protein, 11 aa, Artificial Sequence
  Description of Artificial Sequence: Synthetic peptide
  Seed: LHRTFDPHFLR (MOG_HUMAN)
LNRTFDPHFLK

SEQ ID NO: 123392 - protein, 10 aa, Artificial Sequence
  Description of Artificial Sequence: Synthetic peptide
  Seed: WVSPGVLVLL (MOG_HUMAN)
WLSPGVLVLV

SEQ ID NO: 123393 - protein, 9 aa, Artificial Sequence
  Description of Artificial Sequence: Synthetic peptide
  Seed: ALVGDEVEL (MOG_HUMAN)
AMVGDEVEW

SEQ ID NO: 123394 - protein, 10 aa, Artificial Sequence
  Description of Artificial Sequence: Synthetic peptide
  Seed: FTCFFRDHSY (MOG_HUMAN)
FICFFRDHSR

SEQ ID NO: 123395 - protein, 9 aa, Artificial Sequence
  Description of Artificial Sequence: Synthetic peptide
  Seed: ITVGLIFLC (MOG_HUMAN)
IVVGLIFLV

SEQ ID NO: 123396 - protein, 10 aa, Artificial Sequence
  Description of Artificial Sequence: Synthetic peptide
  Seed: GLIFLCLQYR (MOG_HUMAN)
GVIFLCLQYK

SEQ ID NO: 123397 - protein, 9 aa, Artificial Sequence
  Description of Artificial Sequence: Synthetic peptide
  Seed: TCFFRDHSY (MOG_HUMAN)
TPFFRDHSF

SEQ ID NO: 123398 - protein, 10 aa, Artificial Sequence
  Description of Artificial Sequence: Synthetic peptide
  Seed: VPVLGPLVAL (MOG_HUMAN)
VWVLGPLVAV

SEQ ID NO: 123399 - protein, 9 aa, Artificial Sequence
  Description of Artificial Sequence: Synthetic peptide
  Seed: RVIGPRHPI (MOG_HUMAN)
RSIGPRHPV

SEQ ID NO: 123400 - protein, 11 aa, Artificial Sequence
  Description of Artificial Sequence: Synthetic peptide
  Seed: SSSYAGQFRVI (MOG_HUMAN)
SQSYAGQFRVF

SEQ ID NO: 123401 - protein, 9 aa, Artificial Sequence
  Description of Artificial Sequence: Synthetic peptide
  Seed: VGDEVELPC (MOG_HUMAN)
VWDEVELPL

SEQ ID NO: 123402 - protein, 10 aa, Artificial Sequence
  Description of Artificial Sequence: Synthetic peptide
  Seed: RTFDPHFLRV (MOG_HUMAN)
RQFDPHFLRP

SEQ ID NO: 123403 - protein, 11 aa, Artificial Sequence
  Description of Artificial Sequence: Synthetic peptide
  Seed: KLRAEIENLHR (MOG_HUMAN)
KMRAEIENLHR

SEQ ID NO: 123404 - protein, 11 aa, Artificial Sequence
  Description of Artificial Sequence: Synthetic peptide
  Seed: FSDEGGFTCFF (MOG_HUMAN)
FVDEGGFTCFY

SEQ ID NO: 123405 - protein, 10 aa, Artificial Sequence
  Description of Artificial Sequence: Synthetic peptide
  Seed: LPVLLLQITV (MOG_HUMAN)
LLVLLLQITV

SEQ ID NO: 123406 - protein, 9 aa, Artificial Sequence
  Description of Artificial Sequence: Synthetic peptide
  Seed: RIRNVRFSD (MOG_HUMAN)
RSRNVRFSK

SEQ ID NO: 123407 - protein, 11 aa, Artificial Sequence
  Description of Artificial Sequence: Synthetic peptide
  Seed: RTFDPHFLRVP (MOG_HUMAN)
RMFDPHFLRVK

SEQ ID NO: 123408 - protein, 9 aa, Artificial Sequence
  Description of Artificial Sequence: Synthetic peptide
  Seed: ICYNWLHRR (MOG_HUMAN)
IFYNWLHRR

SEQ ID NO: 123409 - protein, 9 aa, Artificial Sequence
  Description of Artificial Sequence: Synthetic peptide
  Seed: SCLCSFLLL (MOG_HUMAN)
SVLCSFLLW

SEQ ID NO: 123410 - protein, 10 aa, Artificial Sequence
  Description of Artificial Sequence: Synthetic peptide
  Seed: RALVGDEVEL (MOG_HUMAN)
RQLVGDEVEL

SEQ ID NO: 123411 - protein, 9 aa, Artificial Sequence
  Description of Artificial Sequence: Synthetic peptide
  Seed: SRPSLPSCL (MOG_HUMAN)
SYPSLPSCV

SEQ ID NO: 123412 - protein, 9 aa, Artificial Sequence
  Description of Artificial Sequence: Synthetic peptide
  Seed: TFDPHFLRV (MOG_HUMAN)
TIDPHFLRM

SEQ ID NO: 123413 - protein, 9 aa, Artificial Sequence
  Description of Artificial Sequence: Synthetic peptide
  Seed: RVPCWKITL (MOG_HUMAN)
RYPCWKITF

SEQ ID NO: 123414 - protein, 10 aa, Artificial Sequence
  Description of Artificial Sequence: Synthetic peptide
  Seed: RTFDPHFLRV (MOG_HUMAN)
RIFDPHFLRY

SEQ ID NO: 123415 - protein, 9 aa, Artificial Sequence
  Description of Artificial Sequence: Synthetic peptide
  Seed: CSFLLLLLL (MOG_HUMAN)
CMFLLLLLV

SEQ ID NO: 123416 - protein, 10 aa, Artificial Sequence
  Description of Artificial Sequence: Synthetic peptide
  Seed: DQDGDQAPEY (MOG_HUMAN)
DSDGDQAPEY

SEQ ID NO: 123417 - protein, 9 aa, Artificial Sequence
  Description of Artificial Sequence: Synthetic peptide
  Seed: SSYAGQFRV (MOG_HUMAN)
SQYAGQFRL

SEQ ID NO: 123418 - protein, 11 aa, Artificial Sequence
  Description of Artificial Sequence: Synthetic peptide
  Seed: RPSLPSCLCSF (MOG_HUMAN)
RSSLPSCLCSF

SEQ ID NO: 123419 - protein, 10 aa, Artificial Sequence
  Description of Artificial Sequence: Synthetic peptide
  Seed: VPVLGPLVAL (MOG_HUMAN)
VLVLGPLVAY

SEQ ID NO: 123420 - protein, 10 aa, Artificial Sequence
  Description of Artificial Sequence: Synthetic peptide
  Seed: LIFLCLQYRL (MOG_HUMAN)
LNFLCLQYRR

SEQ ID NO: 123421 - protein, 9 aa, Artificial Sequence
  Description of Artificial Sequence: Synthetic peptide
  Seed: LQVSSSYAG (MOG_HUMAN)
LAVSSSYAM

SEQ ID NO: 123422 - protein, 9 aa, Artificial Sequence
  Description of Artificial Sequence: Synthetic peptide
  Seed: EEAAMELKV (MOG_HUMAN)
EEAAMELKL

SEQ ID NO: 123423 - protein, 10 aa, Artificial Sequence
  Description of Artificial Sequence: Synthetic peptide
  Seed: FSDEGGFTCF (MOG_HUMAN)
FIDEGGFTCV

SEQ ID NO: 123424 - protein, 10 aa, Artificial Sequence
  Description of Artificial Sequence: Synthetic peptide
  Seed: PVLGPLVALI (MOG_HUMAN)
PMLGPLVALL

SEQ ID NO: 123425 - protein, 10 aa, Artificial Sequence
  Description of Artificial Sequence: Synthetic peptide
  Seed: IGPRHPIRAL (MOG_HUMAN)
IRPRHPIRAF

SEQ ID NO: 123426 - protein, 9 aa, Artificial Sequence
  Description of Artificial Sequence: Synthetic peptide
  Seed: RVIGPRHPI (MOG_HUMAN)
RAIGPRHPI

SEQ ID NO: 123427 - protein, 9 aa, Artificial Sequence
  Description of Artificial Sequence: Synthetic peptide
  Seed: LQVSSSYAG (MOG_HUMAN)
LQVSSSYAW

SEQ ID NO: 123428 - protein, 9 aa, Artificial Sequence
  Description of Artificial Sequence: Synthetic peptide
  Seed: RTFDPHFLR (MOG_HUMAN)
RSFDPHFLI

SEQ ID NO: 123429 - protein, 10 aa, Artificial Sequence
  Description of Artificial Sequence: Synthetic peptide
  Seed: YWVSPGVLVL (MOG_HUMAN)
YMVSPGVLVY

SEQ ID NO: 123430 - protein, 9 aa, Artificial Sequence
  Description of Artificial Sequence: Synthetic peptide
  Seed: HSYQEEAAM (MOG_HUMAN)
HVYQEEAAM

SEQ ID NO: 123431 - protein, 9 aa, Artificial Sequence
  Description of Artificial Sequence: Synthetic peptide
  Seed: MASLSRPSL (MOG_HUMAN)
MQSLSRPSL

SEQ ID NO: 123432 - protein, 10 aa, Artificial Sequence
  Description of Artificial Sequence: Synthetic peptide
  Seed: LLQITVGLIF (MOG_HUMAN)
LRQITVGLIL

SEQ ID NO: 123433 - protein, 10 aa, Artificial Sequence
  Description of Artificial Sequence: Synthetic peptide
  Seed: DAIGEGKVTL (MOG_HUMAN)
DIIGEGKVTF

SEQ ID NO: 123434 - protein, 9 aa, Artificial Sequence
  Description of Artificial Sequence: Synthetic peptide
  Seed: CYNWLHRRL (MOG_HUMAN)
CYNWLHRRF

SEQ ID NO: 123435 - protein, 11 aa, Artificial Sequence
  Description of Artificial Sequence: Synthetic peptide
  Seed: FSDEGGFTCFF (MOG_HUMAN)
FIDEGGFTCFI

SEQ ID NO: 123436 - protein, 10 aa, Artificial Sequence
  Description of Artificial Sequence: Synthetic peptide
  Seed: LLLQVSSSYA (MOG_HUMAN)
LVLQVSSSYF

SEQ ID NO: 123437 - protein, 9 aa, Artificial Sequence
  Description of Artificial Sequence: Synthetic peptide
  Seed: LLLQITVGL (MOG_HUMAN)
LILQITVGL

SEQ ID NO: 123438 - protein, 9 aa, Artificial Sequence
  Description of Artificial Sequence: Synthetic peptide
  Seed: CLCSFLLLL (MOG_HUMAN)
CQCSFLLLL

SEQ ID NO: 123439 - protein, 10 aa, Artificial Sequence
  Description of Artificial Sequence: Synthetic peptide
  Seed: RLAGQFLEEL (MOG_HUMAN)
RVAGQFLEEW

SEQ ID NO: 123440 - protein, 10 aa, Artificial Sequence
  Description of Artificial Sequence: Synthetic peptide
  Seed: APEYRGRTEL (MOG_HUMAN)
APEYRGRTEI

SEQ ID NO: 123441 - protein, 9 aa, Artificial Sequence
  Description of Artificial Sequence: Synthetic peptide
  Seed: WYRPPFSRV (MOG_HUMAN)
WYRPPFSRM

SEQ ID NO: 123442 - protein, 11 aa, Artificial Sequence
  Description of Artificial Sequence: Synthetic peptide
  Seed: RISPGKNATGM (MOG_HUMAN)
RVSPGKNATGW

SEQ ID NO: 123443 - protein, 9 aa, Artificial Sequence
  Description of Artificial Sequence: Synthetic peptide
  Seed: LLLQVSSSY (MOG_HUMAN)
LQLQVSSSW

SEQ ID NO: 123444 - protein, 10 aa, Artificial Sequence
  Description of Artificial Sequence: Synthetic peptide
  Seed: SLSRPSLPSC (MOG_HUMAN)
SWSRPSLPSV

SEQ ID NO: 123445 - protein, 11 aa, Artificial Sequence
  Description of Artificial Sequence: Synthetic peptide
  Seed: KDQDGDQAPEY (MOG_HUMAN)
KQQDGDQAPEW

SEQ ID NO: 123446 - protein, 9 aa, Artificial Sequence
  Description of Artificial Sequence: Synthetic peptide
  Seed: YQEEAAMEL (MOG_HUMAN)
YWEEAAMEL

SEQ ID NO: 123447 - protein, 11 aa, Artificial Sequence
  Description of Artificial Sequence: Synthetic peptide
  Seed: VIGPRHPIRAL (MOG_HUMAN)
VGGPRHPIRAL

SEQ ID NO: 123448 - protein, 9 aa, Artificial Sequence
  Description of Artificial Sequence: Synthetic peptide
  Seed: LSRPSLPSC (MOG_HUMAN)
LSRPSLPSI

SEQ ID NO: 123449 - protein, 10 aa, Artificial Sequence
  Description of Artificial Sequence: Synthetic peptide
  Seed: HRTFDPHFLR (MOG_HUMAN)
HCTFDPHFLK

SEQ ID NO: 123450 - protein, 10 aa, Artificial Sequence
  Description of Artificial Sequence: Synthetic peptide
  Seed: HRTFDPHFLR (MOG_HUMAN)
HWTFDPHFLY

SEQ ID NO: 123451 - protein, 10 aa, Artificial Sequence
  Description of Artificial Sequence: Synthetic peptide
  Seed: VGWYRPPFSR (MOG_HUMAN)
VMWYRPPFSK

SEQ ID NO: 123452 - protein, 9 aa, Artificial Sequence
  Description of Artificial Sequence: Synthetic peptide
  Seed: WVSPGVLVL (MOG_HUMAN)
WYSPGVLVF

SEQ ID NO: 123453 - protein, 10 aa, Artificial Sequence
  Description of Artificial Sequence: Synthetic peptide
  Seed: RIRNVRFSDE (MOG_HUMAN)
RYRNVRFSDL

SEQ ID NO: 123454 - protein, 9 aa, Artificial Sequence
  Description of Artificial Sequence: Synthetic peptide
  Seed: CSFLLLLLL (MOG_HUMAN)
CTFLLLLLY

SEQ ID NO: 123455 - protein, 9 aa, Artificial Sequence
  Description of Artificial Sequence: Synthetic peptide
  Seed: RVIGPRHPI (MOG_HUMAN)
RVIGPRHPW

SEQ ID NO: 123456 - protein, 9 aa, Artificial Sequence
  Description of Artificial Sequence: Synthetic peptide
  Seed: AIGEGKVTL (MOG_HUMAN)
ATGEGKVTW

SEQ ID NO: 123457 - protein, 11 aa, Artificial Sequence
  Description of Artificial Sequence: Synthetic peptide
  Seed: RTFDPHFLRVP (MOG_HUMAN)
RMFDPHFLRVD

SEQ ID NO: 123458 - protein, 10 aa, Artificial Sequence
  Description of Artificial Sequence: Synthetic peptide
  Seed: FVIVPVLGPL (MOG_HUMAN)
FFIVPVLGPL

SEQ ID NO: 123459 - protein, 10 aa, Artificial Sequence
  Description of Artificial Sequence: Synthetic peptide
  Seed: IGPRHPIRAL (MOG_HUMAN)
ISPRHPIRAL

SEQ ID NO: 123460 - protein, 11 aa, Artificial Sequence
  Description of Artificial Sequence: Synthetic peptide
  Seed: RTFDPHFLRVP (MOG_HUMAN)
RMFDPHFLRVT

SEQ ID NO: 123461 - protein, 9 aa, Artificial Sequence
  Description of Artificial Sequence: Synthetic peptide
  Seed: TCFFRDHSY (MOG_HUMAN)
TAFFRDHSL

SEQ ID NO: 123462 - protein, 10 aa, Artificial Sequence
  Description of Artificial Sequence: Synthetic peptide
  Seed: QEEAAMELKV (MOG_HUMAN)
QEEAAMELKW

SEQ ID NO: 123463 - protein, 11 aa, Artificial Sequence
  Description of Artificial Sequence: Synthetic peptide
  Seed: SPGKNATGMEV (MOG_HUMAN)
SPGKNATGMEM

SEQ ID NO: 123464 - protein, 9 aa, Artificial Sequence
  Description of Artificial Sequence: Synthetic peptide
  Seed: FLRVPCWKI (MOG_HUMAN)
FVRVPCWKV

SEQ ID NO: 123465 - protein, 10 aa, Artificial Sequence
  Description of Artificial Sequence: Synthetic peptide
  Seed: PHFLRVPCWK (MOG_HUMAN)
PMFLRVPCWR

SEQ ID NO: 123466 - protein, 10 aa, Artificial Sequence
  Description of Artificial Sequence: Synthetic peptide
  Seed: FDPHFLRVPC (MOG_HUMAN)
FFPHFLRVPT

SEQ ID NO: 123467 - protein, 9 aa, Artificial Sequence
  Description of Artificial Sequence: Synthetic peptide
  Seed: WVSPGVLVL (MOG_HUMAN)
WISPGVLVV

SEQ ID NO: 123468 - protein, 10 aa, Artificial Sequence
  Description of Artificial Sequence: Synthetic peptide
  Seed: YWVSPGVLVL (MOG_HUMAN)
YAVSPGVLVF

SEQ ID NO: 123469 - protein, 10 aa, Artificial Sequence
  Description of Artificial Sequence: Synthetic peptide
  Seed: ITLFVIVPVL (MOG_HUMAN)
IMLFVIVPVL

SEQ ID NO: 123470 - protein, 11 aa, Artificial Sequence
  Description of Artificial Sequence: Synthetic peptide
  Seed: LLLLLQVSSSY (MOG_HUMAN)
LMLLLQVSSSF

SEQ ID NO: 123471 - protein, 9 aa, Artificial Sequence
  Description of Artificial Sequence: Synthetic peptide
  Seed: PVLGPLVAL (MOG_HUMAN)
PPLGPLVAM

SEQ ID NO: 123472 - protein, 9 aa, Artificial Sequence
  Description of Artificial Sequence: Synthetic peptide
  Seed: LQVSSSYAG (MOG_HUMAN)
LKVSSSYAM

SEQ ID NO: 123473 - protein, 9 aa, Artificial Sequence
  Description of Artificial Sequence: Synthetic peptide
  Seed: LLLQITVGL (MOG_HUMAN)
LMLQITVGR

SEQ ID NO: 123474 - protein, 11 aa, Artificial Sequence
  Description of Artificial Sequence: Synthetic peptide
  Seed: FSDEGGFTCFF (MOG_HUMAN)
FIDEGGFTCFL

SEQ ID NO: 123475 - protein, 10 aa, Artificial Sequence
  Description of Artificial Sequence: Synthetic peptide
  Seed: RTFDPHFLRV (MOG_HUMAN)
RQFDPHFLRG

SEQ ID NO: 123476 - protein, 9 aa, Artificial Sequence
  Description of Artificial Sequence: Synthetic peptide
  Seed: ICYNWLHRR (MOG_HUMAN)
IMYNWLHRY

SEQ ID NO: 123477 - protein, 11 aa, Artificial Sequence
  Description of Artificial Sequence: Synthetic peptide
  Seed: GQFLEELRNPF (MOG_HUMAN)
GMFLEELRNPY

SEQ ID NO: 123478 - protein, 10 aa, Artificial Sequence
  Description of Artificial Sequence: Synthetic peptide
  Seed: ITVGLIFLCL (MOG_HUMAN)
IQVGLIFLCV

SEQ ID NO: 123479 - protein, 10 aa, Artificial Sequence
  Description of Artificial Sequence: Synthetic peptide
  Seed: GPRHPIRALV (MOG_HUMAN)
GMRHPIRALL

SEQ ID NO: 123480 - protein, 10 aa, Artificial Sequence
  Description of Artificial Sequence: Synthetic peptide
  Seed: SCLCSFLLLL (MOG_HUMAN)
SLLCSFLLLI

SEQ ID NO: 123481 - protein, 9 aa, Artificial Sequence
  Description of Artificial Sequence: Synthetic peptide
  Seed: RTFDPHFLR (MOG_HUMAN)
RTFDPHFLL

SEQ ID NO: 123482 - protein, 9 aa, Artificial Sequence
  Description of Artificial Sequence: Synthetic peptide
  Seed: ALIICYNWL (MOG_HUMAN)
AQIICYNWV

SEQ ID NO: 123483 - protein, 10 aa, Artificial Sequence
  Description of Artificial Sequence: Synthetic peptide
  Seed: KVTLRIRNVR (MOG_HUMAN)
KPTLRIRNVR

SEQ ID NO: 123484 - protein, 10 aa, Artificial Sequence
  Description of Artificial Sequence: Synthetic peptide
  Seed: LIFLCLQYRL (MOG_HUMAN)
LIFLCLQYRK

SEQ ID NO: 123485 - protein, 9 aa, Artificial Sequence
  Description of Artificial Sequence: Synthetic peptide
  Seed: LIFLCLQYR (MOG_HUMAN)
LGFLCLQYR

SEQ ID NO: 123486 - protein, 10 aa, Artificial Sequence
  Description of Artificial Sequence: Synthetic peptide
  Seed: RTFDPHFLRV (MOG_HUMAN)
RWFDPHFLRL

SEQ ID NO: 123487 - protein, 9 aa, Artificial Sequence
  Description of Artificial Sequence: Synthetic peptide
  Seed: RIRNVRFSD (MOG_HUMAN)
RWRNVRFSM

SEQ ID NO: 123488 - protein, 10 aa, Artificial Sequence
  Description of Artificial Sequence: Synthetic peptide
  Seed: TGMEVGWYRP (MOG_HUMAN)
TMMEVGWYRA

SEQ ID NO: 123489 - protein, 11 aa, Artificial Sequence
  Description of Artificial Sequence: Synthetic peptide
  Seed: RDHSYQEEAAM (MOG_HUMAN)
RCHSYQEEAAW

SEQ ID NO: 123490 - protein, 10 aa, Artificial Sequence
  Description of Artificial Sequence: Synthetic peptide
  Seed: SCLCSFLLLL (MOG_HUMAN)
SNLCSFLLLI

SEQ ID NO: 123491 - protein, 10 aa, Artificial Sequence
  Description of Artificial Sequence: Synthetic peptide
  Seed: ITVGLIFLCL (MOG_HUMAN)
IAVGLIFLCW

SEQ ID NO: 123492 - protein, 9 aa, Artificial Sequence
  Description of Artificial Sequence: Synthetic peptide
  Seed: ITVGLIFLC (MOG_HUMAN)
ISVGLIFLA

SEQ ID NO: 123493 - protein, 11 aa, Artificial Sequence
  Description of Artificial Sequence: Synthetic peptide
  Seed: RFSDEGGFTCF (MOG_HUMAN)
RVSDEGGFTCY

SEQ ID NO: 123494 - protein, 9 aa, Artificial Sequence
  Description of Artificial Sequence: Synthetic peptide
  Seed: SLPSCLCSF (MOG_HUMAN)
SMPSCLCSV

SEQ ID NO: 123495 - protein, 10 aa, Artificial Sequence
  Description of Artificial Sequence: Synthetic peptide
  Seed: RVVHLYRNGK (MOG_HUMAN)
RFVHLYRNGR

SEQ ID NO: 123496 - protein, 10 aa, Artificial Sequence
  Description of Artificial Sequence: Synthetic peptide
  Seed: VIVPVLGPLV (MOG_HUMAN)
VQVPVLGPLV

SEQ ID NO: 123497 - protein, 9 aa, Artificial Sequence
  Description of Artificial Sequence: Synthetic peptide
  Seed: RTFDPHFLR (MOG_HUMAN)
RYFDPHFLF

SEQ ID NO: 123498 - protein, 10 aa, Artificial Sequence
  Description of Artificial Sequence: Synthetic peptide
  Seed: RTFDPHFLRV (MOG_HUMAN)
RIFDPHFLRT

SEQ ID NO: 123499 - protein, 9 aa, Artificial Sequence
  Description of Artificial Sequence: Synthetic peptide
  Seed: EGKVTLRIR (MOG_HUMAN)
ETKVTLRIR

SEQ ID NO: 123500 - protein, 10 aa, Artificial Sequence
  Description of Artificial Sequence: Synthetic peptide
  Seed: IGPRHPIRAL (MOG_HUMAN)
IDPRHPIRAI

SEQ ID NO: 123501 - protein, 9 aa, Artificial Sequence
  Description of Artificial Sequence: Synthetic peptide
  Seed: FLEELRNPF (MOG_HUMAN)
FTEELRNPF

SEQ ID NO: 123502 - protein, 9 aa, Artificial Sequence
  Description of Artificial Sequence: Synthetic peptide
  Seed: LIFLCLQYR (MOG_HUMAN)
LWFLCLQYR

SEQ ID NO: 123503 - protein, 9 aa, Artificial Sequence
  Description of Artificial Sequence: Synthetic peptide
  Seed: LKVEDPFYW (MOG_HUMAN)
LSVEDPFYI

SEQ ID NO: 123504 - protein, 8 aa, Artificial Sequence
  Description of Artificial Sequence: Synthetic peptide
  Seed: RIRNVRFS (MOG_HUMAN)
RSRNVRFK

SEQ ID NO: 123505 - protein, 10 aa, Artificial Sequence
  Description of Artificial Sequence: Synthetic peptide
  Seed: ITLFVIVPVL (MOG_HUMAN)
IYLFVIVPVV

SEQ ID NO: 123506 - protein, 9 aa, Artificial Sequence
  Description of Artificial Sequence: Synthetic peptide
  Seed: YRPPFSRVV (MOG_HUMAN)
YKPPFSRVY

SEQ ID NO: 123507 - protein, 9 aa, Artificial Sequence
  Description of Artificial Sequence: Synthetic peptide
  Seed: SCLCSFLLL (MOG_HUMAN)
SMLCSFLLL

SEQ ID NO: 123508 - protein, 9 aa, Artificial Sequence
  Description of Artificial Sequence: Synthetic peptide
  Seed: VSPGVLVLL (MOG_HUMAN)
VIPGVLVLA

SEQ ID NO: 123509 - protein, 9 aa, Artificial Sequence
  Description of Artificial Sequence: Synthetic peptide
  Seed: SCLCSFLLL (MOG_HUMAN)
SMLCSFLLM

SEQ ID NO: 123510 - protein, 9 aa, Artificial Sequence
  Description of Artificial Sequence: Synthetic peptide
  Seed: FSDEGGFTC (MOG_HUMAN)
FEDEGGFTL

SEQ ID NO: 123511 - protein, 9 aa, Artificial Sequence
  Description of Artificial Sequence: Synthetic peptide
  Seed: CLCSFLLLL (MOG_HUMAN)
CSCSFLLLF

SEQ ID NO: 123512 - protein, 9 aa, Artificial Sequence
  Description of Artificial Sequence: Synthetic peptide
  Seed: LQVSSSYAG (MOG_HUMAN)
LIVSSSYAY

SEQ ID NO: 123513 - protein, 9 aa, Artificial Sequence
  Description of Artificial Sequence: Synthetic peptide
  Seed: RIRNVRFSD (MOG_HUMAN)
RARNVRFSE

SEQ ID NO: 123514 - protein, 10 aa, Artificial Sequence
  Description of Artificial Sequence: Synthetic peptide
  Seed: VLLAVLPVLL (MOG_HUMAN)
VPLAVLPVLV

SEQ ID NO: 123515 - protein, 10 aa, Artificial Sequence
  Description of Artificial Sequence: Synthetic peptide
  Seed: FVIVPVLGPL (MOG_HUMAN)
FIIVPVLGPL

SEQ ID NO: 123516 - protein, 11 aa, Artificial Sequence
  Description of Artificial Sequence: Synthetic peptide
  Seed: KITLFVIVPVL (MOG_HUMAN)
KLTLFVIVPVV

SEQ ID NO: 123517 - protein, 9 aa, Artificial Sequence
  Description of Artificial Sequence: Synthetic peptide
  Seed: FLEELRNPF (MOG_HUMAN)
FWEELRNPF

SEQ ID NO: 123518 - protein, 10 aa, Artificial Sequence
  Description of Artificial Sequence: Synthetic peptide
  Seed: YWVSPGVLVL (MOG_HUMAN)
YTVSPGVLVY

SEQ ID NO: 123519 - protein, 11 aa, Artificial Sequence
  Description of Artificial Sequence: Synthetic peptide
  Seed: RTFDPHFLRVP (MOG_HUMAN)
RMFDPHFLRVS

SEQ ID NO: 123520 - protein, 10 aa, Artificial Sequence
  Description of Artificial Sequence: Synthetic peptide
  Seed: RVIGPRHPIR (MOG_HUMAN)
RTIGPRHPIA

SEQ ID NO: 123521 - protein, 9 aa, Artificial Sequence
  Description of Artificial Sequence: Synthetic peptide
  Seed: FSDEGGFTC (MOG_HUMAN)
FHDEGGFTM

SEQ ID NO: 123522 - protein, 11 aa, Artificial Sequence
  Description of Artificial Sequence: Synthetic peptide
  Seed: RFSDEGGFTCF (MOG_HUMAN)
RTSDEGGFTCL

SEQ ID NO: 123523 - protein, 9 aa, Artificial Sequence
  Description of Artificial Sequence: Synthetic peptide
  Seed: AEIENLHRT (MOG_HUMAN)
AEIENLHRV

SEQ ID NO: 123524 - protein, 9 aa, Artificial Sequence
  Description of Artificial Sequence: Synthetic peptide
  Seed: TFDPHFLRV (MOG_HUMAN)
TFDPHFLRC

SEQ ID NO: 123525 - protein, 9 aa, Artificial Sequence
  Description of Artificial Sequence: Synthetic peptide
  Seed: TFDPHFLRV (MOG_HUMAN)
TGDPHFLRI

SEQ ID NO: 123526 - protein, 9 aa, Artificial Sequence
  Description of Artificial Sequence: Synthetic peptide
  Seed: RIRNVRFSD (MOG_HUMAN)
RQRNVRFSM

SEQ ID NO: 123527 - protein, 9 aa, Artificial Sequence
  Description of Artificial Sequence: Synthetic peptide
  Seed: LLLQVSSSY (MOG_HUMAN)
LALQVSSSY

SEQ ID NO: 123528 - protein, 9 aa, Artificial Sequence
  Description of Artificial Sequence: Synthetic peptide
  Seed: YRPPFSRVV (MOG_HUMAN)
YYPPFSRVY

SEQ ID NO: 123529 - protein, 9 aa, Artificial Sequence
  Description of Artificial Sequence: Synthetic peptide
  Seed: RVPCWKITL (MOG_HUMAN)
RTPCWKITW

SEQ ID NO: 123530 - protein, 9 aa, Artificial Sequence
  Description of Artificial Sequence: Synthetic peptide
  Seed: SSYAGQFRV (MOG_HUMAN)
SMYAGQFRF

SEQ ID NO: 123531 - protein, 9 aa, Artificial Sequence
  Description of Artificial Sequence: Synthetic peptide
  Seed: FSDEGGFTC (MOG_HUMAN)
FFDEGGFTC

SEQ ID NO: 123532 - protein, 9 aa, Artificial Sequence
  Description of Artificial Sequence: Synthetic peptide
  Seed: TLFVIVPVL (MOG_HUMAN)
TQFVIVPVI

SEQ ID NO: 123533 - protein, 9 aa, Artificial Sequence
  Description of Artificial Sequence: Synthetic peptide
  Seed: MEVGWYRPP (MOG_HUMAN)
MEVGWYRPW

SEQ ID NO: 123534 - protein, 10 aa, Artificial Sequence
  Description of Artificial Sequence: Synthetic peptide
  Seed: FSDEGGFTCF (MOG_HUMAN)
FSDEGGFTCI

SEQ ID NO: 123535 - protein, 10 aa, Artificial Sequence
  Description of Artificial Sequence: Synthetic peptide
  Seed: MEVGWYRPPF (MOG_HUMAN)
MKVGWYRPPM

SEQ ID NO: 123536 - protein, 11 aa, Artificial Sequence
  Description of Artificial Sequence: Synthetic peptide
  Seed: RVIGPRHPIRA (MOG_HUMAN)
RLIGPRHPIRR

SEQ ID NO: 123537 - protein, 9 aa, Artificial Sequence
  Description of Artificial Sequence: Synthetic peptide
  Seed: FSDEGGFTC (MOG_HUMAN)
FFDEGGFTM

SEQ ID NO: 123538 - protein, 10 aa, Artificial Sequence
  Description of Artificial Sequence: Synthetic peptide
  Seed: LLQITVGLIF (MOG_HUMAN)
LMQITVGLIF

SEQ ID NO: 123539 - protein, 9 aa, Artificial Sequence
  Description of Artificial Sequence: Synthetic peptide
  Seed: IVPVLGPLV (MOG_HUMAN)
IAPVLGPLV

SEQ ID NO: 123540 - protein, 9 aa, Artificial Sequence
  Description of Artificial Sequence: Synthetic peptide
  Seed: KDQDGDQAP (MOG_HUMAN)
KEQDGDQAI

SEQ ID NO: 123541 - protein, 9 aa, Artificial Sequence
  Description of Artificial Sequence: Synthetic peptide
  Seed: FYWVSPGVL (MOG_HUMAN)
FEWVSPGVM

SEQ ID NO: 123542 - protein, 9 aa, Artificial Sequence
  Description of Artificial Sequence: Synthetic peptide
  Seed: VIVPVLGPL (MOG_HUMAN)
VTVPVLGPR

SEQ ID NO: 123543 - protein, 10 aa, Artificial Sequence
  Description of Artificial Sequence: Synthetic peptide
  Seed: WVSPGVLVLL (MOG_HUMAN)
WQSPGVLVLF

SEQ ID NO: 123544 - protein, 9 aa, Artificial Sequence
  Description of Artificial Sequence: Synthetic peptide
  Seed: TFDPHFLRV (MOG_HUMAN)
TMDPHFLRM

SEQ ID NO: 123545 - protein, 9 aa, Artificial Sequence
  Description of Artificial Sequence: Synthetic peptide
  Seed: MELKVEDPF (MOG_HUMAN)
MMLKVEDPL

SEQ ID NO: 123546 - protein, 10 aa, Artificial Sequence
  Description of Artificial Sequence: Synthetic peptide
  Seed: ELPCRISPGK (MOG_HUMAN)
ETPCRISPGR

SEQ ID NO: 123547 - protein, 10 aa, Artificial Sequence
  Description of Artificial Sequence: Synthetic peptide
  Seed: TGMEVGWYRP (MOG_HUMAN)
TLMEVGWYRR

SEQ ID NO: 123548 - protein, 9 aa, Artificial Sequence
  Description of Artificial Sequence: Synthetic peptide
  Seed: MASLSRPSL (MOG_HUMAN)
MWSLSRPSM

SEQ ID NO: 123549 - protein, 10 aa, Artificial Sequence
  Description of Artificial Sequence: Synthetic peptide
  Seed: LVLLAVLPVL (MOG_HUMAN)
LRLLAVLPVV

SEQ ID NO: 123550 - protein, 9 aa, Artificial Sequence
  Description of Artificial Sequence: Synthetic peptide
  Seed: RRLAGQFLE (MOG_HUMAN)
RKLAGQFLL

SEQ ID NO: 123551 - protein, 9 aa, Artificial Sequence
  Description of Artificial Sequence: Synthetic peptide
  Seed: KVEDPFYWV (MOG_HUMAN)
KQEDPFYWV

SEQ ID NO: 123552 - protein, 9 aa, Artificial Sequence
  Description of Artificial Sequence: Synthetic peptide
  Seed: LKVEDPFYW (MOG_HUMAN)
LGVEDPFYW

SEQ ID NO: 123553 - protein, 9 aa, Artificial Sequence
  Description of Artificial Sequence: Synthetic peptide
  Seed: FSDEGGFTC (MOG_HUMAN)
FRDEGGFTM

SEQ ID NO: 123554 - protein, 10 aa, Artificial Sequence
  Description of Artificial Sequence: Synthetic peptide
  Seed: FYWVSPGVLV (MOG_HUMAN)
FHWVSPGVLF

SEQ ID NO: 123555 - protein, 9 aa, Artificial Sequence
  Description of Artificial Sequence: Synthetic peptide
  Seed: RVIGPRHPI (MOG_HUMAN)
RYIGPRHPF

SEQ ID NO: 123556 - protein, 9 aa, Artificial Sequence
  Description of Artificial Sequence: Synthetic peptide
  Seed: TFDPHFLRV (MOG_HUMAN)
TWDPHFLRL

SEQ ID NO: 123557 - protein, 9 aa, Artificial Sequence
  Description of Artificial Sequence: Synthetic peptide
  Seed: RIRNVRFSD (MOG_HUMAN)
RQRNVRFSR

SEQ ID NO: 123558 - protein, 9 aa, Artificial Sequence
  Description of Artificial Sequence: Synthetic peptide
  Seed: IICYNWLHR (MOG_HUMAN)
ILCYNWLHK

SEQ ID NO: 123559 - protein, 9 aa, Artificial Sequence
  Description of Artificial Sequence: Synthetic peptide
  Seed: VGDEVELPC (MOG_HUMAN)
VQDEVELPM

SEQ ID NO: 123560 - protein, 11 aa, Artificial Sequence
  Description of Artificial Sequence: Synthetic peptide
  Seed: RDHSYQEEAAM (MOG_HUMAN)
RKHSYQEEAAY

SEQ ID NO: 123561 - protein, 10 aa, Artificial Sequence
  Description of Artificial Sequence: Synthetic peptide
  Seed: FDPHFLRVPC (MOG_HUMAN)
FSPHFLRVPF

SEQ ID NO: 123562 - protein, 9 aa, Artificial Sequence
  Description of Artificial Sequence: Synthetic peptide
  Seed: MASLSRPSL (MOG_HUMAN)
MTSLSRPSY

SEQ ID NO: 123563 - protein, 10 aa, Artificial Sequence
  Description of Artificial Sequence: Synthetic peptide
  Seed: FDPHFLRVPC (MOG_HUMAN)
FTPHFLRVPT

SEQ ID NO: 123564 - protein, 9 aa, Artificial Sequence
  Description of Artificial Sequence: Synthetic peptide
  Seed: KDQDGDQAP (MOG_HUMAN)
KEQDGDQAT

SEQ ID NO: 123565 - protein, 10 aa, Artificial Sequence
  Description of Artificial Sequence: Synthetic peptide
  Seed: LQITVGLIFL (MOG_HUMAN)
LTITVGLIFV

SEQ ID NO: 123566 - protein, 9 aa, Artificial Sequence
  Description of Artificial Sequence: Synthetic peptide
  Seed: LKVEDPFYW (MOG_HUMAN)
LQVEDPFYI

SEQ ID NO: 123567 - protein, 9 aa, Artificial Sequence
  Description of Artificial Sequence: Synthetic peptide
  Seed: LQITVGLIF (MOG_HUMAN)
LQITVGLIH

SEQ ID NO: 123568 - protein, 10 aa, Artificial Sequence
  Description of Artificial Sequence: Synthetic peptide
  Seed: VLLAVLPVLL (MOG_HUMAN)
VLLAVLPVLA

SEQ ID NO: 123569 - protein, 9 aa, Artificial Sequence
  Description of Artificial Sequence: Synthetic peptide
  Seed: RTFDPHFLR (MOG_HUMAN)
RSFDPHFLM

SEQ ID NO: 123570 - protein, 10 aa, Artificial Sequence
  Description of Artificial Sequence: Synthetic peptide
  Seed: VIVPVLGPLV (MOG_HUMAN)
VLVPVLGPLA

SEQ ID NO: 123571 - protein, 11 aa, Artificial Sequence
  Description of Artificial Sequence: Synthetic peptide
  Seed: LQVSSSYAGQF (MOG_HUMAN)
LSVSSSYAGQY

SEQ ID NO: 123572 - protein, 9 aa, Artificial Sequence
  Description of Artificial Sequence: Synthetic peptide
  Seed: RIRNVRFSD (MOG_HUMAN)
RLRNVRFSI

SEQ ID NO: 123573 - protein, 10 aa, Artificial Sequence
  Description of Artificial Sequence: Synthetic peptide
  Seed: YWVSPGVLVL (MOG_HUMAN)
YYVSPGVLVL

SEQ ID NO: 123574 - protein, 9 aa, Artificial Sequence
  Description of Artificial Sequence: Synthetic peptide
  Seed: RTFDPHFLR (MOG_HUMAN)
RLFDPHFLW

SEQ ID NO: 123575 - protein, 9 aa, Artificial Sequence
  Description of Artificial Sequence: Synthetic peptide
  Seed: YRPPFSRVV (MOG_HUMAN)
YCPPFSRVL

SEQ ID NO: 123576 - protein, 11 aa, Artificial Sequence
  Description of Artificial Sequence: Synthetic peptide
  Seed: RDHSYQEEAAM (MOG_HUMAN)
RAHSYQEEAAY

SEQ ID NO: 123577 - protein, 10 aa, Artificial Sequence
  Description of Artificial Sequence: Synthetic peptide
  Seed: RPPFSRVVHL (MOG_HUMAN)
RIPFSRVVHM

SEQ ID NO: 123578 - protein, 9 aa, Artificial Sequence
  Description of Artificial Sequence: Synthetic peptide
  Seed: LAGQFLEEL (MOG_HUMAN)
LAGQFLEEV

SEQ ID NO: 123579 - protein, 10 aa, Artificial Sequence
  Description of Artificial Sequence: Synthetic peptide
  Seed: AVLPVLLLQI (MOG_HUMAN)
ALLPVLLLQL

SEQ ID NO: 123580 - protein, 11 aa, Artificial Sequence
  Description of Artificial Sequence: Synthetic peptide
  Seed: RISPGKNATGM (MOG_HUMAN)
RVSPGKNATGY

SEQ ID NO: 123581 - protein, 9 aa, Artificial Sequence
  Description of Artificial Sequence: Synthetic peptide
  Seed: SSSYAGQFR (MOG_HUMAN)
SLSYAGQFR

SEQ ID NO: 123582 - protein, 9 aa, Artificial Sequence
  Description of Artificial Sequence: Synthetic peptide
  Seed: FYWVSPGVL (MOG_HUMAN)
FWWVSPGVW

SEQ ID NO: 123583 - protein, 10 aa, Artificial Sequence
  Description of Artificial Sequence: Synthetic peptide
  Seed: SSYAGQFRVI (MOG_HUMAN)
SPYAGQFRVF

SEQ ID NO: 123584 - protein, 10 aa, Artificial Sequence
  Description of Artificial Sequence: Synthetic peptide
  Seed: VGWYRPPFSR (MOG_HUMAN)
VCWYRPPFSR

SEQ ID NO: 123585 - protein, 9 aa, Artificial Sequence
  Description of Artificial Sequence: Synthetic peptide
  Seed: WVSPGVLVL (MOG_HUMAN)
WISPGVLVA

SEQ ID NO: 123586 - protein, 10 aa, Artificial Sequence
  Description of Artificial Sequence: Synthetic peptide
  Seed: LLQITVGLIF (MOG_HUMAN)
LVQITVGLIM

SEQ ID NO: 123587 - protein, 10 aa, Artificial Sequence
  Description of Artificial Sequence: Synthetic peptide
  Seed: LLQITVGLIF (MOG_HUMAN)
LTQITVGLIY

SEQ ID NO: 123588 - protein, 9 aa, Artificial Sequence
  Description of Artificial Sequence: Synthetic peptide
  Seed: FYWVSPGVL (MOG_HUMAN)
FHWVSPGVF

SEQ ID NO: 123589 - protein, 9 aa, Artificial Sequence
  Description of Artificial Sequence: Synthetic peptide
  Seed: LHRRLAGQF (MOG_HUMAN)
LQRRLAGQF

SEQ ID NO: 123590 - protein, 10 aa, Artificial Sequence
  Description of Artificial Sequence: Synthetic peptide
  Seed: TGMEVGWYRP (MOG_HUMAN)
TVMEVGWYRG

SEQ ID NO: 123591 - protein, 9 aa, Artificial Sequence
  Description of Artificial Sequence: Synthetic peptide
  Seed: IGEGKVTLR (MOG_HUMAN)
ITEGKVTLL

SEQ ID NO: 123592 - protein, 10 aa, Artificial Sequence
  Description of Artificial Sequence: Synthetic peptide
  Seed: IICYNWLHRR (MOG_HUMAN)
ISCYNWLHRR

SEQ ID NO: 123593 - protein, 8 aa, Artificial Sequence
  Description of Artificial Sequence: Synthetic peptide
  Seed: FSDEGGFT (MOG_HUMAN)
FQDEGGFL

SEQ ID NO: 123594 - protein, 11 aa, Artificial Sequence
  Description of Artificial Sequence: Synthetic peptide
  Seed: LQVSSSYAGQF (MOG_HUMAN)
LTVSSSYAGQF

SEQ ID NO: 123595 - protein, 10 aa, Artificial Sequence
  Description of Artificial Sequence: Synthetic peptide
  Seed: FDPHFLRVPC (MOG_HUMAN)
FYPHFLRVPM

SEQ ID NO: 123596 - protein, 10 aa, Artificial Sequence
  Description of Artificial Sequence: Synthetic peptide
  Seed: LLLQVSSSYA (MOG_HUMAN)
LMLQVSSSYE

SEQ ID NO: 123597 - protein, 9 aa, Artificial Sequence
  Description of Artificial Sequence: Synthetic peptide
  Seed: TFDPHFLRV (MOG_HUMAN)
TNDPHFLRM

SEQ ID NO: 123598 - protein, 9 aa, Artificial Sequence
  Description of Artificial Sequence: Synthetic peptide
  Seed: VSPGVLVLL (MOG_HUMAN)
VCPGVLVLL

SEQ ID NO: 123599 - protein, 9 aa, Artificial Sequence
  Description of Artificial Sequence: Synthetic peptide
  Seed: VGDEVELPC (MOG_HUMAN)
VQDEVELPL

SEQ ID NO: 123600 - protein, 10 aa, Artificial Sequence
  Description of Artificial Sequence: Synthetic peptide
  Seed: IGPRHPIRAL (MOG_HUMAN)
IGPRHPIRAM

SEQ ID NO: 123601 - protein, 9 aa, Artificial Sequence
  Description of Artificial Sequence: Synthetic peptide
  Seed: LCSFLLLLL (MOG_HUMAN)
LTSFLLLLF

SEQ ID NO: 123602 - protein, 10 aa, Artificial Sequence
  Description of Artificial Sequence: Synthetic peptide
  Seed: LLLQVSSSYA (MOG_HUMAN)
LQLQVSSSYW

SEQ ID NO: 123603 - protein, 9 aa, Artificial Sequence
  Description of Artificial Sequence: Synthetic peptide
  Seed: GLIFLCLQY (MOG_HUMAN)
GWIFLCLQY

SEQ ID NO: 123604 - protein, 9 aa, Artificial Sequence
  Description of Artificial Sequence: Synthetic peptide
  Seed: VGDEVELPC (MOG_HUMAN)
VCDEVELPM

SEQ ID NO: 123605 - protein, 9 aa, Artificial Sequence
  Description of Artificial Sequence: Synthetic peptide
  Seed: FSDEGGFTC (MOG_HUMAN)
FWDEGGFTA

SEQ ID NO: 123606 - protein, 10 aa, Artificial Sequence
  Description of Artificial Sequence: Synthetic peptide
  Seed: SSYAGQFRVI (MOG_HUMAN)
SKYAGQFRVF

SEQ ID NO: 123607 - protein, 9 aa, Artificial Sequence
  Description of Artificial Sequence: Synthetic peptide
  Seed: KLRAEIENL (MOG_HUMAN)
KARAEIENA

SEQ ID NO: 123608 - protein, 9 aa, Artificial Sequence
  Description of Artificial Sequence: Synthetic peptide
  Seed: LLAVLPVLL (MOG_HUMAN)
LTAVLPVLV

SEQ ID NO: 123609 - protein, 10 aa, Artificial Sequence
  Description of Artificial Sequence: Synthetic peptide
  Seed: FRVIGPRHPI (MOG_HUMAN)
FRVIGPRHPV

SEQ ID NO: 123610 - protein, 11 aa, Artificial Sequence
  Description of Artificial Sequence: Synthetic peptide
  Seed: HRTFDPHFLRV (MOG_HUMAN)
HMTFDPHFLRT

SEQ ID NO: 123611 - protein, 9 aa, Artificial Sequence
  Description of Artificial Sequence: Synthetic peptide
  Seed: IGEGKVTLR (MOG_HUMAN)
IMEGKVTLY

SEQ ID NO: 123612 - protein, 9 aa, Artificial Sequence
  Description of Artificial Sequence: Synthetic peptide
  Seed: FYWVSPGVL (MOG_HUMAN)
FTWVSPGVM

SEQ ID NO: 123613 - protein, 9 aa, Artificial Sequence
  Description of Artificial Sequence: Synthetic peptide
  Seed: HSYQEEAAM (MOG_HUMAN)
HKYQEEAAM

SEQ ID NO: 123614 - protein, 9 aa, Artificial Sequence
  Description of Artificial Sequence: Synthetic peptide
  Seed: MELKVEDPF (MOG_HUMAN)
MILKVEDPY

SEQ ID NO: 123615 - protein, 10 aa, Artificial Sequence
  Description of Artificial Sequence: Synthetic peptide
  Seed: FVIVPVLGPL (MOG_HUMAN)
FMIVPVLGPA

SEQ ID NO: 123616 - protein, 9 aa, Artificial Sequence
  Description of Artificial Sequence: Synthetic peptide
  Seed: VLLAVLPVL (MOG_HUMAN)
VQLAVLPVL

SEQ ID NO: 123617 - protein, 11 aa, Artificial Sequence
  Description of Artificial Sequence: Synthetic peptide
  Seed: LLLQITVGLIF (MOG_HUMAN)
LKLQITVGLIF

SEQ ID NO: 123618 - protein, 10 aa, Artificial Sequence
  Description of Artificial Sequence: Synthetic peptide
  Seed: LVLLAVLPVL (MOG_HUMAN)
LALLAVLPVI

SEQ ID NO: 123619 - protein, 10 aa, Artificial Sequence
  Description of Artificial Sequence: Synthetic peptide
  Seed: VLLLQITVGL (MOG_HUMAN)
VSLLQITVGL

SEQ ID NO: 123620 - protein, 9 aa, Artificial Sequence
  Description of Artificial Sequence: Synthetic peptide
  Seed: SLPSCLCSF (MOG_HUMAN)
SFPSCLCSF

SEQ ID NO: 123621 - protein, 9 aa, Artificial Sequence
  Description of Artificial Sequence: Synthetic peptide
  Seed: RVIGPRHPI (MOG_HUMAN)
RSIGPRHPK

SEQ ID NO: 123622 - protein, 10 aa, Artificial Sequence
  Description of Artificial Sequence: Synthetic peptide
  Seed: RVIGPRHPIR (MOG_HUMAN)
RWIGPRHPIR

SEQ ID NO: 123623 - protein, 11 aa, Artificial Sequence
  Description of Artificial Sequence: Synthetic peptide
  Seed: VLVLLAVLPVL (MOG_HUMAN)
VYVLLAVLPVV

SEQ ID NO: 123624 - protein, 10 aa, Artificial Sequence
  Description of Artificial Sequence: Synthetic peptide
  Seed: LQYRLRGKLR (MOG_HUMAN)
LVYRLRGKLR

SEQ ID NO: 123625 - protein, 11 aa, Artificial Sequence
  Description of Artificial Sequence: Synthetic peptide
  Seed: EVGWYRPPFSR (MOG_HUMAN)
ETGWYRPPFSR

SEQ ID NO: 123626 - protein, 10 aa, Artificial Sequence
  Description of Artificial Sequence: Synthetic peptide
  Seed: RTFDPHFLRV (MOG_HUMAN)
RIFDPHFLRK

SEQ ID NO: 123627 - protein, 9 aa, Artificial Sequence
  Description of Artificial Sequence: Synthetic peptide
  Seed: FSDEGGFTC (MOG_HUMAN)
FDDEGGFTL

SEQ ID NO: 123628 - protein, 9 aa, Artificial Sequence
  Description of Artificial Sequence: Synthetic peptide
  Seed: VGDEVELPC (MOG_HUMAN)
VQDEVELPI

SEQ ID NO: 123629 - protein, 11 aa, Artificial Sequence
  Description of Artificial Sequence: Synthetic peptide
  Seed: FSDEGGFTCFF (MOG_HUMAN)
FLDEGGFTCFM

SEQ ID NO: 123630 - protein, 9 aa, Artificial Sequence
  Description of Artificial Sequence: Synthetic peptide
  Seed: VSSSYAGQF (MOG_HUMAN)
VASSYAGQF

SEQ ID NO: 123631 - protein, 8 aa, Artificial Sequence
  Description of Artificial Sequence: Synthetic peptide
  Seed: FLCLQYRL (MOG_HUMAN)
FMCLQYRL

SEQ ID NO: 123632 - protein, 9 aa, Artificial Sequence
  Description of Artificial Sequence: Synthetic peptide
  Seed: SDEGGFTCF (MOG_HUMAN)
SAEGGFTCY

SEQ ID NO: 123633 - protein, 9 aa, Artificial Sequence
  Description of Artificial Sequence: Synthetic peptide
  Seed: AIGEGKVTL (MOG_HUMAN)
AAGEGKVTY

SEQ ID NO: 123634 - protein, 9 aa, Artificial Sequence
  Description of Artificial Sequence: Synthetic peptide
  Seed: VIVPVLGPL (MOG_HUMAN)
VVVPVLGPR

SEQ ID NO: 123635 - protein, 9 aa, Artificial Sequence
  Description of Artificial Sequence: Synthetic peptide
  Seed: TFDPHFLRV (MOG_HUMAN)
TFDPHFLRI

SEQ ID NO: 123636 - protein, 9 aa, Artificial Sequence
  Description of Artificial Sequence: Synthetic peptide
  Seed: RVIGPRHPI (MOG_HUMAN)
RTIGPRHPF

SEQ ID NO: 123637 - protein, 10 aa, Artificial Sequence
  Description of Artificial Sequence: Synthetic peptide
  Seed: FDPHFLRVPC (MOG_HUMAN)
FFPHFLRVPA

SEQ ID NO: 123638 - protein, 11 aa, Artificial Sequence
  Description of Artificial Sequence: Synthetic peptide
  Seed: SSSYAGQFRVI (MOG_HUMAN)
SFSYAGQFRVF

SEQ ID NO: 123639 - protein, 9 aa, Artificial Sequence
  Description of Artificial Sequence: Synthetic peptide
  Seed: FSDEGGFTC (MOG_HUMAN)
FHDEGGFTL

SEQ ID NO: 123640 - protein, 10 aa, Artificial Sequence
  Description of Artificial Sequence: Synthetic peptide
  Seed: WYRPPFSRVV (MOG_HUMAN)
WYRPPFSRVW

SEQ ID NO: 123641 - protein, 10 aa, Artificial Sequence
  Description of Artificial Sequence: Synthetic peptide
  Seed: KNATGMEVGW (MOG_HUMAN)
KRATGMEVGW

SEQ ID NO: 123642 - protein, 11 aa, Artificial Sequence
  Description of Artificial Sequence: Synthetic peptide
  Seed: HRTFDPHFLRV (MOG_HUMAN)
HFTFDPHFLRR

SEQ ID NO: 123643 - protein, 9 aa, Artificial Sequence
  Description of Artificial Sequence: Synthetic peptide
  Seed: RIRNVRFSD (MOG_HUMAN)
RQRNVRFSA

SEQ ID NO: 123644 - protein, 8 aa, Artificial Sequence
  Description of Artificial Sequence: Synthetic peptide
  Seed: YAGQFRVI (MOG_HUMAN)
YAGQFRVL

SEQ ID NO: 123645 - protein, 9 aa, Artificial Sequence
  Description of Artificial Sequence: Synthetic peptide
  Seed: WVSPGVLVL (MOG_HUMAN)
WPSPGVLVF

SEQ ID NO: 123646 - protein, 10 aa, Artificial Sequence
  Description of Artificial Sequence: Synthetic peptide
  Seed: IFLCLQYRLR (MOG_HUMAN)
IILCLQYRLR

SEQ ID NO: 123647 - protein, 9 aa, Artificial Sequence
  Description of Artificial Sequence: Synthetic peptide
  Seed: TGMEVGWYR (MOG_HUMAN)
TAMEVGWYK

SEQ ID NO: 123648 - protein, 10 aa, Artificial Sequence
  Description of Artificial Sequence: Synthetic peptide
  Seed: SSYAGQFRVI (MOG_HUMAN)
SMYAGQFRVW

SEQ ID NO: 123649 - protein, 10 aa, Artificial Sequence
  Description of Artificial Sequence: Synthetic peptide
  Seed: VLLLQITVGL (MOG_HUMAN)
VSLLQITVGI

SEQ ID NO: 123650 - protein, 10 aa, Artificial Sequence
  Description of Artificial Sequence: Synthetic peptide
  Seed: WLHRRLAGQF (MOG_HUMAN)
WLHRRLAGQL

SEQ ID NO: 123651 - protein, 9 aa, Artificial Sequence
  Description of Artificial Sequence: Synthetic peptide
  Seed: HSYQEEAAM (MOG_HUMAN)
HRYQEEAAV

SEQ ID NO: 123652 - protein, 9 aa, Artificial Sequence
  Description of Artificial Sequence: Synthetic peptide
  Seed: SLPSCLCSF (MOG_HUMAN)
SRPSCLCSF

SEQ ID NO: 123653 - protein, 9 aa, Artificial Sequence
  Description of Artificial Sequence: Synthetic peptide
  Seed: LLLQVSSSY (MOG_HUMAN)
LMLQVSSSF

SEQ ID NO: 123654 - protein, 10 aa, Artificial Sequence
  Description of Artificial Sequence: Synthetic peptide
  Seed: VLLAVLPVLL (MOG_HUMAN)
VWLAVLPVLL

SEQ ID NO: 123655 - protein, 10 aa, Artificial Sequence
  Description of Artificial Sequence: Synthetic peptide
  Seed: FTCFFRDHSY (MOG_HUMAN)
FACFFRDHSM

SEQ ID NO: 123656 - protein, 9 aa, Artificial Sequence
  Description of Artificial Sequence: Synthetic peptide
  Seed: SLPSCLCSF (MOG_HUMAN)
SLPSCLCSV

SEQ ID NO: 123657 - protein, 9 aa, Artificial Sequence
  Description of Artificial Sequence: Synthetic peptide
  Seed: SRPSLPSCL (MOG_HUMAN)
SIPSLPSCF

SEQ ID NO: 123658 - protein, 11 aa, Artificial Sequence
  Description of Artificial Sequence: Synthetic peptide
  Seed: LHRTFDPHFLR (MOG_HUMAN)
LNRTFDPHFLR

SEQ ID NO: 123659 - protein, 10 aa, Artificial Sequence
  Description of Artificial Sequence: Synthetic peptide
  Seed: HRTFDPHFLR (MOG_HUMAN)
HATFDPHFLR

SEQ ID NO: 123660 - protein, 9 aa, Artificial Sequence
  Description of Artificial Sequence: Synthetic peptide
  Seed: KVEDPFYWV (MOG_HUMAN)
KIEDPFYWI

SEQ ID NO: 123661 - protein, 9 aa, Artificial Sequence
  Description of Artificial Sequence: Synthetic peptide
  Seed: RIRNVRFSD (MOG_HUMAN)
RVRNVRFSG

SEQ ID NO: 123662 - protein, 9 aa, Artificial Sequence
  Description of Artificial Sequence: Synthetic peptide
  Seed: VSPGVLVLL (MOG_HUMAN)
VVPGVLVLL

SEQ ID NO: 123663 - protein, 9 aa, Artificial Sequence
  Description of Artificial Sequence: Synthetic peptide
  Seed: VSPGVLVLL (MOG_HUMAN)
VIPGVLVLM

SEQ ID NO: 123664 - protein, 10 aa, Artificial Sequence
  Description of Artificial Sequence: Synthetic peptide
  Seed: FDPHFLRVPC (MOG_HUMAN)
FTPHFLRVPI

SEQ ID NO: 123665 - protein, 9 aa, Artificial Sequence
  Description of Artificial Sequence: Synthetic peptide
  Seed: LQITVGLIF (MOG_HUMAN)
LIITVGLIY

SEQ ID NO: 123666 - protein, 9 aa, Artificial Sequence
  Description of Artificial Sequence: Synthetic peptide
  Seed: VIVPVLGPL (MOG_HUMAN)
VQVPVLGPY

SEQ ID NO: 123667 - protein, 9 aa, Artificial Sequence
  Description of Artificial Sequence: Synthetic peptide
  Seed: VGDEVELPC (MOG_HUMAN)
VQDEVELPV

SEQ ID NO: 123668 - protein, 11 aa, Artificial Sequence
  Description of Artificial Sequence: Synthetic peptide
  Seed: RPPFSRVVHLY (MOG_HUMAN)
RMPFSRVVHLY

SEQ ID NO: 123669 - protein, 9 aa, Artificial Sequence
  Description of Artificial Sequence: Synthetic peptide
  Seed: VSSSYAGQF (MOG_HUMAN)
VVSSYAGQY

SEQ ID NO: 123670 - protein, 9 aa, Artificial Sequence
  Description of Artificial Sequence: Synthetic peptide
  Seed: LAGQFLEEL (MOG_HUMAN)
LSGQFLEEF

SEQ ID NO: 123671 - protein, 9 aa, Artificial Sequence
  Description of Artificial Sequence: Synthetic peptide
  Seed: YRPPFSRVV (MOG_HUMAN)
YQPPFSRVM

SEQ ID NO: 123672 - protein, 9 aa, Artificial Sequence
  Description of Artificial Sequence: Synthetic peptide
  Seed: LCSFLLLLL (MOG_HUMAN)
LMSFLLLLI

SEQ ID NO: 123673 - protein, 8 aa, Artificial Sequence
  Description of Artificial Sequence: Synthetic peptide
  Seed: RTFDPHFL (MOG_HUMAN)
RSFDPHFW

SEQ ID NO: 123674 - protein, 10 aa, Artificial Sequence
  Description of Artificial Sequence: Synthetic peptide
  Seed: FVIVPVLGPL (MOG_HUMAN)
FLIVPVLGPM

SEQ ID NO: 123675 - protein, 9 aa, Artificial Sequence
  Description of Artificial Sequence: Synthetic peptide
  Seed: TFDPHFLRV (MOG_HUMAN)
TYDPHFLRM

SEQ ID NO: 123676 - protein, 9 aa, Artificial Sequence
  Description of Artificial Sequence: Synthetic peptide
  Seed: AIGEGKVTL (MOG_HUMAN)
ALGEGKVTF

SEQ ID NO: 123677 - protein, 9 aa, Artificial Sequence
  Description of Artificial Sequence: Synthetic peptide
  Seed: VSPGVLVLL (MOG_HUMAN)
VLPGVLVLY

SEQ ID NO: 123678 - protein, 9 aa, Artificial Sequence
  Description of Artificial Sequence: Synthetic peptide
  Seed: KLRAEIENL (MOG_HUMAN)
KMRAEIENR

SEQ ID NO: 123679 - protein, 9 aa, Artificial Sequence
  Description of Artificial Sequence: Synthetic peptide
  Seed: WVSPGVLVL (MOG_HUMAN)
WFSPGVLVY

SEQ ID NO: 123680 - protein, 9 aa, Artificial Sequence
  Description of Artificial Sequence: Synthetic peptide
  Seed: RDHSYQEEA (MOG_HUMAN)
RDHSYQEEM

SEQ ID NO: 123681 - protein, 10 aa, Artificial Sequence
  Description of Artificial Sequence: Synthetic peptide
  Seed: RTFDPHFLRV (MOG_HUMAN)
RFFDPHFLRW

SEQ ID NO: 123682 - protein, 9 aa, Artificial Sequence
  Description of Artificial Sequence: Synthetic peptide
  Seed: VLPVLLLQI (MOG_HUMAN)
VIPVLLLQV

SEQ ID NO: 123683 - protein, 10 aa, Artificial Sequence
  Description of Artificial Sequence: Synthetic peptide
  Seed: SSYAGQFRVI (MOG_HUMAN)
SSYAGQFRVK

SEQ ID NO: 123684 - protein, 9 aa, Artificial Sequence
  Description of Artificial Sequence: Synthetic peptide
  Seed: RTFDPHFLR (MOG_HUMAN)
RWFDPHFLF

SEQ ID NO: 123685 - protein, 9 aa, Artificial Sequence
  Description of Artificial Sequence: Synthetic peptide
  Seed: TGMEVGWYR (MOG_HUMAN)
TMMEVGWYV

SEQ ID NO: 123686 - protein, 10 aa, Artificial Sequence
  Description of Artificial Sequence: Synthetic peptide
  Seed: YWVSPGVLVL (MOG_HUMAN)
YAVSPGVLVI

SEQ ID NO: 123687 - protein, 9 aa, Artificial Sequence
  Description of Artificial Sequence: Synthetic peptide
  Seed: SRPSLPSCL (MOG_HUMAN)
SFPSLPSCI

SEQ ID NO: 123688 - protein, 10 aa, Artificial Sequence
  Description of Artificial Sequence: Synthetic peptide
  Seed: RLAGQFLEEL (MOG_HUMAN)
RLAGQFLEEA

SEQ ID NO: 123689 - protein, 9 aa, Artificial Sequence
  Description of Artificial Sequence: Synthetic peptide
  Seed: LCSFLLLLL (MOG_HUMAN)
LMSFLLLLL

SEQ ID NO: 123690 - protein, 9 aa, Artificial Sequence
  Description of Artificial Sequence: Synthetic peptide
  Seed: VIGPRHPIR (MOG_HUMAN)
VTGPRHPIR

SEQ ID NO: 123691 - protein, 9 aa, Artificial Sequence
  Description of Artificial Sequence: Synthetic peptide
  Seed: RVIGPRHPI (MOG_HUMAN)
RVIGPRHPY

SEQ ID NO: 123692 - protein, 10 aa, Artificial Sequence
  Description of Artificial Sequence: Synthetic peptide
  Seed: RVIGPRHPIR (MOG_HUMAN)
RAIGPRHPIR

SEQ ID NO: 123693 - protein, 9 aa, Artificial Sequence
  Description of Artificial Sequence: Synthetic peptide
  Seed: RIRNVRFSD (MOG_HUMAN)
RYRNVRFSC

SEQ ID NO: 123694 - protein, 10 aa, Artificial Sequence
  Description of Artificial Sequence: Synthetic peptide
  Seed: RVVHLYRNGK (MOG_HUMAN)
RPVHLYRNGK

SEQ ID NO: 123695 - protein, 10 aa, Artificial Sequence
  Description of Artificial Sequence: Synthetic peptide
  Seed: ITVGLIFLCL (MOG_HUMAN)
ISVGLIFLCY

SEQ ID NO: 123696 - protein, 10 aa, Artificial Sequence
  Description of Artificial Sequence: Synthetic peptide
  Seed: RIRNVRFSDE (MOG_HUMAN)
RARNVRFSDY

SEQ ID NO: 123697 - protein, 9 aa, Artificial Sequence
  Description of Artificial Sequence: Synthetic peptide
  Seed: RIRNVRFSD (MOG_HUMAN)
RFRNVRFSF

SEQ ID NO: 123698 - protein, 9 aa, Artificial Sequence
  Description of Artificial Sequence: Synthetic peptide
  Seed: LIICYNWLH (MOG_HUMAN)
LGICYNWLR

SEQ ID NO: 123699 - protein, 9 aa, Artificial Sequence
  Description of Artificial Sequence: Synthetic peptide
  Seed: LAGQFLEEL (MOG_HUMAN)
LYGQFLEEF

SEQ ID NO: 123700 - protein, 9 aa, Artificial Sequence
  Description of Artificial Sequence: Synthetic peptide
  Seed: SRPSLPSCL (MOG_HUMAN)
SGPSLPSCL

SEQ ID NO: 123701 - protein, 10 aa, Artificial Sequence
  Description of Artificial Sequence: Synthetic peptide
  Seed: GLIFLCLQYR (MOG_HUMAN)
GMIFLCLQYR

SEQ ID NO: 123702 - protein, 11 aa, Artificial Sequence
  Description of Artificial Sequence: Synthetic peptide
  Seed: RDHSYQEEAAM (MOG_HUMAN)
RLHSYQEEAAW

SEQ ID NO: 123703 - protein, 9 aa, Artificial Sequence
  Description of Artificial Sequence: Synthetic peptide
  Seed: LPVLLLQIT (MOG_HUMAN)
LPVLLLQIV

SEQ ID NO: 123704 - protein, 9 aa, Artificial Sequence
  Description of Artificial Sequence: Synthetic peptide
  Seed: VEDPFYWVS (MOG_HUMAN)
VEDPFYWVV

SEQ ID NO: 123705 - protein, 10 aa, Artificial Sequence
  Description of Artificial Sequence: Synthetic peptide
  Seed: FDPHFLRVPC (MOG_HUMAN)
FYPHFLRVPI

SEQ ID NO: 123706 - protein, 10 aa, Artificial Sequence
  Description of Artificial Sequence: Synthetic peptide
  Seed: SSYAGQFRVI (MOG_HUMAN)
SSYAGQFRVM

SEQ ID NO: 123707 - protein, 8 aa, Artificial Sequence
  Description of Artificial Sequence: Synthetic peptide
  Seed: FSDEGGFT (MOG_HUMAN)
FQDEGGFM

SEQ ID NO: 123708 - protein, 9 aa, Artificial Sequence
  Description of Artificial Sequence: Synthetic peptide
  Seed: SLPSCLCSF (MOG_HUMAN)
SIPSCLCSA

SEQ ID NO: 123709 - protein, 9 aa, Artificial Sequence
  Description of Artificial Sequence: Synthetic peptide
  Seed: EGGFTCFFR (MOG_HUMAN)
ETGFTCFFK

SEQ ID NO: 123710 - protein, 9 aa, Artificial Sequence
  Description of Artificial Sequence: Synthetic peptide
  Seed: ITLFVIVPV (MOG_HUMAN)
IMLFVIVPW

SEQ ID NO: 123711 - protein, 9 aa, Artificial Sequence
  Description of Artificial Sequence: Synthetic peptide
  Seed: RVPCWKITL (MOG_HUMAN)
RYPCWKITM

SEQ ID NO: 123712 - protein, 10 aa, Artificial Sequence
  Description of Artificial Sequence: Synthetic peptide
  Seed: FVIVPVLGPL (MOG_HUMAN)
FMIVPVLGPY

SEQ ID NO: 123713 - protein, 10 aa, Artificial Sequence
  Description of Artificial Sequence: Synthetic peptide
  Seed: IFLCLQYRLR (MOG_HUMAN)
IYLCLQYRLR

SEQ ID NO: 123714 - protein, 10 aa, Artificial Sequence
  Description of Artificial Sequence: Synthetic peptide
  Seed: FVIVPVLGPL (MOG_HUMAN)
FNIVPVLGPY

SEQ ID NO: 123715 - protein, 11 aa, Artificial Sequence
  Description of Artificial Sequence: Synthetic peptide
  Seed: RLAGQFLEELR (MOG_HUMAN)
RIAGQFLEELR

SEQ ID NO: 123716 - protein, 10 aa, Artificial Sequence
  Description of Artificial Sequence: Synthetic peptide
  Seed: LVLLAVLPVL (MOG_HUMAN)
LSLLAVLPVI

SEQ ID NO: 123717 - protein, 10 aa, Artificial Sequence
  Description of Artificial Sequence: Synthetic peptide
  Seed: RTFDPHFLRV (MOG_HUMAN)
RAFDPHFLRK

SEQ ID NO: 123718 - protein, 10 aa, Artificial Sequence
  Description of Artificial Sequence: Synthetic peptide
  Seed: FTCFFRDHSY (MOG_HUMAN)
FQCFFRDHSM

SEQ ID NO: 123719 - protein, 10 aa, Artificial Sequence
  Description of Artificial Sequence: Synthetic peptide
  Seed: VLLLQITVGL (MOG_HUMAN)
VALLQITVGI

SEQ ID NO: 123720 - protein, 9 aa, Artificial Sequence
  Description of Artificial Sequence: Synthetic peptide
  Seed: RIRNVRFSD (MOG_HUMAN)
RLRNVRFSM

SEQ ID NO: 123721 - protein, 9 aa, Artificial Sequence
  Description of Artificial Sequence: Synthetic peptide
  Seed: MASLSRPSL (MOG_HUMAN)
MYSLSRPSY

SEQ ID NO: 123722 - protein, 10 aa, Artificial Sequence
  Description of Artificial Sequence: Synthetic peptide
  Seed: SLSRPSLPSC (MOG_HUMAN)
SHSRPSLPSV

SEQ ID NO: 123723 - protein, 9 aa, Artificial Sequence
  Description of Artificial Sequence: Synthetic peptide
  Seed: IVPVLGPLV (MOG_HUMAN)
ISPVLGPLM

SEQ ID NO: 123724 - protein, 9 aa, Artificial Sequence
  Description of Artificial Sequence: Synthetic peptide
  Seed: YQEEAAMEL (MOG_HUMAN)
YTEEAAMEF

SEQ ID NO: 123725 - protein, 9 aa, Artificial Sequence
  Description of Artificial Sequence: Synthetic peptide
  Seed: YQEEAAMEL (MOG_HUMAN)
YCEEAAMEI

SEQ ID NO: 123726 - protein, 9 aa, Artificial Sequence
  Description of Artificial Sequence: Synthetic peptide
  Seed: SSSYAGQFR (MOG_HUMAN)
SASYAGQFR

SEQ ID NO: 123727 - protein, 9 aa, Artificial Sequence
  Description of Artificial Sequence: Synthetic peptide
  Seed: VSSSYAGQF (MOG_HUMAN)
VMSSYAGQW

SEQ ID NO: 123728 - protein, 9 aa, Artificial Sequence
  Description of Artificial Sequence: Synthetic peptide
  Seed: KLRAEIENL (MOG_HUMAN)
KVRAEIENK

SEQ ID NO: 123729 - protein, 10 aa, Artificial Sequence
  Description of Artificial Sequence: Synthetic peptide
  Seed: RTFDPHFLRV (MOG_HUMAN)
RLFDPHFLRP

SEQ ID NO: 123730 - protein, 10 aa, Artificial Sequence
  Description of Artificial Sequence: Synthetic peptide
  Seed: RTFDPHFLRV (MOG_HUMAN)
RYFDPHFLRM

SEQ ID NO: 123731 - protein, 9 aa, Artificial Sequence
  Description of Artificial Sequence: Synthetic peptide
  Seed: WVSPGVLVL (MOG_HUMAN)
WPSPGVLVY

SEQ ID NO: 123732 - protein, 10 aa, Artificial Sequence
  Description of Artificial Sequence: Synthetic peptide
  Seed: RPPFSRVVHL (MOG_HUMAN)
RHPFSRVVHM

SEQ ID NO: 123733 - protein, 9 aa, Artificial Sequence
  Description of Artificial Sequence: Synthetic peptide
  Seed: AIGEGKVTL (MOG_HUMAN)
AQGEGKVTI

SEQ ID NO: 123734 - protein, 9 aa, Artificial Sequence
  Description of Artificial Sequence: Synthetic peptide
  Seed: GWYRPPFSR (MOG_HUMAN)
GAYRPPFSR

SEQ ID NO: 123735 - protein, 8 aa, Artificial Sequence
  Description of Artificial Sequence: Synthetic peptide
  Seed: IENLHRTF (MOG_HUMAN)
IANLHRTL

SEQ ID NO: 123736 - protein, 9 aa, Artificial Sequence
  Description of Artificial Sequence: Synthetic peptide
  Seed: LAVLPVLLL (MOG_HUMAN)
LMVLPVLLV

SEQ ID NO: 123737 - protein, 11 aa, Artificial Sequence
  Description of Artificial Sequence: Synthetic peptide
  Seed: LHRTFDPHFLR (MOG_HUMAN)
LMRTFDPHFLR

SEQ ID NO: 123738 - protein, 11 aa, Artificial Sequence
  Description of Artificial Sequence: Synthetic peptide
  Seed: KDAIGEGKVTL (MOG_HUMAN)
KEAIGEGKVTI

SEQ ID NO: 123739 - protein, 10 aa, Artificial Sequence
  Description of Artificial Sequence: Synthetic peptide
  Seed: CLCSFLLLLL (MOG_HUMAN)
CMCSFLLLLL

SEQ ID NO: 123740 - protein, 10 aa, Artificial Sequence
  Description of Artificial Sequence: Synthetic peptide
  Seed: RLAGQFLEEL (MOG_HUMAN)
RIAGQFLEEF

SEQ ID NO: 123741 - protein, 9 aa, Artificial Sequence
  Description of Artificial Sequence: Synthetic peptide
  Seed: MASLSRPSL (MOG_HUMAN)
MTSLSRPSK

SEQ ID NO: 123742 - protein, 9 aa, Artificial Sequence
  Description of Artificial Sequence: Synthetic peptide
  Seed: MASLSRPSL (MOG_HUMAN)
MGSLSRPSM

SEQ ID NO: 123743 - protein, 10 aa, Artificial Sequence
  Description of Artificial Sequence: Synthetic peptide
  Seed: FRVIGPRHPI (MOG_HUMAN)
FTVIGPRHPV

SEQ ID NO: 123744 - protein, 10 aa, Artificial Sequence
  Description of Artificial Sequence: Synthetic peptide
  Seed: RVPCWKITLF (MOG_HUMAN)
RFPCWKITLL

SEQ ID NO: 123745 - protein, 9 aa, Artificial Sequence
  Description of Artificial Sequence: Synthetic peptide
  Seed: MASLSRPSL (MOG_HUMAN)
MHSLSRPSM

SEQ ID NO: 123746 - protein, 9 aa, Artificial Sequence
  Description of Artificial Sequence: Synthetic peptide
  Seed: LVLLAVLPV (MOG_HUMAN)
LLLLAVLPM

SEQ ID NO: 123747 - protein, 10 aa, Artificial Sequence
  Description of Artificial Sequence: Synthetic peptide
  Seed: SLSRPSLPSC (MOG_HUMAN)
STSRPSLPSM

SEQ ID NO: 123748 - protein, 10 aa, Artificial Sequence
  Description of Artificial Sequence: Synthetic peptide
  Seed: ICYNWLHRRL (MOG_HUMAN)
IYYNWLHRRW

SEQ ID NO: 123749 - protein, 10 aa, Artificial Sequence
  Description of Artificial Sequence: Synthetic peptide
  Seed: WVSPGVLVLL (MOG_HUMAN)
WMSPGVLVLL

SEQ ID NO: 123750 - protein, 11 aa, Artificial Sequence
  Description of Artificial Sequence: Synthetic peptide
  Seed: RPSLPSCLCSF (MOG_HUMAN)
RPSLPSCLCSM

SEQ ID NO: 123751 - protein, 11 aa, Artificial Sequence
  Description of Artificial Sequence: Synthetic peptide
  Seed: RDHSYQEEAAM (MOG_HUMAN)
RQHSYQEEAAW

SEQ ID NO: 123752 - protein, 9 aa, Artificial Sequence
  Description of Artificial Sequence: Synthetic peptide
  Seed: RTFDPHFLR (MOG_HUMAN)
RAFDPHFLY

SEQ ID NO: 123753 - protein, 9 aa, Artificial Sequence
  Description of Artificial Sequence: Synthetic peptide
  Seed: GEGKVTLRI (MOG_HUMAN)
GEGKVTLRV

SEQ ID NO: 123754 - protein, 10 aa, Artificial Sequence
  Description of Artificial Sequence: Synthetic peptide
  Seed: FSDEGGFTCF (MOG_HUMAN)
FGDEGGFTCF

SEQ ID NO: 123755 - protein, 8 aa, Artificial Sequence
  Description of Artificial Sequence: Synthetic peptide
  Seed: VIGPRHPI (MOG_HUMAN)
VAGPRHPF

SEQ ID NO: 123756 - protein, 10 aa, Artificial Sequence
  Description of Artificial Sequence: Synthetic peptide
  Seed: RIRNVRFSDE (MOG_HUMAN)
RMRNVRFSDV

SEQ ID NO: 123757 - protein, 10 aa, Artificial Sequence
  Description of Artificial Sequence: Synthetic peptide
  Seed: RIRNVRFSDE (MOG_HUMAN)
RWRNVRFSDK

SEQ ID NO: 123758 - protein, 10 aa, Artificial Sequence
  Description of Artificial Sequence: Synthetic peptide
  Seed: VPVLGPLVAL (MOG_HUMAN)
VPVLGPLVAF

SEQ ID NO: 123759 - protein, 9 aa, Artificial Sequence
  Description of Artificial Sequence: Synthetic peptide
  Seed: RIRNVRFSD (MOG_HUMAN)
RYRNVRFSG

SEQ ID NO: 123760 - protein, 10 aa, Artificial Sequence
  Description of Artificial Sequence: Synthetic peptide
  Seed: RTFDPHFLRV (MOG_HUMAN)
RAFDPHFLRM

SEQ ID NO: 123761 - protein, 9 aa, Artificial Sequence
  Description of Artificial Sequence: Synthetic peptide
  Seed: VGDEVELPC (MOG_HUMAN)
VVDEVELPV

SEQ ID NO: 123762 - protein, 9 aa, Artificial Sequence
  Description of Artificial Sequence: Synthetic peptide
  Seed: WVSPGVLVL (MOG_HUMAN)
WPSPGVLVL

SEQ ID NO: 123763 - protein, 10 aa, Artificial Sequence
  Description of Artificial Sequence: Synthetic peptide
  Seed: LIFLCLQYRL (MOG_HUMAN)
LMFLCLQYRI

SEQ ID NO: 123764 - protein, 10 aa, Artificial Sequence
  Description of Artificial Sequence: Synthetic peptide
  Seed: LIFLCLQYRL (MOG_HUMAN)
LPFLCLQYRR

SEQ ID NO: 123765 - protein, 10 aa, Artificial Sequence
  Description of Artificial Sequence: Synthetic peptide
  Seed: RTFDPHFLRV (MOG_HUMAN)
RKFDPHFLRY

SEQ ID NO: 123766 - protein, 9 aa, Artificial Sequence
  Description of Artificial Sequence: Synthetic peptide
  Seed: YQEEAAMEL (MOG_HUMAN)
YVEEAAMEL

SEQ ID NO: 123767 - protein, 10 aa, Artificial Sequence
  Description of Artificial Sequence: Synthetic peptide
  Seed: FDPHFLRVPC (MOG_HUMAN)
FIPHFLRVPI

SEQ ID NO: 123768 - protein, 8 aa, Artificial Sequence
  Description of Artificial Sequence: Synthetic peptide
  Seed: FSDEGGFT (MOG_HUMAN)
FGDEGGFI

SEQ ID NO: 123769 - protein, 10 aa, Artificial Sequence
  Description of Artificial Sequence: Synthetic peptide
  Seed: TGMEVGWYRP (MOG_HUMAN)
TVMEVGWYRN

SEQ ID NO: 123770 - protein, 9 aa, Artificial Sequence
  Description of Artificial Sequence: Synthetic peptide
  Seed: YRPPFSRVV (MOG_HUMAN)
YFPPFSRVV

SEQ ID NO: 123771 - protein, 10 aa, Artificial Sequence
  Description of Artificial Sequence: Synthetic peptide
  Seed: VLLLQITVGL (MOG_HUMAN)
VNLLQITVGI

SEQ ID NO: 123772 - protein, 10 aa, Artificial Sequence
  Description of Artificial Sequence: Synthetic peptide
  Seed: VLLAVLPVLL (MOG_HUMAN)
VKLAVLPVLL

SEQ ID NO: 123773 - protein, 10 aa, Artificial Sequence
  Description of Artificial Sequence: Synthetic peptide
  Seed: SLSRPSLPSC (MOG_HUMAN)
SPSRPSLPSV

SEQ ID NO: 123774 - protein, 11 aa, Artificial Sequence
  Description of Artificial Sequence: Synthetic peptide
  Seed: MELKVEDPFYW (MOG_HUMAN)
MTLKVEDPFYW

SEQ ID NO: 123775 - protein, 9 aa, Artificial Sequence
  Description of Artificial Sequence: Synthetic peptide
  Seed: RIRNVRFSD (MOG_HUMAN)
RIRNVRFSG

SEQ ID NO: 123776 - protein, 11 aa, Artificial Sequence
  Description of Artificial Sequence: Synthetic peptide
  Seed: RFSDEGGFTCF (MOG_HUMAN)
RRSDEGGFTCF

SEQ ID NO: 123777 - protein, 9 aa, Artificial Sequence
  Description of Artificial Sequence: Synthetic peptide
  Seed: FSDEGGFTC (MOG_HUMAN)
FVDEGGFTM

SEQ ID NO: 123778 - protein, 10 aa, Artificial Sequence
  Description of Artificial Sequence: Synthetic peptide
  Seed: LPSCLCSFLL (MOG_HUMAN)
LPSCLCSFLY

SEQ ID NO: 123779 - protein, 9 aa, Artificial Sequence
  Description of Artificial Sequence: Synthetic peptide
  Seed: RIRNVRFSD (MOG_HUMAN)
RSRNVRFSM

SEQ ID NO: 123780 - protein, 9 aa, Artificial Sequence
  Description of Artificial Sequence: Synthetic peptide
  Seed: SRPSLPSCL (MOG_HUMAN)
SIPSLPSCI

SEQ ID NO: 123781 - protein, 9 aa, Artificial Sequence
  Description of Artificial Sequence: Synthetic peptide
  Seed: RVPCWKITL (MOG_HUMAN)
RTPCWKITF

SEQ ID NO: 123782 - protein, 9 aa, Artificial Sequence
  Description of Artificial Sequence: Synthetic peptide
  Seed: IVPVLGPLV (MOG_HUMAN)
IMPVLGPLI

SEQ ID NO: 123783 - protein, 8 aa, Artificial Sequence
  Description of Artificial Sequence: Synthetic peptide
  Seed: RPSLPSCL (MOG_HUMAN)
RPSLPSCM

SEQ ID NO: 123784 - protein, 10 aa, Artificial Sequence
  Description of Artificial Sequence: Synthetic peptide
  Seed: FDPHFLRVPC (MOG_HUMAN)
FDPHFLRVPM

SEQ ID NO: 123785 - protein, 10 aa, Artificial Sequence
  Description of Artificial Sequence: Synthetic peptide
  Seed: RTFDPHFLRV (MOG_HUMAN)
RSFDPHFLRS

SEQ ID NO: 123786 - protein, 9 aa, Artificial Sequence
  Description of Artificial Sequence: Synthetic peptide
  Seed: AIGEGKVTL (MOG_HUMAN)
AFGEGKVTL

SEQ ID NO: 123787 - protein, 9 aa, Artificial Sequence
  Description of Artificial Sequence: Synthetic peptide
  Seed: YWVSPGVLV (MOG_HUMAN)
YSVSPGVLL

SEQ ID NO: 123788 - protein, 9 aa, Artificial Sequence
  Description of Artificial Sequence: Synthetic peptide
  Seed: RVVHLYRNG (MOG_HUMAN)
RTVHLYRNV

SEQ ID NO: 123789 - protein, 10 aa, Artificial Sequence
  Description of Artificial Sequence: Synthetic peptide
  Seed: FTCFFRDHSY (MOG_HUMAN)
FACFFRDHSW

SEQ ID NO: 123790 - protein, 9 aa, Artificial Sequence
  Description of Artificial Sequence: Synthetic peptide
  Seed: LAGQFLEEL (MOG_HUMAN)
LQGQFLEEW

SEQ ID NO: 123791 - protein, 10 aa, Artificial Sequence
  Description of Artificial Sequence: Synthetic peptide
  Seed: FDPHFLRVPC (MOG_HUMAN)
FKPHFLRVPI

SEQ ID NO: 123792 - protein, 10 aa, Artificial Sequence
  Description of Artificial Sequence: Synthetic peptide
  Seed: VLLLQITVGL (MOG_HUMAN)
VYLLQITVGI

SEQ ID NO: 123793 - protein, 10 aa, Artificial Sequence
  Description of Artificial Sequence: Synthetic peptide
  Seed: FVIVPVLGPL (MOG_HUMAN)
FAIVPVLGPV

SEQ ID NO: 123794 - protein, 10 aa, Artificial Sequence
  Description of Artificial Sequence: Synthetic peptide
  Seed: RTFDPHFLRV (MOG_HUMAN)
RLFDPHFLRN

SEQ ID NO: 123795 - protein, 10 aa, Artificial Sequence
  Description of Artificial Sequence: Synthetic peptide
  Seed: VLLLQITVGL (MOG_HUMAN)
VSLLQITVGV

SEQ ID NO: 123796 - protein, 10 aa, Artificial Sequence
  Description of Artificial Sequence: Synthetic peptide
  Seed: FDPHFLRVPC (MOG_HUMAN)
FDPHFLRVPT

SEQ ID NO: 123797 - protein, 11 aa, Artificial Sequence
  Description of Artificial Sequence: Synthetic peptide
  Seed: VIGPRHPIRAL (MOG_HUMAN)
VAGPRHPIRAL

SEQ ID NO: 123798 - protein, 10 aa, Artificial Sequence
  Description of Artificial Sequence: Synthetic peptide
  Seed: QFLEELRNPF (MOG_HUMAN)
QYLEELRNPF

SEQ ID NO: 123799 - protein, 9 aa, Artificial Sequence
  Description of Artificial Sequence: Synthetic peptide
  Seed: TGMEVGWYR (MOG_HUMAN)
TTMEVGWYK

SEQ ID NO: 123800 - protein, 9 aa, Artificial Sequence
  Description of Artificial Sequence: Synthetic peptide
  Seed: EEAAMELKV (MOG_HUMAN)
EEAAMELKF

SEQ ID NO: 123801 - protein, 10 aa, Artificial Sequence
  Description of Artificial Sequence: Synthetic peptide
  Seed: FVIVPVLGPL (MOG_HUMAN)
FPIVPVLGPI

SEQ ID NO: 123802 - protein, 10 aa, Artificial Sequence
  Description of Artificial Sequence: Synthetic peptide
  Seed: FDPHFLRVPC (MOG_HUMAN)
FTPHFLRVPV

SEQ ID NO: 123803 - protein, 10 aa, Artificial Sequence
  Description of Artificial Sequence: Synthetic peptide
  Seed: RTFDPHFLRV (MOG_HUMAN)
RFFDPHFLRD

SEQ ID NO: 123804 - protein, 10 aa, Artificial Sequence
  Description of Artificial Sequence: Synthetic peptide
  Seed: RIRNVRFSDE (MOG_HUMAN)
RMRNVRFSDK

SEQ ID NO: 123805 - protein, 10 aa, Artificial Sequence
  Description of Artificial Sequence: Synthetic peptide
  Seed: YWVSPGVLVL (MOG_HUMAN)
YFVSPGVLVY

SEQ ID NO: 123806 - protein, 10 aa, Artificial Sequence
  Description of Artificial Sequence: Synthetic peptide
  Seed: FDPHFLRVPC (MOG_HUMAN)
FYPHFLRVPS

SEQ ID NO: 123807 - protein, 9 aa, Artificial Sequence
  Description of Artificial Sequence: Synthetic peptide
  Seed: SSYAGQFRV (MOG_HUMAN)
SQYAGQFRI

SEQ ID NO: 123808 - protein, 9 aa, Artificial Sequence
  Description of Artificial Sequence: Synthetic peptide
  Seed: HSYQEEAAM (MOG_HUMAN)
HPYQEEAAI

SEQ ID NO: 123809 - protein, 10 aa, Artificial Sequence
  Description of Artificial Sequence: Synthetic peptide
  Seed: LLLQVSSSYA (MOG_HUMAN)
LDLQVSSSYV

SEQ ID NO: 123810 - protein, 10 aa, Artificial Sequence
  Description of Artificial Sequence: Synthetic peptide
  Seed: RPPFSRVVHL (MOG_HUMAN)
RAPFSRVVHL

SEQ ID NO: 123811 - protein, 10 aa, Artificial Sequence
  Description of Artificial Sequence: Synthetic peptide
  Seed: RTFDPHFLRV (MOG_HUMAN)
RCFDPHFLRW

SEQ ID NO: 123812 - protein, 9 aa, Artificial Sequence
  Description of Artificial Sequence: Synthetic peptide
  Seed: WYRPPFSRV (MOG_HUMAN)
WFRPPFSRY

SEQ ID NO: 123813 - protein, 10 aa, Artificial Sequence
  Description of Artificial Sequence: Synthetic peptide
  Seed: SDEGGFTCFF (MOG_HUMAN)
SIEGGFTCFW

SEQ ID NO: 123814 - protein, 10 aa, Artificial Sequence
  Description of Artificial Sequence: Synthetic peptide
  Seed: FDPHFLRVPC (MOG_HUMAN)
FSPHFLRVPS

SEQ ID NO: 123815 - protein, 9 aa, Artificial Sequence
  Description of Artificial Sequence: Synthetic peptide
  Seed: VLLAVLPVL (MOG_HUMAN)
VVLAVLPVY

SEQ ID NO: 123816 - protein, 10 aa, Artificial Sequence
  Description of Artificial Sequence: Synthetic peptide
  Seed: FVIVPVLGPL (MOG_HUMAN)
FMIVPVLGPV

SEQ ID NO: 123817 - protein, 9 aa, Artificial Sequence
  Description of Artificial Sequence: Synthetic peptide
  Seed: KLRAEIENL (MOG_HUMAN)
KIRAEIENW

SEQ ID NO: 123818 - protein, 9 aa, Artificial Sequence
  Description of Artificial Sequence: Synthetic peptide
  Seed: SSYAGQFRV (MOG_HUMAN)
SVYAGQFRM

SEQ ID NO: 123819 - protein, 10 aa, Artificial Sequence
  Description of Artificial Sequence: Synthetic peptide
  Seed: SSYAGQFRVI (MOG_HUMAN)
SHYAGQFRVF

SEQ ID NO: 123820 - protein, 9 aa, Artificial Sequence
  Description of Artificial Sequence: Synthetic peptide
  Seed: VVHLYRNGK (MOG_HUMAN)
VFHLYRNGR

SEQ ID NO: 123821 - protein, 9 aa, Artificial Sequence
  Description of Artificial Sequence: Synthetic peptide
  Seed: VIVPVLGPL (MOG_HUMAN)
VVVPVLGPL

SEQ ID NO: 123822 - protein, 10 aa, Artificial Sequence
  Description of Artificial Sequence: Synthetic peptide
  Seed: VLLLQITVGL (MOG_HUMAN)
VFLLQITVGI

SEQ ID NO: 123823 - protein, 10 aa, Artificial Sequence
  Description of Artificial Sequence: Synthetic peptide
  Seed: LLQITVGLIF (MOG_HUMAN)
LFQITVGLIM

SEQ ID NO: 123824 - protein, 10 aa, Artificial Sequence
  Description of Artificial Sequence: Synthetic peptide
  Seed: FVIVPVLGPL (MOG_HUMAN)
FYIVPVLGPY

SEQ ID NO: 123825 - protein, 9 aa, Artificial Sequence
  Description of Artificial Sequence: Synthetic peptide
  Seed: YQEEAAMEL (MOG_HUMAN)
YSEEAAMEF

SEQ ID NO: 123826 - protein, 9 aa, Artificial Sequence
  Description of Artificial Sequence: Synthetic peptide
  Seed: AIGEGKVTL (MOG_HUMAN)
ARGEGKVTL

SEQ ID NO: 123827 - protein, 9 aa, Artificial Sequence
  Description of Artificial Sequence: Synthetic peptide
  Seed: AIGEGKVTL (MOG_HUMAN)
AIGEGKVTV

SEQ ID NO: 123828 - protein, 10 aa, Artificial Sequence
  Description of Artificial Sequence: Synthetic peptide
  Seed: RPPFSRVVHL (MOG_HUMAN)
RTPFSRVVHM

SEQ ID NO: 123829 - protein, 11 aa, Artificial Sequence
  Description of Artificial Sequence: Synthetic peptide
  Seed: RDHSYQEEAAM (MOG_HUMAN)
REHSYQEEAAM

SEQ ID NO: 123830 - protein, 10 aa, Artificial Sequence
  Description of Artificial Sequence: Synthetic peptide
  Seed: TGMEVGWYRP (MOG_HUMAN)
TMMEVGWYRC

SEQ ID NO: 123831 - protein, 10 aa, Artificial Sequence
  Description of Artificial Sequence: Synthetic peptide
  Seed: FDPHFLRVPC (MOG_HUMAN)
FNPHFLRVPI

SEQ ID NO: 123832 - protein, 10 aa, Artificial Sequence
  Description of Artificial Sequence: Synthetic peptide
  Seed: LLLLQVSSSY (MOG_HUMAN)
LKLLQVSSSF

SEQ ID NO: 123833 - protein, 11 aa, Artificial Sequence
  Description of Artificial Sequence: Synthetic peptide
  Seed: FYWVSPGVLVL (MOG_HUMAN)
FYWVSPGVLVF

SEQ ID NO: 123834 - protein, 10 aa, Artificial Sequence
  Description of Artificial Sequence: Synthetic peptide
  Seed: IGPRHPIRAL (MOG_HUMAN)
IQPRHPIRAV

SEQ ID NO: 123835 - protein, 11 aa, Artificial Sequence
  Description of Artificial Sequence: Synthetic peptide
  Seed: HRTFDPHFLRV (MOG_HUMAN)
HTTFDPHFLRR

SEQ ID NO: 123836 - protein, 10 aa, Artificial Sequence
  Description of Artificial Sequence: Synthetic peptide
  Seed: SLSRPSLPSC (MOG_HUMAN)
SSSRPSLPSK

SEQ ID NO: 123837 - protein, 9 aa, Artificial Sequence
  Description of Artificial Sequence: Synthetic peptide
  Seed: TFDPHFLRV (MOG_HUMAN)
TSDPHFLRH

SEQ ID NO: 123838 - protein, 10 aa, Artificial Sequence
  Description of Artificial Sequence: Synthetic peptide
  Seed: RALVGDEVEL (MOG_HUMAN)
RSLVGDEVEF

SEQ ID NO: 123839 - protein, 9 aa, Artificial Sequence
  Description of Artificial Sequence: Synthetic peptide
  Seed: KVEDPFYWV (MOG_HUMAN)
KMEDPFYWM

SEQ ID NO: 123840 - protein, 10 aa, Artificial Sequence
  Description of Artificial Sequence: Synthetic peptide
  Seed: FRVIGPRHPI (MOG_HUMAN)
FHVIGPRHPI

SEQ ID NO: 123841 - protein, 11 aa, Artificial Sequence
  Description of Artificial Sequence: Synthetic peptide
  Seed: RDHSYQEEAAM (MOG_HUMAN)
RNHSYQEEAAY

SEQ ID NO: 123842 - protein, 11 aa, Artificial Sequence
  Description of Artificial Sequence: Synthetic peptide
  Seed: KDAIGEGKVTL (MOG_HUMAN)
KEAIGEGKVTA

SEQ ID NO: 123843 - protein, 9 aa, Artificial Sequence
  Description of Artificial Sequence: Synthetic peptide
  Seed: LLAVLPVLL (MOG_HUMAN)
LQAVLPVLI

SEQ ID NO: 123844 - protein, 9 aa, Artificial Sequence
  Description of Artificial Sequence: Synthetic peptide
  Seed: QITVGLIFL (MOG_HUMAN)
QITVGLIFV

SEQ ID NO: 123845 - protein, 11 aa, Artificial Sequence
  Description of Artificial Sequence: Synthetic peptide
  Seed: LLLLLQVSSSY (MOG_HUMAN)
LSLLLQVSSSY

SEQ ID NO: 123846 - protein, 11 aa, Artificial Sequence
  Description of Artificial Sequence: Synthetic peptide
  Seed: RRLAGQFLEEL (MOG_HUMAN)
RFLAGQFLEEV

SEQ ID NO: 123847 - protein, 9 aa, Artificial Sequence
  Description of Artificial Sequence: Synthetic peptide
  Seed: VGDEVELPC (MOG_HUMAN)
VFDEVELPF

SEQ ID NO: 123848 - protein, 10 aa, Artificial Sequence
  Description of Artificial Sequence: Synthetic peptide
  Seed: FSDEGGFTCF (MOG_HUMAN)
FADEGGFTCM

SEQ ID NO: 123849 - protein, 9 aa, Artificial Sequence
  Description of Artificial Sequence: Synthetic peptide
  Seed: LLAVLPVLL (MOG_HUMAN)
LLAVLPVLF

SEQ ID NO: 123850 - protein, 11 aa, Artificial Sequence
  Description of Artificial Sequence: Synthetic peptide
  Seed: LIICYNWLHRR (MOG_HUMAN)
LTICYNWLHRR

SEQ ID NO: 123851 - protein, 9 aa, Artificial Sequence
  Description of Artificial Sequence: Synthetic peptide
  Seed: YRPPFSRVV (MOG_HUMAN)
YAPPFSRVI

SEQ ID NO: 123852 - protein, 10 aa, Artificial Sequence
  Description of Artificial Sequence: Synthetic peptide
  Seed: KITLFVIVPV (MOG_HUMAN)
KMTLFVIVPI

SEQ ID NO: 123853 - protein, 10 aa, Artificial Sequence
  Description of Artificial Sequence: Synthetic peptide
  Seed: SLPSCLCSFL (MOG_HUMAN)
SLPSCLCSFV

SEQ ID NO: 123854 - protein, 10 aa, Artificial Sequence
  Description of Artificial Sequence: Synthetic peptide
  Seed: LLLQVSSSYA (MOG_HUMAN)
LGLQVSSSYY

SEQ ID NO: 123855 - protein, 10 aa, Artificial Sequence
  Description of Artificial Sequence: Synthetic peptide
  Seed: AVLPVLLLQI (MOG_HUMAN)
AQLPVLLLQI

SEQ ID NO: 123856 - protein, 11 aa, Artificial Sequence
  Description of Artificial Sequence: Synthetic peptide
  Seed: RDHSYQEEAAM (MOG_HUMAN)
RSHSYQEEAAW

SEQ ID NO: 123857 - protein, 9 aa, Artificial Sequence
  Description of Artificial Sequence: Synthetic peptide
  Seed: RIRNVRFSD (MOG_HUMAN)
RARNVRFSF

SEQ ID NO: 123858 - protein, 9 aa, Artificial Sequence
  Description of Artificial Sequence: Synthetic peptide
  Seed: MEVGWYRPP (MOG_HUMAN)
MEVGWYRPA

SEQ ID NO: 123859 - protein, 9 aa, Artificial Sequence
  Description of Artificial Sequence: Synthetic peptide
  Seed: WVSPGVLVL (MOG_HUMAN)
WSSPGVLVV

SEQ ID NO: 123860 - protein, 10 aa, Artificial Sequence
  Description of Artificial Sequence: Synthetic peptide
  Seed: FSDEGGFTCF (MOG_HUMAN)
FWDEGGFTCI

SEQ ID NO: 123861 - protein, 9 aa, Artificial Sequence
  Description of Artificial Sequence: Synthetic peptide
  Seed: SLPSCLCSF (MOG_HUMAN)
SWPSCLCSL

SEQ ID NO: 123862 - protein, 10 aa, Artificial Sequence
  Description of Artificial Sequence: Synthetic peptide
  Seed: RLAGQFLEEL (MOG_HUMAN)
RMAGQFLEEF

SEQ ID NO: 123863 - protein, 9 aa, Artificial Sequence
  Description of Artificial Sequence: Synthetic peptide
  Seed: LKVEDPFYW (MOG_HUMAN)
LMVEDPFYF

SEQ ID NO: 123864 - protein, 9 aa, Artificial Sequence
  Description of Artificial Sequence: Synthetic peptide
  Seed: VPCWKITLF (MOG_HUMAN)
VQCWKITLF

SEQ ID NO: 123865 - protein, 10 aa, Artificial Sequence
  Description of Artificial Sequence: Synthetic peptide
  Seed: VSSSYAGQFR (MOG_HUMAN)
VLSSYAGQFR

SEQ ID NO: 123866 - protein, 10 aa, Artificial Sequence
  Description of Artificial Sequence: Synthetic peptide
  Seed: FVIVPVLGPL (MOG_HUMAN)
FTIVPVLGPI

SEQ ID NO: 123867 - protein, 9 aa, Artificial Sequence
  Description of Artificial Sequence: Synthetic peptide
  Seed: MEVGWYRPP (MOG_HUMAN)
MEVGWYRPV

SEQ ID NO: 123868 - protein, 9 aa, Artificial Sequence
  Description of Artificial Sequence: Synthetic peptide
  Seed: RTFDPHFLR (MOG_HUMAN)
RIFDPHFLY

SEQ ID NO: 123869 - protein, 10 aa, Artificial Sequence
  Description of Artificial Sequence: Synthetic peptide
  Seed: FVIVPVLGPL (MOG_HUMAN)
FGIVPVLGPY

SEQ ID NO: 123870 - protein, 9 aa, Artificial Sequence
  Description of Artificial Sequence: Synthetic peptide
  Seed: RIRNVRFSD (MOG_HUMAN)
RLRNVRFSR

SEQ ID NO: 123871 - protein, 9 aa, Artificial Sequence
  Description of Artificial Sequence: Synthetic peptide
  Seed: KVEDPFYWV (MOG_HUMAN)
KVEDPFYWI

SEQ ID NO: 123872 - protein, 10 aa, Artificial Sequence
  Description of Artificial Sequence: Synthetic peptide
  Seed: LLLQVSSSYA (MOG_HUMAN)
LALQVSSSYF

SEQ ID NO: 123873 - protein, 9 aa, Artificial Sequence
  Description of Artificial Sequence: Synthetic peptide
  Seed: LAGQFLEEL (MOG_HUMAN)
LSGQFLEEV

SEQ ID NO: 123874 - protein, 11 aa, Artificial Sequence
  Description of Artificial Sequence: Synthetic peptide
  Seed: RFSDEGGFTCF (MOG_HUMAN)
RVSDEGGFTCI

SEQ ID NO: 123875 - protein, 9 aa, Artificial Sequence
  Description of Artificial Sequence: Synthetic peptide
  Seed: ICYNWLHRR (MOG_HUMAN)
IWYNWLHRR

SEQ ID NO: 123876 - protein, 9 aa, Artificial Sequence
  Description of Artificial Sequence: Synthetic peptide
  Seed: WVSPGVLVL (MOG_HUMAN)
WGSPGVLVM

SEQ ID NO: 123877 - protein, 9 aa, Artificial Sequence
  Description of Artificial Sequence: Synthetic peptide
  Seed: RVPCWKITL (MOG_HUMAN)
RTPCWKITV

SEQ ID NO: 123878 - protein, 10 aa, Artificial Sequence
  Description of Artificial Sequence: Synthetic peptide
  Seed: DEGGFTCFFR (MOG_HUMAN)
DTGGFTCFFR

SEQ ID NO: 123879 - protein, 9 aa, Artificial Sequence
  Description of Artificial Sequence: Synthetic peptide
  Seed: CYNWLHRRL (MOG_HUMAN)
CYNWLHRRM

SEQ ID NO: 123880 - protein, 10 aa, Artificial Sequence
  Description of Artificial Sequence: Synthetic peptide
  Seed: LLLQVSSSYA (MOG_HUMAN)
LGLQVSSSYV

SEQ ID NO: 123881 - protein, 9 aa, Artificial Sequence
  Description of Artificial Sequence: Synthetic peptide
  Seed: RTFDPHFLR (MOG_HUMAN)
RYFDPHFLK

SEQ ID NO: 123882 - protein, 9 aa, Artificial Sequence
  Description of Artificial Sequence: Synthetic peptide
  Seed: TCFFRDHSY (MOG_HUMAN)
TSFFRDHSM

SEQ ID NO: 123883 - protein, 10 aa, Artificial Sequence
  Description of Artificial Sequence: Synthetic peptide
  Seed: LLLQVSSSYA (MOG_HUMAN)
LHLQVSSSYV

SEQ ID NO: 123884 - protein, 11 aa, Artificial Sequence
  Description of Artificial Sequence: Synthetic peptide
  Seed: LQVSSSYAGQF (MOG_HUMAN)
LSVSSSYAGQF

SEQ ID NO: 123885 - protein, 11 aa, Artificial Sequence
  Description of Artificial Sequence: Synthetic peptide
  Seed: ELLKDAIGEGK (MOG_HUMAN)
EALKDAIGEGR

SEQ ID NO: 123886 - protein, 9 aa, Artificial Sequence
  Description of Artificial Sequence: Synthetic peptide
  Seed: LLLQITVGL (MOG_HUMAN)
LMLQITVGM

SEQ ID NO: 123887 - protein, 9 aa, Artificial Sequence
  Description of Artificial Sequence: Synthetic peptide
  Seed: TLFVIVPVL (MOG_HUMAN)
TLFVIVPVM

SEQ ID NO: 123888 - protein, 9 aa, Artificial Sequence
  Description of Artificial Sequence: Synthetic peptide
  Seed: RVPCWKITL (MOG_HUMAN)
RVPCWKITV

SEQ ID NO: 123889 - protein, 9 aa, Artificial Sequence
  Description of Artificial Sequence: Synthetic peptide
  Seed: ITVGLIFLC (MOG_HUMAN)
ISVGLIFLL

SEQ ID NO: 123890 - protein, 9 aa, Artificial Sequence
  Description of Artificial Sequence: Synthetic peptide
  Seed: FSDEGGFTC (MOG_HUMAN)
FGDEGGFTF

SEQ ID NO: 123891 - protein, 10 aa, Artificial Sequence
  Description of Artificial Sequence: Synthetic peptide
  Seed: DEGGFTCFFR (MOG_HUMAN)
DMGGFTCFFK

SEQ ID NO: 123892 - protein, 11 aa, Artificial Sequence
  Description of Artificial Sequence: Synthetic peptide
  Seed: LLLLLQVSSSY (MOG_HUMAN)
LMLLLQVSSSY

SEQ ID NO: 123893 - protein, 11 aa, Artificial Sequence
  Description of Artificial Sequence: Synthetic peptide
  Seed: FSDEGGFTCFF (MOG_HUMAN)
FFDEGGFTCFM

SEQ ID NO: 123894 - protein, 9 aa, Artificial Sequence
  Description of Artificial Sequence: Synthetic peptide
  Seed: LQITVGLIF (MOG_HUMAN)
LRITVGLIM

SEQ ID NO: 123895 - protein, 9 aa, Artificial Sequence
  Description of Artificial Sequence: Synthetic peptide
  Seed: VSSSYAGQF (MOG_HUMAN)
VQSSYAGQM

SEQ ID NO: 123896 - protein, 9 aa, Artificial Sequence
  Description of Artificial Sequence: Synthetic peptide
  Seed: RDHSYQEEA (MOG_HUMAN)
REHSYQEEC

SEQ ID NO: 123897 - protein, 9 aa, Artificial Sequence
  Description of Artificial Sequence: Synthetic peptide
  Seed: HSYQEEAAM (MOG_HUMAN)
HAYQEEAAY

SEQ ID NO: 123898 - protein, 9 aa, Artificial Sequence
  Description of Artificial Sequence: Synthetic peptide
  Seed: MASLSRPSL (MOG_HUMAN)
MQSLSRPSM

SEQ ID NO: 123899 - protein, 9 aa, Artificial Sequence
  Description of Artificial Sequence: Synthetic peptide
  Seed: LSRPSLPSC (MOG_HUMAN)
LPRPSLPSV

SEQ ID NO: 123900 - protein, 9 aa, Artificial Sequence
  Description of Artificial Sequence: Synthetic peptide
  Seed: RTELLKDAI (MOG_HUMAN)
RQELLKDAF

SEQ ID NO: 123901 - protein, 10 aa, Artificial Sequence
  Description of Artificial Sequence: Synthetic peptide
  Seed: FDPHFLRVPC (MOG_HUMAN)
FPPHFLRVPA

SEQ ID NO: 123902 - protein, 10 aa, Artificial Sequence
  Description of Artificial Sequence: Synthetic peptide
  Seed: IGPRHPIRAL (MOG_HUMAN)
IEPRHPIRAF

SEQ ID NO: 123903 - protein, 9 aa, Artificial Sequence
  Description of Artificial Sequence: Synthetic peptide
  Seed: YQEEAAMEL (MOG_HUMAN)
YEEEAAMET

SEQ ID NO: 123904 - protein, 9 aa, Artificial Sequence
  Description of Artificial Sequence: Synthetic peptide
  Seed: GQFRVIGPR (MOG_HUMAN)
GVFRVIGPK

SEQ ID NO: 123905 - protein, 9 aa, Artificial Sequence
  Description of Artificial Sequence: Synthetic peptide
  Seed: FYWVSPGVL (MOG_HUMAN)
FMWVSPGVI

SEQ ID NO: 123906 - protein, 10 aa, Artificial Sequence
  Description of Artificial Sequence: Synthetic peptide
  Seed: RLRGKLRAEI (MOG_HUMAN)
RSRGKLRAEK

SEQ ID NO: 123907 - protein, 9 aa, Artificial Sequence
  Description of Artificial Sequence: Synthetic peptide
  Seed: YRPPFSRVV (MOG_HUMAN)
YAPPFSRVV

SEQ ID NO: 123908 - protein, 9 aa, Artificial Sequence
  Description of Artificial Sequence: Synthetic peptide
  Seed: RVPCWKITL (MOG_HUMAN)
RAPCWKITK

SEQ ID NO: 123909 - protein, 9 aa, Artificial Sequence
  Description of Artificial Sequence: Synthetic peptide
  Seed: SRPSLPSCL (MOG_HUMAN)
SRPSLPSCM

SEQ ID NO: 123910 - protein, 10 aa, Artificial Sequence
  Description of Artificial Sequence: Synthetic peptide
  Seed: LLQITVGLIF (MOG_HUMAN)
LFQITVGLIF

SEQ ID NO: 123911 - protein, 10 aa, Artificial Sequence
  Description of Artificial Sequence: Synthetic peptide
  Seed: LQITVGLIFL (MOG_HUMAN)
LHITVGLIFY

SEQ ID NO: 123912 - protein, 9 aa, Artificial Sequence
  Description of Artificial Sequence: Synthetic peptide
  Seed: CLCSFLLLL (MOG_HUMAN)
CVCSFLLLW

SEQ ID NO: 123913 - protein, 10 aa, Artificial Sequence
  Description of Artificial Sequence: Synthetic peptide
  Seed: FSDEGGFTCF (MOG_HUMAN)
FWDEGGFTCF

SEQ ID NO: 123914 - protein, 9 aa, Artificial Sequence
  Description of Artificial Sequence: Synthetic peptide
  Seed: HSYQEEAAM (MOG_HUMAN)
HAYQEEAAF

SEQ ID NO: 123915 - protein, 11 aa, Artificial Sequence
  Description of Artificial Sequence: Synthetic peptide
  Seed: SSSYAGQFRVI (MOG_HUMAN)
SYSYAGQFRVF

SEQ ID NO: 123916 - protein, 10 aa, Artificial Sequence
  Description of Artificial Sequence: Synthetic peptide
  Seed: WVSPGVLVLL (MOG_HUMAN)
WMSPGVLVLI

SEQ ID NO: 123917 - protein, 9 aa, Artificial Sequence
  Description of Artificial Sequence: Synthetic peptide
  Seed: VIVPVLGPL (MOG_HUMAN)
VQVPVLGPV

SEQ ID NO: 123918 - protein, 9 aa, Artificial Sequence
  Description of Artificial Sequence: Synthetic peptide
  Seed: VSPGVLVLL (MOG_HUMAN)
VMPGVLVLR

SEQ ID NO: 123919 - protein, 9 aa, Artificial Sequence
  Description of Artificial Sequence: Synthetic peptide
  Seed: LQVSSSYAG (MOG_HUMAN)
LKVSSSYAY

SEQ ID NO: 123920 - protein, 9 aa, Artificial Sequence
  Description of Artificial Sequence: Synthetic peptide
  Seed: SLPSCLCSF (MOG_HUMAN)
SFPSCLCSI

SEQ ID NO: 123921 - protein, 9 aa, Artificial Sequence
  Description of Artificial Sequence: Synthetic peptide
  Seed: KDQDGDQAP (MOG_HUMAN)
KEQDGDQAV

SEQ ID NO: 123922 - protein, 9 aa, Artificial Sequence
  Description of Artificial Sequence: Synthetic peptide
  Seed: YQEEAAMEL (MOG_HUMAN)
YEEEAAMEC

SEQ ID NO: 123923 - protein, 10 aa, Artificial Sequence
  Description of Artificial Sequence: Synthetic peptide
  Seed: LIFLCLQYRL (MOG_HUMAN)
LYFLCLQYRR

SEQ ID NO: 123924 - protein, 10 aa, Artificial Sequence
  Description of Artificial Sequence: Synthetic peptide
  Seed: VGWYRPPFSR (MOG_HUMAN)
VIWYRPPFSR

SEQ ID NO: 123925 - protein, 9 aa, Artificial Sequence
  Description of Artificial Sequence: Synthetic peptide
  Seed: SSYAGQFRV (MOG_HUMAN)
SAYAGQFRW

SEQ ID NO: 123926 - protein, 11 aa, Artificial Sequence
  Description of Artificial Sequence: Synthetic peptide
  Seed: HRTFDPHFLRV (MOG_HUMAN)
HRTFDPHFLRR

SEQ ID NO: 123927 - protein, 9 aa, Artificial Sequence
  Description of Artificial Sequence: Synthetic peptide
  Seed: KLRAEIENL (MOG_HUMAN)
KMRAEIENF

SEQ ID NO: 123928 - protein, 10 aa, Artificial Sequence
  Description of Artificial Sequence: Synthetic peptide
  Seed: LQITVGLIFL (MOG_HUMAN)
LVITVGLIFV

SEQ ID NO: 123929 - protein, 11 aa, Artificial Sequence
  Description of Artificial Sequence: Synthetic peptide
  Seed: KDQDGDQAPEY (MOG_HUMAN)
KEQDGDQAPEY

SEQ ID NO: 123930 - protein, 11 aa, Artificial Sequence
  Description of Artificial Sequence: Synthetic peptide
  Seed: HRTFDPHFLRV (MOG_HUMAN)
HMTFDPHFLRE

SEQ ID NO: 123931 - protein, 11 aa, Artificial Sequence
  Description of Artificial Sequence: Synthetic peptide
  Seed: FSDEGGFTCFF (MOG_HUMAN)
FADEGGFTCFM

SEQ ID NO: 123932 - protein, 10 aa, Artificial Sequence
  Description of Artificial Sequence: Synthetic peptide
  Seed: ITVGLIFLCL (MOG_HUMAN)
IMVGLIFLCA

SEQ ID NO: 123933 - protein, 9 aa, Artificial Sequence
  Description of Artificial Sequence: Synthetic peptide
  Seed: RVIGPRHPI (MOG_HUMAN)
RSIGPRHPI

SEQ ID NO: 123934 - protein, 10 aa, Artificial Sequence
  Description of Artificial Sequence: Synthetic peptide
  Seed: SCLCSFLLLL (MOG_HUMAN)
SQLCSFLLLL

SEQ ID NO: 123935 - protein, 9 aa, Artificial Sequence
  Description of Artificial Sequence: Synthetic peptide
  Seed: FRVIGPRHP (MOG_HUMAN)
FHVIGPRHA

SEQ ID NO: 123936 - protein, 11 aa, Artificial Sequence
  Description of Artificial Sequence: Synthetic peptide
  Seed: RDHSYQEEAAM (MOG_HUMAN)
RGHSYQEEAAY

SEQ ID NO: 123937 - protein, 9 aa, Artificial Sequence
  Description of Artificial Sequence: Synthetic peptide
  Seed: RIRNVRFSD (MOG_HUMAN)
RARNVRFSK

SEQ ID NO: 123938 - protein, 10 aa, Artificial Sequence
  Description of Artificial Sequence: Synthetic peptide
  Seed: RTFDPHFLRV (MOG_HUMAN)
RYFDPHFLRG

SEQ ID NO: 123939 - protein, 10 aa, Artificial Sequence
  Description of Artificial Sequence: Synthetic peptide
  Seed: RTFDPHFLRV (MOG_HUMAN)
RYFDPHFLRT

SEQ ID NO: 123940 - protein, 10 aa, Artificial Sequence
  Description of Artificial Sequence: Synthetic peptide
  Seed: FSDEGGFTCF (MOG_HUMAN)
FFDEGGFTCL

SEQ ID NO: 123941 - protein, 10 aa, Artificial Sequence
  Description of Artificial Sequence: Synthetic peptide
  Seed: WYRPPFSRVV (MOG_HUMAN)
WWRPPFSRVF

SEQ ID NO: 123942 - protein, 9 aa, Artificial Sequence
  Description of Artificial Sequence: Synthetic peptide
  Seed: SRPSLPSCL (MOG_HUMAN)
SQPSLPSCY

SEQ ID NO: 123943 - protein, 9 aa, Artificial Sequence
  Description of Artificial Sequence: Synthetic peptide
  Seed: ITVGLIFLC (MOG_HUMAN)
ISVGLIFLF

SEQ ID NO: 123944 - protein, 10 aa, Artificial Sequence
  Description of Artificial Sequence: Synthetic peptide
  Seed: FSDEGGFTCF (MOG_HUMAN)
FIDEGGFTCI

SEQ ID NO: 123945 - protein, 10 aa, Artificial Sequence
  Description of Artificial Sequence: Synthetic peptide
  Seed: GLIFLCLQYR (MOG_HUMAN)
GYIFLCLQYK

SEQ ID NO: 123946 - protein, 9 aa, Artificial Sequence
  Description of Artificial Sequence: Synthetic peptide
  Seed: LQVSSSYAG (MOG_HUMAN)
LKVSSSYAF

SEQ ID NO: 123947 - protein, 10 aa, Artificial Sequence
  Description of Artificial Sequence: Synthetic peptide
  Seed: TGMEVGWYRP (MOG_HUMAN)
TQMEVGWYRK

SEQ ID NO: 123948 - protein, 10 aa, Artificial Sequence
  Description of Artificial Sequence: Synthetic peptide
  Seed: LLLQVSSSYA (MOG_HUMAN)
LTLQVSSSYV

SEQ ID NO: 123949 - protein, 10 aa, Artificial Sequence
  Description of Artificial Sequence: Synthetic peptide
  Seed: ITLFVIVPVL (MOG_HUMAN)
IMLFVIVPVA

SEQ ID NO: 123950 - protein, 10 aa, Artificial Sequence
  Description of Artificial Sequence: Synthetic peptide
  Seed: ITLFVIVPVL (MOG_HUMAN)
IPLFVIVPVV

SEQ ID NO: 123951 - protein, 10 aa, Artificial Sequence
  Description of Artificial Sequence: Synthetic peptide
  Seed: FDPHFLRVPC (MOG_HUMAN)
FFPHFLRVPM

SEQ ID NO: 123952 - protein, 9 aa, Artificial Sequence
  Description of Artificial Sequence: Synthetic peptide
  Seed: AGQFLEELR (MOG_HUMAN)
AVQFLEELR

SEQ ID NO: 123953 - protein, 9 aa, Artificial Sequence
  Description of Artificial Sequence: Synthetic peptide
  Seed: AIGEGKVTL (MOG_HUMAN)
APGEGKVTV

SEQ ID NO: 123954 - protein, 9 aa, Artificial Sequence
  Description of Artificial Sequence: Synthetic peptide
  Seed: WYRPPFSRV (MOG_HUMAN)
WFRPPFSRM

SEQ ID NO: 123955 - protein, 11 aa, Artificial Sequence
  Description of Artificial Sequence: Synthetic peptide
  Seed: LQVSSSYAGQF (MOG_HUMAN)
LQVSSSYAGQM

SEQ ID NO: 123956 - protein, 10 aa, Artificial Sequence
  Description of Artificial Sequence: Synthetic peptide
  Seed: FDPHFLRVPC (MOG_HUMAN)
FEPHFLRVPF

SEQ ID NO: 123957 - protein, 9 aa, Artificial Sequence
  Description of Artificial Sequence: Synthetic peptide
  Seed: RTFDPHFLR (MOG_HUMAN)
RGFDPHFLR

SEQ ID NO: 123958 - protein, 10 aa, Artificial Sequence
  Description of Artificial Sequence: Synthetic peptide
  Seed: LIFLCLQYRL (MOG_HUMAN)
LGFLCLQYRR

SEQ ID NO: 123959 - protein, 9 aa, Artificial Sequence
  Description of Artificial Sequence: Synthetic peptide
  Seed: YRLRGKLRA (MOG_HUMAN)
YRLRGKLRY

SEQ ID NO: 123960 - protein, 9 aa, Artificial Sequence
  Description of Artificial Sequence: Synthetic peptide
  Seed: YRPPFSRVV (MOG_HUMAN)
YTPPFSRVL

SEQ ID NO: 123961 - protein, 9 aa, Artificial Sequence
  Description of Artificial Sequence: Synthetic peptide
  Seed: LQITVGLIF (MOG_HUMAN)
LHITVGLIF

SEQ ID NO: 123962 - protein, 10 aa, Artificial Sequence
  Description of Artificial Sequence: Synthetic peptide
  Seed: RPPFSRVVHL (MOG_HUMAN)
RNPFSRVVHL

SEQ ID NO: 123963 - protein, 11 aa, Artificial Sequence
  Description of Artificial Sequence: Synthetic peptide
  Seed: RISPGKNATGM (MOG_HUMAN)
RLSPGKNATGW

SEQ ID NO: 123964 - protein, 10 aa, Artificial Sequence
  Description of Artificial Sequence: Synthetic peptide
  Seed: ATGMEVGWYR (MOG_HUMAN)
ASGMEVGWYR

SEQ ID NO: 123965 - protein, 10 aa, Artificial Sequence
  Description of Artificial Sequence: Synthetic peptide
  Seed: RTFDPHFLRV (MOG_HUMAN)
RVFDPHFLRD

SEQ ID NO: 123966 - protein, 10 aa, Artificial Sequence
  Description of Artificial Sequence: Synthetic peptide
  Seed: LLQITVGLIF (MOG_HUMAN)
LSQITVGLIM

SEQ ID NO: 123967 - protein, 9 aa, Artificial Sequence
  Description of Artificial Sequence: Synthetic peptide
  Seed: LAGQFLEEL (MOG_HUMAN)
LLGQFLEEA

SEQ ID NO: 123968 - protein, 9 aa, Artificial Sequence
  Description of Artificial Sequence: Synthetic peptide
  Seed: VELPCRISP (MOG_HUMAN)
VELPCRISI

SEQ ID NO: 123969 - protein, 9 aa, Artificial Sequence
  Description of Artificial Sequence: Synthetic peptide
  Seed: SSYAGQFRV (MOG_HUMAN)
STYAGQFRF

SEQ ID NO: 123970 - protein, 9 aa, Artificial Sequence
  Description of Artificial Sequence: Synthetic peptide
  Seed: SDEGGFTCF (MOG_HUMAN)
SAEGGFTCF

SEQ ID NO: 123971 - protein, 9 aa, Artificial Sequence
  Description of Artificial Sequence: Synthetic peptide
  Seed: LLLQVSSSY (MOG_HUMAN)
LALQVSSSM

SEQ ID NO: 123972 - protein, 11 aa, Artificial Sequence
  Description of Artificial Sequence: Synthetic peptide
  Seed: NATGMEVGWYR (MOG_HUMAN)
NSTGMEVGWYR

SEQ ID NO: 123973 - protein, 11 aa, Artificial Sequence
  Description of Artificial Sequence: Synthetic peptide
  Seed: RIRNVRFSDEG (MOG_HUMAN)
RVRNVRFSDEK

SEQ ID NO: 123974 - protein, 10 aa, Artificial Sequence
  Description of Artificial Sequence: Synthetic peptide
  Seed: FDPHFLRVPC (MOG_HUMAN)
FKPHFLRVPV

SEQ ID NO: 123975 - protein, 9 aa, Artificial Sequence
  Description of Artificial Sequence: Synthetic peptide
  Seed: GLIFLCLQY (MOG_HUMAN)
GTIFLCLQK

SEQ ID NO: 123976 - protein, 9 aa, Artificial Sequence
  Description of Artificial Sequence: Synthetic peptide
  Seed: MELKVEDPF (MOG_HUMAN)
MMLKVEDPY

SEQ ID NO: 123977 - protein, 9 aa, Artificial Sequence
  Description of Artificial Sequence: Synthetic peptide
  Seed: VGDEVELPC (MOG_HUMAN)
VTDEVELPI

SEQ ID NO: 123978 - protein, 9 aa, Artificial Sequence
  Description of Artificial Sequence: Synthetic peptide
  Seed: SYAGQFRVI (MOG_HUMAN)
SWAGQFRVW

SEQ ID NO: 123979 - protein, 9 aa, Artificial Sequence
  Description of Artificial Sequence: Synthetic peptide
  Seed: TLRIRNVRF (MOG_HUMAN)
TLRIRNVRL

SEQ ID NO: 123980 - protein, 10 aa, Artificial Sequence
  Description of Artificial Sequence: Synthetic peptide
  Seed: RTFDPHFLRV (MOG_HUMAN)
RWFDPHFLRH

SEQ ID NO: 123981 - protein, 9 aa, Artificial Sequence
  Description of Artificial Sequence: Synthetic peptide
  Seed: YQEEAAMEL (MOG_HUMAN)
YEEEAAMEL

SEQ ID NO: 123982 - protein, 9 aa, Artificial Sequence
  Description of Artificial Sequence: Synthetic peptide
  Seed: RVIGPRHPI (MOG_HUMAN)
RPIGPRHPY

SEQ ID NO: 123983 - protein, 9 aa, Artificial Sequence
  Description of Artificial Sequence: Synthetic peptide
  Seed: SLPSCLCSF (MOG_HUMAN)
SSPSCLCSI

SEQ ID NO: 123984 - protein, 9 aa, Artificial Sequence
  Description of Artificial Sequence: Synthetic peptide
  Seed: LAGQFLEEL (MOG_HUMAN)
LSGQFLEEW

SEQ ID NO: 123985 - protein, 9 aa, Artificial Sequence
  Description of Artificial Sequence: Synthetic peptide
  Seed: KVEDPFYWV (MOG_HUMAN)
KMEDPFYWL

SEQ ID NO: 123986 - protein, 9 aa, Artificial Sequence
  Description of Artificial Sequence: Synthetic peptide
  Seed: RIRNVRFSD (MOG_HUMAN)
RYRNVRFSF

SEQ ID NO: 123987 - protein, 9 aa, Artificial Sequence
  Description of Artificial Sequence: Synthetic peptide
  Seed: LRAEIENLH (MOG_HUMAN)
LRAEIENLY

SEQ ID NO: 123988 - protein, 10 aa, Artificial Sequence
  Description of Artificial Sequence: Synthetic peptide
  Seed: IGPRHPIRAL (MOG_HUMAN)
IYPRHPIRAV

SEQ ID NO: 123989 - protein, 9 aa, Artificial Sequence
  Description of Artificial Sequence: Synthetic peptide
  Seed: LQITVGLIF (MOG_HUMAN)
LSITVGLIM

SEQ ID NO: 123990 - protein, 10 aa, Artificial Sequence
  Description of Artificial Sequence: Synthetic peptide
  Seed: SFLLLLLLQV (MOG_HUMAN)
SILLLLLLQV

SEQ ID NO: 123991 - protein, 10 aa, Artificial Sequence
  Description of Artificial Sequence: Synthetic peptide
  Seed: KVTLRIRNVR (MOG_HUMAN)
KWTLRIRNVR

SEQ ID NO: 123992 - protein, 10 aa, Artificial Sequence
  Description of Artificial Sequence: Synthetic peptide
  Seed: WVSPGVLVLL (MOG_HUMAN)
WTSPGVLVLL

SEQ ID NO: 123993 - protein, 9 aa, Artificial Sequence
  Description of Artificial Sequence: Synthetic peptide
  Seed: YQEEAAMEL (MOG_HUMAN)
YTEEAAMEI

SEQ ID NO: 123994 - protein, 9 aa, Artificial Sequence
  Description of Artificial Sequence: Synthetic peptide
  Seed: YRPPFSRVV (MOG_HUMAN)
YVPPFSRVF

SEQ ID NO: 123995 - protein, 9 aa, Artificial Sequence
  Description of Artificial Sequence: Synthetic peptide
  Seed: VLGPLVALI (MOG_HUMAN)
VMGPLVALF

SEQ ID NO: 123996 - protein, 10 aa, Artificial Sequence
  Description of Artificial Sequence: Synthetic peptide
  Seed: FTCFFRDHSY (MOG_HUMAN)
FPCFFRDHSM

SEQ ID NO: 123997 - protein, 10 aa, Artificial Sequence
  Description of Artificial Sequence: Synthetic peptide
  Seed: RTFDPHFLRV (MOG_HUMAN)
RLFDPHFLRL

SEQ ID NO: 123998 - protein, 9 aa, Artificial Sequence
  Description of Artificial Sequence: Synthetic peptide
  Seed: TFDPHFLRV (MOG_HUMAN)
TWDPHFLRV

SEQ ID NO: 123999 - protein, 11 aa, Artificial Sequence
  Description of Artificial Sequence: Synthetic peptide
  Seed: HRTFDPHFLRV (MOG_HUMAN)
HMTFDPHFLRS

SEQ ID NO: 124000 - protein, 9 aa, Artificial Sequence
  Description of Artificial Sequence: Synthetic peptide
  Seed: LSRPSLPSC (MOG_HUMAN)
LPRPSLPSI

SEQ ID NO: 124001 - protein, 10 aa, Artificial Sequence
  Description of Artificial Sequence: Synthetic peptide
  Seed: LLLQVSSSYA (MOG_HUMAN)
LQLQVSSSYR

SEQ ID NO: 124002 - protein, 10 aa, Artificial Sequence
  Description of Artificial Sequence: Synthetic peptide
  Seed: FVIVPVLGPL (MOG_HUMAN)
FTIVPVLGPY

SEQ ID NO: 124003 - protein, 9 aa, Artificial Sequence
  Description of Artificial Sequence: Synthetic peptide
  Seed: WVSPGVLVL (MOG_HUMAN)
WMSPGVLVT

SEQ ID NO: 124004 - protein, 9 aa, Artificial Sequence
  Description of Artificial Sequence: Synthetic peptide
  Seed: FLLLLLLQV (MOG_HUMAN)
FTLLLLLQI

SEQ ID NO: 124005 - protein, 10 aa, Artificial Sequence
  Description of Artificial Sequence: Synthetic peptide
  Seed: PFSRVVHLYR (MOG_HUMAN)
PSSRVVHLYR

SEQ ID NO: 124006 - protein, 10 aa, Artificial Sequence
  Description of Artificial Sequence: Synthetic peptide
  Seed: RTFDPHFLRV (MOG_HUMAN)
RVFDPHFLRF

SEQ ID NO: 124007 - protein, 11 aa, Artificial Sequence
  Description of Artificial Sequence: Synthetic peptide
  Seed: RISPGKNATGM (MOG_HUMAN)
RVSPGKNATGF

SEQ ID NO: 124008 - protein, 10 aa, Artificial Sequence
  Description of Artificial Sequence: Synthetic peptide
  Seed: VPVLGPLVAL (MOG_HUMAN)
VAVLGPLVAM

SEQ ID NO: 124009 - protein, 11 aa, Artificial Sequence
  Description of Artificial Sequence: Synthetic peptide
  Seed: RVIGPRHPIRA (MOG_HUMAN)
RMIGPRHPIRK

SEQ ID NO: 124010 - protein, 9 aa, Artificial Sequence
  Description of Artificial Sequence: Synthetic peptide
  Seed: VIVPVLGPL (MOG_HUMAN)
VTVPVLGPA

SEQ ID NO: 124011 - protein, 9 aa, Artificial Sequence
  Description of Artificial Sequence: Synthetic peptide
  Seed: SSYAGQFRV (MOG_HUMAN)
SCYAGQFRW

SEQ ID NO: 124012 - protein, 9 aa, Artificial Sequence
  Description of Artificial Sequence: Synthetic peptide
  Seed: VGDEVELPC (MOG_HUMAN)
VIDEVELPV

SEQ ID NO: 124013 - protein, 9 aa, Artificial Sequence
  Description of Artificial Sequence: Synthetic peptide
  Seed: VGDEVELPC (MOG_HUMAN)
VLDEVELPF

SEQ ID NO: 124014 - protein, 11 aa, Artificial Sequence
  Description of Artificial Sequence: Synthetic peptide
  Seed: ELLKDAIGEGK (MOG_HUMAN)
EVLKDAIGEGK

SEQ ID NO: 124015 - protein, 10 aa, Artificial Sequence
  Description of Artificial Sequence: Synthetic peptide
  Seed: FSDEGGFTCF (MOG_HUMAN)
FMDEGGFTCW

SEQ ID NO: 124016 - protein, 10 aa, Artificial Sequence
  Description of Artificial Sequence: Synthetic peptide
  Seed: LLQITVGLIF (MOG_HUMAN)
LHQITVGLIM

SEQ ID NO: 124017 - protein, 9 aa, Artificial Sequence
  Description of Artificial Sequence: Synthetic peptide
  Seed: LLQVSSSYA (MOG_HUMAN)
LMQVSSSYV

SEQ ID NO: 124018 - protein, 10 aa, Artificial Sequence
  Description of Artificial Sequence: Synthetic peptide
  Seed: SLSRPSLPSC (MOG_HUMAN)
SHSRPSLPSK

SEQ ID NO: 124019 - protein, 9 aa, Artificial Sequence
  Description of Artificial Sequence: Synthetic peptide
  Seed: FYWVSPGVL (MOG_HUMAN)
FEWVSPGVF

SEQ ID NO: 124020 - protein, 9 aa, Artificial Sequence
  Description of Artificial Sequence: Synthetic peptide
  Seed: FSDEGGFTC (MOG_HUMAN)
FIDEGGFTF

SEQ ID NO: 124021 - protein, 11 aa, Artificial Sequence
  Description of Artificial Sequence: Synthetic peptide
  Seed: VPVLGPLVALI (MOG_HUMAN)
VFVLGPLVALV

SEQ ID NO: 124022 - protein, 10 aa, Artificial Sequence
  Description of Artificial Sequence: Synthetic peptide
  Seed: FSDEGGFTCF (MOG_HUMAN)
FFDEGGFTCF

SEQ ID NO: 124023 - protein, 10 aa, Artificial Sequence
  Description of Artificial Sequence: Synthetic peptide
  Seed: WVSPGVLVLL (MOG_HUMAN)
WSSPGVLVLW

SEQ ID NO: 124024 - protein, 10 aa, Artificial Sequence
  Description of Artificial Sequence: Synthetic peptide
  Seed: IICYNWLHRR (MOG_HUMAN)
IQCYNWLHRR

SEQ ID NO: 124025 - protein, 9 aa, Artificial Sequence
  Description of Artificial Sequence: Synthetic peptide
  Seed: YQEEAAMEL (MOG_HUMAN)
YGEEAAMEM

SEQ ID NO: 124026 - protein, 9 aa, Artificial Sequence
  Description of Artificial Sequence: Synthetic peptide
  Seed: LQVSSSYAG (MOG_HUMAN)
LTVSSSYAF

SEQ ID NO: 124027 - protein, 10 aa, Artificial Sequence
  Description of Artificial Sequence: Synthetic peptide
  Seed: PVLGPLVALI (MOG_HUMAN)
PRLGPLVALV

SEQ ID NO: 124028 - protein, 10 aa, Artificial Sequence
  Description of Artificial Sequence: Synthetic peptide
  Seed: RTFDPHFLRV (MOG_HUMAN)
RGFDPHFLRW

SEQ ID NO: 124029 - protein, 10 aa, Artificial Sequence
  Description of Artificial Sequence: Synthetic peptide
  Seed: LLLQITVGLI (MOG_HUMAN)
LILQITVGLV

SEQ ID NO: 124030 - protein, 10 aa, Artificial Sequence
  Description of Artificial Sequence: Synthetic peptide
  Seed: FVIVPVLGPL (MOG_HUMAN)
FMIVPVLGPL

SEQ ID NO: 124031 - protein, 10 aa, Artificial Sequence
  Description of Artificial Sequence: Synthetic peptide
  Seed: SLPSCLCSFL (MOG_HUMAN)
SMPSCLCSFV

SEQ ID NO: 124032 - protein, 9 aa, Artificial Sequence
  Description of Artificial Sequence: Synthetic peptide
  Seed: FSDEGGFTC (MOG_HUMAN)
FRDEGGFTI

SEQ ID NO: 124033 - protein, 9 aa, Artificial Sequence
  Description of Artificial Sequence: Synthetic peptide
  Seed: AIGEGKVTL (MOG_HUMAN)
APGEGKVTY

SEQ ID NO: 124034 - protein, 9 aa, Artificial Sequence
  Description of Artificial Sequence: Synthetic peptide
  Seed: YQEEAAMEL (MOG_HUMAN)
YDEEAAMEL

SEQ ID NO: 124035 - protein, 10 aa, Artificial Sequence
  Description of Artificial Sequence: Synthetic peptide
  Seed: FVIVPVLGPL (MOG_HUMAN)
FCIVPVLGPI

SEQ ID NO: 124036 - protein, 9 aa, Artificial Sequence
  Description of Artificial Sequence: Synthetic peptide
  Seed: RTFDPHFLR (MOG_HUMAN)
RLFDPHFLI

SEQ ID NO: 124037 - protein, 10 aa, Artificial Sequence
  Description of Artificial Sequence: Synthetic peptide
  Seed: SCLCSFLLLL (MOG_HUMAN)
SILCSFLLLA

SEQ ID NO: 124038 - protein, 10 aa, Artificial Sequence
  Description of Artificial Sequence: Synthetic peptide
  Seed: HRTFDPHFLR (MOG_HUMAN)
HYTFDPHFLK

SEQ ID NO: 124039 - protein, 10 aa, Artificial Sequence
  Description of Artificial Sequence: Synthetic peptide
  Seed: LVLLAVLPVL (MOG_HUMAN)
LMLLAVLPVL

SEQ ID NO: 124040 - protein, 9 aa, Artificial Sequence
  Description of Artificial Sequence: Synthetic peptide
  Seed: IVPVLGPLV (MOG_HUMAN)
IIPVLGPLL

SEQ ID NO: 124041 - protein, 9 aa, Artificial Sequence
  Description of Artificial Sequence: Synthetic peptide
  Seed: LSRPSLPSC (MOG_HUMAN)
LPRPSLPSA

SEQ ID NO: 124042 - protein, 10 aa, Artificial Sequence
  Description of Artificial Sequence: Synthetic peptide
  Seed: AEIENLHRTF (MOG_HUMAN)
AAIENLHRTY

SEQ ID NO: 124043 - protein, 10 aa, Artificial Sequence
  Description of Artificial Sequence: Synthetic peptide
  Seed: FVIVPVLGPL (MOG_HUMAN)
FLIVPVLGPL

SEQ ID NO: 124044 - protein, 10 aa, Artificial Sequence
  Description of Artificial Sequence: Synthetic peptide
  Seed: MEVGWYRPPF (MOG_HUMAN)
MKVGWYRPPY

SEQ ID NO: 124045 - protein, 11 aa, Artificial Sequence
  Description of Artificial Sequence: Synthetic peptide
  Seed: RFSDEGGFTCF (MOG_HUMAN)
RCSDEGGFTCW

SEQ ID NO: 124046 - protein, 10 aa, Artificial Sequence
  Description of Artificial Sequence: Synthetic peptide
  Seed: YWVSPGVLVL (MOG_HUMAN)
YPVSPGVLVM

SEQ ID NO: 124047 - protein, 10 aa, Artificial Sequence
  Description of Artificial Sequence: Synthetic peptide
  Seed: SLSRPSLPSC (MOG_HUMAN)
SFSRPSLPSV

SEQ ID NO: 124048 - protein, 10 aa, Artificial Sequence
  Description of Artificial Sequence: Synthetic peptide
  Seed: LLQITVGLIF (MOG_HUMAN)
LWQITVGLIF

SEQ ID NO: 124049 - protein, 9 aa, Artificial Sequence
  Description of Artificial Sequence: Synthetic peptide
  Seed: IGEGKVTLR (MOG_HUMAN)
ISEGKVTLL

SEQ ID NO: 124050 - protein, 10 aa, Artificial Sequence
  Description of Artificial Sequence: Synthetic peptide
  Seed: KITLFVIVPV (MOG_HUMAN)
KWTLFVIVPV

SEQ ID NO: 124051 - protein, 10 aa, Artificial Sequence
  Description of Artificial Sequence: Synthetic peptide
  Seed: TGMEVGWYRP (MOG_HUMAN)
TFMEVGWYRL

SEQ ID NO: 124052 - protein, 9 aa, Artificial Sequence
  Description of Artificial Sequence: Synthetic peptide
  Seed: VIVPVLGPL (MOG_HUMAN)
VIVPVLGPR

SEQ ID NO: 124053 - protein, 11 aa, Artificial Sequence
  Description of Artificial Sequence: Synthetic peptide
  Seed: RAEIENLHRTF (MOG_HUMAN)
RTEIENLHRTW

SEQ ID NO: 124054 - protein, 9 aa, Artificial Sequence
  Description of Artificial Sequence: Synthetic peptide
  Seed: ALVGDEVEL (MOG_HUMAN)
AMVGDEVEI

SEQ ID NO: 124055 - protein, 9 aa, Artificial Sequence
  Description of Artificial Sequence: Synthetic peptide
  Seed: VLPVLLLQI (MOG_HUMAN)
VSPVLLLQL

SEQ ID NO: 124056 - protein, 10 aa, Artificial Sequence
  Description of Artificial Sequence: Synthetic peptide
  Seed: DAIGEGKVTL (MOG_HUMAN)
DVIGEGKVTR

SEQ ID NO: 124057 - protein, 10 aa, Artificial Sequence
  Description of Artificial Sequence: Synthetic peptide
  Seed: RVVHLYRNGK (MOG_HUMAN)
RRVHLYRNGK

SEQ ID NO: 124058 - protein, 10 aa, Artificial Sequence
  Description of Artificial Sequence: Synthetic peptide
  Seed: SLSRPSLPSC (MOG_HUMAN)
SVSRPSLPSS

SEQ ID NO: 124059 - protein, 10 aa, Artificial Sequence
  Description of Artificial Sequence: Synthetic peptide
  Seed: RVIGPRHPIR (MOG_HUMAN)
RIIGPRHPIK

SEQ ID NO: 124060 - protein, 9 aa, Artificial Sequence
  Description of Artificial Sequence: Synthetic peptide
  Seed: HFLRVPCWK (MOG_HUMAN)
HSLRVPCWK

SEQ ID NO: 124061 - protein, 11 aa, Artificial Sequence
  Description of Artificial Sequence: Synthetic peptide
  Seed: IGPRHPIRALV (MOG_HUMAN)
IYPRHPIRALL

SEQ ID NO: 124062 - protein, 10 aa, Artificial Sequence
  Description of Artificial Sequence: Synthetic peptide
  Seed: RTFDPHFLRV (MOG_HUMAN)
RIFDPHFLRF

SEQ ID NO: 124063 - protein, 10 aa, Artificial Sequence
  Description of Artificial Sequence: Synthetic peptide
  Seed: AEIENLHRTF (MOG_HUMAN)
AQIENLHRTI

SEQ ID NO: 124064 - protein, 10 aa, Artificial Sequence
  Description of Artificial Sequence: Synthetic peptide
  Seed: SSYAGQFRVI (MOG_HUMAN)
SIYAGQFRVF

SEQ ID NO: 124065 - protein, 10 aa, Artificial Sequence
  Description of Artificial Sequence: Synthetic peptide
  Seed: FDPHFLRVPC (MOG_HUMAN)
FGPHFLRVPM

SEQ ID NO: 124066 - protein, 10 aa, Artificial Sequence
  Description of Artificial Sequence: Synthetic peptide
  Seed: SLSRPSLPSC (MOG_HUMAN)
SLSRPSLPSI

SEQ ID NO: 124067 - protein, 11 aa, Artificial Sequence
  Description of Artificial Sequence: Synthetic peptide
  Seed: LHRTFDPHFLR (MOG_HUMAN)
LYRTFDPHFLK

SEQ ID NO: 124068 - protein, 8 aa, Artificial Sequence
  Description of Artificial Sequence: Synthetic peptide
  Seed: SRVVHLYR (MOG_HUMAN)
SMVVHLYR

SEQ ID NO: 124069 - protein, 11 aa, Artificial Sequence
  Description of Artificial Sequence: Synthetic peptide
  Seed: HRTFDPHFLRV (MOG_HUMAN)
HMTFDPHFLRR

SEQ ID NO: 124070 - protein, 9 aa, Artificial Sequence
  Description of Artificial Sequence: Synthetic peptide
  Seed: EGGFTCFFR (MOG_HUMAN)
EVGFTCFFR

SEQ ID NO: 124071 - protein, 9 aa, Artificial Sequence
  Description of Artificial Sequence: Synthetic peptide
  Seed: QITVGLIFL (MOG_HUMAN)
QMTVGLIFV

SEQ ID NO: 124072 - protein, 10 aa, Artificial Sequence
  Description of Artificial Sequence: Synthetic peptide
  Seed: FVIVPVLGPL (MOG_HUMAN)
FRIVPVLGPY

SEQ ID NO: 124073 - protein, 9 aa, Artificial Sequence
  Description of Artificial Sequence: Synthetic peptide
  Seed: HSYQEEAAM (MOG_HUMAN)
HPYQEEAAL

SEQ ID NO: 124074 - protein, 10 aa, Artificial Sequence
  Description of Artificial Sequence: Synthetic peptide
  Seed: LIICYNWLHR (MOG_HUMAN)
LFICYNWLHK

SEQ ID NO: 124075 - protein, 11 aa, Artificial Sequence
  Description of Artificial Sequence: Synthetic peptide
  Seed: SSSYAGQFRVI (MOG_HUMAN)
SSSYAGQFRVF

SEQ ID NO: 124076 - protein, 9 aa, Artificial Sequence
  Description of Artificial Sequence: Synthetic peptide
  Seed: QEEAAMELK (MOG_HUMAN)
QTEAAMELY

SEQ ID NO: 124077 - protein, 10 aa, Artificial Sequence
  Description of Artificial Sequence: Synthetic peptide
  Seed: WVSPGVLVLL (MOG_HUMAN)
WVSPGVLVLA

SEQ ID NO: 124078 - protein, 9 aa, Artificial Sequence
  Description of Artificial Sequence: Synthetic peptide
  Seed: LQITVGLIF (MOG_HUMAN)
LMITVGLIY

SEQ ID NO: 124079 - protein, 10 aa, Artificial Sequence
  Description of Artificial Sequence: Synthetic peptide
  Seed: RVVHLYRNGK (MOG_HUMAN)
RNVHLYRNGK

SEQ ID NO: 124080 - protein, 9 aa, Artificial Sequence
  Description of Artificial Sequence: Synthetic peptide
  Seed: GLIFLCLQY (MOG_HUMAN)
GSIFLCLQY

SEQ ID NO: 124081 - protein, 9 aa, Artificial Sequence
  Description of Artificial Sequence: Synthetic peptide
  Seed: LSRPSLPSC (MOG_HUMAN)
LARPSLPSK

SEQ ID NO: 124082 - protein, 9 aa, Artificial Sequence
  Description of Artificial Sequence: Synthetic peptide
  Seed: RRLAGQFLE (MOG_HUMAN)
RRLAGQFLT

SEQ ID NO: 124083 - protein, 9 aa, Artificial Sequence
  Description of Artificial Sequence: Synthetic peptide
  Seed: GEGKVTLRI (MOG_HUMAN)
GEGKVTLRM

SEQ ID NO: 124084 - protein, 10 aa, Artificial Sequence
  Description of Artificial Sequence: Synthetic peptide
  Seed: FVIVPVLGPL (MOG_HUMAN)
FKIVPVLGPA

SEQ ID NO: 124085 - protein, 9 aa, Artificial Sequence
  Description of Artificial Sequence: Synthetic peptide
  Seed: RIRNVRFSD (MOG_HUMAN)
RFRNVRFSK

SEQ ID NO: 124086 - protein, 9 aa, Artificial Sequence
  Description of Artificial Sequence: Synthetic peptide
  Seed: FSDEGGFTC (MOG_HUMAN)
FFDEGGFTL

SEQ ID NO: 124087 - protein, 10 aa, Artificial Sequence
  Description of Artificial Sequence: Synthetic peptide
  Seed: FDPHFLRVPC (MOG_HUMAN)
FVPHFLRVPI

SEQ ID NO: 124088 - protein, 9 aa, Artificial Sequence
  Description of Artificial Sequence: Synthetic peptide
  Seed: LQITVGLIF (MOG_HUMAN)
LKITVGLIM

SEQ ID NO: 124089 - protein, 11 aa, Artificial Sequence
  Description of Artificial Sequence: Synthetic peptide
  Seed: VLVLLAVLPVL (MOG_HUMAN)
VVVLLAVLPVV

SEQ ID NO: 124090 - protein, 8 aa, Artificial Sequence
  Description of Artificial Sequence: Synthetic peptide
  Seed: FLCLQYRL (MOG_HUMAN)
FMCLQYRV

SEQ ID NO: 124091 - protein, 9 aa, Artificial Sequence
  Description of Artificial Sequence: Synthetic peptide
  Seed: YQEEAAMEL (MOG_HUMAN)
YSEEAAMEY

SEQ ID NO: 124092 - protein, 10 aa, Artificial Sequence
  Description of Artificial Sequence: Synthetic peptide
  Seed: VLLLQITVGL (MOG_HUMAN)
VTLLQITVGL

SEQ ID NO: 124093 - protein, 9 aa, Artificial Sequence
  Description of Artificial Sequence: Synthetic peptide
  Seed: HRTFDPHFL (MOG_HUMAN)
HHTFDPHFL

SEQ ID NO: 124094 - protein, 10 aa, Artificial Sequence
  Description of Artificial Sequence: Synthetic peptide
  Seed: FYWVSPGVLV (MOG_HUMAN)
FMWVSPGVLF

SEQ ID NO: 124095 - protein, 9 aa, Artificial Sequence
  Description of Artificial Sequence: Synthetic peptide
  Seed: MASLSRPSL (MOG_HUMAN)
MFSLSRPSM

SEQ ID NO: 124096 - protein, 9 aa, Artificial Sequence
  Description of Artificial Sequence: Synthetic peptide
  Seed: RVIGPRHPI (MOG_HUMAN)
RTIGPRHPV

SEQ ID NO: 124097 - protein, 8 aa, Artificial Sequence
  Description of Artificial Sequence: Synthetic peptide
  Seed: YWVSPGVL (MOG_HUMAN)
YFVSPGVL

SEQ ID NO: 124098 - protein, 11 aa, Artificial Sequence
  Description of Artificial Sequence: Synthetic peptide
  Seed: RRLAGQFLEEL (MOG_HUMAN)
RFLAGQFLEEI

SEQ ID NO: 124099 - protein, 9 aa, Artificial Sequence
  Description of Artificial Sequence: Synthetic peptide
  Seed: TLRIRNVRF (MOG_HUMAN)
TMRIRNVRM

SEQ ID NO: 124100 - protein, 11 aa, Artificial Sequence
  Description of Artificial Sequence: Synthetic peptide
  Seed: RFSDEGGFTCF (MOG_HUMAN)
RISDEGGFTCI

SEQ ID NO: 124101 - protein, 10 aa, Artificial Sequence
  Description of Artificial Sequence: Synthetic peptide
  Seed: FDPHFLRVPC (MOG_HUMAN)
FVPHFLRVPS

SEQ ID NO: 124102 - protein, 10 aa, Artificial Sequence
  Description of Artificial Sequence: Synthetic peptide
  Seed: LLAVLPVLLL (MOG_HUMAN)
LLAVLPVLLA

SEQ ID NO: 124103 - protein, 10 aa, Artificial Sequence
  Description of Artificial Sequence: Synthetic peptide
  Seed: RTFDPHFLRV (MOG_HUMAN)
RFFDPHFLRF

SEQ ID NO: 124104 - protein, 9 aa, Artificial Sequence
  Description of Artificial Sequence: Synthetic peptide
  Seed: WVSPGVLVL (MOG_HUMAN)
WQSPGVLVH

SEQ ID NO: 124105 - protein, 9 aa, Artificial Sequence
  Description of Artificial Sequence: Synthetic peptide
  Seed: LQITVGLIF (MOG_HUMAN)
LYITVGLIY

SEQ ID NO: 124106 - protein, 9 aa, Artificial Sequence
  Description of Artificial Sequence: Synthetic peptide
  Seed: RRLAGQFLE (MOG_HUMAN)
RRLAGQFLV

SEQ ID NO: 124107 - protein, 9 aa, Artificial Sequence
  Description of Artificial Sequence: Synthetic peptide
  Seed: DQAPEYRGR (MOG_HUMAN)
DTAPEYRGK

SEQ ID NO: 124108 - protein, 9 aa, Artificial Sequence
  Description of Artificial Sequence: Synthetic peptide
  Seed: MASLSRPSL (MOG_HUMAN)
MASLSRPSM

SEQ ID NO: 124109 - protein, 9 aa, Artificial Sequence
  Description of Artificial Sequence: Synthetic peptide
  Seed: RTFDPHFLR (MOG_HUMAN)
RIFDPHFLI

SEQ ID NO: 124110 - protein, 9 aa, Artificial Sequence
  Description of Artificial Sequence: Synthetic peptide
  Seed: VIGPRHPIR (MOG_HUMAN)
VVGPRHPIR

SEQ ID NO: 124111 - protein, 9 aa, Artificial Sequence
  Description of Artificial Sequence: Synthetic peptide
  Seed: VALIICYNW (MOG_HUMAN)
VSLIICYNF

SEQ ID NO: 124112 - protein, 9 aa, Artificial Sequence
  Description of Artificial Sequence: Synthetic peptide
  Seed: RTFDPHFLR (MOG_HUMAN)
RAFDPHFLV

SEQ ID NO: 124113 - protein, 9 aa, Artificial Sequence
  Description of Artificial Sequence: Synthetic peptide
  Seed: SYAGQFRVI (MOG_HUMAN)
SRAGQFRVF

SEQ ID NO: 124114 - protein, 9 aa, Artificial Sequence
  Description of Artificial Sequence: Synthetic peptide
  Seed: LLLQVSSSY (MOG_HUMAN)
LKLQVSSSM

SEQ ID NO: 124115 - protein, 9 aa, Artificial Sequence
  Description of Artificial Sequence: Synthetic peptide
  Seed: VGDEVELPC (MOG_HUMAN)
VADEVELPF

SEQ ID NO: 124116 - protein, 9 aa, Artificial Sequence
  Description of Artificial Sequence: Synthetic peptide
  Seed: TGMEVGWYR (MOG_HUMAN)
TVMEVGWYK

SEQ ID NO: 124117 - protein, 9 aa, Artificial Sequence
  Description of Artificial Sequence: Synthetic peptide
  Seed: LVLLAVLPV (MOG_HUMAN)
LSLLAVLPV

SEQ ID NO: 124118 - protein, 9 aa, Artificial Sequence
  Description of Artificial Sequence: Synthetic peptide
  Seed: RVIGPRHPI (MOG_HUMAN)
RMIGPRHPF

SEQ ID NO: 124119 - protein, 8 aa, Artificial Sequence
  Description of Artificial Sequence: Synthetic peptide
  Seed: RIRNVRFS (MOG_HUMAN)
RTRNVRFI

SEQ ID NO: 124120 - protein, 9 aa, Artificial Sequence
  Description of Artificial Sequence: Synthetic peptide
  Seed: YQEEAAMEL (MOG_HUMAN)
YSEEAAMEI

SEQ ID NO: 124121 - protein, 9 aa, Artificial Sequence
  Description of Artificial Sequence: Synthetic peptide
  Seed: FSDEGGFTC (MOG_HUMAN)
FWDEGGFTV

SEQ ID NO: 124122 - protein, 9 aa, Artificial Sequence
  Description of Artificial Sequence: Synthetic peptide
  Seed: VTLRIRNVR (MOG_HUMAN)
VILRIRNVR

SEQ ID NO: 124123 - protein, 11 aa, Artificial Sequence
  Description of Artificial Sequence: Synthetic peptide
  Seed: RFSDEGGFTCF (MOG_HUMAN)
RMSDEGGFTCV

SEQ ID NO: 124124 - protein, 9 aa, Artificial Sequence
  Description of Artificial Sequence: Synthetic peptide
  Seed: LSRPSLPSC (MOG_HUMAN)
LVRPSLPSI

SEQ ID NO: 124125 - protein, 9 aa, Artificial Sequence
  Description of Artificial Sequence: Synthetic peptide
  Seed: RIRNVRFSD (MOG_HUMAN)
RARNVRFSN

SEQ ID NO: 124126 - protein, 10 aa, Artificial Sequence
  Description of Artificial Sequence: Synthetic peptide
  Seed: LLAVLPVLLL (MOG_HUMAN)
LMAVLPVLLM

SEQ ID NO: 124127 - protein, 10 aa, Artificial Sequence
  Description of Artificial Sequence: Synthetic peptide
  Seed: IGPRHPIRAL (MOG_HUMAN)
IKPRHPIRAI

SEQ ID NO: 124128 - protein, 11 aa, Artificial Sequence
  Description of Artificial Sequence: Synthetic peptide
  Seed: RISPGKNATGM (MOG_HUMAN)
RASPGKNATGF

SEQ ID NO: 124129 - protein, 9 aa, Artificial Sequence
  Description of Artificial Sequence: Synthetic peptide
  Seed: RVPCWKITL (MOG_HUMAN)
RPPCWKITF

SEQ ID NO: 124130 - protein, 10 aa, Artificial Sequence
  Description of Artificial Sequence: Synthetic peptide
  Seed: RIRNVRFSDE (MOG_HUMAN)
RYRNVRFSDK

SEQ ID NO: 124131 - protein, 9 aa, Artificial Sequence
  Description of Artificial Sequence: Synthetic peptide
  Seed: RVPCWKITL (MOG_HUMAN)
RAPCWKITV

SEQ ID NO: 124132 - protein, 9 aa, Artificial Sequence
  Description of Artificial Sequence: Synthetic peptide
  Seed: LLAVLPVLL (MOG_HUMAN)
LMAVLPVLY

SEQ ID NO: 124133 - protein, 9 aa, Artificial Sequence
  Description of Artificial Sequence: Synthetic peptide
  Seed: TFDPHFLRV (MOG_HUMAN)
TADPHFLRC

SEQ ID NO: 124134 - protein, 9 aa, Artificial Sequence
  Description of Artificial Sequence: Synthetic peptide
  Seed: RTFDPHFLR (MOG_HUMAN)
RSFDPHFLF

SEQ ID NO: 124135 - protein, 11 aa, Artificial Sequence
  Description of Artificial Sequence: Synthetic peptide
  Seed: VIGPRHPIRAL (MOG_HUMAN)
VNGPRHPIRAM

SEQ ID NO: 124136 - protein, 10 aa, Artificial Sequence
  Description of Artificial Sequence: Synthetic peptide
  Seed: FDPHFLRVPC (MOG_HUMAN)
FCPHFLRVPP

SEQ ID NO: 124137 - protein, 10 aa, Artificial Sequence
  Description of Artificial Sequence: Synthetic peptide
  Seed: SDEGGFTCFF (MOG_HUMAN)
STEGGFTCFW

SEQ ID NO: 124138 - protein, 9 aa, Artificial Sequence
  Description of Artificial Sequence: Synthetic peptide
  Seed: LAVLPVLLL (MOG_HUMAN)
LTVLPVLLF

SEQ ID NO: 124139 - protein, 10 aa, Artificial Sequence
  Description of Artificial Sequence: Synthetic peptide
  Seed: YWVSPGVLVL (MOG_HUMAN)
YIVSPGVLVY

SEQ ID NO: 124140 - protein, 9 aa, Artificial Sequence
  Description of Artificial Sequence: Synthetic peptide
  Seed: SRPSLPSCL (MOG_HUMAN)
SAPSLPSCL

SEQ ID NO: 124141 - protein, 9 aa, Artificial Sequence
  Description of Artificial Sequence: Synthetic peptide
  Seed: FSDEGGFTC (MOG_HUMAN)
FIDEGGFTM

SEQ ID NO: 124142 - protein, 9 aa, Artificial Sequence
  Description of Artificial Sequence: Synthetic peptide
  Seed: GWYRPPFSR (MOG_HUMAN)
GFYRPPFSK

SEQ ID NO: 124143 - protein, 9 aa, Artificial Sequence
  Description of Artificial Sequence: Synthetic peptide
  Seed: SYAGQFRVI (MOG_HUMAN)
SFAGQFRVW

SEQ ID NO: 124144 - protein, 10 aa, Artificial Sequence
  Description of Artificial Sequence: Synthetic peptide
  Seed: FSDEGGFTCF (MOG_HUMAN)
FVDEGGFTCV

SEQ ID NO: 124145 - protein, 8 aa, Artificial Sequence
  Description of Artificial Sequence: Synthetic peptide
  Seed: FSDEGGFT (MOG_HUMAN)
FIDEGGFV

SEQ ID NO: 124146 - protein, 10 aa, Artificial Sequence
  Description of Artificial Sequence: Synthetic peptide
  Seed: RIRNVRFSDE (MOG_HUMAN)
RARNVRFSDI

SEQ ID NO: 124147 - protein, 9 aa, Artificial Sequence
  Description of Artificial Sequence: Synthetic peptide
  Seed: RTFDPHFLR (MOG_HUMAN)
RTFDPHFLW

SEQ ID NO: 124148 - protein, 9 aa, Artificial Sequence
  Description of Artificial Sequence: Synthetic peptide
  Seed: LSRPSLPSC (MOG_HUMAN)
LIRPSLPSF

SEQ ID NO: 124149 - protein, 9 aa, Artificial Sequence
  Description of Artificial Sequence: Synthetic peptide
  Seed: FSDEGGFTC (MOG_HUMAN)
FFDEGGFTF

SEQ ID NO: 124150 - protein, 10 aa, Artificial Sequence
  Description of Artificial Sequence: Synthetic peptide
  Seed: HRTFDPHFLR (MOG_HUMAN)
HGTFDPHFLR

SEQ ID NO: 124151 - protein, 10 aa, Artificial Sequence
  Description of Artificial Sequence: Synthetic peptide
  Seed: TGMEVGWYRP (MOG_HUMAN)
TFMEVGWYRM

SEQ ID NO: 124152 - protein, 11 aa, Artificial Sequence
  Description of Artificial Sequence: Synthetic peptide
  Seed: RISPGKNATGM (MOG_HUMAN)
RPSPGKNATGM

SEQ ID NO: 124153 - protein, 10 aa, Artificial Sequence
  Description of Artificial Sequence: Synthetic peptide
  Seed: RLRGKLRAEI (MOG_HUMAN)
RTRGKLRAEL

SEQ ID NO: 124154 - protein, 11 aa, Artificial Sequence
  Description of Artificial Sequence: Synthetic peptide
  Seed: KLRAEIENLHR (MOG_HUMAN)
KTRAEIENLHR

SEQ ID NO: 124155 - protein, 10 aa, Artificial Sequence
  Description of Artificial Sequence: Synthetic peptide
  Seed: FTCFFRDHSY (MOG_HUMAN)
FVCFFRDHSR

SEQ ID NO: 124156 - protein, 10 aa, Artificial Sequence
  Description of Artificial Sequence: Synthetic peptide
  Seed: ICYNWLHRRL (MOG_HUMAN)
IYYNWLHRRM

SEQ ID NO: 124157 - protein, 9 aa, Artificial Sequence
  Description of Artificial Sequence: Synthetic peptide
  Seed: ALVGDEVEL (MOG_HUMAN)
AMVGDEVEY

SEQ ID NO: 124158 - protein, 11 aa, Artificial Sequence
  Description of Artificial Sequence: Synthetic peptide
  Seed: YWVSPGVLVLL (MOG_HUMAN)
YYVSPGVLVLI

SEQ ID NO: 124159 - protein, 10 aa, Artificial Sequence
  Description of Artificial Sequence: Synthetic peptide
  Seed: IGPRHPIRAL (MOG_HUMAN)
ITPRHPIRAM

SEQ ID NO: 124160 - protein, 9 aa, Artificial Sequence
  Description of Artificial Sequence: Synthetic peptide
  Seed: FSRVVHLYR (MOG_HUMAN)
FFRVVHLYK

SEQ ID NO: 124161 - protein, 10 aa, Artificial Sequence
  Description of Artificial Sequence: Synthetic peptide
  Seed: VLLAVLPVLL (MOG_HUMAN)
VLLAVLPVLV

SEQ ID NO: 124162 - protein, 10 aa, Artificial Sequence
  Description of Artificial Sequence: Synthetic peptide
  Seed: IGPRHPIRAL (MOG_HUMAN)
IQPRHPIRAM

SEQ ID NO: 124163 - protein, 9 aa, Artificial Sequence
  Description of Artificial Sequence: Synthetic peptide
  Seed: RIRNVRFSD (MOG_HUMAN)
RGRNVRFSY

SEQ ID NO: 124164 - protein, 9 aa, Artificial Sequence
  Description of Artificial Sequence: Synthetic peptide
  Seed: RVPCWKITL (MOG_HUMAN)
RLPCWKITW

SEQ ID NO: 124165 - protein, 9 aa, Artificial Sequence
  Description of Artificial Sequence: Synthetic peptide
  Seed: RVPCWKITL (MOG_HUMAN)
RLPCWKITF

SEQ ID NO: 124166 - protein, 11 aa, Artificial Sequence
  Description of Artificial Sequence: Synthetic peptide
  Seed: RFSDEGGFTCF (MOG_HUMAN)
RASDEGGFTCL

SEQ ID NO: 124167 - protein, 9 aa, Artificial Sequence
  Description of Artificial Sequence: Synthetic peptide
  Seed: TCFFRDHSY (MOG_HUMAN)
TYFFRDHSY

SEQ ID NO: 124168 - protein, 10 aa, Artificial Sequence
  Description of Artificial Sequence: Synthetic peptide
  Seed: IGPRHPIRAL (MOG_HUMAN)
IPPRHPIRAL

SEQ ID NO: 124169 - protein, 9 aa, Artificial Sequence
  Description of Artificial Sequence: Synthetic peptide
  Seed: RIRNVRFSD (MOG_HUMAN)
RWRNVRFSY

SEQ ID NO: 124170 - protein, 10 aa, Artificial Sequence
  Description of Artificial Sequence: Synthetic peptide
  Seed: GLIFLCLQYR (MOG_HUMAN)
GIIFLCLQYK

SEQ ID NO: 124171 - protein, 9 aa, Artificial Sequence
  Description of Artificial Sequence: Synthetic peptide
  Seed: HFLRVPCWK (MOG_HUMAN)
HTLRVPCWR

SEQ ID NO: 124172 - protein, 10 aa, Artificial Sequence
  Description of Artificial Sequence: Synthetic peptide
  Seed: FVIVPVLGPL (MOG_HUMAN)
FLIVPVLGPV

SEQ ID NO: 124173 - protein, 8 aa, Artificial Sequence
  Description of Artificial Sequence: Synthetic peptide
  Seed: FSDEGGFT (MOG_HUMAN)
FIDEGGFI

SEQ ID NO: 124174 - protein, 10 aa, Artificial Sequence
  Description of Artificial Sequence: Synthetic peptide
  Seed: LSRPSLPSCL (MOG_HUMAN)
LSRPSLPSCW

SEQ ID NO: 124175 - protein, 9 aa, Artificial Sequence
  Description of Artificial Sequence: Synthetic peptide
  Seed: VIVPVLGPL (MOG_HUMAN)
VVVPVLGPY

SEQ ID NO: 124176 - protein, 10 aa, Artificial Sequence
  Description of Artificial Sequence: Synthetic peptide
  Seed: IGPRHPIRAL (MOG_HUMAN)
ITPRHPIRAL

SEQ ID NO: 124177 - protein, 10 aa, Artificial Sequence
  Description of Artificial Sequence: Synthetic peptide
  Seed: AEIENLHRTF (MOG_HUMAN)
ARIENLHRTL

SEQ ID NO: 124178 - protein, 9 aa, Artificial Sequence
  Description of Artificial Sequence: Synthetic peptide
  Seed: RIRNVRFSD (MOG_HUMAN)
RVRNVRFSH

SEQ ID NO: 124179 - protein, 9 aa, Artificial Sequence
  Description of Artificial Sequence: Synthetic peptide
  Seed: MELKVEDPF (MOG_HUMAN)
MQLKVEDPY

SEQ ID NO: 124180 - protein, 10 aa, Artificial Sequence
  Description of Artificial Sequence: Synthetic peptide
  Seed: PVLGPLVALI (MOG_HUMAN)
PMLGPLVALI

SEQ ID NO: 124181 - protein, 10 aa, Artificial Sequence
  Description of Artificial Sequence: Synthetic peptide
  Seed: AEIENLHRTF (MOG_HUMAN)
AKIENLHRTY

SEQ ID NO: 124182 - protein, 9 aa, Artificial Sequence
  Description of Artificial Sequence: Synthetic peptide
  Seed: FLEELRNPF (MOG_HUMAN)
FSEELRNPM

SEQ ID NO: 124183 - protein, 9 aa, Artificial Sequence
  Description of Artificial Sequence: Synthetic peptide
  Seed: LLAVLPVLL (MOG_HUMAN)
LQAVLPVLL

SEQ ID NO: 124184 - protein, 10 aa, Artificial Sequence
  Description of Artificial Sequence: Synthetic peptide
  Seed: TGMEVGWYRP (MOG_HUMAN)
TMMEVGWYRH

SEQ ID NO: 124185 - protein, 9 aa, Artificial Sequence
  Description of Artificial Sequence: Synthetic peptide
  Seed: SLPSCLCSF (MOG_HUMAN)
SFPSCLCSY

SEQ ID NO: 124186 - protein, 8 aa, Artificial Sequence
  Description of Artificial Sequence: Synthetic peptide
  Seed: GGFTCFFR (MOG_HUMAN)
GYFTCFFR

SEQ ID NO: 124187 - protein, 10 aa, Artificial Sequence
  Description of Artificial Sequence: Synthetic peptide
  Seed: PVLGPLVALI (MOG_HUMAN)
PYLGPLVALI

SEQ ID NO: 124188 - protein, 10 aa, Artificial Sequence
  Description of Artificial Sequence: Synthetic peptide
  Seed: RTFDPHFLRV (MOG_HUMAN)
RLFDPHFLRA

SEQ ID NO: 124189 - protein, 9 aa, Artificial Sequence
  Description of Artificial Sequence: Synthetic peptide
  Seed: TFDPHFLRV (MOG_HUMAN)
TEDPHFLRY

SEQ ID NO: 124190 - protein, 9 aa, Artificial Sequence
  Description of Artificial Sequence: Synthetic peptide
  Seed: ALIICYNWL (MOG_HUMAN)
AMIICYNWL

SEQ ID NO: 124191 - protein, 9 aa, Artificial Sequence
  Description of Artificial Sequence: Synthetic peptide
  Seed: KLRAEIENL (MOG_HUMAN)
KMRAEIENI

SEQ ID NO: 124192 - protein, 9 aa, Artificial Sequence
  Description of Artificial Sequence: Synthetic peptide
  Seed: SSSYAGQFR (MOG_HUMAN)
STSYAGQFR

SEQ ID NO: 124193 - protein, 9 aa, Artificial Sequence
  Description of Artificial Sequence: Synthetic peptide
  Seed: AIGEGKVTL (MOG_HUMAN)
ALGEGKVTV

SEQ ID NO: 124194 - protein, 9 aa, Artificial Sequence
  Description of Artificial Sequence: Synthetic peptide
  Seed: RVIGPRHPI (MOG_HUMAN)
RVIGPRHPG

SEQ ID NO: 124195 - protein, 10 aa, Artificial Sequence
  Description of Artificial Sequence: Synthetic peptide
  Seed: HRTFDPHFLR (MOG_HUMAN)
HCTFDPHFLR

SEQ ID NO: 124196 - protein, 10 aa, Artificial Sequence
  Description of Artificial Sequence: Synthetic peptide
  Seed: RTFDPHFLRV (MOG_HUMAN)
RTFDPHFLRM

SEQ ID NO: 124197 - protein, 10 aa, Artificial Sequence
  Description of Artificial Sequence: Synthetic peptide
  Seed: RTFDPHFLRV (MOG_HUMAN)
RWFDPHFLRM

SEQ ID NO: 124198 - protein, 9 aa, Artificial Sequence
  Description of Artificial Sequence: Synthetic peptide
  Seed: SLPSCLCSF (MOG_HUMAN)
SKPSCLCSF

SEQ ID NO: 124199 - protein, 9 aa, Artificial Sequence
  Description of Artificial Sequence: Synthetic peptide
  Seed: TLFVIVPVL (MOG_HUMAN)
TQFVIVPVL

SEQ ID NO: 124200 - protein, 10 aa, Artificial Sequence
  Description of Artificial Sequence: Synthetic peptide
  Seed: LLKDAIGEGK (MOG_HUMAN)
LSKDAIGEGY

SEQ ID NO: 124201 - protein, 10 aa, Artificial Sequence
  Description of Artificial Sequence: Synthetic peptide
  Seed: FVIVPVLGPL (MOG_HUMAN)
FKIVPVLGPV

SEQ ID NO: 124202 - protein, 9 aa, Artificial Sequence
  Description of Artificial Sequence: Synthetic peptide
  Seed: IVPVLGPLV (MOG_HUMAN)
IAPVLGPLF

SEQ ID NO: 124203 - protein, 9 aa, Artificial Sequence
  Description of Artificial Sequence: Synthetic peptide
  Seed: VLPVLLLQI (MOG_HUMAN)
VLPVLLLQA

SEQ ID NO: 124204 - protein, 9 aa, Artificial Sequence
  Description of Artificial Sequence: Synthetic peptide
  Seed: SSYAGQFRV (MOG_HUMAN)
SSYAGQFRL

SEQ ID NO: 124205 - protein, 9 aa, Artificial Sequence
  Description of Artificial Sequence: Synthetic peptide
  Seed: SSYAGQFRV (MOG_HUMAN)
SLYAGQFRR

SEQ ID NO: 124206 - protein, 9 aa, Artificial Sequence
  Description of Artificial Sequence: Synthetic peptide
  Seed: RIRNVRFSD (MOG_HUMAN)
RARNVRFSP

SEQ ID NO: 124207 - protein, 9 aa, Artificial Sequence
  Description of Artificial Sequence: Synthetic peptide
  Seed: KVTLRIRNV (MOG_HUMAN)
KMTLRIRNK

SEQ ID NO: 124208 - protein, 10 aa, Artificial Sequence
  Description of Artificial Sequence: Synthetic peptide
  Seed: VLLAVLPVLL (MOG_HUMAN)
VGLAVLPVLV

SEQ ID NO: 124209 - protein, 9 aa, Artificial Sequence
  Description of Artificial Sequence: Synthetic peptide
  Seed: RDHSYQEEA (MOG_HUMAN)
REHSYQEEP

SEQ ID NO: 124210 - protein, 9 aa, Artificial Sequence
  Description of Artificial Sequence: Synthetic peptide
  Seed: RIRNVRFSD (MOG_HUMAN)
RFRNVRFSG

SEQ ID NO: 124211 - protein, 10 aa, Artificial Sequence
  Description of Artificial Sequence: Synthetic peptide
  Seed: LSRPSLPSCL (MOG_HUMAN)
LMRPSLPSCK

SEQ ID NO: 124212 - protein, 9 aa, Artificial Sequence
  Description of Artificial Sequence: Synthetic peptide
  Seed: FYWVSPGVL (MOG_HUMAN)
FAWVSPGVM

SEQ ID NO: 124213 - protein, 9 aa, Artificial Sequence
  Description of Artificial Sequence: Synthetic peptide
  Seed: LAGQFLEEL (MOG_HUMAN)
LLGQFLEEL

SEQ ID NO: 124214 - protein, 9 aa, Artificial Sequence
  Description of Artificial Sequence: Synthetic peptide
  Seed: AEIENLHRT (MOG_HUMAN)
ADIENLHRL

SEQ ID NO: 124215 - protein, 10 aa, Artificial Sequence
  Description of Artificial Sequence: Synthetic peptide
  Seed: FSDEGGFTCF (MOG_HUMAN)
FADEGGFTCL

SEQ ID NO: 124216 - protein, 10 aa, Artificial Sequence
  Description of Artificial Sequence: Synthetic peptide
  Seed: HRTFDPHFLR (MOG_HUMAN)
HKTFDPHFLR

SEQ ID NO: 124217 - protein, 11 aa, Artificial Sequence
  Description of Artificial Sequence: Synthetic peptide
  Seed: DAIGEGKVTLR (MOG_HUMAN)
DVIGEGKVTLK

SEQ ID NO: 124218 - protein, 9 aa, Artificial Sequence
  Description of Artificial Sequence: Synthetic peptide
  Seed: LLAVLPVLL (MOG_HUMAN)
LAAVLPVLL

SEQ ID NO: 124219 - protein, 9 aa, Artificial Sequence
  Description of Artificial Sequence: Synthetic peptide
  Seed: KLRAEIENL (MOG_HUMAN)
KLRAEIENA

SEQ ID NO: 124220 - protein, 10 aa, Artificial Sequence
  Description of Artificial Sequence: Synthetic peptide
  Seed: HRTFDPHFLR (MOG_HUMAN)
HNTFDPHFLY

SEQ ID NO: 124221 - protein, 10 aa, Artificial Sequence
  Description of Artificial Sequence: Synthetic peptide
  Seed: LLLLQVSSSY (MOG_HUMAN)
LCLLQVSSSY

SEQ ID NO: 124222 - protein, 9 aa, Artificial Sequence
  Description of Artificial Sequence: Synthetic peptide
  Seed: VLLAVLPVL (MOG_HUMAN)
VLLAVLPVF

SEQ ID NO: 124223 - protein, 9 aa, Artificial Sequence
  Description of Artificial Sequence: Synthetic peptide
  Seed: SRPSLPSCL (MOG_HUMAN)
SAPSLPSCI

SEQ ID NO: 124224 - protein, 9 aa, Artificial Sequence
  Description of Artificial Sequence: Synthetic peptide
  Seed: TGMEVGWYR (MOG_HUMAN)
TTMEVGWYQ

SEQ ID NO: 124225 - protein, 10 aa, Artificial Sequence
  Description of Artificial Sequence: Synthetic peptide
  Seed: IGPRHPIRAL (MOG_HUMAN)
IYPRHPIRAF

SEQ ID NO: 124226 - protein, 9 aa, Artificial Sequence
  Description of Artificial Sequence: Synthetic peptide
  Seed: RVPCWKITL (MOG_HUMAN)
RPPCWKITM

SEQ ID NO: 124227 - protein, 10 aa, Artificial Sequence
  Description of Artificial Sequence: Synthetic peptide
  Seed: RVVHLYRNGK (MOG_HUMAN)
RKVHLYRNGK

SEQ ID NO: 124228 - protein, 9 aa, Artificial Sequence
  Description of Artificial Sequence: Synthetic peptide
  Seed: AIGEGKVTL (MOG_HUMAN)
AMGEGKVTW

SEQ ID NO: 124229 - protein, 10 aa, Artificial Sequence
  Description of Artificial Sequence: Synthetic peptide
  Seed: VGWYRPPFSR (MOG_HUMAN)
VWWYRPPFSK

SEQ ID NO: 124230 - protein, 9 aa, Artificial Sequence
  Description of Artificial Sequence: Synthetic peptide
  Seed: KLRAEIENL (MOG_HUMAN)
KQRAEIENV

SEQ ID NO: 124231 - protein, 11 aa, Artificial Sequence
  Description of Artificial Sequence: Synthetic peptide
  Seed: RVPCWKITLFV (MOG_HUMAN)
RMPCWKITLFV

SEQ ID NO: 124232 - protein, 9 aa, Artificial Sequence
  Description of Artificial Sequence: Synthetic peptide
  Seed: LCSFLLLLL (MOG_HUMAN)
LLSFLLLLV

SEQ ID NO: 124233 - protein, 9 aa, Artificial Sequence
  Description of Artificial Sequence: Synthetic peptide
  Seed: IFLCLQYRL (MOG_HUMAN)
IFLCLQYRF

SEQ ID NO: 124234 - protein, 9 aa, Artificial Sequence
  Description of Artificial Sequence: Synthetic peptide
  Seed: VPCWKITLF (MOG_HUMAN)
VQCWKITLY

SEQ ID NO: 124235 - protein, 9 aa, Artificial Sequence
  Description of Artificial Sequence: Synthetic peptide
  Seed: WVSPGVLVL (MOG_HUMAN)
WHSPGVLVI

SEQ ID NO: 124236 - protein, 9 aa, Artificial Sequence
  Description of Artificial Sequence: Synthetic peptide
  Seed: LSRPSLPSC (MOG_HUMAN)
LARPSLPSF

SEQ ID NO: 124237 - protein, 10 aa, Artificial Sequence
  Description of Artificial Sequence: Synthetic peptide
  Seed: FYWVSPGVLV (MOG_HUMAN)
FFWVSPGVLM

SEQ ID NO: 124238 - protein, 10 aa, Artificial Sequence
  Description of Artificial Sequence: Synthetic peptide
  Seed: LSRPSLPSCL (MOG_HUMAN)
LTRPSLPSCW

SEQ ID NO: 124239 - protein, 10 aa, Artificial Sequence
  Description of Artificial Sequence: Synthetic peptide
  Seed: IGPRHPIRAL (MOG_HUMAN)
IIPRHPIRAV

SEQ ID NO: 124240 - protein, 10 aa, Artificial Sequence
  Description of Artificial Sequence: Synthetic peptide
  Seed: ITLFVIVPVL (MOG_HUMAN)
IWLFVIVPVV

SEQ ID NO: 124241 - protein, 9 aa, Artificial Sequence
  Description of Artificial Sequence: Synthetic peptide
  Seed: VLPVLLLQI (MOG_HUMAN)
VAPVLLLQL

SEQ ID NO: 124242 - protein, 11 aa, Artificial Sequence
  Description of Artificial Sequence: Synthetic peptide
  Seed: QVSSSYAGQFR (MOG_HUMAN)
QTSSSYAGQFK

SEQ ID NO: 124243 - protein, 9 aa, Artificial Sequence
  Description of Artificial Sequence: Synthetic peptide
  Seed: RIRNVRFSD (MOG_HUMAN)
RVRNVRFSM

SEQ ID NO: 124244 - protein, 9 aa, Artificial Sequence
  Description of Artificial Sequence: Synthetic peptide
  Seed: KVTLRIRNV (MOG_HUMAN)
KATLRIRNM

SEQ ID NO: 124245 - protein, 9 aa, Artificial Sequence
  Description of Artificial Sequence: Synthetic peptide
  Seed: MASLSRPSL (MOG_HUMAN)
MMSLSRPSY

SEQ ID NO: 124246 - protein, 10 aa, Artificial Sequence
  Description of Artificial Sequence: Synthetic peptide
  Seed: YWVSPGVLVL (MOG_HUMAN)
YAVSPGVLVY

SEQ ID NO: 124247 - protein, 9 aa, Artificial Sequence
  Description of Artificial Sequence: Synthetic peptide
  Seed: AGQFLEELR (MOG_HUMAN)
ASQFLEELY

SEQ ID NO: 124248 - protein, 9 aa, Artificial Sequence
  Description of Artificial Sequence: Synthetic peptide
  Seed: SRPSLPSCL (MOG_HUMAN)
SYPSLPSCL

SEQ ID NO: 124249 - protein, 9 aa, Artificial Sequence
  Description of Artificial Sequence: Synthetic peptide
  Seed: HSYQEEAAM (MOG_HUMAN)
HQYQEEAAF

SEQ ID NO: 124250 - protein, 9 aa, Artificial Sequence
  Description of Artificial Sequence: Synthetic peptide
  Seed: FSDEGGFTC (MOG_HUMAN)
FLDEGGFTC

SEQ ID NO: 124251 - protein, 10 aa, Artificial Sequence
  Description of Artificial Sequence: Synthetic peptide
  Seed: HRTFDPHFLR (MOG_HUMAN)
HQTFDPHFLR

SEQ ID NO: 124252 - protein, 8 aa, Artificial Sequence
  Description of Artificial Sequence: Synthetic peptide
  Seed: YWVSPGVL (MOG_HUMAN)
YFVSPGVF

SEQ ID NO: 124253 - protein, 10 aa, Artificial Sequence
  Description of Artificial Sequence: Synthetic peptide
  Seed: FTCFFRDHSY (MOG_HUMAN)
FSCFFRDHSF

SEQ ID NO: 124254 - protein, 9 aa, Artificial Sequence
  Description of Artificial Sequence: Synthetic peptide
  Seed: TCFFRDHSY (MOG_HUMAN)
TQFFRDHSF

SEQ ID NO: 124255 - protein, 10 aa, Artificial Sequence
  Description of Artificial Sequence: Synthetic peptide
  Seed: LVLLAVLPVL (MOG_HUMAN)
LYLLAVLPVL

SEQ ID NO: 124256 - protein, 10 aa, Artificial Sequence
  Description of Artificial Sequence: Synthetic peptide
  Seed: RTFDPHFLRV (MOG_HUMAN)
RIFDPHFLRP

SEQ ID NO: 124257 - protein, 10 aa, Artificial Sequence
  Description of Artificial Sequence: Synthetic peptide
  Seed: WVSPGVLVLL (MOG_HUMAN)
WASPGVLVLV

SEQ ID NO: 124258 - protein, 9 aa, Artificial Sequence
  Description of Artificial Sequence: Synthetic peptide
  Seed: TGMEVGWYR (MOG_HUMAN)
TLMEVGWYR

SEQ ID NO: 124259 - protein, 10 aa, Artificial Sequence
  Description of Artificial Sequence: Synthetic peptide
  Seed: RLAGQFLEEL (MOG_HUMAN)
RMAGQFLEEW

SEQ ID NO: 124260 - protein, 9 aa, Artificial Sequence
  Description of Artificial Sequence: Synthetic peptide
  Seed: VPVLGPLVA (MOG_HUMAN)
VPVLGPLVT

SEQ ID NO: 124261 - protein, 9 aa, Artificial Sequence
  Description of Artificial Sequence: Synthetic peptide
  Seed: RIRNVRFSD (MOG_HUMAN)
RSRNVRFSP

SEQ ID NO: 124262 - protein, 10 aa, Artificial Sequence
  Description of Artificial Sequence: Synthetic peptide
  Seed: LLLQVSSSYA (MOG_HUMAN)
LALQVSSSYV

SEQ ID NO: 124263 - protein, 9 aa, Artificial Sequence
  Description of Artificial Sequence: Synthetic peptide
  Seed: TFDPHFLRV (MOG_HUMAN)
THDPHFLRF

SEQ ID NO: 124264 - protein, 10 aa, Artificial Sequence
  Description of Artificial Sequence: Synthetic peptide
  Seed: ITVGLIFLCL (MOG_HUMAN)
ILVGLIFLCV

SEQ ID NO: 124265 - protein, 10 aa, Artificial Sequence
  Description of Artificial Sequence: Synthetic peptide
  Seed: VLLLQITVGL (MOG_HUMAN)
VHLLQITVGI

SEQ ID NO: 124266 - protein, 10 aa, Artificial Sequence
  Description of Artificial Sequence: Synthetic peptide
  Seed: VLLLQITVGL (MOG_HUMAN)
VTLLQITVGV

SEQ ID NO: 124267 - protein, 9 aa, Artificial Sequence
  Description of Artificial Sequence: Synthetic peptide
  Seed: SYAGQFRVI (MOG_HUMAN)
SWAGQFRVM

SEQ ID NO: 124268 - protein, 10 aa, Artificial Sequence
  Description of Artificial Sequence: Synthetic peptide
  Seed: VLLLQITVGL (MOG_HUMAN)
VPLLQITVGL

SEQ ID NO: 124269 - protein, 9 aa, Artificial Sequence
  Description of Artificial Sequence: Synthetic peptide
  Seed: TLFVIVPVL (MOG_HUMAN)
TQFVIVPVM

SEQ ID NO: 124270 - protein, 11 aa, Artificial Sequence
  Description of Artificial Sequence: Synthetic peptide
  Seed: KDQDGDQAPEY (MOG_HUMAN)
KLQDGDQAPEY

SEQ ID NO: 124271 - protein, 9 aa, Artificial Sequence
  Description of Artificial Sequence: Synthetic peptide
  Seed: LIICYNWLH (MOG_HUMAN)
LWICYNWLK

SEQ ID NO: 124272 - protein, 11 aa, Artificial Sequence
  Description of Artificial Sequence: Synthetic peptide
  Seed: RVPCWKITLFV (MOG_HUMAN)
RLPCWKITLFL

SEQ ID NO: 124273 - protein, 9 aa, Artificial Sequence
  Description of Artificial Sequence: Synthetic peptide
  Seed: VLLAVLPVL (MOG_HUMAN)
VLLAVLPVA

SEQ ID NO: 124274 - protein, 10 aa, Artificial Sequence
  Description of Artificial Sequence: Synthetic peptide
  Seed: DEGGFTCFFR (MOG_HUMAN)
DGGGFTCFFR

SEQ ID NO: 124275 - protein, 9 aa, Artificial Sequence
  Description of Artificial Sequence: Synthetic peptide
  Seed: YQEEAAMEL (MOG_HUMAN)
YHEEAAMEV

SEQ ID NO: 124276 - protein, 9 aa, Artificial Sequence
  Description of Artificial Sequence: Synthetic peptide
  Seed: QITVGLIFL (MOG_HUMAN)
QQTVGLIFV

SEQ ID NO: 124277 - protein, 9 aa, Artificial Sequence
  Description of Artificial Sequence: Synthetic peptide
  Seed: SSYAGQFRV (MOG_HUMAN)
SLYAGQFRY

SEQ ID NO: 124278 - protein, 9 aa, Artificial Sequence
  Description of Artificial Sequence: Synthetic peptide
  Seed: TCFFRDHSY (MOG_HUMAN)
TLFFRDHSF

SEQ ID NO: 124279 - protein, 10 aa, Artificial Sequence
  Description of Artificial Sequence: Synthetic peptide
  Seed: ATGMEVGWYR (MOG_HUMAN)
AAGMEVGWYK

SEQ ID NO: 124280 - protein, 10 aa, Artificial Sequence
  Description of Artificial Sequence: Synthetic peptide
  Seed: AIGEGKVTLR (MOG_HUMAN)
ATGEGKVTLK

SEQ ID NO: 124281 - protein, 10 aa, Artificial Sequence
  Description of Artificial Sequence: Synthetic peptide
  Seed: LPSCLCSFLL (MOG_HUMAN)
LPSCLCSFLM

SEQ ID NO: 124282 - protein, 9 aa, Artificial Sequence
  Description of Artificial Sequence: Synthetic peptide
  Seed: FSDEGGFTC (MOG_HUMAN)
FDDEGGFTM

SEQ ID NO: 124283 - protein, 9 aa, Artificial Sequence
  Description of Artificial Sequence: Synthetic peptide
  Seed: VEDPFYWVS (MOG_HUMAN)
VEDPFYWVI

SEQ ID NO: 124284 - protein, 11 aa, Artificial Sequence
  Description of Artificial Sequence: Synthetic peptide
  Seed: LPSCLCSFLLL (MOG_HUMAN)
LPSCLCSFLLW

SEQ ID NO: 124285 - protein, 10 aa, Artificial Sequence
  Description of Artificial Sequence: Synthetic peptide
  Seed: SDEGGFTCFF (MOG_HUMAN)
SFEGGFTCFW

SEQ ID NO: 124286 - protein, 10 aa, Artificial Sequence
  Description of Artificial Sequence: Synthetic peptide
  Seed: KVTLRIRNVR (MOG_HUMAN)
KETLRIRNVR

SEQ ID NO: 124287 - protein, 10 aa, Artificial Sequence
  Description of Artificial Sequence: Synthetic peptide
  Seed: FSDEGGFTCF (MOG_HUMAN)
FMDEGGFTCL

SEQ ID NO: 124288 - protein, 10 aa, Artificial Sequence
  Description of Artificial Sequence: Synthetic peptide
  Seed: WVSPGVLVLL (MOG_HUMAN)
WMSPGVLVLA

SEQ ID NO: 124289 - protein, 9 aa, Artificial Sequence
  Description of Artificial Sequence: Synthetic peptide
  Seed: VSPGVLVLL (MOG_HUMAN)
VTPGVLVLM

SEQ ID NO: 124290 - protein, 10 aa, Artificial Sequence
  Description of Artificial Sequence: Synthetic peptide
  Seed: FVIVPVLGPL (MOG_HUMAN)
FAIVPVLGPI

SEQ ID NO: 124291 - protein, 10 aa, Artificial Sequence
  Description of Artificial Sequence: Synthetic peptide
  Seed: ITLFVIVPVL (MOG_HUMAN)
ISLFVIVPVW

SEQ ID NO: 124292 - protein, 9 aa, Artificial Sequence
  Description of Artificial Sequence: Synthetic peptide
  Seed: VLPVLLLQI (MOG_HUMAN)
VMPVLLLQV

SEQ ID NO: 124293 - protein, 10 aa, Artificial Sequence
  Description of Artificial Sequence: Synthetic peptide
  Seed: LLLQVSSSYA (MOG_HUMAN)
LMLQVSSSYN

SEQ ID NO: 124294 - protein, 10 aa, Artificial Sequence
  Description of Artificial Sequence: Synthetic peptide
  Seed: FVIVPVLGPL (MOG_HUMAN)
FEIVPVLGPL

SEQ ID NO: 124295 - protein, 10 aa, Artificial Sequence
  Description of Artificial Sequence: Synthetic peptide
  Seed: LQITVGLIFL (MOG_HUMAN)
LQITVGLIFI

SEQ ID NO: 124296 - protein, 9 aa, Artificial Sequence
  Description of Artificial Sequence: Synthetic peptide
  Seed: RVPCWKITL (MOG_HUMAN)
RLPCWKITI

SEQ ID NO: 124297 - protein, 10 aa, Artificial Sequence
  Description of Artificial Sequence: Synthetic peptide
  Seed: SDEGGFTCFF (MOG_HUMAN)
SSEGGFTCFW

SEQ ID NO: 124298 - protein, 9 aa, Artificial Sequence
  Description of Artificial Sequence: Synthetic peptide
  Seed: LKVEDPFYW (MOG_HUMAN)
LCVEDPFYW

SEQ ID NO: 124299 - protein, 9 aa, Artificial Sequence
  Description of Artificial Sequence: Synthetic peptide
  Seed: ICYNWLHRR (MOG_HUMAN)
IIYNWLHRV

SEQ ID NO: 124300 - protein, 10 aa, Artificial Sequence
  Description of Artificial Sequence: Synthetic peptide
  Seed: SFLLLLLLQV (MOG_HUMAN)
SSLLLLLLQV

SEQ ID NO: 124301 - protein, 9 aa, Artificial Sequence
  Description of Artificial Sequence: Synthetic peptide
  Seed: LPVLLLQIT (MOG_HUMAN)
LPVLLLQIM

SEQ ID NO: 124302 - protein, 9 aa, Artificial Sequence
  Description of Artificial Sequence: Synthetic peptide
  Seed: LKVEDPFYW (MOG_HUMAN)
LLVEDPFYW

SEQ ID NO: 124303 - protein, 10 aa, Artificial Sequence
  Description of Artificial Sequence: Synthetic peptide
  Seed: RPPFSRVVHL (MOG_HUMAN)
RMPFSRVVHL

SEQ ID NO: 124304 - protein, 11 aa, Artificial Sequence
  Description of Artificial Sequence: Synthetic peptide
  Seed: RFSDEGGFTCF (MOG_HUMAN)
RMSDEGGFTCM

SEQ ID NO: 124305 - protein, 9 aa, Artificial Sequence
  Description of Artificial Sequence: Synthetic peptide
  Seed: VPVLGPLVA (MOG_HUMAN)
VAVLGPLVL

SEQ ID NO: 124306 - protein, 10 aa, Artificial Sequence
  Description of Artificial Sequence: Synthetic peptide
  Seed: RPPFSRVVHL (MOG_HUMAN)
RRPFSRVVHM

SEQ ID NO: 124307 - protein, 9 aa, Artificial Sequence
  Description of Artificial Sequence: Synthetic peptide
  Seed: TFDPHFLRV (MOG_HUMAN)
TQDPHFLRY

SEQ ID NO: 124308 - protein, 9 aa, Artificial Sequence
  Description of Artificial Sequence: Synthetic peptide
  Seed: SLPSCLCSF (MOG_HUMAN)
SWPSCLCSM

SEQ ID NO: 124309 - protein, 11 aa, Artificial Sequence
  Description of Artificial Sequence: Synthetic peptide
  Seed: HRTFDPHFLRV (MOG_HUMAN)
HETFDPHFLRR

SEQ ID NO: 124310 - protein, 10 aa, Homo sapiens
  Native (MOG_HUMAN)
VELPCRISPG

SEQ ID NO: 124311 - protein, 10 aa, Homo sapiens
  Native (MOG_HUMAN)
KNATGMEVGW

SEQ ID NO: 124312 - protein, 9 aa, Homo sapiens
  Native (MOG_HUMAN)
ELKVEDPFY

SEQ ID NO: 124313 - protein, 11 aa, Homo sapiens
  Native (MOG_HUMAN)
GVLVLLAVLPV

SEQ ID NO: 124314 - protein, 9 aa, Homo sapiens
  Native (MOG_HUMAN)
RIRNVRFSD

SEQ ID NO: 124315 - protein, 8 aa, Homo sapiens
  Native (MOG_HUMAN)
GMEVGWYR

SEQ ID NO: 124316 - protein, 11 aa, Homo sapiens
  Native (MOG_HUMAN)
RPPFSRVVHLY

SEQ ID NO: 124317 - protein, 8 aa, Homo sapiens
  Native (MOG_HUMAN)
HRTFDPHF

SEQ ID NO: 124318 - protein, 9 aa, Homo sapiens
  Native (MOG_HUMAN)
QYRLRGKLR

SEQ ID NO: 124319 - protein, 11 aa, Homo sapiens
  Native (MOG_HUMAN)
QAPEYRGRTEL

SEQ ID NO: 124320 - protein, 11 aa, Homo sapiens
  Native (MOG_HUMAN)
IGPRHPIRALV

SEQ ID NO: 124321 - protein, 9 aa, Homo sapiens
  Native (MOG_HUMAN)
TELLKDAIG

SEQ ID NO: 124322 - protein, 10 aa, Homo sapiens
  Native (MOG_HUMAN)
AVLPVLLLQI

SEQ ID NO: 124323 - protein, 9 aa, Homo sapiens
  Native (MOG_HUMAN)
FLCLQYRLR

SEQ ID NO: 124324 - protein, 10 aa, Homo sapiens
  Native (MOG_HUMAN)
LIICYNWLHR

SEQ ID NO: 124325 - protein, 10 aa, Homo sapiens
  Native (MOG_HUMAN)
FSRVVHLYRN

SEQ ID NO: 124326 - protein, 10 aa, Homo sapiens
  Native (MOG_HUMAN)
DQDGDQAPEY

SEQ ID NO: 124327 - protein, 11 aa, Homo sapiens
  Native (MOG_HUMAN)
VRFSDEGGFTC

SEQ ID NO: 124328 - protein, 11 aa, Homo sapiens
  Native (MOG_HUMAN)
NGKDQDGDQAP

SEQ ID NO: 124329 - protein, 8 aa, Homo sapiens
  Native (MOG_HUMAN)
VPCWKITL

SEQ ID NO: 124330 - protein, 10 aa, Homo sapiens
  Native (MOG_HUMAN)
SSYAGQFRVI

SEQ ID NO: 124331 - protein, 9 aa, Homo sapiens
  Native (MOG_HUMAN)
YRLRGKLRA

SEQ ID NO: 124332 - protein, 9 aa, Homo sapiens
  Native (MOG_HUMAN)
GLIFLCLQY

SEQ ID NO: 124333 - protein, 11 aa, Homo sapiens
  Native (MOG_HUMAN)
IVPVLGPLVAL

SEQ ID NO: 124334 - protein, 10 aa, Homo sapiens
  Native (MOG_HUMAN)
LRVPCWKITL

SEQ ID NO: 124335 - protein, 9 aa, Homo sapiens
  Native (MOG_HUMAN)
LQVSSSYAG

SEQ ID NO: 124336 - protein, 10 aa, Homo sapiens
  Native (MOG_HUMAN)
LLLLQVSSSY

SEQ ID NO: 124337 - protein, 9 aa, Homo sapiens
  Native (MOG_HUMAN)
CSFLLLLLL

SEQ ID NO: 124338 - protein, 9 aa, Homo sapiens
  Native (MOG_HUMAN)
LHRRLAGQF

SEQ ID NO: 124339 - protein, 11 aa, Homo sapiens
  Native (MOG_HUMAN)
HSYQEEAAMEL

SEQ ID NO: 124340 - protein, 11 aa, Homo sapiens
  Native (MOG_HUMAN)
ELLKDAIGEGK

SEQ ID NO: 124341 - protein, 10 aa, Homo sapiens
  Native (MOG_HUMAN)
KITLFVIVPV

SEQ ID NO: 124342 - protein, 10 aa, Homo sapiens
  Native (MOG_HUMAN)
LIFLCLQYRL

SEQ ID NO: 124343 - protein, 10 aa, Homo sapiens
  Native (MOG_HUMAN)
GPRHPIRALV

SEQ ID NO: 124344 - protein, 11 aa, Homo sapiens
  Native (MOG_HUMAN)
GPRHPIRALVG

SEQ ID NO: 124345 - protein, 10 aa, Homo sapiens
  Native (MOG_HUMAN)
LRAEIENLHR

SEQ ID NO: 124346 - protein, 10 aa, Homo sapiens
  Native (MOG_HUMAN)
RTFDPHFLRV

SEQ ID NO: 124347 - protein, 9 aa, Homo sapiens
  Native (MOG_HUMAN)
AIGEGKVTL

SEQ ID NO: 124348 - protein, 11 aa, Homo sapiens
  Native (MOG_HUMAN)
YRPPFSRVVHL

SEQ ID NO: 124349 - protein, 9 aa, Homo sapiens
  Native (MOG_HUMAN)
LLQVSSSYA

SEQ ID NO: 124350 - protein, 10 aa, Homo sapiens
  Native (MOG_HUMAN)
VLLAVLPVLL

SEQ ID NO: 124351 - protein, 10 aa, Homo sapiens
  Native (MOG_HUMAN)
DPHFLRVPCW

SEQ ID NO: 124352 - protein, 8 aa, Homo sapiens
  Native (MOG_HUMAN)
FYWVSPGV

SEQ ID NO: 124353 - protein, 11 aa, Homo sapiens
  Native (MOG_HUMAN)
KNATGMEVGWY

SEQ ID NO: 124354 - protein, 8 aa, Homo sapiens
  Native (MOG_HUMAN)
ATGMEVGW

SEQ ID NO: 124355 - protein, 10 aa, Homo sapiens
  Native (MOG_HUMAN)
EYRGRTELLK

SEQ ID NO: 124356 - protein, 10 aa, Homo sapiens
  Native (MOG_HUMAN)
CRISPGKNAT

SEQ ID NO: 124357 - protein, 10 aa, Homo sapiens
  Native (MOG_HUMAN)
HFLRVPCWKI

SEQ ID NO: 124358 - protein, 10 aa, Homo sapiens
  Native (MOG_HUMAN)
SCLCSFLLLL

SEQ ID NO: 124359 - protein, 10 aa, Homo sapiens
  Native (MOG_HUMAN)
LLLQITVGLI

SEQ ID NO: 124360 - protein, 8 aa, Homo sapiens
  Native (MOG_HUMAN)
SYQEEAAM

SEQ ID NO: 124361 - protein, 8 aa, Homo sapiens
  Native (MOG_HUMAN)
AVLPVLLL

SEQ ID NO: 124362 - protein, 9 aa, Homo sapiens
  Native (MOG_HUMAN)
SSSYAGQFR

SEQ ID NO: 124363 - protein, 10 aa, Homo sapiens
  Native (MOG_HUMAN)
RIRNVRFSDE

SEQ ID NO: 124364 - protein, 11 aa, Homo sapiens
  Native (MOG_HUMAN)
SYQEEAAMELK

SEQ ID NO: 124365 - protein, 8 aa, Homo sapiens
  Native (MOG_HUMAN)
VLGPLVAL

SEQ ID NO: 124366 - protein, 9 aa, Homo sapiens
  Native (MOG_HUMAN)
GVLVLLAVL

SEQ ID NO: 124367 - protein, 8 aa, Homo sapiens
  Native (MOG_HUMAN)
YRGRTELL

SEQ ID NO: 124368 - protein, 8 aa, Homo sapiens
  Native (MOG_HUMAN)
SRVVHLYR

SEQ ID NO: 124369 - protein, 11 aa, Homo sapiens
  Native (MOG_HUMAN)
PPFSRVVHLYR

SEQ ID NO: 124370 - protein, 8 aa, Homo sapiens
  Native (MOG_HUMAN)
LPSCLCSF

SEQ ID NO: 124371 - protein, 9 aa, Homo sapiens
  Native (MOG_HUMAN)
SPGKNATGM

SEQ ID NO: 124372 - protein, 8 aa, Homo sapiens
  Native (MOG_HUMAN)
LLQVSSSY

SEQ ID NO: 124373 - protein, 10 aa, Homo sapiens
  Native (MOG_HUMAN)
PHFLRVPCWK

SEQ ID NO: 124374 - protein, 11 aa, Homo sapiens
  Native (MOG_HUMAN)
APEYRGRTELL

SEQ ID NO: 124375 - protein, 9 aa, Homo sapiens
  Native (MOG_HUMAN)
YRGRTELLK

SEQ ID NO: 124376 - protein, 8 aa, Homo sapiens
  Native (MOG_HUMAN)
YRPPFSRV

SEQ ID NO: 124377 - protein, 9 aa, Homo sapiens
  Native (MOG_HUMAN)
PSCLCSFLL

SEQ ID NO: 124378 - protein, 8 aa, Homo sapiens
  Native (MOG_HUMAN)
EAAMELKV

SEQ ID NO: 124379 - protein, 9 aa, Homo sapiens
  Native (MOG_HUMAN)
CLCSFLLLL

SEQ ID NO: 124380 - protein, 9 aa, Homo sapiens
  Native (MOG_HUMAN)
SLPSCLCSF

SEQ ID NO: 124381 - protein, 11 aa, Homo sapiens
  Native (MOG_HUMAN)
LPCRISPGKNA

SEQ ID NO: 124382 - protein, 11 aa, Homo sapiens
  Native (MOG_HUMAN)
DQDGDQAPEYR

SEQ ID NO: 124383 - protein, 10 aa, Homo sapiens
  Native (MOG_HUMAN)
WYRPPFSRVV

SEQ ID NO: 124384 - protein, 8 aa, Homo sapiens
  Native (MOG_HUMAN)
LLAVLPVL

SEQ ID NO: 124385 - protein, 10 aa, Homo sapiens
  Native (MOG_HUMAN)
PPFSRVVHLY

SEQ ID NO: 124386 - protein, 8 aa, Homo sapiens
  Native (MOG_HUMAN)
FLCLQYRL

SEQ ID NO: 124387 - protein, 9 aa, Homo sapiens
  Native (MOG_HUMAN)
DEGGFTCFF

SEQ ID NO: 124388 - protein, 11 aa, Homo sapiens
  Native (MOG_HUMAN)
VGDEVELPCRI

SEQ ID NO: 124389 - protein, 9 aa, Homo sapiens
  Native (MOG_HUMAN)
KVEDPFYWV

SEQ ID NO: 124390 - protein, 11 aa, Homo sapiens
  Native (MOG_HUMAN)
FSDEGGFTCFF

SEQ ID NO: 124391 - protein, 8 aa, Homo sapiens
  Native (MOG_HUMAN)
LPVLLLQI

SEQ ID NO: 124392 - protein, 10 aa, Homo sapiens
  Native (MOG_HUMAN)
YQEEAAMELK

SEQ ID NO: 124393 - protein, 10 aa, Homo sapiens
  Native (MOG_HUMAN)
CLCSFLLLLL

SEQ ID NO: 124394 - protein, 9 aa, Homo sapiens
  Native (MOG_HUMAN)
KDAIGEGKV

SEQ ID NO: 124395 - protein, 10 aa, Homo sapiens
  Native (MOG_HUMAN)
SSSYAGQFRV

SEQ ID NO: 124396 - protein, 11 aa, Homo sapiens
  Native (MOG_HUMAN)
SRVVHLYRNGK

SEQ ID NO: 124397 - protein, 11 aa, Homo sapiens
  Native (MOG_HUMAN)
VGLIFLCLQYR

SEQ ID NO: 124398 - protein, 9 aa, Homo sapiens
  Native (MOG_HUMAN)
ATGMEVGWY

SEQ ID NO: 124399 - protein, 10 aa, Homo sapiens
  Native (MOG_HUMAN)
VGWYRPPFSR

SEQ ID NO: 124400 - protein, 8 aa, Homo sapiens
  Native (MOG_HUMAN)
HRRLAGQF

SEQ ID NO: 124401 - protein, 9 aa, Homo sapiens
  Native (MOG_HUMAN)
ICYNWLHRR

SEQ ID NO: 124402 - protein, 9 aa, Homo sapiens
  Native (MOG_HUMAN)
GEGKVTLRI

SEQ ID NO: 124403 - protein, 8 aa, Homo sapiens
  Native (MOG_HUMAN)
CYNWLHRR

SEQ ID NO: 124404 - protein, 8 aa, Homo sapiens
  Native (MOG_HUMAN)
GGFTCFFR

SEQ ID NO: 124405 - protein, 10 aa, Homo sapiens
  Native (MOG_HUMAN)
LSRPSLPSCL

SEQ ID NO: 124406 - protein, 10 aa, Homo sapiens
  Native (MOG_HUMAN)
ITVGLIFLCL

SEQ ID NO: 124407 - protein, 11 aa, Homo sapiens
  Native (MOG_HUMAN)
GLIFLCLQYRL

SEQ ID NO: 124408 - protein, 9 aa, Homo sapiens
  Native (MOG_HUMAN)
VIGPRHPIR

SEQ ID NO: 124409 - protein, 9 aa, Homo sapiens
  Native (MOG_HUMAN)
EIENLHRTF

SEQ ID NO: 124410 - protein, 8 aa, Homo sapiens
  Native (MOG_HUMAN)
RPPFSRVV

SEQ ID NO: 124411 - protein, 9 aa, Homo sapiens
  Native (MOG_HUMAN)
VPVLGPLVA

SEQ ID NO: 124412 - protein, 9 aa, Homo sapiens
  Native (MOG_HUMAN)
VLPVLLLQI

SEQ ID NO: 124413 - protein, 11 aa, Homo sapiens
  Native (MOG_HUMAN)
SPGKNATGMEV

SEQ ID NO: 124414 - protein, 10 aa, Homo sapiens
  Native (MOG_HUMAN)
LLLQVSSSYA

SEQ ID NO: 124415 - protein, 8 aa, Homo sapiens
  Native (MOG_HUMAN)
MELKVEDP

SEQ ID NO: 124416 - protein, 9 aa, Homo sapiens
  Native (MOG_HUMAN)
HFLRVPCWK

SEQ ID NO: 124417 - protein, 9 aa, Homo sapiens
  Native (MOG_HUMAN)
GPRHPIRAL

SEQ ID NO: 124418 - protein, 9 aa, Homo sapiens
  Native (MOG_HUMAN)
VELPCRISP

SEQ ID NO: 124419 - protein, 9 aa, Homo sapiens
  Native (MOG_HUMAN)
GWYRPPFSR

SEQ ID NO: 124420 - protein, 10 aa, Homo sapiens
  Native (MOG_HUMAN)
PFYWVSPGVL

SEQ ID NO: 124421 - protein, 11 aa, Homo sapiens
  Native (MOG_HUMAN)
FVIVPVLGPLV

SEQ ID NO: 124422 - protein, 9 aa, Homo sapiens
  Native (MOG_HUMAN)
DHSYQEEAA

SEQ ID NO: 124423 - protein, 11 aa, Homo sapiens
  Native (MOG_HUMAN)
LRVPCWKITLF

SEQ ID NO: 124424 - protein, 11 aa, Homo sapiens
  Native (MOG_HUMAN)
SLSRPSLPSCL

SEQ ID NO: 124425 - protein, 11 aa, Homo sapiens
  Native (MOG_HUMAN)
HRTFDPHFLRV

SEQ ID NO: 124426 - protein, 11 aa, Homo sapiens
  Native (MOG_HUMAN)
KLRAEIENLHR

SEQ ID NO: 124427 - protein, 10 aa, Homo sapiens
  Native (MOG_HUMAN)
FLLLLLLQVS

SEQ ID NO: 124428 - protein, 8 aa, Homo sapiens
  Native (MOG_HUMAN)
QFRVIGPR

SEQ ID NO: 124429 - protein, 9 aa, Homo sapiens
  Native (MOG_HUMAN)
SPGVLVLLA

SEQ ID NO: 124430 - protein, 11 aa, Homo sapiens
  Native (MOG_HUMAN)
IRALVGDEVEL

SEQ ID NO: 124431 - protein, 8 aa, Homo sapiens
  Native (MOG_HUMAN)
LLQITVGL

SEQ ID NO: 124432 - protein, 9 aa, Homo sapiens
  Native (MOG_HUMAN)
TLRIRNVRF

SEQ ID NO: 124433 - protein, 11 aa, Homo sapiens
  Native (MOG_HUMAN)
YRLRGKLRAEI

SEQ ID NO: 124434 - protein, 8 aa, Homo sapiens
  Native (MOG_HUMAN)
VEDPFYWV

SEQ ID NO: 124435 - protein, 8 aa, Homo sapiens
  Native (MOG_HUMAN)
DEGGFTCF

SEQ ID NO: 124436 - protein, 8 aa, Homo sapiens
  Native (MOG_HUMAN)
LAVLPVLL

SEQ ID NO: 124437 - protein, 11 aa, Homo sapiens
  Native (MOG_HUMAN)
DGDQAPEYRGR

SEQ ID NO: 124438 - protein, 10 aa, Homo sapiens
  Native (MOG_HUMAN)
KVTLRIRNVR

SEQ ID NO: 124439 - protein, 9 aa, Homo sapiens
  Native (MOG_HUMAN)
HRRLAGQFL

SEQ ID NO: 124440 - protein, 8 aa, Homo sapiens
  Native (MOG_HUMAN)
GPRHPIRA

SEQ ID NO: 124441 - protein, 9 aa, Homo sapiens
  Native (MOG_HUMAN)
LRAEIENLH

SEQ ID NO: 124442 - protein, 9 aa, Homo sapiens
  Native (MOG_HUMAN)
TGMEVGWYR

SEQ ID NO: 124443 - protein, 8 aa, Homo sapiens
  Native (MOG_HUMAN)
YAGQFRVI

SEQ ID NO: 124444 - protein, 9 aa, Homo sapiens
  Native (MOG_HUMAN)
SCLCSFLLL

SEQ ID NO: 124445 - protein, 10 aa, Homo sapiens
  Native (MOG_HUMAN)
QFLEELRNPF

SEQ ID NO: 124446 - protein, 10 aa, Homo sapiens
  Native (MOG_HUMAN)
FRVIGPRHPI

SEQ ID NO: 124447 - protein, 10 aa, Homo sapiens
  Native (MOG_HUMAN)
IICYNWLHRR

SEQ ID NO: 124448 - protein, 10 aa, Homo sapiens
  Native (MOG_HUMAN)
GPLVALIICY

SEQ ID NO: 124449 - protein, 10 aa, Homo sapiens
  Native (MOG_HUMAN)
LPVLLLQITV

SEQ ID NO: 124450 - protein, 10 aa, Homo sapiens
  Native (MOG_HUMAN)
MELKVEDPFY

SEQ ID NO: 124451 - protein, 10 aa, Homo sapiens
  Native (MOG_HUMAN)
LVLLAVLPVL

SEQ ID NO: 124452 - protein, 10 aa, Homo sapiens
  Native (MOG_HUMAN)
TGMEVGWYRP

SEQ ID NO: 124453 - protein, 8 aa, Homo sapiens
  Native (MOG_HUMAN)
CFFRDHSY

SEQ ID NO: 124454 - protein, 10 aa, Homo sapiens
  Native (MOG_HUMAN)
SRPSLPSCLC

SEQ ID NO: 124455 - protein, 8 aa, Homo sapiens
  Native (MOG_HUMAN)
AEIENLHR

SEQ ID NO: 124456 - protein, 10 aa, Homo sapiens
  Native (MOG_HUMAN)
RLAGQFLEEL

SEQ ID NO: 124457 - protein, 10 aa, Homo sapiens
  Native (MOG_HUMAN)
IVPVLGPLVA

SEQ ID NO: 124458 - protein, 11 aa, Homo sapiens
  Native (MOG_HUMAN)
AAMELKVEDPF

SEQ ID NO: 124459 - protein, 9 aa, Homo sapiens
  Native (MOG_HUMAN)
IRALVGDEV

SEQ ID NO: 124460 - protein, 10 aa, Homo sapiens
  Native (MOG_HUMAN)
IFLCLQYRLR

SEQ ID NO: 124461 - protein, 8 aa, Homo sapiens
  Native (MOG_HUMAN)
DHSYQEEA

SEQ ID NO: 124462 - protein, 10 aa, Homo sapiens
  Native (MOG_HUMAN)
PFSRVVHLYR

SEQ ID NO: 124463 - protein, 8 aa, Homo sapiens
  Native (MOG_HUMAN)
VLLLQITV

SEQ ID NO: 124464 - protein, 9 aa, Homo sapiens
  Native (MOG_HUMAN)
LPSCLCSFL

SEQ ID NO: 124465 - protein, 10 aa, Homo sapiens
  Native (MOG_HUMAN)
DEGGFTCFFR

SEQ ID NO: 124466 - protein, 9 aa, Homo sapiens
  Native (MOG_HUMAN)
SDEGGFTCF

SEQ ID NO: 124467 - protein, 11 aa, Homo sapiens
  Native (MOG_HUMAN)
GFTCFFRDHSY

SEQ ID NO: 124468 - protein, 9 aa, Homo sapiens
  Native (MOG_HUMAN)
YWVSPGVLV

SEQ ID NO: 124469 - protein, 9 aa, Homo sapiens
  Native (MOG_HUMAN)
RPPFSRVVH

SEQ ID NO: 124470 - protein, 8 aa, Homo sapiens
  Native (MOG_HUMAN)
LIFLCLQY

SEQ ID NO: 124471 - protein, 8 aa, Homo sapiens
  Native (MOG_HUMAN)
VTLRIRNV

SEQ ID NO: 124472 - protein, 9 aa, Homo sapiens
  Native (MOG_HUMAN)
RPSLPSCLC

SEQ ID NO: 124473 - protein, 11 aa, Homo sapiens
  Native (MOG_HUMAN)
FLRVPCWKITL

SEQ ID NO: 124474 - protein, 11 aa, Homo sapiens
  Native (MOG_HUMAN)
SSSYAGQFRVI

SEQ ID NO: 124475 - protein, 11 aa, Homo sapiens
  Native (MOG_HUMAN)
AMELKVEDPFY

SEQ ID NO: 124476 - protein, 8 aa, Homo sapiens
  Native (MOG_HUMAN)
TLFVIVPV

SEQ ID NO: 124477 - protein, 11 aa, Homo sapiens
  Native (MOG_HUMAN)
LIFLCLQYRLR

SEQ ID NO: 124478 - protein, 8 aa, Homo sapiens
  Native (MOG_HUMAN)
QEEAAMEL

SEQ ID NO: 124479 - protein, 11 aa, Homo sapiens
  Native (MOG_HUMAN)
VLVLLAVLPVL

SEQ ID NO: 124480 - protein, 9 aa, Homo sapiens
  Native (MOG_HUMAN)
RDHSYQEEA

SEQ ID NO: 124481 - protein, 9 aa, Homo sapiens
  Native (MOG_HUMAN)
PVLGPLVAL

SEQ ID NO: 124482 - protein, 10 aa, Homo sapiens
  Native (MOG_HUMAN)
VGDEVELPCR

SEQ ID NO: 124483 - protein, 10 aa, Homo sapiens
  Native (MOG_HUMAN)
ELPCRISPGK

SEQ ID NO: 124484 - protein, 10 aa, Homo sapiens
  Native (MOG_HUMAN)
VSSSYAGQFR

SEQ ID NO: 124485 - protein, 8 aa, Homo sapiens
  Native (MOG_HUMAN)
ASLSRPSL

SEQ ID NO: 124486 - protein, 8 aa, Homo sapiens
  Native (MOG_HUMAN)
RGKLRAEI

SEQ ID NO: 124487 - protein, 9 aa, Homo sapiens
  Native (MOG_HUMAN)
AEIENLHRT

SEQ ID NO: 124488 - protein, 10 aa, Homo sapiens
  Native (MOG_HUMAN)
VLLLQITVGL

SEQ ID NO: 124489 - protein, 11 aa, Homo sapiens
  Native (MOG_HUMAN)
RAEIENLHRTF

SEQ ID NO: 124490 - protein, 11 aa, Homo sapiens
  Native (MOG_HUMAN)
SLPSCLCSFLL

SEQ ID NO: 124491 - protein, 8 aa, Homo sapiens
  Native (MOG_HUMAN)
TELLKDAI

SEQ ID NO: 124492 - protein, 11 aa, Homo sapiens
  Native (MOG_HUMAN)
YWVSPGVLVLL

SEQ ID NO: 124493 - protein, 10 aa, Homo sapiens
  Native (MOG_HUMAN)
FYWVSPGVLV

SEQ ID NO: 124494 - protein, 10 aa, Homo sapiens
  Native (MOG_HUMAN)
RDHSYQEEAA

SEQ ID NO: 124495 - protein, 10 aa, Homo sapiens
  Native (MOG_HUMAN)
YRPPFSRVVH

SEQ ID NO: 124496 - protein, 10 aa, Homo sapiens
  Native (MOG_HUMAN)
ISPGKNATGM

SEQ ID NO: 124497 - protein, 8 aa, Homo sapiens
  Native (MOG_HUMAN)
IGEGKVTL

SEQ ID NO: 124498 - protein, 8 aa, Homo sapiens
  Native (MOG_HUMAN)
PRHPIRAL

SEQ ID NO: 124499 - protein, 10 aa, Homo sapiens
  Native (MOG_HUMAN)
LQYRLRGKLR

SEQ ID NO: 124500 - protein, 10 aa, Homo sapiens
  Native (MOG_HUMAN)
VEDPFYWVSP

SEQ ID NO: 124501 - protein, 10 aa, Homo sapiens
  Native (MOG_HUMAN)
ELKVEDPFYW

SEQ ID NO: 124502 - protein, 8 aa, Homo sapiens
  Native (MOG_HUMAN)
FSRVVHLY

SEQ ID NO: 124503 - protein, 11 aa, Homo sapiens
  Native (MOG_HUMAN)
GQFLEELRNPF

SEQ ID NO: 124504 - protein, 9 aa, Homo sapiens
  Native (MOG_HUMAN)
LRGKLRAEI

SEQ ID NO: 124505 - protein, 9 aa, Homo sapiens
  Native (MOG_HUMAN)
DQAPEYRGR

SEQ ID NO: 124506 - protein, 9 aa, Homo sapiens
  Native (MOG_HUMAN)
TLFVIVPVL

SEQ ID NO: 124507 - protein, 9 aa, Homo sapiens
  Native (MOG_HUMAN)
DGDQAPEYR

SEQ ID NO: 124508 - protein, 10 aa, Homo sapiens
  Native (MOG_HUMAN)
SDEGGFTCFF

SEQ ID NO: 124509 - protein, 11 aa, Homo sapiens
  Native (MOG_HUMAN)
RIRNVRFSDEG

SEQ ID NO: 124510 - protein, 9 aa, Homo sapiens
  Native (MOG_HUMAN)
IVPVLGPLV

SEQ ID NO: 124511 - protein, 9 aa, Homo sapiens
  Native (MOG_HUMAN)
AGQFLEELR

SEQ ID NO: 124512 - protein, 11 aa, Homo sapiens
  Native (MOG_HUMAN)
KDQDGDQAPEY

SEQ ID NO: 124513 - protein, 8 aa, Homo sapiens
  Native (MOG_HUMAN)
LVGDEVEL

SEQ ID NO: 124514 - protein, 10 aa, Homo sapiens
  Native (MOG_HUMAN)
RPPFSRVVHL

SEQ ID NO: 124515 - protein, 10 aa, Homo sapiens
  Native (MOG_HUMAN)
WVSPGVLVLL

SEQ ID NO: 124516 - protein, 9 aa, Homo sapiens
  Native (MOG_HUMAN)
DEVELPCRI

SEQ ID NO: 124517 - protein, 11 aa, Homo sapiens
  Native (MOG_HUMAN)
MELKVEDPFYW

SEQ ID NO: 124518 - protein, 11 aa, Homo sapiens
  Native (MOG_HUMAN)
SPGVLVLLAVL

SEQ ID NO: 124519 - protein, 9 aa, Homo sapiens
  Native (MOG_HUMAN)
IGEGKVTLR

SEQ ID NO: 124520 - protein, 8 aa, Homo sapiens
  Native (MOG_HUMAN)
RIRNVRFS

SEQ ID NO: 124521 - protein, 9 aa, Homo sapiens
  Native (MOG_HUMAN)
IICYNWLHR

SEQ ID NO: 124522 - protein, 10 aa, Homo sapiens
  Native (MOG_HUMAN)
VTLRIRNVRF

SEQ ID NO: 124523 - protein, 8 aa, Homo sapiens
  Native (MOG_HUMAN)
QITVGLIF

SEQ ID NO: 124524 - protein, 8 aa, Homo sapiens
  Native (MOG_HUMAN)
FSDEGGFT

SEQ ID NO: 124525 - protein, 10 aa, Homo sapiens
  Native (MOG_HUMAN)
RVPCWKITLF

SEQ ID NO: 124526 - protein, 11 aa, Homo sapiens
  Native (MOG_HUMAN)
LPSCLCSFLLL

SEQ ID NO: 124527 - protein, 11 aa, Homo sapiens
  Native (MOG_HUMAN)
FYWVSPGVLVL

SEQ ID NO: 124528 - protein, 11 aa, Homo sapiens
  Native (MOG_HUMAN)
NATGMEVGWYR

SEQ ID NO: 124529 - protein, 9 aa, Homo sapiens
  Native (MOG_HUMAN)
EGGFTCFFR

SEQ ID NO: 124530 - protein, 11 aa, Homo sapiens
  Native (MOG_HUMAN)
RISPGKNATGM

SEQ ID NO: 124531 - protein, 9 aa, Homo sapiens
  Native (MOG_HUMAN)
QITVGLIFL

SEQ ID NO: 124532 - protein, 9 aa, Homo sapiens
  Native (MOG_HUMAN)
LPCRISPGK

SEQ ID NO: 124533 - protein, 8 aa, Homo sapiens
  Native (MOG_HUMAN)
VSPGVLVL

SEQ ID NO: 124534 - protein, 10 aa, Homo sapiens
  Native (MOG_HUMAN)
HRTFDPHFLR

SEQ ID NO: 124535 - protein, 8 aa, Homo sapiens
  Native (MOG_HUMAN)
RTFDPHFL

SEQ ID NO: 124536 - protein, 10 aa, Homo sapiens
  Native (MOG_HUMAN)
LHRTFDPHFL

SEQ ID NO: 124537 - protein, 9 aa, Homo sapiens
  Native (MOG_HUMAN)
CLQYRLRGK

SEQ ID NO: 124538 - protein, 9 aa, Homo sapiens
  Native (MOG_HUMAN)
TVGLIFLCL

SEQ ID NO: 124539 - protein, 9 aa, Homo sapiens
  Native (MOG_HUMAN)
VTLRIRNVR

SEQ ID NO: 124540 - protein, 10 aa, Homo sapiens
  Native (MOG_HUMAN)
NLHRTFDPHF

SEQ ID NO: 124541 - protein, 9 aa, Homo sapiens
  Native (MOG_HUMAN)
GPLVALIIC

SEQ ID NO: 124542 - protein, 11 aa, Homo sapiens
  Native (MOG_HUMAN)
ALIICYNWLHR

SEQ ID NO: 124543 - protein, 9 aa, Homo sapiens
  Native (MOG_HUMAN)
LLQITVGLI

SEQ ID NO: 124544 - protein, 11 aa, Homo sapiens
  Native (MOG_HUMAN)
GKVTLRIRNVR

SEQ ID NO: 124545 - protein, 9 aa, Homo sapiens
  Native (MOG_HUMAN)
FLEELRNPF

SEQ ID NO: 124546 - protein, 8 aa, Homo sapiens
  Native (MOG_HUMAN)
HPIRALVG

SEQ ID NO: 124547 - protein, 11 aa, Homo sapiens
  Native (MOG_HUMAN)
LQVSSSYAGQF

SEQ ID NO: 124548 - protein, 9 aa, Homo sapiens
  Native (MOG_HUMAN)
VIVPVLGPL

SEQ ID NO: 124549 - protein, 10 aa, Homo sapiens
  Native (MOG_HUMAN)
PEYRGRTELL

SEQ ID NO: 124550 - protein, 11 aa, Homo sapiens
  Native (MOG_HUMAN)
LIICYNWLHRR

SEQ ID NO: 124551 - protein, 8 aa, Homo sapiens
  Native (MOG_HUMAN)
LLLLLLQV

SEQ ID NO: 124552 - protein, 9 aa, Homo sapiens
  Native (MOG_HUMAN)
PRHPIRALV

SEQ ID NO: 124553 - protein, 10 aa, Homo sapiens
  Native (MOG_HUMAN)
ICYNWLHRRL

SEQ ID NO: 124554 - protein, 10 aa, Homo sapiens
  Native (MOG_HUMAN)
RLRGKLRAEI

SEQ ID NO: 124555 - protein, 8 aa, Homo sapiens
  Native (MOG_HUMAN)
SPGVLVLL

SEQ ID NO: 124556 - protein, 9 aa, Homo sapiens
  Native (MOG_HUMAN)
KLRAEIENL

SEQ ID NO: 124557 - protein, 9 aa, Homo sapiens
  Native (MOG_HUMAN)
EGKVTLRIR

SEQ ID NO: 124558 - protein, 10 aa, Homo sapiens
  Native (MOG_HUMAN)
LAGQFLEELR

SEQ ID NO: 124559 - protein, 10 aa, Homo sapiens
  Native (MOG_HUMAN)
LLAVLPVLLL

SEQ ID NO: 124560 - protein, 11 aa, Homo sapiens
  Native (MOG_HUMAN)
CRISPGKNATG

SEQ ID NO: 124561 - protein, 8 aa, Homo sapiens
  Native (MOG_HUMAN)
LEELRNPF

SEQ ID NO: 124562 - protein, 10 aa, Homo sapiens
  Native (MOG_HUMAN)
DAIGEGKVTL

SEQ ID NO: 124563 - protein, 9 aa, Homo sapiens
  Native (MOG_HUMAN)
QEEAAMELK

SEQ ID NO: 124564 - protein, 11 aa, Homo sapiens
  Native (MOG_HUMAN)
CLQYRLRGKLR

SEQ ID NO: 124565 - protein, 10 aa, Homo sapiens
  Native (MOG_HUMAN)
YWVSPGVLVL

SEQ ID NO: 124566 - protein, 9 aa, Homo sapiens
  Native (MOG_HUMAN)
DAIGEGKVT

SEQ ID NO: 124567 - protein, 8 aa, Homo sapiens
  Native (MOG_HUMAN)
RPSLPSCL

SEQ ID NO: 124568 - protein, 10 aa, Homo sapiens
  Native (MOG_HUMAN)
VLVLLAVLPV

SEQ ID NO: 124569 - protein, 9 aa, Homo sapiens
  Native (MOG_HUMAN)
PEYRGRTEL

SEQ ID NO: 124570 - protein, 10 aa, Homo sapiens
  Native (MOG_HUMAN)
ITLFVIVPVL

SEQ ID NO: 124571 - protein, 8 aa, Homo sapiens
  Native (MOG_HUMAN)
GPLVALII

SEQ ID NO: 124572 - protein, 8 aa, Homo sapiens
  Native (MOG_HUMAN)
YWVSPGVL

SEQ ID NO: 124573 - protein, 9 aa, Homo sapiens
  Native (MOG_HUMAN)
FLRVPCWKI

SEQ ID NO: 124574 - protein, 9 aa, Homo sapiens
  Native (MOG_HUMAN)
EVGWYRPPF

SEQ ID NO: 124575 - protein, 10 aa, Homo sapiens
  Native (MOG_HUMAN)
LVALIICYNW

SEQ ID NO: 124576 - protein, 10 aa, Homo sapiens
  Native (MOG_HUMAN)
RRLAGQFLEE

SEQ ID NO: 124577 - protein, 8 aa, Homo sapiens
  Native (MOG_HUMAN)
EYRGRTEL

SEQ ID NO: 124578 - protein, 9 aa, Homo sapiens
  Native (MOG_HUMAN)
DPHFLRVPC

SEQ ID NO: 124579 - protein, 9 aa, Homo sapiens
  Native (MOG_HUMAN)
PPFSRVVHL

SEQ ID NO: 124580 - protein, 11 aa, Homo sapiens
  Native (MOG_HUMAN)
HPIRALVGDEV

SEQ ID NO: 124581 - protein, 10 aa, Homo sapiens
  Native (MOG_HUMAN)
QVSSSYAGQF

SEQ ID NO: 124582 - protein, 9 aa, Homo sapiens
  Native (MOG_HUMAN)
LCSFLLLLL

SEQ ID NO: 124583 - protein, 9 aa, Homo sapiens
  Native (MOG_HUMAN)
LIICYNWLH

SEQ ID NO: 124584 - protein, 11 aa, Homo sapiens
  Native (MOG_HUMAN)
LLKDAIGEGKV

SEQ ID NO: 124585 - protein, 9 aa, Homo sapiens
  Native (MOG_HUMAN)
RTELLKDAI

SEQ ID NO: 124586 - protein, 9 aa, Homo sapiens
  Native (MOG_HUMAN)
VRFSDEGGF

SEQ ID NO: 124587 - protein, 10 aa, Homo sapiens
  Native (MOG_HUMAN)
SYQEEAAMEL

SEQ ID NO: 124588 - protein, 8 aa, Homo sapiens
  Native (MOG_HUMAN)
IFLCLQYR

SEQ ID NO: 124589 - protein, 11 aa, Homo sapiens
  Native (MOG_HUMAN)
EVGWYRPPFSR

SEQ ID NO: 124590 - protein, 8 aa, Homo sapiens
  Native (MOG_HUMAN)
TFDPHFLR

SEQ ID NO: 124591 - protein, 10 aa, Homo sapiens
  Native (MOG_HUMAN)
WLHRRLAGQF

SEQ ID NO: 124592 - protein, 9 aa, Homo sapiens
  Native (MOG_HUMAN)
PLVALIICY

SEQ ID NO: 124593 - protein, 10 aa, Homo sapiens
  Native (MOG_HUMAN)
FRDHSYQEEA

SEQ ID NO: 124594 - protein, 10 aa, Homo sapiens
  Native (MOG_HUMAN)
GRTELLKDAI

SEQ ID NO: 124595 - protein, 10 aa, Homo sapiens
  Native (MOG_HUMAN)
SPGVLVLLAV

SEQ ID NO: 124596 - protein, 9 aa, Homo sapiens
  Native (MOG_HUMAN)
EYRGRTELL

SEQ ID NO: 124597 - protein, 8 aa, Homo sapiens
  Native (MOG_HUMAN)
LQITVGLI

SEQ ID NO: 124598 - protein, 9 aa, Homo sapiens
  Native (MOG_HUMAN)
LGPLVALII

SEQ ID NO: 124599 - protein, 8 aa, Homo sapiens
  Native (MOG_HUMAN)
SSYAGQFR

SEQ ID NO: 124600 - protein, 10 aa, Homo sapiens
  Native (MOG_HUMAN)
PVLGPLVALI

SEQ ID NO: 124601 - protein, 9 aa, Homo sapiens
  Native (MOG_HUMAN)
PFSRVVHLY

SEQ ID NO: 124602 - protein, 8 aa, Homo sapiens
  Native (MOG_HUMAN)
IENLHRTF

SEQ ID NO: 124603 - protein, 9 aa, Homo sapiens
  Native (MOG_HUMAN)
RVVHLYRNG

SEQ ID NO: 124604 - protein, 10 aa, Homo sapiens
  Native (MOG_HUMAN)
AMELKVEDPF

SEQ ID NO: 124605 - protein, 11 aa, Homo sapiens
  Native (MOG_HUMAN)
LVGDEVELPCR

SEQ ID NO: 124606 - protein, 11 aa, Homo sapiens
  Native (MOG_HUMAN)
LHRTFDPHFLR

SEQ ID NO: 124607 - protein, 11 aa, Homo sapiens
  Native (MOG_HUMAN)
KITLFVIVPVL

SEQ ID NO: 124608 - protein, 10 aa, Homo sapiens
  Native (MOG_HUMAN)
APEYRGRTEL

SEQ ID NO: 124609 - protein, 11 aa, Homo sapiens
  Native (MOG_HUMAN)
RNVRFSDEGGF

SEQ ID NO: 124610 - protein, 11 aa, Homo sapiens
  Native (MOG_HUMAN)
RVPCWKITLFV

SEQ ID NO: 124611 - protein, 9 aa, Homo sapiens
  Native (MOG_HUMAN)
GQFRVIGPR

SEQ ID NO: 124612 - protein, 11 aa, Homo sapiens
  Native (MOG_HUMAN)
VLLAVLPVLLL

SEQ ID NO: 124613 - protein, 8 aa, Homo sapiens
  Native (MOG_HUMAN)
VIGPRHPI

SEQ ID NO: 124614 - protein, 11 aa, Homo sapiens
  Native (MOG_HUMAN)
WLHRRLAGQFL

SEQ ID NO: 124615 - protein, 10 aa, Homo sapiens
  Native (MOG_HUMAN)
AIGEGKVTLR

SEQ ID NO: 124616 - protein, 9 aa, Homo sapiens
  Native (MOG_HUMAN)
FRVIGPRHP

SEQ ID NO: 124617 - protein, 11 aa, Homo sapiens
  Native (MOG_HUMAN)
RTFDPHFLRVP

SEQ ID NO: 124618 - protein, 8 aa, Homo sapiens
  Native (MOG_HUMAN)
VLLAVLPV

SEQ ID NO: 124619 - protein, 9 aa, Homo sapiens
  Native (MOG_HUMAN)
VGDEVELPC

SEQ ID NO: 124620 - protein, 10 aa, Homo sapiens
  Native (MOG_HUMAN)
GKLRAEIENL

SEQ ID NO: 124621 - protein, 10 aa, Homo sapiens
  Native (MOG_HUMAN)
FDPHFLRVPC

SEQ ID NO: 124622 - protein, 9 aa, Homo sapiens
  Native (MOG_HUMAN)
LSRPSLPSC

SEQ ID NO: 124623 - protein, 11 aa, Homo sapiens
  Native (MOG_HUMAN)
VLPVLLLQITV

SEQ ID NO: 124624 - protein, 8 aa, Homo sapiens
  Native (MOG_HUMAN)
CSFLLLLL

SEQ ID NO: 124625 - protein, 8 aa, Homo sapiens
  Native (MOG_HUMAN)
FDPHFLRV

SEQ ID NO: 124626 - protein, 9 aa, Homo sapiens
  Native (MOG_HUMAN)
KVTLRIRNV

SEQ ID NO: 124627 - protein, 11 aa, Homo sapiens
  Native (MOG_HUMAN)
LLLLLQVSSSY

SEQ ID NO: 124628 - protein, 9 aa, Homo sapiens
  Native (MOG_HUMAN)
CRISPGKNA

SEQ ID NO: 124629 - protein, 9 aa, Homo sapiens
  Native (MOG_HUMAN)
RVPCWKITL

SEQ ID NO: 124630 - protein, 11 aa, Homo sapiens
  Native (MOG_HUMAN)
ATGMEVGWYRP

SEQ ID NO: 124631 - protein, 8 aa, Homo sapiens
  Native (MOG_HUMAN)
SSSYAGQF

SEQ ID NO: 124632 - protein, 9 aa, Homo sapiens
  Native (MOG_HUMAN)
TCFFRDHSY

SEQ ID NO: 124633 - protein, 11 aa, Homo sapiens
  Native (MOG_HUMAN)
YQEEAAMELKV

SEQ ID NO: 124634 - protein, 9 aa, Homo sapiens
  Native (MOG_HUMAN)
ITVGLIFLC

SEQ ID NO: 124635 - protein, 10 aa, Homo sapiens
  Native (MOG_HUMAN)
VPCWKITLFV

SEQ ID NO: 124636 - protein, 10 aa, Homo sapiens
  Native (MOG_HUMAN)
LLQITVGLIF

SEQ ID NO: 124637 - protein, 8 aa, Homo sapiens
  Native (MOG_HUMAN)
WYRPPFSR

SEQ ID NO: 124638 - protein, 8 aa, Homo sapiens
  Native (MOG_HUMAN)
ALIICYNW

SEQ ID NO: 124639 - protein, 10 aa, Homo sapiens
  Native (MOG_HUMAN)
DHSYQEEAAM

SEQ ID NO: 124640 - protein, 9 aa, Homo sapiens
  Native (MOG_HUMAN)
RAEIENLHR

SEQ ID NO: 124641 - protein, 9 aa, Homo sapiens
  Native (MOG_HUMAN)
LHRTFDPHF

SEQ ID NO: 124642 - protein, 8 aa, Homo sapiens
  Native (MOG_HUMAN)
DEVELPCR

SEQ ID NO: 124643 - protein, 9 aa, Homo sapiens
  Native (MOG_HUMAN)
WYRPPFSRV

SEQ ID NO: 124644 - protein, 9 aa, Homo sapiens
  Native (MOG_HUMAN)
NATGMEVGW

SEQ ID NO: 124645 - protein, 8 aa, Homo sapiens
  Native (MOG_HUMAN)
YNWLHRRL

SEQ ID NO: 124646 - protein, 10 aa, Homo sapiens
  Native (MOG_HUMAN)
LQITVGLIFL

SEQ ID NO: 124647 - protein, 11 aa, Homo sapiens
  Native (MOG_HUMAN)
RDHSYQEEAAM

SEQ ID NO: 124648 - protein, 10 aa, Homo sapiens
  Native (MOG_HUMAN)
LLKDAIGEGK

SEQ ID NO: 124649 - protein, 10 aa, Homo sapiens
  Native (MOG_HUMAN)
SLPSCLCSFL

SEQ ID NO: 124650 - protein, 9 aa, Homo sapiens
  Native (MOG_HUMAN)
CYNWLHRRL

SEQ ID NO: 124651 - protein, 9 aa, Homo sapiens
  Native (MOG_HUMAN)
FSDEGGFTC

SEQ ID NO: 124652 - protein, 8 aa, Homo sapiens
  Native (MOG_HUMAN)
IVPVLGPL

SEQ ID NO: 124653 - protein, 9 aa, Homo sapiens
  Native (MOG_HUMAN)
RRLAGQFLE

SEQ ID NO: 124654 - protein, 10 aa, Homo sapiens
  Native (MOG_HUMAN)
SLSRPSLPSC

SEQ ID NO: 124655 - protein, 10 aa, Homo sapiens
  Native (MOG_HUMAN)
VLGPLVALII

SEQ ID NO: 124656 - protein, 10 aa, Homo sapiens
  Native (MOG_HUMAN)
SFLLLLLLQV

SEQ ID NO: 124657 - protein, 9 aa, Homo sapiens
  Native (MOG_HUMAN)
LKDAIGEGK

SEQ ID NO: 124658 - protein, 10 aa, Homo sapiens
  Native (MOG_HUMAN)
QEEAAMELKV

SEQ ID NO: 124659 - protein, 8 aa, Homo sapiens
  Native (MOG_HUMAN)
RRLAGQFL

SEQ ID NO: 124660 - protein, 9 aa, Homo sapiens
  Native (MOG_HUMAN)
LQYRLRGKL

SEQ ID NO: 124661 - protein, 9 aa, Homo sapiens
  Native (MOG_HUMAN)
ALVGDEVEL

SEQ ID NO: 124662 - protein, 11 aa, Homo sapiens
  Native (MOG_HUMAN)
FRVIGPRHPIR

SEQ ID NO: 124663 - protein, 11 aa, Homo sapiens
  Native (MOG_HUMAN)
YAGQFRVIGPR

SEQ ID NO: 124664 - protein, 10 aa, Homo sapiens
  Native (MOG_HUMAN)
VIVPVLGPLV

SEQ ID NO: 124665 - protein, 10 aa, Homo sapiens
  Native (MOG_HUMAN)
RPSLPSCLCS

SEQ ID NO: 124666 - protein, 8 aa, Homo sapiens
  Native (MOG_HUMAN)
LRAEIENL

SEQ ID NO: 124667 - protein, 8 aa, Homo sapiens
  Native (MOG_HUMAN)
LRIRNVRF

SEQ ID NO: 124668 - protein, 10 aa, Homo sapiens
  Native (MOG_HUMAN)
PSLPSCLCSF

SEQ ID NO: 124669 - protein, 9 aa, Homo sapiens
  Native (MOG_HUMAN)
QDGDQAPEY

SEQ ID NO: 124670 - protein, 10 aa, Homo sapiens
  Native (MOG_HUMAN)
VGLIFLCLQY

SEQ ID NO: 124671 - protein, 10 aa, Homo sapiens
  Native (MOG_HUMAN)
IGPRHPIRAL

SEQ ID NO: 124672 - protein, 9 aa, Homo sapiens
  Native (MOG_HUMAN)
MEVGWYRPP

SEQ ID NO: 124673 - protein, 11 aa, Homo sapiens
  Native (MOG_HUMAN)
LLLQITVGLIF

SEQ ID NO: 124674 - protein, 11 aa, Homo sapiens
  Native (MOG_HUMAN)
AIGEGKVTLRI

SEQ ID NO: 124675 - protein, 11 aa, Homo sapiens
  Native (MOG_HUMAN)
VPVLGPLVALI

SEQ ID NO: 124676 - protein, 11 aa, Homo sapiens
  Native (MOG_HUMAN)
RLAGQFLEELR

SEQ ID NO: 124677 - protein, 10 aa, Homo sapiens
  Native (MOG_HUMAN)
AGQFRVIGPR

SEQ ID NO: 124678 - protein, 10 aa, Homo sapiens
  Native (MOG_HUMAN)
GLIFLCLQYR

SEQ ID NO: 124679 - protein, 9 aa, Homo sapiens
  Native (MOG_HUMAN)
GRTELLKDA

SEQ ID NO: 124680 - protein, 9 aa, Homo sapiens
  Native (MOG_HUMAN)
KDQDGDQAP

SEQ ID NO: 124681 - protein, 9 aa, Homo sapiens
  Native (MOG_HUMAN)
LPVLLLQIT

SEQ ID NO: 124682 - protein, 8 aa, Homo sapiens
  Native (MOG_HUMAN)
LFVIVPVL

SEQ ID NO: 124683 - protein, 8 aa, Homo sapiens
  Native (MOG_HUMAN)
RALVGDEV

SEQ ID NO: 124684 - protein, 11 aa, Homo sapiens
  Native (MOG_HUMAN)
QVSSSYAGQFR

SEQ ID NO: 124685 - protein, 11 aa, Homo sapiens
  Native (MOG_HUMAN)
LVLLAVLPVLL

SEQ ID NO: 124686 - protein, 10 aa, Homo sapiens
  Native (MOG_HUMAN)
RALVGDEVEL

SEQ ID NO: 124687 - protein, 9 aa, Homo sapiens
  Native (MOG_HUMAN)
LKVEDPFYW

SEQ ID NO: 124688 - protein, 8 aa, Homo sapiens
  Native (MOG_HUMAN)
LGPLVALI

SEQ ID NO: 124689 - protein, 11 aa, Homo sapiens
  Native (MOG_HUMAN)
KDAIGEGKVTL

SEQ ID NO: 124690 - protein, 9 aa, Homo sapiens
  Native (MOG_HUMAN)
ALIICYNWL

SEQ ID NO: 124691 - protein, 11 aa, Homo sapiens
  Native (MOG_HUMAN)
SDEGGFTCFFR

SEQ ID NO: 124692 - protein, 8 aa, Homo sapiens
  Native (MOG_HUMAN)
KVEDPFYW

SEQ ID NO: 124693 - protein, 9 aa, Homo sapiens
  Native (MOG_HUMAN)
CWKITLFVI

SEQ ID NO: 124694 - protein, 9 aa, Homo sapiens
  Native (MOG_HUMAN)
LVLLAVLPV

SEQ ID NO: 124695 - protein, 11 aa, Homo sapiens
  Native (MOG_HUMAN)
RPSLPSCLCSF

SEQ ID NO: 124696 - protein, 11 aa, Homo sapiens
  Native (MOG_HUMAN)
RVIGPRHPIRA

SEQ ID NO: 124697 - protein, 9 aa, Homo sapiens
  Native (MOG_HUMAN)
VEDPFYWVS

SEQ ID NO: 124698 - protein, 11 aa, Artificial Sequence
  Description of Artificial Sequence: Synthetic peptide
  Seed: AAMELKVEDPF (MOG_HUMAN)
  misc_feature (2)..(2): Xaa can be Ala, or Ser
  misc_feature (11)..(11): Xaa can be Tyr, or Phe
AXMELKVEDPX

SEQ ID NO: 124699 - protein, 8 aa, Artificial Sequence
  Description of Artificial Sequence: Synthetic peptide
  Seed: AEIENLHR (MOG_HUMAN)
  misc_feature (2)..(2): Xaa can be Ala, Ser, Val, Thr, Ile, Leu, Gln, Asp, Gly, Glu, or Asn
  misc_feature (8)..(8): Xaa can be Lys, Arg, Leu, Met, Val, Phe, or Ile
AXIENLHX

SEQ ID NO: 124700 - protein, 9 aa, Artificial Sequence
  Description of Artificial Sequence: Synthetic peptide
  Seed: AEIENLHRT (MOG_HUMAN)
  misc_feature (2)..(2): Xaa can be Glu, Asp, Gln, Ser, Ala, Asn, Thr, Lys, Gly, Val, Met, Pro, His, Ile, or Arg
  misc_feature (9)..(9): Xaa can be Trp, Leu, Met, Phe, Ile, Tyr, Pro, Val, Ala, Cys, Arg, Ser, Lys, Thr, Gly, Glu, Gln, His, Asp, or Asn
AXIENLHRX

SEQ ID NO: 124701 - protein, 10 aa, Artificial Sequence
  Description of Artificial Sequence: Synthetic peptide
  Seed: AEIENLHRTF (MOG_HUMAN)
  misc_feature (2)..(2): Xaa can be Glu, Arg, Gln, Asp, Ala, Met, Thr, Ser, His, Leu, Val, Ile, Asn, Tyr, Gly, Lys, Pro, Trp, Phe, or Cys
  misc_feature (10)..(10): Xaa can be Leu, Tyr, Phe, Trp, Met, Ile, Val, His, Cys, Ala, Thr, Lys, Arg, Gln, Pro, Asn, Ser, Asp, Glu, or Gly
AXIENLHRTX

SEQ ID NO: 124702 - protein, 9 aa, Artificial Sequence
  Description of Artificial Sequence: Synthetic peptide
  Seed: AGQFLEELR (MOG_HUMAN)
  misc_feature (2)..(2): Xaa can be Ala, Ser, Thr, Val, Gly, Asn, Ile, Asp, Phe, Leu, Gln, Met, Trp, Glu, Tyr, Pro, or Cys
  misc_feature (9)..(9): Xaa can be Lys, Arg, Tyr, Phe, Met, Leu, His, Ile, Trp, or Val
AXQFLEELX

SEQ ID NO: 124703 - protein, 10 aa, Artificial Sequence
  Description of Artificial Sequence: Synthetic peptide
  Seed: AGQFRVIGPR (MOG_HUMAN)
  misc_feature (2)..(2): Xaa can be Ala, Asn, Tyr, Phe, Arg, Cys, Thr, Val, Gly, Met, Glu, Lys, His, Leu, Ser, Ile, Pro, Gln, Trp, or Asp
  misc_feature (10)..(10): Xaa can be Arg, or Lys
AXQFRVIGPX

SEQ ID NO: 124704 - protein, 9 aa, Artificial Sequence
  Description of Artificial Sequence: Synthetic peptide
  Seed: AIGEGKVTL (MOG_HUMAN)
  misc_feature (2)..(2): Xaa can be Arg, Pro, Ala, Glu, Met, Gln, Tyr, Leu, Val, Ser, Asp, Phe, Thr, Ile, Gly, Asn, Trp, Cys, His, or Lys
  misc_feature (9)..(9): Xaa can be Ile, Met, Phe, Leu, Tyr, Val, Arg, Trp, Lys, Ala, His, Cys, Thr, Pro, Gln, Ser, Asn, Gly, or Glu
AXGEGKVTX

SEQ ID NO: 124705 - protein, 10 aa, Artificial Sequence
  Description of Artificial Sequence: Synthetic peptide
  Seed: AIGEGKVTLR (MOG_HUMAN)
  misc_feature (2)..(2): Xaa can be Ala, Val, Ser, Thr, Met, Ile, Gln, Leu, Cys, Gly, Glu, Phe, Pro, Tyr, Asn, Asp, Trp, or Ly s
  misc_feature (10)..(10): Xaa can be Tyr, Lys, Arg, Phe, Leu, Met, Trp, His, Val, Ile, or Ala
AXGEGKVTLX

SEQ ID NO: 124706 - protein, 11 aa, Artificial Sequence
  Description of Artificial Sequence: Synthetic peptide
  Seed: AIGEGKVTLRI (MOG_HUMAN)
  misc_feature (2)..(2): Xaa can be Gln, Leu, Met, Ile, Val, Glu, or Ala
  misc_feature (11)..(11): Xaa can be Trp, Phe, Leu, Ile, Val, Met, Tyr, or Ala
AXGEGKVTLRX

SEQ ID NO: 124707 - protein, 8 aa, Artificial Sequence
  Description of Artificial Sequence: Synthetic peptide
  Seed: ALIICYNW (MOG_HUMAN)
  misc_feature (2)..(2): Xaa can be Ser, Gly, Asp, Ile, Asn, Phe, Met, Ala, Pro, Cys, Thr, Leu, Val, or Gln
  misc_feature (8)..(8): Xaa can be Trp, or Phe
AXIICYNX

SEQ ID NO: 124708 - protein, 9 aa, Artificial Sequence
  Description of Artificial Sequence: Synthetic peptide
  Seed: ALIICYNWL (MOG_HUMAN)
  misc_feature (2)..(2): Xaa can be Leu, Met, Ile, Gln, Val, Thr, Ala, or Ser
  misc_feature (9)..(9): Xaa can be Val, Leu, Ile, Ala, or Met
AXIICYNWX

SEQ ID NO: 124709 - protein, 11 aa, Artificial Sequence
  Description of Artificial Sequence: Synthetic peptide
  Seed: ALIICYNWLHR (MOG_HUMAN)
  misc_feature (2)..(2): Xaa can be Tyr, Ile, Val, Arg, Thr, Gln, Phe, Lys, Leu, Met, Trp, Ser, Cys, Pro, His, Ala, Asn, Gly, Asp, or Glu
  misc_feature (11)..(11): Xaa can be Arg, or Lys
AXIICYNWLHX

SEQ ID NO: 124710 - protein, 9 aa, Artificial Sequence
  Description of Artificial Sequence: Synthetic peptide
  Seed: ALVGDEVEL (MOG_HUMAN)
  misc_feature (2)..(2): Xaa can be Gln, Ala, Ile, Val, Leu, Thr, Met, Ser, Gly, Arg, His, Phe, Asn, Glu, Pro, Tyr, Lys, Asp, Cys, or Trp
  misc_feature (9)..(9): Xaa can be Leu, Tyr, Met, Lys, Phe, Arg, Trp, Val, Ile, His, Ala, Gln, Cys, or Thr
AXVGDEVEX

SEQ ID NO: 124711 - protein, 10 aa, Artificial Sequence
  Description of Artificial Sequence: Synthetic peptide
  Seed: AMELKVEDPF (MOG_HUMAN)
  misc_feature (2)..(2): Xaa can be Gln, Leu, Glu, Met, Val, Ser, Lys, Asn, Ile, Phe, Cys, Trp, Arg, Thr, His, Gly, Asp, Ala, Pro, or Tyr
  misc_feature (10)..(10): Xaa can be Met, Leu, Ile, Phe, Tyr, or Val
AXELKVEDPX

SEQ ID NO: 124712 - protein, 11 aa, Artificial Sequence
  Description of Artificial Sequence: Synthetic peptide
  Seed: AMELKVEDPFY (MOG_HUMAN)
  misc_feature (2)..(2): Xaa can be Thr, Ser, Ile, Val, Met, Ala, or Leu
  misc_feature (11)..(11): Xaa can be Tyr, Lys, or Arg
AXELKVEDPFX

SEQ ID NO: 124713 - protein, 10 aa, Artificial Sequence
  Description of Artificial Sequence: Synthetic peptide
  Seed: APEYRGRTEL (MOG_HUMAN)
  misc_feature (2)..(2): Xaa can be Pro, Tyr, Cys, Val, Arg, Leu, Glu, Phe, Gln, Met, Trp, Asn, Ser, Ala, His, Gly, Asp, Lys, Thr, or Ile
  misc_feature (10)..(10): Xaa can be Met, Leu, Val, Ile, Phe, Ala, Tyr, Cys, Gly, Thr, Ser, or Trp
AXEYRGRTEX

SEQ ID NO: 124714 - protein, 11 aa, Artificial Sequence
  Description of Artificial Sequence: Synthetic peptide
  Seed: APEYRGRTELL (MOG_HUMAN)
  misc_feature (2)..(2): Xaa can be , or Pro
  misc_feature (11)..(11): Xaa can be Tyr, Asn, Pro, His, Trp, Phe, Ala, Leu, Arg, Ile, Gly, Met, Asp, Cys, Ser, Glu, Lys, Gln, Thr, or Val
AXEYRGRTELX

SEQ ID NO: 124715 - protein, 8 aa, Artificial Sequence
  Description of Artificial Sequence: Synthetic peptide
  Seed: ASLSRPSL (MOG_HUMAN)
  misc_feature (2)..(2): Xaa can be Ala, Ser, Thr, Gln, Pro, Val, Gly, Ile, Glu, Asn, Asp, Met, Leu, or His
  misc_feature (8)..(8): Xaa can be Leu, Ile, Val, Phe, Met, or Tyr
AXLSRPSX

SEQ ID NO: 124716 - protein, 8 aa, Artificial Sequence
  Description of Artificial Sequence: Synthetic peptide
  Seed: ATGMEVGW (MOG_HUMAN)
  misc_feature (2)..(2): Xaa can be Thr, Ser, or Ala
  misc_feature (8)..(8): Xaa can be , or Trp
AXGMEVGX

SEQ ID NO: 124717 - protein, 9 aa, Artificial Sequence
  Description of Artificial Sequence: Synthetic peptide
  Seed: ATGMEVGWY (MOG_HUMAN)
  misc_feature (2)..(2): Xaa can be Thr, Ala, Ser, Ile, Val, Phe, Trp, Gln, Met, Gly, Leu, or Tyr
  misc_feature (9)..(9): Xaa can be Tyr, Lys, or Arg
AXGMEVGWX

SEQ ID NO: 124718 - protein, 10 aa, Artificial Sequence
  Description of Artificial Sequence: Synthetic peptide
  Seed: ATGMEVGWYR (MOG_HUMAN)
  misc_feature (2)..(2): Xaa can be Met, Thr, Ser, Ile, Val, Glu, Tyr, Asp, Ala, Cys, Asn, Leu, Trp, Phe, Gln, Gly, Lys, His, Pro, or Arg
  misc_feature (10)..(10): Xaa can be Arg, Lys, Tyr, His, Val, Leu, or Met
AXGMEVGWYX

SEQ ID NO: 124719 - protein, 11 aa, Artificial Sequence
  Description of Artificial Sequence: Synthetic peptide
  Seed: ATGMEVGWYRP (MOG_HUMAN)
  misc_feature (2)..(2): Xaa can be Leu, Trp, Ala, Gln, Thr, Ile, Val, Arg, Tyr, Phe, Ser, Met, Lys, Pro, Cys, Asp, Gly, Glu, His, or Asn
  misc_feature (11)..(11): Xaa can be Arg, Lys, Pro, Asp, Glu, Met, Gln, Val, Ile, Asn, Gly, His, Phe, Cys, Ser, Thr, Tyr, Leu, Ala, or Trp
AXGMEVGWYRX

SEQ ID NO: 124720 - protein, 8 aa, Artificial Sequence
  Description of Artificial Sequence: Synthetic peptide
  Seed: AVLPVLLL (MOG_HUMAN)
  misc_feature (2)..(2): Xaa can be Gln, Ser, Thr, Ala, Glu, Gly, Asn, Pro, Met, Leu, Ile, Asp, Val, His, or Lys
  misc_feature (8)..(8): Xaa can be Val, Ile, Leu, Met, Phe, Tyr, Thr, Cys, or Ala
AXLPVLLX

SEQ ID NO: 124721 - protein, 10 aa, Artificial Sequence
  Description of Artificial Sequence: Synthetic peptide
  Seed: AVLPVLLLQI (MOG_HUMAN)
  misc_feature (2)..(2): Xaa can be Gln, Leu, Met, Ile, Val, Glu, Thr, Asn, Cys, Lys, Ser, Arg, Trp, Ala, Phe, Gly, His, Tyr, Asp, or Pro
  misc_feature (10)..(10): Xaa can be Leu, Ile, Val, Ala, Met, Thr, Phe, Cys, Trp, or Ser
AXLPVLLLQX

SEQ ID NO: 124722 - protein, 8 aa, Artificial Sequence
  Description of Artificial Sequence: Synthetic peptide
  Seed: CFFRDHSY (MOG_HUMAN)
  misc_feature (2)..(2): Xaa can be Tyr, Phe, Trp, Met, Gln, Ala, Ile, Thr, Leu, Gly, Val, Pro, Ser, or Glu
  misc_feature (8)..(8): Xaa can be Tyr, Phe, Met, Leu, or Ile
CXFRDHSX

SEQ ID NO: 124723 - protein, 9 aa, Artificial Sequence
  Description of Artificial Sequence: Synthetic peptide
  Seed: CLCSFLLLL (MOG_HUMAN)
  misc_feature (2)..(2): Xaa can be Leu, Met, Thr, Ser, Ala, Ile, Gln, Val, Arg, Asn, Gly, Phe, Glu, Cys, Tyr, Trp, Lys, Asp, Pro, or His
  misc_feature (9)..(9): Xaa can be Phe, Trp, Tyr, Arg, Leu, Lys, Val, Ile, Met, Ala, Thr, Cys, or His
CXCSFLLLX

SEQ ID NO: 124724 - protein, 10 aa, Artificial Sequence
  Description of Artificial Sequence: Synthetic peptide
  Seed: CLCSFLLLLL (MOG_HUMAN)
  misc_feature (2)..(2): Xaa can be Met, Leu, Ile, Val, Thr, Gln, Ala, Ser, Gly, Phe, Asn, Trp, or Tyr
  misc_feature (10)..(10): Xaa can be Lys, Arg, Leu, Ile, Ala, Val, Met, Tyr, Thr, Phe, or Cys
CXCSFLLLLX

SEQ ID NO: 124725 - protein, 9 aa, Artificial Sequence
  Description of Artificial Sequence: Synthetic peptide
  Seed: CLQYRLRGK (MOG_HUMAN)
  misc_feature (2)..(2): Xaa can be Met, Leu, Tyr, Gln, Val, Phe, Ile, Ser, Thr, Trp, Asn, Gly, or Ala
  misc_feature (9)..(9): Xaa can be Arg, or Lys
CXQYRLRGX

SEQ ID NO: 124726 - protein, 11 aa, Artificial Sequence
  Description of Artificial Sequence: Synthetic peptide
  Seed: CLQYRLRGKLR (MOG_HUMAN)
  misc_feature (2)..(2): Xaa can be Val, Thr, Arg, Ser, Lys, Ile, Leu, Phe, Gln, Met, Tyr, or Ala
  misc_feature (11)..(11): Xaa can be , or Arg
CXQYRLRGKLX

SEQ ID NO: 124727 - protein, 9 aa, Artificial Sequence
  Description of Artificial Sequence: Synthetic peptide
  Seed: CRISPGKNA (MOG_HUMAN)
  misc_feature (2)..(2): Xaa can be Arg, His, or Gln
  misc_feature (9)..(9): Xaa can be Ala, Leu, Ile, Pro, Cys, Met, Val, Trp, Tyr, Thr, or Phe
CXISPGKNX

SEQ ID NO: 124728 - protein, 10 aa, Artificial Sequence
  Description of Artificial Sequence: Synthetic peptide
  Seed: CRISPGKNAT (MOG_HUMAN)
  misc_feature (2)..(2): Xaa can be Arg, His, Gln, Pro, or Lys
  misc_feature (10)..(10): Xaa can be Ala, Val, Met, Leu, Phe, Cys, Ile, Ser, Gly, Thr, Pro, Lys, Arg, Tyr, or Trp
CXISPGKNAX

SEQ ID NO: 124729 - protein, 11 aa, Artificial Sequence
  Description of Artificial Sequence: Synthetic peptide
  Seed: CRISPGKNATG (MOG_HUMAN)
  misc_feature (2)..(2): Xaa can be Arg, His, Gln, or Lys
  misc_feature (11)..(11): Xaa can be Phe, Leu, Met, Ala, Lys, Pro, Arg, Tyr, Gly, Trp, Ile, Ser, Thr, Val, or Cys
CXISPGKNATX

SEQ ID NO: 124730 - protein, 8 aa, Artificial Sequence
  Description of Artificial Sequence: Synthetic peptide
  Seed: CSFLLLLL (MOG_HUMAN)
  misc_feature (2)..(2): Xaa can be Ala, Gln, Met, Ser, Gly, Glu, Asn, His, Asp, or Thr
  misc_feature (8)..(8): Xaa can be Val, Ile, Leu, Phe, Met, Ala, or Tyr
CXFLLLLX

SEQ ID NO: 124731 - protein, 9 aa, Artificial Sequence
  Description of Artificial Sequence: Synthetic peptide
  Seed: CSFLLLLLL (MOG_HUMAN)
  misc_feature (2)..(2): Xaa can be Arg, Gln, Met, Leu, Ser, Ile, Val, Thr, Ala, Gly, Asn, Glu, Cys, His, Pro, Asp, Tyr, Trp, Phe, or Lys
  misc_feature (9)..(9): Xaa can be Trp, Val, Phe, Leu, Ile, Tyr, Met, Ala, Cys, Lys, Thr, His, or Arg
CXFLLLLLX

SEQ ID NO: 124732 - protein, 9 aa, Artificial Sequence
  Description of Artificial Sequence: Synthetic peptide
  Seed: CWKITLFVI (MOG_HUMAN)
  misc_feature (2)..(2): Xaa can be Tyr, Trp, Phe, or Met
  misc_feature (9)..(9): Xaa can be Phe, Leu, Ile, Trp, Met, Tyr, or Val
CXKITLFVX

SEQ ID NO: 124733 - protein, 8 aa, Artificial Sequence
  Description of Artificial Sequence: Synthetic peptide
  Seed: CYNWLHRR (MOG_HUMAN)
  misc_feature (2)..(2): Xaa can be Thr, Ser, Leu, Trp, Ile, Phe, Gln, Met, Val, or Tyr
  misc_feature (8)..(8): Xaa can be , or Arg
CXNWLHRX

SEQ ID NO: 124734 - protein, 9 aa, Artificial Sequence
  Description of Artificial Sequence: Synthetic peptide
  Seed: CYNWLHRRL (MOG_HUMAN)
  misc_feature (2)..(2): Xaa can be Tyr, Arg, Trp, Phe, or Met
  misc_feature (9)..(9): Xaa can be Phe, Tyr, Leu, Met, Ile, Trp, or Val
CXNWLHRRX

SEQ ID NO: 124735 - protein, 9 aa, Artificial Sequence
  Description of Artificial Sequence: Synthetic peptide
  Seed: DAIGEGKVT (MOG_HUMAN)
  misc_feature (2)..(2): Xaa can be Ala, Ser, Pro, Gly, Thr, Val, or Ile
  misc_feature (9)..(9): Xaa can be Ile, Val, Leu, Met, Ala, Cys, Phe, or Thr
DXIGEGKVX

SEQ ID NO: 124736 - protein, 10 aa, Artificial Sequence
  Description of Artificial Sequence: Synthetic peptide
  Seed: DAIGEGKVTL (MOG_HUMAN)
  misc_feature (2)..(2): Xaa can be Val, Thr, Ala, Ile, Pro, Gln, Ser, Gly, Met, Leu, Glu, Asn, Cys, Trp, Asp, Phe, Lys, or Ty r
  misc_feature (10)..(10): Xaa can be Lys, Arg, Trp, Val, Tyr, Phe, Ile, Leu, Met, Ala, His, Gln, or Cys
DXIGEGKVTX

SEQ ID NO: 124737 - protein, 11 aa, Artificial Sequence
  Description of Artificial Sequence: Synthetic peptide
  Seed: DAIGEGKVTLR (MOG_HUMAN)
  misc_feature (2)..(2): Xaa can be Thr, Val, Ile, Ala, Leu, Ser, Met, Gln, Tyr, His, Cys, Asp, Glu, Lys, Trp, Phe, Gly, Pro, Asn, or Arg
  misc_feature (11)..(11): Xaa can be Arg, Lys, Tyr, His, Gln, Phe, Met, Leu, Trp, Glu, Asn, Ala, Val, or Ile
DXIGEGKVTLX

SEQ ID NO: 124738 - protein, 8 aa, Artificial Sequence
  Description of Artificial Sequence: Synthetic peptide
  Seed: DEGGFTCF (MOG_HUMAN)
  misc_feature (2)..(2): Xaa can be , or Glu
  misc_feature (8)..(8): Xaa can be Tyr, Trp, Phe, Leu, or Met
DXGGFTCX

SEQ ID NO: 124739 - protein, 9 aa, Artificial Sequence
  Description of Artificial Sequence: Synthetic peptide
  Seed: DEGGFTCFF (MOG_HUMAN)
  misc_feature (2)..(2): Xaa can be Glu, or Gln
  misc_feature (9)..(9): Xaa can be Trp, Ile, Met, Tyr, Phe, Leu, or His
DXGGFTCFX

SEQ ID NO: 124740 - protein, 10 aa, Artificial Sequence
  Description of Artificial Sequence: Synthetic peptide
  Seed: DEGGFTCFFR (MOG_HUMAN)
  misc_feature (2)..(2): Xaa can be Thr, Val, Ile, Ala, His, Gln, Ser, Tyr, Leu, Asn, Glu, Met, Cys, Phe, Gly, Asp, Pro, Trp, Lys, or Arg
  misc_feature (10)..(10): Xaa can be Arg, Lys, Tyr, His, Met, Leu, or Gln
DXGGFTCFFX

SEQ ID NO: 124741 - protein, 8 aa, Artificial Sequence
  Description of Artificial Sequence: Synthetic peptide
  Seed: DEVELPCR (MOG_HUMAN)
  misc_feature (2)..(2): Xaa can be Glu, Asp, or Gln
  misc_feature (8)..(8): Xaa can be Phe, Tyr, Val, Arg, Lys, Met, Ile, His, Trp, Thr, Leu, or Ala
DXVELPCX

SEQ ID NO: 124742 - protein, 9 aa, Artificial Sequence
  Description of Artificial Sequence: Synthetic peptide
  Seed: DEVELPCRI (MOG_HUMAN)
  misc_feature (2)..(2): Xaa can be Glu, Gln, Asp, Ala, Ser, Leu, Met, Ile, Val, Asn, Gly, Lys, or Arg
  misc_feature (9)..(9): Xaa can be Val, Ile, Leu, Trp, Met, Tyr, Ala, Phe, Arg, Gly, Cys, Ser, Pro, His, or Thr
DXVELPCRX

SEQ ID NO: 124743 - protein, 9 aa, Artificial Sequence
  Description of Artificial Sequence: Synthetic peptide
  Seed: DGDQAPEYR (MOG_HUMAN)
  misc_feature (2)..(2): Xaa can be Phe, Ala, Tyr, Thr, Leu, Val, Met, Ile, Ser, Trp, Gly, Gln, Glu, Asn, Asp, Pro, Cys, or Ly s
  misc_feature (9)..(9): Xaa can be Tyr, Lys, Arg, Phe, Leu, Met, His, Trp, Ile, or Val
DXDQAPEYX

SEQ ID NO: 124744 - protein, 11 aa, Artificial Sequence
  Description of Artificial Sequence: Synthetic peptide
  Seed: DGDQAPEYRGR (MOG_HUMAN)
  misc_feature (2)..(2): Xaa can be Phe, Ile, Met, Ala, Ser, Trp, Tyr, Gly, Asn, Leu, Gln, Thr, Val, Asp, or Glu
  misc_feature (11)..(11): Xaa can be Lys, or Arg
DXDQAPEYRGX

SEQ ID NO: 124745 - protein, 8 aa, Artificial Sequence
  Description of Artificial Sequence: Synthetic peptide
  Seed: DHSYQEEA (MOG_HUMAN)
  misc_feature (2)..(2): Xaa can be , or His
  misc_feature (8)..(8): Xaa can be Ala, Ile, Leu, or Val
DXSYQEEX

SEQ ID NO: 124746 - protein, 9 aa, Artificial Sequence
  Description of Artificial Sequence: Synthetic peptide
  Seed: DHSYQEEAA (MOG_HUMAN)
  misc_feature (2)..(2): Xaa can be His, Arg, or Gln
  misc_feature (9)..(9): Xaa can be Met, Ala, Ile, Leu, Val, Thr, Cys, or Phe
DXSYQEEAX

SEQ ID NO: 124747 - protein, 10 aa, Artificial Sequence
  Description of Artificial Sequence: Synthetic peptide
  Seed: DHSYQEEAAM (MOG_HUMAN)
  misc_feature (2)..(2): Xaa can be , or His
  misc_feature (10)..(10): Xaa can be Phe, Met, or Leu
DXSYQEEAAX

SEQ ID NO: 124748 - protein, 9 aa, Artificial Sequence
  Description of Artificial Sequence: Synthetic peptide
  Seed: DPHFLRVPC (MOG_HUMAN)
  misc_feature (2)..(2): Xaa can be Pro, Ala, Met, Val, Ile, or Gly
  misc_feature (9)..(9): Xaa can be Ala, Val, Leu, Thr, Ser, Phe, Cys, Pro, Ile, or Met
DXHFLRVPX

SEQ ID NO: 124749 - protein, 10 aa, Artificial Sequence
  Description of Artificial Sequence: Synthetic peptide
  Seed: DPHFLRVPCW (MOG_HUMAN)
  misc_feature (2)..(2): Xaa can be , or Pro
  misc_feature (10)..(10): Xaa can be , or Trp
DXHFLRVPCX

SEQ ID NO: 124750 - protein, 9 aa, Artificial Sequence
  Description of Artificial Sequence: Synthetic peptide
  Seed: DQAPEYRGR (MOG_HUMAN)
  misc_feature (2)..(2): Xaa can be Val, Thr, Ile, Ala, Met, Leu, Ser, Gly, Glu, Pro, Tyr, Cys, Gln, Trp, Asp, Phe, Asn, Arg, Lys, or His
  misc_feature (9)..(9): Xaa can be Arg, Lys, Tyr, Met, Leu, Phe, His, Gln, Val, or Ile
DXAPEYRGX

SEQ ID NO: 124751 - protein, 10 aa, Artificial Sequence
  Description of Artificial Sequence: Synthetic peptide
  Seed: DQDGDQAPEY (MOG_HUMAN)
  misc_feature (2)..(2): Xaa can be Glu, Ala, Met, Pro, Thr, Val, Gln, Leu, Ile, Ser, Arg, Phe, Tyr, Gly, Lys, Trp, Asn, His, Asp, or Cys
  misc_feature (10)..(10): Xaa can be Tyr, Phe, Lys, Trp, Arg, Met, or Leu
DXDGDQAPEX

SEQ ID NO: 124752 - protein, 11 aa, Artificial Sequence
  Description of Artificial Sequence: Synthetic peptide
  Seed: DQDGDQAPEYR (MOG_HUMAN)
  misc_feature (2)..(2): Xaa can be Thr, Ile, Val, Leu, Met, Ser, Ala, Gln, Trp, Tyr, Phe, Gly, Glu, Asp, Asn, Cys, Lys, Pro, His, or Arg
  misc_feature (11)..(11): Xaa can be Lys, Tyr, Arg, Phe, Trp, His, or Met
DXDGDQAPEYX

SEQ ID NO: 124753 - protein, 8 aa, Artificial Sequence
  Description of Artificial Sequence: Synthetic peptide
  Seed: EAAMELKV (MOG_HUMAN)
  misc_feature (2)..(2): Xaa can be Ala, or Pro
  misc_feature (8)..(8): Xaa can be Val, Leu, or Ile
EXAMELKX

SEQ ID NO: 124754 - protein, 9 aa, Artificial Sequence
  Description of Artificial Sequence: Synthetic peptide
  Seed: EEAAMELKV (MOG_HUMAN)
  misc_feature (2)..(2): Xaa can be Glu, Asp, Gln, Met, Leu, Ser, Ala, Ile, Val, Lys, Gly, Arg, His, Asn, or Thr
  misc_feature (9)..(9): Xaa can be Trp, Ile, Val, Leu, Phe, Met, Tyr, Pro, Ala, Cys, His, Lys, Thr, Gly, Arg, Gln, or Ser
EXAAMELKX

SEQ ID NO: 124755 - protein, 9 aa, Artificial Sequence
  Description of Artificial Sequence: Synthetic peptide
  Seed: EGGFTCFFR (MOG_HUMAN)
  misc_feature (2)..(2): Xaa can be Ile, Ser, Ala, Val, Thr, Asp, Asn, Glu, Leu, Met, Gln, Phe, Tyr, Trp, Cys, Gly, Pro, Arg, Lys, or His
  misc_feature (9)..(9): Xaa can be Arg, Lys, His, or Tyr
EXGFTCFFX

SEQ ID NO: 124756 - protein, 9 aa, Artificial Sequence
  Description of Artificial Sequence: Synthetic peptide
  Seed: EGKVTLRIR (MOG_HUMAN)
  misc_feature (2)..(2): Xaa can be Thr, Val, Met, Ala, Phe, Trp, Ile, Ser, Tyr, Cys, Gln, Pro, Asp, Leu, Asn, Gly, His, or Gl u
  misc_feature (9)..(9): Xaa can be Arg, Lys, or Tyr
EXKVTLRIX

SEQ ID NO: 124757 - protein, 9 aa, Artificial Sequence
  Description of Artificial Sequence: Synthetic peptide
  Seed: EIENLHRTF (MOG_HUMAN)
  misc_feature (2)..(2): Xaa can be Ala, Val, Phe, Ser, Ile, Thr, Gln, Leu, Met, Tyr, Pro, Gly, Glu, Cys, Asn, Trp, Asp, or Hi s
  misc_feature (9)..(9): Xaa can be Trp, Tyr, Phe, Met, Leu, Ile, Val, or Lys
EXENLHRTX

SEQ ID NO: 124758 - protein, 9 aa, Artificial Sequence
  Description of Artificial Sequence: Synthetic peptide
  Seed: ELKVEDPFY (MOG_HUMAN)
  misc_feature (2)..(2): Xaa can be Gln, Leu, Val, Ala, Ile, Met, Trp, Glu, Tyr, Pro, Phe, Ser, Gly, or Thr
  misc_feature (9)..(9): Xaa can be Tyr, Phe, or Met
EXKVEDPFX

SEQ ID NO: 124759 - protein, 10 aa, Artificial Sequence
  Description of Artificial Sequence: Synthetic peptide
  Seed: ELKVEDPFYW (MOG_HUMAN)
  misc_feature (2)..(2): Xaa can be Ala, Thr, Ser, Phe, Asn, Ile, Met, Val, Pro, Cys, Leu, Gly, or Gln
  misc_feature (10)..(10): Xaa can be Trp, or Phe
EXKVEDPFYX

SEQ ID NO: 124760 - protein, 11 aa, Artificial Sequence
  Description of Artificial Sequence: Synthetic peptide
  Seed: ELLKDAIGEGK (MOG_HUMAN)
  misc_feature (2)..(2): Xaa can be Val, Thr, Ala, Ile, Ser, Met, Leu, Gly, Asn, Gln, Cys, Glu, Asp, or Phe
  misc_feature (11)..(11): Xaa can be Lys, Arg, Tyr, His, Phe, or Met
EXLKDAIGEGX

SEQ ID NO: 124761 - protein, 10 aa, Artificial Sequence
  Description of Artificial Sequence: Synthetic peptide
  Seed: ELPCRISPGK (MOG_HUMAN)
  misc_feature (2)..(2): Xaa can be Val, Ile, Thr, Gln, Gly, Ala, Asn, Met, Glu, Ser, Leu, Phe, Tyr, or Cys
  misc_feature (10)..(10): Xaa can be Lys, Arg, Tyr, Leu, or Met
EXPCRISPGX

SEQ ID NO: 124762 - protein, 9 aa, Artificial Sequence
  Description of Artificial Sequence: Synthetic peptide
  Seed: EVGWYRPPF (MOG_HUMAN)
  misc_feature (2)..(2): Xaa can be Thr, Val, Ile, Ala, Met, Gln, Ser, Leu, Gly, Pro, Asp, Phe, Asn, Glu, or Cys
  misc_feature (9)..(9): Xaa can be Arg, Tyr, Phe, Lys, Met, Trp, His, or Leu
EXGWYRPPX

SEQ ID NO: 124763 - protein, 11 aa, Artificial Sequence
  Description of Artificial Sequence: Synthetic peptide
  Seed: EVGWYRPPFSR (MOG_HUMAN)
  misc_feature (2)..(2): Xaa can be Leu, Ser, Tyr, Met, Arg, Val, Ala, Ile, Thr, Gly, Pro, Glu, Trp, Phe, Asp, His, Cys, Gln, Asn, or Lys
  misc_feature (11)..(11): Xaa can be Arg, or Lys
EXGWYRPPFSX

SEQ ID NO: 124764 - protein, 8 aa, Artificial Sequence
  Description of Artificial Sequence: Synthetic peptide
  Seed: EYRGRTEL (MOG_HUMAN)
  misc_feature (2)..(2): Xaa can be Ala, Met, Leu, Pro, Ile, Tyr, Gln, Val, Gly, Phe, Ser, Asn, Cys, His, or Thr
  misc_feature (8)..(8): Xaa can be Leu, Ile, Met, Phe, Val, or Tyr
EXRGRTEX

SEQ ID NO: 124765 - protein, 9 aa, Artificial Sequence
  Description of Artificial Sequence: Synthetic peptide
  Seed: EYRGRTELL (MOG_HUMAN)
  misc_feature (2)..(2): Xaa can be Met, Leu, Pro, Tyr, Arg, Phe, Gln, Val, Ile, Ala, Trp, Ser, Gly, His, Thr, Asn, Cys, Glu, Asp, or Lys
  misc_feature (9)..(9): Xaa can be Leu, Met, Ile, Val, Phe, Tyr, Ala, Trp, or Cys
EXRGRTELX

SEQ ID NO: 124766 - protein, 10 aa, Artificial Sequence
  Description of Artificial Sequence: Synthetic peptide
  Seed: EYRGRTELLK (MOG_HUMAN)
  misc_feature (2)..(2): Xaa can be Thr, Met, Leu, Val, Tyr, Ile, Phe, Ser, Trp, Glu, Asp, Gln, Asn, Gly, Ala, or Cys
  misc_feature (10)..(10): Xaa can be Arg, or Lys
EXRGRTELLX

SEQ ID NO: 124767 - protein, 8 aa, Artificial Sequence
  Description of Artificial Sequence: Synthetic peptide
  Seed: FDPHFLRV (MOG_HUMAN)
  misc_feature (2)..(2): Xaa can be Gln, Glu, Asp, Met, Ser, Ala, Pro, Gly, Asn, or Val
  misc_feature (8)..(8): Xaa can be Ile, Val, Leu, Met, or Phe
FXPHFLRX

SEQ ID NO: 124768 - protein, 10 aa, Artificial Sequence
  Description of Artificial Sequence: Synthetic peptide
  Seed: FDPHFLRVPC (MOG_HUMAN)
  misc_feature (2)..(2): Xaa can be Gly, His, Tyr, Met, Lys, Arg, Gln, Ala, Val, Trp, Phe, Pro, Ile, Leu, Glu, Thr, Cys, Asp, Ser, or Asn
  misc_feature (10)..(10): Xaa can be Leu, Met, Thr, Tyr, Phe, Ala, Pro, Trp, Cys, Val, Ser, Gly, or Ile
FXPHFLRVPX

SEQ ID NO: 124769 - protein, 8 aa, Artificial Sequence
  Description of Artificial Sequence: Synthetic peptide
  Seed: FLCLQYRL (MOG_HUMAN)
  misc_feature (2)..(2): Xaa can be Met, Leu, or Ile
  misc_feature (8)..(8): Xaa can be Val, Met, Ile, Ala, or Leu
FXCLQYRX

SEQ ID NO: 124770 - protein, 9 aa, Artificial Sequence
  Description of Artificial Sequence: Synthetic peptide
  Seed: FLCLQYRLR (MOG_HUMAN)
  misc_feature (2)..(2): Xaa can be Met, Ser, Ala, Ile, Val, Tyr, Leu, Gln, Thr, Phe, Trp, Asn, Glu, Pro, Cys, His, Asp, or Gl y
  misc_feature (9)..(9): Xaa can be Arg, Lys, or Tyr
FXCLQYRLX

SEQ ID NO: 124771 - protein, 9 aa, Artificial Sequence
  Description of Artificial Sequence: Synthetic peptide
  Seed: FLEELRNPF (MOG_HUMAN)
  misc_feature (2)..(2): Xaa can be Pro, Tyr, Leu, Ala, Met, Phe, Ser, Ile, Arg, Thr, Val, Gly, Gln, Glu, Trp, Asn, Cys, His, Asp, or Lys
  misc_feature (9)..(9): Xaa can be Met, Tyr, Phe, Leu, Val, Ile, Lys, Trp, His, Arg, Ala, Cys, Thr, Asn, Ser, Glu, Gln, or Gl y
FXEELRNPX

SEQ ID NO: 124772 - protein, 9 aa, Artificial Sequence
  Description of Artificial Sequence: Synthetic peptide
  Seed: FLLLLLLQV (MOG_HUMAN)
  misc_feature (2)..(2): Xaa can be Met, Leu, Gln, Thr, Ile, Ala, Ser, Val, Asn, Gly, Glu, Phe, Asp, Cys, Tyr, or Trp
  misc_feature (9)..(9): Xaa can be Val, Arg, Leu, Ile, Lys, Met, Tyr, Ala, Phe, Thr, Ser, His, Cys, Pro, or Gly
FXLLLLLQX

SEQ ID NO: 124773 - protein, 10 aa, Artificial Sequence
  Description of Artificial Sequence: Synthetic peptide
  Seed: FLLLLLLQVS (MOG_HUMAN)
  misc_feature (2)..(2): Xaa can be Leu, Met, Gln, Ile, Val, Thr, His, Arg, Asp, Glu, Tyr, Ala, Phe, Lys, Pro, Trp, Ser, Cys, Gly, or Asn
  misc_feature (10)..(10): Xaa can be Ile, Ala, Leu, Val, Met, Thr, Gly, Ser, Trp, Tyr, Asp, Arg, Lys, His, Pro, Phe, Cys, Gln, Asn, or Glu
FXLLLLLQVX

SEQ ID NO: 124774 - protein, 9 aa, Artificial Sequence
  Description of Artificial Sequence: Synthetic peptide
  Seed: FLRVPCWKI (MOG_HUMAN)
  misc_feature (2)..(2): Xaa can be Met, Leu, Val, Ile, Thr, Gln, Ser, or Ala
  misc_feature (9)..(9): Xaa can be Val, Ile, Leu, Ala, Thr, or Met
FXRVPCWKX

SEQ ID NO: 124775 - protein, 11 aa, Artificial Sequence
  Description of Artificial Sequence: Synthetic peptide
  Seed: FLRVPCWKITL (MOG_HUMAN)
  misc_feature (2)..(2): Xaa can be Leu, Met, Gln, Val, Ile, or Thr
  misc_feature (11)..(11): Xaa can be Val, Ile, Ala, Met, or Leu
FXRVPCWKITX

SEQ ID NO: 124776 - protein, 10 aa, Artificial Sequence
  Description of Artificial Sequence: Synthetic peptide
  Seed: FRDHSYQEEA (MOG_HUMAN)
  misc_feature (2)..(2): Xaa can be , or Arg
  misc_feature (10)..(10): Xaa can be Leu, Ala, Val, or Ile
FXDHSYQEEX

SEQ ID NO: 124777 - protein, 9 aa, Artificial Sequence
  Description of Artificial Sequence: Synthetic peptide
  Seed: FRVIGPRHP (MOG_HUMAN)
  misc_feature (2)..(2): Xaa can be His, Arg, Gln, Pro, Glu, or Lys
  misc_feature (9)..(9): Xaa can be Ala, Leu, Val, Ile, Cys, Met, Thr, Pro, Gly, Ser, or Phe
FXVIGPRHX

SEQ ID NO: 124778 - protein, 10 aa, Artificial Sequence
  Description of Artificial Sequence: Synthetic peptide
  Seed: FRVIGPRHPI (MOG_HUMAN)
  misc_feature (2)..(2): Xaa can be Arg, Leu, Met, His, Thr, Ala, Gln, Phe, Tyr, Trp, Cys, Asn, Lys, Gly, Asp, Ile, Val, Pro, Glu, or Ser
  misc_feature (10)..(10): Xaa can be Ala, Leu, Met, Ile, Val, Phe, Tyr, Cys, Thr, Ser, Trp, Arg, or Lys
FXVIGPRHPX

SEQ ID NO: 124779 - protein, 11 aa, Artificial Sequence
  Description of Artificial Sequence: Synthetic peptide
  Seed: FRVIGPRHPIR (MOG_HUMAN)
  misc_feature (2)..(2): Xaa can be Ala, Met, Cys, Tyr, Thr, His, Phe, Arg, Val, Lys, Ser, or Ile
  misc_feature (11)..(11): Xaa can be , or Arg
FXVIGPRHPIX

SEQ ID NO: 124780 - protein, 8 aa, Artificial Sequence
  Description of Artificial Sequence: Synthetic peptide
  Seed: FSDEGGFT (MOG_HUMAN)
  misc_feature (2)..(2): Xaa can be Ala, Ser, Val, Ile, Thr, Leu, Gly, Met, Gln, Phe, Asn, Cys, Pro, Trp, Glu, Tyr, His, Asp, Arg, or Lys
  misc_feature (8)..(8): Xaa can be Met, Ile, Leu, Phe, Val, Tyr, Trp, Ala, Cys, Thr, Lys, Gln, Arg, or Ser
FXDEGGFX

SEQ ID NO: 124781 - protein, 9 aa, Artificial Sequence
  Description of Artificial Sequence: Synthetic peptide
  Seed: FSDEGGFTC (MOG_HUMAN)
  misc_feature (2)..(2): Xaa can be Trp, Tyr, Val, Met, Ser, Thr, Phe, Ala, Leu, Ile, Gly, Gln, Cys, Arg, Asn, Asp, His, Pro, Glu, or Lys
  misc_feature (9)..(9): Xaa can be Met, Cys, Val, Trp, Tyr, Ile, Lys, Phe, Ala, Leu, Arg, Thr, His, Ser, Pro, Gln, Gly, Glu, Asn, or Asp
FXDEGGFTX

SEQ ID NO: 124782 - protein, 10 aa, Artificial Sequence
  Description of Artificial Sequence: Synthetic peptide
  Seed: FSDEGGFTCF (MOG_HUMAN)
  misc_feature (2)..(2): Xaa can be Ala, Trp, Met, Tyr, Val, Ser, Phe, Ile, Thr, Leu, Pro, Gly, Cys, Gln, Asn, Arg, Glu, His, Lys, or Asp
  misc_feature (10)..(10): Xaa can be Lys, Ile, Phe, Trp, Met, Tyr, Val, Leu, Arg, Ala, Cys, Thr, His, Ser, Gly, Pro, Gln, Asn, Glu, or Asp
FXDEGGFTCX

SEQ ID NO: 124783 - protein, 11 aa, Artificial Sequence
  Description of Artificial Sequence: Synthetic peptide
  Seed: FSDEGGFTCFF (MOG_HUMAN)
  misc_feature (2)..(2): Xaa can be Ala, Thr, Val, Ser, Ile, Gly, Met, Leu, Tyr, Phe, Cys, Trp, Gln, Asn, Glu, His, Asp, Pro, Arg, or Lys
  misc_feature (11)..(11): Xaa can be Leu, Met, Phe, Tyr, Trp, Ile, Lys, Val, Arg, His, Cys, Ala, Thr, Gln, Glu, Ser, Gly, Asn, or Pro
FXDEGGFTCFX

SEQ ID NO: 124784 - protein, 8 aa, Artificial Sequence
  Description of Artificial Sequence: Synthetic peptide
  Seed: FSRVVHLY (MOG_HUMAN)
  misc_feature (2)..(2): Xaa can be Ala, Ser, Gln, Gly, Pro, Thr, Val, Ile, Leu, Cys, Asp, Glu, Met, Asn, Phe, Tyr, Lys, Arg, Trp, or His
  misc_feature (8)..(8): Xaa can be Tyr, Phe, Trp, Leu, Met, Ile, Val, His, or Ala
FXRVVHLX

SEQ ID NO: 124785 - protein, 9 aa, Artificial Sequence
  Description of Artificial Sequence: Synthetic peptide
  Seed: FSRVVHLYR (MOG_HUMAN)
  misc_feature (2)..(2): Xaa can be Ser, Thr, Val, Met, Ile, Ala, Leu, Tyr, Gln, Gly, Phe, Asn, Trp, Cys, His, Lys, Arg, Asp, Glu, or Pro
  misc_feature (9)..(9): Xaa can be Lys, Arg, Ala, Val, Ile, Leu, Ser, Tyr, His, Gly, Met, Thr, Pro, Gln, Asn, or Phe
FXRVVHLYX

SEQ ID NO: 124786 - protein, 10 aa, Artificial Sequence
  Description of Artificial Sequence: Synthetic peptide
  Seed: FSRVVHLYRN (MOG_HUMAN)
  misc_feature (2)..(2): Xaa can be Val, Met, Ile, Thr, Gln, Tyr, Phe, Ser, Leu, Trp, Ala, Asn, Gly, or His
  misc_feature (10)..(10): Xaa can be Arg, Lys, Tyr, His, Glu, Trp, Thr, Cys, Val, Met, Ser, Pro, Asp, Ala, Gln, Leu, Phe, Asn, Ile, or Gly
FXRVVHLYRX

SEQ ID NO: 124787 - protein, 10 aa, Artificial Sequence
  Description of Artificial Sequence: Synthetic peptide
  Seed: FTCFFRDHSY (MOG_HUMAN)
  misc_feature (2)..(2): Xaa can be Pro, Ala, Ser, Thr, Gln, Met, Gly, Val, Ile, Leu, Lys, Phe, Asn, Tyr, Arg, Trp, His, Glu, Cys, or Asp
  misc_feature (10)..(10): Xaa can be Tyr, Phe, Trp, Arg, Met, Lys, Leu, Ile, His, Val, or Ala
FXCFFRDHSX

SEQ ID NO: 124788 - protein, 10 aa, Artificial Sequence
  Description of Artificial Sequence: Synthetic peptide
  Seed: FVIVPVLGPL (MOG_HUMAN)
  misc_feature (2)..(2): Xaa can be Thr, Met, Val, Gln, Leu, Ile, Ser, Ala, Gly, His, Pro, Cys, Trp, Glu, Arg, Asn, Phe, Tyr, Lys, or Asp
  misc_feature (10)..(10): Xaa can be Tyr, Ala, Val, Met, Lys, Thr, Phe, Ser, Arg, Leu, Ile, His, Cys, Gly, Pro, Gln, Trp, or Gl u
FXIVPVLGPX

SEQ ID NO: 124789 - protein, 11 aa, Artificial Sequence
  Description of Artificial Sequence: Synthetic peptide
  Seed: FVIVPVLGPLV (MOG_HUMAN)
  misc_feature (2)..(2): Xaa can be Leu, Met, Gln, Tyr, Ala, Thr, Ser, Ile, Val, or Phe
  misc_feature (11)..(11): Xaa can be Val, Ile, Met, Ala, Phe, Thr, Leu, Gly, Asp, Tyr, Gln, Cys, Lys, Ser, Arg, His, Trp, Asn, Pro, or Glu
FXIVPVLGPLX

SEQ ID NO: 124790 - protein, 8 aa, Artificial Sequence
  Description of Artificial Sequence: Synthetic peptide
  Seed: FYWVSPGV (MOG_HUMAN)
  misc_feature (2)..(2): Xaa can be Tyr, Phe, or Trp
  misc_feature (8)..(8): Xaa can be Met, Tyr, Phe, Leu, Val, or Ile
FXWVSPGX

SEQ ID NO: 124791 - protein, 9 aa, Artificial Sequence
  Description of Artificial Sequence: Synthetic peptide
  Seed: FYWVSPGVL (MOG_HUMAN)
  misc_feature (2)..(2): Xaa can be Gln, Tyr, Ala, Arg, Met, Phe, Ser, Thr, Val, Lys, Glu, Ile, Leu, Gly, Trp, Asn, Cys, His, Pro, or Asp
  misc_feature (9)..(9): Xaa can be Tyr, Met, Leu, Phe, Ile, Lys, Trp, Val, Arg, His, Ala, Cys, Thr, Ser, Gln, Gly, Asn, or Pr o
FXWVSPGVX

SEQ ID NO: 124792 - protein, 10 aa, Artificial Sequence
  Description of Artificial Sequence: Synthetic peptide
  Seed: FYWVSPGVLV (MOG_HUMAN)
  misc_feature (2)..(2): Xaa can be Tyr, Phe, Trp, His, Arg, Met, Lys, Ala, Gly, Ser, Val, Pro, Leu, Thr, Ile, Gln, Asn, Asp, Glu, or Cys
  misc_feature (10)..(10): Xaa can be Trp, Phe, Leu, Met, Tyr, Ile, Val, Lys, Ser, His, Thr, Gln, Glu, Gly, Asp, Asn, Arg, Cys, Ala, or Pro
FXWVSPGVLX

SEQ ID NO: 124793 - protein, 11 aa, Artificial Sequence
  Description of Artificial Sequence: Synthetic peptide
  Seed: FYWVSPGVLVL (MOG_HUMAN)
  misc_feature (2)..(2): Xaa can be Arg, Tyr, Trp, Phe, His, Gln, Met, Lys, Val, Ile, or Ser
  misc_feature (11)..(11): Xaa can be Phe, Tyr, Leu, Met, Trp, His, Ile, Val, Lys, or Arg
FXWVSPGVLVX

SEQ ID NO: 124794 - protein, 9 aa, Artificial Sequence
  Description of Artificial Sequence: Synthetic peptide
  Seed: GEGKVTLRI (MOG_HUMAN)
  misc_feature (2)..(2): Xaa can be Glu, Gln, Asp, Met, Leu, Val, Ile, Ala, Ser, or Thr
  misc_feature (9)..(9): Xaa can be Val, Ile, Leu, Trp, Phe, Met, Tyr, Cys, Ala, Thr, Lys, His, Ser, Arg, Gly, or Pro
GXGKVTLRX

SEQ ID NO: 124795 - protein, 11 aa, Artificial Sequence
  Description of Artificial Sequence: Synthetic peptide
  Seed: GFTCFFRDHSY (MOG_HUMAN)
  misc_feature (2)..(2): Xaa can be Met, Tyr, or Phe
  misc_feature (11)..(11): Xaa can be , or Tyr
GXTCFFRDHSX

SEQ ID NO: 124796 - protein, 8 aa, Artificial Sequence
  Description of Artificial Sequence: Synthetic peptide
  Seed: GGFTCFFR (MOG_HUMAN)
  misc_feature (2)..(2): Xaa can be Ile, Phe, Leu, Trp, Ala, Met, Val, Gln, Thr, Ser, Tyr, His, Asn, Cys, Lys, Gly, or Arg
  misc_feature (8)..(8): Xaa can be Arg, or Lys
GXFTCFFX

SEQ ID NO: 124797 - protein, 10 aa, Artificial Sequence
  Description of Artificial Sequence: Synthetic peptide
  Seed: GKLRAEIENL (MOG_HUMAN)
  misc_feature (2)..(2): Xaa can be Trp, Met, Phe, Tyr, Leu, Pro, Val, Thr, Asn, Lys, Ala, Asp, Glu, Ile, Cys, His, Ser, Gly, Arg, or Gln
  misc_feature (10)..(10): Xaa can be Leu, Val, Ile, or Ala
GXLRAEIENX

SEQ ID NO: 124798 - protein, 11 aa, Artificial Sequence
  Description of Artificial Sequence: Synthetic peptide
  Seed: GKVTLRIRNVR (MOG_HUMAN)
  misc_feature (2)..(2): Xaa can be Glu, Gln, Tyr, Met, Leu, Ala, Ile, Cys, Val, Trp, His, Ser, Asp, Thr, Pro, Phe, Gly, Arg, Asn, or Lys
  misc_feature (11)..(11): Xaa can be , or Arg
GXVTLRIRNVX

SEQ ID NO: 124799 - protein, 9 aa, Artificial Sequence
  Description of Artificial Sequence: Synthetic peptide
  Seed: GLIFLCLQY (MOG_HUMAN)
  misc_feature (2)..(2): Xaa can be Gln, Met, Leu, Thr, Ala, Ser, Val, Ile, Gly, Lys, Asn, Arg, Tyr, Glu, Phe, Pro, His, Trp, Asp, or Cys
  misc_feature (9)..(9): Xaa can be Tyr, Phe, Arg, Lys, Met, Trp, Leu, Val, Ile, or His
GXIFLCLQX

SEQ ID NO: 124800 - protein, 10 aa, Artificial Sequence
  Description of Artificial Sequence: Synthetic peptide
  Seed: GLIFLCLQYR (MOG_HUMAN)
  misc_feature (2)..(2): Xaa can be Met, Gly, Cys, His, Ser, Thr, Gln, Trp, Ala, Phe, Arg, Leu, Tyr, Asn, Asp, Val, Glu, Lys, Ile, or Pro
  misc_feature (10)..(10): Xaa can be Lys, Arg, or His
GXIFLCLQYX

SEQ ID NO: 124801 - protein, 11 aa, Artificial Sequence
  Description of Artificial Sequence: Synthetic peptide
  Seed: GLIFLCLQYRL (MOG_HUMAN)
  misc_feature (2)..(2): Xaa can be Met, Leu, Phe, Tyr, or Ile
  misc_feature (11)..(11): Xaa can be Val, Leu, or Ile
GXIFLCLQYRX

SEQ ID NO: 124802 - protein, 8 aa, Artificial Sequence
  Description of Artificial Sequence: Synthetic peptide
  Seed: GMEVGWYR (MOG_HUMAN)
  misc_feature (2)..(2): Xaa can be Met, Phe, Ile, Leu, Arg, Trp, Ser, Tyr, Thr, Ala, Val, Asn, or Gln
  misc_feature (8)..(8): Xaa can be Arg, or Lys
GXEVGWYX

SEQ ID NO: 124803 - protein, 8 aa, Artificial Sequence
  Description of Artificial Sequence: Synthetic peptide
  Seed: GPLVALII (MOG_HUMAN)
  misc_feature (2)..(2): Xaa can be , or Pro
  misc_feature (8)..(8): Xaa can be Val, Ile, Leu, or Ala
GXLVALIX

SEQ ID NO: 124804 - protein, 9 aa, Artificial Sequence
  Description of Artificial Sequence: Synthetic peptide
  Seed: GPLVALIIC (MOG_HUMAN)
  misc_feature (2)..(2): Xaa can be , or Pro
  misc_feature (9)..(9): Xaa can be Ile, Cys, Ala, Thr, Gly, Pro, Met, Phe, Leu, Val, Ser, or Tyr
GXLVALIIX

SEQ ID NO: 124805 - protein, 10 aa, Artificial Sequence
  Description of Artificial Sequence: Synthetic peptide
  Seed: GPLVALIICY (MOG_HUMAN)
  misc_feature (2)..(2): Xaa can be , or Pro
  misc_feature (10)..(10): Xaa can be , or Tyr
GXLVALIICX

SEQ ID NO: 124806 - protein, 8 aa, Artificial Sequence
  Description of Artificial Sequence: Synthetic peptide
  Seed: GPRHPIRA (MOG_HUMAN)
  misc_feature (2)..(2): Xaa can be , or Pro
  misc_feature (8)..(8): Xaa can be Ala, Ile, Leu, Phe, Val, or Met
GXRHPIRX

SEQ ID NO: 124807 - protein, 9 aa, Artificial Sequence
  Description of Artificial Sequence: Synthetic peptide
  Seed: GPRHPIRAL (MOG_HUMAN)
  misc_feature (2)..(2): Xaa can be Pro, Ala, Val, Ile, Glu, His, Arg, Met, Gln, Ser, Leu, Thr, Gly, Asp, Tyr, Phe, Asn, or Cy s
  misc_feature (9)..(9): Xaa can be Leu, Met, Ile, Ala, Val, Phe, Cys, Thr, Pro, Tyr, Glu, Gly, Gln, Arg, Asp, Trp, Lys, His, Asn, or Ser
GXRHPIRAX

SEQ ID NO: 124808 - protein, 10 aa, Artificial Sequence
  Description of Artificial Sequence: Synthetic peptide
  Seed: GPRHPIRALV (MOG_HUMAN)
  misc_feature (2)..(2): Xaa can be Pro, Trp, Asp, Arg, Ile, Cys, Leu, Ser, His, Glu, Gln, Phe, Ala, Val, Thr, Lys, Asn, Gly, Tyr, or Met
  misc_feature (10)..(10): Xaa can be Met, Leu, Val, Tyr, Lys, Trp, Arg, Phe, Ile, Cys, Asp, Thr, Ala, Asn, Gln, His, Gly, Ser, Glu, or Pro
GXRHPIRALX

SEQ ID NO: 124809 - protein, 11 aa, Artificial Sequence
  Description of Artificial Sequence: Synthetic peptide
  Seed: GPRHPIRALVG (MOG_HUMAN)
  misc_feature (2)..(2): Xaa can be , or Pro
  misc_feature (11)..(11): Xaa can be Cys, Pro, Val, Gly, Phe, Thr, Ile, Ala, Met, Ser, or Leu
GXRHPIRALVX

SEQ ID NO: 124810 - protein, 11 aa, Artificial Sequence
  Description of Artificial Sequence: Synthetic peptide
  Seed: GQFLEELRNPF (MOG_HUMAN)
  misc_feature (2)..(2): Xaa can be Gln, Met, Leu, Glu, Lys, Arg, Ile, Thr, His, Val, Ala, or Ser
  misc_feature (11)..(11): Xaa can be Tyr, Phe, Met, Leu, or Trp
GXFLEELRNPX

SEQ ID NO: 124811 - protein, 9 aa, Artificial Sequence
  Description of Artificial Sequence: Synthetic peptide
  Seed: GQFRVIGPR (MOG_HUMAN)
  misc_feature (2)..(2): Xaa can be Arg, Met, Leu, Ile, Val, Gln, Thr, Ser, Ala, Trp, Glu, Asp, Cys, Asn, Gly, Pro, Phe, Tyr, or His
  misc_feature (9)..(9): Xaa can be Arg, Lys, Tyr, His, Leu, Val, Met, Ile, Ala, Phe, Gln, Cys, Asn, Thr, Gly, Trp, Ser, Pro, or Glu
GXFRVIGPX

SEQ ID NO: 124812 - protein, 9 aa, Artificial Sequence
  Description of Artificial Sequence: Synthetic peptide
  Seed: GRTELLKDA (MOG_HUMAN)
  misc_feature (2)..(2): Xaa can be Arg, or Gln
  misc_feature (9)..(9): Xaa can be Leu, Val, Tyr, Trp, Met, Ile, Phe, Ala, or Cys
GXTELLKDX

SEQ ID NO: 124813 - protein, 10 aa, Artificial Sequence
  Description of Artificial Sequence: Synthetic peptide
  Seed: GRTELLKDAI (MOG_HUMAN)
  misc_feature (2)..(2): Xaa can be , or Arg
  misc_feature (10)..(10): Xaa can be Cys, Val, Leu, Tyr, Lys, His, Phe, Met, Arg, Trp, Ile, or Ala
GXTELLKDAX

SEQ ID NO: 124814 - protein, 9 aa, Artificial Sequence
  Description of Artificial Sequence: Synthetic peptide
  Seed: GVLVLLAVL (MOG_HUMAN)
  misc_feature (2)..(2): Xaa can be Leu, Gln, Met, Ile, Val, Thr, Ala, or Ser
  misc_feature (9)..(9): Xaa can be Val, Leu, Ile, Ala, Met, or Thr
GXLVLLAVX

SEQ ID NO: 124815 - protein, 11 aa, Artificial Sequence
  Description of Artificial Sequence: Synthetic peptide
  Seed: GVLVLLAVLPV (MOG_HUMAN)
  misc_feature (2)..(2): Xaa can be Met, Leu, Gln, Thr, Val, Phe, Ile, Tyr, Arg, Lys, or Ser
  misc_feature (11)..(11): Xaa can be Val, Leu, or Ile
GXLVLLAVLPX

SEQ ID NO: 124816 - protein, 9 aa, Artificial Sequence
  Description of Artificial Sequence: Synthetic peptide
  Seed: GWYRPPFSR (MOG_HUMAN)
  misc_feature (2)..(2): Xaa can be Leu, Met, Thr, Ile, Val, Ala, Ser, Tyr, Gln, Gly, Glu, Cys, His, Asn, Asp, Pro, Phe, Trp, Lys, or Arg
  misc_feature (9)..(9): Xaa can be Arg, Lys, Tyr, His, Val, Leu, Phe, Met, Ile, or Ala
GXYRPPFSX

SEQ ID NO: 124817 - protein, 9 aa, Artificial Sequence
  Description of Artificial Sequence: Synthetic peptide
  Seed: HFLRVPCWK (MOG_HUMAN)
  misc_feature (2)..(2): Xaa can be Thr, Val, Ile, Ala, Leu, Met, Ser, Asn, Pro, Cys, Tyr, Gly, Gln, Trp, Asp, Phe, Glu, Arg, His, or Lys
  misc_feature (9)..(9): Xaa can be Arg, Lys, Tyr, His, or Ala
HXLRVPCWX

SEQ ID NO: 124818 - protein, 10 aa, Artificial Sequence
  Description of Artificial Sequence: Synthetic peptide
  Seed: HFLRVPCWKI (MOG_HUMAN)
  misc_feature (2)..(2): Xaa can be Tyr, Trp, Phe, Met, or Gln
  misc_feature (10)..(10): Xaa can be Phe, Leu, Trp, Ile, Met, Val, or Tyr
HXLRVPCWKX

SEQ ID NO: 124819 - protein, 8 aa, Artificial Sequence
  Description of Artificial Sequence: Synthetic peptide
  Seed: HPIRALVG (MOG_HUMAN)
  misc_feature (2)..(2): Xaa can be Pro, or Ala
  misc_feature (8)..(8): Xaa can be Ala, Tyr, Ser, Pro, Met, Thr, Val, Phe, Ile, Leu, Cys, or Gly
HXIRALVX

SEQ ID NO: 124820 - protein, 11 aa, Artificial Sequence
  Description of Artificial Sequence: Synthetic peptide
  Seed: HPIRALVGDEV (MOG_HUMAN)
  misc_feature (2)..(2): Xaa can be , or Pro
  misc_feature (11)..(11): Xaa can be Leu, Ile, Met, Phe, Thr, Val, Cys, Tyr, Trp, or Ala
HXIRALVGDEX

SEQ ID NO: 124821 - protein, 8 aa, Artificial Sequence
  Description of Artificial Sequence: Synthetic peptide
  Seed: HRRLAGQF (MOG_HUMAN)
  misc_feature (2)..(2): Xaa can be Tyr, Arg, or Phe
  misc_feature (8)..(8): Xaa can be Phe, Tyr, Leu, or Met
HXRLAGQX

SEQ ID NO: 124822 - protein, 9 aa, Artificial Sequence
  Description of Artificial Sequence: Synthetic peptide
  Seed: HRRLAGQFL (MOG_HUMAN)
  misc_feature (2)..(2): Xaa can be His, Arg, Gln, Tyr, Glu, Ala, Phe, Trp, Met, Pro, Lys, Asn, Gly, Ser, or Asp
  misc_feature (9)..(9): Xaa can be Leu, Tyr, Phe, Met, Ile, Ala, Cys, Val, Pro, Trp, His, Ser, Lys, Thr, or Arg
HXRLAGQFX

SEQ ID NO: 124823 - protein, 8 aa, Artificial Sequence
  Description of Artificial Sequence: Synthetic peptide
  Seed: HRTFDPHF (MOG_HUMAN)
  misc_feature (2)..(2): Xaa can be Tyr, or Arg
  misc_feature (8)..(8): Xaa can be Tyr, or Phe
HXTFDPHX

SEQ ID NO: 124824 - protein, 9 aa, Artificial Sequence
  Description of Artificial Sequence: Synthetic peptide
  Seed: HRTFDPHFL (MOG_HUMAN)
  misc_feature (2)..(2): Xaa can be Arg, His, Gln, Ala, Tyr, Glu, Phe, Lys, Trp, Gly, Ser, Ile, Asn, Val, Leu, Met, Thr, or As p
  misc_feature (9)..(9): Xaa can be Leu, Met, Tyr, Phe, Ile, Val, Trp, Ala, Pro, Lys, Thr, Cys, His, or Arg
HXTFDPHFX

SEQ ID NO: 124825 - protein, 10 aa, Artificial Sequence
  Description of Artificial Sequence: Synthetic peptide
  Seed: HRTFDPHFLR (MOG_HUMAN)
  misc_feature (2)..(2): Xaa can be Arg, Glu, Phe, Tyr, Leu, Trp, Pro, Val, Ile, His, Met, Cys, Ser, Asn, Ala, Thr, Gln, Gly, Asp, or Lys
  misc_feature (10)..(10): Xaa can be Gln, Tyr, Lys, Glu, Arg, His, Met, Phe, Leu, Val, Ser, Thr, Ala, Cys, Ile, Trp, or Gly
HXTFDPHFLX

SEQ ID NO: 124826 - protein, 11 aa, Artificial Sequence
  Description of Artificial Sequence: Synthetic peptide
  Seed: HRTFDPHFLRV (MOG_HUMAN)
  misc_feature (2)..(2): Xaa can be Cys, Pro, Lys, Ser, Arg, Asn, Tyr, Leu, Ile, Phe, His, Thr, Gln, Trp, Ala, Glu, Asp, Val, Met, or Gly
  misc_feature (11)..(11): Xaa can be Gln, His, Gly, Thr, Pro, Met, Cys, Glu, Lys, Asn, Ala, Val, Tyr, Asp, Phe, Ile, Ser, Arg, Leu, or Trp
HXTFDPHFLRX

SEQ ID NO: 124827 - protein, 9 aa, Artificial Sequence
  Description of Artificial Sequence: Synthetic peptide
  Seed: HSYQEEAAM (MOG_HUMAN)
  misc_feature (2)..(2): Xaa can be Pro, Gln, Ala, Arg, His, Met, Thr, Ser, Val, Leu, Ile, Asn, Gly, Asp, Glu, Phe, Lys, Tyr, Cys, or Trp
  misc_feature (9)..(9): Xaa can be Met, Trp, Tyr, Leu, Phe, Lys, Ile, Val, His, Arg, Ala, Cys, Gln, Thr, Ser, Gly, Pro, Asn, or Glu
HXYQEEAAX

SEQ ID NO: 124828 - protein, 11 aa, Artificial Sequence
  Description of Artificial Sequence: Synthetic peptide
  Seed: HSYQEEAAMEL (MOG_HUMAN)
  misc_feature (2)..(2): Xaa can be Ala, Gln, Ile, Val, Thr, Ser, Leu, Met, Gly, Arg, Glu, Asn, Cys, Phe, Tyr, Pro, Asp, His, Lys, or Trp
  misc_feature (11)..(11): Xaa can be Trp, Leu, Met, Phe, Tyr, Lys, Arg, His, Ile, Val, Cys, Ala, or Gln
HXYQEEAAMEX

SEQ ID NO: 124829 - protein, 9 aa, Artificial Sequence
  Description of Artificial Sequence: Synthetic peptide
  Seed: ICYNWLHRR (MOG_HUMAN)
  misc_feature (2)..(2): Xaa can be Met, Leu, Thr, Val, Ile, Gln, Ser, Ala, Phe, Trp, Tyr, Asn, Cys, Gly, Asp, Lys, Arg, Glu, His, or Pro
  misc_feature (9)..(9): Xaa can be Lys, Arg, Tyr, His, Leu, Phe, Val, Ile, Met, Ala, Gln, Trp, Thr, or Cys
IXYNWLHRX

SEQ ID NO: 124830 - protein, 10 aa, Artificial Sequence
  Description of Artificial Sequence: Synthetic peptide
  Seed: ICYNWLHRRL (MOG_HUMAN)
  misc_feature (2)..(2): Xaa can be Tyr, Trp, Phe, Met, Gln, His, Leu, Gly, Glu, Lys, Pro, Ile, Arg, Cys, Val, Asp, Asn, Thr, Ala, or Ser
  misc_feature (10)..(10): Xaa can be Ile, Phe, Leu, Trp, Met, Val, or Tyr
IXYNWLHRRX

SEQ ID NO: 124831 - protein, 8 aa, Artificial Sequence
  Description of Artificial Sequence: Synthetic peptide
  Seed: IENLHRTF (MOG_HUMAN)
  misc_feature (2)..(2): Xaa can be Glu, Ala, Asp, Ser, Arg, Gln, Val, Thr, Tyr, Phe, Gly, Asn, Ile, His, Met, Trp, Leu, Pro, Lys, or Cys
  misc_feature (8)..(8): Xaa can be Phe, Tyr, Leu, Met, Ile, Val, Trp, His, Ala, Cys, Pro, or Thr
IXNLHRTX

SEQ ID NO: 124832 - protein, 8 aa, Artificial Sequence
  Description of Artificial Sequence: Synthetic peptide
  Seed: IFLCLQYR (MOG_HUMAN)
  misc_feature (2)..(2): Xaa can be Trp, Leu, Met, Thr, Phe, Tyr, Ala, Val, Ser, Ile, or Gln
  misc_feature (8)..(8): Xaa can be Arg, or Lys
IXLCLQYX

SEQ ID NO: 124833 - protein, 9 aa, Artificial Sequence
  Description of Artificial Sequence: Synthetic peptide
  Seed: IFLCLQYRL (MOG_HUMAN)
  misc_feature (2)..(2): Xaa can be Tyr, Phe, Trp, Met, Val, Gln, Ser, Leu, His, Thr, Ile, Asn, Gly, or Ala
  misc_feature (9)..(9): Xaa can be Phe, Trp, Leu, Ile, Val, Met, Tyr, or Cys
IXLCLQYRX

SEQ ID NO: 124834 - protein, 10 aa, Artificial Sequence
  Description of Artificial Sequence: Synthetic peptide
  Seed: IFLCLQYRLR (MOG_HUMAN)
  misc_feature (2)..(2): Xaa can be Trp, Phe, Met, Tyr, Thr, Gln, Val, Ser, Ile, Arg, His, Ala, Asn, Leu, Gly, Glu, Cys, Asp, Pro, or Lys
  misc_feature (10)..(10): Xaa can be Arg, Lys, His, or Tyr
IXLCLQYRLX

SEQ ID NO: 124835 - protein, 8 aa, Artificial Sequence
  Description of Artificial Sequence: Synthetic peptide
  Seed: IGEGKVTL (MOG_HUMAN)
  misc_feature (2)..(2): Xaa can be Thr, Ser, Ala, Phe, Tyr, Gln, His, Val, Arg, Trp, Leu, Glu, Cys, Asn, Gly, Asp, Ile, or Me t
  misc_feature (8)..(8): Xaa can be Leu, Met, Ile, Phe, Val, or Tyr
IXEGKVTX

SEQ ID NO: 124836 - protein, 9 aa, Artificial Sequence
  Description of Artificial Sequence: Synthetic peptide
  Seed: IGEGKVTLR (MOG_HUMAN)
  misc_feature (2)..(2): Xaa can be Ala, Thr, Ile, Met, Ser, Leu, Val, Gly, Tyr, Phe, Cys, Asn, Trp, Gln, Pro, Glu, Asp, or Hi s
  misc_feature (9)..(9): Xaa can be Lys, Arg, Tyr, Phe, Leu, Met, Val, Ile, Trp, His, Gln, Cys, or Ala
IXEGKVTLX

SEQ ID NO: 124837 - protein, 10 aa, Artificial Sequence
  Description of Artificial Sequence: Synthetic peptide
  Seed: IGPRHPIRAL (MOG_HUMAN)
  misc_feature (2)..(2): Xaa can be Ala, Arg, Met, Phe, Ser, Gln, Val, Thr, Ile, Gly, Leu, Pro, Tyr, Cys, Asp, Glu, Trp, Lys, Asn, or His
  misc_feature (10)..(10): Xaa can be Leu, Met, Ile, Phe, Thr, Ala, Cys, Val, Tyr, Trp, or Ser
IXPRHPIRAX

SEQ ID NO: 124838 - protein, 11 aa, Artificial Sequence
  Description of Artificial Sequence: Synthetic peptide
  Seed: IGPRHPIRALV (MOG_HUMAN)
  misc_feature (2)..(2): Xaa can be Ala, His, Trp, Asp, Gln, Leu, Tyr, Cys, Met, Arg, Lys, Ser, Thr, Pro, Phe, Val, Glu, Gly, Asn, or Ile
  misc_feature (11)..(11): Xaa can be Cys, Glu, Pro, Ile, Trp, Tyr, Ser, Gln, Arg, Thr, Lys, Gly, Val, Asp, Asn, Phe, Leu, Met, His, or Ala
IXPRHPIRALX

SEQ ID NO: 124839 - protein, 9 aa, Artificial Sequence
  Description of Artificial Sequence: Synthetic peptide
  Seed: IICYNWLHR (MOG_HUMAN)
  misc_feature (2)..(2): Xaa can be Met, Thr, Val, Ala, Ile, Ser, Leu, Asp, Pro, Trp, Phe, Gly, Asn, Gln, Tyr, Cys, His, or Gl u
  misc_feature (9)..(9): Xaa can be Arg, Lys, Tyr, His, or Leu
IXCYNWLHX

SEQ ID NO: 124840 - protein, 10 aa, Artificial Sequence
  Description of Artificial Sequence: Synthetic peptide
  Seed: IICYNWLHRR (MOG_HUMAN)
  misc_feature (2)..(2): Xaa can be Met, Phe, Tyr, Thr, Val, Leu, Trp, Ile, Ala, Gln, Asn, Gly, Ser, Pro, Glu, Lys, His, Arg, Cys, or Asp
  misc_feature (10)..(10): Xaa can be Arg, Lys, Tyr, His, Gln, Gly, Met, Glu, Asn, Ser, Trp, Ile, Ala, Cys, Val, Pro, Thr, Asp, Leu, or Phe
IXCYNWLHRX

SEQ ID NO: 124841 - protein, 9 aa, Artificial Sequence
  Description of Artificial Sequence: Synthetic peptide
  Seed: IRALVGDEV (MOG_HUMAN)
  misc_feature (2)..(2): Xaa can be Arg, His, Gln, Ala, Tyr, Phe, Gly, Lys, Trp, Pro, Glu, Asn, Asp, Ser, Thr, Ile, Val, Met, or Leu
  misc_feature (9)..(9): Xaa can be Leu, Met, Phe, Ile, Lys, Tyr, Val, Ala, Arg, Trp, Pro, Thr, Cys, or Ser
IXALVGDEX

SEQ ID NO: 124842 - protein, 11 aa, Artificial Sequence
  Description of Artificial Sequence: Synthetic peptide
  Seed: IRALVGDEVEL (MOG_HUMAN)
  misc_feature (2)..(2): Xaa can be Arg, His, Tyr, Gly, Ala, or Gln
  misc_feature (11)..(11): Xaa can be Leu, Phe, Met, Tyr, Ile, Lys, Trp, Cys, Val, Ala, or Arg
IXALVGDEVEX

SEQ ID NO: 124843 - protein, 10 aa, Artificial Sequence
  Description of Artificial Sequence: Synthetic peptide
  Seed: ISPGKNATGM (MOG_HUMAN)
  misc_feature (2)..(2): Xaa can be Ala, Ser, Ile, Thr, Val, Leu, Met, Gly, Gln, Phe, Asn, Cys, Glu, Tyr, Arg, Trp, Pro, Asp, or His
  misc_feature (10)..(10): Xaa can be Leu, Met, Tyr, Lys, Phe, Arg, Ile, Val, His, or Trp
IXPGKNATGX

SEQ ID NO: 124844 - protein, 9 aa, Artificial Sequence
  Description of Artificial Sequence: Synthetic peptide
  Seed: ITLFVIVPV (MOG_HUMAN)
  misc_feature (2)..(2): Xaa can be Met, Leu, Gln, Thr, Val, Ile, Ser, Ala, Asn, Cys, Gly, Trp, Phe, Pro, or Glu
  misc_feature (9)..(9): Xaa can be Val, Leu, Trp, Met, Ala, Ile, Phe, Thr, Ser, Tyr, Cys, Gly, or Pro
IXLFVIVPX

SEQ ID NO: 124845 - protein, 10 aa, Artificial Sequence
  Description of Artificial Sequence: Synthetic peptide
  Seed: ITLFVIVPVL (MOG_HUMAN)
  misc_feature (2)..(2): Xaa can be Met, Gln, Leu, Ile, Ser, Thr, Ala, Val, Lys, Phe, Tyr, Trp, Arg, Asn, Asp, Gly, Pro, Glu, His, or Cys
  misc_feature (10)..(10): Xaa can be Val, Leu, Ala, Ile, Met, Trp, Phe, Tyr, Thr, Asn, Glu, Asp, Arg, Pro, His, Lys, Gln, Ser, Gly, or Cys
IXLFVIVPVX

SEQ ID NO: 124846 - protein, 9 aa, Artificial Sequence
  Description of Artificial Sequence: Synthetic peptide
  Seed: ITVGLIFLC (MOG_HUMAN)
  misc_feature (2)..(2): Xaa can be Thr, Ser, Ala, Val, Ile, Cys, Gly, Leu, Met, Asn, Pro, Gln, Asp, Phe, Trp, Tyr, Glu, His, Lys, or Arg
  misc_feature (9)..(9): Xaa can be Trp, Phe, Val, Leu, Ile, Ala, Met, Tyr, Thr, or Cys
IXVGLIFLX

SEQ ID NO: 124847 - protein, 10 aa, Artificial Sequence
  Description of Artificial Sequence: Synthetic peptide
  Seed: ITVGLIFLCL (MOG_HUMAN)
  misc_feature (2)..(2): Xaa can be Ala, Thr, Ser, Gln, Met, Leu, Val, Ile, Gly, Cys, Asn, or Pro
  misc_feature (10)..(10): Xaa can be Trp, Val, Leu, Ile, Ala, Phe, Met, Thr, or Tyr
IXVGLIFLCX

SEQ ID NO: 124848 - protein, 8 aa, Artificial Sequence
  Description of Artificial Sequence: Synthetic peptide
  Seed: IVPVLGPL (MOG_HUMAN)
  misc_feature (2)..(2): Xaa can be Ala, Ser, Thr, Gly, Tyr, Leu, Met, Pro, Val, Ile, Gln, Cys, Asn, or Phe
  misc_feature (8)..(8): Xaa can be Leu, Met, Phe, Tyr, Ile, Lys, or Val
IXPVLGPX

SEQ ID NO: 124849 - protein, 9 aa, Artificial Sequence
  Description of Artificial Sequence: Synthetic peptide
  Seed: IVPVLGPLV (MOG_HUMAN)
  misc_feature (2)..(2): Xaa can be Ala, Pro, Ser, Thr, Gln, Val, Ile, Met, Leu, Gly, Asn, Arg, Phe, Tyr, Asp, Cys, Glu, Trp, His, or Lys
  misc_feature (9)..(9): Xaa can be Met, Leu, Ile, Val, Phe, Tyr, Lys, Cys, Ala, Arg, Thr, Trp, Pro, Gly, or His
IXPVLGPLX

SEQ ID NO: 124850 - protein, 10 aa, Artificial Sequence
  Description of Artificial Sequence: Synthetic peptide
  Seed: IVPVLGPLVA (MOG_HUMAN)
  misc_feature (2)..(2): Xaa can be Met, Glu, Asn, Tyr, Lys, Gln, His, Pro, Cys, Trp, Ile, Arg, Asp, Thr, Gly, Ser, Phe, Ala, Val, or Leu
  misc_feature (10)..(10): Xaa can be Ala, or Val
IXPVLGPLVX

SEQ ID NO: 124851 - protein, 11 aa, Artificial Sequence
  Description of Artificial Sequence: Synthetic peptide
  Seed: IVPVLGPLVAL (MOG_HUMAN)
  misc_feature (2)..(2): Xaa can be Ala, Met, Thr, Ile, Ser, Leu, Gly, Val, Gln, Pro, Asn, Cys, Asp, Glu, or Phe
  misc_feature (11)..(11): Xaa can be Lys, Leu, Met, Phe, Arg, Ile, Val, Tyr, Ala, Cys, or Trp
IXPVLGPLVAX

SEQ ID NO: 124852 - protein, 9 aa, Artificial Sequence
  Description of Artificial Sequence: Synthetic peptide
  Seed: KDAIGEGKV (MOG_HUMAN)
  misc_feature (2)..(2): Xaa can be Glu, Asp, or Gln
  misc_feature (9)..(9): Xaa can be Phe, Leu, Met, Ala, Val, Ile, Thr, Tyr, Gly, Cys, Trp, Ser, or Pro
KXAIGEGKX

SEQ ID NO: 124853 - protein, 11 aa, Artificial Sequence
  Description of Artificial Sequence: Synthetic peptide
  Seed: KDAIGEGKVTL (MOG_HUMAN)
  misc_feature (2)..(2): Xaa can be Glu, Asp, or Gln
  misc_feature (11)..(11): Xaa can be Trp, Phe, Met, Cys, Leu, Ile, Ala, Val, Tyr, Gly, Ser, Glu, Lys, Gln, Pro, Thr, His, Asp, or Arg
KXAIGEGKVTX

SEQ ID NO: 124854 - protein, 9 aa, Artificial Sequence
  Description of Artificial Sequence: Synthetic peptide
  Seed: KDQDGDQAP (MOG_HUMAN)
  misc_feature (2)..(2): Xaa can be Glu, Asp, or Gln
  misc_feature (9)..(9): Xaa can be Leu, Met, Pro, Val, Ile, Ala, Cys, Phe, Thr, Arg, Trp, Lys, Tyr, Glu, Asp, Gln, Ser, Gly, His, or Asn
KXQDGDQAX

SEQ ID NO: 124855 - protein, 11 aa, Artificial Sequence
  Description of Artificial Sequence: Synthetic peptide
  Seed: KDQDGDQAPEY (MOG_HUMAN)
  misc_feature (2)..(2): Xaa can be Ala, Glu, Val, Gly, Ile, Gln, Thr, Met, Ser, Leu, Asp, Asn, Pro, Cys, His, Lys, Arg, Phe, Trp, or Tyr
  misc_feature (11)..(11): Xaa can be Tyr, Phe, Trp, Lys, Met, Arg, Leu, His, Ile, Cys, Val, or Ala
KXQDGDQAPEX

SEQ ID NO: 124856 - protein, 10 aa, Artificial Sequence
  Description of Artificial Sequence: Synthetic peptide
  Seed: KITLFVIVPV (MOG_HUMAN)
  misc_feature (2)..(2): Xaa can be Leu, Met, Gln, Ile, Val, Glu, Asn, Arg, Ala, Phe, Ser, Thr, Asp, Tyr, Lys, Trp, Gly, His, Pro, or Cys
  misc_feature (10)..(10): Xaa can be Ala, Lys, Ile, Val, Leu, Met, Thr, Cys, or Ser
KXTLFVIVPX

SEQ ID NO: 124857 - protein, 11 aa, Artificial Sequence
  Description of Artificial Sequence: Synthetic peptide
  Seed: KITLFVIVPVL (MOG_HUMAN)
  misc_feature (2)..(2): Xaa can be Leu, Met, Ile, Arg, Pro, Phe, Gln, Glu, Lys, Ala, Thr, His, Tyr, Asp, Ser, Asn, Gly, Trp, Val, or Cys
  misc_feature (11)..(11): Xaa can be Ile, Leu, Val, Ala, Met, Arg, Cys, Thr, Pro, Ser, Phe, His, Asp, Trp, Glu, Gly, Tyr, Lys, Gln, or Asn
KXTLFVIVPVX

SEQ ID NO: 124858 - protein, 9 aa, Artificial Sequence
  Description of Artificial Sequence: Synthetic peptide
  Seed: KLRAEIENL (MOG_HUMAN)
  misc_feature (2)..(2): Xaa can be Thr, Val, Ser, Met, Ile, Ala, Gln, Phe, Tyr, Arg, Leu, Gly, Asn, Glu, Trp, Lys, His, Pro, Asp, or Cys
  misc_feature (9)..(9): Xaa can be Tyr, Leu, Ile, Phe, Lys, Met, Val, Arg, Trp, Ala, Thr, Ser, His, Gly, Cys, Gln, Pro, Asn, or Glu
KXRAEIENX

SEQ ID NO: 124859 - protein, 11 aa, Artificial Sequence
  Description of Artificial Sequence: Synthetic peptide
  Seed: KLRAEIENLHR (MOG_HUMAN)
  misc_feature (2)..(2): Xaa can be Trp, Ser, Val, Asn, Phe, Leu, Met, Gln, Ala, Thr, Tyr, Ile, or Gly
  misc_feature (11)..(11): Xaa can be Arg, or Lys
KXRAEIENLHX

SEQ ID NO: 124860 - protein, 10 aa, Artificial Sequence
  Description of Artificial Sequence: Synthetic peptide
  Seed: KNATGMEVGW (MOG_HUMAN)
  misc_feature (2)..(2): Xaa can be Thr, Ser, Ala, Met, Val, Ile, Asn, Gly, Cys, Leu, Tyr, His, Gln, Trp, Lys, Pro, Phe, Glu, Asp, or Arg
  misc_feature (10)..(10): Xaa can be Trp, Phe, Tyr, Met, Leu, or Ile
KXATGMEVGX

SEQ ID NO: 124861 - protein, 11 aa, Artificial Sequence
  Description of Artificial Sequence: Synthetic peptide
  Seed: KNATGMEVGWY (MOG_HUMAN)
  misc_feature (2)..(2): Xaa can be Val, Ile, Leu, Asn, Tyr, Met, Gln, Gly, Ala, Thr, Ser, Phe, or Trp
  misc_feature (11)..(11): Xaa can be , or Tyr
KXATGMEVGWX

SEQ ID NO: 124862 - protein, 8 aa, Artificial Sequence
  Description of Artificial Sequence: Synthetic peptide
  Seed: KVEDPFYW (MOG_HUMAN)
  misc_feature (2)..(2): Xaa can be Ser, Thr, Ala, Val, Pro, Trp, Met, Tyr, Cys, Asn, Ile, Gly, Phe, Leu, Gln, or Asp
  misc_feature (8)..(8): Xaa can be Trp, Phe, Leu, or Tyr
KXEDPFYX

SEQ ID NO: 124863 - protein, 9 aa, Artificial Sequence
  Description of Artificial Sequence: Synthetic peptide
  Seed: KVEDPFYWV (MOG_HUMAN)
  misc_feature (2)..(2): Xaa can be Leu, Met, Thr, Val, Ile, Gln, Ala, Ser, Gly, Phe, Cys, or Asn
  misc_feature (9)..(9): Xaa can be Leu, Met, Val, Ile, Phe, Ala, Cys, Thr, or Ser
KXEDPFYWX

SEQ ID NO: 124864 - protein, 9 aa, Artificial Sequence
  Description of Artificial Sequence: Synthetic peptide
  Seed: KVTLRIRNV (MOG_HUMAN)
  misc_feature (2)..(2): Xaa can be Thr, Ser, Val, Ala, Leu, Ile, Met, Gly, Gln, Phe, Tyr, Trp, or Asn
  misc_feature (9)..(9): Xaa can be Lys, Ala, Val, Leu, Met, Phe, Tyr, Ile, Trp, Ser, Thr, Gly, or Cys
KXTLRIRNX

SEQ ID NO: 124865 - protein, 10 aa, Artificial Sequence
  Description of Artificial Sequence: Synthetic peptide
  Seed: KVTLRIRNVR (MOG_HUMAN)
  misc_feature (2)..(2): Xaa can be Asn, Cys, Ala, Pro, Arg, Thr, Val, Glu, Ile, Leu, Met, Lys, Asp, Tyr, Gly, His, Ser, Trp, Phe, or Gln
  misc_feature (10)..(10): Xaa can be Lys, or Arg
KXTLRIRNVX

SEQ ID NO: 124866 - protein, 9 aa, Artificial Sequence
  Description of Artificial Sequence: Synthetic peptide
  Seed: LAGQFLEEL (MOG_HUMAN)
  misc_feature (2)..(2): Xaa can be Leu, Val, Ile, Ser, Thr, Ala, Met, Gln, Arg, Pro, Gly, Glu, Asn, Phe, Tyr, Asp, His, Trp, Cys, or Lys
  misc_feature (9)..(9): Xaa can be Met, Phe, Tyr, Leu, Trp, Ile, Val, Lys, Arg, Ala, His, Thr, Cys, or Ser
LXGQFLEEX

SEQ ID NO: 124867 - protein, 10 aa, Artificial Sequence
  Description of Artificial Sequence: Synthetic peptide
  Seed: LAGQFLEELR (MOG_HUMAN)
  misc_feature (2)..(2): Xaa can be Thr, Ala, Gly, Ile, Val, Phe, Leu, Ser, Tyr, Met, Gln, Glu, Trp, or Asp
  misc_feature (10)..(10): Xaa can be Lys, or Arg
LXGQFLEELX

SEQ ID NO: 124868 - protein, 8 aa, Artificial Sequence
  Description of Artificial Sequence: Synthetic peptide
  Seed: LAVLPVLL (MOG_HUMAN)
  misc_feature (2)..(2): Xaa can be Pro, Ala, Thr, Ser, Gln, Gly, Glu, Asn, Met, Ile, or Val
  misc_feature (8)..(8): Xaa can be Ile, Leu, Val, Met, Phe, Tyr, Lys, Ala, or Cys
LXVLPVLX

SEQ ID NO: 124869 - protein, 9 aa, Artificial Sequence
  Description of Artificial Sequence: Synthetic peptide
  Seed: LAVLPVLLL (MOG_HUMAN)
  misc_feature (2)..(2): Xaa can be Arg, Gln, Ala, Pro, Ser, Met, Gly, Glu, Leu, Thr, Ile, Asn, Val, Cys, Asp, His, Lys, Trp, Tyr, or Phe
  misc_feature (9)..(9): Xaa can be Leu, Tyr, Trp, Phe, Ile, Met, Val, Lys, Ala, Cys, His, Arg, Thr, Ser, Pro, or Gln
LXVLPVLLX

SEQ ID NO: 124870 - protein, 9 aa, Artificial Sequence
  Description of Artificial Sequence: Synthetic peptide
  Seed: LCSFLLLLL (MOG_HUMAN)
  misc_feature (2)..(2): Xaa can be Arg, Met, Ile, Leu, Thr, Gln, Ala, Val, Ser, Gly, Asn, Cys, Pro, Phe, Trp, Asp, Glu, Lys, or Tyr
  misc_feature (9)..(9): Xaa can be Trp, Leu, Phe, Val, Met, Ile, Tyr, Ala, Cys, Thr, Lys, Arg, or His
LXSFLLLLX

SEQ ID NO: 124871 - protein, 8 aa, Artificial Sequence
  Description of Artificial Sequence: Synthetic peptide
  Seed: LEELRNPF (MOG_HUMAN)
  misc_feature (2)..(2): Xaa can be Glu, or Asp
  misc_feature (8)..(8): Xaa can be Phe, Leu, Met, Ile, Tyr, or Val
LXELRNPX

SEQ ID NO: 124872 - protein, 8 aa, Artificial Sequence
  Description of Artificial Sequence: Synthetic peptide
  Seed: LFVIVPVL (MOG_HUMAN)
  misc_feature (2)..(2): Xaa can be Tyr, Phe, or Trp
  misc_feature (8)..(8): Xaa can be Leu, Met, Tyr, Phe, or Ile
LXVIVPVX

SEQ ID NO: 124873 - protein, 8 aa, Artificial Sequence
  Description of Artificial Sequence: Synthetic peptide
  Seed: LGPLVALI (MOG_HUMAN)
  misc_feature (2)..(2): Xaa can be Pro, Gln, Glu, Ala, Thr, Val, Met, Leu, Gly, Ile, Ser, Asp, Asn, His, or Lys
  misc_feature (8)..(8): Xaa can be Val, Ile, Leu, Met, Phe, Ala, or Cys
LXPLVALX

SEQ ID NO: 124874 - protein, 9 aa, Artificial Sequence
  Description of Artificial Sequence: Synthetic peptide
  Seed: LGPLVALII (MOG_HUMAN)
  misc_feature (2)..(2): Xaa can be Ala, Pro, Gln, Ser, Thr, Gly, Asn, Val, Ile, Leu, Met, Tyr, Phe, Arg, Asp, Cys, Glu, His, Lys, or Trp
  misc_feature (9)..(9): Xaa can be Leu, Met, Ile, Val, Phe, Tyr, Cys, Ala, Lys, Trp, Thr, or Pro
LXPLVALIX

SEQ ID NO: 124875 - protein, 9 aa, Artificial Sequence
  Description of Artificial Sequence: Synthetic peptide
  Seed: LHRRLAGQF (MOG_HUMAN)
  misc_feature (2)..(2): Xaa can be Gln, Met, Lys, Glu, Leu, His, Ser, Thr, Val, Ala, Arg, Asn, Ile, or Gly
  misc_feature (9)..(9): Xaa can be Tyr, Phe, Met, Leu, Trp, Val, His, or Ile
LXRRLAGQX

SEQ ID NO: 124876 - protein, 9 aa, Artificial Sequence
  Description of Artificial Sequence: Synthetic peptide
  Seed: LHRTFDPHF (MOG_HUMAN)
  misc_feature (2)..(2): Xaa can be Gln, Met, His, Arg, Tyr, Lys, Phe, Ser, Glu, Leu, Ala, Asn, Val, Gly, Thr, Ile, or Pro
  misc_feature (9)..(9): Xaa can be Tyr, Phe, Met, Leu, Ile, Val, Trp, His, or Ala
LXRTFDPHX

SEQ ID NO: 124877 - protein, 10 aa, Artificial Sequence
  Description of Artificial Sequence: Synthetic peptide
  Seed: LHRTFDPHFL (MOG_HUMAN)
  misc_feature (2)..(2): Xaa can be , or His
  misc_feature (10)..(10): Xaa can be Phe, or Leu
LXRTFDPHFX

SEQ ID NO: 124878 - protein, 11 aa, Artificial Sequence
  Description of Artificial Sequence: Synthetic peptide
  Seed: LHRTFDPHFLR (MOG_HUMAN)
  misc_feature (2)..(2): Xaa can be Met, Phe, Tyr, Trp, His, Asp, Val, Gly, Thr, Glu, Pro, Asn, Arg, Ser, Lys, Ile, Gln, Ala, Leu, or Cys
  misc_feature (11)..(11): Xaa can be Arg, Lys, His, or Tyr
LXRTFDPHFLX

SEQ ID NO: 124879 - protein, 8 aa, Artificial Sequence
  Description of Artificial Sequence: Synthetic peptide
  Seed: LIFLCLQY (MOG_HUMAN)
  misc_feature (2)..(2): Xaa can be Gln, Ala, Met, Ser, Trp, Arg, Thr, Asn, Leu, Lys, Phe, Glu, Gly, Tyr, Ile, or Val
  misc_feature (8)..(8): Xaa can be Tyr, Phe, Leu, or Met
LXFLCLQX

SEQ ID NO: 124880 - protein, 9 aa, Artificial Sequence
  Description of Artificial Sequence: Synthetic peptide
  Seed: LIFLCLQYR (MOG_HUMAN)
  misc_feature (2)..(2): Xaa can be Met, Leu, Thr, Val, Ile, Ser, Tyr, Trp, Phe, Asp, Pro, His, Lys, Glu, Gly, Ala, Gln, Asn, Cys, or Arg
  misc_feature (9)..(9): Xaa can be Arg, Lys, His, Tyr, Val, Leu, Met, Ile, Phe, or Ala
LXFLCLQYX

SEQ ID NO: 124881 - protein, 10 aa, Artificial Sequence
  Description of Artificial Sequence: Synthetic peptide
  Seed: LIFLCLQYRL (MOG_HUMAN)
  misc_feature (2)..(2): Xaa can be Trp, Ser, Ala, Tyr, Val, Thr, Leu, Phe, Met, Gln, Ile, Gly, Asn, Glu, Lys, Pro, His, Asp, Cys, or Arg
  misc_feature (10)..(10): Xaa can be Lys, Arg, His, Leu, Met, Gln, Phe, Tyr, Cys, Ala, Gly, Asp, Trp, Asn, Val, Glu, Ile, Ser, Pro, or Thr
LXFLCLQYRX

SEQ ID NO: 124882 - protein, 11 aa, Artificial Sequence
  Description of Artificial Sequence: Synthetic peptide
  Seed: LIFLCLQYRLR (MOG_HUMAN)
  misc_feature (2)..(2): Xaa can be Gly, His, Tyr, Phe, Ile, Ala, Met, Gln, Leu, Ser, Trp, Val, Lys, Arg, Thr, Asn, or Cys
  misc_feature (11)..(11): Xaa can be Arg, or Lys
LXFLCLQYRLX

SEQ ID NO: 124883 - protein, 9 aa, Artificial Sequence
  Description of Artificial Sequence: Synthetic peptide
  Seed: LIICYNWLH (MOG_HUMAN)
  misc_feature (2)..(2): Xaa can be Ile, Ser, Val, Thr, Leu, Ala, Met, Gln, Tyr, Trp, Phe, Arg, Cys, Pro, Gly, Asp, Asn, Lys, Glu, or His
  misc_feature (9)..(9): Xaa can be Lys, Arg, His, or Tyr
LXICYNWLX

SEQ ID NO: 124884 - protein, 10 aa, Artificial Sequence
  Description of Artificial Sequence: Synthetic peptide
  Seed: LIICYNWLHR (MOG_HUMAN)
  misc_feature (2)..(2): Xaa can be Met, Thr, Phe, Val, Tyr, Ile, Gly, Trp, Arg, Glu, Asn, Asp, His, Pro, Ser, Cys, Leu, Ala, Lys, or Gln
  misc_feature (10)..(10): Xaa can be Arg, Lys, Tyr, or His
LXICYNWLHX

SEQ ID NO: 124885 - protein, 11 aa, Artificial Sequence
  Description of Artificial Sequence: Synthetic peptide
  Seed: LIICYNWLHRR (MOG_HUMAN)
  misc_feature (2)..(2): Xaa can be Met, Phe, Tyr, Leu, Gly, Ala, Thr, Ser, Gln, Arg, Ile, Trp, Val, Pro, His, Lys, or Asn
  misc_feature (11)..(11): Xaa can be Arg, Lys, His, Tyr, Asp, Gly, Asn, Pro, Ser, Glu, Gln, Met, Ala, Thr, Phe, Val, Trp, Cys, Leu, or Ile
LXICYNWLHRX

SEQ ID NO: 124886 - protein, 9 aa, Artificial Sequence
  Description of Artificial Sequence: Synthetic peptide
  Seed: LKDAIGEGK (MOG_HUMAN)
  misc_feature (2)..(2): Xaa can be Thr, Ala, Ser, Leu, Val, Met, Ile, Phe, Tyr, Gly, Glu, Trp, Asp, Pro, Asn, Gln, Cys, His, or Lys
  misc_feature (9)..(9): Xaa can be Lys, Arg, Tyr, Met, Leu, Phe, His, Trp, Val, Ile, or Gln
LXDAIGEGX

SEQ ID NO: 124887 - protein, 9 aa, Artificial Sequence
  Description of Artificial Sequence: Synthetic peptide
  Seed: LKVEDPFYW (MOG_HUMAN)
  misc_feature (2)..(2): Xaa can be Ser, Thr, Gln, Val, Ala, Leu, Met, Glu, Ile, Gly, Cys, Asn, Arg, Lys, Asp, His, Phe, Trp, Pro, or Tyr
  misc_feature (9)..(9): Xaa can be Trp, Phe, Leu, Ile, Met, Tyr, Val, or Cys
LXVEDPFYX

SEQ ID NO: 124888 - protein, 8 aa, Artificial Sequence
  Description of Artificial Sequence: Synthetic peptide
  Seed: LLAVLPVL (MOG_HUMAN)
  misc_feature (2)..(2): Xaa can be Gln, Gly, Ala, Met, Ser, Glu, Asn, Pro, Val, Leu, Asp, His, Lys, Ile, Thr, Trp, Phe, Tyr, or Arg
  misc_feature (8)..(8): Xaa can be Val, Ile, Leu, Met, Ala, Cys, or Phe
LXAVLPVX

SEQ ID NO: 124889 - protein, 9 aa, Artificial Sequence
  Description of Artificial Sequence: Synthetic peptide
  Seed: LLAVLPVLL (MOG_HUMAN)
  misc_feature (2)..(2): Xaa can be Met, Leu, Gln, Ala, Arg, Ile, Val, Thr, Ser, Phe, Asn, Gly, Glu, Cys, Asp, Tyr, Trp, Pro, His, or Lys
  misc_feature (9)..(9): Xaa can be Tyr, Leu, Phe, Ile, Met, Val, Lys, Arg, Trp, Ala, Cys, His, Thr, Gly, Ser, or Pro
LXAVLPVLX

SEQ ID NO: 124890 - protein, 10 aa, Artificial Sequence
  Description of Artificial Sequence: Synthetic peptide
  Seed: LLAVLPVLLL (MOG_HUMAN)
  misc_feature (2)..(2): Xaa can be Met, Leu, Arg, Ile, Gln, Val, Gly, Thr, Asn, Ser, Cys, or Ala
  misc_feature (10)..(10): Xaa can be Leu, Val, Ile, Phe, Met, Lys, Ala, Arg, Tyr, His, Cys, Gly, Thr, Ser, Trp, Pro, Asn, Gln, Asp, or Glu
LXAVLPVLLX

SEQ ID NO: 124891 - protein, 10 aa, Artificial Sequence
  Description of Artificial Sequence: Synthetic peptide
  Seed: LLKDAIGEGK (MOG_HUMAN)
  misc_feature (2)..(2): Xaa can be Ala, Ser, Val, Ile, Thr, Leu, Met, Gln, Gly, Phe, Tyr, Glu, Asn, Asp, Pro, Cys, Trp, Lys, or His
  misc_feature (10)..(10): Xaa can be Lys, Tyr, Arg, Phe, His, Leu, Met, Trp, Val, Ile, or Ala
LXKDAIGEGX

SEQ ID NO: 124892 - protein, 11 aa, Artificial Sequence
  Description of Artificial Sequence: Synthetic peptide
  Seed: LLKDAIGEGKV (MOG_HUMAN)
  misc_feature (2)..(2): Xaa can be Leu, Met, Ile, or Val
  misc_feature (11)..(11): Xaa can be Val, Leu, Met, Ala, or Ile
LXKDAIGEGKX

SEQ ID NO: 124893 - protein, 8 aa, Artificial Sequence
  Description of Artificial Sequence: Synthetic peptide
  Seed: LLLLLLQV (MOG_HUMAN)
  misc_feature (2)..(2): Xaa can be Leu, or Met
  misc_feature (8)..(8): Xaa can be , or Val
LXLLLLQX

SEQ ID NO: 124894 - protein, 11 aa, Artificial Sequence
  Description of Artificial Sequence: Synthetic peptide
  Seed: LLLLLQVSSSY (MOG_HUMAN)
  misc_feature (2)..(2): Xaa can be Gln, Met, Ala, Gly, Asn, Tyr, Trp, Ile, Val, Thr, Glu, Lys, Ser, Cys, Arg, His, Leu, Phe, Asp, or Pro
  misc_feature (11)..(11): Xaa can be Tyr, Met, Phe, or Leu
LXLLLQVSSSX

SEQ ID NO: 124895 - protein, 10 aa, Artificial Sequence
  Description of Artificial Sequence: Synthetic peptide
  Seed: LLLLQVSSSY (MOG_HUMAN)
  misc_feature (2)..(2): Xaa can be Gln, Met, Ser, Phe, Cys, Asp, Lys, Leu, Ile, Glu, His, Tyr, Ala, Asn, Pro, Trp, Thr, Gly, Arg, or Val
  misc_feature (10)..(10): Xaa can be Phe, Tyr, Leu, Met, Ile, His, Trp, or Val
LXLLQVSSSX

SEQ ID NO: 124896 - protein, 9 aa, Artificial Sequence
  Description of Artificial Sequence: Synthetic peptide
  Seed: LLLQITVGL (MOG_HUMAN)
  misc_feature (2)..(2): Xaa can be Leu, Met, Arg, Gln, Val, Ile, Ser, Thr, Ala, Gly, Glu, Asn, Phe, Cys, Tyr, Trp, Lys, Asp, Pro, or His
  misc_feature (9)..(9): Xaa can be Tyr, Phe, Leu, Arg, Val, Lys, Ile, Trp, Met, Ala, Thr, His, Cys, Ser, or Gln
LXLQITVGX

SEQ ID NO: 124897 - protein, 10 aa, Artificial Sequence
  Description of Artificial Sequence: Synthetic peptide
  Seed: LLLQITVGLI (MOG_HUMAN)
  misc_feature (2)..(2): Xaa can be Leu, Met, Ile, Gln, Lys, Ala, Val, Asn, Trp, Thr, Cys, His, Ser, Tyr, Arg, Glu, Asp, Phe, Gly, or Pro
  misc_feature (10)..(10): Xaa can be Val, Ile, Leu, Ala, Met, Gly, Glu, Phe, Asp, Asn, Trp, Thr, Gln, Arg, Cys, Tyr, His, Pro, Lys, or Ser
LXLQITVGLX

SEQ ID NO: 124898 - protein, 11 aa, Artificial Sequence
  Description of Artificial Sequence: Synthetic peptide
  Seed: LLLQITVGLIF (MOG_HUMAN)
  misc_feature (2)..(2): Xaa can be Tyr, Phe, Ser, Arg, Thr, Asn, Leu, Trp, Gln, Asp, Cys, Glu, Ile, Lys, Ala, Met, Gly, Val, His, or Pro
  misc_feature (11)..(11): Xaa can be Tyr, Phe, or Met
LXLQITVGLIX

SEQ ID NO: 124899 - protein, 9 aa, Artificial Sequence
  Description of Artificial Sequence: Synthetic peptide
  Seed: LLLQVSSSY (MOG_HUMAN)
  misc_feature (2)..(2): Xaa can be Gln, Pro, Met, Ala, Ser, Val, Thr, Leu, Lys, Ile, Gly, His, Glu, Arg, Asn, Phe, Tyr, Cys, Trp, or Asp
  misc_feature (9)..(9): Xaa can be Met, Phe, Tyr, Leu, Trp, His, Ile, Arg, Lys, Val, Ala, Gly, Thr, Ser, Cys, Gln, Glu, or As n
LXLQVSSSX

SEQ ID NO: 124900 - protein, 10 aa, Artificial Sequence
  Description of Artificial Sequence: Synthetic peptide
  Seed: LLLQVSSSYA (MOG_HUMAN)
  misc_feature (2)..(2): Xaa can be Met, Ile, Ala, Ser, Val, Gln, Thr, Leu, Asn, Arg, Asp, Trp, Lys, Phe, Gly, Pro, Tyr, His, Cys, or Glu
  misc_feature (10)..(10): Xaa can be Tyr, Met, Phe, Ile, Val, Leu, Ala, Asp, Thr, Trp, His, Gln, Asn, Glu, Ser, Arg, Gly, Pro, Lys, or Cys
LXLQVSSSYX

SEQ ID NO: 124901 - protein, 8 aa, Artificial Sequence
  Description of Artificial Sequence: Synthetic peptide
  Seed: LLQITVGL (MOG_HUMAN)
  misc_feature (2)..(2): Xaa can be Met, Leu, Ala, Phe, Tyr, Ile, or Trp
  misc_feature (8)..(8): Xaa can be Val, Leu, or Ile
LXQITVGX

SEQ ID NO: 124902 - protein, 9 aa, Artificial Sequence
  Description of Artificial Sequence: Synthetic peptide
  Seed: LLQITVGLI (MOG_HUMAN)
  misc_feature (2)..(2): Xaa can be Met, Leu, Gln, Ile, Thr, or Val
  misc_feature (9)..(9): Xaa can be Val, Leu, Ile, Met, Ala, Phe, or Thr
LXQITVGLX

SEQ ID NO: 124903 - protein, 10 aa, Artificial Sequence
  Description of Artificial Sequence: Synthetic peptide
  Seed: LLQITVGLIF (MOG_HUMAN)
  misc_feature (2)..(2): Xaa can be Lys, Met, Arg, Gln, His, Ser, Glu, Trp, Leu, Asp, Asn, Pro, Gly, Tyr, Thr, Phe, Cys, Ala, Ile, or Val
  misc_feature (10)..(10): Xaa can be Trp, His, Tyr, Ile, Met, Phe, Leu, or Val
LXQITVGLIX

SEQ ID NO: 124904 - protein, 8 aa, Artificial Sequence
  Description of Artificial Sequence: Synthetic peptide
  Seed: LLQVSSSY (MOG_HUMAN)
  misc_feature (2)..(2): Xaa can be Gln, Met, Lys, Leu, Pro, Val, Tyr, Ala, His, Ser, Phe, Arg, Ile, Asn, Trp, Thr, Gly, or Gl u
  misc_feature (8)..(8): Xaa can be Tyr, Phe, Met, Trp, Ile, or Leu
LXQVSSSX

SEQ ID NO: 124905 - protein, 9 aa, Artificial Sequence
  Description of Artificial Sequence: Synthetic peptide
  Seed: LLQVSSSYA (MOG_HUMAN)
  misc_feature (2)..(2): Xaa can be Leu, Met, Ile, Gln, Thr, Val, Ser, or Ala
  misc_feature (9)..(9): Xaa can be Val, Leu, Ile, Ala, Cys, Met, or Thr
LXQVSSSYX

SEQ ID NO: 124906 - protein, 9 aa, Artificial Sequence
  Description of Artificial Sequence: Synthetic peptide
  Seed: LPCRISPGK (MOG_HUMAN)
  misc_feature (2)..(2): Xaa can be Val, Thr, Ile, Leu, Ser, Met, Ala, Gly, Asn, Asp, Gln, or Pro
  misc_feature (9)..(9): Xaa can be Lys, Arg, Tyr, or His
LXCRISPGX

SEQ ID NO: 124907 - protein, 11 aa, Artificial Sequence
  Description of Artificial Sequence: Synthetic peptide
  Seed: LPCRISPGKNA (MOG_HUMAN)
  misc_feature (2)..(2): Xaa can be , or Pro
  misc_feature (11)..(11): Xaa can be Thr, Val, Phe, Pro, Met, Cys, Ile, Leu, or Ala
LXCRISPGKNX

SEQ ID NO: 124908 - protein, 8 aa, Artificial Sequence
  Description of Artificial Sequence: Synthetic peptide
  Seed: LPSCLCSF (MOG_HUMAN)
  misc_feature (2)..(2): Xaa can be , or Pro
  misc_feature (8)..(8): Xaa can be Tyr, Leu, Phe, Ile, or Met
LXSCLCSX

SEQ ID NO: 124909 - protein, 9 aa, Artificial Sequence
  Description of Artificial Sequence: Synthetic peptide
  Seed: LPSCLCSFL (MOG_HUMAN)
  misc_feature (2)..(2): Xaa can be Pro, Ala, Met, Val, Thr, Ile, or Ser
  misc_feature (9)..(9): Xaa can be Tyr, Trp, Phe, Ala, Met, Thr, Leu, Cys, Ile, Pro, Val, Ser, or His
LXSCLCSFX

SEQ ID NO: 124910 - protein, 10 aa, Artificial Sequence
  Description of Artificial Sequence: Synthetic peptide
  Seed: LPSCLCSFLL (MOG_HUMAN)
  misc_feature (2)..(2): Xaa can be Pro, Ala, Met, Ile, Val, Ser, or Thr
  misc_feature (10)..(10): Xaa can be Trp, Tyr, Phe, Thr, Ala, Leu, His, Met, Ile, or Val
LXSCLCSFLX

SEQ ID NO: 124911 - protein, 11 aa, Artificial Sequence
  Description of Artificial Sequence: Synthetic peptide
  Seed: LPSCLCSFLLL (MOG_HUMAN)
  misc_feature (2)..(2): Xaa can be Pro, or Ala
  misc_feature (11)..(11): Xaa can be Trp, Leu, Phe, Met, or Tyr
LXSCLCSFLLX

SEQ ID NO: 124912 - protein, 8 aa, Artificial Sequence
  Description of Artificial Sequence: Synthetic peptide
  Seed: LPVLLLQI (MOG_HUMAN)
  misc_feature (2)..(2): Xaa can be Pro, Ala, Glu, Gln, or Asp
  misc_feature (8)..(8): Xaa can be Val, Ile, Leu, Pro, Phe, Thr, Ala, Cys, or Met
LXVLLLQX

SEQ ID NO: 124913 - protein, 9 aa, Artificial Sequence
  Description of Artificial Sequence: Synthetic peptide
  Seed: LPVLLLQIT (MOG_HUMAN)
  misc_feature (2)..(2): Xaa can be Pro, or Ala
  misc_feature (9)..(9): Xaa can be Ile, Val, Leu, Phe, Cys, Tyr, Ser, Pro, Thr, Ala, Gly, or Met
LXVLLLQIX

SEQ ID NO: 124914 - protein, 10 aa, Artificial Sequence
  Description of Artificial Sequence: Synthetic peptide
  Seed: LPVLLLQITV (MOG_HUMAN)
  misc_feature (2)..(2): Xaa can be Pro, Met, Leu, Gln, Val, Cys, Glu, Arg, Ala, Gly, Asp, Trp, Lys, Ile, Thr, Phe, Tyr, His, Ser, or Asn
  misc_feature (10)..(10): Xaa can be Val, Ala, Leu, Ile, Ser, Thr, Met, Cys, or Phe
LXVLLLQITX

SEQ ID NO: 124915 - protein, 8 aa, Artificial Sequence
  Description of Artificial Sequence: Synthetic peptide
  Seed: LQITVGLI (MOG_HUMAN)
  misc_feature (2)..(2): Xaa can be Gln, Glu, Ala, Ser, Pro, Gly, or Met
  misc_feature (8)..(8): Xaa can be Ile, Val, Leu, or Met
LXITVGLX

SEQ ID NO: 124916 - protein, 9 aa, Artificial Sequence
  Description of Artificial Sequence: Synthetic peptide
  Seed: LQITVGLIF (MOG_HUMAN)
  misc_feature (2)..(2): Xaa can be Gln, Glu, Ala, Ser, Thr, Arg, Met, Gly, His, Lys, Val, Ile, Asp, Pro, Leu, Asn, Tyr, Phe, Cys, or Trp
  misc_feature (9)..(9): Xaa can be Trp, Leu, Tyr, Phe, Met, Ile, Val, His, Lys, Arg, Cys, Ala, Gly, Thr, Asn, or Ser
LXITVGLIX

SEQ ID NO: 124917 - protein, 10 aa, Artificial Sequence
  Description of Artificial Sequence: Synthetic peptide
  Seed: LQITVGLIFL (MOG_HUMAN)
  misc_feature (2)..(2): Xaa can be Lys, Met, Gln, Ile, Val, Leu, Ala, Ser, Thr, His, Arg, Glu, Gly, Asn, Phe, Pro, Asp, Tyr, Trp, or Cys
  misc_feature (10)..(10): Xaa can be Val, Tyr, Phe, Met, Leu, Ile, Ala, Thr, Arg, Ser, Lys, Asp, Cys, Glu, Pro, His, Trp, Gln, Asn, or Gly
LXITVGLIFX

SEQ ID NO: 124918 - protein, 9 aa, Artificial Sequence
  Description of Artificial Sequence: Synthetic peptide
  Seed: LQVSSSYAG (MOG_HUMAN)
  misc_feature (2)..(2): Xaa can be Gln, Met, Lys, Glu, Ser, Val, His, Leu, Arg, Ala, Ile, Thr, Phe, Asn, Tyr, Gly, Pro, Cys, Trp, or Asp
  misc_feature (9)..(9): Xaa can be Phe, Met, Tyr, Leu, Trp, Ile, His, Val, Gly, Ala, Thr, Ser, Gln, Asn, Pro, or Cys
LXVSSSYAX

SEQ ID NO: 124919 - protein, 11 aa, Artificial Sequence
  Description of Artificial Sequence: Synthetic peptide
  Seed: LQVSSSYAGQF (MOG_HUMAN)
  misc_feature (2)..(2): Xaa can be Gln, Ser, Lys, Thr, Met, Leu, Glu, Gly, Pro, Cys, Val, Trp, Ile, Asp, Tyr, Phe, Arg, Ala, His, or Asn
  misc_feature (11)..(11): Xaa can be Phe, Tyr, Trp, Met, Leu, or Ile
LXVSSSYAGQX

SEQ ID NO: 124920 - protein, 9 aa, Artificial Sequence
  Description of Artificial Sequence: Synthetic peptide
  Seed: LQYRLRGKL (MOG_HUMAN)
  misc_feature (2)..(2): Xaa can be Arg, Gln, Met, Ala, Glu, His, Ser, Leu, Lys, Val, Asp, Gly, Asn, Phe, Ile, Thr, Pro, or Ty r
  misc_feature (9)..(9): Xaa can be Tyr, Phe, Leu, Met, Val, Ile, His, Trp, Cys, Ala, Lys, or Arg
LXYRLRGKX

SEQ ID NO: 124921 - protein, 10 aa, Artificial Sequence
  Description of Artificial Sequence: Synthetic peptide
  Seed: LQYRLRGKLR (MOG_HUMAN)
  misc_feature (2)..(2): Xaa can be Leu, Gln, Met, Phe, Thr, Tyr, Trp, Ile, Ser, Val, His, Asn, Gly, Cys, or Ala
  misc_feature (10)..(10): Xaa can be Arg, or Lys
LXYRLRGKLX

SEQ ID NO: 124922 - protein, 8 aa, Artificial Sequence
  Description of Artificial Sequence: Synthetic peptide
  Seed: LRAEIENL (MOG_HUMAN)
  misc_feature (2)..(2): Xaa can be Arg, Tyr, His, or Ala
  misc_feature (8)..(8): Xaa can be Leu, Phe, Met, Tyr, or Ile
LXAEIENX

SEQ ID NO: 124923 - protein, 9 aa, Artificial Sequence
  Description of Artificial Sequence: Synthetic peptide
  Seed: LRAEIENLH (MOG_HUMAN)
  misc_feature (2)..(2): Xaa can be Arg, Tyr, Phe, Gln, Lys, Ala, His, Trp, Gly, Ser, Met, Thr, Val, Ile, Asn, or Leu
  misc_feature (9)..(9): Xaa can be Leu, Met, Phe, Tyr, Ile, Val, Trp, Arg, Lys, or His
LXAEIENLX

SEQ ID NO: 124924 - protein, 10 aa, Artificial Sequence
  Description of Artificial Sequence: Synthetic peptide
  Seed: LRAEIENLHR (MOG_HUMAN)
  misc_feature (2)..(2): Xaa can be Arg, Tyr, Phe, Met, or Gln
  misc_feature (10)..(10): Xaa can be Leu, Phe, Met, Tyr, Val, Arg, Lys, His, Ile, Trp, or Ala
LXAEIENLHX

SEQ ID NO: 124925 - protein, 9 aa, Artificial Sequence
  Description of Artificial Sequence: Synthetic peptide
  Seed: LRGKLRAEI (MOG_HUMAN)
  misc_feature (2)..(2): Xaa can be Arg, His, Ala, Gln, Tyr, Phe, Trp, Ser, Gly, Ile, Leu, Met, Glu, Asn, Thr, Val, Asp, Cys, Lys, or Pro
  misc_feature (9)..(9): Xaa can be Leu, Ile, Met, Phe, Tyr, Val, Arg, Trp, His, Lys, or Cys
LXGKLRAEX

SEQ ID NO: 124926 - protein, 8 aa, Artificial Sequence
  Description of Artificial Sequence: Synthetic peptide
  Seed: LRIRNVRF (MOG_HUMAN)
  misc_feature (2)..(2): Xaa can be Arg, or Tyr
  misc_feature (8)..(8): Xaa can be Phe, Leu, or Tyr
LXIRNVRX

SEQ ID NO: 124927 - protein, 10 aa, Artificial Sequence
  Description of Artificial Sequence: Synthetic peptide
  Seed: LRVPCWKITL (MOG_HUMAN)
  misc_feature (2)..(2): Xaa can be Arg, Tyr, His, Gly, Ala, Ser, Leu, Thr, Asn, Gln, or Met
  misc_feature (10)..(10): Xaa can be Leu, Tyr, Phe, Met, Trp, Ile, Lys, Arg, or Val
LXVPCWKITX

SEQ ID NO: 124928 - protein, 11 aa, Artificial Sequence
  Description of Artificial Sequence: Synthetic peptide
  Seed: LRVPCWKITLF (MOG_HUMAN)
  misc_feature (2)..(2): Xaa can be , or Arg
  misc_feature (11)..(11): Xaa can be Tyr, Ile, Leu, Met, Arg, Lys, Trp, or Phe
LXVPCWKITLX

SEQ ID NO: 124929 - protein, 9 aa, Artificial Sequence
  Description of Artificial Sequence: Synthetic peptide
  Seed: LSRPSLPSC (MOG_HUMAN)
  misc_feature (2)..(2): Xaa can be Pro, Thr, Val, Met, Phe, Tyr, Ser, Gln, Ile, Ala, Leu, Gly, Asn, Trp, Glu, Cys, Asp, His, Lys, or Arg
  misc_feature (9)..(9): Xaa can be Tyr, Ile, Trp, Val, Leu, Lys, Met, Phe, Ala, His, Gly, Ser, Arg, Thr, Cys, Pro, Asn, Gln, Glu, or Asp
LXRPSLPSX

SEQ ID NO: 124930 - protein, 10 aa, Artificial Sequence
  Description of Artificial Sequence: Synthetic peptide
  Seed: LSRPSLPSCL (MOG_HUMAN)
  misc_feature (2)..(2): Xaa can be Thr, Ser, Val, Tyr, Ala, Ile, Arg, Met, Gln, Gly, Leu, Phe, Trp, Cys, Asn, Pro, Glu, Lys, Asp, or His
  misc_feature (10)..(10): Xaa can be Trp, Lys, Leu, Tyr, Phe, Ala, Met, Val, Ile, His, Ser, Gly, Arg, or Thr
LXRPSLPSCX

SEQ ID NO: 124931 - protein, 10 aa, Artificial Sequence
  Description of Artificial Sequence: Synthetic peptide
  Seed: LVALIICYNW (MOG_HUMAN)
  misc_feature (2)..(2): Xaa can be Thr, Ser, Ala, Gly, Val, Cys, Glu, Pro, Asn, Leu, Met, Asp, Tyr, Trp, Ile, Phe, His, Lys, Gln, or Arg
  misc_feature (10)..(10): Xaa can be Trp, Phe, Tyr, Leu, Ile, or Met
LXALIICYNX

SEQ ID NO: 124932 - protein, 8 aa, Artificial Sequence
  Description of Artificial Sequence: Synthetic peptide
  Seed: LVGDEVEL (MOG_HUMAN)
  misc_feature (2)..(2): Xaa can be Thr, Ala, Ser, Val, Ile, Met, Asn, Glu, Gln, Tyr, Gly, Leu, Phe, Asp, Cys, Pro, His, or Ar g
  misc_feature (8)..(8): Xaa can be Lys, Leu, Arg, Met, Ile, Tyr, Phe, or Val
LXGDEVEX

SEQ ID NO: 124933 - protein, 11 aa, Artificial Sequence
  Description of Artificial Sequence: Synthetic peptide
  Seed: LVGDEVELPCR (MOG_HUMAN)
  misc_feature (2)..(2): Xaa can be Ala, Thr, Val, Ile, Ser, Met, Leu, Glu, Asp, Phe, Tyr, Gly, Gln, Asn, or Cys
  misc_feature (11)..(11): Xaa can be Lys, Arg, Tyr, Phe, Leu, Met, or His
LXGDEVELPCX

SEQ ID NO: 124934 - protein, 9 aa, Artificial Sequence
  Description of Artificial Sequence: Synthetic peptide
  Seed: LVLLAVLPV (MOG_HUMAN)
  misc_feature (2)..(2): Xaa can be Gln, Met, Leu, Val, Ile, Thr, Ser, Ala, Glu, Gly, Asp, Asn, or Cys
  misc_feature (9)..(9): Xaa can be Val, Ile, Leu, Ala, Thr, Met, Ser, Cys, or Phe
LXLLAVLPX

SEQ ID NO: 124935 - protein, 10 aa, Artificial Sequence
  Description of Artificial Sequence: Synthetic peptide
  Seed: LVLLAVLPVL (MOG_HUMAN)
  misc_feature (2)..(2): Xaa can be Gln, Met, Leu, Ser, Arg, Ile, Gly, Tyr, Phe, His, Lys, Glu, Val, Thr, Cys, Trp, Asp, Ala, Pro, or Asn
  misc_feature (10)..(10): Xaa can be Ala, Leu, Val, Thr, Ile, Met, Pro, Gln, Arg, Trp, Tyr, Phe, Gly, Asp, Glu, Asn, His, Cys, Ser, or Lys
LXLLAVLPVX

SEQ ID NO: 124936 - protein, 11 aa, Artificial Sequence
  Description of Artificial Sequence: Synthetic peptide
  Seed: LVLLAVLPVLL (MOG_HUMAN)
  misc_feature (2)..(2): Xaa can be Phe, Met, Tyr, Leu, Val, His, Arg, Lys, Gln, Thr, Ser, Ala, Asn, Ile, Gly, Trp, Asp, Glu, Cys, or Pro
  misc_feature (11)..(11): Xaa can be Val, Leu, Ile, Ala, or Met
LXLLAVLPVLX

SEQ ID NO: 124937 - protein, 9 aa, Artificial Sequence
  Description of Artificial Sequence: Synthetic peptide
  Seed: MASLSRPSL (MOG_HUMAN)
  misc_feature (2)..(2): Xaa can be Pro, Gln, Arg, Ala, Ser, Thr, Tyr, Val, Met, His, Phe, Leu, Lys, Ile, Gly, Asn, Glu, Trp, Asp, or Cys
  misc_feature (9)..(9): Xaa can be Leu, Trp, Tyr, Phe, Ile, Met, Val, Lys, His, Ala, Cys, Arg, Thr, Ser, Gln, Pro, Gly, Asp, Asn, or Glu
MXSLSRPSX

SEQ ID NO: 124938 - protein, 8 aa, Artificial Sequence
  Description of Artificial Sequence: Synthetic peptide
  Seed: MELKVEDP (MOG_HUMAN)
  misc_feature (2)..(2): Xaa can be Glu, or Asp
  misc_feature (8)..(8): Xaa can be Leu, Ala, Val, Ile, Ser, Cys, Phe, Thr, Pro, or Met
MXLKVEDX

SEQ ID NO: 124939 - protein, 9 aa, Artificial Sequence
  Description of Artificial Sequence: Synthetic peptide
  Seed: MELKVEDPF (MOG_HUMAN)
  misc_feature (2)..(2): Xaa can be Glu, Gln, Asp, Met, Leu, Lys, Val, Thr, Ala, Ser, Ile, His, Arg, Pro, Tyr, Gly, Phe, Asn, Cys, or Trp
  misc_feature (9)..(9): Xaa can be Phe, Tyr, Met, Leu, Trp, Ile, Val, Ala, His, Lys, Cys, Arg, Pro, Glu, Asp, Ser, Thr, or Gl y
MXLKVEDPX

SEQ ID NO: 124940 - protein, 10 aa, Artificial Sequence
  Description of Artificial Sequence: Synthetic peptide
  Seed: MELKVEDPFY (MOG_HUMAN)
  misc_feature (2)..(2): Xaa can be Gln, Glu, Met, Asp, Lys, Thr, Trp, His, Phe, Val, Ala, Cys, Arg, Ile, Pro, Gly, Asn, Leu, Ser, or Tyr
  misc_feature (10)..(10): Xaa can be Phe, Tyr, Met, Trp, Leu, His, Val, or Ile
MXLKVEDPFX

SEQ ID NO: 124941 - protein, 11 aa, Artificial Sequence
  Description of Artificial Sequence: Synthetic peptide
  Seed: MELKVEDPFYW (MOG_HUMAN)
  misc_feature (2)..(2): Xaa can be Ser, Thr, Ala, Glu, Val, Cys, Asn, Gly, Met, Leu, Ile, Pro, Tyr, Phe, Asp, Trp, Arg, Gln, or Lys
  misc_feature (11)..(11): Xaa can be Trp, Phe, Tyr, Leu, Met, Ile, Val, or Cys
MXLKVEDPFYX

SEQ ID NO: 124942 - protein, 9 aa, Artificial Sequence
  Description of Artificial Sequence: Synthetic peptide
  Seed: MEVGWYRPP (MOG_HUMAN)
  misc_feature (2)..(2): Xaa can be Glu, Asp, Gln, or Pro
  misc_feature (9)..(9): Xaa can be Tyr, Phe, Ala, Met, Leu, Val, Ile, Trp, Pro, Gly, Thr, Ser, His, Gln, or Cys
MXVGWYRPX

SEQ ID NO: 124943 - protein, 10 aa, Artificial Sequence
  Description of Artificial Sequence: Synthetic peptide
  Seed: MEVGWYRPPF (MOG_HUMAN)
  misc_feature (2)..(2): Xaa can be Glu, Gln, Met, Lys, Leu, Arg, His, Ala, Pro, Thr, Val, Ile, Ser, Tyr, Gly, Cys, Trp, Asn, Phe, or Asp
  misc_feature (10)..(10): Xaa can be Tyr, Phe, Met, Leu, Trp, Ile, His, Val, Ala, Cys, Pro, Ser, or Thr
MXVGWYRPPX

SEQ ID NO: 124944 - protein, 9 aa, Artificial Sequence
  Description of Artificial Sequence: Synthetic peptide
  Seed: NATGMEVGW (MOG_HUMAN)
  misc_feature (2)..(2): Xaa can be Pro, Val, Ala, Ser, Thr, Phe, Leu, Gly, Met, Cys, Asn, or Ile
  misc_feature (9)..(9): Xaa can be Trp, Phe, Tyr, Leu, or Met
NXTGMEVGX

SEQ ID NO: 124945 - protein, 11 aa, Artificial Sequence
  Description of Artificial Sequence: Synthetic peptide
  Seed: NATGMEVGWYR (MOG_HUMAN)
  misc_feature (2)..(2): Xaa can be Met, Phe, Asn, Ala, Arg, Leu, Ser, Cys, Gly, His, Lys, Thr, Gln, Val, Trp, Glu, Tyr, Ile, Asp, or Pro
  misc_feature (11)..(11): Xaa can be Arg, or Lys
NXTGMEVGWYX

SEQ ID NO: 124946 - protein, 11 aa, Artificial Sequence
  Description of Artificial Sequence: Synthetic peptide
  Seed: NGKDQDGDQAP (MOG_HUMAN)
  misc_feature (2)..(2): Xaa can be Gly, Arg, Ile, Leu, Ala, Met, Val, Gln, Ser, Thr, Asp, Glu, Asn, Trp, Phe, Cys, Pro, Lys, Tyr, or His
  misc_feature (11)..(11): Xaa can be Lys, Glu, Phe, Arg, Tyr, Leu, Asn, Gln, Asp, His, Met, Ile, Trp, Val, Gly, Pro, or Ser
NXKDQDGDQAX

SEQ ID NO: 124947 - protein, 10 aa, Artificial Sequence
  Description of Artificial Sequence: Synthetic peptide
  Seed: NLHRTFDPHF (MOG_HUMAN)
  misc_feature (2)..(2): Xaa can be Met, Gln, Lys, Leu, Ile, Val, Ala, or Arg
  misc_feature (10)..(10): Xaa can be Tyr, Phe, or Met
NXHRTFDPHX

SEQ ID NO: 124948 - protein, 9 aa, Artificial Sequence
  Description of Artificial Sequence: Synthetic peptide
  Seed: PEYRGRTEL (MOG_HUMAN)
  misc_feature (2)..(2): Xaa can be Glu, Gln, His, Asp, or Arg
  misc_feature (9)..(9): Xaa can be Met, Leu, Ile, Trp, Val, Phe, Pro, Ala, Cys, Thr, or Tyr
PXYRGRTEX

SEQ ID NO: 124949 - protein, 10 aa, Artificial Sequence
  Description of Artificial Sequence: Synthetic peptide
  Seed: PEYRGRTELL (MOG_HUMAN)
  misc_feature (2)..(2): Xaa can be , or Glu
  misc_feature (10)..(10): Xaa can be Ala, Val, Met, or Leu
PXYRGRTELX

SEQ ID NO: 124950 - protein, 9 aa, Artificial Sequence
  Description of Artificial Sequence: Synthetic peptide
  Seed: PFSRVVHLY (MOG_HUMAN)
  misc_feature (2)..(2): Xaa can be Phe, Tyr, Met, Thr, Gly, Glu, Gln, Ser, Asn, Leu, Trp, Ile, Asp, Ala, or Val
  misc_feature (9)..(9): Xaa can be Tyr, Phe, Met, or Leu
PXSRVVHLX

SEQ ID NO: 124951 - protein, 10 aa, Artificial Sequence
  Description of Artificial Sequence: Synthetic peptide
  Seed: PFSRVVHLYR (MOG_HUMAN)
  misc_feature (2)..(2): Xaa can be Val, Arg, Met, His, Tyr, Ala, Trp, Phe, Gln, Ser, Lys, Ile, Thr, Leu, Gly, Pro, Cys, Asp, Asn, or Glu
  misc_feature (10)..(10): Xaa can be Arg, or Lys
PXSRVVHLYX

SEQ ID NO: 124952 - protein, 10 aa, Artificial Sequence
  Description of Artificial Sequence: Synthetic peptide
  Seed: PFYWVSPGVL (MOG_HUMAN)
  misc_feature (2)..(2): Xaa can be Phe, Tyr, Met, or Ser
  misc_feature (10)..(10): Xaa can be Phe, Met, Leu, or Tyr
PXYWVSPGVX

SEQ ID NO: 124953 - protein, 10 aa, Artificial Sequence
  Description of Artificial Sequence: Synthetic peptide
  Seed: PHFLRVPCWK (MOG_HUMAN)
  misc_feature (2)..(2): Xaa can be Ile, Val, His, Phe, Trp, Met, Tyr, Arg, Leu, Thr, Lys, Ser, Ala, Gln, Pro, Cys, Glu, Gly, Asn, or Asp
  misc_feature (10)..(10): Xaa can be Arg, or Lys
PXFLRVPCWX

SEQ ID NO: 124954 - protein, 9 aa, Artificial Sequence
  Description of Artificial Sequence: Synthetic peptide
  Seed: PLVALIICY (MOG_HUMAN)
  misc_feature (2)..(2): Xaa can be Gln, Val, Ser, Leu, Thr, Met, Ile, Ala, Trp, Phe, Asn, Glu, Gly, Tyr, or Pro
  misc_feature (9)..(9): Xaa can be Tyr, Phe, or Met
PXVALIICX

SEQ ID NO: 124955 - protein, 9 aa, Artificial Sequence
  Description of Artificial Sequence: Synthetic peptide
  Seed: PPFSRVVHL (MOG_HUMAN)
  misc_feature (2)..(2): Xaa can be Pro, Ala, Met, Arg, His, Leu, Val, Gln, Ile, Ser, Glu, Phe, Gly, Tyr, Asp, Asn, Lys, or Th r
  misc_feature (9)..(9): Xaa can be Leu, Met, Ile, Val, Phe, Ala, Pro, Cys, or Thr
PXFSRVVHX

SEQ ID NO: 124956 - protein, 10 aa, Artificial Sequence
  Description of Artificial Sequence: Synthetic peptide
  Seed: PPFSRVVHLY (MOG_HUMAN)
  misc_feature (2)..(2): Xaa can be Tyr, Met, Trp, Phe, Arg, Thr, Ile, Glu, Gln, Asp, Pro, Asn, Cys, Gly, Lys, Val, Ser, His, Ala, or Leu
  misc_feature (10)..(10): Xaa can be Tyr, or Phe
PXFSRVVHLX

SEQ ID NO: 124957 - protein, 11 aa, Artificial Sequence
  Description of Artificial Sequence: Synthetic peptide
  Seed: PPFSRVVHLYR (MOG_HUMAN)
  misc_feature (2)..(2): Xaa can be Thr, His, Cys, Met, Arg, Ser, Phe, Val, Ile, Trp, Ala, Leu, Tyr, Gln, Lys, Asp, Asn, Glu, Pro, or Gly
  misc_feature (11)..(11): Xaa can be Arg, or Lys
PXFSRVVHLYX

SEQ ID NO: 124958 - protein, 8 aa, Artificial Sequence
  Description of Artificial Sequence: Synthetic peptide
  Seed: PRHPIRAL (MOG_HUMAN)
  misc_feature (2)..(2): Xaa can be Arg, Tyr, Met, Phe, Ala, Trp, Lys, Leu, Gln, Glu, Ser, Val, Asn, His, or Ile
  misc_feature (8)..(8): Xaa can be Leu, Met, Phe, Tyr, Val, or Ile
PXHPIRAX

SEQ ID NO: 124959 - protein, 9 aa, Artificial Sequence
  Description of Artificial Sequence: Synthetic peptide
  Seed: PRHPIRALV (MOG_HUMAN)
  misc_feature (2)..(2): Xaa can be Arg, His, or Gln
  misc_feature (9)..(9): Xaa can be Ala, Leu, Ile, Val, Met, or Phe
PXHPIRALX

SEQ ID NO: 124960 - protein, 9 aa, Artificial Sequence
  Description of Artificial Sequence: Synthetic peptide
  Seed: PSCLCSFLL (MOG_HUMAN)
  misc_feature (2)..(2): Xaa can be Thr, Ser, Ala, Val, Met, Gln, Leu, Ile, Gly, Cys, or Asn
  misc_feature (9)..(9): Xaa can be Trp, Phe, Leu, Met, or Tyr
PXCLCSFLX

SEQ ID NO: 124961 - protein, 10 aa, Artificial Sequence
  Description of Artificial Sequence: Synthetic peptide
  Seed: PSLPSCLCSF (MOG_HUMAN)
  misc_feature (2)..(2): Xaa can be Ser, Thr, Ala, Val, Gln, Leu, Met, Gly, Ile, Pro, Glu, Cys, Asp, Asn, Lys, or Phe
  misc_feature (10)..(10): Xaa can be Trp, Tyr, Phe, Leu, or Met
PXLPSCLCSX

SEQ ID NO: 124962 - protein, 9 aa, Artificial Sequence
  Description of Artificial Sequence: Synthetic peptide
  Seed: PVLGPLVAL (MOG_HUMAN)
  misc_feature (2)..(2): Xaa can be Ala, Pro, Ser, Val, Leu, Thr, Met, Ile, Gly, Gln, Tyr, Phe, Glu, Asn, Cys, Asp, His, Lys, or Trp
  misc_feature (9)..(9): Xaa can be Tyr, Phe, Leu, Ala, Met, Val, Ile, Lys, His, Thr, Gly, Cys, Ser, Pro, or Arg
PXLGPLVAX

SEQ ID NO: 124963 - protein, 10 aa, Artificial Sequence
  Description of Artificial Sequence: Synthetic peptide
  Seed: PVLGPLVALI (MOG_HUMAN)
  misc_feature (2)..(2): Xaa can be Phe, Tyr, Trp, Met, Arg, Ser, Ile, Leu, Ala, Val, Thr, His, Lys, Gly, Gln, Asn, or Cys
  misc_feature (10)..(10): Xaa can be Val, Leu, Ile, Ala, Met, or Thr
PXLGPLVALX

SEQ ID NO: 124964 - protein, 11 aa, Artificial Sequence
  Description of Artificial Sequence: Synthetic peptide
  Seed: QAPEYRGRTEL (MOG_HUMAN)
  misc_feature (2)..(2): Xaa can be Pro, Met, Arg, Ala, Ser, Tyr, Leu, Val, His, Lys, Thr, Phe, Ile, Trp, Gln, Gly, Asp, Glu, Asn, or Cys
  misc_feature (11)..(11): Xaa can be Leu, Met, Phe, Val, Ile, Ala, or Tyr
QXPEYRGRTEX

SEQ ID NO: 124965 - protein, 9 aa, Artificial Sequence
  Description of Artificial Sequence: Synthetic peptide
  Seed: QDGDQAPEY (MOG_HUMAN)
  misc_feature (2)..(2): Xaa can be Glu, Leu, Gln, Ile, Ala, Val, Ser, Met, Thr, Asp, Phe, Gly, Pro, Trp, Asn, Tyr, Lys, His, or Cys
  misc_feature (9)..(9): Xaa can be Tyr, Phe, Lys, Met, Arg, Leu, Trp, Cys, His, Ile, or Val
QXGDQAPEX

SEQ ID NO: 124966 - protein, 8 aa, Artificial Sequence
  Description of Artificial Sequence: Synthetic peptide
  Seed: QEEAAMEL (MOG_HUMAN)
  misc_feature (2)..(2): Xaa can be Glu, Asp, or Gln
  misc_feature (8)..(8): Xaa can be Leu, Val, Ile, Phe, Met, Pro, Tyr, Ala, Trp, Thr, or Cys
QXEAAMEX

SEQ ID NO: 124967 - protein, 9 aa, Artificial Sequence
  Description of Artificial Sequence: Synthetic peptide
  Seed: QEEAAMELK (MOG_HUMAN)
  misc_feature (2)..(2): Xaa can be Thr, Ser, Ala, Val, Leu, Met, Ile, Phe, Glu, Asn, Asp, Gln, Gly, Cys, Trp, or Tyr
  misc_feature (9)..(9): Xaa can be Tyr, Lys, Arg, His, Phe, or Met
QXEAAMELX

SEQ ID NO: 124968 - protein, 10 aa, Artificial Sequence
  Description of Artificial Sequence: Synthetic peptide
  Seed: QEEAAMELKV (MOG_HUMAN)
  misc_feature (2)..(2): Xaa can be Glu, Gln, Asp, or Lys
  misc_feature (10)..(10): Xaa can be Trp, Tyr, Phe, Leu, Val, Met, Thr, Ile, Cys, Ser, Pro, His, Ala, or Gly
QXEAAMELKX

SEQ ID NO: 124969 - protein, 10 aa, Artificial Sequence
  Description of Artificial Sequence: Synthetic peptide
  Seed: QFLEELRNPF (MOG_HUMAN)
  misc_feature (2)..(2): Xaa can be Tyr, Trp, or Phe
  misc_feature (10)..(10): Xaa can be Trp, Phe, Tyr, Ile, Leu, or Met
QXLEELRNPX

SEQ ID NO: 124970 - protein, 8 aa, Artificial Sequence
  Description of Artificial Sequence: Synthetic peptide
  Seed: QFRVIGPR (MOG_HUMAN)
  misc_feature (2)..(2): Xaa can be Tyr, Met, or Phe
  misc_feature (8)..(8): Xaa can be , or Arg
QXRVIGPX

SEQ ID NO: 124971 - protein, 8 aa, Artificial Sequence
  Description of Artificial Sequence: Synthetic peptide
  Seed: QITVGLIF (MOG_HUMAN)
  misc_feature (2)..(2): Xaa can be Tyr, Phe, Gln, Met, Arg, Asn, Val, Ile, Ala, Trp, His, Leu, Lys, or Ser
  misc_feature (8)..(8): Xaa can be Tyr, Phe, or Met
QXTVGLIX

SEQ ID NO: 124972 - protein, 9 aa, Artificial Sequence
  Description of Artificial Sequence: Synthetic peptide
  Seed: QITVGLIFL (MOG_HUMAN)
  misc_feature (2)..(2): Xaa can be Met, Leu, Ala, Ser, Thr, Ile, Val, Gln, Gly, or Asn
  misc_feature (9)..(9): Xaa can be Leu, Ile, Val, Ala, Met, Phe, or Thr
QXTVGLIFX

SEQ ID NO: 124973 - protein, 10 aa, Artificial Sequence
  Description of Artificial Sequence: Synthetic peptide
  Seed: QVSSSYAGQF (MOG_HUMAN)
  misc_feature (2)..(2): Xaa can be Met, Val, Thr, Ala, Ile, Ser, Leu, Glu, Pro, Gln, Tyr, Arg, Phe, Cys, Trp, Asn, Lys, Asp, His, or Gly
  misc_feature (10)..(10): Xaa can be Trp, Phe, Tyr, Arg, Lys, or Met
QXSSSYAGQX

SEQ ID NO: 124974 - protein, 11 aa, Artificial Sequence
  Description of Artificial Sequence: Synthetic peptide
  Seed: QVSSSYAGQFR (MOG_HUMAN)
  misc_feature (2)..(2): Xaa can be Ser, Gln, Ala, Thr, Val, Phe, Leu, Gly, Met, Ile, Tyr, Asn, Lys, Trp, Arg, or His
  misc_feature (11)..(11): Xaa can be Arg, or Lys
QXSSSYAGQFX

SEQ ID NO: 124975 - protein, 9 aa, Artificial Sequence
  Description of Artificial Sequence: Synthetic peptide
  Seed: QYRLRGKLR (MOG_HUMAN)
  misc_feature (2)..(2): Xaa can be Val, Thr, Phe, Met, Ala, Asn, Asp, Ile, Leu, Gly, Trp, Gln, Ser, or Tyr
  misc_feature (9)..(9): Xaa can be Arg, or Lys
QXRLRGKLX

SEQ ID NO: 124976 - protein, 9 aa, Artificial Sequence
  Description of Artificial Sequence: Synthetic peptide
  Seed: RAEIENLHR (MOG_HUMAN)
  misc_feature (2)..(2): Xaa can be Thr, Ser, Val, Ile, Ala, Met, Leu, Gln, Phe, Tyr, Gly, Trp, Asp, Cys, Asn, Glu, or Pro
  misc_feature (9)..(9): Xaa can be Tyr, Arg, Lys, Phe, His, Met, Trp, or Leu
RXEIENLHX

SEQ ID NO: 124977 - protein, 11 aa, Artificial Sequence
  Description of Artificial Sequence: Synthetic peptide
  Seed: RAEIENLHRTF (MOG_HUMAN)
  misc_feature (2)..(2): Xaa can be Thr, Ser, Ala, Val, Cys, Gly, Asp, Trp, Asn, Met, Leu, Gln, Pro, Glu, Phe, Ile, or Tyr
  misc_feature (11)..(11): Xaa can be Trp, Phe, Leu, Tyr, Met, or Ile
RXEIENLHRTX

SEQ ID NO: 124978 - protein, 8 aa, Artificial Sequence
  Description of Artificial Sequence: Synthetic peptide
  Seed: RALVGDEV (MOG_HUMAN)
  misc_feature (2)..(2): Xaa can be Gln, Ala, Ser, Met, or Glu
  misc_feature (8)..(8): Xaa can be Val, Ile, or Leu
RXLVGDEX

SEQ ID NO: 124979 - protein, 10 aa, Artificial Sequence
  Description of Artificial Sequence: Synthetic peptide
  Seed: RALVGDEVEL (MOG_HUMAN)
  misc_feature (2)..(2): Xaa can be Gln, Leu, Met, Thr, Val, Ala, Ile, Ser, Glu, Gly, Phe, Asn, Cys, Asp, Arg, His, Tyr, Lys, Pro, or Trp
  misc_feature (10)..(10): Xaa can be Trp, Val, Ile, Leu, Lys, Phe, Arg, Met, Tyr, Cys, Ala, His, or Thr
RXLVGDEVEX

SEQ ID NO: 124980 - protein, 9 aa, Artificial Sequence
  Description of Artificial Sequence: Synthetic peptide
  Seed: RDHSYQEEA (MOG_HUMAN)
  misc_feature (2)..(2): Xaa can be Glu, Asp, Gln, Ser, or Ala
  misc_feature (9)..(9): Xaa can be Leu, Ile, Tyr, Pro, Ala, Phe, Met, Cys, Val, Trp, Ser, Thr, Gly, Lys, Gln, Arg, Asn, Asp, His, or Glu
RXHSYQEEX

SEQ ID NO: 124981 - protein, 10 aa, Artificial Sequence
  Description of Artificial Sequence: Synthetic peptide
  Seed: RDHSYQEEAA (MOG_HUMAN)
  misc_feature (2)..(2): Xaa can be Glu, Asp, or Gln
  misc_feature (10)..(10): Xaa can be Ile, Met, Leu, Ala, Phe, Cys, Thr, Pro, Val, Glu, Gly, Trp, Gln, Asp, Ser, or Tyr
RXHSYQEEAX

SEQ ID NO: 124982 - protein, 11 aa, Artificial Sequence
  Description of Artificial Sequence: Synthetic peptide
  Seed: RDHSYQEEAAM (MOG_HUMAN)
  misc_feature (2)..(2): Xaa can be Glu, Asp, Ser, Thr, Lys, Gln, Tyr, Ile, His, Trp, Leu, Phe, Pro, Cys, Arg, Asn, Ala, Val, Met, or Gly
  misc_feature (11)..(11): Xaa can be Met, Tyr, Phe, Trp, Leu, Ile, Cys, Val, Ala, Pro, Ser, Thr, or Gly
RXHSYQEEAAX

SEQ ID NO: 124983 - protein, 11 aa, Artificial Sequence
  Description of Artificial Sequence: Synthetic peptide
  Seed: RFSDEGGFTCF (MOG_HUMAN)
  misc_feature (2)..(2): Xaa can be Ala, Arg, Val, Ile, Gln, Ser, Thr, Met, Leu, Phe, Gly, Trp, Tyr, Pro, Asn, Cys, His, Glu, Lys, or Asp
  misc_feature (11)..(11): Xaa can be Trp, Met, Ile, Tyr, Phe, Lys, Leu, Val, Arg, His, Cys, Ala, Gln, Thr, Glu, Asn, or Ser
RXSDEGGFTCX

SEQ ID NO: 124984 - protein, 8 aa, Artificial Sequence
  Description of Artificial Sequence: Synthetic peptide
  Seed: RGKLRAEI (MOG_HUMAN)
  misc_feature (2)..(2): Xaa can be Ala, Val, Met, Ile, Pro, Leu, Ser, Gln, Gly, Asn, Asp, Thr, Tyr, Phe, His, Cys, or Glu
  misc_feature (8)..(8): Xaa can be Leu, Ile, Met, Val, or Phe
RXKLRAEX

SEQ ID NO: 124985 - protein, 8 aa, Artificial Sequence
  Description of Artificial Sequence: Synthetic peptide
  Seed: RIRNVRFS (MOG_HUMAN)
  misc_feature (2)..(2): Xaa can be Thr, Ser, Val, Ile, Met, Phe, Tyr, Leu, Ala, Gln, Trp, Gly, His, Lys, Asn, or Arg
  misc_feature (8)..(8): Xaa can be Lys, Ala, Met, Val, Ile, Phe, Tyr, Leu, Pro, Ser, Thr, Arg, Gly, Asn, Glu, Gln, Cys, His, Trp, or Asp
RXRNVRFX

SEQ ID NO: 124986 - protein, 9 aa, Artificial Sequence
  Description of Artificial Sequence: Synthetic peptide
  Seed: RIRNVRFSD (MOG_HUMAN)
  misc_feature (2)..(2): Xaa can be Met, Val, Phe, Ala, Trp, Tyr, Thr, Leu, Ser, Gln, Ile, Gly, Asn, Cys, His, Lys, Arg, Glu, Pro, or Asp
  misc_feature (9)..(9): Xaa can be Lys, Ala, Val, Met, Tyr, Ile, Leu, Arg, Ser, Thr, Gly, Pro, Phe, Gln, His, Cys, Asn, Glu, Trp, or Asp
RXRNVRFSX

SEQ ID NO: 124987 - protein, 10 aa, Artificial Sequence
  Description of Artificial Sequence: Synthetic peptide
  Seed: RIRNVRFSDE (MOG_HUMAN)
  misc_feature (2)..(2): Xaa can be Thr, Val, Met, Tyr, Ala, Ile, Ser, Phe, Trp, Leu, Gln, Gly, Asn, Cys, His, or Lys
  misc_feature (10)..(10): Xaa can be Lys, Ala, Tyr, Ser, Leu, Val, Ile, Met, Arg, Phe, Gly, Thr, Pro, Gln, Asn, Cys, Glu, His, Trp, or Asp
RXRNVRFSDX

SEQ ID NO: 124988 - protein, 11 aa, Artificial Sequence
  Description of Artificial Sequence: Synthetic peptide
  Seed: RIRNVRFSDEG (MOG_HUMAN)
  misc_feature (2)..(2): Xaa can be Thr, Val, Ser, Met, Tyr, Ile, Phe, Ala, Leu, Trp, Gln, Gly, Asn, or His
  misc_feature (11)..(11): Xaa can be Lys, Ala, Val, Ile, Met, Leu, Tyr, Ser, Pro, Thr, Gly, Phe, Arg, Gln, Glu, Asn, His, or Cy s
RXRNVRFSDEX

SEQ ID NO: 124989 - protein, 11 aa, Artificial Sequence
  Description of Artificial Sequence: Synthetic peptide
  Seed: RISPGKNATGM (MOG_HUMAN)
  misc_feature (2)..(2): Xaa can be Pro, Ala, Ser, Val, Thr, Leu, Gln, Ile, Gly, Met, Glu, Phe, Asn, Cys, Asp, Tyr, His, Lys, Trp, or Arg
  misc_feature (11)..(11): Xaa can be Trp, Phe, Tyr, Leu, Met, Ile, Lys, His, Val, Arg, Cys, Ala, Ser, Gly, Thr, Pro, or Gln
RXSPGKNATGX

SEQ ID NO: 124990 - protein, 10 aa, Artificial Sequence
  Description of Artificial Sequence: Synthetic peptide
  Seed: RLAGQFLEEL (MOG_HUMAN)
  misc_feature (2)..(2): Xaa can be Met, Gln, Leu, Val, Ile, Ala, Thr, Ser, Glu, Phe, Gly, Asn, Tyr, Lys, His, Arg, Trp, Cys, Asp, or Pro
  misc_feature (10)..(10): Xaa can be Tyr, Trp, Phe, Leu, Arg, Lys, Met, Val, Ile, Ala, Thr, Cys, Ser, or His
RXAGQFLEEX

SEQ ID NO: 124991 - protein, 11 aa, Artificial Sequence
  Description of Artificial Sequence: Synthetic peptide
  Seed: RLAGQFLEELR (MOG_HUMAN)
  misc_feature (2)..(2): Xaa can be Met, Leu, Ile, Phe, Trp, Ala, Val, Gln, Ser, Thr, Tyr, His, Gly, Cys, or Asn
  misc_feature (11)..(11): Xaa can be Arg, Lys, Val, Pro, Glu, Thr, Asp, Ile, Leu, Cys, Asn, Tyr, Gln, Phe, His, Trp, Met, Ser, Ala, or Gly
RXAGQFLEELX

SEQ ID NO: 124992 - protein, 10 aa, Artificial Sequence
  Description of Artificial Sequence: Synthetic peptide
  Seed: RLRGKLRAEI (MOG_HUMAN)
  misc_feature (2)..(2): Xaa can be Ser, Thr, Val, Tyr, Met, Phe, Ala, Ile, Leu, Gln, Trp, Gly, Asn, Cys, His, Arg, Pro, Asp, Lys, or Glu
  misc_feature (10)..(10): Xaa can be Ile, Leu, Met, Phe, Lys, Val, Ala, Tyr, Ser, Gly, Arg, Pro, Thr, Gln, Cys, Glu, Asn, or Hi s
RXRGKLRAEX

SEQ ID NO: 124993 - protein, 11 aa, Artificial Sequence
  Description of Artificial Sequence: Synthetic peptide
  Seed: RNVRFSDEGGF (MOG_HUMAN)
  misc_feature (2)..(2): Xaa can be Arg, His, Phe, Gln, Cys, Ala, Leu, Glu, Asn, Trp, Gly, Tyr, Val, Asp, Met, Ile, Thr, Lys, Ser, or Pro
  misc_feature (11)..(11): Xaa can be Leu, Phe, Met, Val, or Ile
RXVRFSDEGGX

SEQ ID NO: 124994 - protein, 8 aa, Artificial Sequence
  Description of Artificial Sequence: Synthetic peptide
  Seed: RPPFSRVV (MOG_HUMAN)
  misc_feature (2)..(2): Xaa can be , or Pro
  misc_feature (8)..(8): Xaa can be Met, Phe, Ile, Ala, Val, Leu, or Pro
RXPFSRVX

SEQ ID NO: 124995 - protein, 9 aa, Artificial Sequence
  Description of Artificial Sequence: Synthetic peptide
  Seed: RPPFSRVVH (MOG_HUMAN)
  misc_feature (2)..(2): Xaa can be Pro, Ala, Val, Ile, or Ser
  misc_feature (9)..(9): Xaa can be Leu, Met, Phe, Ile, Ala, Ser, Pro, His, Thr, Tyr, Val, Cys, Gly, or Trp
RXPFSRVVX

SEQ ID NO: 124996 - protein, 10 aa, Artificial Sequence
  Description of Artificial Sequence: Synthetic peptide
  Seed: RPPFSRVVHL (MOG_HUMAN)
  misc_feature (2)..(2): Xaa can be Pro, Leu, Arg, Tyr, Val, Asn, Ser, His, Trp, Met, Phe, Ile, Ala, Gln, Asp, Thr, Glu, Gly, Lys, or Cys
  misc_feature (10)..(10): Xaa can be Ile, Phe, Val, Leu, Ala, Met, Cys, Thr, Pro, or Ser
RXPFSRVVHX

SEQ ID NO: 124997 - protein, 11 aa, Artificial Sequence
  Description of Artificial Sequence: Synthetic peptide
  Seed: RPPFSRVVHLY (MOG_HUMAN)
  misc_feature (2)..(2): Xaa can be Tyr, Val, Ser, Met, Phe, Thr, Trp, Gln, Lys, Asn, His, Gly, Arg, Ala, Cys, Asp, Pro, Ile, Glu, or Leu
  misc_feature (11)..(11): Xaa can be Tyr, Phe, or Met
RXPFSRVVHLX

SEQ ID NO: 124998 - protein, 8 aa, Artificial Sequence
  Description of Artificial Sequence: Synthetic peptide
  Seed: RPSLPSCL (MOG_HUMAN)
  misc_feature (2)..(2): Xaa can be , or Pro
  misc_feature (8)..(8): Xaa can be Ile, Met, Ala, Phe, Val, Pro, or Leu
RXSLPSCX

SEQ ID NO: 124999 - protein, 9 aa, Artificial Sequence
  Description of Artificial Sequence: Synthetic peptide
  Seed: RPSLPSCLC (MOG_HUMAN)
  misc_feature (2)..(2): Xaa can be Pro, Ala, Ile, or Val
  misc_feature (9)..(9): Xaa can be Leu, Met, Ala, Val, Gly, Ser, Cys, Thr, Trp, Pro, His, Ile, Phe, or Tyr
RXSLPSCLX

SEQ ID NO: 125000 - protein, 10 aa, Artificial Sequence
  Description of Artificial Sequence: Synthetic peptide
  Seed: RPSLPSCLCS (MOG_HUMAN)
  misc_feature (2)..(2): Xaa can be , or Pro
  misc_feature (10)..(10): Xaa can be Phe, Met, Ala, Pro, Val, Ser, Leu, Tyr, Ile, Gly, Thr, or Cys
RXSLPSCLCX

SEQ ID NO: 125001 - protein, 11 aa, Artificial Sequence
  Description of Artificial Sequence: Synthetic peptide
  Seed: RPSLPSCLCSF (MOG_HUMAN)
  misc_feature (2)..(2): Xaa can be Pro, Thr, Ser, Ala, Val, Cys, Ile, Leu, Met, Glu, Gln, Gly, Asn, Asp, Trp, Phe, Lys, or Ty r
  misc_feature (11)..(11): Xaa can be Trp, Phe, Tyr, Leu, Ile, Met, Val, Cys, Ala, Gly, Ser, Thr, or Pro
RXSLPSCLCSX

SEQ ID NO: 125002 - protein, 8 aa, Artificial Sequence
  Description of Artificial Sequence: Synthetic peptide
  Seed: RRLAGQFL (MOG_HUMAN)
  misc_feature (2)..(2): Xaa can be Arg, His, Tyr, Gln, or Glu
  misc_feature (8)..(8): Xaa can be Tyr, Phe, Leu, His, Met, Ile, Val, Trp, Lys, or Arg
RXLAGQFX

SEQ ID NO: 125003 - protein, 9 aa, Artificial Sequence
  Description of Artificial Sequence: Synthetic peptide
  Seed: RRLAGQFLE (MOG_HUMAN)
  misc_feature (2)..(2): Xaa can be Arg, Gln, Lys, Met, His, Glu, Asn, Gly, Ser, Leu, Ala, Thr, Tyr, Ile, Val, Asp, Cys, or Tr p
  misc_feature (9)..(9): Xaa can be Leu, Lys, Arg, Met, Phe, Tyr, Ile, Val, Trp, Ala, Cys, His, Gly, Ser, Gln, Thr, Glu, Asp, Asn, or Pro
RXLAGQFLX

SEQ ID NO: 125004 - protein, 10 aa, Artificial Sequence
  Description of Artificial Sequence: Synthetic peptide
  Seed: RRLAGQFLEE (MOG_HUMAN)
  misc_feature (2)..(2): Xaa can be Arg, His, Lys, Gln, Asn, Glu, Gly, Met, or Ala
  misc_feature (10)..(10): Xaa can be Leu, Phe, Lys, Arg, Val, Tyr, Ile, Met, Trp, Gly, Gln, Glu, Ser, Thr, Ala, Pro, His, Asn, or Cys
RXLAGQFLEX

SEQ ID NO: 125005 - protein, 11 aa, Artificial Sequence
  Description of Artificial Sequence: Synthetic peptide
  Seed: RRLAGQFLEEL (MOG_HUMAN)
  misc_feature (2)..(2): Xaa can be Arg, Gln, Met, Leu, Tyr, Lys, His, Phe, Trp, Ser, Val, Ala, Ile, Thr, Gly, Cys, or Asn
  misc_feature (11)..(11): Xaa can be Val, Leu, Ile, Met, Ala, Phe, Tyr, Arg, Lys, Trp, His, Gln, Cys, Pro, Ser, Thr, Glu, Gly, or Asn
RXLAGQFLEEX

SEQ ID NO: 125006 - protein, 9 aa, Artificial Sequence
  Description of Artificial Sequence: Synthetic peptide
  Seed: RTELLKDAI (MOG_HUMAN)
  misc_feature (2)..(2): Xaa can be Gln, Thr, Ser, Met, Leu, Ile, Ala, Val, Glu, Cys, Pro, Asn, Gly, or Phe
  misc_feature (9)..(9): Xaa can be Trp, Phe, Leu, Ile, Met, Val, or Tyr
RXELLKDAX

SEQ ID NO: 125007 - protein, 8 aa, Artificial Sequence
  Description of Artificial Sequence: Synthetic peptide
  Seed: RTFDPHFL (MOG_HUMAN)
  misc_feature (2)..(2): Xaa can be Arg, Ala, Val, Ser, Thr, Gly, Ile, Gln, Tyr, Asn, Glu, His, Lys, Cys, Phe, Met, Leu, Trp, Asp, or Pro
  misc_feature (8)..(8): Xaa can be Leu, Trp, Tyr, Phe, Met, Ile, Val, His, Lys, Cys, Thr, Arg, Gln, or Ala
RXFDPHFX

SEQ ID NO: 125008 - protein, 9 aa, Artificial Sequence
  Description of Artificial Sequence: Synthetic peptide
  Seed: RTFDPHFLR (MOG_HUMAN)
  misc_feature (2)..(2): Xaa can be Arg, Val, Met, Thr, Leu, Ser, Ile, Ala, Tyr, Trp, Phe, Gln, Gly, Asn, Cys, Lys, Pro, His, Glu, or Asp
  misc_feature (9)..(9): Xaa can be Trp, Lys, Tyr, Phe, Arg, Met, Leu, His, Ile, Val, Ala, Gln, Gly, Ser, Thr, Glu, Cys, Asn, Pro, or Asp
RXFDPHFLX

SEQ ID NO: 125009 - protein, 10 aa, Artificial Sequence
  Description of Artificial Sequence: Synthetic peptide
  Seed: RTFDPHFLRV (MOG_HUMAN)
  misc_feature (2)..(2): Xaa can be Ile, Thr, Arg, Asn, Ser, Gln, Leu, Trp, Cys, Gly, Phe, Met, Ala, Tyr, Val, Glu, His, Lys, Asp, or Pro
  misc_feature (10)..(10): Xaa can be Trp, Arg, Ile, Leu, Lys, Met, Val, Phe, Tyr, Ala, His, Cys, Gly, Thr, Asp, Asn, Pro, Ser, Glu, or Gln
RXFDPHFLRX

SEQ ID NO: 125010 - protein, 11 aa, Artificial Sequence
  Description of Artificial Sequence: Synthetic peptide
  Seed: RTFDPHFLRVP (MOG_HUMAN)
  misc_feature (2)..(2): Xaa can be Trp, Ser, Ile, Phe, Val, Tyr, Met, Leu, Gln, Thr, Ala, Gly, Cys, Asn, His, Glu, Arg, or Ly s
  misc_feature (11)..(11): Xaa can be Arg, Lys, His, Trp, Asn, Ala, Phe, Val, Leu, Thr, Ile, Met, Ser, Glu, Gln, Tyr, Gly, Asp, Cys, or Pro
RXFDPHFLRVX

SEQ ID NO: 125011 - protein, 9 aa, Artificial Sequence
  Description of Artificial Sequence: Synthetic peptide
  Seed: RVIGPRHPI (MOG_HUMAN)
  misc_feature (2)..(2): Xaa can be Pro, Thr, Val, Ser, Met, Ala, Tyr, Phe, Ile, Gln, Leu, Trp, Gly, Asn, Cys, Glu, Asp, Arg, His, or Lys
  misc_feature (9)..(9): Xaa can be Leu, Ile, Tyr, Met, Lys, Phe, Val, Trp, Arg, Ala, His, Ser, Cys, Thr, Gly, Pro, Asn, Gln, Glu, or Asp
RXIGPRHPX

SEQ ID NO: 125012 - protein, 10 aa, Artificial Sequence
  Description of Artificial Sequence: Synthetic peptide
  Seed: RVIGPRHPIR (MOG_HUMAN)
  misc_feature (2)..(2): Xaa can be Ser, Thr, Val, Met, Tyr, Phe, Ile, Ala, Leu, Trp, Gly, Asn, Gln, Cys, Lys, His, Arg, Asp, Pro, or Glu
  misc_feature (10)..(10): Xaa can be Lys, Arg, Ala, Val, Ile, Leu, Met, Tyr, Ser, Gly, Pro, Thr, Cys, Phe, Gln, Asn, His, or Gl u
RXIGPRHPIX

SEQ ID NO: 125013 - protein, 11 aa, Artificial Sequence
  Description of Artificial Sequence: Synthetic peptide
  Seed: RVIGPRHPIRA (MOG_HUMAN)
  misc_feature (2)..(2): Xaa can be Val, Tyr, Met, Phe, Thr, Ile, Ser, Gln, Trp, Leu, Ala, Gly, Asn, Cys, Arg, or His
  misc_feature (11)..(11): Xaa can be Arg, Lys, Cys, Ala, Ile, Gly, Gln, Met, Tyr, Pro, Trp, Phe, Val, Ser, Leu, Asp, Asn, Thr, Glu, or His
RXIGPRHPIRX

SEQ ID NO: 125014 - protein, 9 aa, Artificial Sequence
  Description of Artificial Sequence: Synthetic peptide
  Seed: RVPCWKITL (MOG_HUMAN)
  misc_feature (2)..(2): Xaa can be Arg, Tyr, Gln, Leu, Met, Ser, Ala, Thr, Trp, Pro, Phe, Val, Ile, Cys, Gly, Asn, Glu, Lys, His, or Asp
  misc_feature (9)..(9): Xaa can be Leu, Val, Ile, Tyr, Met, Phe, Trp, Lys, Arg, Ala, Cys, His, Thr, Gly, Pro, Ser, or Gln
RXPCWKITX

SEQ ID NO: 125015 - protein, 10 aa, Artificial Sequence
  Description of Artificial Sequence: Synthetic peptide
  Seed: RVPCWKITLF (MOG_HUMAN)
  misc_feature (2)..(2): Xaa can be Tyr, Trp, Ala, Phe, Gln, Leu, Thr, Ser, Met, Val, Ile, Gly, Cys, Glu, Pro, His, Asn, Lys, Arg, or Asp
  misc_feature (10)..(10): Xaa can be Trp, Tyr, Phe, Leu, Met, Ile, Val, Glu, Lys, Thr, Ala, Cys, Asn, Pro, Asp, Gly, Ser, His, Arg, or Gln
RXPCWKITLX

SEQ ID NO: 125016 - protein, 11 aa, Artificial Sequence
  Description of Artificial Sequence: Synthetic peptide
  Seed: RVPCWKITLFV (MOG_HUMAN)
  misc_feature (2)..(2): Xaa can be Leu, Met, Ile, Gln, Val, or Thr
  misc_feature (11)..(11): Xaa can be Val, Ile, Leu, Met, or Ala
RXPCWKITLFX

SEQ ID NO: 125017 - protein, 9 aa, Artificial Sequence
  Description of Artificial Sequence: Synthetic peptide
  Seed: RVVHLYRNG (MOG_HUMAN)
  misc_feature (2)..(2): Xaa can be Thr, Ser, Val, Met, Ile, Ala, Trp, Tyr, Leu, Phe, Gly, Gln, Cys, or Asn
  misc_feature (9)..(9): Xaa can be Lys, Ala, Val, Ile, Leu, Gly, Met, Ser, Arg, Thr, Tyr, Cys, or Pro
RXVHLYRNX

SEQ ID NO: 125018 - protein, 10 aa, Artificial Sequence
  Description of Artificial Sequence: Synthetic peptide
  Seed: RVVHLYRNGK (MOG_HUMAN)
  misc_feature (2)..(2): Xaa can be Thr, Ser, Tyr, Val, Trp, Met, Gln, Gly, Phe, Ala, Cys, Asn, Pro, Glu, His, Lys, Arg, Asp, Leu, or Ile
  misc_feature (10)..(10): Xaa can be Met, Arg, Leu, Lys, Ala, Val, Tyr, Ile, Ser, Thr, Gly, Pro, or Phe
RXVHLYRNGX

SEQ ID NO: 125019 - protein, 9 aa, Artificial Sequence
  Description of Artificial Sequence: Synthetic peptide
  Seed: SCLCSFLLL (MOG_HUMAN)
  misc_feature (2)..(2): Xaa can be Arg, Met, Leu, Gln, Thr, Ile, Ser, Ala, Val, Asn, Gly, Cys, Phe, Pro, Trp, Lys, Glu, or As p
  misc_feature (9)..(9): Xaa can be Trp, Val, Phe, Leu, Ile, Met, Ala, Tyr, Cys, Thr, Lys, Ser, Arg, Gln, or His
SXLCSFLLX

SEQ ID NO: 125020 - protein, 10 aa, Artificial Sequence
  Description of Artificial Sequence: Synthetic peptide
  Seed: SCLCSFLLLL (MOG_HUMAN)
  misc_feature (2)..(2): Xaa can be Leu, Met, Gln, Val, Ile, Pro, His, Thr, Glu, Asn, Cys, Phe, Lys, Ser, Arg, Tyr, Trp, Ala, Gly, or Asp
  misc_feature (10)..(10): Xaa can be Ile, Ala, Met, Leu, Thr, Val, Ser, Lys, Gln, Arg, His, Pro, Glu, Asp, Cys, Asn, Trp, Tyr, Gly, or Phe
SXLCSFLLLX

SEQ ID NO: 125021 - protein, 9 aa, Artificial Sequence
  Description of Artificial Sequence: Synthetic peptide
  Seed: SDEGGFTCF (MOG_HUMAN)
  misc_feature (2)..(2): Xaa can be Glu, Gln, Asp, Ala, Val, Met, Leu, Ser, Ile, Pro, Phe, Trp, Gly, Thr, Tyr, Lys, Asn, Cys, His, or Arg
  misc_feature (9)..(9): Xaa can be Tyr, Phe, Met, Leu, Trp, Ile, Val, Pro, Ala, Thr, His, Gly, Cys, Lys, or Ser
SXEGGFTCX

SEQ ID NO: 125022 - protein, 10 aa, Artificial Sequence
  Description of Artificial Sequence: Synthetic peptide
  Seed: SDEGGFTCFF (MOG_HUMAN)
  misc_feature (2)..(2): Xaa can be Glu, Ile, Asn, Trp, Ala, Pro, Gln, Lys, Met, Gly, Asp, Thr, Phe, Arg, Tyr, Ser, His, Val, Cys, or Leu
  misc_feature (10)..(10): Xaa can be Phe, Tyr, Trp, or Ile
SXEGGFTCFX

SEQ ID NO: 125023 - protein, 11 aa, Artificial Sequence
  Description of Artificial Sequence: Synthetic peptide
  Seed: SDEGGFTCFFR (MOG_HUMAN)
  misc_feature (2)..(2): Xaa can be Ala, Phe, Thr, Gln, Ser, Trp, Leu, Val, Ile, Tyr, Met, Gly, Arg, Pro, His, Cys, Asn, Asp, Glu, or Lys
  misc_feature (11)..(11): Xaa can be Arg, or Lys
SXEGGFTCFFX

SEQ ID NO: 125024 - protein, 10 aa, Artificial Sequence
  Description of Artificial Sequence: Synthetic peptide
  Seed: SFLLLLLLQV (MOG_HUMAN)
  misc_feature (2)..(2): Xaa can be Met, Gln, Leu, Val, Arg, Phe, Ser, Asp, Cys, Tyr, Trp, Ile, Glu, Pro, Ala, Asn, Lys, His, Gly, or Thr
  misc_feature (10)..(10): Xaa can be Leu, Val, Ile, Ala, Thr, or Met
SXLLLLLLQX

SEQ ID NO: 125025 - protein, 9 aa, Artificial Sequence
  Description of Artificial Sequence: Synthetic peptide
  Seed: SLPSCLCSF (MOG_HUMAN)
  misc_feature (2)..(2): Xaa can be Leu, Ala, Met, Ile, Tyr, Ser, Phe, Val, Thr, Gln, Arg, Gly, Glu, Asn, Trp, Pro, Asp, His, Cys, or Lys
  misc_feature (9)..(9): Xaa can be Leu, Tyr, Met, Phe, Trp, Ile, Val, Lys, Arg, Ala, His, Cys, Thr, or Ser
SXPSCLCSX

SEQ ID NO: 125026 - protein, 10 aa, Artificial Sequence
  Description of Artificial Sequence: Synthetic peptide
  Seed: SLPSCLCSFL (MOG_HUMAN)
  misc_feature (2)..(2): Xaa can be Met, Ile, Leu, Val, Thr, Gln, Ser, Ala, Pro, Glu, Gly, Asp, Cys, Trp, Phe, Lys, Arg, His, Asn, or Tyr
  misc_feature (10)..(10): Xaa can be Leu, Phe, Met, Val, Ile, Ala, or Thr
SXPSCLCSFX

SEQ ID NO: 125027 - protein, 11 aa, Artificial Sequence
  Description of Artificial Sequence: Synthetic peptide
  Seed: SLPSCLCSFLL (MOG_HUMAN)
  misc_feature (2)..(2): Xaa can be Met, Leu, or Ile
  misc_feature (11)..(11): Xaa can be Val, Leu, Ala, Ile, or Met
SXPSCLCSFLX

SEQ ID NO: 125028 - protein, 10 aa, Artificial Sequence
  Description of Artificial Sequence: Synthetic peptide
  Seed: SLSRPSLPSC (MOG_HUMAN)
  misc_feature (2)..(2): Xaa can be Pro, Phe, Ser, Arg, Asn, Cys, Glu, Asp, Ala, Trp, Tyr, Gly, Val, Thr, Lys, His, Leu, Ile, Gln, or Met
  misc_feature (10)..(10): Xaa can be Thr, Asn, Phe, Leu, Lys, Arg, Met, Cys, Ile, Ala, Pro, Tyr, Val, Ser, Gly, Glu, Gln, or Hi s
SXSRPSLPSX

SEQ ID NO: 125029 - protein, 11 aa, Artificial Sequence
  Description of Artificial Sequence: Synthetic peptide
  Seed: SLSRPSLPSCL (MOG_HUMAN)
  misc_feature (2)..(2): Xaa can be Gln, Met, Leu, Ile, or Val
  misc_feature (11)..(11): Xaa can be Trp, Leu, Phe, Val, Ile, or Met
SXSRPSLPSCX

SEQ ID NO: 125030 - protein, 9 aa, Artificial Sequence
  Description of Artificial Sequence: Synthetic peptide
  Seed: SPGKNATGM (MOG_HUMAN)
  misc_feature (2)..(2): Xaa can be Pro, Ala, Ile, Ser, Gln, Val, Met, Leu, Glu, Gly, Phe, Thr, Cys, Tyr, Asn, Asp, or Trp
  misc_feature (9)..(9): Xaa can be Tyr, Phe, Met, Ala, Leu, Thr, Val, Ile, Ser, Cys, or Pro
SXGKNATGX

SEQ ID NO: 125031 - protein, 11 aa, Artificial Sequence
  Description of Artificial Sequence: Synthetic peptide
  Seed: SPGKNATGMEV (MOG_HUMAN)
  misc_feature (2)..(2): Xaa can be , or Pro
  misc_feature (11)..(11): Xaa can be Val, Pro, Tyr, Gly, Ala, Cys, Trp, Phe, Leu, Ser, Ile, Met, or Thr
SXGKNATGMEX

SEQ ID NO: 125032 - protein, 8 aa, Artificial Sequence
  Description of Artificial Sequence: Synthetic peptide
  Seed: SPGVLVLL (MOG_HUMAN)
  misc_feature (2)..(2): Xaa can be Pro, or Ala
  misc_feature (8)..(8): Xaa can be Val, Ile, Leu, Phe, Met, Pro, Ala, Thr, or Cys
SXGVLVLX

SEQ ID NO: 125033 - protein, 9 aa, Artificial Sequence
  Description of Artificial Sequence: Synthetic peptide
  Seed: SPGVLVLLA (MOG_HUMAN)
  misc_feature (2)..(2): Xaa can be Pro, or Ala
  misc_feature (9)..(9): Xaa can be Val, Ile, Leu, Ser, Tyr, Ala, Pro, Gly, Cys, Phe, Thr, or Met
SXGVLVLLX

SEQ ID NO: 125034 - protein, 10 aa, Artificial Sequence
  Description of Artificial Sequence: Synthetic peptide
  Seed: SPGVLVLLAV (MOG_HUMAN)
  misc_feature (2)..(2): Xaa can be , or Pro
  misc_feature (10)..(10): Xaa can be Phe, Gly, Met, Ile, Pro, Ala, Leu, Thr, Ser, Cys, or Val
SXGVLVLLAX

SEQ ID NO: 125035 - protein, 11 aa, Artificial Sequence
  Description of Artificial Sequence: Synthetic peptide
  Seed: SPGVLVLLAVL (MOG_HUMAN)
  misc_feature (2)..(2): Xaa can be , or Pro
  misc_feature (11)..(11): Xaa can be Ile, Val, Leu, Cys, Met, Phe, or Ala
SXGVLVLLAVX

SEQ ID NO: 125036 - protein, 9 aa, Artificial Sequence
  Description of Artificial Sequence: Synthetic peptide
  Seed: SRPSLPSCL (MOG_HUMAN)
  misc_feature (2)..(2): Xaa can be Tyr, Arg, Ala, His, Phe, Gln, Thr, Trp, Leu, Ser, Ile, Met, Val, Gly, Glu, Pro, Lys, Asn, Cys, or Asp
  misc_feature (9)..(9): Xaa can be Ile, Met, Phe, Val, Leu, Tyr, Ala, Cys, Trp, His, Lys, Thr, Arg, Pro, or Ser
SXPSLPSCX

SEQ ID NO: 125037 - protein, 10 aa, Artificial Sequence
  Description of Artificial Sequence: Synthetic peptide
  Seed: SRPSLPSCLC (MOG_HUMAN)
  misc_feature (2)..(2): Xaa can be , or Arg
  misc_feature (10)..(10): Xaa can be Val, Pro, Ala, or Cys
SXPSLPSCLX

SEQ ID NO: 125038 - protein, 8 aa, Artificial Sequence
  Description of Artificial Sequence: Synthetic peptide
  Seed: SRVVHLYR (MOG_HUMAN)
  misc_feature (2)..(2): Xaa can be Met, Val, Tyr, Thr, Phe, Trp, Leu, Ala, Ser, Arg, Gln, Cys, Gly, Asn, His, Lys, or Ile
  misc_feature (8)..(8): Xaa can be Arg, or Lys
SXVVHLYX

SEQ ID NO: 125039 - protein, 11 aa, Artificial Sequence
  Description of Artificial Sequence: Synthetic peptide
  Seed: SRVVHLYRNGK (MOG_HUMAN)
  misc_feature (2)..(2): Xaa can be , or Arg
  misc_feature (11)..(11): Xaa can be Phe, Lys, Tyr, Met, or Leu
SXVVHLYRNGX

SEQ ID NO: 125040 - protein, 8 aa, Artificial Sequence
  Description of Artificial Sequence: Synthetic peptide
  Seed: SSSYAGQF (MOG_HUMAN)
  misc_feature (2)..(2): Xaa can be Ala, Ser, or Thr
  misc_feature (8)..(8): Xaa can be Leu, Phe, Tyr, or Met
SXSYAGQX

SEQ ID NO: 125041 - protein, 9 aa, Artificial Sequence
  Description of Artificial Sequence: Synthetic peptide
  Seed: SSSYAGQFR (MOG_HUMAN)
  misc_feature (2)..(2): Xaa can be Val, Thr, Ile, Ser, Phe, Met, Cys, Asn, Gln, Ala, Gly, Asp, Leu, Glu, Trp, Pro, Tyr, or Hi s
  misc_feature (9)..(9): Xaa can be Arg, Lys, Tyr, Phe, His, Met, or Leu
SXSYAGQFX

SEQ ID NO: 125042 - protein, 10 aa, Artificial Sequence
  Description of Artificial Sequence: Synthetic peptide
  Seed: SSSYAGQFRV (MOG_HUMAN)
  misc_feature (2)..(2): Xaa can be Thr, Val, Ala, Leu, Asp, Pro, His, Glu, Met, Trp, Lys, Gly, Cys, Ile, Arg, Ser, Tyr, Phe, Gln, or Asn
  misc_feature (10)..(10): Xaa can be Val, Leu, Ile, or Ala
SXSYAGQFRX

SEQ ID NO: 125043 - protein, 11 aa, Artificial Sequence
  Description of Artificial Sequence: Synthetic peptide
  Seed: SSSYAGQFRVI (MOG_HUMAN)
  misc_feature (2)..(2): Xaa can be Tyr, Trp, Phe, Ser, Arg, Thr, Gln, Asp, Ile, Leu, Pro, Cys, Met, Ala, Val, Gly, His, Glu, Asn, or Lys
  misc_feature (11)..(11): Xaa can be Trp, Phe, Leu, Ile, Met, or Val
SXSYAGQFRVX

SEQ ID NO: 125044 - protein, 8 aa, Artificial Sequence
  Description of Artificial Sequence: Synthetic peptide
  Seed: SSYAGQFR (MOG_HUMAN)
  misc_feature (2)..(2): Xaa can be Tyr, Thr, Met, Phe, Ala, Ser, Trp, Leu, Gly, Ile, Val, Gln, or Asn
  misc_feature (8)..(8): Xaa can be Arg, or Lys
SXYAGQFX

SEQ ID NO: 125045 - protein, 9 aa, Artificial Sequence
  Description of Artificial Sequence: Synthetic peptide
  Seed: SSYAGQFRV (MOG_HUMAN)
  misc_feature (2)..(2): Xaa can be Met, Leu, Gln, Val, Ser, Ile, Thr, Ala, Tyr, Phe, Glu, Cys, Asn, Gly, Trp, Asp, Pro, His, Lys, or Arg
  misc_feature (9)..(9): Xaa can be Tyr, Val, Trp, Arg, Phe, Leu, Lys, Ile, Met, His, Ala, Cys, Thr, Gly, Pro, Ser, Gln, or Gl u
SXYAGQFRX

SEQ ID NO: 125046 - protein, 10 aa, Artificial Sequence
  Description of Artificial Sequence: Synthetic peptide
  Seed: SSYAGQFRVI (MOG_HUMAN)
  misc_feature (2)..(2): Xaa can be Ala, Gln, Val, Thr, Ser, Met, Tyr, Leu, Phe, Gly, Trp, Ile, Asn, Asp, Glu, Pro, Cys, Lys, His, or Arg
  misc_feature (10)..(10): Xaa can be Leu, Ile, Phe, Met, Trp, Tyr, Lys, Val, His, Ala, Cys, Gln, or Thr
SXYAGQFRVX

SEQ ID NO: 125047 - protein, 9 aa, Artificial Sequence
  Description of Artificial Sequence: Synthetic peptide
  Seed: SYAGQFRVI (MOG_HUMAN)
  misc_feature (2)..(2): Xaa can be Arg, Tyr, Ala, Phe, Gln, Met, Gly, Trp, Ser, Lys, Thr, Ile, His, Val, Glu, Leu, Asn, Asp, Pro, or Cys
  misc_feature (9)..(9): Xaa can be Met, Leu, Phe, Val, Ile, Tyr, Trp, Ala, Cys, Lys, His, Thr, or Arg
SXAGQFRVX

SEQ ID NO: 125048 - protein, 8 aa, Artificial Sequence
  Description of Artificial Sequence: Synthetic peptide
  Seed: SYQEEAAM (MOG_HUMAN)
  misc_feature (2)..(2): Xaa can be Tyr, Phe, Arg, or Trp
  misc_feature (8)..(8): Xaa can be Phe, Leu, Tyr, Met, or Ile
SXQEEAAX

SEQ ID NO: 125049 - protein, 10 aa, Artificial Sequence
  Description of Artificial Sequence: Synthetic peptide
  Seed: SYQEEAAMEL (MOG_HUMAN)
  misc_feature (2)..(2): Xaa can be Arg, Tyr, Gln, Trp, Phe, Ala, His, Val, Lys, Met, Leu, Glu, Thr, Ser, Ile, Asn, Cys, or Gl y
  misc_feature (10)..(10): Xaa can be Leu, Met, Phe, Tyr, Ile, Trp, Val, Lys, Cys, Arg, or His
SXQEEAAMEX

SEQ ID NO: 125050 - protein, 11 aa, Artificial Sequence
  Description of Artificial Sequence: Synthetic peptide
  Seed: SYQEEAAMELK (MOG_HUMAN)
  misc_feature (2)..(2): Xaa can be Ala, Thr, Leu, Met, Gly, Val, Phe, Asn, Gln, Ile, Tyr, Ser, Glu, Trp, or Asp
  misc_feature (11)..(11): Xaa can be Lys, Arg, Tyr, Phe, or Leu
SXQEEAAMELX

SEQ ID NO: 125051 - protein, 9 aa, Artificial Sequence
  Description of Artificial Sequence: Synthetic peptide
  Seed: TCFFRDHSY (MOG_HUMAN)
  misc_feature (2)..(2): Xaa can be Ala, Ser, Thr, Gly, Pro, Ile, Gln, Met, Val, Leu, Phe, Lys, Tyr, Cys, Asn, Glu, Asp, Arg, His, or Trp
  misc_feature (9)..(9): Xaa can be Phe, Tyr, Met, Leu, Trp, Ile, Val, Lys, His, Ala, Arg, or Cys
TXFFRDHSX

SEQ ID NO: 125052 - protein, 8 aa, Artificial Sequence
  Description of Artificial Sequence: Synthetic peptide
  Seed: TELLKDAI (MOG_HUMAN)
  misc_feature (2)..(2): Xaa can be Glu, Asp, or Gln
  misc_feature (8)..(8): Xaa can be Leu, Tyr, Ile, Phe, Val, Met, Cys, His, Thr, Trp, Pro, or Ala
TXLLKDAX

SEQ ID NO: 125053 - protein, 9 aa, Artificial Sequence
  Description of Artificial Sequence: Synthetic peptide
  Seed: TELLKDAIG (MOG_HUMAN)
  misc_feature (2)..(2): Xaa can be Glu, or Asp
  misc_feature (9)..(9): Xaa can be Val, Ile, Leu, Ala, Thr, Gly, Ser, Tyr, Phe, Pro, Cys, or Met
TXLLKDAIX

SEQ ID NO: 125054 - protein, 8 aa, Artificial Sequence
  Description of Artificial Sequence: Synthetic peptide
  Seed: TFDPHFLR (MOG_HUMAN)
  misc_feature (2)..(2): Xaa can be Thr, Ser, Val, Met, Ala, Ile, Leu, Phe, Tyr, Gly, Gln, Cys, Asn, Trp, Asp, Glu, Pro, His, Lys, or Arg
  misc_feature (8)..(8): Xaa can be Tyr, Arg, Lys, Leu, Met, Phe, Ile, Val, His, Trp, Gln, or Glu
TXDPHFLX

SEQ ID NO: 125055 - protein, 9 aa, Artificial Sequence
  Description of Artificial Sequence: Synthetic peptide
  Seed: TFDPHFLRV (MOG_HUMAN)
  misc_feature (2)..(2): Xaa can be Ala, Leu, Phe, Thr, Ser, Tyr, Ile, Val, Trp, Met, Arg, Gly, Pro, Gln, Asn, Cys, His, Glu, Asp, or Lys
  misc_feature (9)..(9): Xaa can be Val, Phe, Tyr, Leu, Lys, Trp, Met, Ile, Cys, Ala, Arg, His, Thr, Gln, Ser, Pro, Glu, Asn, Gly, or Asp
TXDPHFLRX

SEQ ID NO: 125056 - protein, 9 aa, Artificial Sequence
  Description of Artificial Sequence: Synthetic peptide
  Seed: TGMEVGWYR (MOG_HUMAN)
  misc_feature (2)..(2): Xaa can be Thr, Val, Ile, Met, Ala, Leu, Ser, Gln, Gly, Cys, Trp, Tyr, Phe, Asp, Glu, Asn, Arg, His, Lys, or Pro
  misc_feature (9)..(9): Xaa can be Lys, Arg, Tyr, His, Leu, Ile, Met, Val, Gln, Phe, Ala, Glu, Thr, Ser, Asn, or Trp
TXMEVGWYX

SEQ ID NO: 125057 - protein, 10 aa, Artificial Sequence
  Description of Artificial Sequence: Synthetic peptide
  Seed: TGMEVGWYRP (MOG_HUMAN)
  misc_feature (2)..(2): Xaa can be Trp, Tyr, Met, Ile, Ser, Phe, Val, Leu, Gly, Thr, Gln, Ala, Asn, Cys, Arg, Pro, Lys, His, Asp, or Glu
  misc_feature (10)..(10): Xaa can be Arg, Lys, Val, Thr, Leu, Phe, Gly, Asp, Trp, Ser, Glu, Ala, Tyr, Asn, Gln, Cys, Met, Pro, Ile, or His
TXMEVGWYRX

SEQ ID NO: 125058 - protein, 8 aa, Artificial Sequence
  Description of Artificial Sequence: Synthetic peptide
  Seed: TLFVIVPV (MOG_HUMAN)
  misc_feature (2)..(2): Xaa can be Gln, Met, Ala, Leu, Glu, Pro, Asn, Ser, Gly, Asp, His, Ile, Thr, Lys, or Val
  misc_feature (8)..(8): Xaa can be Ile, Val, Leu, Ala, Met, Phe, or Cys
TXFVIVPX

SEQ ID NO: 125059 - protein, 9 aa, Artificial Sequence
  Description of Artificial Sequence: Synthetic peptide
  Seed: TLFVIVPVL (MOG_HUMAN)
  misc_feature (2)..(2): Xaa can be Gln, Met, Ala, Leu, Arg, Ser, Val, Thr, Ile, Glu, Phe, Asn, Gly, Tyr, Asp, Pro, His, Lys, Cys, or Trp
  misc_feature (9)..(9): Xaa can be Tyr, Leu, Met, Phe, Ile, Val, Lys, Arg, Trp, Ala, Cys, His, Thr, Ser, or Pro
TXFVIVPVX

SEQ ID NO: 125060 - protein, 9 aa, Artificial Sequence
  Description of Artificial Sequence: Synthetic peptide
  Seed: TLRIRNVRF (MOG_HUMAN)
  misc_feature (2)..(2): Xaa can be Met, Leu, Pro, Ala, Val, Gln, Gly, Ile, Ser, Thr, Asn, Glu, Asp, Phe, Arg, His, Lys, Cys, Trp, or Tyr
  misc_feature (9)..(9): Xaa can be Leu, Met, Ile, Tyr, Val, Phe, Ala, Cys, or Thr
TXRIRNVRX

SEQ ID NO: 125061 - protein, 9 aa, Artificial Sequence
  Description of Artificial Sequence: Synthetic peptide
  Seed: TVGLIFLCL (MOG_HUMAN)
  misc_feature (2)..(2): Xaa can be Leu, Ala, Met, Ile, Val, Gln, Ser, or Thr
  misc_feature (9)..(9): Xaa can be Leu, Val, Ile, Met, Ala, or Phe
TXGLIFLCX

SEQ ID NO: 125062 - protein, 9 aa, Artificial Sequence
  Description of Artificial Sequence: Synthetic peptide
  Seed: VALIICYNW (MOG_HUMAN)
  misc_feature (2)..(2): Xaa can be Ala, Ser, Thr, Pro, Met, Leu, Val, Gln, Ile, Cys, Asn, Gly, Arg, Phe, Glu, Lys, Trp, or As p
  misc_feature (9)..(9): Xaa can be Trp, Phe, Tyr, Leu, Ile, Met, or Val
VXLIICYNX

SEQ ID NO: 125063 - protein, 8 aa, Artificial Sequence
  Description of Artificial Sequence: Synthetic peptide
  Seed: VEDPFYWV (MOG_HUMAN)
  misc_feature (2)..(2): Xaa can be , or Glu
  misc_feature (8)..(8): Xaa can be Met, Val, Leu, Phe, Ile, Cys, or Ala
VXDPFYWX

SEQ ID NO: 125064 - protein, 9 aa, Artificial Sequence
  Description of Artificial Sequence: Synthetic peptide
  Seed: VEDPFYWVS (MOG_HUMAN)
  misc_feature (2)..(2): Xaa can be Glu, Asp, or Gln
  misc_feature (9)..(9): Xaa can be Ile, Ala, Leu, Met, Val, Phe, Cys, Thr, Pro, Glu, Asp, Gln, Ser, Lys, Tyr, Arg, Asn, Gly, or Trp
VXDPFYWVX

SEQ ID NO: 125065 - protein, 10 aa, Artificial Sequence
  Description of Artificial Sequence: Synthetic peptide
  Seed: VEDPFYWVSP (MOG_HUMAN)
  misc_feature (2)..(2): Xaa can be , or Glu
  misc_feature (10)..(10): Xaa can be Leu, Gly, Pro, Ile, Thr, Met, Cys, Ala, Phe, Val, or Ser
VXDPFYWVSX

SEQ ID NO: 125066 - protein, 9 aa, Artificial Sequence
  Description of Artificial Sequence: Synthetic peptide
  Seed: VELPCRISP (MOG_HUMAN)
  misc_feature (2)..(2): Xaa can be Glu, Asp, or Gln
  misc_feature (9)..(9): Xaa can be Leu, Met, Val, Ala, Ile, Cys, Phe, Pro, Trp, Asp, Glu, Gly, Ser, Thr, or Tyr
VXLPCRISX

SEQ ID NO: 125067 - protein, 10 aa, Artificial Sequence
  Description of Artificial Sequence: Synthetic peptide
  Seed: VELPCRISPG (MOG_HUMAN)
  misc_feature (2)..(2): Xaa can be , or Glu
  misc_feature (10)..(10): Xaa can be Leu, Cys, Ser, Val, Gly, Thr, Pro, Met, Ala, or Ile
VXLPCRISPX

SEQ ID NO: 125068 - protein, 9 aa, Artificial Sequence
  Description of Artificial Sequence: Synthetic peptide
  Seed: VGDEVELPC (MOG_HUMAN)
  misc_feature (2)..(2): Xaa can be Ala, Ser, Thr, Ile, Val, Leu, Met, Gly, Gln, Phe, Cys, Tyr, Trp, Asn, Asp, Lys, Glu, Pro, Arg, or His
  misc_feature (9)..(9): Xaa can be Phe, Ile, Val, Leu, Met, Ala, Cys, Tyr, Trp, Lys, Thr, Arg, Ser, Gln, Pro, His, Asn, Gly, or Glu
VXDEVELPX

SEQ ID NO: 125069 - protein, 10 aa, Artificial Sequence
  Description of Artificial Sequence: Synthetic peptide
  Seed: VGDEVELPCR (MOG_HUMAN)
  misc_feature (2)..(2): Xaa can be Thr, Ala, Val, Met, Ile, Leu, Ser, Tyr, Phe, Trp, Gly, Cys, Asn, Asp, Gln, Glu, Pro, Lys, or His
  misc_feature (10)..(10): Xaa can be Lys, Tyr, Arg, Phe, Leu, Met, Trp, His, Gln, Ile, or Val
VXDEVELPCX

SEQ ID NO: 125070 - protein, 11 aa, Artificial Sequence
  Description of Artificial Sequence: Synthetic peptide
  Seed: VGDEVELPCRI (MOG_HUMAN)
  misc_feature (2)..(2): Xaa can be Ala, Thr, Val, Ile, Gln, Met, Leu, Phe, Ser, Gly, Cys, Pro, Asn, Trp, Tyr, Asp, or Glu
  misc_feature (11)..(11): Xaa can be Leu, Met, Phe, Ile, Val, Cys, Trp, Tyr, or Ala
VXDEVELPCRX

SEQ ID NO: 125071 - protein, 10 aa, Artificial Sequence
  Description of Artificial Sequence: Synthetic peptide
  Seed: VGLIFLCLQY (MOG_HUMAN)
  misc_feature (2)..(2): Xaa can be Asp, Val, Asn, His, Met, Tyr, Arg, Thr, Ile, Gly, Trp, Cys, Glu, Phe, Ser, Lys, Gln, Pro, Ala, or Leu
  misc_feature (10)..(10): Xaa can be , or Tyr
VXLIFLCLQX

SEQ ID NO: 125072 - protein, 11 aa, Artificial Sequence
  Description of Artificial Sequence: Synthetic peptide
  Seed: VGLIFLCLQYR (MOG_HUMAN)
  misc_feature (2)..(2): Xaa can be Lys, Thr, Gly, Ile, Trp, Asn, Gln, Val, Ala, Phe, Ser, Arg, Tyr, His, Leu, Met, Glu, Pro, Cys, or Asp
  misc_feature (11)..(11): Xaa can be Arg, or Lys
VXLIFLCLQYX

SEQ ID NO: 125073 - protein, 10 aa, Artificial Sequence
  Description of Artificial Sequence: Synthetic peptide
  Seed: VGWYRPPFSR (MOG_HUMAN)
  misc_feature (2)..(2): Xaa can be Phe, Met, Trp, Thr, Tyr, Val, Leu, Gly, Ile, Lys, Asn, Ala, Pro, Ser, Cys, Gln, Asp, Glu, Arg, or His
  misc_feature (10)..(10): Xaa can be Arg, Lys, His, or Tyr
VXWYRPPFSX

SEQ ID NO: 125074 - protein, 8 aa, Artificial Sequence
  Description of Artificial Sequence: Synthetic peptide
  Seed: VIGPRHPI (MOG_HUMAN)
  misc_feature (2)..(2): Xaa can be Ala, Val, Ser, Thr, Gly, Ile, Phe, Leu, Tyr, Gln, Met, Asn, Arg, Glu, Asp, His, Pro, Cys, Trp, or Lys
  misc_feature (8)..(8): Xaa can be Leu, Phe, Met, Ile, Val, Tyr, Arg, Lys, Trp, Ala, Cys, or His
VXGPRHPX

SEQ ID NO: 125075 - protein, 9 aa, Artificial Sequence
  Description of Artificial Sequence: Synthetic peptide
  Seed: VIGPRHPIR (MOG_HUMAN)
  misc_feature (2)..(2): Xaa can be Leu, Met, Ile, Thr, Val, Gln, Pro, Ala, Trp, Tyr, Ser, Phe, Asp, Gly, or Asn
  misc_feature (9)..(9): Xaa can be Lys, Arg, Tyr, Leu, Met, or Val
VXGPRHPIX

SEQ ID NO: 125076 - protein, 11 aa, Artificial Sequence
  Description of Artificial Sequence: Synthetic peptide
  Seed: VIGPRHPIRAL (MOG_HUMAN)
  misc_feature (2)..(2): Xaa can be Ala, Thr, Ser, Gly, Ile, Val, Leu, Met, Asp, His, Glu, Tyr, Gln, Lys, Arg, Trp, Phe, Cys, Pro, or Asn
  misc_feature (11)..(11): Xaa can be Phe, Leu, Val, Met, Ala, Ile, Tyr, or Trp
VXGPRHPIRAX

SEQ ID NO: 125077 - protein, 9 aa, Artificial Sequence
  Description of Artificial Sequence: Synthetic peptide
  Seed: VIVPVLGPL (MOG_HUMAN)
  misc_feature (2)..(2): Xaa can be Ala, Met, Leu, Gln, Ile, Thr, Ser, Val, Pro, Gly, Glu, Asn, Asp, Cys, Phe, Tyr, His, Arg, Trp, or Lys
  misc_feature (9)..(9): Xaa can be Tyr, Phe, Met, Leu, Arg, Lys, Val, Ile, His, Ala, Trp, Cys, Thr, Ser, Pro, Gly, Gln, or As n
VXVPVLGPX

SEQ ID NO: 125078 - protein, 10 aa, Artificial Sequence
  Description of Artificial Sequence: Synthetic peptide
  Seed: VIVPVLGPLV (MOG_HUMAN)
  misc_feature (2)..(2): Xaa can be Leu, Met, Gln, Ile, Val, Thr, Ala, Glu, Ser, Pro, or Gly
  misc_feature (10)..(10): Xaa can be Val, Ile, Leu, Met, Ala, Phe, Cys, Gly, Thr, Trp, Pro, Ser, Glu, Asp, Lys, Tyr, Arg, Asn, His, or Gln
VXVPVLGPLX

SEQ ID NO: 125079 - protein, 8 aa, Artificial Sequence
  Description of Artificial Sequence: Synthetic peptide
  Seed: VLGPLVAL (MOG_HUMAN)
  misc_feature (2)..(2): Xaa can be Ala, Gln, Ser, Met, Thr, Leu, Arg, Val, Ile, Gly, Asn, Phe, Glu, Asp, Cys, Tyr, Pro, His, Lys, or Trp
  misc_feature (8)..(8): Xaa can be Leu, Tyr, Met, Phe, Ile, Val, Lys, Arg, His, Ala, Trp, Cys, Thr, Gln, Pro, or Ser
VXGPLVAX

SEQ ID NO: 125080 - protein, 9 aa, Artificial Sequence
  Description of Artificial Sequence: Synthetic peptide
  Seed: VLGPLVALI (MOG_HUMAN)
  misc_feature (2)..(2): Xaa can be Met, Leu, Ala, Val, Ile, Ser, Gln, Thr, Arg, Asn, Gly, Phe, Tyr, Pro, Cys, Glu, His, Trp, Asp, or Lys
  misc_feature (9)..(9): Xaa can be Leu, Met, Val, Lys, Ile, Phe, Arg, Tyr, Trp, Ala, Cys, His, Thr, or Ser
VXGPLVALX

SEQ ID NO: 125081 - protein, 10 aa, Artificial Sequence
  Description of Artificial Sequence: Synthetic peptide
  Seed: VLGPLVALII (MOG_HUMAN)
  misc_feature (2)..(2): Xaa can be Leu, Met, Ile, Val, or Thr
  misc_feature (10)..(10): Xaa can be Val, Leu, Asp, Tyr, Arg, Ala, Pro, His, Lys, Ser, Ile, Phe, Glu, Thr, Cys, Gly, Met, Trp, Gln, or Asn
VXGPLVALIX

SEQ ID NO: 125082 - protein, 8 aa, Artificial Sequence
  Description of Artificial Sequence: Synthetic peptide
  Seed: VLLAVLPV (MOG_HUMAN)
  misc_feature (2)..(2): Xaa can be Met, Leu, Ile, Gln, or Val
  misc_feature (8)..(8): Xaa can be Val, Ala, Ile, or Leu
VXLAVLPX

SEQ ID NO: 125083 - protein, 9 aa, Artificial Sequence
  Description of Artificial Sequence: Synthetic peptide
  Seed: VLLAVLPVL (MOG_HUMAN)
  misc_feature (2)..(2): Xaa can be Gln, Met, Leu, Ala, Ile, Arg, Val, Thr, Ser, Asn, Gly, Glu, Phe, Cys, Pro, Asp, Lys, His, Tyr, or Trp
  misc_feature (9)..(9): Xaa can be Tyr, Ile, Phe, Leu, Val, Met, Arg, Lys, Ala, Trp, Thr, Cys, Ser, His, or Pro
VXLAVLPVX

SEQ ID NO: 125084 - protein, 10 aa, Artificial Sequence
  Description of Artificial Sequence: Synthetic peptide
  Seed: VLLAVLPVLL (MOG_HUMAN)
  misc_feature (2)..(2): Xaa can be Leu, Met, Gln, Phe, Tyr, Cys, Ala, Ser, Ile, Val, Glu, Asn, Pro, Lys, Gly, Thr, Arg, Trp, Asp, or His
  misc_feature (10)..(10): Xaa can be Leu, Ala, Val, Met, Ile, Thr, Phe, Trp, Cys, Ser, Pro, Gln, Gly, Tyr, Lys, Asp, His, Asn, Arg, or Glu
VXLAVLPVLX

SEQ ID NO: 125085 - protein, 11 aa, Artificial Sequence
  Description of Artificial Sequence: Synthetic peptide
  Seed: VLLAVLPVLLL (MOG_HUMAN)
  misc_feature (2)..(2): Xaa can be Leu, Met, Phe, Tyr, Thr, Ile, Gln, or Val
  misc_feature (11)..(11): Xaa can be Val, Leu, Ile, Ala, Met, or Thr
VXLAVLPVLLX

SEQ ID NO: 125086 - protein, 8 aa, Artificial Sequence
  Description of Artificial Sequence: Synthetic peptide
  Seed: VLLLQITV (MOG_HUMAN)
  misc_feature (2)..(2): Xaa can be Met, or Leu
  misc_feature (8)..(8): Xaa can be , or Val
VXLLQITX

SEQ ID NO: 125087 - protein, 10 aa, Artificial Sequence
  Description of Artificial Sequence: Synthetic peptide
  Seed: VLLLQITVGL (MOG_HUMAN)
  misc_feature (2)..(2): Xaa can be Met, Phe, Tyr, Asp, Val, His, Glu, Lys, Asn, Thr, Ile, Gln, Ala, Leu, Pro, Cys, Ser, Arg, Trp, or Gly
  misc_feature (10)..(10): Xaa can be Leu, Ala, Val, Met, Ile, or Thr
VXLLQITVGX

SEQ ID NO: 125088 - protein, 9 aa, Artificial Sequence
  Description of Artificial Sequence: Synthetic peptide
  Seed: VLPVLLLQI (MOG_HUMAN)
  misc_feature (2)..(2): Xaa can be Met, Leu, Gln, Ala, Ser, Thr, Val, Ile, Gly, Tyr, Phe, Arg, Asn, Cys, Trp, Pro, His, Glu, Asp, or Lys
  misc_feature (9)..(9): Xaa can be Leu, Ile, Met, Val, Phe, Tyr, Arg, Trp, Lys, Ala, Cys, Thr, or His
VXPVLLLQX

SEQ ID NO: 125089 - protein, 11 aa, Artificial Sequence
  Description of Artificial Sequence: Synthetic peptide
  Seed: VLPVLLLQITV (MOG_HUMAN)
  misc_feature (2)..(2): Xaa can be Met, or Leu
  misc_feature (11)..(11): Xaa can be , or Val
VXPVLLLQITX

SEQ ID NO: 125090 - protein, 10 aa, Artificial Sequence
  Description of Artificial Sequence: Synthetic peptide
  Seed: VLVLLAVLPV (MOG_HUMAN)
  misc_feature (2)..(2): Xaa can be Met, Leu, Gln, Phe, Tyr, Thr, Ser, His, Lys, Pro, Ile, Val, Gly, Asn, Trp, Cys, Arg, Ala, Asp, or Glu
  misc_feature (10)..(10): Xaa can be Val, Ala, Leu, Ile, Thr, or Met
VXVLLAVLPX

SEQ ID NO: 125091 - protein, 11 aa, Artificial Sequence
  Description of Artificial Sequence: Synthetic peptide
  Seed: VLVLLAVLPVL (MOG_HUMAN)
  misc_feature (2)..(2): Xaa can be Leu, Met, Tyr, Phe, Arg, Thr, Gly, Ser, Trp, Ile, Asn, His, Gln, Ala, Glu, Lys, Asp, Pro, Cys, or Val
  misc_feature (11)..(11): Xaa can be Val, Leu, Ile, or Ala
VXVLLAVLPVX

SEQ ID NO: 125092 - protein, 8 aa, Artificial Sequence
  Description of Artificial Sequence: Synthetic peptide
  Seed: VPCWKITL (MOG_HUMAN)
  misc_feature (2)..(2): Xaa can be Pro, Ala, or Met
  misc_feature (8)..(8): Xaa can be Leu, Met, Val, Ala, Phe, or Ile
VXCWKITX

SEQ ID NO: 125093 - protein, 9 aa, Artificial Sequence
  Description of Artificial Sequence: Synthetic peptide
  Seed: VPCWKITLF (MOG_HUMAN)
  misc_feature (2)..(2): Xaa can be Pro, Ala, Gln, Val, Ser, Met, Ile, Leu, Thr, Gly, Phe, Asp, His, Tyr, Glu, Lys, Trp, Asn, Arg, or Cys
  misc_feature (9)..(9): Xaa can be Tyr, Phe, Met, Leu, Trp, Ile, His, Val, Ala, Ser, Gly, Cys, Thr, or Pro
VXCWKITLX

SEQ ID NO: 125094 - protein, 10 aa, Artificial Sequence
  Description of Artificial Sequence: Synthetic peptide
  Seed: VPCWKITLFV (MOG_HUMAN)
  misc_feature (2)..(2): Xaa can be , or Pro
  misc_feature (10)..(10): Xaa can be Ala, or Val
VXCWKITLFX

SEQ ID NO: 125095 - protein, 8 aa, Artificial Sequence
  Description of Artificial Sequence: Synthetic peptide
  Seed: VPVLGPLV (MOG_HUMAN)
  misc_feature (2)..(2): Xaa can be Pro, Gln, Ala, Met, Glu, Gly, Ser, Lys, Phe, Arg, Thr, His, Asn, Ile, Asp, Val, Leu, or Ty r
  misc_feature (8)..(8): Xaa can be Val, Ile, Leu, Met, Ala, Phe, Tyr, Cys, Pro, Trp, Thr, Ser, or Gly
VXVLGPLX

SEQ ID NO: 125096 - protein, 9 aa, Artificial Sequence
  Description of Artificial Sequence: Synthetic peptide
  Seed: VPVLGPLVA (MOG_HUMAN)
  misc_feature (2)..(2): Xaa can be Pro, Ala, His, Gln, Arg, Ser, Thr, Gly, Val, Leu, Met, Ile, Cys, Lys, Asn, Glu, Phe, Tyr, or Asp
  misc_feature (9)..(9): Xaa can be Leu, Met, Val, Ile, Ala, Trp, Tyr, Phe, Cys, Thr, Pro, Gly, Ser, His, Arg, Gln, Asn, Lys, or Glu
VXVLGPLVX

SEQ ID NO: 125097 - protein, 10 aa, Artificial Sequence
  Description of Artificial Sequence: Synthetic peptide
  Seed: VPVLGPLVAL (MOG_HUMAN)
  misc_feature (2)..(2): Xaa can be Pro, Gln, Ala, Met, Thr, Val, Ser, Leu, Phe, Gly, Ile, Glu, Cys, Asp, Asn, Tyr, His, Trp, Lys, or Arg
  misc_feature (10)..(10): Xaa can be Ala, Ile, Leu, Val, Tyr, Phe, Lys, Met, Arg, Trp, Thr, Cys, His, Gln, Gly, Asn, Ser, Pro, or Glu
VXVLGPLVAX

SEQ ID NO: 125098 - protein, 11 aa, Artificial Sequence
  Description of Artificial Sequence: Synthetic peptide
  Seed: VPVLGPLVALI (MOG_HUMAN)
  misc_feature (2)..(2): Xaa can be Pro, Met, Leu, Cys, Arg, Thr, Tyr, Glu, Phe, Ala, Asn, Val, Lys, His, Asp, Ser, Ile, Gln, Trp, or Gly
  misc_feature (11)..(11): Xaa can be Ile, Leu, Val, Met, Ala, Phe, or Cys
VXVLGPLVALX

SEQ ID NO: 125099 - protein, 9 aa, Artificial Sequence
  Description of Artificial Sequence: Synthetic peptide
  Seed: VRFSDEGGF (MOG_HUMAN)
  misc_feature (2)..(2): Xaa can be Arg, Gln, His, Met, Lys, Ala, Tyr, Leu, Gly, Ile, Ser, Thr, Val, Glu, Phe, or Pro
  misc_feature (9)..(9): Xaa can be Tyr, Phe, Met, Leu, Trp, Arg, Lys, Ile, His, or Val
VXFSDEGGX

SEQ ID NO: 125100 - protein, 11 aa, Artificial Sequence
  Description of Artificial Sequence: Synthetic peptide
  Seed: VRFSDEGGFTC (MOG_HUMAN)
  misc_feature (2)..(2): Xaa can be Arg, His, Gln, Tyr, Ala, Glu, Gly, Lys, Asn, Phe, Trp, Ser, Pro, Leu, Met, Val, Ile, Thr, Asp, or Cys
  misc_feature (11)..(11): Xaa can be Phe, Leu, Met, Lys, Tyr, Ile, Trp, Val, Arg, Ala, Cys, His, Gly, Gln, Pro, Thr, Ser, Asn, or Glu
VXFSDEGGFTX

SEQ ID NO: 125101 - protein, 8 aa, Artificial Sequence
  Description of Artificial Sequence: Synthetic peptide
  Seed: VSPGVLVL (MOG_HUMAN)
  misc_feature (2)..(2): Xaa can be Ala, Ser, Thr, Val, Pro, Ile, Gly, Gln, Phe, His, Arg, Leu, Asn, Tyr, Met, Asp, Glu, Lys, or Cys
  misc_feature (8)..(8): Xaa can be Leu, Val, Ile, Met, Tyr, Phe, Lys, Arg, Cys, Ala, or His
VXPGVLVX

SEQ ID NO: 125102 - protein, 9 aa, Artificial Sequence
  Description of Artificial Sequence: Synthetic peptide
  Seed: VSPGVLVLL (MOG_HUMAN)
  misc_feature (2)..(2): Xaa can be Leu, Ala, Met, Pro, Tyr, Val, Thr, Gln, Ile, Arg, Ser, Gly, Phe, Glu, Trp, Cys, Asn, Asp, His, or Lys
  misc_feature (9)..(9): Xaa can be Met, Tyr, Leu, Phe, Val, Ile, Trp, Lys, Arg, Cys, Ala, His, Thr, Gly, Ser, Pro, or Gln
VXPGVLVLX

SEQ ID NO: 125103 - protein, 9 aa, Artificial Sequence
  Description of Artificial Sequence: Synthetic peptide
  Seed: VSSSYAGQF (MOG_HUMAN)
  misc_feature (2)..(2): Xaa can be Ala, Ser, Val, Ile, Gln, Gly, Thr, Met, Leu, Tyr, Glu, Phe, Arg, Pro, Asn, Lys, Asp, Cys, Trp, or His
  misc_feature (9)..(9): Xaa can be Tyr, Phe, Trp, Met, Leu, Lys, Ile, His, Val, Arg, or Ala
VXSSYAGQX

SEQ ID NO: 125104 - protein, 10 aa, Artificial Sequence
  Description of Artificial Sequence: Synthetic peptide
  Seed: VSSSYAGQFR (MOG_HUMAN)
  misc_feature (2)..(2): Xaa can be Thr, Ser, Glu, Gly, Gln, Leu, Ala, Val, Met, Ile, Cys, Asn, Asp, Phe, Pro, Tyr, Trp, Lys, Arg, or His
  misc_feature (10)..(10): Xaa can be Arg, Lys, Tyr, Phe, or His
VXSSYAGQFX

SEQ ID NO: 125105 - protein, 8 aa, Artificial Sequence
  Description of Artificial Sequence: Synthetic peptide
  Seed: VTLRIRNV (MOG_HUMAN)
  misc_feature (2)..(2): Xaa can be Gln, Ala, Glu, Val, Gly, Ile, Leu, Ser, Asp, Asn, His, Pro, Met, or Thr
  misc_feature (8)..(8): Xaa can be Val, Ile, Leu, Met, Cys, Ala, or Phe
VXLRIRNX

SEQ ID NO: 125106 - protein, 9 aa, Artificial Sequence
  Description of Artificial Sequence: Synthetic peptide
  Seed: VTLRIRNVR (MOG_HUMAN)
  misc_feature (2)..(2): Xaa can be Thr, Ala, Tyr, Met, Gln, Ser, Val, Trp, Phe, Gly, Leu, Ile, Cys, Asn, Glu, Pro, Asp, or Hi s
  misc_feature (9)..(9): Xaa can be Arg, Lys, or Tyr
VXLRIRNVX

SEQ ID NO: 125107 - protein, 10 aa, Artificial Sequence
  Description of Artificial Sequence: Synthetic peptide
  Seed: VTLRIRNVRF (MOG_HUMAN)
  misc_feature (2)..(2): Xaa can be Thr, Ser, Ala, Met, Glu, Asp, Cys, Asn, Ile, Val, Gln, Pro, Gly, or Leu
  misc_feature (10)..(10): Xaa can be Trp, Phe, Tyr, Leu, or Met
VXLRIRNVRX

SEQ ID NO: 125108 - protein, 9 aa, Artificial Sequence
  Description of Artificial Sequence: Synthetic peptide
  Seed: VVHLYRNGK (MOG_HUMAN)
  misc_feature (2)..(2): Xaa can be Thr, Ser, Val, Met, Gly, Pro, Leu, Ala, Tyr, Phe, Trp, Ile, Asp, Gln, or Asn
  misc_feature (9)..(9): Xaa can be Lys, Arg, Ala, Tyr, Val, Ile, or His
VXHLYRNGX

SEQ ID NO: 125109 - protein, 10 aa, Artificial Sequence
  Description of Artificial Sequence: Synthetic peptide
  Seed: WLHRRLAGQF (MOG_HUMAN)
  misc_feature (2)..(2): Xaa can be Met, Leu, Pro, Ala, Ile, Gln, Val, Lys, Arg, Gly, Ser, Phe, Thr, Glu, Trp, Asn, or His
  misc_feature (10)..(10): Xaa can be Leu, Tyr, Met, Phe, Ile, Val, or Ala
WXHRRLAGQX

SEQ ID NO: 125110 - protein, 11 aa, Artificial Sequence
  Description of Artificial Sequence: Synthetic peptide
  Seed: WLHRRLAGQFL (MOG_HUMAN)
  misc_feature (2)..(2): Xaa can be Met, Leu, Pro, Ala, or Ile
  misc_feature (11)..(11): Xaa can be Leu, Met, Val, Ala, Phe, or Ile
WXHRRLAGQFX

SEQ ID NO: 125111 - protein, 9 aa, Artificial Sequence
  Description of Artificial Sequence: Synthetic peptide
  Seed: WVSPGVLVL (MOG_HUMAN)
  misc_feature (2)..(2): Xaa can be Pro, Ala, Gln, Leu, Arg, Met, Val, His, Ser, Thr, Ile, Tyr, Phe, Gly, Asn, Lys, Glu, Cys, Trp, or Asp
  misc_feature (9)..(9): Xaa can be Tyr, Met, Ile, Phe, Val, Leu, His, Trp, Lys, Ala, Thr, Arg, Cys, Ser, Gly, Gln, Asn, Pro, Glu, or Asp
WXSPGVLVX

SEQ ID NO: 125112 - protein, 10 aa, Artificial Sequence
  Description of Artificial Sequence: Synthetic peptide
  Seed: WVSPGVLVLL (MOG_HUMAN)
  misc_feature (2)..(2): Xaa can be Met, Leu, Gln, Thr, Val, Ala, Ser, Ile, Gly, Asn, Glu, Arg, Pro, Tyr, Cys, Phe, His, Trp, Asp, or Lys
  misc_feature (10)..(10): Xaa can be Trp, Val, Leu, Phe, Met, Tyr, Ile, Lys, Ala, His, Cys, Thr, Arg, Ser, Asn, Glu, Asp, Pro, Gly, or Gln
WXSPGVLVLX

SEQ ID NO: 125113 - protein, 8 aa, Artificial Sequence
  Description of Artificial Sequence: Synthetic peptide
  Seed: WYRPPFSR (MOG_HUMAN)
  misc_feature (2)..(2): Xaa can be Leu, Asn, Met, Thr, Ala, Ile, Trp, Phe, Gly, Ser, Val, or Tyr
  misc_feature (8)..(8): Xaa can be , or Arg
WXRPPFSX

SEQ ID NO: 125114 - protein, 9 aa, Artificial Sequence
  Description of Artificial Sequence: Synthetic peptide
  Seed: WYRPPFSRV (MOG_HUMAN)
  misc_feature (2)..(2): Xaa can be Tyr, Phe, Trp, Ala, His, Met, Ile, Val, Leu, Ser, Arg, or Gln
  misc_feature (9)..(9): Xaa can be Met, Tyr, Phe, Leu, Val, Trp, Ile, His, Cys, or Ala
WXRPPFSRX

SEQ ID NO: 125115 - protein, 10 aa, Artificial Sequence
  Description of Artificial Sequence: Synthetic peptide
  Seed: WYRPPFSRVV (MOG_HUMAN)
  misc_feature (2)..(2): Xaa can be Tyr, Phe, Trp, Val, Leu, His, Met, Ala, Thr, Ser, Ile, Arg, Lys, Pro, Cys, Gln, Gly, Asp, Glu, or Asn
  misc_feature (10)..(10): Xaa can be Met, Val, Ile, Leu, Tyr, Phe, Trp, or His
WXRPPFSRVX

SEQ ID NO: 125116 - protein, 8 aa, Artificial Sequence
  Description of Artificial Sequence: Synthetic peptide
  Seed: YAGQFRVI (MOG_HUMAN)
  misc_feature (2)..(2): Xaa can be Ala, Ser, Arg, Thr, Val, Gly, Pro, Ile, Leu, Asp, Phe, Gln, Glu, Met, Asn, His, Tyr, Cys, Trp, or Lys
  misc_feature (8)..(8): Xaa can be Leu, Tyr, Met, Phe, Ile, Val, His, Trp, Ala, Cys, Lys, Arg, or Gln
YXGQFRVX

SEQ ID NO: 125117 - protein, 11 aa, Artificial Sequence
  Description of Artificial Sequence: Synthetic peptide
  Seed: YAGQFRVIGPR (MOG_HUMAN)
  misc_feature (2)..(2): Xaa can be Val, Tyr, Ala, Met, Ser, Thr, Trp, Phe, Asn, Leu, Arg, Pro, Cys, Lys, Ile, Asp, His, Glu, Gln, or Gly
  misc_feature (11)..(11): Xaa can be Arg, or Lys
YXGQFRVIGPX

SEQ ID NO: 125118 - protein, 8 aa, Artificial Sequence
  Description of Artificial Sequence: Synthetic peptide
  Seed: YNWLHRRL (MOG_HUMAN)
  misc_feature (2)..(2): Xaa can be Gln, Ala, Thr, Ser, Arg, Met, Glu, His, Gly, Asn, Leu, Val, Asp, Ile, Tyr, Pro, Phe, Trp, Cys, or Lys
  misc_feature (8)..(8): Xaa can be Leu, Phe, Tyr, Met, Ile, Val, Trp, Ala, or Cys
YXWLHRRX

SEQ ID NO: 125119 - protein, 9 aa, Artificial Sequence
  Description of Artificial Sequence: Synthetic peptide
  Seed: YQEEAAMEL (MOG_HUMAN)
  misc_feature (2)..(2): Xaa can be Glu, Ala, Arg, His, Met, Tyr, Leu, Trp, Gln, Asp, Thr, Phe, Ile, Ser, Val, Gly, Cys, Asn, Pro, or Lys
  misc_feature (9)..(9): Xaa can be Trp, Phe, Leu, Tyr, Val, Met, Ile, Lys, Cys, Ala, Arg, Thr, His, Pro, Ser, Gly, Gln, Asn, Glu, or Asp
YXEEAAMEX

SEQ ID NO: 125120 - protein, 10 aa, Artificial Sequence
  Description of Artificial Sequence: Synthetic peptide
  Seed: YQEEAAMELK (MOG_HUMAN)
  misc_feature (2)..(2): Xaa can be Thr, Ser, Val, Ala, Met, Leu, Ile, Gly, Asn, Phe, Gln, Glu, Pro, Tyr, Asp, Cys, or Trp
  misc_feature (10)..(10): Xaa can be Tyr, Lys, Arg, Phe, His, Trp, Leu, Met, or Gln
YXEEAAMELX

SEQ ID NO: 125121 - protein, 11 aa, Artificial Sequence
  Description of Artificial Sequence: Synthetic peptide
  Seed: YQEEAAMELKV (MOG_HUMAN)
  misc_feature (2)..(2): Xaa can be Gln, Leu, or Met
  misc_feature (11)..(11): Xaa can be Val, Ile, or Leu
YXEEAAMELKX

SEQ ID NO: 125122 - protein, 8 aa, Artificial Sequence
  Description of Artificial Sequence: Synthetic peptide
  Seed: YRGRTELL (MOG_HUMAN)
  misc_feature (2)..(2): Xaa can be His, Arg, Tyr, Phe, Ala, Trp, Gln, Ile, Asp, Glu, Met, Gly, Ser, Thr, Asn, or Val
  misc_feature (8)..(8): Xaa can be Leu, Met, Phe, Ile, Tyr, or Val
YXGRTELX

SEQ ID NO: 125123 - protein, 9 aa, Artificial Sequence
  Description of Artificial Sequence: Synthetic peptide
  Seed: YRGRTELLK (MOG_HUMAN)
  misc_feature (2)..(2): Xaa can be Arg, Tyr, Phe, Gln, Ala, Trp, His, Met, Leu, Ser, Lys, or Gly
  misc_feature (9)..(9): Xaa can be Leu, Phe, Tyr, Met, Ile, Val, Lys, Trp, Arg, or His
YXGRTELLX

SEQ ID NO: 125124 - protein, 9 aa, Artificial Sequence
  Description of Artificial Sequence: Synthetic peptide
  Seed: YRLRGKLRA (MOG_HUMAN)
  misc_feature (2)..(2): Xaa can be Arg, His, Gln, Lys, Tyr, Phe, Ala, Met, Trp, Ser, Gly, Leu, or Asn
  misc_feature (9)..(9): Xaa can be Leu, Phe, Tyr, Met, Ile, Val, Ala, Lys, Thr, Arg, Cys, Pro, Ser, Gly, His, Trp, Glu, Gln, or Asn
YXLRGKLRX

SEQ ID NO: 125125 - protein, 11 aa, Artificial Sequence
  Description of Artificial Sequence: Synthetic peptide
  Seed: YRLRGKLRAEI (MOG_HUMAN)
  misc_feature (2)..(2): Xaa can be Arg, or Gln
  misc_feature (11)..(11): Xaa can be Leu, Val, Phe, Arg, Ile, Tyr, Met, or Lys
YXLRGKLRAEX

SEQ ID NO: 125126 - protein, 8 aa, Artificial Sequence
  Description of Artificial Sequence: Synthetic peptide
  Seed: YRPPFSRV (MOG_HUMAN)
  misc_feature (2)..(2): Xaa can be Arg, Tyr, His, Asn, Phe, Glu, Ala, Gln, Ser, Gly, Thr, Pro, Trp, Val, Met, Lys, Ile, Asp, Leu, or Cys
  misc_feature (8)..(8): Xaa can be Leu, Phe, Met, Tyr, Ile, Val, Trp, His, Lys, or Ala
YXPPFSRX

SEQ ID NO: 125127 - protein, 9 aa, Artificial Sequence
  Description of Artificial Sequence: Synthetic peptide
  Seed: YRPPFSRVV (MOG_HUMAN)
  misc_feature (2)..(2): Xaa can be Phe, Tyr, Ala, Arg, Ser, His, Thr, Trp, Ile, Gln, Val, Gly, Leu, Met, Asn, Lys, Cys, Pro, Glu, or Asp
  misc_feature (9)..(9): Xaa can be Ala, Val, Tyr, Ile, Leu, Phe, Met, Cys, Trp, His, Thr, Lys, Arg, Ser, Pro, Gln, Gly, Glu, or Asn
YXPPFSRVX

SEQ ID NO: 125128 - protein, 10 aa, Artificial Sequence
  Description of Artificial Sequence: Synthetic peptide
  Seed: YRPPFSRVVH (MOG_HUMAN)
  misc_feature (2)..(2): Xaa can be Arg, Tyr, His, Phe, Gln, Trp, Met, Ala, Cys, Glu, Gly, Pro, Ile, Val, Asn, Thr, Ser, Lys, or Leu
  misc_feature (10)..(10): Xaa can be Leu, Tyr, Phe, Met, Ile, Trp, Val, Cys, His, Lys, Arg, Gln, or Ala
YXPPFSRVVX

SEQ ID NO: 125129 - protein, 11 aa, Artificial Sequence
  Description of Artificial Sequence: Synthetic peptide
  Seed: YRPPFSRVVHL (MOG_HUMAN)
  misc_feature (2)..(2): Xaa can be Arg, Tyr, His, Pro, Gln, Lys, Phe, Trp, Ala, Ile, Asn, Thr, Leu, Asp, Ser, Cys, Met, Gly, Glu, or Val
  misc_feature (11)..(11): Xaa can be Met, Phe, Leu, Ile, Tyr, Trp, Val, Cys, Arg, His, or Lys
YXPPFSRVVHX

SEQ ID NO: 125130 - protein, 8 aa, Artificial Sequence
  Description of Artificial Sequence: Synthetic peptide
  Seed: YWVSPGVL (MOG_HUMAN)
  misc_feature (2)..(2): Xaa can be Tyr, Phe, Arg, Met, Trp, His, or Gln
  misc_feature (8)..(8): Xaa can be Leu, Tyr, Phe, Met, Ile, Val, His, Trp, or Ala
YXVSPGVX

SEQ ID NO: 125131 - protein, 9 aa, Artificial Sequence
  Description of Artificial Sequence: Synthetic peptide
  Seed: YWVSPGVLV (MOG_HUMAN)
  misc_feature (2)..(2): Xaa can be Arg, Tyr, Phe, Gln, Ala, His, Trp, Met, Leu, Ile, Pro, Lys, Thr, Gly, Glu, Asn, Val, Cys, Ser, or Asp
  misc_feature (9)..(9): Xaa can be Met, Phe, Ile, Val, Leu, Tyr, Trp, His, Ala, Cys, Lys, Arg, Thr, Gly, Ser, Gln, or Pro
YXVSPGVLX

SEQ ID NO: 125132 - protein, 10 aa, Artificial Sequence
  Description of Artificial Sequence: Synthetic peptide
  Seed: YWVSPGVLVL (MOG_HUMAN)
  misc_feature (2)..(2): Xaa can be Leu, Met, Arg, Tyr, Ala, Phe, Trp, Thr, Ser, Gln, Val, His, Ile, Asn, Pro, Glu, Asp, Lys, Cys, or Gly
  misc_feature (10)..(10): Xaa can be Met, Val, Leu, Phe, Tyr, Ile, Trp, His, Ala, Cys, Lys, Thr, Arg, Gln, Glu, Gly, Pro, Asp, Asn, or Ser
YXVSPGVLVX

SEQ ID NO: 125133 - protein, 11 aa, Artificial Sequence
  Description of Artificial Sequence: Synthetic peptide
  Seed: YWVSPGVLVLL (MOG_HUMAN)
  misc_feature (2)..(2): Xaa can be Tyr, Trp, Phe, Gln, His, or Met
  misc_feature (11)..(11): Xaa can be Phe, Met, Trp, Tyr, Leu, Ile, Val, or His
YXVSPGVLVLX

SEQ ID NO: 125134 - protein, 9 aa, Artificial Sequence
  Description of Artificial Sequence: Synthetic peptide
  Seed: AEADLSYTW (PMEL_HUMAN)
AEADLSYTF

SEQ ID NO: 125135 - protein, 9 aa, Artificial Sequence
  Description of Artificial Sequence: Synthetic peptide
  Seed: ALDGGNKHF (PMEL_HUMAN)
AFDGGNKHM

SEQ ID NO: 125136 - protein, 9 aa, Artificial Sequence
  Description of Artificial Sequence: Synthetic peptide
  Seed: AVIGALLAV (PMEL_HUMAN)
ATIGALLAV

SEQ ID NO: 125137 - protein, 9 aa, Artificial Sequence
  Description of Artificial Sequence: Synthetic peptide
  Seed: ESAEILQAV (PMEL_HUMAN)
EVAEILQAM

SEQ ID NO: 125138 - protein, 9 aa, Artificial Sequence
  Description of Artificial Sequence: Synthetic peptide
  Seed: FGDSSGTLI (PMEL_HUMAN)
FADSSGTLL

SEQ ID NO: 125139 - protein, 9 aa, Artificial Sequence
  Description of Artificial Sequence: Synthetic peptide
  Seed: FTITDQVPF (PMEL_HUMAN)
FAITDQVPF

SEQ ID NO: 125140 - protein, 9 aa, Artificial Sequence
  Description of Artificial Sequence: Synthetic peptide
  Seed: FLRNQPLTF (PMEL_HUMAN)
FARNQPLTL

SEQ ID NO: 125141 - protein, 9 aa, Artificial Sequence
  Description of Artificial Sequence: Synthetic peptide
  Seed: FLRNQPLTF (PMEL_HUMAN)
FMRNQPLTM

SEQ ID NO: 125142 - protein, 9 aa, Artificial Sequence
  Description of Artificial Sequence: Synthetic peptide
  Seed: HTMEVTVYH (PMEL_HUMAN)
HTMEVTVYK

SEQ ID NO: 125143 - protein, 9 aa, Artificial Sequence
  Description of Artificial Sequence: Synthetic peptide
  Seed: HTMEVTVYH (PMEL_HUMAN)
HTMEVTVYR

SEQ ID NO: 125144 - protein, 9 aa, Artificial Sequence
  Description of Artificial Sequence: Synthetic peptide
  Seed: HTMEVTVYH (PMEL_HUMAN)
HTMEVTVYY

SEQ ID NO: 125145 - protein, 9 aa, Artificial Sequence
  Description of Artificial Sequence: Synthetic peptide
  Seed: LADTNSLAV (PMEL_HUMAN)
LADTNSLAL

SEQ ID NO: 125146 - protein, 9 aa, Artificial Sequence
  Description of Artificial Sequence: Synthetic peptide
  Seed: LIYRRRLMK (PMEL_HUMAN)
LMYRRRLMK

SEQ ID NO: 125147 - protein, 9 aa, Artificial Sequence
  Description of Artificial Sequence: Synthetic peptide
  Seed: LIYRRRLMK (PMEL_HUMAN)
LVYRRRLMK

SEQ ID NO: 125148 - protein, 9 aa, Artificial Sequence
  Description of Artificial Sequence: Synthetic peptide
  Seed: MLGTHTMEV (PMEL_HUMAN)
MMGTHTMEL

SEQ ID NO: 125149 - protein, 9 aa, Artificial Sequence
  Description of Artificial Sequence: Synthetic peptide
  Seed: MTPAEVSIV (PMEL_HUMAN)
MMPAEVSIL

SEQ ID NO: 125150 - protein, 9 aa, Artificial Sequence
  Description of Artificial Sequence: Synthetic peptide
  Seed: PLDCVLYRY (PMEL_HUMAN)
PTDCVLYRY

SEQ ID NO: 125151 - protein, 9 aa, Artificial Sequence
  Description of Artificial Sequence: Synthetic peptide
  Seed: RAMLGTHTM (PMEL_HUMAN)
RAMLGTHTF

SEQ ID NO: 125152 - protein, 9 aa, Artificial Sequence
  Description of Artificial Sequence: Synthetic peptide
  Seed: RAMLGTHTM (PMEL_HUMAN)
RAMLGTHTL

SEQ ID NO: 125153 - protein, 9 aa, Artificial Sequence
  Description of Artificial Sequence: Synthetic peptide
  Seed: RYGSFSVTL (PMEL_HUMAN)
RMGSFSVTF

SEQ ID NO: 125154 - protein, 9 aa, Artificial Sequence
  Description of Artificial Sequence: Synthetic peptide
  Seed: RALVVTHTY (PMEL_HUMAN)
RSLVVTHTY

SEQ ID NO: 125155 - protein, 9 aa, Artificial Sequence
  Description of Artificial Sequence: Synthetic peptide
  Seed: RALVVTHTY (PMEL_HUMAN)
RTLVVTHTY

SEQ ID NO: 125156 - protein, 9 aa, Artificial Sequence
  Description of Artificial Sequence: Synthetic peptide
  Seed: TPAEVSIVV (PMEL_HUMAN)
TPAEVSIVL

SEQ ID NO: 125157 - protein, 9 aa, Artificial Sequence
  Description of Artificial Sequence: Synthetic peptide
  Seed: VSNDGPTLI (PMEL_HUMAN)
VFNDGPTLL

SEQ ID NO: 125158 - protein, 9 aa, Artificial Sequence
  Description of Artificial Sequence: Synthetic peptide
  Seed: VLPSPACQL (PMEL_HUMAN)
VMPSPACQL

SEQ ID NO: 125159 - protein, 9 aa, Artificial Sequence
  Description of Artificial Sequence: Synthetic peptide
  Seed: VLPSPACQL (PMEL_HUMAN)
VMPSPACQM

SEQ ID NO: 125160 - protein, 9 aa, Artificial Sequence
  Description of Artificial Sequence: Synthetic peptide
  Seed: VSNDGPTLI (PMEL_HUMAN)
VYNDGPTLL

SEQ ID NO: 125161 - protein, 9 aa, Artificial Sequence
  Description of Artificial Sequence: Synthetic peptide
  Seed: YLEPGPVTA (PMEL_HUMAN)
YMEPGPVTL

SEQ ID NO: 125162 - protein, 9 aa, Artificial Sequence
  Description of Artificial Sequence: Synthetic peptide
  Seed: YRYGSFSVT (PMEL_HUMAN)
YRYGSFSVL

SEQ ID NO: 125163 - protein, 10 aa, Artificial Sequence
  Description of Artificial Sequence: Synthetic peptide
  Seed: YRYGSFSVTL (PMEL_HUMAN)
YRYGSFSVTF

SEQ ID NO: 125164 - protein, 10 aa, Artificial Sequence
  Description of Artificial Sequence: Synthetic peptide
  Seed: YRYGSFSVTL (PMEL_HUMAN)
YRYGSFSVTM

SEQ ID NO: 125165 - protein, 9 aa, Artificial Sequence
  Description of Artificial Sequence: Synthetic peptide
  Seed: YLAEADLSY (PMEL_HUMAN)
YSAEADLSY

SEQ ID NO: 125166 - protein, 9 aa, Artificial Sequence
  Description of Artificial Sequence: Synthetic peptide
  Seed: YLAEADLSY (PMEL_HUMAN)
YTAEADLSY

SEQ ID NO: 125167 - protein, 10 aa, Artificial Sequence
  Description of Artificial Sequence: Synthetic peptide
  Seed: YRYGSFSVTL (PMEL_HUMAN)
YYYGSFSVTM

SEQ ID NO: 125168 - protein, 9 aa, Homo sapiens
  Native (PMEL_HUMAN)
AEMSTPEAT

SEQ ID NO: 125169 - protein, 8 aa, Homo sapiens
  Native (PMEL_HUMAN)
AEVSIVVL

SEQ ID NO: 125170 - protein, 9 aa, Homo sapiens
  Native (PMEL_HUMAN)
AHSSSAFTI

SEQ ID NO: 125171 - protein, 9 aa, Homo sapiens
  Native (PMEL_HUMAN)
ALLAVGATK

SEQ ID NO: 125172 - protein, 9 aa, Homo sapiens
  Native (PMEL_HUMAN)
ALNFPGSQK

SEQ ID NO: 125173 - protein, 9 aa, Homo sapiens
  Native (PMEL_HUMAN)
ASFSIALNF

SEQ ID NO: 125174 - protein, 9 aa, Homo sapiens
  Native (PMEL_HUMAN)
AVIGALLAV

SEQ ID NO: 125175 - protein, 9 aa, Homo sapiens
  Native (PMEL_HUMAN)
CPIGENSPL

SEQ ID NO: 125176 - protein, 9 aa, Homo sapiens
  Native (PMEL_HUMAN)
ESAEILQAV

SEQ ID NO: 125177 - protein, 10 aa, Homo sapiens
  Native (PMEL_HUMAN)
EVMGTTLAEM

SEQ ID NO: 125178 - protein, 9 aa, Homo sapiens
  Native (PMEL_HUMAN)
FTITDQVPF

SEQ ID NO: 125179 - protein, 9 aa, Homo sapiens
  Native (PMEL_HUMAN)
GTATLRLVK

SEQ ID NO: 125180 - protein, 10 aa, Homo sapiens
  Native (PMEL_HUMAN)
HTMEVTVYHR

SEQ ID NO: 125181 - protein, 9 aa, Homo sapiens
  Native (PMEL_HUMAN)
IMPGQEAGL

SEQ ID NO: 125182 - protein, 9 aa, Homo sapiens
  Native (PMEL_HUMAN)
KQDFSVPQL

SEQ ID NO: 125183 - protein, 9 aa, Homo sapiens
  Native (PMEL_HUMAN)
KVSNDGPTL

SEQ ID NO: 125184 - protein, 9 aa, Homo sapiens
  Native (PMEL_HUMAN)
LADTNSLAV

SEQ ID NO: 125185 - protein, 10 aa, Homo sapiens
  Native (PMEL_HUMAN)
LAEADLSYTW

SEQ ID NO: 125186 - protein, 9 aa, Homo sapiens
  Native (PMEL_HUMAN)
LIYRRRLMK

SEQ ID NO: 125187 - protein, 11 aa, Homo sapiens
  Native (PMEL_HUMAN)
LMAVVLASLIY

SEQ ID NO: 125188 - protein, 9 aa, Homo sapiens
  Native (PMEL_HUMAN)
LPKEACMEI

SEQ ID NO: 125189 - protein, 10 aa, Homo sapiens
  Native (PMEL_HUMAN)
LRNQPLTFAL

SEQ ID NO: 125190 - protein, 9 aa, Homo sapiens
  Native (PMEL_HUMAN)
LSIGTGRAM

SEQ ID NO: 125191 - protein, 9 aa, Homo sapiens
  Native (PMEL_HUMAN)
MPTAESTGM

SEQ ID NO: 125192 - protein, 10 aa, Homo sapiens
  Native (PMEL_HUMAN)
MTPAEVSIVV

SEQ ID NO: 125193 - protein, 9 aa, Homo sapiens
  Native (PMEL_HUMAN)
QEAGLGQVP

SEQ ID NO: 125194 - protein, 10 aa, Homo sapiens
  Native (PMEL_HUMAN)
QEAGLGQVPL

SEQ ID NO: 125195 - protein, 9 aa, Homo sapiens
  Native (PMEL_HUMAN)
QPLTFALQL

SEQ ID NO: 125196 - protein, 9 aa, Homo sapiens
  Native (PMEL_HUMAN)
RALVVTHTY

SEQ ID NO: 125197 - protein, 9 aa, Homo sapiens
  Native (PMEL_HUMAN)
RAMLGTHTM

SEQ ID NO: 125198 - protein, 9 aa, Homo sapiens
  Native (PMEL_HUMAN)
RLMKQDFSV

SEQ ID NO: 125199 - protein, 10 aa, Homo sapiens
  Native (PMEL_HUMAN)
RNQDWLGVSR

SEQ ID NO: 125200 - protein, 10 aa, Homo sapiens
  Native (PMEL_HUMAN)
RSFVYVWKTW

SEQ ID NO: 125201 - protein, 9 aa, Homo sapiens
  Native (PMEL_HUMAN)
RYGSFSVTL

SEQ ID NO: 125202 - protein, 8 aa, Homo sapiens
  Native (PMEL_HUMAN)
SEVMGTTL

SEQ ID NO: 125203 - protein, 9 aa, Homo sapiens
  Native (PMEL_HUMAN)
SLAVVSTQL

SEQ ID NO: 125204 - protein, 9 aa, Homo sapiens
  Native (PMEL_HUMAN)
SSHWLRLPR

SEQ ID NO: 125205 - protein, 10 aa, Homo sapiens
  Native (PMEL_HUMAN)
TAAQVTTTEW

SEQ ID NO: 125206 - protein, 9 aa, Homo sapiens
  Native (PMEL_HUMAN)
TEAQRLDCW

SEQ ID NO: 125207 - protein, 9 aa, Homo sapiens
  Native (PMEL_HUMAN)
TLIGANASF

SEQ ID NO: 125208 - protein, 9 aa, Homo sapiens
  Native (PMEL_HUMAN)
TPAEVSIVV

SEQ ID NO: 125209 - protein, 11 aa, Homo sapiens
  Native (PMEL_HUMAN)
TWDFGDSSGTL

SEQ ID NO: 125210 - protein, 9 aa, Homo sapiens
  Native (PMEL_HUMAN)
VISTAPVQM

SEQ ID NO: 125211 - protein, 9 aa, Homo sapiens
  Native (PMEL_HUMAN)
VLPSPACQL

SEQ ID NO: 125212 - protein, 10 aa, Homo sapiens
  Native (PMEL_HUMAN)
VPFSVSVSQL

SEQ ID NO: 125213 - protein, 9 aa, Homo sapiens
  Native (PMEL_HUMAN)
VPLAHSSSA

SEQ ID NO: 125214 - protein, 9 aa, Homo sapiens
  Native (PMEL_HUMAN)
VTAQVVLQA

SEQ ID NO: 125215 - protein, 9 aa, Homo sapiens
  Native (PMEL_HUMAN)
VVLASLIYR

SEQ ID NO: 125216 - protein, 9 aa, Homo sapiens
  Native (PMEL_HUMAN)
YHRRGSRSY

SEQ ID NO: 125217 - protein, 10 aa, Homo sapiens
  Native (PMEL_HUMAN)
YRYGSFSVTL

SEQ ID NO: 125218 - protein, 9 aa, Homo sapiens
  Native (PMEL_HUMAN)
YVWKTWGQY

SEQ ID NO: 125219 - protein, 9 aa, Artificial Sequence
  Description of Artificial Sequence: Synthetic peptide
  Seed: LTSCGSSPV (PMEL_HUMAN)
LVSCGSSPM

SEQ ID NO: 125220 - protein, 9 aa, Artificial Sequence
  Description of Artificial Sequence: Synthetic peptide
  Seed: RALVVTHTY (PMEL_HUMAN)
RPLVVTHTF

SEQ ID NO: 125221 - protein, 11 aa, Artificial Sequence
  Description of Artificial Sequence: Synthetic peptide
  Seed: RALDGGNKHFL (PMEL_HUMAN)
RVLDGGNKHFY

SEQ ID NO: 125222 - protein, 10 aa, Artificial Sequence
  Description of Artificial Sequence: Synthetic peptide
  Seed: THTMEVTVYH (PMEL_HUMAN)
TWTMEVTVYY

SEQ ID NO: 125223 - protein, 10 aa, Artificial Sequence
  Description of Artificial Sequence: Synthetic peptide
  Seed: YVPLAHSSSA (PMEL_HUMAN)
YTPLAHSSSA

SEQ ID NO: 125224 - protein, 10 aa, Artificial Sequence
  Description of Artificial Sequence: Synthetic peptide
  Seed: YVWKTWGQYW (PMEL_HUMAN)
YGWKTWGQYW

SEQ ID NO: 125225 - protein, 10 aa, Artificial Sequence
  Description of Artificial Sequence: Synthetic peptide
  Seed: AVIGALLAVG (PMEL_HUMAN)
AVIGALLAVA

SEQ ID NO: 125226 - protein, 9 aa, Artificial Sequence
  Description of Artificial Sequence: Synthetic peptide
  Seed: LYRYGSFSV (PMEL_HUMAN)
LTRYGSFSV

SEQ ID NO: 125227 - protein, 9 aa, Artificial Sequence
  Description of Artificial Sequence: Synthetic peptide
  Seed: FPGSQKVLP (PMEL_HUMAN)
FPGSQKVLL

SEQ ID NO: 125228 - protein, 10 aa, Artificial Sequence
  Description of Artificial Sequence: Synthetic peptide
  Seed: SVPQLPHSSS (PMEL_HUMAN)
SEPQLPHSSF

SEQ ID NO: 125229 - protein, 10 aa, Artificial Sequence
  Description of Artificial Sequence: Synthetic peptide
  Seed: YLAEADLSYT (PMEL_HUMAN)
YTAEADLSYL

SEQ ID NO: 125230 - protein, 10 aa, Artificial Sequence
  Description of Artificial Sequence: Synthetic peptide
  Seed: GALLAVGATK (PMEL_HUMAN)
GVLLAVGATK

SEQ ID NO: 125231 - protein, 9 aa, Artificial Sequence
  Description of Artificial Sequence: Synthetic peptide
  Seed: RLMKQDFSV (PMEL_HUMAN)
RTMKQDFSV

SEQ ID NO: 125232 - protein, 9 aa, Artificial Sequence
  Description of Artificial Sequence: Synthetic peptide
  Seed: TVYHRRGSR (PMEL_HUMAN)
TAYHRRGSR

SEQ ID NO: 125233 - protein, 11 aa, Artificial Sequence
  Description of Artificial Sequence: Synthetic peptide
  Seed: VLGGPVSGLSI (PMEL_HUMAN)
VAGGPVSGLSL

SEQ ID NO: 125234 - protein, 9 aa, Artificial Sequence
  Description of Artificial Sequence: Synthetic peptide
  Seed: YLEPGPVTA (PMEL_HUMAN)
YVEPGPVTI

SEQ ID NO: 125235 - protein, 9 aa, Artificial Sequence
  Description of Artificial Sequence: Synthetic peptide
  Seed: ASFSIALNF (PMEL_HUMAN)
ALFSIALNF

SEQ ID NO: 125236 - protein, 9 aa, Artificial Sequence
  Description of Artificial Sequence: Synthetic peptide
  Seed: EKVPVSEVM (PMEL_HUMAN)
EMVPVSEVY

SEQ ID NO: 125237 - protein, 10 aa, Artificial Sequence
  Description of Artificial Sequence: Synthetic peptide
  Seed: TTEWVETTAR (PMEL_HUMAN)
TTEWVETTAY

SEQ ID NO: 125238 - protein, 9 aa, Artificial Sequence
  Description of Artificial Sequence: Synthetic peptide
  Seed: RAMLGTHTM (PMEL_HUMAN)
RGMLGTHTF

SEQ ID NO: 125239 - protein, 9 aa, Artificial Sequence
  Description of Artificial Sequence: Synthetic peptide
  Seed: LADTNSLAV (PMEL_HUMAN)
LYDTNSLAM

SEQ ID NO: 125240 - protein, 9 aa, Artificial Sequence
  Description of Artificial Sequence: Synthetic peptide
  Seed: VQMPTAEST (PMEL_HUMAN)
VHMPTAESV

SEQ ID NO: 125241 - protein, 8 aa, Artificial Sequence
  Description of Artificial Sequence: Synthetic peptide
  Seed: LLDGTATL (PMEL_HUMAN)
LADGTATV

SEQ ID NO: 125242 - protein, 8 aa, Artificial Sequence
  Description of Artificial Sequence: Synthetic peptide
  Seed: SVSQLRAL (PMEL_HUMAN)
SASQLRAL

SEQ ID NO: 125243 - protein, 9 aa, Artificial Sequence
  Description of Artificial Sequence: Synthetic peptide
  Seed: AEADLSYTW (PMEL_HUMAN)
AQADLSYTI

SEQ ID NO: 125244 - protein, 10 aa, Artificial Sequence
  Description of Artificial Sequence: Synthetic peptide
  Seed: YLAEADLSYT (PMEL_HUMAN)
YMAEADLSYS

SEQ ID NO: 125245 - protein, 9 aa, Artificial Sequence
  Description of Artificial Sequence: Synthetic peptide
  Seed: LSIGTGRAM (PMEL_HUMAN)
LYIGTGRAW

SEQ ID NO: 125246 - protein, 9 aa, Artificial Sequence
  Description of Artificial Sequence: Synthetic peptide
  Seed: TPAEVSIVV (PMEL_HUMAN)
TCAEVSIVY

SEQ ID NO: 125247 - protein, 10 aa, Artificial Sequence
  Description of Artificial Sequence: Synthetic peptide
  Seed: LIMPGQEAGL (PMEL_HUMAN)
LQMPGQEAGL

SEQ ID NO: 125248 - protein, 9 aa, Artificial Sequence
  Description of Artificial Sequence: Synthetic peptide
  Seed: LPDGQVIWV (PMEL_HUMAN)
LVDGQVIWV

SEQ ID NO: 125249 - protein, 9 aa, Artificial Sequence
  Description of Artificial Sequence: Synthetic peptide
  Seed: TLIGANASF (PMEL_HUMAN)
TWIGANASM

SEQ ID NO: 125250 - protein, 9 aa, Artificial Sequence
  Description of Artificial Sequence: Synthetic peptide
  Seed: SQKRSFVYV (PMEL_HUMAN)
SSKRSFVYM

SEQ ID NO: 125251 - protein, 9 aa, Artificial Sequence
  Description of Artificial Sequence: Synthetic peptide
  Seed: YLAEADLSY (PMEL_HUMAN)
YPAEADLSL

SEQ ID NO: 125252 - protein, 9 aa, Artificial Sequence
  Description of Artificial Sequence: Synthetic peptide
  Seed: ASFSIALNF (PMEL_HUMAN)
AYFSIALNY

SEQ ID NO: 125253 - protein, 11 aa, Artificial Sequence
  Description of Artificial Sequence: Synthetic peptide
  Seed: HTMEVTVYHRR (PMEL_HUMAN)
HTMEVTVYHRW

SEQ ID NO: 125254 - protein, 9 aa, Artificial Sequence
  Description of Artificial Sequence: Synthetic peptide
  Seed: TLISRALVV (PMEL_HUMAN)
TMISRALVF

SEQ ID NO: 125255 - protein, 10 aa, Artificial Sequence
  Description of Artificial Sequence: Synthetic peptide
  Seed: MTPAEVSIVV (PMEL_HUMAN)
MIPAEVSIVT

SEQ ID NO: 125256 - protein, 10 aa, Artificial Sequence
  Description of Artificial Sequence: Synthetic peptide
  Seed: KRQVPLDCVL (PMEL_HUMAN)
KAQVPLDCVY

SEQ ID NO: 125257 - protein, 10 aa, Artificial Sequence
  Description of Artificial Sequence: Synthetic peptide
  Seed: RRLMKQDFSV (PMEL_HUMAN)
RDLMKQDFSL

SEQ ID NO: 125258 - protein, 10 aa, Artificial Sequence
  Description of Artificial Sequence: Synthetic peptide
  Seed: QVPLDCVLYR (PMEL_HUMAN)
QVPLDCVLYK

SEQ ID NO: 125259 - protein, 9 aa, Artificial Sequence
  Description of Artificial Sequence: Synthetic peptide
  Seed: HTMEVTVYH (PMEL_HUMAN)
HMMEVTVYY

SEQ ID NO: 125260 - protein, 9 aa, Artificial Sequence
  Description of Artificial Sequence: Synthetic peptide
  Seed: ITGSLGPLL (PMEL_HUMAN)
IAGSLGPLL

SEQ ID NO: 125261 - protein, 9 aa, Artificial Sequence
  Description of Artificial Sequence: Synthetic peptide
  Seed: ILKGGSGTY (PMEL_HUMAN)
IYKGGSGTF

SEQ ID NO: 125262 - protein, 9 aa, Artificial Sequence
  Description of Artificial Sequence: Synthetic peptide
  Seed: QLVLHQILK (PMEL_HUMAN)
QTVLHQILY

SEQ ID NO: 125263 - protein, 10 aa, Artificial Sequence
  Description of Artificial Sequence: Synthetic peptide
  Seed: SLADTNSLAV (PMEL_HUMAN)
SYADTNSLAM

SEQ ID NO: 125264 - protein, 9 aa, Artificial Sequence
  Description of Artificial Sequence: Synthetic peptide
  Seed: SQVWGGQPV (PMEL_HUMAN)
SLVWGGQPV

SEQ ID NO: 125265 - protein, 10 aa, Artificial Sequence
  Description of Artificial Sequence: Synthetic peptide
  Seed: VPQLPHSSSH (PMEL_HUMAN)
VEQLPHSSSY

SEQ ID NO: 125266 - protein, 10 aa, Artificial Sequence
  Description of Artificial Sequence: Synthetic peptide
  Seed: VPLAHSSSAF (PMEL_HUMAN)
VPLAHSSSAA

SEQ ID NO: 125267 - protein, 11 aa, Artificial Sequence
  Description of Artificial Sequence: Synthetic peptide
  Seed: FGDSSGTLISR (PMEL_HUMAN)
FTDSSGTLISF

SEQ ID NO: 125268 - protein, 9 aa, Artificial Sequence
  Description of Artificial Sequence: Synthetic peptide
  Seed: AEADLSYTW (PMEL_HUMAN)
AEADLSYTI

SEQ ID NO: 125269 - protein, 9 aa, Artificial Sequence
  Description of Artificial Sequence: Synthetic peptide
  Seed: FLRNQPLTF (PMEL_HUMAN)
FYRNQPLTM

SEQ ID NO: 125270 - protein, 9 aa, Artificial Sequence
  Description of Artificial Sequence: Synthetic peptide
  Seed: TAQVVLQAA (PMEL_HUMAN)
TPQVVLQAM

SEQ ID NO: 125271 - protein, 9 aa, Artificial Sequence
  Description of Artificial Sequence: Synthetic peptide
  Seed: GTYCLNVSL (PMEL_HUMAN)
GIYCLNVSI

SEQ ID NO: 125272 - protein, 9 aa, Artificial Sequence
  Description of Artificial Sequence: Synthetic peptide
  Seed: RALVVTHTY (PMEL_HUMAN)
RTLVVTHTW

SEQ ID NO: 125273 - protein, 9 aa, Artificial Sequence
  Description of Artificial Sequence: Synthetic peptide
  Seed: VSNDGPTLI (PMEL_HUMAN)
VHNDGPTLF

SEQ ID NO: 125274 - protein, 9 aa, Artificial Sequence
  Description of Artificial Sequence: Synthetic peptide
  Seed: ESAEILQAV (PMEL_HUMAN)
EAAEILQAF

SEQ ID NO: 125275 - protein, 9 aa, Artificial Sequence
  Description of Artificial Sequence: Synthetic peptide
  Seed: FGDSSGTLI (PMEL_HUMAN)
FRDSSGTLL

SEQ ID NO: 125276 - protein, 9 aa, Artificial Sequence
  Description of Artificial Sequence: Synthetic peptide
  Seed: MEVTVYHRR (PMEL_HUMAN)
MPVTVYHRR

SEQ ID NO: 125277 - protein, 9 aa, Artificial Sequence
  Description of Artificial Sequence: Synthetic peptide
  Seed: ASFSIALNF (PMEL_HUMAN)
AKFSIALNY

SEQ ID NO: 125278 - protein, 9 aa, Artificial Sequence
  Description of Artificial Sequence: Synthetic peptide
  Seed: VLMAVVLAS (PMEL_HUMAN)
VTMAVVLAA

SEQ ID NO: 125279 - protein, 10 aa, Artificial Sequence
  Description of Artificial Sequence: Synthetic peptide
  Seed: VLMAVVLASL (PMEL_HUMAN)
VWMAVVLASF

SEQ ID NO: 125280 - protein, 9 aa, Artificial Sequence
  Description of Artificial Sequence: Synthetic peptide
  Seed: SVPQLPHSS (PMEL_HUMAN)
SNPQLPHSM

SEQ ID NO: 125281 - protein, 8 aa, Artificial Sequence
  Description of Artificial Sequence: Synthetic peptide
  Seed: TEWVETTA (PMEL_HUMAN)
TEWVETTF

SEQ ID NO: 125282 - protein, 10 aa, Artificial Sequence
  Description of Artificial Sequence: Synthetic peptide
  Seed: KTWGQYWQVL (PMEL_HUMAN)
KMWGQYWQVL

SEQ ID NO: 125283 - protein, 9 aa, Artificial Sequence
  Description of Artificial Sequence: Synthetic peptide
  Seed: RLVKRQVPL (PMEL_HUMAN)
RMVKRQVPM

SEQ ID NO: 125284 - protein, 8 aa, Artificial Sequence
  Description of Artificial Sequence: Synthetic peptide
  Seed: VLPDGQVI (PMEL_HUMAN)
VAPDGQVL

SEQ ID NO: 125285 - protein, 9 aa, Artificial Sequence
  Description of Artificial Sequence: Synthetic peptide
  Seed: THTMEVTVY (PMEL_HUMAN)
TVTMEVTVF

SEQ ID NO: 125286 - protein, 10 aa, Artificial Sequence
  Description of Artificial Sequence: Synthetic peptide
  Seed: GTHTMEVTVY (PMEL_HUMAN)
GMHTMEVTVY

SEQ ID NO: 125287 - protein, 8 aa, Artificial Sequence
  Description of Artificial Sequence: Synthetic peptide
  Seed: LLDGTATL (PMEL_HUMAN)
LMDGTATV

SEQ ID NO: 125288 - protein, 11 aa, Artificial Sequence
  Description of Artificial Sequence: Synthetic peptide
  Seed: KVLPDGQVIWV (PMEL_HUMAN)
KTLPDGQVIWM

SEQ ID NO: 125289 - protein, 9 aa, Artificial Sequence
  Description of Artificial Sequence: Synthetic peptide
  Seed: ALLAVGATK (PMEL_HUMAN)
AILAVGATR

SEQ ID NO: 125290 - protein, 9 aa, Artificial Sequence
  Description of Artificial Sequence: Synthetic peptide
  Seed: SSIMSTESI (PMEL_HUMAN)
SHIMSTESM

SEQ ID NO: 125291 - protein, 11 aa, Artificial Sequence
  Description of Artificial Sequence: Synthetic peptide
  Seed: LGPLLDGTATL (PMEL_HUMAN)
LVPLLDGTATL

SEQ ID NO: 125292 - protein, 11 aa, Artificial Sequence
  Description of Artificial Sequence: Synthetic peptide
  Seed: ISRALVVTHTY (PMEL_HUMAN)
ILRALVVTHTW

SEQ ID NO: 125293 - protein, 9 aa, Artificial Sequence
  Description of Artificial Sequence: Synthetic peptide
  Seed: AHSSSAFTI (PMEL_HUMAN)
ALSSSAFTY

SEQ ID NO: 125294 - protein, 9 aa, Artificial Sequence
  Description of Artificial Sequence: Synthetic peptide
  Seed: AHSSSAFTI (PMEL_HUMAN)
ARSSSAFTF

SEQ ID NO: 125295 - protein, 9 aa, Artificial Sequence
  Description of Artificial Sequence: Synthetic peptide
  Seed: AEADLSYTW (PMEL_HUMAN)
ALADLSYTV

SEQ ID NO: 125296 - protein, 10 aa, Artificial Sequence
  Description of Artificial Sequence: Synthetic peptide
  Seed: SLGPLLDGTA (PMEL_HUMAN)
SMGPLLDGTV

SEQ ID NO: 125297 - protein, 10 aa, Artificial Sequence
  Description of Artificial Sequence: Synthetic peptide
  Seed: LVLMAVVLAS (PMEL_HUMAN)
LHLMAVVLAM

SEQ ID NO: 125298 - protein, 10 aa, Artificial Sequence
  Description of Artificial Sequence: Synthetic peptide
  Seed: LDGGNKHFLR (PMEL_HUMAN)
LVGGNKHFLR

SEQ ID NO: 125299 - protein, 10 aa, Artificial Sequence
  Description of Artificial Sequence: Synthetic peptide
  Seed: YRYGSFSVTL (PMEL_HUMAN)
YYYGSFSVTL

SEQ ID NO: 125300 - protein, 9 aa, Artificial Sequence
  Description of Artificial Sequence: Synthetic peptide
  Seed: TAQVVLQAA (PMEL_HUMAN)
TPQVVLQAL

SEQ ID NO: 125301 - protein, 10 aa, Artificial Sequence
  Description of Artificial Sequence: Synthetic peptide
  Seed: GTYCLNVSLA (PMEL_HUMAN)
GMYCLNVSLV

SEQ ID NO: 125302 - protein, 9 aa, Artificial Sequence
  Description of Artificial Sequence: Synthetic peptide
  Seed: VSEVMGTTL (PMEL_HUMAN)
VFEVMGTTI

SEQ ID NO: 125303 - protein, 11 aa, Artificial Sequence
  Description of Artificial Sequence: Synthetic peptide
  Seed: SYVPLAHSSSA (PMEL_HUMAN)
SYVPLAHSSSM

SEQ ID NO: 125304 - protein, 9 aa, Artificial Sequence
  Description of Artificial Sequence: Synthetic peptide
  Seed: RLPRIFCSC (PMEL_HUMAN)
RLPRIFCSV

SEQ ID NO: 125305 - protein, 9 aa, Artificial Sequence
  Description of Artificial Sequence: Synthetic peptide
  Seed: ITDQVPFSV (PMEL_HUMAN)
IIDQVPFSW

SEQ ID NO: 125306 - protein, 9 aa, Artificial Sequence
  Description of Artificial Sequence: Synthetic peptide
  Seed: ISRALVVTH (PMEL_HUMAN)
IVRALVVTY

SEQ ID NO: 125307 - protein, 9 aa, Artificial Sequence
  Description of Artificial Sequence: Synthetic peptide
  Seed: VTAQVVLQA (PMEL_HUMAN)
VQAQVVLQV

SEQ ID NO: 125308 - protein, 9 aa, Artificial Sequence
  Description of Artificial Sequence: Synthetic peptide
  Seed: QLVLHQILK (PMEL_HUMAN)
QAVLHQILK

SEQ ID NO: 125309 - protein, 10 aa, Artificial Sequence
  Description of Artificial Sequence: Synthetic peptide
  Seed: AVPSGEGDAF (PMEL_HUMAN)
AMPSGEGDAF

SEQ ID NO: 125310 - protein, 9 aa, Artificial Sequence
  Description of Artificial Sequence: Synthetic peptide
  Seed: HTMEVTVYH (PMEL_HUMAN)
HNMEVTVYK

SEQ ID NO: 125311 - protein, 10 aa, Artificial Sequence
  Description of Artificial Sequence: Synthetic peptide
  Seed: LQLHDPSGYL (PMEL_HUMAN)
LQLHDPSGYF

SEQ ID NO: 125312 - protein, 10 aa, Artificial Sequence
  Description of Artificial Sequence: Synthetic peptide
  Seed: TDQVPFSVSV (PMEL_HUMAN)
TMQVPFSVSV

SEQ ID NO: 125313 - protein, 9 aa, Artificial Sequence
  Description of Artificial Sequence: Synthetic peptide
  Seed: MPTAESTGM (PMEL_HUMAN)
MMTAESTGF

SEQ ID NO: 125314 - protein, 10 aa, Artificial Sequence
  Description of Artificial Sequence: Synthetic peptide
  Seed: RGSRSYVPLA (PMEL_HUMAN)
RMSRSYVPLY

SEQ ID NO: 125315 - protein, 10 aa, Artificial Sequence
  Description of Artificial Sequence: Synthetic peptide
  Seed: ESTGMTPEKV (PMEL_HUMAN)
ETTGMTPEKV

SEQ ID NO: 125316 - protein, 9 aa, Artificial Sequence
  Description of Artificial Sequence: Synthetic peptide
  Seed: SQKRSFVYV (PMEL_HUMAN)
SLKRSFVYG

SEQ ID NO: 125317 - protein, 11 aa, Artificial Sequence
  Description of Artificial Sequence: Synthetic peptide
  Seed: VLASLIYRRRL (PMEL_HUMAN)
VLASLIYRRRV

SEQ ID NO: 125318 - protein, 10 aa, Artificial Sequence
  Description of Artificial Sequence: Synthetic peptide
  Seed: ALNFPGSQKV (PMEL_HUMAN)
ATNFPGSQKK

SEQ ID NO: 125319 - protein, 10 aa, Artificial Sequence
  Description of Artificial Sequence: Synthetic peptide
  Seed: EVMGTTLAEM (PMEL_HUMAN)
EAMGTTLAEY

SEQ ID NO: 125320 - protein, 9 aa, Artificial Sequence
  Description of Artificial Sequence: Synthetic peptide
  Seed: MAVVLASLI (PMEL_HUMAN)
MVVVLASLL

SEQ ID NO: 125321 - protein, 9 aa, Artificial Sequence
  Description of Artificial Sequence: Synthetic peptide
  Seed: RLVKRQVPL (PMEL_HUMAN)
RQVKRQVPW

SEQ ID NO: 125322 - protein, 11 aa, Artificial Sequence
  Description of Artificial Sequence: Synthetic peptide
  Seed: CVLYRYGSFSV (PMEL_HUMAN)
CILYRYGSFSV

SEQ ID NO: 125323 - protein, 10 aa, Artificial Sequence
  Description of Artificial Sequence: Synthetic peptide
  Seed: THTMEVTVYH (PMEL_HUMAN)
TSTMEVTVYK

SEQ ID NO: 125324 - protein, 8 aa, Artificial Sequence
  Description of Artificial Sequence: Synthetic peptide
  Seed: RSFVYVWK (PMEL_HUMAN)
RSFVYVWR

SEQ ID NO: 125325 - protein, 11 aa, Artificial Sequence
  Description of Artificial Sequence: Synthetic peptide
  Seed: QAVPSGEGDAF (PMEL_HUMAN)
QHVPSGEGDAF

SEQ ID NO: 125326 - protein, 10 aa, Artificial Sequence
  Description of Artificial Sequence: Synthetic peptide
  Seed: RGSRSYVPLA (PMEL_HUMAN)
RSSRSYVPLI

SEQ ID NO: 125327 - protein, 9 aa, Artificial Sequence
  Description of Artificial Sequence: Synthetic peptide
  Seed: ESAEILQAV (PMEL_HUMAN)
EVAEILQAL

SEQ ID NO: 125328 - protein, 9 aa, Artificial Sequence
  Description of Artificial Sequence: Synthetic peptide
  Seed: HTMEVTVYH (PMEL_HUMAN)
HMMEVTVYI

SEQ ID NO: 125329 - protein, 11 aa, Artificial Sequence
  Description of Artificial Sequence: Synthetic peptide
  Seed: QPVLPSPACQL (PMEL_HUMAN)
QPVLPSPACQY

SEQ ID NO: 125330 - protein, 10 aa, Artificial Sequence
  Description of Artificial Sequence: Synthetic peptide
  Seed: VLMAVVLASL (PMEL_HUMAN)
VIMAVVLASI

SEQ ID NO: 125331 - protein, 9 aa, Artificial Sequence
  Description of Artificial Sequence: Synthetic peptide
  Seed: VISTAPVQM (PMEL_HUMAN)
VASTAPVQL

SEQ ID NO: 125332 - protein, 9 aa, Artificial Sequence
  Description of Artificial Sequence: Synthetic peptide
  Seed: AEPSGTTSV (PMEL_HUMAN)
AQPSGTTSF

SEQ ID NO: 125333 - protein, 9 aa, Artificial Sequence
  Description of Artificial Sequence: Synthetic peptide
  Seed: ILKGGSGTY (PMEL_HUMAN)
IIKGGSGTM

SEQ ID NO: 125334 - protein, 8 aa, Artificial Sequence
  Description of Artificial Sequence: Synthetic peptide
  Seed: VLPDGQVI (PMEL_HUMAN)
VMPDGQVL

SEQ ID NO: 125335 - protein, 10 aa, Artificial Sequence
  Description of Artificial Sequence: Synthetic peptide
  Seed: NASFSIALNF (PMEL_HUMAN)
NDSFSIALNW

SEQ ID NO: 125336 - protein, 9 aa, Artificial Sequence
  Description of Artificial Sequence: Synthetic peptide
  Seed: RALVVTHTY (PMEL_HUMAN)
RALVVTHTK

SEQ ID NO: 125337 - protein, 9 aa, Artificial Sequence
  Description of Artificial Sequence: Synthetic peptide
  Seed: AVIGALLAV (PMEL_HUMAN)
APIGALLAL

SEQ ID NO: 125338 - protein, 10 aa, Artificial Sequence
  Description of Artificial Sequence: Synthetic peptide
  Seed: RALDGGNKHF (PMEL_HUMAN)
RQLDGGNKHV

SEQ ID NO: 125339 - protein, 9 aa, Artificial Sequence
  Description of Artificial Sequence: Synthetic peptide
  Seed: KQDFSVPQL (PMEL_HUMAN)
KMDFSVPQM

SEQ ID NO: 125340 - protein, 10 aa, Artificial Sequence
  Description of Artificial Sequence: Synthetic peptide
  Seed: SRALVVTHTY (PMEL_HUMAN)
SCALVVTHTW

SEQ ID NO: 125341 - protein, 10 aa, Artificial Sequence
  Description of Artificial Sequence: Synthetic peptide
  Seed: AVIGALLAVG (PMEL_HUMAN)
AMIGALLAVE

SEQ ID NO: 125342 - protein, 10 aa, Artificial Sequence
  Description of Artificial Sequence: Synthetic peptide
  Seed: LGQVPLIVGI (PMEL_HUMAN)
LHQVPLIVGV

SEQ ID NO: 125343 - protein, 10 aa, Artificial Sequence
  Description of Artificial Sequence: Synthetic peptide
  Seed: RQLYPEWTEA (PMEL_HUMAN)
RYLYPEWTEF

SEQ ID NO: 125344 - protein, 9 aa, Artificial Sequence
  Description of Artificial Sequence: Synthetic peptide
  Seed: LLHLAVIGA (PMEL_HUMAN)
LQHLAVIGV

SEQ ID NO: 125345 - protein, 9 aa, Artificial Sequence
  Description of Artificial Sequence: Synthetic peptide
  Seed: TVYHRRGSR (PMEL_HUMAN)
TLYHRRGSR

SEQ ID NO: 125346 - protein, 9 aa, Artificial Sequence
  Description of Artificial Sequence: Synthetic peptide
  Seed: VSEVMGTTL (PMEL_HUMAN)
VIEVMGTTL

SEQ ID NO: 125347 - protein, 9 aa, Artificial Sequence
  Description of Artificial Sequence: Synthetic peptide
  Seed: VTLDIVQGI (PMEL_HUMAN)
VRLDIVQGV

SEQ ID NO: 125348 - protein, 9 aa, Artificial Sequence
  Description of Artificial Sequence: Synthetic peptide
  Seed: ISRALVVTH (PMEL_HUMAN)
IQRALVVTK

SEQ ID NO: 125349 - protein, 11 aa, Artificial Sequence
  Description of Artificial Sequence: Synthetic peptide
  Seed: LYRYGSFSVTL (PMEL_HUMAN)
LRRYGSFSVTF

SEQ ID NO: 125350 - protein, 10 aa, Artificial Sequence
  Description of Artificial Sequence: Synthetic peptide
  Seed: AEILQAVPSG (PMEL_HUMAN)
AEILQAVPSM

SEQ ID NO: 125351 - protein, 11 aa, Artificial Sequence
  Description of Artificial Sequence: Synthetic peptide
  Seed: ISRALVVTHTY (PMEL_HUMAN)
IQRALVVTHTY

SEQ ID NO: 125352 - protein, 9 aa, Artificial Sequence
  Description of Artificial Sequence: Synthetic peptide
  Seed: LYRYGSFSV (PMEL_HUMAN)
LTRYGSFSI

SEQ ID NO: 125353 - protein, 9 aa, Artificial Sequence
  Description of Artificial Sequence: Synthetic peptide
  Seed: YLAEADLSY (PMEL_HUMAN)
YEAEADLSM

SEQ ID NO: 125354 - protein, 9 aa, Artificial Sequence
  Description of Artificial Sequence: Synthetic peptide
  Seed: SITGSLGPL (PMEL_HUMAN)
SSTGSLGPY

SEQ ID NO: 125355 - protein, 10 aa, Artificial Sequence
  Description of Artificial Sequence: Synthetic peptide
  Seed: RSFVYVWKTW (PMEL_HUMAN)
RMFVYVWKTY

SEQ ID NO: 125356 - protein, 10 aa, Artificial Sequence
  Description of Artificial Sequence: Synthetic peptide
  Seed: LMAVVLASLI (PMEL_HUMAN)
LMAVVLASLS

SEQ ID NO: 125357 - protein, 10 aa, Artificial Sequence
  Description of Artificial Sequence: Synthetic peptide
  Seed: QVPLDCVLYR (PMEL_HUMAN)
QLPLDCVLYR

SEQ ID NO: 125358 - protein, 9 aa, Artificial Sequence
  Description of Artificial Sequence: Synthetic peptide
  Seed: ISRALVVTH (PMEL_HUMAN)
ITRALVVTI

SEQ ID NO: 125359 - protein, 10 aa, Artificial Sequence
  Description of Artificial Sequence: Synthetic peptide
  Seed: TAAQVTTTEW (PMEL_HUMAN)
TVAQVTTTEY

SEQ ID NO: 125360 - protein, 9 aa, Artificial Sequence
  Description of Artificial Sequence: Synthetic peptide
  Seed: AVIGALLAV (PMEL_HUMAN)
AMIGALLAT

SEQ ID NO: 125361 - protein, 11 aa, Artificial Sequence
  Description of Artificial Sequence: Synthetic peptide
  Seed: FTITDQVPFSV (PMEL_HUMAN)
FMITDQVPFSA

SEQ ID NO: 125362 - protein, 10 aa, Artificial Sequence
  Description of Artificial Sequence: Synthetic peptide
  Seed: VVLASLIYRR (PMEL_HUMAN)
VLLASLIYRK

SEQ ID NO: 125363 - protein, 9 aa, Artificial Sequence
  Description of Artificial Sequence: Synthetic peptide
  Seed: HSSSHWLRL (PMEL_HUMAN)
HYSSHWLRY

SEQ ID NO: 125364 - protein, 9 aa, Artificial Sequence
  Description of Artificial Sequence: Synthetic peptide
  Seed: DQVPFSVSV (PMEL_HUMAN)
DSVPFSVSV

SEQ ID NO: 125365 - protein, 10 aa, Artificial Sequence
  Description of Artificial Sequence: Synthetic peptide
  Seed: ELTVSCQGGL (PMEL_HUMAN)
ESTVSCQGGV

SEQ ID NO: 125366 - protein, 11 aa, Artificial Sequence
  Description of Artificial Sequence: Synthetic peptide
  Seed: IMSTESITGSL (PMEL_HUMAN)
IMSTESITGSV

SEQ ID NO: 125367 - protein, 9 aa, Artificial Sequence
  Description of Artificial Sequence: Synthetic peptide
  Seed: LASLIYRRR (PMEL_HUMAN)
LVSLIYRRR

SEQ ID NO: 125368 - protein, 9 aa, Artificial Sequence
  Description of Artificial Sequence: Synthetic peptide
  Seed: ISRALVVTH (PMEL_HUMAN)
IMRALVVTY

SEQ ID NO: 125369 - protein, 9 aa, Artificial Sequence
  Description of Artificial Sequence: Synthetic peptide
  Seed: SGLSIGTGR (PMEL_HUMAN)
SMLSIGTGK

SEQ ID NO: 125370 - protein, 9 aa, Artificial Sequence
  Description of Artificial Sequence: Synthetic peptide
  Seed: AEAPNTTAG (PMEL_HUMAN)
ADAPNTTAM

SEQ ID NO: 125371 - protein, 11 aa, Artificial Sequence
  Description of Artificial Sequence: Synthetic peptide
  Seed: MPTAESTGMTP (PMEL_HUMAN)
MPTAESTGMTA

SEQ ID NO: 125372 - protein, 9 aa, Artificial Sequence
  Description of Artificial Sequence: Synthetic peptide
  Seed: STESITGSL (PMEL_HUMAN)
STESITGSY

SEQ ID NO: 125373 - protein, 10 aa, Artificial Sequence
  Description of Artificial Sequence: Synthetic peptide
  Seed: MPTAESTGMT (PMEL_HUMAN)
MHTAESTGMV

SEQ ID NO: 125374 - protein, 11 aa, Artificial Sequence
  Description of Artificial Sequence: Synthetic peptide
  Seed: TWDFGDSSGTL (PMEL_HUMAN)
TIDFGDSSGTL

SEQ ID NO: 125375 - protein, 9 aa, Artificial Sequence
  Description of Artificial Sequence: Synthetic peptide
  Seed: VLKRCLLHL (PMEL_HUMAN)
VAKRCLLHK

SEQ ID NO: 125376 - protein, 11 aa, Artificial Sequence
  Description of Artificial Sequence: Synthetic peptide
  Seed: FTITDQVPFSV (PMEL_HUMAN)
FQITDQVPFSI

SEQ ID NO: 125377 - protein, 10 aa, Artificial Sequence
  Description of Artificial Sequence: Synthetic peptide
  Seed: SAEILQAVPS (PMEL_HUMAN)
SLEILQAVPA

SEQ ID NO: 125378 - protein, 11 aa, Artificial Sequence
  Description of Artificial Sequence: Synthetic peptide
  Seed: SYVPLAHSSSA (PMEL_HUMAN)
SIVPLAHSSSM

SEQ ID NO: 125379 - protein, 9 aa, Artificial Sequence
  Description of Artificial Sequence: Synthetic peptide
  Seed: LADTNSLAV (PMEL_HUMAN)
LQDTNSLAI

SEQ ID NO: 125380 - protein, 10 aa, Artificial Sequence
  Description of Artificial Sequence: Synthetic peptide
  Seed: ESAEILQAVP (PMEL_HUMAN)
EAAEILQAVA

SEQ ID NO: 125381 - protein, 9 aa, Artificial Sequence
  Description of Artificial Sequence: Synthetic peptide
  Seed: GTATLRLVK (PMEL_HUMAN)
GVATLRLVR

SEQ ID NO: 125382 - protein, 10 aa, Artificial Sequence
  Description of Artificial Sequence: Synthetic peptide
  Seed: SQVWGGQPVY (PMEL_HUMAN)
SSVWGGQPVF

SEQ ID NO: 125383 - protein, 9 aa, Artificial Sequence
  Description of Artificial Sequence: Synthetic peptide
  Seed: AGQVPTTEV (PMEL_HUMAN)
AQQVPTTEV

SEQ ID NO: 125384 - protein, 9 aa, Artificial Sequence
  Description of Artificial Sequence: Synthetic peptide
  Seed: MEVTVYHRR (PMEL_HUMAN)
MCVTVYHRR

SEQ ID NO: 125385 - protein, 9 aa, Artificial Sequence
  Description of Artificial Sequence: Synthetic peptide
  Seed: MAVVLASLI (PMEL_HUMAN)
MHVVLASLY

SEQ ID NO: 125386 - protein, 9 aa, Artificial Sequence
  Description of Artificial Sequence: Synthetic peptide
  Seed: QVWGGQPVY (PMEL_HUMAN)
QAWGGQPVY

SEQ ID NO: 125387 - protein, 8 aa, Artificial Sequence
  Description of Artificial Sequence: Synthetic peptide
  Seed: LHDPSGYL (PMEL_HUMAN)
LSDPSGYI

SEQ ID NO: 125388 - protein, 8 aa, Artificial Sequence
  Description of Artificial Sequence: Synthetic peptide
  Seed: LNFPGSQK (PMEL_HUMAN)
LIFPGSQL

SEQ ID NO: 125389 - protein, 9 aa, Artificial Sequence
  Description of Artificial Sequence: Synthetic peptide
  Seed: AVVSTQLIM (PMEL_HUMAN)
AVVSTQLIF

SEQ ID NO: 125390 - protein, 9 aa, Artificial Sequence
  Description of Artificial Sequence: Synthetic peptide
  Seed: HTMEVTVYH (PMEL_HUMAN)
HVMEVTVYI

SEQ ID NO: 125391 - protein, 9 aa, Artificial Sequence
  Description of Artificial Sequence: Synthetic peptide
  Seed: YLEPGPVTA (PMEL_HUMAN)
YTEPGPVTC

SEQ ID NO: 125392 - protein, 9 aa, Artificial Sequence
  Description of Artificial Sequence: Synthetic peptide
  Seed: KVLPDGQVI (PMEL_HUMAN)
KLLPDGQVW

SEQ ID NO: 125393 - protein, 9 aa, Artificial Sequence
  Description of Artificial Sequence: Synthetic peptide
  Seed: AAQVTTTEW (PMEL_HUMAN)
ASQVTTTEF

SEQ ID NO: 125394 - protein, 10 aa, Artificial Sequence
  Description of Artificial Sequence: Synthetic peptide
  Seed: MKQDFSVPQL (PMEL_HUMAN)
MIQDFSVPQF

SEQ ID NO: 125395 - protein, 9 aa, Artificial Sequence
  Description of Artificial Sequence: Synthetic peptide
  Seed: RALVVTHTY (PMEL_HUMAN)
RSLVVTHTW

SEQ ID NO: 125396 - protein, 9 aa, Artificial Sequence
  Description of Artificial Sequence: Synthetic peptide
  Seed: AGQVPTTEV (PMEL_HUMAN)
AAQVPTTEL

SEQ ID NO: 125397 - protein, 10 aa, Artificial Sequence
  Description of Artificial Sequence: Synthetic peptide
  Seed: LLHLAVIGAL (PMEL_HUMAN)
LMHLAVIGAL

SEQ ID NO: 125398 - protein, 11 aa, Artificial Sequence
  Description of Artificial Sequence: Synthetic peptide
  Seed: LVLMAVVLASL (PMEL_HUMAN)
LKLMAVVLASL

SEQ ID NO: 125399 - protein, 10 aa, Artificial Sequence
  Description of Artificial Sequence: Synthetic peptide
  Seed: SVPQLPHSSS (PMEL_HUMAN)
SYPQLPHSSV

SEQ ID NO: 125400 - protein, 10 aa, Artificial Sequence
  Description of Artificial Sequence: Synthetic peptide
  Seed: ALNFPGSQKV (PMEL_HUMAN)
AINFPGSQKK

SEQ ID NO: 125401 - protein, 10 aa, Artificial Sequence
  Description of Artificial Sequence: Synthetic peptide
  Seed: VPQLPHSSSH (PMEL_HUMAN)
VKQLPHSSSF

SEQ ID NO: 125402 - protein, 10 aa, Artificial Sequence
  Description of Artificial Sequence: Synthetic peptide
  Seed: RTKAWNRQLY (PMEL_HUMAN)
RTKAWNRQLS

SEQ ID NO: 125403 - protein, 9 aa, Artificial Sequence
  Description of Artificial Sequence: Synthetic peptide
  Seed: ESAEILQAV (PMEL_HUMAN)
ESAEILQAR

SEQ ID NO: 125404 - protein, 9 aa, Artificial Sequence
  Description of Artificial Sequence: Synthetic peptide
  Seed: FGDSSGTLI (PMEL_HUMAN)
FEDSSGTLM

SEQ ID NO: 125405 - protein, 9 aa, Artificial Sequence
  Description of Artificial Sequence: Synthetic peptide
  Seed: HLAVIGALL (PMEL_HUMAN)
HIAVIGALY

SEQ ID NO: 125406 - protein, 9 aa, Artificial Sequence
  Description of Artificial Sequence: Synthetic peptide
  Seed: QAAIPLTSC (PMEL_HUMAN)
QPAIPLTSP

SEQ ID NO: 125407 - protein, 9 aa, Artificial Sequence
  Description of Artificial Sequence: Synthetic peptide
  Seed: QDFSVPQLP (PMEL_HUMAN)
QEFSVPQLV

SEQ ID NO: 125408 - protein, 10 aa, Artificial Sequence
  Description of Artificial Sequence: Synthetic peptide
  Seed: TGMTPAEVSI (PMEL_HUMAN)
TMMTPAEVSV

SEQ ID NO: 125409 - protein, 9 aa, Artificial Sequence
  Description of Artificial Sequence: Synthetic peptide
  Seed: MTPEKVPVS (PMEL_HUMAN)
MLPEKVPVV

SEQ ID NO: 125410 - protein, 11 aa, Artificial Sequence
  Description of Artificial Sequence: Synthetic peptide
  Seed: QEAGLGQVPLI (PMEL_HUMAN)
QEAGLGQVPLL

SEQ ID NO: 125411 - protein, 10 aa, Artificial Sequence
  Description of Artificial Sequence: Synthetic peptide
  Seed: RGSRSYVPLA (PMEL_HUMAN)
RFSRSYVPLR

SEQ ID NO: 125412 - protein, 9 aa, Artificial Sequence
  Description of Artificial Sequence: Synthetic peptide
  Seed: VLYRYGSFS (PMEL_HUMAN)
VMYRYGSFV

SEQ ID NO: 125413 - protein, 9 aa, Artificial Sequence
  Description of Artificial Sequence: Synthetic peptide
  Seed: AEADLSYTW (PMEL_HUMAN)
AAADLSYTV

SEQ ID NO: 125414 - protein, 10 aa, Artificial Sequence
  Description of Artificial Sequence: Synthetic peptide
  Seed: LAVIGALLAV (PMEL_HUMAN)
LLVIGALLAI

SEQ ID NO: 125415 - protein, 9 aa, Artificial Sequence
  Description of Artificial Sequence: Synthetic peptide
  Seed: RAMLGTHTM (PMEL_HUMAN)
RLMLGTHTW

SEQ ID NO: 125416 - protein, 9 aa, Artificial Sequence
  Description of Artificial Sequence: Synthetic peptide
  Seed: TVYHRRGSR (PMEL_HUMAN)
TYYHRRGSR

SEQ ID NO: 125417 - protein, 9 aa, Artificial Sequence
  Description of Artificial Sequence: Synthetic peptide
  Seed: RQVPLDCVL (PMEL_HUMAN)
RIVPLDCVM

SEQ ID NO: 125418 - protein, 9 aa, Artificial Sequence
  Description of Artificial Sequence: Synthetic peptide
  Seed: NFPGSQKVL (PMEL_HUMAN)
NYPGSQKVY

SEQ ID NO: 125419 - protein, 8 aa, Artificial Sequence
  Description of Artificial Sequence: Synthetic peptide
  Seed: TLDIVQGI (PMEL_HUMAN)
TVDIVQGL

SEQ ID NO: 125420 - protein, 9 aa, Artificial Sequence
  Description of Artificial Sequence: Synthetic peptide
  Seed: LYRYGSFSV (PMEL_HUMAN)
LGRYGSFSK

SEQ ID NO: 125421 - protein, 9 aa, Artificial Sequence
  Description of Artificial Sequence: Synthetic peptide
  Seed: RAMLGTHTM (PMEL_HUMAN)
RCMLGTHTW

SEQ ID NO: 125422 - protein, 9 aa, Artificial Sequence
  Description of Artificial Sequence: Synthetic peptide
  Seed: SQVWGGQPV (PMEL_HUMAN)
SSVWGGQPF

SEQ ID NO: 125423 - protein, 9 aa, Artificial Sequence
  Description of Artificial Sequence: Synthetic peptide
  Seed: SQKRSFVYV (PMEL_HUMAN)
STKRSFVYM

SEQ ID NO: 125424 - protein, 9 aa, Artificial Sequence
  Description of Artificial Sequence: Synthetic peptide
  Seed: LADTNSLAV (PMEL_HUMAN)
LEDTNSLAL

SEQ ID NO: 125425 - protein, 10 aa, Artificial Sequence
  Description of Artificial Sequence: Synthetic peptide
  Seed: WKTWGQYWQV (PMEL_HUMAN)
WLTWGQYWQL

SEQ ID NO: 125426 - protein, 9 aa, Artificial Sequence
  Description of Artificial Sequence: Synthetic peptide
  Seed: RNQPLTFAL (PMEL_HUMAN)
RAQPLTFAM

SEQ ID NO: 125427 - protein, 9 aa, Artificial Sequence
  Description of Artificial Sequence: Synthetic peptide
  Seed: QPVLPSPAC (PMEL_HUMAN)
QAVLPSPAA

SEQ ID NO: 125428 - protein, 9 aa, Artificial Sequence
  Description of Artificial Sequence: Synthetic peptide
  Seed: TTPGQAPTA (PMEL_HUMAN)
TIPGQAPTV

SEQ ID NO: 125429 - protein, 9 aa, Artificial Sequence
  Description of Artificial Sequence: Synthetic peptide
  Seed: GSWSQKRSF (PMEL_HUMAN)
GSWSQKRSW

SEQ ID NO: 125430 - protein, 9 aa, Artificial Sequence
  Description of Artificial Sequence: Synthetic peptide
  Seed: LSGTTAAQV (PMEL_HUMAN)
LMGTTAAQV

SEQ ID NO: 125431 - protein, 9 aa, Artificial Sequence
  Description of Artificial Sequence: Synthetic peptide
  Seed: DQVPFSVSV (PMEL_HUMAN)
DSVPFSVSF

SEQ ID NO: 125432 - protein, 9 aa, Artificial Sequence
  Description of Artificial Sequence: Synthetic peptide
  Seed: QAAIPLTSC (PMEL_HUMAN)
QAAIPLTSI

SEQ ID NO: 125433 - protein, 9 aa, Artificial Sequence
  Description of Artificial Sequence: Synthetic peptide
  Seed: RQVPLDCVL (PMEL_HUMAN)
RMVPLDCVW

SEQ ID NO: 125434 - protein, 9 aa, Artificial Sequence
  Description of Artificial Sequence: Synthetic peptide
  Seed: RNQPLTFAL (PMEL_HUMAN)
RRQPLTFAY

SEQ ID NO: 125435 - protein, 9 aa, Artificial Sequence
  Description of Artificial Sequence: Synthetic peptide
  Seed: RLVKRQVPL (PMEL_HUMAN)
RLVKRQVPK

SEQ ID NO: 125436 - protein, 11 aa, Artificial Sequence
  Description of Artificial Sequence: Synthetic peptide
  Seed: RTKAWNRQLYP (PMEL_HUMAN)
RQKAWNRQLYK

SEQ ID NO: 125437 - protein, 9 aa, Artificial Sequence
  Description of Artificial Sequence: Synthetic peptide
  Seed: DGGNKHFLR (PMEL_HUMAN)
DYGNKHFLK

SEQ ID NO: 125438 - protein, 10 aa, Artificial Sequence
  Description of Artificial Sequence: Synthetic peptide
  Seed: YGSFSVTLDI (PMEL_HUMAN)
YASFSVTLDM

SEQ ID NO: 125439 - protein, 10 aa, Artificial Sequence
  Description of Artificial Sequence: Synthetic peptide
  Seed: VSLADTNSLA (PMEL_HUMAN)
VMLADTNSLL

SEQ ID NO: 125440 - protein, 9 aa, Artificial Sequence
  Description of Artificial Sequence: Synthetic peptide
  Seed: QVIWVNNTI (PMEL_HUMAN)
QMIWVNNTM

SEQ ID NO: 125441 - protein, 10 aa, Artificial Sequence
  Description of Artificial Sequence: Synthetic peptide
  Seed: RNQDWLGVSR (PMEL_HUMAN)
RLQDWLGVSR

SEQ ID NO: 125442 - protein, 9 aa, Artificial Sequence
  Description of Artificial Sequence: Synthetic peptide
  Seed: SQKRSFVYV (PMEL_HUMAN)
SMKRSFVYY

SEQ ID NO: 125443 - protein, 10 aa, Artificial Sequence
  Description of Artificial Sequence: Synthetic peptide
  Seed: VPQLPHSSSH (PMEL_HUMAN)
VTQLPHSSSM

SEQ ID NO: 125444 - protein, 10 aa, Artificial Sequence
  Description of Artificial Sequence: Synthetic peptide
  Seed: KVSNDGPTLI (PMEL_HUMAN)
KISNDGPTLL

SEQ ID NO: 125445 - protein, 10 aa, Artificial Sequence
  Description of Artificial Sequence: Synthetic peptide
  Seed: RALDGGNKHF (PMEL_HUMAN)
RLLDGGNKHM

SEQ ID NO: 125446 - protein, 8 aa, Artificial Sequence
  Description of Artificial Sequence: Synthetic peptide
  Seed: LHDPSGYL (PMEL_HUMAN)
LFDPSGYF

SEQ ID NO: 125447 - protein, 9 aa, Artificial Sequence
  Description of Artificial Sequence: Synthetic peptide
  Seed: VTLDIVQGI (PMEL_HUMAN)
VSLDIVQGV

SEQ ID NO: 125448 - protein, 10 aa, Artificial Sequence
  Description of Artificial Sequence: Synthetic peptide
  Seed: LAVIGALLAV (PMEL_HUMAN)
LVVIGALLAV

SEQ ID NO: 125449 - protein, 10 aa, Artificial Sequence
  Description of Artificial Sequence: Synthetic peptide
  Seed: FSVSVSQLRA (PMEL_HUMAN)
FTVSVSQLRQ

SEQ ID NO: 125450 - protein, 9 aa, Artificial Sequence
  Description of Artificial Sequence: Synthetic peptide
  Seed: KTWGQYWQV (PMEL_HUMAN)
KQWGQYWQY

SEQ ID NO: 125451 - protein, 9 aa, Artificial Sequence
  Description of Artificial Sequence: Synthetic peptide
  Seed: GQVPLIVGI (PMEL_HUMAN)
GLVPLIVGA

SEQ ID NO: 125452 - protein, 9 aa, Artificial Sequence
  Description of Artificial Sequence: Synthetic peptide
  Seed: SGTLISRAL (PMEL_HUMAN)
SATLISRAI

SEQ ID NO: 125453 - protein, 9 aa, Artificial Sequence
  Description of Artificial Sequence: Synthetic peptide
  Seed: YPQETDDAC (PMEL_HUMAN)
YLQETDDAF

SEQ ID NO: 125454 - protein, 10 aa, Artificial Sequence
  Description of Artificial Sequence: Synthetic peptide
  Seed: RGSRSYVPLA (PMEL_HUMAN)
RNSRSYVPLT

SEQ ID NO: 125455 - protein, 9 aa, Artificial Sequence
  Description of Artificial Sequence: Synthetic peptide
  Seed: TDQVPFSVS (PMEL_HUMAN)
TEQVPFSVM

SEQ ID NO: 125456 - protein, 9 aa, Artificial Sequence
  Description of Artificial Sequence: Synthetic peptide
  Seed: ISRALVVTH (PMEL_HUMAN)
ILRALVVTK

SEQ ID NO: 125457 - protein, 10 aa, Artificial Sequence
  Description of Artificial Sequence: Synthetic peptide
  Seed: GPLLDGTATL (PMEL_HUMAN)
GRLLDGTATA

SEQ ID NO: 125458 - protein, 9 aa, Artificial Sequence
  Description of Artificial Sequence: Synthetic peptide
  Seed: SQVWGGQPV (PMEL_HUMAN)
SEVWGGQPM

SEQ ID NO: 125459 - protein, 9 aa, Artificial Sequence
  Description of Artificial Sequence: Synthetic peptide
  Seed: ANASFSIAL (PMEL_HUMAN)
AKASFSIAV

SEQ ID NO: 125460 - protein, 9 aa, Artificial Sequence
  Description of Artificial Sequence: Synthetic peptide
  Seed: LVLKRCLLH (PMEL_HUMAN)
LLLKRCLLR

SEQ ID NO: 125461 - protein, 9 aa, Artificial Sequence
  Description of Artificial Sequence: Synthetic peptide
  Seed: VLPDGQVIW (PMEL_HUMAN)
VIPDGQVII

SEQ ID NO: 125462 - protein, 11 aa, Artificial Sequence
  Description of Artificial Sequence: Synthetic peptide
  Seed: VSLADTNSLAV (PMEL_HUMAN)
VMLADTNSLAL

SEQ ID NO: 125463 - protein, 10 aa, Artificial Sequence
  Description of Artificial Sequence: Synthetic peptide
  Seed: SLADTNSLAV (PMEL_HUMAN)
SVADTNSLAI

SEQ ID NO: 125464 - protein, 9 aa, Artificial Sequence
  Description of Artificial Sequence: Synthetic peptide
  Seed: NFPGSQKVL (PMEL_HUMAN)
NFPGSQKVM

SEQ ID NO: 125465 - protein, 10 aa, Artificial Sequence
  Description of Artificial Sequence: Synthetic peptide
  Seed: LPHSSSHWLR (PMEL_HUMAN)
LYHSSSHWLK

SEQ ID NO: 125466 - protein, 9 aa, Artificial Sequence
  Description of Artificial Sequence: Synthetic peptide
  Seed: AEPSGTTSV (PMEL_HUMAN)
AAPSGTTSV

SEQ ID NO: 125467 - protein, 9 aa, Artificial Sequence
  Description of Artificial Sequence: Synthetic peptide
  Seed: GQVPLIVGI (PMEL_HUMAN)
GTVPLIVGI

SEQ ID NO: 125468 - protein, 8 aa, Artificial Sequence
  Description of Artificial Sequence: Synthetic peptide
  Seed: FGDSSGTL (PMEL_HUMAN)
FVDSSGTI

SEQ ID NO: 125469 - protein, 10 aa, Artificial Sequence
  Description of Artificial Sequence: Synthetic peptide
  Seed: SQVWGGQPVY (PMEL_HUMAN)
SMVWGGQPVF

SEQ ID NO: 125470 - protein, 11 aa, Artificial Sequence
  Description of Artificial Sequence: Synthetic peptide
  Seed: QAVPSGEGDAF (PMEL_HUMAN)
QHVPSGEGDAM

SEQ ID NO: 125471 - protein, 11 aa, Artificial Sequence
  Description of Artificial Sequence: Synthetic peptide
  Seed: RYGSFSVTLDI (PMEL_HUMAN)
RKGSFSVTLDW

SEQ ID NO: 125472 - protein, 9 aa, Artificial Sequence
  Description of Artificial Sequence: Synthetic peptide
  Seed: LADTNSLAV (PMEL_HUMAN)
LGDTNSLAI

SEQ ID NO: 125473 - protein, 10 aa, Artificial Sequence
  Description of Artificial Sequence: Synthetic peptide
  Seed: VPFSVSVSQL (PMEL_HUMAN)
VPFSVSVSQV

SEQ ID NO: 125474 - protein, 9 aa, Artificial Sequence
  Description of Artificial Sequence: Synthetic peptide
  Seed: DGGNKHFLR (PMEL_HUMAN)
DWGNKHFLR

SEQ ID NO: 125475 - protein, 10 aa, Artificial Sequence
  Description of Artificial Sequence: Synthetic peptide
  Seed: GTYCLNVSLA (PMEL_HUMAN)
GIYCLNVSLV

SEQ ID NO: 125476 - protein, 10 aa, Artificial Sequence
  Description of Artificial Sequence: Synthetic peptide
  Seed: LLHLAVIGAL (PMEL_HUMAN)
LLHLAVIGAV

SEQ ID NO: 125477 - protein, 9 aa, Artificial Sequence
  Description of Artificial Sequence: Synthetic peptide
  Seed: ESAEILQAV (PMEL_HUMAN)
EMAEILQAK

SEQ ID NO: 125478 - protein, 9 aa, Artificial Sequence
  Description of Artificial Sequence: Synthetic peptide
  Seed: SGTLISRAL (PMEL_HUMAN)
SATLISRAF

SEQ ID NO: 125479 - protein, 10 aa, Artificial Sequence
  Description of Artificial Sequence: Synthetic peptide
  Seed: GPLLDGTATL (PMEL_HUMAN)
GMLLDGTATM

SEQ ID NO: 125480 - protein, 9 aa, Artificial Sequence
  Description of Artificial Sequence: Synthetic peptide
  Seed: HLAVIGALL (PMEL_HUMAN)
HLAVIGALV

SEQ ID NO: 125481 - protein, 9 aa, Artificial Sequence
  Description of Artificial Sequence: Synthetic peptide
  Seed: LYRYGSFSV (PMEL_HUMAN)
LFRYGSFSY

SEQ ID NO: 125482 - protein, 9 aa, Artificial Sequence
  Description of Artificial Sequence: Synthetic peptide
  Seed: GANASFSIA (PMEL_HUMAN)
GANASFSIK

SEQ ID NO: 125483 - protein, 11 aa, Artificial Sequence
  Description of Artificial Sequence: Synthetic peptide
  Seed: LVLMAVVLASL (PMEL_HUMAN)
LLLMAVVLASV

SEQ ID NO: 125484 - protein, 9 aa, Artificial Sequence
  Description of Artificial Sequence: Synthetic peptide
  Seed: RNQPLTFAL (PMEL_HUMAN)
RHQPLTFAY

SEQ ID NO: 125485 - protein, 9 aa, Artificial Sequence
  Description of Artificial Sequence: Synthetic peptide
  Seed: AVVLASLIY (PMEL_HUMAN)
AMVLASLIL

SEQ ID NO: 125486 - protein, 11 aa, Artificial Sequence
  Description of Artificial Sequence: Synthetic peptide
  Seed: VPVSEVMGTTL (PMEL_HUMAN)
VPVSEVMGTTY

SEQ ID NO: 125487 - protein, 10 aa, Artificial Sequence
  Description of Artificial Sequence: Synthetic peptide
  Seed: SVPQLPHSSS (PMEL_HUMAN)
SIPQLPHSSL

SEQ ID NO: 125488 - protein, 10 aa, Artificial Sequence
  Description of Artificial Sequence: Synthetic peptide
  Seed: YLAEADLSYT (PMEL_HUMAN)
YVAEADLSYL

SEQ ID NO: 125489 - protein, 9 aa, Artificial Sequence
  Description of Artificial Sequence: Synthetic peptide
  Seed: AVVLASLIY (PMEL_HUMAN)
AYVLASLIY

SEQ ID NO: 125490 - protein, 10 aa, Artificial Sequence
  Description of Artificial Sequence: Synthetic peptide
  Seed: EVSIVVLSGT (PMEL_HUMAN)
EASIVVLSGV

SEQ ID NO: 125491 - protein, 10 aa, Artificial Sequence
  Description of Artificial Sequence: Synthetic peptide
  Seed: GALLAVGATK (PMEL_HUMAN)
GTLLAVGATK

SEQ ID NO: 125492 - protein, 10 aa, Artificial Sequence
  Description of Artificial Sequence: Synthetic peptide
  Seed: MPTAESTGMT (PMEL_HUMAN)
MDTAESTGML

SEQ ID NO: 125493 - protein, 9 aa, Artificial Sequence
  Description of Artificial Sequence: Synthetic peptide
  Seed: VSLADTNSL (PMEL_HUMAN)
VSLADTNSI

SEQ ID NO: 125494 - protein, 9 aa, Artificial Sequence
  Description of Artificial Sequence: Synthetic peptide
  Seed: RGGQVSLKV (PMEL_HUMAN)
RQGQVSLKM

SEQ ID NO: 125495 - protein, 9 aa, Artificial Sequence
  Description of Artificial Sequence: Synthetic peptide
  Seed: TDQVPFSVS (PMEL_HUMAN)
TEQVPFSVA

SEQ ID NO: 125496 - protein, 9 aa, Artificial Sequence
  Description of Artificial Sequence: Synthetic peptide
  Seed: LSIGTGRAM (PMEL_HUMAN)
LQIGTGRAL

SEQ ID NO: 125497 - protein, 9 aa, Artificial Sequence
  Description of Artificial Sequence: Synthetic peptide
  Seed: FTITDQVPF (PMEL_HUMAN)
FAITDQVPM

SEQ ID NO: 125498 - protein, 9 aa, Artificial Sequence
  Description of Artificial Sequence: Synthetic peptide
  Seed: DSSGTLISR (PMEL_HUMAN)
DASGTLISR

SEQ ID NO: 125499 - protein, 9 aa, Artificial Sequence
  Description of Artificial Sequence: Synthetic peptide
  Seed: TTDGHRPTA (PMEL_HUMAN)
TGDGHRPTM

SEQ ID NO: 125500 - protein, 10 aa, Artificial Sequence
  Description of Artificial Sequence: Synthetic peptide
  Seed: SSSHWLRLPR (PMEL_HUMAN)
SESHWLRLPR

SEQ ID NO: 125501 - protein, 9 aa, Artificial Sequence
  Description of Artificial Sequence: Synthetic peptide
  Seed: FSVSVSQLR (PMEL_HUMAN)
FAVSVSQLV

SEQ ID NO: 125502 - protein, 10 aa, Artificial Sequence
  Description of Artificial Sequence: Synthetic peptide
  Seed: VPQLPHSSSH (PMEL_HUMAN)
VSQLPHSSSY

SEQ ID NO: 125503 - protein, 9 aa, Artificial Sequence
  Description of Artificial Sequence: Synthetic peptide
  Seed: RALVVTHTY (PMEL_HUMAN)
RGLVVTHTY

SEQ ID NO: 125504 - protein, 10 aa, Artificial Sequence
  Description of Artificial Sequence: Synthetic peptide
  Seed: SGTYCLNVSL (PMEL_HUMAN)
SCTYCLNVSY

SEQ ID NO: 125505 - protein, 10 aa, Artificial Sequence
  Description of Artificial Sequence: Synthetic peptide
  Seed: SSHWLRLPRI (PMEL_HUMAN)
STHWLRLPRR

SEQ ID NO: 125506 - protein, 9 aa, Artificial Sequence
  Description of Artificial Sequence: Synthetic peptide
  Seed: MLGTHTMEV (PMEL_HUMAN)
MVGTHTMEI

SEQ ID NO: 125507 - protein, 10 aa, Artificial Sequence
  Description of Artificial Sequence: Synthetic peptide
  Seed: VYVWKTWGQY (PMEL_HUMAN)
VFVWKTWGQY

SEQ ID NO: 125508 - protein, 9 aa, Artificial Sequence
  Description of Artificial Sequence: Synthetic peptide
  Seed: RAMLGTHTM (PMEL_HUMAN)
RIMLGTHTW

SEQ ID NO: 125509 - protein, 10 aa, Artificial Sequence
  Description of Artificial Sequence: Synthetic peptide
  Seed: SLIYRRRLMK (PMEL_HUMAN)
SGIYRRRLMK

SEQ ID NO: 125510 - protein, 10 aa, Artificial Sequence
  Description of Artificial Sequence: Synthetic peptide
  Seed: SVPQLPHSSS (PMEL_HUMAN)
SYPQLPHSSL

SEQ ID NO: 125511 - protein, 9 aa, Artificial Sequence
  Description of Artificial Sequence: Synthetic peptide
  Seed: GTYCLNVSL (PMEL_HUMAN)
GLYCLNVSR

SEQ ID NO: 125512 - protein, 9 aa, Artificial Sequence
  Description of Artificial Sequence: Synthetic peptide
  Seed: TEWVETTAR (PMEL_HUMAN)
TTWVETTAK

SEQ ID NO: 125513 - protein, 9 aa, Artificial Sequence
  Description of Artificial Sequence: Synthetic peptide
  Seed: TLIGANASF (PMEL_HUMAN)
TKIGANASM

SEQ ID NO: 125514 - protein, 9 aa, Artificial Sequence
  Description of Artificial Sequence: Synthetic peptide
  Seed: FGDSSGTLI (PMEL_HUMAN)
FDDSSGTLF

SEQ ID NO: 125515 - protein, 9 aa, Artificial Sequence
  Description of Artificial Sequence: Synthetic peptide
  Seed: MTPEKVPVS (PMEL_HUMAN)
MTPEKVPVI

SEQ ID NO: 125516 - protein, 9 aa, Artificial Sequence
  Description of Artificial Sequence: Synthetic peptide
  Seed: LAVVSTQLI (PMEL_HUMAN)
LAVVSTQLW

SEQ ID NO: 125517 - protein, 10 aa, Artificial Sequence
  Description of Artificial Sequence: Synthetic peptide
  Seed: LAVVSTQLIM (PMEL_HUMAN)
LAVVSTQLIY

SEQ ID NO: 125518 - protein, 11 aa, Artificial Sequence
  Description of Artificial Sequence: Synthetic peptide
  Seed: SQKRSFVYVWK (PMEL_HUMAN)
SYKRSFVYVWR

SEQ ID NO: 125519 - protein, 9 aa, Artificial Sequence
  Description of Artificial Sequence: Synthetic peptide
  Seed: RTKAWNRQL (PMEL_HUMAN)
RWKAWNRQA

SEQ ID NO: 125520 - protein, 10 aa, Artificial Sequence
  Description of Artificial Sequence: Synthetic peptide
  Seed: KTWGQYWQVL (PMEL_HUMAN)
KMWGQYWQVA

SEQ ID NO: 125521 - protein, 11 aa, Artificial Sequence
  Description of Artificial Sequence: Synthetic peptide
  Seed: FSVTLDIVQGI (PMEL_HUMAN)
FLVTLDIVQGI

SEQ ID NO: 125522 - protein, 9 aa, Artificial Sequence
  Description of Artificial Sequence: Synthetic peptide
  Seed: FLRNQPLTF (PMEL_HUMAN)
FPRNQPLTF

SEQ ID NO: 125523 - protein, 9 aa, Artificial Sequence
  Description of Artificial Sequence: Synthetic peptide
  Seed: HSSSHWLRL (PMEL_HUMAN)
HLSSHWLRY

SEQ ID NO: 125524 - protein, 9 aa, Artificial Sequence
  Description of Artificial Sequence: Synthetic peptide
  Seed: RAMLGTHTM (PMEL_HUMAN)
RCMLGTHTF

SEQ ID NO: 125525 - protein, 9 aa, Artificial Sequence
  Description of Artificial Sequence: Synthetic peptide
  Seed: RLVKRQVPL (PMEL_HUMAN)
RNVKRQVPY

SEQ ID NO: 125526 - protein, 9 aa, Artificial Sequence
  Description of Artificial Sequence: Synthetic peptide
  Seed: VPLDCVLYR (PMEL_HUMAN)
VNLDCVLYR

SEQ ID NO: 125527 - protein, 9 aa, Artificial Sequence
  Description of Artificial Sequence: Synthetic peptide
  Seed: LLVLMAVVL (PMEL_HUMAN)
LQVLMAVVF

SEQ ID NO: 125528 - protein, 10 aa, Artificial Sequence
  Description of Artificial Sequence: Synthetic peptide
  Seed: AMLGTHTMEV (PMEL_HUMAN)
AHLGTHTMEV

SEQ ID NO: 125529 - protein, 9 aa, Artificial Sequence
  Description of Artificial Sequence: Synthetic peptide
  Seed: ALVVTHTYL (PMEL_HUMAN)
AMVVTHTYY

SEQ ID NO: 125530 - protein, 9 aa, Artificial Sequence
  Description of Artificial Sequence: Synthetic peptide
  Seed: SLAVVSTQL (PMEL_HUMAN)
SVAVVSTQL

SEQ ID NO: 125531 - protein, 10 aa, Artificial Sequence
  Description of Artificial Sequence: Synthetic peptide
  Seed: SQKRSFVYVW (PMEL_HUMAN)
SEKRSFVYVF

SEQ ID NO: 125532 - protein, 9 aa, Artificial Sequence
  Description of Artificial Sequence: Synthetic peptide
  Seed: KQDFSVPQL (PMEL_HUMAN)
KYDFSVPQY

SEQ ID NO: 125533 - protein, 10 aa, Artificial Sequence
  Description of Artificial Sequence: Synthetic peptide
  Seed: SGTYCLNVSL (PMEL_HUMAN)
SETYCLNVSW

SEQ ID NO: 125534 - protein, 9 aa, Artificial Sequence
  Description of Artificial Sequence: Synthetic peptide
  Seed: GGPVSGLSI (PMEL_HUMAN)
GSPVSGLSL

SEQ ID NO: 125535 - protein, 10 aa, Artificial Sequence
  Description of Artificial Sequence: Synthetic peptide
  Seed: GSFSVTLDIV (PMEL_HUMAN)
GLFSVTLDIA

SEQ ID NO: 125536 - protein, 9 aa, Artificial Sequence
  Description of Artificial Sequence: Synthetic peptide
  Seed: KTWGQYWQV (PMEL_HUMAN)
KAWGQYWQA

SEQ ID NO: 125537 - protein, 9 aa, Artificial Sequence
  Description of Artificial Sequence: Synthetic peptide
  Seed: HSSSHWLRL (PMEL_HUMAN)
HASSHWLRW

SEQ ID NO: 125538 - protein, 10 aa, Artificial Sequence
  Description of Artificial Sequence: Synthetic peptide
  Seed: SQKRSFVYVW (PMEL_HUMAN)
SQKRSFVYVM

SEQ ID NO: 125539 - protein, 10 aa, Artificial Sequence
  Description of Artificial Sequence: Synthetic peptide
  Seed: ESITGSLGPL (PMEL_HUMAN)
EAITGSLGPW

SEQ ID NO: 125540 - protein, 10 aa, Artificial Sequence
  Description of Artificial Sequence: Synthetic peptide
  Seed: LKVSNDGPTL (PMEL_HUMAN)
LQVSNDGPTF

SEQ ID NO: 125541 - protein, 10 aa, Artificial Sequence
  Description of Artificial Sequence: Synthetic peptide
  Seed: DWLGVSRQLR (PMEL_HUMAN)
DILGVSRQLR

SEQ ID NO: 125542 - protein, 9 aa, Artificial Sequence
  Description of Artificial Sequence: Synthetic peptide
  Seed: DQVPFSVSV (PMEL_HUMAN)
DIVPFSVSI

SEQ ID NO: 125543 - protein, 9 aa, Artificial Sequence
  Description of Artificial Sequence: Synthetic peptide
  Seed: MTPEKVPVS (PMEL_HUMAN)
MGPEKVPVV

SEQ ID NO: 125544 - protein, 10 aa, Artificial Sequence
  Description of Artificial Sequence: Synthetic peptide
  Seed: VLMAVVLASL (PMEL_HUMAN)
VFMAVVLASL

SEQ ID NO: 125545 - protein, 10 aa, Artificial Sequence
  Description of Artificial Sequence: Synthetic peptide
  Seed: ALDGGNKHFL (PMEL_HUMAN)
AFDGGNKHFM

SEQ ID NO: 125546 - protein, 9 aa, Artificial Sequence
  Description of Artificial Sequence: Synthetic peptide
  Seed: DGGNKHFLR (PMEL_HUMAN)
DLGNKHFLR

SEQ ID NO: 125547 - protein, 10 aa, Artificial Sequence
  Description of Artificial Sequence: Synthetic peptide
  Seed: FSVSVSQLRA (PMEL_HUMAN)
FIVSVSQLRR

SEQ ID NO: 125548 - protein, 9 aa, Artificial Sequence
  Description of Artificial Sequence: Synthetic peptide
  Seed: FGDSSGTLI (PMEL_HUMAN)
FSDSSGTLL

SEQ ID NO: 125549 - protein, 8 aa, Artificial Sequence
  Description of Artificial Sequence: Synthetic peptide
  Seed: VSNDGPTL (PMEL_HUMAN)
VVNDGPTL

SEQ ID NO: 125550 - protein, 9 aa, Artificial Sequence
  Description of Artificial Sequence: Synthetic peptide
  Seed: SFVYVWKTW (PMEL_HUMAN)
SFVYVWKTF

SEQ ID NO: 125551 - protein, 11 aa, Artificial Sequence
  Description of Artificial Sequence: Synthetic peptide
  Seed: FSVTLDIVQGI (PMEL_HUMAN)
FSVTLDIVQGV

SEQ ID NO: 125552 - protein, 10 aa, Artificial Sequence
  Description of Artificial Sequence: Synthetic peptide
  Seed: SLIYRRRLMK (PMEL_HUMAN)
SQIYRRRLMK

SEQ ID NO: 125553 - protein, 9 aa, Artificial Sequence
  Description of Artificial Sequence: Synthetic peptide
  Seed: QPVLPSPAC (PMEL_HUMAN)
QPVLPSPAY

SEQ ID NO: 125554 - protein, 9 aa, Artificial Sequence
  Description of Artificial Sequence: Synthetic peptide
  Seed: TEWVETTAR (PMEL_HUMAN)
TEWVETTAY

SEQ ID NO: 125555 - protein, 9 aa, Artificial Sequence
  Description of Artificial Sequence: Synthetic peptide
  Seed: HWLRLPRIF (PMEL_HUMAN)
HYLRLPRIY

SEQ ID NO: 125556 - protein, 10 aa, Artificial Sequence
  Description of Artificial Sequence: Synthetic peptide
  Seed: LAHSSSAFTI (PMEL_HUMAN)
LSHSSSAFTW

SEQ ID NO: 125557 - protein, 9 aa, Artificial Sequence
  Description of Artificial Sequence: Synthetic peptide
  Seed: LPDGQVIWV (PMEL_HUMAN)
LWDGQVIWI

SEQ ID NO: 125558 - protein, 11 aa, Artificial Sequence
  Description of Artificial Sequence: Synthetic peptide
  Seed: VQMPTAESTGM (PMEL_HUMAN)
VQMPTAESTGW

SEQ ID NO: 125559 - protein, 10 aa, Artificial Sequence
  Description of Artificial Sequence: Synthetic peptide
  Seed: VPLAHSSSAF (PMEL_HUMAN)
VRLAHSSSAY

SEQ ID NO: 125560 - protein, 10 aa, Artificial Sequence
  Description of Artificial Sequence: Synthetic peptide
  Seed: KTWGQYWQVL (PMEL_HUMAN)
KLWGQYWQVF

SEQ ID NO: 125561 - protein, 9 aa, Artificial Sequence
  Description of Artificial Sequence: Synthetic peptide
  Seed: RLPRIFCSC (PMEL_HUMAN)
RMPRIFCSV

SEQ ID NO: 125562 - protein, 9 aa, Artificial Sequence
  Description of Artificial Sequence: Synthetic peptide
  Seed: LPDGQVIWV (PMEL_HUMAN)
LADGQVIWI

SEQ ID NO: 125563 - protein, 9 aa, Artificial Sequence
  Description of Artificial Sequence: Synthetic peptide
  Seed: RALVVTHTY (PMEL_HUMAN)
RGLVVTHTK

SEQ ID NO: 125564 - protein, 9 aa, Artificial Sequence
  Description of Artificial Sequence: Synthetic peptide
  Seed: GSRSYVPLA (PMEL_HUMAN)
GSRSYVPLG

SEQ ID NO: 125565 - protein, 10 aa, Artificial Sequence
  Description of Artificial Sequence: Synthetic peptide
  Seed: RQLYPEWTEA (PMEL_HUMAN)
RILYPEWTEI

SEQ ID NO: 125566 - protein, 10 aa, Artificial Sequence
  Description of Artificial Sequence: Synthetic peptide
  Seed: TAAQVTTTEW (PMEL_HUMAN)
TQAQVTTTEF

SEQ ID NO: 125567 - protein, 10 aa, Artificial Sequence
  Description of Artificial Sequence: Synthetic peptide
  Seed: TPAEVSIVVL (PMEL_HUMAN)
TPAEVSIVVM

SEQ ID NO: 125568 - protein, 9 aa, Artificial Sequence
  Description of Artificial Sequence: Synthetic peptide
  Seed: RLVKRQVPL (PMEL_HUMAN)
RYVKRQVPY

SEQ ID NO: 125569 - protein, 8 aa, Artificial Sequence
  Description of Artificial Sequence: Synthetic peptide
  Seed: FSVSVSQL (PMEL_HUMAN)
FQVSVSQL

SEQ ID NO: 125570 - protein, 9 aa, Artificial Sequence
  Description of Artificial Sequence: Synthetic peptide
  Seed: SYVPLAHSS (PMEL_HUMAN)
SFVPLAHSY

SEQ ID NO: 125571 - protein, 9 aa, Artificial Sequence
  Description of Artificial Sequence: Synthetic peptide
  Seed: TTPGQAPTA (PMEL_HUMAN)
TSPGQAPTM

SEQ ID NO: 125572 - protein, 10 aa, Artificial Sequence
  Description of Artificial Sequence: Synthetic peptide
  Seed: KTWGQYWQVL (PMEL_HUMAN)
KIWGQYWQVD

SEQ ID NO: 125573 - protein, 10 aa, Artificial Sequence
  Description of Artificial Sequence: Synthetic peptide
  Seed: VYHRRGSRSY (PMEL_HUMAN)
VMHRRGSRSY

SEQ ID NO: 125574 - protein, 9 aa, Artificial Sequence
  Description of Artificial Sequence: Synthetic peptide
  Seed: LPDGQVIWV (PMEL_HUMAN)
LMDGQVIWL

SEQ ID NO: 125575 - protein, 9 aa, Artificial Sequence
  Description of Artificial Sequence: Synthetic peptide
  Seed: TAEAPNTTA (PMEL_HUMAN)
TFEAPNTTL

SEQ ID NO: 125576 - protein, 9 aa, Artificial Sequence
  Description of Artificial Sequence: Synthetic peptide
  Seed: TTDGHRPTA (PMEL_HUMAN)
TTDGHRPTL

SEQ ID NO: 125577 - protein, 11 aa, Artificial Sequence
  Description of Artificial Sequence: Synthetic peptide
  Seed: YLAEADLSYTW (PMEL_HUMAN)
YMAEADLSYTW

SEQ ID NO: 125578 - protein, 11 aa, Artificial Sequence
  Description of Artificial Sequence: Synthetic peptide
  Seed: QAVPSGEGDAF (PMEL_HUMAN)
QMVPSGEGDAY

SEQ ID NO: 125579 - protein, 9 aa, Artificial Sequence
  Description of Artificial Sequence: Synthetic peptide
  Seed: MSTPEATGM (PMEL_HUMAN)
MSTPEATGW

SEQ ID NO: 125580 - protein, 11 aa, Artificial Sequence
  Description of Artificial Sequence: Synthetic peptide
  Seed: RRGSRSYVPLA (PMEL_HUMAN)
RWGSRSYVPLK

SEQ ID NO: 125581 - protein, 9 aa, Artificial Sequence
  Description of Artificial Sequence: Synthetic peptide
  Seed: AQVVLQAAI (PMEL_HUMAN)
AKVVLQAAM

SEQ ID NO: 125582 - protein, 10 aa, Artificial Sequence
  Description of Artificial Sequence: Synthetic peptide
  Seed: RGSRSYVPLA (PMEL_HUMAN)
RASRSYVPLK

SEQ ID NO: 125583 - protein, 8 aa, Artificial Sequence
  Description of Artificial Sequence: Synthetic peptide
  Seed: LLDGTATL (PMEL_HUMAN)
LYDGTATL

SEQ ID NO: 125584 - protein, 11 aa, Artificial Sequence
  Description of Artificial Sequence: Synthetic peptide
  Seed: FGDSSGTLISR (PMEL_HUMAN)
FNDSSGTLISI

SEQ ID NO: 125585 - protein, 9 aa, Artificial Sequence
  Description of Artificial Sequence: Synthetic peptide
  Seed: YLAEADLSY (PMEL_HUMAN)
YFAEADLSL

SEQ ID NO: 125586 - protein, 10 aa, Artificial Sequence
  Description of Artificial Sequence: Synthetic peptide
  Seed: MTPAEVSIVV (PMEL_HUMAN)
MHPAEVSIVV

SEQ ID NO: 125587 - protein, 10 aa, Artificial Sequence
  Description of Artificial Sequence: Synthetic peptide
  Seed: VLMAVVLASL (PMEL_HUMAN)
VPMAVVLASY

SEQ ID NO: 125588 - protein, 9 aa, Artificial Sequence
  Description of Artificial Sequence: Synthetic peptide
  Seed: VVLQAAIPL (PMEL_HUMAN)
VILQAAIPF

SEQ ID NO: 125589 - protein, 9 aa, Artificial Sequence
  Description of Artificial Sequence: Synthetic peptide
  Seed: KQDFSVPQL (PMEL_HUMAN)
KRDFSVPQL

SEQ ID NO: 125590 - protein, 9 aa, Artificial Sequence
  Description of Artificial Sequence: Synthetic peptide
  Seed: VLPSPACQL (PMEL_HUMAN)
VGPSPACQL

SEQ ID NO: 125591 - protein, 10 aa, Artificial Sequence
  Description of Artificial Sequence: Synthetic peptide
  Seed: IESAEILQAV (PMEL_HUMAN)
IMSAEILQAT

SEQ ID NO: 125592 - protein, 10 aa, Artificial Sequence
  Description of Artificial Sequence: Synthetic peptide
  Seed: LQLHDPSGYL (PMEL_HUMAN)
LPLHDPSGYV

SEQ ID NO: 125593 - protein, 9 aa, Artificial Sequence
  Description of Artificial Sequence: Synthetic peptide
  Seed: ILLVLMAVV (PMEL_HUMAN)
IMLVLMAVL

SEQ ID NO: 125594 - protein, 10 aa, Artificial Sequence
  Description of Artificial Sequence: Synthetic peptide
  Seed: EVVGTTPGQA (PMEL_HUMAN)
EIVGTTPGQK

SEQ ID NO: 125595 - protein, 9 aa, Artificial Sequence
  Description of Artificial Sequence: Synthetic peptide
  Seed: IYRRRLMKQ (PMEL_HUMAN)
ITRRRLMKS

SEQ ID NO: 125596 - protein, 9 aa, Artificial Sequence
  Description of Artificial Sequence: Synthetic peptide
  Seed: RAMLGTHTM (PMEL_HUMAN)
RLMLGTHTR

SEQ ID NO: 125597 - protein, 10 aa, Artificial Sequence
  Description of Artificial Sequence: Synthetic peptide
  Seed: RNQDWLGVSR (PMEL_HUMAN)
RYQDWLGVSR

SEQ ID NO: 125598 - protein, 9 aa, Artificial Sequence
  Description of Artificial Sequence: Synthetic peptide
  Seed: FLRNQPLTF (PMEL_HUMAN)
FTRNQPLTV

SEQ ID NO: 125599 - protein, 9 aa, Artificial Sequence
  Description of Artificial Sequence: Synthetic peptide
  Seed: GTYCLNVSL (PMEL_HUMAN)
GMYCLNVSV

SEQ ID NO: 125600 - protein, 9 aa, Artificial Sequence
  Description of Artificial Sequence: Synthetic peptide
  Seed: SQVWGGQPV (PMEL_HUMAN)
SPVWGGQPY

SEQ ID NO: 125601 - protein, 9 aa, Artificial Sequence
  Description of Artificial Sequence: Synthetic peptide
  Seed: ASFSIALNF (PMEL_HUMAN)
APFSIALNW

SEQ ID NO: 125602 - protein, 8 aa, Artificial Sequence
  Description of Artificial Sequence: Synthetic peptide
  Seed: SNDGPTLI (PMEL_HUMAN)
STDGPTLL

SEQ ID NO: 125603 - protein, 9 aa, Artificial Sequence
  Description of Artificial Sequence: Synthetic peptide
  Seed: TEWVETTAR (PMEL_HUMAN)
TEWVETTAW

SEQ ID NO: 125604 - protein, 9 aa, Artificial Sequence
  Description of Artificial Sequence: Synthetic peptide
  Seed: ASFSIALNF (PMEL_HUMAN)
AVFSIALNK

SEQ ID NO: 125605 - protein, 8 aa, Artificial Sequence
  Description of Artificial Sequence: Synthetic peptide
  Seed: VLYRYGSF (PMEL_HUMAN)
VQYRYGSF

SEQ ID NO: 125606 - protein, 9 aa, Artificial Sequence
  Description of Artificial Sequence: Synthetic peptide
  Seed: VQMPTAEST (PMEL_HUMAN)
VNMPTAESY

SEQ ID NO: 125607 - protein, 9 aa, Artificial Sequence
  Description of Artificial Sequence: Synthetic peptide
  Seed: LPHSSSHWL (PMEL_HUMAN)
LPHSSSHWW

SEQ ID NO: 125608 - protein, 9 aa, Artificial Sequence
  Description of Artificial Sequence: Synthetic peptide
  Seed: FGDSSGTLI (PMEL_HUMAN)
FYDSSGTLL

SEQ ID NO: 125609 - protein, 9 aa, Artificial Sequence
  Description of Artificial Sequence: Synthetic peptide
  Seed: DSSGTLISR (PMEL_HUMAN)
DTSGTLISM

SEQ ID NO: 125610 - protein, 9 aa, Artificial Sequence
  Description of Artificial Sequence: Synthetic peptide
  Seed: FTITDQVPF (PMEL_HUMAN)
FLITDQVPY

SEQ ID NO: 125611 - protein, 9 aa, Artificial Sequence
  Description of Artificial Sequence: Synthetic peptide
  Seed: FLRNQPLTF (PMEL_HUMAN)
FIRNQPLTI

SEQ ID NO: 125612 - protein, 9 aa, Artificial Sequence
  Description of Artificial Sequence: Synthetic peptide
  Seed: AGQVPTTEV (PMEL_HUMAN)
AIQVPTTEY

SEQ ID NO: 125613 - protein, 9 aa, Artificial Sequence
  Description of Artificial Sequence: Synthetic peptide
  Seed: ASFSIALNF (PMEL_HUMAN)
ACFSIALNW

SEQ ID NO: 125614 - protein, 11 aa, Artificial Sequence
  Description of Artificial Sequence: Synthetic peptide
  Seed: SPVPGTTDGHR (PMEL_HUMAN)
SIVPGTTDGHR

SEQ ID NO: 125615 - protein, 9 aa, Artificial Sequence
  Description of Artificial Sequence: Synthetic peptide
  Seed: VSNDGPTLI (PMEL_HUMAN)
VSNDGPTLM

SEQ ID NO: 125616 - protein, 9 aa, Artificial Sequence
  Description of Artificial Sequence: Synthetic peptide
  Seed: LPDGQVIWV (PMEL_HUMAN)
LGDGQVIWL

SEQ ID NO: 125617 - protein, 9 aa, Artificial Sequence
  Description of Artificial Sequence: Synthetic peptide
  Seed: VTLDIVQGI (PMEL_HUMAN)
VSLDIVQGI

SEQ ID NO: 125618 - protein, 9 aa, Artificial Sequence
  Description of Artificial Sequence: Synthetic peptide
  Seed: AVVSTQLIM (PMEL_HUMAN)
ALVSTQLIF

SEQ ID NO: 125619 - protein, 11 aa, Artificial Sequence
  Description of Artificial Sequence: Synthetic peptide
  Seed: RRGSRSYVPLA (PMEL_HUMAN)
RRGSRSYVPLV

SEQ ID NO: 125620 - protein, 10 aa, Artificial Sequence
  Description of Artificial Sequence: Synthetic peptide
  Seed: SQKRSFVYVW (PMEL_HUMAN)
SWKRSFVYVY

SEQ ID NO: 125621 - protein, 9 aa, Artificial Sequence
  Description of Artificial Sequence: Synthetic peptide
  Seed: IMPGQEAGL (PMEL_HUMAN)
IGPGQEAGL

SEQ ID NO: 125622 - protein, 9 aa, Artificial Sequence
  Description of Artificial Sequence: Synthetic peptide
  Seed: EVMGTTLAE (PMEL_HUMAN)
EVMGTTLAH

SEQ ID NO: 125623 - protein, 8 aa, Artificial Sequence
  Description of Artificial Sequence: Synthetic peptide
  Seed: LVKRQVPL (PMEL_HUMAN)
LIKRQVPL

SEQ ID NO: 125624 - protein, 9 aa, Artificial Sequence
  Description of Artificial Sequence: Synthetic peptide
  Seed: RLMKQDFSV (PMEL_HUMAN)
RLMKQDFST

SEQ ID NO: 125625 - protein, 9 aa, Artificial Sequence
  Description of Artificial Sequence: Synthetic peptide
  Seed: HTYLEPGPV (PMEL_HUMAN)
HLYLEPGPA

SEQ ID NO: 125626 - protein, 9 aa, Artificial Sequence
  Description of Artificial Sequence: Synthetic peptide
  Seed: SSIMSTESI (PMEL_HUMAN)
SRIMSTESY

SEQ ID NO: 125627 - protein, 9 aa, Artificial Sequence
  Description of Artificial Sequence: Synthetic peptide
  Seed: AEADLSYTW (PMEL_HUMAN)
ADADLSYTA

SEQ ID NO: 125628 - protein, 9 aa, Artificial Sequence
  Description of Artificial Sequence: Synthetic peptide
  Seed: LYPEWTEAQ (PMEL_HUMAN)
LFPEWTEAM

SEQ ID NO: 125629 - protein, 10 aa, Artificial Sequence
  Description of Artificial Sequence: Synthetic peptide
  Seed: ALDGGNKHFL (PMEL_HUMAN)
ATDGGNKHFI

SEQ ID NO: 125630 - protein, 10 aa, Artificial Sequence
  Description of Artificial Sequence: Synthetic peptide
  Seed: LAVIGALLAV (PMEL_HUMAN)
LLVIGALLAL

SEQ ID NO: 125631 - protein, 11 aa, Artificial Sequence
  Description of Artificial Sequence: Synthetic peptide
  Seed: RALDGGNKHFL (PMEL_HUMAN)
RTLDGGNKHFK

SEQ ID NO: 125632 - protein, 10 aa, Artificial Sequence
  Description of Artificial Sequence: Synthetic peptide
  Seed: KTWGQYWQVL (PMEL_HUMAN)
KLWGQYWQVR

SEQ ID NO: 125633 - protein, 9 aa, Artificial Sequence
  Description of Artificial Sequence: Synthetic peptide
  Seed: LTSCGSSPV (PMEL_HUMAN)
LSSCGSSPY

SEQ ID NO: 125634 - protein, 10 aa, Artificial Sequence
  Description of Artificial Sequence: Synthetic peptide
  Seed: SRALVVTHTY (PMEL_HUMAN)
SAALVVTHTW

SEQ ID NO: 125635 - protein, 9 aa, Artificial Sequence
  Description of Artificial Sequence: Synthetic peptide
  Seed: SQKRSFVYV (PMEL_HUMAN)
SCKRSFVYK

SEQ ID NO: 125636 - protein, 9 aa, Artificial Sequence
  Description of Artificial Sequence: Synthetic peptide
  Seed: AEADLSYTW (PMEL_HUMAN)
ATADLSYTL

SEQ ID NO: 125637 - protein, 10 aa, Artificial Sequence
  Description of Artificial Sequence: Synthetic peptide
  Seed: DSSGTLISRA (PMEL_HUMAN)
DVSGTLISRV

SEQ ID NO: 125638 - protein, 10 aa, Artificial Sequence
  Description of Artificial Sequence: Synthetic peptide
  Seed: MAVVLASLIY (PMEL_HUMAN)
MHVVLASLIF

SEQ ID NO: 125639 - protein, 10 aa, Artificial Sequence
  Description of Artificial Sequence: Synthetic peptide
  Seed: GLSIGTGRAM (PMEL_HUMAN)
GQSIGTGRAM

SEQ ID NO: 125640 - protein, 9 aa, Artificial Sequence
  Description of Artificial Sequence: Synthetic peptide
  Seed: SGLSIGTGR (PMEL_HUMAN)
SALSIGTGR

SEQ ID NO: 125641 - protein, 10 aa, Artificial Sequence
  Description of Artificial Sequence: Synthetic peptide
  Seed: GEGDAFELTV (PMEL_HUMAN)
GEGDAFELTY

SEQ ID NO: 125642 - protein, 9 aa, Artificial Sequence
  Description of Artificial Sequence: Synthetic peptide
  Seed: VPTTEVIST (PMEL_HUMAN)
VPTTEVISA

SEQ ID NO: 125643 - protein, 10 aa, Artificial Sequence
  Description of Artificial Sequence: Synthetic peptide
  Seed: DGTATLRLVK (PMEL_HUMAN)
DTTATLRLVK

SEQ ID NO: 125644 - protein, 9 aa, Artificial Sequence
  Description of Artificial Sequence: Synthetic peptide
  Seed: QVIWVNNTI (PMEL_HUMAN)
QAIWVNNTL

SEQ ID NO: 125645 - protein, 10 aa, Artificial Sequence
  Description of Artificial Sequence: Synthetic peptide
  Seed: EVVGTTPGQA (PMEL_HUMAN)
EIVGTTPGQV

SEQ ID NO: 125646 - protein, 10 aa, Artificial Sequence
  Description of Artificial Sequence: Synthetic peptide
  Seed: SVPQLPHSSS (PMEL_HUMAN)
SHPQLPHSSM

SEQ ID NO: 125647 - protein, 11 aa, Artificial Sequence
  Description of Artificial Sequence: Synthetic peptide
  Seed: RYGSFSVTLDI (PMEL_HUMAN)
RCGSFSVTLDF

SEQ ID NO: 125648 - protein, 9 aa, Artificial Sequence
  Description of Artificial Sequence: Synthetic peptide
  Seed: AVVLASLIY (PMEL_HUMAN)
AHVLASLIM

SEQ ID NO: 125649 - protein, 9 aa, Artificial Sequence
  Description of Artificial Sequence: Synthetic peptide
  Seed: RAMLGTHTM (PMEL_HUMAN)
RVMLGTHTA

SEQ ID NO: 125650 - protein, 10 aa, Artificial Sequence
  Description of Artificial Sequence: Synthetic peptide
  Seed: LQLHDPSGYL (PMEL_HUMAN)
LMLHDPSGYY

SEQ ID NO: 125651 - protein, 9 aa, Artificial Sequence
  Description of Artificial Sequence: Synthetic peptide
  Seed: SQVWGGQPV (PMEL_HUMAN)
SMVWGGQPW

SEQ ID NO: 125652 - protein, 8 aa, Artificial Sequence
  Description of Artificial Sequence: Synthetic peptide
  Seed: RELPIPEP (PMEL_HUMAN)
RELPIPEA

SEQ ID NO: 125653 - protein, 8 aa, Artificial Sequence
  Description of Artificial Sequence: Synthetic peptide
  Seed: LIYRRRLM (PMEL_HUMAN)
LLYRRRLL

SEQ ID NO: 125654 - protein, 10 aa, Artificial Sequence
  Description of Artificial Sequence: Synthetic peptide
  Seed: SQVWGGQPVY (PMEL_HUMAN)
SPVWGGQPVF

SEQ ID NO: 125655 - protein, 9 aa, Artificial Sequence
  Description of Artificial Sequence: Synthetic peptide
  Seed: EKVPVSEVM (PMEL_HUMAN)
EAVPVSEVY

SEQ ID NO: 125656 - protein, 10 aa, Artificial Sequence
  Description of Artificial Sequence: Synthetic peptide
  Seed: KVSNDGPTLI (PMEL_HUMAN)
KLSNDGPTLM

SEQ ID NO: 125657 - protein, 9 aa, Artificial Sequence
  Description of Artificial Sequence: Synthetic peptide
  Seed: LADTNSLAV (PMEL_HUMAN)
LCDTNSLAM

SEQ ID NO: 125658 - protein, 9 aa, Artificial Sequence
  Description of Artificial Sequence: Synthetic peptide
  Seed: SRSYVPLAH (PMEL_HUMAN)
SRSYVPLAM

SEQ ID NO: 125659 - protein, 10 aa, Artificial Sequence
  Description of Artificial Sequence: Synthetic peptide
  Seed: RGSRSYVPLA (PMEL_HUMAN)
RESRSYVPLA

SEQ ID NO: 125660 - protein, 10 aa, Artificial Sequence
  Description of Artificial Sequence: Synthetic peptide
  Seed: RSFVYVWKTW (PMEL_HUMAN)
RTFVYVWKTF

SEQ ID NO: 125661 - protein, 9 aa, Artificial Sequence
  Description of Artificial Sequence: Synthetic peptide
  Seed: WQVLGGPVS (PMEL_HUMAN)
WEVLGGPVY

SEQ ID NO: 125662 - protein, 11 aa, Artificial Sequence
  Description of Artificial Sequence: Synthetic peptide
  Seed: KAWNRQLYPEW (PMEL_HUMAN)
KTWNRQLYPEW

SEQ ID NO: 125663 - protein, 10 aa, Artificial Sequence
  Description of Artificial Sequence: Synthetic peptide
  Seed: AESTGMTPEK (PMEL_HUMAN)
AMSTGMTPEK

SEQ ID NO: 125664 - protein, 8 aa, Artificial Sequence
  Description of Artificial Sequence: Synthetic peptide
  Seed: FGDSSGTL (PMEL_HUMAN)
FSDSSGTV

SEQ ID NO: 125665 - protein, 11 aa, Artificial Sequence
  Description of Artificial Sequence: Synthetic peptide
  Seed: QPVLPSPACQL (PMEL_HUMAN)
QPVLPSPACQA

SEQ ID NO: 125666 - protein, 9 aa, Artificial Sequence
  Description of Artificial Sequence: Synthetic peptide
  Seed: RIFCSCPIG (PMEL_HUMAN)
RTFCSCPIA

SEQ ID NO: 125667 - protein, 10 aa, Artificial Sequence
  Description of Artificial Sequence: Synthetic peptide
  Seed: EVISTAPVQM (PMEL_HUMAN)
EVISTAPVQR

SEQ ID NO: 125668 - protein, 11 aa, Artificial Sequence
  Description of Artificial Sequence: Synthetic peptide
  Seed: FGDSSGTLISR (PMEL_HUMAN)
FTDSSGTLISM

SEQ ID NO: 125669 - protein, 10 aa, Artificial Sequence
  Description of Artificial Sequence: Synthetic peptide
  Seed: TDQVPFSVSV (PMEL_HUMAN)
TEQVPFSVSV

SEQ ID NO: 125670 - protein, 10 aa, Artificial Sequence
  Description of Artificial Sequence: Synthetic peptide
  Seed: SSHWLRLPRI (PMEL_HUMAN)
STHWLRLPRK

SEQ ID NO: 125671 - protein, 10 aa, Artificial Sequence
  Description of Artificial Sequence: Synthetic peptide
  Seed: WKTWGQYWQV (PMEL_HUMAN)
WNTWGQYWQV

SEQ ID NO: 125672 - protein, 9 aa, Artificial Sequence
  Description of Artificial Sequence: Synthetic peptide
  Seed: EVMGTTLAE (PMEL_HUMAN)
EAMGTTLAR

SEQ ID NO: 125673 - protein, 9 aa, Artificial Sequence
  Description of Artificial Sequence: Synthetic peptide
  Seed: VIWVNNTII (PMEL_HUMAN)
VMWVNNTII

SEQ ID NO: 125674 - protein, 9 aa, Artificial Sequence
  Description of Artificial Sequence: Synthetic peptide
  Seed: LNFPGSQKV (PMEL_HUMAN)
LSFPGSQKV

SEQ ID NO: 125675 - protein, 9 aa, Artificial Sequence
  Description of Artificial Sequence: Synthetic peptide
  Seed: SAFTITDQV (PMEL_HUMAN)
SSFTITDQF

SEQ ID NO: 125676 - protein, 9 aa, Artificial Sequence
  Description of Artificial Sequence: Synthetic peptide
  Seed: LIVGILLVL (PMEL_HUMAN)
LIVGILLVA

SEQ ID NO: 125677 - protein, 9 aa, Artificial Sequence
  Description of Artificial Sequence: Synthetic peptide
  Seed: KQDFSVPQL (PMEL_HUMAN)
KTDFSVPQV

SEQ ID NO: 125678 - protein, 10 aa, Artificial Sequence
  Description of Artificial Sequence: Synthetic peptide
  Seed: VPLIVGILLV (PMEL_HUMAN)
VFLIVGILLV

SEQ ID NO: 125679 - protein, 9 aa, Artificial Sequence
  Description of Artificial Sequence: Synthetic peptide
  Seed: KQDFSVPQL (PMEL_HUMAN)
KMDFSVPQV

SEQ ID NO: 125680 - protein, 9 aa, Artificial Sequence
  Description of Artificial Sequence: Synthetic peptide
  Seed: SVPQLPHSS (PMEL_HUMAN)
SFPQLPHSL

SEQ ID NO: 125681 - protein, 9 aa, Artificial Sequence
  Description of Artificial Sequence: Synthetic peptide
  Seed: LAVVSTQLI (PMEL_HUMAN)
LSVVSTQLY

SEQ ID NO: 125682 - protein, 8 aa, Artificial Sequence
  Description of Artificial Sequence: Synthetic peptide
  Seed: VQVPTTEV (PMEL_HUMAN)
VQVPTTEI

SEQ ID NO: 125683 - protein, 10 aa, Artificial Sequence
  Description of Artificial Sequence: Synthetic peptide
  Seed: KTWGQYWQVL (PMEL_HUMAN)
KMWGQYWQVF

SEQ ID NO: 125684 - protein, 10 aa, Artificial Sequence
  Description of Artificial Sequence: Synthetic peptide
  Seed: GDSSGTLISR (PMEL_HUMAN)
GISSGTLISR

SEQ ID NO: 125685 - protein, 9 aa, Artificial Sequence
  Description of Artificial Sequence: Synthetic peptide
  Seed: LMAVVLASL (PMEL_HUMAN)
LQAVVLASY

SEQ ID NO: 125686 - protein, 11 aa, Artificial Sequence
  Description of Artificial Sequence: Synthetic peptide
  Seed: RLPRIFCSCPI (PMEL_HUMAN)
RPPRIFCSCPL

SEQ ID NO: 125687 - protein, 9 aa, Artificial Sequence
  Description of Artificial Sequence: Synthetic peptide
  Seed: RNQPLTFAL (PMEL_HUMAN)
RTQPLTFAW

SEQ ID NO: 125688 - protein, 9 aa, Artificial Sequence
  Description of Artificial Sequence: Synthetic peptide
  Seed: SGTLISRAL (PMEL_HUMAN)
SATLISRAY

SEQ ID NO: 125689 - protein, 9 aa, Artificial Sequence
  Description of Artificial Sequence: Synthetic peptide
  Seed: RIFCSCPIG (PMEL_HUMAN)
RVFCSCPIA

SEQ ID NO: 125690 - protein, 9 aa, Artificial Sequence
  Description of Artificial Sequence: Synthetic peptide
  Seed: VVLASLIYR (PMEL_HUMAN)
VFLASLIYK

SEQ ID NO: 125691 - protein, 9 aa, Artificial Sequence
  Description of Artificial Sequence: Synthetic peptide
  Seed: FGDSSGTLI (PMEL_HUMAN)
FCDSSGTLL

SEQ ID NO: 125692 - protein, 10 aa, Artificial Sequence
  Description of Artificial Sequence: Synthetic peptide
  Seed: SLIYRRRLMK (PMEL_HUMAN)
SDIYRRRLMK

SEQ ID NO: 125693 - protein, 10 aa, Artificial Sequence
  Description of Artificial Sequence: Synthetic peptide
  Seed: RYGSFSVTLD (PMEL_HUMAN)
RWGSFSVTLM

SEQ ID NO: 125694 - protein, 9 aa, Artificial Sequence
  Description of Artificial Sequence: Synthetic peptide
  Seed: EVMGTTLAE (PMEL_HUMAN)
EIMGTTLAK

SEQ ID NO: 125695 - protein, 10 aa, Artificial Sequence
  Description of Artificial Sequence: Synthetic peptide
  Seed: LMAVVLASLI (PMEL_HUMAN)
LMAVVLASLD

SEQ ID NO: 125696 - protein, 9 aa, Artificial Sequence
  Description of Artificial Sequence: Synthetic peptide
  Seed: RYGSFSVTL (PMEL_HUMAN)
RTGSFSVTF

SEQ ID NO: 125697 - protein, 10 aa, Artificial Sequence
  Description of Artificial Sequence: Synthetic peptide
  Seed: VLMAVVLASL (PMEL_HUMAN)
VTMAVVLASV

SEQ ID NO: 125698 - protein, 8 aa, Artificial Sequence
  Description of Artificial Sequence: Synthetic peptide
  Seed: TLDIVQGI (PMEL_HUMAN)
TWDIVQGM

SEQ ID NO: 125699 - protein, 9 aa, Artificial Sequence
  Description of Artificial Sequence: Synthetic peptide
  Seed: ALDGGNKHF (PMEL_HUMAN)
AYDGGNKHF

SEQ ID NO: 125700 - protein, 10 aa, Artificial Sequence
  Description of Artificial Sequence: Synthetic peptide
  Seed: GQVPLIVGIL (PMEL_HUMAN)
GEVPLIVGIM

SEQ ID NO: 125701 - protein, 8 aa, Artificial Sequence
  Description of Artificial Sequence: Synthetic peptide
  Seed: FGDSSGTL (PMEL_HUMAN)
FCDSSGTL

SEQ ID NO: 125702 - protein, 10 aa, Artificial Sequence
  Description of Artificial Sequence: Synthetic peptide
  Seed: RRLMKQDFSV (PMEL_HUMAN)
RWLMKQDFSL

SEQ ID NO: 125703 - protein, 10 aa, Artificial Sequence
  Description of Artificial Sequence: Synthetic peptide
  Seed: AVIGALLAVG (PMEL_HUMAN)
AMIGALLAVK

SEQ ID NO: 125704 - protein, 9 aa, Artificial Sequence
  Description of Artificial Sequence: Synthetic peptide
  Seed: CVLYRYGSF (PMEL_HUMAN)
CSLYRYGSW

SEQ ID NO: 125705 - protein, 11 aa, Artificial Sequence
  Description of Artificial Sequence: Synthetic peptide
  Seed: KVLPDGQVIWV (PMEL_HUMAN)
KMLPDGQVIWL

SEQ ID NO: 125706 - protein, 10 aa, Artificial Sequence
  Description of Artificial Sequence: Synthetic peptide
  Seed: MDLVLKRCLL (PMEL_HUMAN)
MELVLKRCLL

SEQ ID NO: 125707 - protein, 10 aa, Artificial Sequence
  Description of Artificial Sequence: Synthetic peptide
  Seed: VPLAHSSSAF (PMEL_HUMAN)
VSLAHSSSAF

SEQ ID NO: 125708 - protein, 9 aa, Artificial Sequence
  Description of Artificial Sequence: Synthetic peptide
  Seed: PLLDGTATL (PMEL_HUMAN)
PILDGTATY

SEQ ID NO: 125709 - protein, 10 aa, Artificial Sequence
  Description of Artificial Sequence: Synthetic peptide
  Seed: RGSRSYVPLA (PMEL_HUMAN)
RASRSYVPLY

SEQ ID NO: 125710 - protein, 10 aa, Artificial Sequence
  Description of Artificial Sequence: Synthetic peptide
  Seed: LAVIGALLAV (PMEL_HUMAN)
LCVIGALLAA

SEQ ID NO: 125711 - protein, 10 aa, Artificial Sequence
  Description of Artificial Sequence: Synthetic peptide
  Seed: RQLYPEWTEA (PMEL_HUMAN)
RVLYPEWTEI

SEQ ID NO: 125712 - protein, 10 aa, Artificial Sequence
  Description of Artificial Sequence: Synthetic peptide
  Seed: SSHWLRLPRI (PMEL_HUMAN)
SSHWLRLPRF

SEQ ID NO: 125713 - protein, 9 aa, Artificial Sequence
  Description of Artificial Sequence: Synthetic peptide
  Seed: FSVSVSQLR (PMEL_HUMAN)
FTVSVSQLL

SEQ ID NO: 125714 - protein, 11 aa, Artificial Sequence
  Description of Artificial Sequence: Synthetic peptide
  Seed: SLADTNSLAVV (PMEL_HUMAN)
SMADTNSLAVM

SEQ ID NO: 125715 - protein, 10 aa, Artificial Sequence
  Description of Artificial Sequence: Synthetic peptide
  Seed: GPLLDGTATL (PMEL_HUMAN)
GPLLDGTATA

SEQ ID NO: 125716 - protein, 9 aa, Artificial Sequence
  Description of Artificial Sequence: Synthetic peptide
  Seed: VSVSQLRAL (PMEL_HUMAN)
VAVSQLRAV

SEQ ID NO: 125717 - protein, 10 aa, Artificial Sequence
  Description of Artificial Sequence: Synthetic peptide
  Seed: SLAVVSTQLI (PMEL_HUMAN)
SMAVVSTQLM

SEQ ID NO: 125718 - protein, 10 aa, Artificial Sequence
  Description of Artificial Sequence: Synthetic peptide
  Seed: LAEADLSYTW (PMEL_HUMAN)
LGEADLSYTW

SEQ ID NO: 125719 - protein, 9 aa, Artificial Sequence
  Description of Artificial Sequence: Synthetic peptide
  Seed: QETDDACIF (PMEL_HUMAN)
QETDDACIA

SEQ ID NO: 125720 - protein, 9 aa, Artificial Sequence
  Description of Artificial Sequence: Synthetic peptide
  Seed: APNTTAGQV (PMEL_HUMAN)
APNTTAGQL

SEQ ID NO: 125721 - protein, 10 aa, Artificial Sequence
  Description of Artificial Sequence: Synthetic peptide
  Seed: TAAQVTTTEW (PMEL_HUMAN)
TAAQVTTTEM

SEQ ID NO: 125722 - protein, 10 aa, Artificial Sequence
  Description of Artificial Sequence: Synthetic peptide
  Seed: THTMEVTVYH (PMEL_HUMAN)
TCTMEVTVYR

SEQ ID NO: 125723 - protein, 10 aa, Artificial Sequence
  Description of Artificial Sequence: Synthetic peptide
  Seed: LVLMAVVLAS (PMEL_HUMAN)
LDLMAVVLAL

SEQ ID NO: 125724 - protein, 9 aa, Artificial Sequence
  Description of Artificial Sequence: Synthetic peptide
  Seed: QLVLHQILK (PMEL_HUMAN)
QSVLHQILK

SEQ ID NO: 125725 - protein, 9 aa, Artificial Sequence
  Description of Artificial Sequence: Synthetic peptide
  Seed: SSIMSTESI (PMEL_HUMAN)
SAIMSTESV

SEQ ID NO: 125726 - protein, 9 aa, Artificial Sequence
  Description of Artificial Sequence: Synthetic peptide
  Seed: AEPSGTTSV (PMEL_HUMAN)
ALPSGTTSM

SEQ ID NO: 125727 - protein, 10 aa, Artificial Sequence
  Description of Artificial Sequence: Synthetic peptide
  Seed: TTEVISTAPV (PMEL_HUMAN)
TVEVISTAPV

SEQ ID NO: 125728 - protein, 9 aa, Artificial Sequence
  Description of Artificial Sequence: Synthetic peptide
  Seed: TLIGANASF (PMEL_HUMAN)
TMIGANASY

SEQ ID NO: 125729 - protein, 11 aa, Artificial Sequence
  Description of Artificial Sequence: Synthetic peptide
  Seed: FSVTLDIVQGI (PMEL_HUMAN)
FMVTLDIVQGI

SEQ ID NO: 125730 - protein, 9 aa, Artificial Sequence
  Description of Artificial Sequence: Synthetic peptide
  Seed: LQAAIPLTS (PMEL_HUMAN)
LMAAIPLTY

SEQ ID NO: 125731 - protein, 10 aa, Artificial Sequence
  Description of Artificial Sequence: Synthetic peptide
  Seed: RTKAWNRQLY (PMEL_HUMAN)
RSKAWNRQLK

SEQ ID NO: 125732 - protein, 10 aa, Artificial Sequence
  Description of Artificial Sequence: Synthetic peptide
  Seed: RQLYPEWTEA (PMEL_HUMAN)
RELYPEWTEV

SEQ ID NO: 125733 - protein, 10 aa, Artificial Sequence
  Description of Artificial Sequence: Synthetic peptide
  Seed: IESAEILQAV (PMEL_HUMAN)
IESAEILQAL

SEQ ID NO: 125734 - protein, 10 aa, Artificial Sequence
  Description of Artificial Sequence: Synthetic peptide
  Seed: YVWKTWGQYW (PMEL_HUMAN)
YWWKTWGQYI

SEQ ID NO: 125735 - protein, 9 aa, Artificial Sequence
  Description of Artificial Sequence: Synthetic peptide
  Seed: YVWKTWGQY (PMEL_HUMAN)
YFWKTWGQY

SEQ ID NO: 125736 - protein, 9 aa, Artificial Sequence
  Description of Artificial Sequence: Synthetic peptide
  Seed: VQVPTTEVI (PMEL_HUMAN)
VAVPTTEVM

SEQ ID NO: 125737 - protein, 11 aa, Artificial Sequence
  Description of Artificial Sequence: Synthetic peptide
  Seed: YLEPGPVTAQV (PMEL_HUMAN)
YIEPGPVTAQL

SEQ ID NO: 125738 - protein, 9 aa, Artificial Sequence
  Description of Artificial Sequence: Synthetic peptide
  Seed: ASFSIALNF (PMEL_HUMAN)
AMFSIALNL

SEQ ID NO: 125739 - protein, 9 aa, Artificial Sequence
  Description of Artificial Sequence: Synthetic peptide
  Seed: HSSSHWLRL (PMEL_HUMAN)
HQSSHWLRL

SEQ ID NO: 125740 - protein, 10 aa, Artificial Sequence
  Description of Artificial Sequence: Synthetic peptide
  Seed: AVIGALLAVG (PMEL_HUMAN)
AVIGALLAVN

SEQ ID NO: 125741 - protein, 10 aa, Artificial Sequence
  Description of Artificial Sequence: Synthetic peptide
  Seed: GPLLDGTATL (PMEL_HUMAN)
GKLLDGTATI

SEQ ID NO: 125742 - protein, 9 aa, Artificial Sequence
  Description of Artificial Sequence: Synthetic peptide
  Seed: SQKRSFVYV (PMEL_HUMAN)
SWKRSFVYA

SEQ ID NO: 125743 - protein, 9 aa, Artificial Sequence
  Description of Artificial Sequence: Synthetic peptide
  Seed: WQVLGGPVS (PMEL_HUMAN)
WHVLGGPVY

SEQ ID NO: 125744 - protein, 10 aa, Artificial Sequence
  Description of Artificial Sequence: Synthetic peptide
  Seed: GALLAVGATK (PMEL_HUMAN)
GILLAVGATK

SEQ ID NO: 125745 - protein, 10 aa, Artificial Sequence
  Description of Artificial Sequence: Synthetic peptide
  Seed: VLMAVVLASL (PMEL_HUMAN)
VWMAVVLASA

SEQ ID NO: 125746 - protein, 9 aa, Artificial Sequence
  Description of Artificial Sequence: Synthetic peptide
  Seed: KQDFSVPQL (PMEL_HUMAN)
KEDFSVPQC

SEQ ID NO: 125747 - protein, 9 aa, Artificial Sequence
  Description of Artificial Sequence: Synthetic peptide
  Seed: KVSNDGPTL (PMEL_HUMAN)
KSSNDGPTI

SEQ ID NO: 125748 - protein, 10 aa, Artificial Sequence
  Description of Artificial Sequence: Synthetic peptide
  Seed: SVPQLPHSSS (PMEL_HUMAN)
SGPQLPHSSM

SEQ ID NO: 125749 - protein, 11 aa, Artificial Sequence
  Description of Artificial Sequence: Synthetic peptide
  Seed: FGDSSGTLISR (PMEL_HUMAN)
FQDSSGTLISI

SEQ ID NO: 125750 - protein, 10 aa, Artificial Sequence
  Description of Artificial Sequence: Synthetic peptide
  Seed: RALDGGNKHF (PMEL_HUMAN)
RILDGGNKHF

SEQ ID NO: 125751 - protein, 9 aa, Artificial Sequence
  Description of Artificial Sequence: Synthetic peptide
  Seed: VTLDIVQGI (PMEL_HUMAN)
VLLDIVQGF

SEQ ID NO: 125752 - protein, 9 aa, Artificial Sequence
  Description of Artificial Sequence: Synthetic peptide
  Seed: LAVVSTQLI (PMEL_HUMAN)
LVVVSTQLY

SEQ ID NO: 125753 - protein, 9 aa, Artificial Sequence
  Description of Artificial Sequence: Synthetic peptide
  Seed: YLAEADLSY (PMEL_HUMAN)
YFAEADLSI

SEQ ID NO: 125754 - protein, 9 aa, Artificial Sequence
  Description of Artificial Sequence: Synthetic peptide
  Seed: YLAEADLSY (PMEL_HUMAN)
YNAEADLSY

SEQ ID NO: 125755 - protein, 9 aa, Artificial Sequence
  Description of Artificial Sequence: Synthetic peptide
  Seed: GLSIGTGRA (PMEL_HUMAN)
GLSIGTGRV

SEQ ID NO: 125756 - protein, 9 aa, Artificial Sequence
  Description of Artificial Sequence: Synthetic peptide
  Seed: LEPGPVTAQ (PMEL_HUMAN)
LEPGPVTAV

SEQ ID NO: 125757 - protein, 9 aa, Artificial Sequence
  Description of Artificial Sequence: Synthetic peptide
  Seed: SQVWGGQPV (PMEL_HUMAN)
SLVWGGQPL

SEQ ID NO: 125758 - protein, 10 aa, Artificial Sequence
  Description of Artificial Sequence: Synthetic peptide
  Seed: SQKRSFVYVW (PMEL_HUMAN)
SRKRSFVYVF

SEQ ID NO: 125759 - protein, 9 aa, Artificial Sequence
  Description of Artificial Sequence: Synthetic peptide
  Seed: MAVVLASLI (PMEL_HUMAN)
MSVVLASLI

SEQ ID NO: 125760 - protein, 9 aa, Artificial Sequence
  Description of Artificial Sequence: Synthetic peptide
  Seed: ASFSIALNF (PMEL_HUMAN)
ALFSIALNL

SEQ ID NO: 125761 - protein, 9 aa, Artificial Sequence
  Description of Artificial Sequence: Synthetic peptide
  Seed: SQKRSFVYV (PMEL_HUMAN)
SIKRSFVYF

SEQ ID NO: 125762 - protein, 9 aa, Artificial Sequence
  Description of Artificial Sequence: Synthetic peptide
  Seed: CWRGGQVSL (PMEL_HUMAN)
CYRGGQVSF

SEQ ID NO: 125763 - protein, 9 aa, Artificial Sequence
  Description of Artificial Sequence: Synthetic peptide
  Seed: RLVKRQVPL (PMEL_HUMAN)
RMVKRQVPW

SEQ ID NO: 125764 - protein, 9 aa, Artificial Sequence
  Description of Artificial Sequence: Synthetic peptide
  Seed: RALVVTHTY (PMEL_HUMAN)
RQLVVTHTI

SEQ ID NO: 125765 - protein, 9 aa, Artificial Sequence
  Description of Artificial Sequence: Synthetic peptide
  Seed: SSIMSTESI (PMEL_HUMAN)
SMIMSTESF

SEQ ID NO: 125766 - protein, 9 aa, Artificial Sequence
  Description of Artificial Sequence: Synthetic peptide
  Seed: YHRRGSRSY (PMEL_HUMAN)
YLRRGSRSY

SEQ ID NO: 125767 - protein, 9 aa, Artificial Sequence
  Description of Artificial Sequence: Synthetic peptide
  Seed: DSSGTLISR (PMEL_HUMAN)
DISGTLISK

SEQ ID NO: 125768 - protein, 9 aa, Artificial Sequence
  Description of Artificial Sequence: Synthetic peptide
  Seed: ALDGGNKHF (PMEL_HUMAN)
AYDGGNKHI

SEQ ID NO: 125769 - protein, 11 aa, Artificial Sequence
  Description of Artificial Sequence: Synthetic peptide
  Seed: FGDSSGTLISR (PMEL_HUMAN)
FSDSSGTLISM

SEQ ID NO: 125770 - protein, 9 aa, Artificial Sequence
  Description of Artificial Sequence: Synthetic peptide
  Seed: MSTPEATGM (PMEL_HUMAN)
MTTPEATGW

SEQ ID NO: 125771 - protein, 9 aa, Artificial Sequence
  Description of Artificial Sequence: Synthetic peptide
  Seed: TLIGANASF (PMEL_HUMAN)
TMIGANASA

SEQ ID NO: 125772 - protein, 9 aa, Artificial Sequence
  Description of Artificial Sequence: Synthetic peptide
  Seed: RQVPLDCVL (PMEL_HUMAN)
RVVPLDCVL

SEQ ID NO: 125773 - protein, 9 aa, Artificial Sequence
  Description of Artificial Sequence: Synthetic peptide
  Seed: YLEPGPVTA (PMEL_HUMAN)
YLEPGPVTY

SEQ ID NO: 125774 - protein, 9 aa, Artificial Sequence
  Description of Artificial Sequence: Synthetic peptide
  Seed: FGDSSGTLI (PMEL_HUMAN)
FADSSGTLT

SEQ ID NO: 125775 - protein, 9 aa, Artificial Sequence
  Description of Artificial Sequence: Synthetic peptide
  Seed: ESAEILQAV (PMEL_HUMAN)
ETAEILQAF

SEQ ID NO: 125776 - protein, 9 aa, Artificial Sequence
  Description of Artificial Sequence: Synthetic peptide
  Seed: RTKAWNRQL (PMEL_HUMAN)
RAKAWNRQV

SEQ ID NO: 125777 - protein, 9 aa, Artificial Sequence
  Description of Artificial Sequence: Synthetic peptide
  Seed: ISRALVVTH (PMEL_HUMAN)
ITRALVVTY

SEQ ID NO: 125778 - protein, 9 aa, Artificial Sequence
  Description of Artificial Sequence: Synthetic peptide
  Seed: VISTAPVQM (PMEL_HUMAN)
VLSTAPVQF

SEQ ID NO: 125779 - protein, 9 aa, Artificial Sequence
  Description of Artificial Sequence: Synthetic peptide
  Seed: AEPSGTTSV (PMEL_HUMAN)
AYPSGTTSL

SEQ ID NO: 125780 - protein, 10 aa, Artificial Sequence
  Description of Artificial Sequence: Synthetic peptide
  Seed: ASFSIALNFP (PMEL_HUMAN)
ATFSIALNFY

SEQ ID NO: 125781 - protein, 9 aa, Artificial Sequence
  Description of Artificial Sequence: Synthetic peptide
  Seed: HTMEVTVYH (PMEL_HUMAN)
HGMEVTVYY

SEQ ID NO: 125782 - protein, 9 aa, Artificial Sequence
  Description of Artificial Sequence: Synthetic peptide
  Seed: ASFSIALNF (PMEL_HUMAN)
AMFSIALNM

SEQ ID NO: 125783 - protein, 10 aa, Artificial Sequence
  Description of Artificial Sequence: Synthetic peptide
  Seed: VSLADTNSLA (PMEL_HUMAN)
VHLADTNSLI

SEQ ID NO: 125784 - protein, 9 aa, Artificial Sequence
  Description of Artificial Sequence: Synthetic peptide
  Seed: LMAVVLASL (PMEL_HUMAN)
LSAVVLASI

SEQ ID NO: 125785 - protein, 10 aa, Artificial Sequence
  Description of Artificial Sequence: Synthetic peptide
  Seed: SVPQLPHSSS (PMEL_HUMAN)
SWPQLPHSSF

SEQ ID NO: 125786 - protein, 10 aa, Artificial Sequence
  Description of Artificial Sequence: Synthetic peptide
  Seed: LAEADLSYTW (PMEL_HUMAN)
LPEADLSYTM

SEQ ID NO: 125787 - protein, 9 aa, Artificial Sequence
  Description of Artificial Sequence: Synthetic peptide
  Seed: LLAVGATKV (PMEL_HUMAN)
LMAVGATKL

SEQ ID NO: 125788 - protein, 9 aa, Artificial Sequence
  Description of Artificial Sequence: Synthetic peptide
  Seed: TEVVGTTPG (PMEL_HUMAN)
TEVVGTTPP

SEQ ID NO: 125789 - protein, 9 aa, Artificial Sequence
  Description of Artificial Sequence: Synthetic peptide
  Seed: FLRNQPLTF (PMEL_HUMAN)
FMRNQPLTK

SEQ ID NO: 125790 - protein, 9 aa, Artificial Sequence
  Description of Artificial Sequence: Synthetic peptide
  Seed: SITGSLGPL (PMEL_HUMAN)
SVTGSLGPI

SEQ ID NO: 125791 - protein, 9 aa, Artificial Sequence
  Description of Artificial Sequence: Synthetic peptide
  Seed: HTMEVTVYH (PMEL_HUMAN)
HSMEVTVYI

SEQ ID NO: 125792 - protein, 9 aa, Artificial Sequence
  Description of Artificial Sequence: Synthetic peptide
  Seed: RLMKQDFSV (PMEL_HUMAN)
RSMKQDFSW

SEQ ID NO: 125793 - protein, 9 aa, Artificial Sequence
  Description of Artificial Sequence: Synthetic peptide
  Seed: HTMEVTVYH (PMEL_HUMAN)
HVMEVTVYF

SEQ ID NO: 125794 - protein, 10 aa, Artificial Sequence
  Description of Artificial Sequence: Synthetic peptide
  Seed: EVMGTTLAEM (PMEL_HUMAN)
EQMGTTLAEY

SEQ ID NO: 125795 - protein, 9 aa, Artificial Sequence
  Description of Artificial Sequence: Synthetic peptide
  Seed: ESAEILQAV (PMEL_HUMAN)
ESAEILQAF

SEQ ID NO: 125796 - protein, 11 aa, Artificial Sequence
  Description of Artificial Sequence: Synthetic peptide
  Seed: RQLRTKAWNRQ (PMEL_HUMAN)
RVLRTKAWNRR

SEQ ID NO: 125797 - protein, 9 aa, Artificial Sequence
  Description of Artificial Sequence: Synthetic peptide
  Seed: YLEPGPVTA (PMEL_HUMAN)
YNEPGPVTL

SEQ ID NO: 125798 - protein, 10 aa, Artificial Sequence
  Description of Artificial Sequence: Synthetic peptide
  Seed: LAVIGALLAV (PMEL_HUMAN)
LHVIGALLAV

SEQ ID NO: 125799 - protein, 10 aa, Artificial Sequence
  Description of Artificial Sequence: Synthetic peptide
  Seed: SITGSLGPLL (PMEL_HUMAN)
SLTGSLGPLI

SEQ ID NO: 125800 - protein, 10 aa, Artificial Sequence
  Description of Artificial Sequence: Synthetic peptide
  Seed: LSIGTGRAML (PMEL_HUMAN)
LSIGTGRAMY

SEQ ID NO: 125801 - protein, 9 aa, Artificial Sequence
  Description of Artificial Sequence: Synthetic peptide
  Seed: TLIGANASF (PMEL_HUMAN)
TTIGANASM

SEQ ID NO: 125802 - protein, 11 aa, Artificial Sequence
  Description of Artificial Sequence: Synthetic peptide
  Seed: CSCPIGENSPL (PMEL_HUMAN)
CTCPIGENSPF

SEQ ID NO: 125803 - protein, 10 aa, Artificial Sequence
  Description of Artificial Sequence: Synthetic peptide
  Seed: LAHSSSAFTI (PMEL_HUMAN)
LGHSSSAFTW

SEQ ID NO: 125804 - protein, 9 aa, Artificial Sequence
  Description of Artificial Sequence: Synthetic peptide
  Seed: FGDSSGTLI (PMEL_HUMAN)
FTDSSGTLV

SEQ ID NO: 125805 - protein, 10 aa, Artificial Sequence
  Description of Artificial Sequence: Synthetic peptide
  Seed: VPLAHSSSAF (PMEL_HUMAN)
VYLAHSSSAY

SEQ ID NO: 125806 - protein, 10 aa, Artificial Sequence
  Description of Artificial Sequence: Synthetic peptide
  Seed: SSHWLRLPRI (PMEL_HUMAN)
SSHWLRLPRY

SEQ ID NO: 125807 - protein, 9 aa, Artificial Sequence
  Description of Artificial Sequence: Synthetic peptide
  Seed: TPAEVSIVV (PMEL_HUMAN)
TGAEVSIVW

SEQ ID NO: 125808 - protein, 10 aa, Artificial Sequence
  Description of Artificial Sequence: Synthetic peptide
  Seed: KTWGQYWQVL (PMEL_HUMAN)
KNWGQYWQVF

SEQ ID NO: 125809 - protein, 9 aa, Artificial Sequence
  Description of Artificial Sequence: Synthetic peptide
  Seed: LHLAVIGAL (PMEL_HUMAN)
LQLAVIGAY

SEQ ID NO: 125810 - protein, 9 aa, Artificial Sequence
  Description of Artificial Sequence: Synthetic peptide
  Seed: LYRYGSFSV (PMEL_HUMAN)
LYRYGSFSM

SEQ ID NO: 125811 - protein, 9 aa, Artificial Sequence
  Description of Artificial Sequence: Synthetic peptide
  Seed: KVSNDGPTL (PMEL_HUMAN)
KLSNDGPTY

SEQ ID NO: 125812 - protein, 9 aa, Artificial Sequence
  Description of Artificial Sequence: Synthetic peptide
  Seed: VQVPTTEVI (PMEL_HUMAN)
VRVPTTEVM

SEQ ID NO: 125813 - protein, 11 aa, Artificial Sequence
  Description of Artificial Sequence: Synthetic peptide
  Seed: THTMEVTVYHR (PMEL_HUMAN)
TDTMEVTVYHR

SEQ ID NO: 125814 - protein, 9 aa, Artificial Sequence
  Description of Artificial Sequence: Synthetic peptide
  Seed: AVVLASLIY (PMEL_HUMAN)
ASVLASLIF

SEQ ID NO: 125815 - protein, 11 aa, Artificial Sequence
  Description of Artificial Sequence: Synthetic peptide
  Seed: RYGSFSVTLDI (PMEL_HUMAN)
RRGSFSVTLDY

SEQ ID NO: 125816 - protein, 10 aa, Artificial Sequence
  Description of Artificial Sequence: Synthetic peptide
  Seed: WKTWGQYWQV (PMEL_HUMAN)
WMTWGQYWQT

SEQ ID NO: 125817 - protein, 9 aa, Artificial Sequence
  Description of Artificial Sequence: Synthetic peptide
  Seed: SPLLSGQQV (PMEL_HUMAN)
SPLLSGQQA

SEQ ID NO: 125818 - protein, 9 aa, Artificial Sequence
  Description of Artificial Sequence: Synthetic peptide
  Seed: YLAEADLSY (PMEL_HUMAN)
YPAEADLST

SEQ ID NO: 125819 - protein, 9 aa, Artificial Sequence
  Description of Artificial Sequence: Synthetic peptide
  Seed: RLMKQDFSV (PMEL_HUMAN)
RMMKQDFST

SEQ ID NO: 125820 - protein, 9 aa, Artificial Sequence
  Description of Artificial Sequence: Synthetic peptide
  Seed: GSSPVPGTT (PMEL_HUMAN)
GSSPVPGTL

SEQ ID NO: 125821 - protein, 10 aa, Artificial Sequence
  Description of Artificial Sequence: Synthetic peptide
  Seed: RTKAWNRQLY (PMEL_HUMAN)
RIKAWNRQLA

SEQ ID NO: 125822 - protein, 10 aa, Artificial Sequence
  Description of Artificial Sequence: Synthetic peptide
  Seed: RALDGGNKHF (PMEL_HUMAN)
RELDGGNKHF

SEQ ID NO: 125823 - protein, 10 aa, Artificial Sequence
  Description of Artificial Sequence: Synthetic peptide
  Seed: SQKRSFVYVW (PMEL_HUMAN)
SDKRSFVYVF

SEQ ID NO: 125824 - protein, 9 aa, Artificial Sequence
  Description of Artificial Sequence: Synthetic peptide
  Seed: KVSNDGPTL (PMEL_HUMAN)
KSSNDGPTW

SEQ ID NO: 125825 - protein, 10 aa, Artificial Sequence
  Description of Artificial Sequence: Synthetic peptide
  Seed: LVLMAVVLAS (PMEL_HUMAN)
LRLMAVVLAM

SEQ ID NO: 125826 - protein, 9 aa, Artificial Sequence
  Description of Artificial Sequence: Synthetic peptide
  Seed: AVIGALLAV (PMEL_HUMAN)
APIGALLAT

SEQ ID NO: 125827 - protein, 11 aa, Artificial Sequence
  Description of Artificial Sequence: Synthetic peptide
  Seed: RALDGGNKHFL (PMEL_HUMAN)
RLLDGGNKHFR

SEQ ID NO: 125828 - protein, 9 aa, Artificial Sequence
  Description of Artificial Sequence: Synthetic peptide
  Seed: KTWGQYWQV (PMEL_HUMAN)
KYWGQYWQF

SEQ ID NO: 125829 - protein, 10 aa, Artificial Sequence
  Description of Artificial Sequence: Synthetic peptide
  Seed: RSFVYVWKTW (PMEL_HUMAN)
RQFVYVWKTF

SEQ ID NO: 125830 - protein, 10 aa, Artificial Sequence
  Description of Artificial Sequence: Synthetic peptide
  Seed: DGTATLRLVK (PMEL_HUMAN)
DATATLRLVR

SEQ ID NO: 125831 - protein, 9 aa, Artificial Sequence
  Description of Artificial Sequence: Synthetic peptide
  Seed: ESAEILQAV (PMEL_HUMAN)
ETAEILQAC

SEQ ID NO: 125832 - protein, 9 aa, Artificial Sequence
  Description of Artificial Sequence: Synthetic peptide
  Seed: MAVVLASLI (PMEL_HUMAN)
MPVVLASLW

SEQ ID NO: 125833 - protein, 9 aa, Artificial Sequence
  Description of Artificial Sequence: Synthetic peptide
  Seed: DSSGTLISR (PMEL_HUMAN)
DQSGTLISR

SEQ ID NO: 125834 - protein, 10 aa, Artificial Sequence
  Description of Artificial Sequence: Synthetic peptide
  Seed: MTPAEVSIVV (PMEL_HUMAN)
MGPAEVSIVS

SEQ ID NO: 125835 - protein, 9 aa, Artificial Sequence
  Description of Artificial Sequence: Synthetic peptide
  Seed: YLAEADLSY (PMEL_HUMAN)
YFAEADLSM

SEQ ID NO: 125836 - protein, 9 aa, Artificial Sequence
  Description of Artificial Sequence: Synthetic peptide
  Seed: VVLQAAIPL (PMEL_HUMAN)
VQLQAAIPV

SEQ ID NO: 125837 - protein, 8 aa, Artificial Sequence
  Description of Artificial Sequence: Synthetic peptide
  Seed: TGMTPAEV (PMEL_HUMAN)
TQMTPAEI

SEQ ID NO: 125838 - protein, 9 aa, Artificial Sequence
  Description of Artificial Sequence: Synthetic peptide
  Seed: TIINGSQVW (PMEL_HUMAN)
TMINGSQVM

SEQ ID NO: 125839 - protein, 9 aa, Artificial Sequence
  Description of Artificial Sequence: Synthetic peptide
  Seed: HTMEVTVYH (PMEL_HUMAN)
HGMEVTVYL

SEQ ID NO: 125840 - protein, 10 aa, Artificial Sequence
  Description of Artificial Sequence: Synthetic peptide
  Seed: MPTAESTGMT (PMEL_HUMAN)
MNTAESTGML

SEQ ID NO: 125841 - protein, 9 aa, Artificial Sequence
  Description of Artificial Sequence: Synthetic peptide
  Seed: TPAEVSIVV (PMEL_HUMAN)
THAEVSIVT

SEQ ID NO: 125842 - protein, 10 aa, Artificial Sequence
  Description of Artificial Sequence: Synthetic peptide
  Seed: YVPLAHSSSA (PMEL_HUMAN)
YHPLAHSSSV

SEQ ID NO: 125843 - protein, 9 aa, Artificial Sequence
  Description of Artificial Sequence: Synthetic peptide
  Seed: QEAGLGQVP (PMEL_HUMAN)
QEAGLGQVI

SEQ ID NO: 125844 - protein, 9 aa, Artificial Sequence
  Description of Artificial Sequence: Synthetic peptide
  Seed: TTDGHRPTA (PMEL_HUMAN)
TFDGHRPTL

SEQ ID NO: 125845 - protein, 9 aa, Artificial Sequence
  Description of Artificial Sequence: Synthetic peptide
  Seed: VSVSQLRAL (PMEL_HUMAN)
VQVSQLRAM

SEQ ID NO: 125846 - protein, 9 aa, Artificial Sequence
  Description of Artificial Sequence: Synthetic peptide
  Seed: AVIGALLAV (PMEL_HUMAN)
ASIGALLAL

SEQ ID NO: 125847 - protein, 10 aa, Artificial Sequence
  Description of Artificial Sequence: Synthetic peptide
  Seed: TLAEMSTPEA (PMEL_HUMAN)
TMAEMSTPEI

SEQ ID NO: 125848 - protein, 10 aa, Artificial Sequence
  Description of Artificial Sequence: Synthetic peptide
  Seed: VVLASLIYRR (PMEL_HUMAN)
VMLASLIYRW

SEQ ID NO: 125849 - protein, 11 aa, Artificial Sequence
  Description of Artificial Sequence: Synthetic peptide
  Seed: RALDGGNKHFL (PMEL_HUMAN)
RTLDGGNKHFI

SEQ ID NO: 125850 - protein, 10 aa, Artificial Sequence
  Description of Artificial Sequence: Synthetic peptide
  Seed: QILKGGSGTY (PMEL_HUMAN)
QALKGGSGTY

SEQ ID NO: 125851 - protein, 11 aa, Artificial Sequence
  Description of Artificial Sequence: Synthetic peptide
  Seed: TVYHRRGSRSY (PMEL_HUMAN)
TSYHRRGSRSF

SEQ ID NO: 125852 - protein, 10 aa, Artificial Sequence
  Description of Artificial Sequence: Synthetic peptide
  Seed: SLIYRRRLMK (PMEL_HUMAN)
SFIYRRRLMK

SEQ ID NO: 125853 - protein, 10 aa, Artificial Sequence
  Description of Artificial Sequence: Synthetic peptide
  Seed: AVVLASLIYR (PMEL_HUMAN)
AQVLASLIYK

SEQ ID NO: 125854 - protein, 9 aa, Artificial Sequence
  Description of Artificial Sequence: Synthetic peptide
  Seed: LMAVVLASL (PMEL_HUMAN)
LQAVVLASL

SEQ ID NO: 125855 - protein, 9 aa, Artificial Sequence
  Description of Artificial Sequence: Synthetic peptide
  Seed: MLGTHTMEV (PMEL_HUMAN)
MVGTHTMEL

SEQ ID NO: 125856 - protein, 9 aa, Artificial Sequence
  Description of Artificial Sequence: Synthetic peptide
  Seed: RQVPLDCVL (PMEL_HUMAN)
REVPLDCVL

SEQ ID NO: 125857 - protein, 11 aa, Artificial Sequence
  Description of Artificial Sequence: Synthetic peptide
  Seed: FGDSSGTLISR (PMEL_HUMAN)
FTDSSGTLISV

SEQ ID NO: 125858 - protein, 9 aa, Artificial Sequence
  Description of Artificial Sequence: Synthetic peptide
  Seed: VPLDCVLYR (PMEL_HUMAN)
VMLDCVLYK

SEQ ID NO: 125859 - protein, 10 aa, Artificial Sequence
  Description of Artificial Sequence: Synthetic peptide
  Seed: ESITGSLGPL (PMEL_HUMAN)
EVITGSLGPM

SEQ ID NO: 125860 - protein, 9 aa, Artificial Sequence
  Description of Artificial Sequence: Synthetic peptide
  Seed: YRYGSFSVT (PMEL_HUMAN)
YKYGSFSVL

SEQ ID NO: 125861 - protein, 9 aa, Artificial Sequence
  Description of Artificial Sequence: Synthetic peptide
  Seed: AEADLSYTW (PMEL_HUMAN)
AEADLSYTA

SEQ ID NO: 125862 - protein, 10 aa, Artificial Sequence
  Description of Artificial Sequence: Synthetic peptide
  Seed: KRQVPLDCVL (PMEL_HUMAN)
KSQVPLDCVF

SEQ ID NO: 125863 - protein, 10 aa, Artificial Sequence
  Description of Artificial Sequence: Synthetic peptide
  Seed: GPLLDGTATL (PMEL_HUMAN)
GRLLDGTATI

SEQ ID NO: 125864 - protein, 9 aa, Artificial Sequence
  Description of Artificial Sequence: Synthetic peptide
  Seed: GTYCLNVSL (PMEL_HUMAN)
GIYCLNVSR

SEQ ID NO: 125865 - protein, 9 aa, Artificial Sequence
  Description of Artificial Sequence: Synthetic peptide
  Seed: QVIWVNNTI (PMEL_HUMAN)
QTIWVNNTM

SEQ ID NO: 125866 - protein, 10 aa, Artificial Sequence
  Description of Artificial Sequence: Synthetic peptide
  Seed: LVLKRCLLHL (PMEL_HUMAN)
LQLKRCLLHV

SEQ ID NO: 125867 - protein, 9 aa, Artificial Sequence
  Description of Artificial Sequence: Synthetic peptide
  Seed: VVLSGTTAA (PMEL_HUMAN)
VSLSGTTAL

SEQ ID NO: 125868 - protein, 9 aa, Artificial Sequence
  Description of Artificial Sequence: Synthetic peptide
  Seed: LSIGTGRAM (PMEL_HUMAN)
LEIGTGRAY

SEQ ID NO: 125869 - protein, 9 aa, Artificial Sequence
  Description of Artificial Sequence: Synthetic peptide
  Seed: RLMKQDFSV (PMEL_HUMAN)
RTMKQDFSL

SEQ ID NO: 125870 - protein, 9 aa, Artificial Sequence
  Description of Artificial Sequence: Synthetic peptide
  Seed: VQVPTTEVI (PMEL_HUMAN)
VLVPTTEVW

SEQ ID NO: 125871 - protein, 9 aa, Artificial Sequence
  Description of Artificial Sequence: Synthetic peptide
  Seed: ANASFSIAL (PMEL_HUMAN)
AIASFSIAY

SEQ ID NO: 125872 - protein, 9 aa, Artificial Sequence
  Description of Artificial Sequence: Synthetic peptide
  Seed: MTPEKVPVS (PMEL_HUMAN)
MSPEKVPVV

SEQ ID NO: 125873 - protein, 11 aa, Artificial Sequence
  Description of Artificial Sequence: Synthetic peptide
  Seed: SEVMGTTLAEM (PMEL_HUMAN)
SEVMGTTLAEY

SEQ ID NO: 125874 - protein, 9 aa, Artificial Sequence
  Description of Artificial Sequence: Synthetic peptide
  Seed: FLRNQPLTF (PMEL_HUMAN)
FLRNQPLTY

SEQ ID NO: 125875 - protein, 11 aa, Artificial Sequence
  Description of Artificial Sequence: Synthetic peptide
  Seed: HLAVIGALLAV (PMEL_HUMAN)
HMAVIGALLAV

SEQ ID NO: 125876 - protein, 10 aa, Artificial Sequence
  Description of Artificial Sequence: Synthetic peptide
  Seed: SCPIGENSPL (PMEL_HUMAN)
SQPIGENSPM

SEQ ID NO: 125877 - protein, 9 aa, Artificial Sequence
  Description of Artificial Sequence: Synthetic peptide
  Seed: VVLQAAIPL (PMEL_HUMAN)
VLLQAAIPI

SEQ ID NO: 125878 - protein, 9 aa, Artificial Sequence
  Description of Artificial Sequence: Synthetic peptide
  Seed: NQDWLGVSR (PMEL_HUMAN)
NADWLGVSY

SEQ ID NO: 125879 - protein, 10 aa, Artificial Sequence
  Description of Artificial Sequence: Synthetic peptide
  Seed: RTKAWNRQLY (PMEL_HUMAN)
RVKAWNRQLM

SEQ ID NO: 125880 - protein, 11 aa, Artificial Sequence
  Description of Artificial Sequence: Synthetic peptide
  Seed: NQDWLGVSRQL (PMEL_HUMAN)
NHDWLGVSRQI

SEQ ID NO: 125881 - protein, 9 aa, Artificial Sequence
  Description of Artificial Sequence: Synthetic peptide
  Seed: DGGNKHFLR (PMEL_HUMAN)
DAGNKHFLR

SEQ ID NO: 125882 - protein, 10 aa, Artificial Sequence
  Description of Artificial Sequence: Synthetic peptide
  Seed: LSIGTGRAML (PMEL_HUMAN)
LAIGTGRAMW

SEQ ID NO: 125883 - protein, 10 aa, Artificial Sequence
  Description of Artificial Sequence: Synthetic peptide
  Seed: KTWGQYWQVL (PMEL_HUMAN)
KYWGQYWQVV

SEQ ID NO: 125884 - protein, 9 aa, Artificial Sequence
  Description of Artificial Sequence: Synthetic peptide
  Seed: KTWGQYWQV (PMEL_HUMAN)
KMWGQYWQP

SEQ ID NO: 125885 - protein, 11 aa, Artificial Sequence
  Description of Artificial Sequence: Synthetic peptide
  Seed: FGDSSGTLISR (PMEL_HUMAN)
FMDSSGTLISF

SEQ ID NO: 125886 - protein, 10 aa, Artificial Sequence
  Description of Artificial Sequence: Synthetic peptide
  Seed: AVIGALLAVG (PMEL_HUMAN)
ALIGALLAVM

SEQ ID NO: 125887 - protein, 10 aa, Artificial Sequence
  Description of Artificial Sequence: Synthetic peptide
  Seed: RELPIPEPEG (PMEL_HUMAN)
RELPIPEPES

SEQ ID NO: 125888 - protein, 9 aa, Artificial Sequence
  Description of Artificial Sequence: Synthetic peptide
  Seed: MSTPEATGM (PMEL_HUMAN)
MPTPEATGY

SEQ ID NO: 125889 - protein, 10 aa, Artificial Sequence
  Description of Artificial Sequence: Synthetic peptide
  Seed: AEVSIVVLSG (PMEL_HUMAN)
AEVSIVVLST

SEQ ID NO: 125890 - protein, 10 aa, Artificial Sequence
  Description of Artificial Sequence: Synthetic peptide
  Seed: RGSRSYVPLA (PMEL_HUMAN)
RQSRSYVPLS

SEQ ID NO: 125891 - protein, 9 aa, Artificial Sequence
  Description of Artificial Sequence: Synthetic peptide
  Seed: TPAEVSIVV (PMEL_HUMAN)
TTAEVSIVV

SEQ ID NO: 125892 - protein, 11 aa, Artificial Sequence
  Description of Artificial Sequence: Synthetic peptide
  Seed: FTITDQVPFSV (PMEL_HUMAN)
FLITDQVPFSA

SEQ ID NO: 125893 - protein, 9 aa, Artificial Sequence
  Description of Artificial Sequence: Synthetic peptide
  Seed: MPTAESTGM (PMEL_HUMAN)
MQTAESTGF

SEQ ID NO: 125894 - protein, 9 aa, Artificial Sequence
  Description of Artificial Sequence: Synthetic peptide
  Seed: SSPGCQPPA (PMEL_HUMAN)
STPGCQPPM

SEQ ID NO: 125895 - protein, 10 aa, Artificial Sequence
  Description of Artificial Sequence: Synthetic peptide
  Seed: YVWKTWGQYW (PMEL_HUMAN)
YTWKTWGQYW

SEQ ID NO: 125896 - protein, 9 aa, Artificial Sequence
  Description of Artificial Sequence: Synthetic peptide
  Seed: AQRLCQPVL (PMEL_HUMAN)
ANRLCQPVK

SEQ ID NO: 125897 - protein, 9 aa, Artificial Sequence
  Description of Artificial Sequence: Synthetic peptide
  Seed: LSIGTGRAM (PMEL_HUMAN)
LFIGTGRAM

SEQ ID NO: 125898 - protein, 9 aa, Artificial Sequence
  Description of Artificial Sequence: Synthetic peptide
  Seed: AEADLSYTW (PMEL_HUMAN)
AIADLSYTI

SEQ ID NO: 125899 - protein, 10 aa, Artificial Sequence
  Description of Artificial Sequence: Synthetic peptide
  Seed: IALNFPGSQK (PMEL_HUMAN)
IPLNFPGSQK

SEQ ID NO: 125900 - protein, 8 aa, Artificial Sequence
  Description of Artificial Sequence: Synthetic peptide
  Seed: ALVVTHTY (PMEL_HUMAN)
AQVVTHTY

SEQ ID NO: 125901 - protein, 9 aa, Artificial Sequence
  Description of Artificial Sequence: Synthetic peptide
  Seed: MAVVLASLI (PMEL_HUMAN)
MMVVLASLV

SEQ ID NO: 125902 - protein, 9 aa, Artificial Sequence
  Description of Artificial Sequence: Synthetic peptide
  Seed: MAVVLASLI (PMEL_HUMAN)
MTVVLASLV

SEQ ID NO: 125903 - protein, 8 aa, Artificial Sequence
  Description of Artificial Sequence: Synthetic peptide
  Seed: HSSSHWLR (PMEL_HUMAN)
HMSSHWLR

SEQ ID NO: 125904 - protein, 10 aa, Artificial Sequence
  Description of Artificial Sequence: Synthetic peptide
  Seed: RQLYPEWTEA (PMEL_HUMAN)
RALYPEWTEV

SEQ ID NO: 125905 - protein, 11 aa, Artificial Sequence
  Description of Artificial Sequence: Synthetic peptide
  Seed: RRGSRSYVPLA (PMEL_HUMAN)
RNGSRSYVPLK

SEQ ID NO: 125906 - protein, 10 aa, Artificial Sequence
  Description of Artificial Sequence: Synthetic peptide
  Seed: WSQKRSFVYV (PMEL_HUMAN)
WLQKRSFVYV

SEQ ID NO: 125907 - protein, 10 aa, Artificial Sequence
  Description of Artificial Sequence: Synthetic peptide
  Seed: RQLYPEWTEA (PMEL_HUMAN)
RGLYPEWTEI

SEQ ID NO: 125908 - protein, 10 aa, Artificial Sequence
  Description of Artificial Sequence: Synthetic peptide
  Seed: EVVGTTPGQA (PMEL_HUMAN)
ETVGTTPGQR

SEQ ID NO: 125909 - protein, 9 aa, Artificial Sequence
  Description of Artificial Sequence: Synthetic peptide
  Seed: DAFELTVSC (PMEL_HUMAN)
DRFELTVSI

SEQ ID NO: 125910 - protein, 9 aa, Artificial Sequence
  Description of Artificial Sequence: Synthetic peptide
  Seed: AGQVPTTEV (PMEL_HUMAN)
ATQVPTTEM

SEQ ID NO: 125911 - protein, 9 aa, Artificial Sequence
  Description of Artificial Sequence: Synthetic peptide
  Seed: LQLHDPSGY (PMEL_HUMAN)
LMLHDPSGF

SEQ ID NO: 125912 - protein, 10 aa, Artificial Sequence
  Description of Artificial Sequence: Synthetic peptide
  Seed: MTPAEVSIVV (PMEL_HUMAN)
MYPAEVSIVM

SEQ ID NO: 125913 - protein, 10 aa, Artificial Sequence
  Description of Artificial Sequence: Synthetic peptide
  Seed: RGSRSYVPLA (PMEL_HUMAN)
RLSRSYVPLK

SEQ ID NO: 125914 - protein, 9 aa, Artificial Sequence
  Description of Artificial Sequence: Synthetic peptide
  Seed: VSEVMGTTL (PMEL_HUMAN)
VQEVMGTTL

SEQ ID NO: 125915 - protein, 9 aa, Artificial Sequence
  Description of Artificial Sequence: Synthetic peptide
  Seed: SITGSLGPL (PMEL_HUMAN)
SLTGSLGPL

SEQ ID NO: 125916 - protein, 9 aa, Artificial Sequence
  Description of Artificial Sequence: Synthetic peptide
  Seed: WSQKRSFVY (PMEL_HUMAN)
WLQKRSFVM

SEQ ID NO: 125917 - protein, 9 aa, Artificial Sequence
  Description of Artificial Sequence: Synthetic peptide
  Seed: YHRRGSRSY (PMEL_HUMAN)
YFRRGSRSF

SEQ ID NO: 125918 - protein, 9 aa, Artificial Sequence
  Description of Artificial Sequence: Synthetic peptide
  Seed: VLGGPVSGL (PMEL_HUMAN)
VQGGPVSGY

SEQ ID NO: 125919 - protein, 10 aa, Artificial Sequence
  Description of Artificial Sequence: Synthetic peptide
  Seed: YVWKTWGQYW (PMEL_HUMAN)
YSWKTWGQYY

SEQ ID NO: 125920 - protein, 11 aa, Artificial Sequence
  Description of Artificial Sequence: Synthetic peptide
  Seed: AEMSTPEATGM (PMEL_HUMAN)
AQMSTPEATGM

SEQ ID NO: 125921 - protein, 9 aa, Artificial Sequence
  Description of Artificial Sequence: Synthetic peptide
  Seed: MSTPEATGM (PMEL_HUMAN)
MLTPEATGY

SEQ ID NO: 125922 - protein, 9 aa, Artificial Sequence
  Description of Artificial Sequence: Synthetic peptide
  Seed: FTITDQVPF (PMEL_HUMAN)
FTITDQVPW

SEQ ID NO: 125923 - protein, 10 aa, Artificial Sequence
  Description of Artificial Sequence: Synthetic peptide
  Seed: GEGDAFELTV (PMEL_HUMAN)
GQGDAFELTV

SEQ ID NO: 125924 - protein, 9 aa, Artificial Sequence
  Description of Artificial Sequence: Synthetic peptide
  Seed: RYGSFSVTL (PMEL_HUMAN)
RLGSFSVTL

SEQ ID NO: 125925 - protein, 9 aa, Artificial Sequence
  Description of Artificial Sequence: Synthetic peptide
  Seed: YVWKTWGQY (PMEL_HUMAN)
YTWKTWGQY

SEQ ID NO: 125926 - protein, 11 aa, Artificial Sequence
  Description of Artificial Sequence: Synthetic peptide
  Seed: FGDSSGTLISR (PMEL_HUMAN)
FLDSSGTLISY

SEQ ID NO: 125927 - protein, 10 aa, Artificial Sequence
  Description of Artificial Sequence: Synthetic peptide
  Seed: SSSHWLRLPR (PMEL_HUMAN)
SNSHWLRLPK

SEQ ID NO: 125928 - protein, 9 aa, Artificial Sequence
  Description of Artificial Sequence: Synthetic peptide
  Seed: VMGTTLAEM (PMEL_HUMAN)
VKGTTLAEF

SEQ ID NO: 125929 - protein, 9 aa, Artificial Sequence
  Description of Artificial Sequence: Synthetic peptide
  Seed: TAEAPNTTA (PMEL_HUMAN)
TSEAPNTTV

SEQ ID NO: 125930 - protein, 9 aa, Artificial Sequence
  Description of Artificial Sequence: Synthetic peptide
  Seed: VSVSQLRAL (PMEL_HUMAN)
VVVSQLRAY

SEQ ID NO: 125931 - protein, 10 aa, Artificial Sequence
  Description of Artificial Sequence: Synthetic peptide
  Seed: KVSNDGPTLI (PMEL_HUMAN)
KQSNDGPTLW

SEQ ID NO: 125932 - protein, 11 aa, Artificial Sequence
  Description of Artificial Sequence: Synthetic peptide
  Seed: YLAEADLSYTW (PMEL_HUMAN)
YTAEADLSYTV

SEQ ID NO: 125933 - protein, 10 aa, Artificial Sequence
  Description of Artificial Sequence: Synthetic peptide
  Seed: VSLADTNSLA (PMEL_HUMAN)
VFLADTNSLL

SEQ ID NO: 125934 - protein, 10 aa, Artificial Sequence
  Description of Artificial Sequence: Synthetic peptide
  Seed: MLGTHTMEVT (PMEL_HUMAN)
MLGTHTMEVI

SEQ ID NO: 125935 - protein, 9 aa, Artificial Sequence
  Description of Artificial Sequence: Synthetic peptide
  Seed: FLRNQPLTF (PMEL_HUMAN)
FLRNQPLTL

SEQ ID NO: 125936 - protein, 9 aa, Artificial Sequence
  Description of Artificial Sequence: Synthetic peptide
  Seed: TLISRALVV (PMEL_HUMAN)
TIISRALVY

SEQ ID NO: 125937 - protein, 10 aa, Artificial Sequence
  Description of Artificial Sequence: Synthetic peptide
  Seed: RSFVYVWKTW (PMEL_HUMAN)
RMFVYVWKTF

SEQ ID NO: 125938 - protein, 11 aa, Artificial Sequence
  Description of Artificial Sequence: Synthetic peptide
  Seed: IPEPEGPDASS (PMEL_HUMAN)
IPEPEGPDASL

SEQ ID NO: 125939 - protein, 9 aa, Artificial Sequence
  Description of Artificial Sequence: Synthetic peptide
  Seed: ILKGGSGTY (PMEL_HUMAN)
IFKGGSGTM

SEQ ID NO: 125940 - protein, 10 aa, Artificial Sequence
  Description of Artificial Sequence: Synthetic peptide
  Seed: ASSIMSTESI (PMEL_HUMAN)
ATSIMSTESW

SEQ ID NO: 125941 - protein, 9 aa, Artificial Sequence
  Description of Artificial Sequence: Synthetic peptide
  Seed: VTLDIVQGI (PMEL_HUMAN)
VSLDIVQGM

SEQ ID NO: 125942 - protein, 9 aa, Artificial Sequence
  Description of Artificial Sequence: Synthetic peptide
  Seed: AEAPNTTAG (PMEL_HUMAN)
AEAPNTTAV

SEQ ID NO: 125943 - protein, 11 aa, Artificial Sequence
  Description of Artificial Sequence: Synthetic peptide
  Seed: GYLAEADLSYT (PMEL_HUMAN)
GFLAEADLSYA

SEQ ID NO: 125944 - protein, 9 aa, Artificial Sequence
  Description of Artificial Sequence: Synthetic peptide
  Seed: ASFSIALNF (PMEL_HUMAN)
ALFSIALNI

SEQ ID NO: 125945 - protein, 9 aa, Artificial Sequence
  Description of Artificial Sequence: Synthetic peptide
  Seed: LTSCGSSPV (PMEL_HUMAN)
LVSCGSSPV

SEQ ID NO: 125946 - protein, 11 aa, Artificial Sequence
  Description of Artificial Sequence: Synthetic peptide
  Seed: HTMEVTVYHRR (PMEL_HUMAN)
HTMEVTVYHRM

SEQ ID NO: 125947 - protein, 10 aa, Artificial Sequence
  Description of Artificial Sequence: Synthetic peptide
  Seed: YVPLAHSSSA (PMEL_HUMAN)
YHPLAHSSSA

SEQ ID NO: 125948 - protein, 10 aa, Artificial Sequence
  Description of Artificial Sequence: Synthetic peptide
  Seed: MTPAEVSIVV (PMEL_HUMAN)
MPPAEVSIVM

SEQ ID NO: 125949 - protein, 9 aa, Artificial Sequence
  Description of Artificial Sequence: Synthetic peptide
  Seed: SQKRSFVYV (PMEL_HUMAN)
SVKRSFVYQ

SEQ ID NO: 125950 - protein, 9 aa, Artificial Sequence
  Description of Artificial Sequence: Synthetic peptide
  Seed: TPAEVSIVV (PMEL_HUMAN)
TIAEVSIVY

SEQ ID NO: 125951 - protein, 10 aa, Artificial Sequence
  Description of Artificial Sequence: Synthetic peptide
  Seed: VSLADTNSLA (PMEL_HUMAN)
VILADTNSLV

SEQ ID NO: 125952 - protein, 9 aa, Artificial Sequence
  Description of Artificial Sequence: Synthetic peptide
  Seed: MAVVLASLI (PMEL_HUMAN)
MIVVLASLY

SEQ ID NO: 125953 - protein, 10 aa, Artificial Sequence
  Description of Artificial Sequence: Synthetic peptide
  Seed: YLAEADLSYT (PMEL_HUMAN)
YSAEADLSYY

SEQ ID NO: 125954 - protein, 9 aa, Artificial Sequence
  Description of Artificial Sequence: Synthetic peptide
  Seed: TLISRALVV (PMEL_HUMAN)
TRISRALVL

SEQ ID NO: 125955 - protein, 9 aa, Artificial Sequence
  Description of Artificial Sequence: Synthetic peptide
  Seed: VSLADTNSL (PMEL_HUMAN)
VQLADTNSM

SEQ ID NO: 125956 - protein, 9 aa, Artificial Sequence
  Description of Artificial Sequence: Synthetic peptide
  Seed: VISTAPVQM (PMEL_HUMAN)
VISTAPVQI

SEQ ID NO: 125957 - protein, 9 aa, Artificial Sequence
  Description of Artificial Sequence: Synthetic peptide
  Seed: HTYLEPGPV (PMEL_HUMAN)
HSYLEPGPF

SEQ ID NO: 125958 - protein, 10 aa, Artificial Sequence
  Description of Artificial Sequence: Synthetic peptide
  Seed: GQEAGLGQVP (PMEL_HUMAN)
GEEAGLGQVT

SEQ ID NO: 125959 - protein, 9 aa, Artificial Sequence
  Description of Artificial Sequence: Synthetic peptide
  Seed: LIYRRRLMK (PMEL_HUMAN)
LVYRRRLMY

SEQ ID NO: 125960 - protein, 9 aa, Artificial Sequence
  Description of Artificial Sequence: Synthetic peptide
  Seed: YWQVLGGPV (PMEL_HUMAN)
YFQVLGGPF

SEQ ID NO: 125961 - protein, 9 aa, Artificial Sequence
  Description of Artificial Sequence: Synthetic peptide
  Seed: AEPSGTTSV (PMEL_HUMAN)
AQPSGTTSV

SEQ ID NO: 125962 - protein, 10 aa, Artificial Sequence
  Description of Artificial Sequence: Synthetic peptide
  Seed: RALDGGNKHF (PMEL_HUMAN)
RVLDGGNKHR

SEQ ID NO: 125963 - protein, 9 aa, Artificial Sequence
  Description of Artificial Sequence: Synthetic peptide
  Seed: ANASFSIAL (PMEL_HUMAN)
ALASFSIAF

SEQ ID NO: 125964 - protein, 11 aa, Artificial Sequence
  Description of Artificial Sequence: Synthetic peptide
  Seed: MEISSPGCQPP (PMEL_HUMAN)
MEISSPGCQPL

SEQ ID NO: 125965 - protein, 10 aa, Artificial Sequence
  Description of Artificial Sequence: Synthetic peptide
  Seed: LGQVPLIVGI (PMEL_HUMAN)
LMQVPLIVGV

SEQ ID NO: 125966 - protein, 10 aa, Artificial Sequence
  Description of Artificial Sequence: Synthetic peptide
  Seed: AVIGALLAVG (PMEL_HUMAN)
AQIGALLAVM

SEQ ID NO: 125967 - protein, 9 aa, Artificial Sequence
  Description of Artificial Sequence: Synthetic peptide
  Seed: KTWGQYWQV (PMEL_HUMAN)
KTWGQYWQK

SEQ ID NO: 125968 - protein, 10 aa, Artificial Sequence
  Description of Artificial Sequence: Synthetic peptide
  Seed: KTWGQYWQVL (PMEL_HUMAN)
KTWGQYWQVV

SEQ ID NO: 125969 - protein, 10 aa, Artificial Sequence
  Description of Artificial Sequence: Synthetic peptide
  Seed: RALDGGNKHF (PMEL_HUMAN)
RTLDGGNKHW

SEQ ID NO: 125970 - protein, 9 aa, Artificial Sequence
  Description of Artificial Sequence: Synthetic peptide
  Seed: AQRLCQPVL (PMEL_HUMAN)
AYRLCQPVK

SEQ ID NO: 125971 - protein, 9 aa, Artificial Sequence
  Description of Artificial Sequence: Synthetic peptide
  Seed: ILKGGSGTY (PMEL_HUMAN)
IHKGGSGTF

SEQ ID NO: 125972 - protein, 9 aa, Artificial Sequence
  Description of Artificial Sequence: Synthetic peptide
  Seed: RAMLGTHTM (PMEL_HUMAN)
RIMLGTHTK

SEQ ID NO: 125973 - protein, 9 aa, Artificial Sequence
  Description of Artificial Sequence: Synthetic peptide
  Seed: SAFTITDQV (PMEL_HUMAN)
SIFTITDQV

SEQ ID NO: 125974 - protein, 11 aa, Artificial Sequence
  Description of Artificial Sequence: Synthetic peptide
  Seed: TVYHRRGSRSY (PMEL_HUMAN)
TKYHRRGSRSY

SEQ ID NO: 125975 - protein, 9 aa, Artificial Sequence
  Description of Artificial Sequence: Synthetic peptide
  Seed: GQVPTTEVV (PMEL_HUMAN)
GVVPTTEVF

SEQ ID NO: 125976 - protein, 10 aa, Artificial Sequence
  Description of Artificial Sequence: Synthetic peptide
  Seed: KTWGQYWQVL (PMEL_HUMAN)
KLWGQYWQVG

SEQ ID NO: 125977 - protein, 10 aa, Artificial Sequence
  Description of Artificial Sequence: Synthetic peptide
  Seed: RQLRTKAWNR (PMEL_HUMAN)
RRLRTKAWNV

SEQ ID NO: 125978 - protein, 9 aa, Artificial Sequence
  Description of Artificial Sequence: Synthetic peptide
  Seed: RLVKRQVPL (PMEL_HUMAN)
RTVKRQVPR

SEQ ID NO: 125979 - protein, 10 aa, Artificial Sequence
  Description of Artificial Sequence: Synthetic peptide
  Seed: ESITGSLGPL (PMEL_HUMAN)
EAITGSLGPF

SEQ ID NO: 125980 - protein, 10 aa, Artificial Sequence
  Description of Artificial Sequence: Synthetic peptide
  Seed: TTEWVETTAR (PMEL_HUMAN)
TFEWVETTAR

SEQ ID NO: 125981 - protein, 9 aa, Artificial Sequence
  Description of Artificial Sequence: Synthetic peptide
  Seed: YLEPGPVTA (PMEL_HUMAN)
YLEPGPVTL

SEQ ID NO: 125982 - protein, 9 aa, Artificial Sequence
  Description of Artificial Sequence: Synthetic peptide
  Seed: ITGSLGPLL (PMEL_HUMAN)
IMGSLGPLA

SEQ ID NO: 125983 - protein, 9 aa, Artificial Sequence
  Description of Artificial Sequence: Synthetic peptide
  Seed: MTPAEVSIV (PMEL_HUMAN)
MLPAEVSII

SEQ ID NO: 125984 - protein, 9 aa, Artificial Sequence
  Description of Artificial Sequence: Synthetic peptide
  Seed: RAMLGTHTM (PMEL_HUMAN)
RIMLGTHTA

SEQ ID NO: 125985 - protein, 9 aa, Artificial Sequence
  Description of Artificial Sequence: Synthetic peptide
  Seed: FGDSSGTLI (PMEL_HUMAN)
FWDSSGTLV

SEQ ID NO: 125986 - protein, 9 aa, Artificial Sequence
  Description of Artificial Sequence: Synthetic peptide
  Seed: EVMGTTLAE (PMEL_HUMAN)
EIMGTTLAY

SEQ ID NO: 125987 - protein, 9 aa, Artificial Sequence
  Description of Artificial Sequence: Synthetic peptide
  Seed: ALVVTHTYL (PMEL_HUMAN)
AMVVTHTYI

SEQ ID NO: 125988 - protein, 11 aa, Artificial Sequence
  Description of Artificial Sequence: Synthetic peptide
  Seed: AEAPNTTAGQV (PMEL_HUMAN)
AEAPNTTAGQW

SEQ ID NO: 125989 - protein, 8 aa, Artificial Sequence
  Description of Artificial Sequence: Synthetic peptide
  Seed: SNDGPTLI (PMEL_HUMAN)
SQDGPTLL

SEQ ID NO: 125990 - protein, 10 aa, Artificial Sequence
  Description of Artificial Sequence: Synthetic peptide
  Seed: MTPAEVSIVV (PMEL_HUMAN)
MIPAEVSIVS

SEQ ID NO: 125991 - protein, 9 aa, Artificial Sequence
  Description of Artificial Sequence: Synthetic peptide
  Seed: GTYCLNVSL (PMEL_HUMAN)
GMYCLNVSM

SEQ ID NO: 125992 - protein, 9 aa, Artificial Sequence
  Description of Artificial Sequence: Synthetic peptide
  Seed: VPFSVSVSQ (PMEL_HUMAN)
VLFSVSVSY

SEQ ID NO: 125993 - protein, 9 aa, Artificial Sequence
  Description of Artificial Sequence: Synthetic peptide
  Seed: WQVLGGPVS (PMEL_HUMAN)
WEVLGGPVM

SEQ ID NO: 125994 - protein, 9 aa, Artificial Sequence
  Description of Artificial Sequence: Synthetic peptide
  Seed: VPFSVSVSQ (PMEL_HUMAN)
VSFSVSVSF

SEQ ID NO: 125995 - protein, 9 aa, Artificial Sequence
  Description of Artificial Sequence: Synthetic peptide
  Seed: SQKRSFVYV (PMEL_HUMAN)
SMKRSFVYV

SEQ ID NO: 125996 - protein, 11 aa, Artificial Sequence
  Description of Artificial Sequence: Synthetic peptide
  Seed: DCWRGGQVSLK (PMEL_HUMAN)
DIWRGGQVSLR

SEQ ID NO: 125997 - protein, 9 aa, Artificial Sequence
  Description of Artificial Sequence: Synthetic peptide
  Seed: VSVSQLRAL (PMEL_HUMAN)
VSVSQLRAY

SEQ ID NO: 125998 - protein, 9 aa, Artificial Sequence
  Description of Artificial Sequence: Synthetic peptide
  Seed: VSEVMGTTL (PMEL_HUMAN)
VFEVMGTTL

SEQ ID NO: 125999 - protein, 9 aa, Artificial Sequence
  Description of Artificial Sequence: Synthetic peptide
  Seed: FLRNQPLTF (PMEL_HUMAN)
FTRNQPLTW

SEQ ID NO: 126000 - protein, 10 aa, Artificial Sequence
  Description of Artificial Sequence: Synthetic peptide
  Seed: ESAEILQAVP (PMEL_HUMAN)
EVAEILQAVH

SEQ ID NO: 126001 - protein, 10 aa, Artificial Sequence
  Description of Artificial Sequence: Synthetic peptide
  Seed: MTPAEVSIVV (PMEL_HUMAN)
MQPAEVSIVW

SEQ ID NO: 126002 - protein, 10 aa, Artificial Sequence
  Description of Artificial Sequence: Synthetic peptide
  Seed: VLMAVVLASL (PMEL_HUMAN)
VVMAVVLASK

SEQ ID NO: 126003 - protein, 11 aa, Artificial Sequence
  Description of Artificial Sequence: Synthetic peptide
  Seed: SYVPLAHSSSA (PMEL_HUMAN)
SDVPLAHSSSL

SEQ ID NO: 126004 - protein, 10 aa, Artificial Sequence
  Description of Artificial Sequence: Synthetic peptide
  Seed: VLMAVVLASL (PMEL_HUMAN)
VLMAVVLASI

SEQ ID NO: 126005 - protein, 9 aa, Artificial Sequence
  Description of Artificial Sequence: Synthetic peptide
  Seed: AVIGALLAV (PMEL_HUMAN)
ASIGALLAM

SEQ ID NO: 126006 - protein, 11 aa, Artificial Sequence
  Description of Artificial Sequence: Synthetic peptide
  Seed: GYLAEADLSYT (PMEL_HUMAN)
GALAEADLSYV

SEQ ID NO: 126007 - protein, 9 aa, Artificial Sequence
  Description of Artificial Sequence: Synthetic peptide
  Seed: FGDSSGTLI (PMEL_HUMAN)
FDDSSGTLM

SEQ ID NO: 126008 - protein, 10 aa, Artificial Sequence
  Description of Artificial Sequence: Synthetic peptide
  Seed: GLSIGTGRAM (PMEL_HUMAN)
GISIGTGRAY

SEQ ID NO: 126009 - protein, 11 aa, Artificial Sequence
  Description of Artificial Sequence: Synthetic peptide
  Seed: RYGSFSVTLDI (PMEL_HUMAN)
RYGSFSVTLDM

SEQ ID NO: 126010 - protein, 9 aa, Artificial Sequence
  Description of Artificial Sequence: Synthetic peptide
  Seed: RTKAWNRQL (PMEL_HUMAN)
RWKAWNRQY

SEQ ID NO: 126011 - protein, 10 aa, Artificial Sequence
  Description of Artificial Sequence: Synthetic peptide
  Seed: MTPAEVSIVV (PMEL_HUMAN)
MYPAEVSIVT

SEQ ID NO: 126012 - protein, 9 aa, Artificial Sequence
  Description of Artificial Sequence: Synthetic peptide
  Seed: LTVSCQGGL (PMEL_HUMAN)
LLVSCQGGI

SEQ ID NO: 126013 - protein, 9 aa, Artificial Sequence
  Description of Artificial Sequence: Synthetic peptide
  Seed: ANASFSIAL (PMEL_HUMAN)
AMASFSIAY

SEQ ID NO: 126014 - protein, 9 aa, Artificial Sequence
  Description of Artificial Sequence: Synthetic peptide
  Seed: LPHSSSHWL (PMEL_HUMAN)
LAHSSSHWW

SEQ ID NO: 126015 - protein, 9 aa, Artificial Sequence
  Description of Artificial Sequence: Synthetic peptide
  Seed: LHLAVIGAL (PMEL_HUMAN)
LHLAVIGAF

SEQ ID NO: 126016 - protein, 9 aa, Artificial Sequence
  Description of Artificial Sequence: Synthetic peptide
  Seed: DAFELTVSC (PMEL_HUMAN)
DAFELTVSY

SEQ ID NO: 126017 - protein, 9 aa, Artificial Sequence
  Description of Artificial Sequence: Synthetic peptide
  Seed: FPDGGPCPS (PMEL_HUMAN)
FPDGGPCPL

SEQ ID NO: 126018 - protein, 9 aa, Artificial Sequence
  Description of Artificial Sequence: Synthetic peptide
  Seed: MEVTVYHRR (PMEL_HUMAN)
MMVTVYHRR

SEQ ID NO: 126019 - protein, 11 aa, Artificial Sequence
  Description of Artificial Sequence: Synthetic peptide
  Seed: RYGSFSVTLDI (PMEL_HUMAN)
RHGSFSVTLDY

SEQ ID NO: 126020 - protein, 8 aa, Artificial Sequence
  Description of Artificial Sequence: Synthetic peptide
  Seed: LHDPSGYL (PMEL_HUMAN)
LYDPSGYM

SEQ ID NO: 126021 - protein, 9 aa, Artificial Sequence
  Description of Artificial Sequence: Synthetic peptide
  Seed: SLGPLLDGT (PMEL_HUMAN)
STGPLLDGL

SEQ ID NO: 126022 - protein, 10 aa, Artificial Sequence
  Description of Artificial Sequence: Synthetic peptide
  Seed: ESITGSLGPL (PMEL_HUMAN)
EMITGSLGPR

SEQ ID NO: 126023 - protein, 9 aa, Artificial Sequence
  Description of Artificial Sequence: Synthetic peptide
  Seed: SFVYVWKTW (PMEL_HUMAN)
SWVYVWKTM

SEQ ID NO: 126024 - protein, 9 aa, Artificial Sequence
  Description of Artificial Sequence: Synthetic peptide
  Seed: ISRALVVTH (PMEL_HUMAN)
IGRALVVTY

SEQ ID NO: 126025 - protein, 9 aa, Artificial Sequence
  Description of Artificial Sequence: Synthetic peptide
  Seed: KHFLRNQPL (PMEL_HUMAN)
KVFLRNQPY

SEQ ID NO: 126026 - protein, 10 aa, Artificial Sequence
  Description of Artificial Sequence: Synthetic peptide
  Seed: ASSIMSTESI (PMEL_HUMAN)
ATSIMSTESF

SEQ ID NO: 126027 - protein, 10 aa, Artificial Sequence
  Description of Artificial Sequence: Synthetic peptide
  Seed: VPLAHSSSAF (PMEL_HUMAN)
VCLAHSSSAF

SEQ ID NO: 126028 - protein, 9 aa, Artificial Sequence
  Description of Artificial Sequence: Synthetic peptide
  Seed: VISTAPVQM (PMEL_HUMAN)
VQSTAPVQV

SEQ ID NO: 126029 - protein, 10 aa, Artificial Sequence
  Description of Artificial Sequence: Synthetic peptide
  Seed: KTWGQYWQVL (PMEL_HUMAN)
KAWGQYWQVF

SEQ ID NO: 126030 - protein, 10 aa, Artificial Sequence
  Description of Artificial Sequence: Synthetic peptide
  Seed: SVPQLPHSSS (PMEL_HUMAN)
SVPQLPHSSM

SEQ ID NO: 126031 - protein, 10 aa, Artificial Sequence
  Description of Artificial Sequence: Synthetic peptide
  Seed: KVSNDGPTLI (PMEL_HUMAN)
KLSNDGPTLF

SEQ ID NO: 126032 - protein, 9 aa, Artificial Sequence
  Description of Artificial Sequence: Synthetic peptide
  Seed: LYPEWTEAQ (PMEL_HUMAN)
LYPEWTEAY

SEQ ID NO: 126033 - protein, 11 aa, Artificial Sequence
  Description of Artificial Sequence: Synthetic peptide
  Seed: RAMLGTHTMEV (PMEL_HUMAN)
RFMLGTHTMEL

SEQ ID NO: 126034 - protein, 10 aa, Artificial Sequence
  Description of Artificial Sequence: Synthetic peptide
  Seed: ALDGGNKHFL (PMEL_HUMAN)
ALDGGNKHFM

SEQ ID NO: 126035 - protein, 11 aa, Artificial Sequence
  Description of Artificial Sequence: Synthetic peptide
  Seed: RLPRIFCSCPI (PMEL_HUMAN)
REPRIFCSCPL

SEQ ID NO: 126036 - protein, 9 aa, Artificial Sequence
  Description of Artificial Sequence: Synthetic peptide
  Seed: RLMKQDFSV (PMEL_HUMAN)
RAMKQDFSY

SEQ ID NO: 126037 - protein, 9 aa, Artificial Sequence
  Description of Artificial Sequence: Synthetic peptide
  Seed: AHSSSAFTI (PMEL_HUMAN)
AKSSSAFTM

SEQ ID NO: 126038 - protein, 9 aa, Artificial Sequence
  Description of Artificial Sequence: Synthetic peptide
  Seed: LQAAIPLTS (PMEL_HUMAN)
LEAAIPLTF

SEQ ID NO: 126039 - protein, 11 aa, Artificial Sequence
  Description of Artificial Sequence: Synthetic peptide
  Seed: CVLYRYGSFSV (PMEL_HUMAN)
CMLYRYGSFSV

SEQ ID NO: 126040 - protein, 10 aa, Artificial Sequence
  Description of Artificial Sequence: Synthetic peptide
  Seed: QVLGGPVSGL (PMEL_HUMAN)
QTLGGPVSGW

SEQ ID NO: 126041 - protein, 11 aa, Artificial Sequence
  Description of Artificial Sequence: Synthetic peptide
  Seed: NNTIINGSQVW (PMEL_HUMAN)
NTTIINGSQVW

SEQ ID NO: 126042 - protein, 9 aa, Artificial Sequence
  Description of Artificial Sequence: Synthetic peptide
  Seed: VSNDGPTLI (PMEL_HUMAN)
VCNDGPTLL

SEQ ID NO: 126043 - protein, 10 aa, Artificial Sequence
  Description of Artificial Sequence: Synthetic peptide
  Seed: GSFSVTLDIV (PMEL_HUMAN)
GMFSVTLDII

SEQ ID NO: 126044 - protein, 9 aa, Artificial Sequence
  Description of Artificial Sequence: Synthetic peptide
  Seed: AGLGQVPLI (PMEL_HUMAN)
AILGQVPLA

SEQ ID NO: 126045 - protein, 9 aa, Artificial Sequence
  Description of Artificial Sequence: Synthetic peptide
  Seed: AHSSSAFTI (PMEL_HUMAN)
AQSSSAFTI

SEQ ID NO: 126046 - protein, 9 aa, Artificial Sequence
  Description of Artificial Sequence: Synthetic peptide
  Seed: KVSNDGPTL (PMEL_HUMAN)
KISNDGPTL

SEQ ID NO: 126047 - protein, 10 aa, Artificial Sequence
  Description of Artificial Sequence: Synthetic peptide
  Seed: YLAEADLSYT (PMEL_HUMAN)
YLAEADLSYS

SEQ ID NO: 126048 - protein, 10 aa, Artificial Sequence
  Description of Artificial Sequence: Synthetic peptide
  Seed: VPQLPHSSSH (PMEL_HUMAN)
VYQLPHSSSM

SEQ ID NO: 126049 - protein, 9 aa, Artificial Sequence
  Description of Artificial Sequence: Synthetic peptide
  Seed: GTATLRLVK (PMEL_HUMAN)
GVATLRLVK

SEQ ID NO: 126050 - protein, 10 aa, Artificial Sequence
  Description of Artificial Sequence: Synthetic peptide
  Seed: SPVPGTTDGH (PMEL_HUMAN)
SPVPGTTDGF

SEQ ID NO: 126051 - protein, 9 aa, Artificial Sequence
  Description of Artificial Sequence: Synthetic peptide
  Seed: YHRRGSRSY (PMEL_HUMAN)
YNRRGSRSF

SEQ ID NO: 126052 - protein, 9 aa, Artificial Sequence
  Description of Artificial Sequence: Synthetic peptide
  Seed: RLVKRQVPL (PMEL_HUMAN)
RQVKRQVPH

SEQ ID NO: 126053 - protein, 11 aa, Artificial Sequence
  Description of Artificial Sequence: Synthetic peptide
  Seed: HSSSHWLRLPR (PMEL_HUMAN)
HHSSHWLRLPR

SEQ ID NO: 126054 - protein, 9 aa, Artificial Sequence
  Description of Artificial Sequence: Synthetic peptide
  Seed: RAMLGTHTM (PMEL_HUMAN)
RWMLGTHTI

SEQ ID NO: 126055 - protein, 9 aa, Artificial Sequence
  Description of Artificial Sequence: Synthetic peptide
  Seed: KTWGQYWQV (PMEL_HUMAN)
KSWGQYWQI

SEQ ID NO: 126056 - protein, 9 aa, Artificial Sequence
  Description of Artificial Sequence: Synthetic peptide
  Seed: GQVPTTEVV (PMEL_HUMAN)
GPVPTTEVY

SEQ ID NO: 126057 - protein, 10 aa, Artificial Sequence
  Description of Artificial Sequence: Synthetic peptide
  Seed: LDGGNKHFLR (PMEL_HUMAN)
LYGGNKHFLR

SEQ ID NO: 126058 - protein, 10 aa, Artificial Sequence
  Description of Artificial Sequence: Synthetic peptide
  Seed: YLAEADLSYT (PMEL_HUMAN)
YQAEADLSYT

SEQ ID NO: 126059 - protein, 11 aa, Artificial Sequence
  Description of Artificial Sequence: Synthetic peptide
  Seed: AEMSTPEATGM (PMEL_HUMAN)
ASMSTPEATGY

SEQ ID NO: 126060 - protein, 10 aa, Artificial Sequence
  Description of Artificial Sequence: Synthetic peptide
  Seed: MTPAEVSIVV (PMEL_HUMAN)
MCPAEVSIVS

SEQ ID NO: 126061 - protein, 10 aa, Artificial Sequence
  Description of Artificial Sequence: Synthetic peptide
  Seed: KRSFVYVWKT (PMEL_HUMAN)
KRSFVYVWKL

SEQ ID NO: 126062 - protein, 9 aa, Artificial Sequence
  Description of Artificial Sequence: Synthetic peptide
  Seed: TLIGANASF (PMEL_HUMAN)
TVIGANASF

SEQ ID NO: 126063 - protein, 10 aa, Artificial Sequence
  Description of Artificial Sequence: Synthetic peptide
  Seed: KRQVPLDCVL (PMEL_HUMAN)
KTQVPLDCVY

SEQ ID NO: 126064 - protein, 10 aa, Artificial Sequence
  Description of Artificial Sequence: Synthetic peptide
  Seed: RTKAWNRQLY (PMEL_HUMAN)
RVKAWNRQLA

SEQ ID NO: 126065 - protein, 9 aa, Artificial Sequence
  Description of Artificial Sequence: Synthetic peptide
  Seed: WLGVSRQLR (PMEL_HUMAN)
WMGVSRQLR

SEQ ID NO: 126066 - protein, 9 aa, Artificial Sequence
  Description of Artificial Sequence: Synthetic peptide
  Seed: ESTGMTPEK (PMEL_HUMAN)
EVTGMTPEY

SEQ ID NO: 126067 - protein, 9 aa, Artificial Sequence
  Description of Artificial Sequence: Synthetic peptide
  Seed: YLAEADLSY (PMEL_HUMAN)
YMAEADLSV

SEQ ID NO: 126068 - protein, 10 aa, Artificial Sequence
  Description of Artificial Sequence: Synthetic peptide
  Seed: RQLRTKAWNR (PMEL_HUMAN)
RRLRTKAWNM

SEQ ID NO: 126069 - protein, 10 aa, Artificial Sequence
  Description of Artificial Sequence: Synthetic peptide
  Seed: VSLADTNSLA (PMEL_HUMAN)
VHLADTNSLL

SEQ ID NO: 126070 - protein, 9 aa, Artificial Sequence
  Description of Artificial Sequence: Synthetic peptide
  Seed: ALVVTHTYL (PMEL_HUMAN)
ALVVTHTYF

SEQ ID NO: 126071 - protein, 11 aa, Artificial Sequence
  Description of Artificial Sequence: Synthetic peptide
  Seed: RALDGGNKHFL (PMEL_HUMAN)
RTLDGGNKHFY

SEQ ID NO: 126072 - protein, 10 aa, Artificial Sequence
  Description of Artificial Sequence: Synthetic peptide
  Seed: GPLLDGTATL (PMEL_HUMAN)
GDLLDGTATA

SEQ ID NO: 126073 - protein, 10 aa, Artificial Sequence
  Description of Artificial Sequence: Synthetic peptide
  Seed: TITDQVPFSV (PMEL_HUMAN)
TMTDQVPFSL

SEQ ID NO: 126074 - protein, 9 aa, Artificial Sequence
  Description of Artificial Sequence: Synthetic peptide
  Seed: VSNDGPTLI (PMEL_HUMAN)
VLNDGPTLM

SEQ ID NO: 126075 - protein, 9 aa, Artificial Sequence
  Description of Artificial Sequence: Synthetic peptide
  Seed: RIFCSCPIG (PMEL_HUMAN)
RYFCSCPIK

SEQ ID NO: 126076 - protein, 9 aa, Artificial Sequence
  Description of Artificial Sequence: Synthetic peptide
  Seed: HSSSHWLRL (PMEL_HUMAN)
HQSSHWLRF

SEQ ID NO: 126077 - protein, 9 aa, Artificial Sequence
  Description of Artificial Sequence: Synthetic peptide
  Seed: TATLRLVKR (PMEL_HUMAN)
TTTLRLVKK

SEQ ID NO: 126078 - protein, 10 aa, Artificial Sequence
  Description of Artificial Sequence: Synthetic peptide
  Seed: WKTWGQYWQV (PMEL_HUMAN)
WDTWGQYWQV

SEQ ID NO: 126079 - protein, 9 aa, Artificial Sequence
  Description of Artificial Sequence: Synthetic peptide
  Seed: MAVVLASLI (PMEL_HUMAN)
MAVVLASLV

SEQ ID NO: 126080 - protein, 11 aa, Artificial Sequence
  Description of Artificial Sequence: Synthetic peptide
  Seed: YVPLAHSSSAF (PMEL_HUMAN)
YQPLAHSSSAY

SEQ ID NO: 126081 - protein, 9 aa, Artificial Sequence
  Description of Artificial Sequence: Synthetic peptide
  Seed: VQVPTTEVI (PMEL_HUMAN)
VDVPTTEVM

SEQ ID NO: 126082 - protein, 11 aa, Artificial Sequence
  Description of Artificial Sequence: Synthetic peptide
  Seed: YLEPGPVTAQV (PMEL_HUMAN)
YAEPGPVTAQM

SEQ ID NO: 126083 - protein, 9 aa, Artificial Sequence
  Description of Artificial Sequence: Synthetic peptide
  Seed: LSIGTGRAM (PMEL_HUMAN)
LKIGTGRAY

SEQ ID NO: 126084 - protein, 10 aa, Artificial Sequence
  Description of Artificial Sequence: Synthetic peptide
  Seed: EVMGTTLAEM (PMEL_HUMAN)
EGMGTTLAEK

SEQ ID NO: 126085 - protein, 9 aa, Artificial Sequence
  Description of Artificial Sequence: Synthetic peptide
  Seed: GQVPLIVGI (PMEL_HUMAN)
GMVPLIVGF

SEQ ID NO: 126086 - protein, 9 aa, Artificial Sequence
  Description of Artificial Sequence: Synthetic peptide
  Seed: KTWGQYWQV (PMEL_HUMAN)
KQWGQYWQC

SEQ ID NO: 126087 - protein, 9 aa, Artificial Sequence
  Description of Artificial Sequence: Synthetic peptide
  Seed: GTYCLNVSL (PMEL_HUMAN)
GVYCLNVSY

SEQ ID NO: 126088 - protein, 9 aa, Artificial Sequence
  Description of Artificial Sequence: Synthetic peptide
  Seed: SFVYVWKTW (PMEL_HUMAN)
SSVYVWKTF

SEQ ID NO: 126089 - protein, 9 aa, Artificial Sequence
  Description of Artificial Sequence: Synthetic peptide
  Seed: AEILQAVPS (PMEL_HUMAN)
AEILQAVPC

SEQ ID NO: 126090 - protein, 9 aa, Artificial Sequence
  Description of Artificial Sequence: Synthetic peptide
  Seed: ESAEILQAV (PMEL_HUMAN)
EVAEILQAA

SEQ ID NO: 126091 - protein, 9 aa, Artificial Sequence
  Description of Artificial Sequence: Synthetic peptide
  Seed: NDGPTLIGA (PMEL_HUMAN)
NEGPTLIGL

SEQ ID NO: 126092 - protein, 9 aa, Artificial Sequence
  Description of Artificial Sequence: Synthetic peptide
  Seed: SLADTNSLA (PMEL_HUMAN)
SQADTNSLI

SEQ ID NO: 126093 - protein, 10 aa, Artificial Sequence
  Description of Artificial Sequence: Synthetic peptide
  Seed: VTAQVVLQAA (PMEL_HUMAN)
VVAQVVLQAI

SEQ ID NO: 126094 - protein, 9 aa, Artificial Sequence
  Description of Artificial Sequence: Synthetic peptide
  Seed: VLPSPACQL (PMEL_HUMAN)
VTPSPACQI

SEQ ID NO: 126095 - protein, 10 aa, Artificial Sequence
  Description of Artificial Sequence: Synthetic peptide
  Seed: RQLRTKAWNR (PMEL_HUMAN)
RLLRTKAWNK

SEQ ID NO: 126096 - protein, 9 aa, Artificial Sequence
  Description of Artificial Sequence: Synthetic peptide
  Seed: HTMEVTVYH (PMEL_HUMAN)
HTMEVTVYI

SEQ ID NO: 126097 - protein, 9 aa, Artificial Sequence
  Description of Artificial Sequence: Synthetic peptide
  Seed: FTITDQVPF (PMEL_HUMAN)
FSITDQVPY

SEQ ID NO: 126098 - protein, 10 aa, Artificial Sequence
  Description of Artificial Sequence: Synthetic peptide
  Seed: RGSRSYVPLA (PMEL_HUMAN)
RPSRSYVPLV

SEQ ID NO: 126099 - protein, 10 aa, Artificial Sequence
  Description of Artificial Sequence: Synthetic peptide
  Seed: VSLADTNSLA (PMEL_HUMAN)
VFLADTNSLV

SEQ ID NO: 126100 - protein, 9 aa, Artificial Sequence
  Description of Artificial Sequence: Synthetic peptide
  Seed: VQMPTAEST (PMEL_HUMAN)
VQMPTAESI

SEQ ID NO: 126101 - protein, 10 aa, Artificial Sequence
  Description of Artificial Sequence: Synthetic peptide
  Seed: GTYCLNVSLA (PMEL_HUMAN)
GMYCLNVSLA

SEQ ID NO: 126102 - protein, 10 aa, Artificial Sequence
  Description of Artificial Sequence: Synthetic peptide
  Seed: LIVGILLVLM (PMEL_HUMAN)
LLVGILLVLL

SEQ ID NO: 126103 - protein, 10 aa, Artificial Sequence
  Description of Artificial Sequence: Synthetic peptide
  Seed: QILKGGSGTY (PMEL_HUMAN)
QTLKGGSGTY

SEQ ID NO: 126104 - protein, 9 aa, Artificial Sequence
  Description of Artificial Sequence: Synthetic peptide
  Seed: FSVSVSQLR (PMEL_HUMAN)
FNVSVSQLR

SEQ ID NO: 126105 - protein, 10 aa, Artificial Sequence
  Description of Artificial Sequence: Synthetic peptide
  Seed: GLSIGTGRAM (PMEL_HUMAN)
GASIGTGRAY

SEQ ID NO: 126106 - protein, 9 aa, Artificial Sequence
  Description of Artificial Sequence: Synthetic peptide
  Seed: HSSSHWLRL (PMEL_HUMAN)
HSSSHWLRV

SEQ ID NO: 126107 - protein, 9 aa, Artificial Sequence
  Description of Artificial Sequence: Synthetic peptide
  Seed: DQVPFSVSV (PMEL_HUMAN)
DLVPFSVSF

SEQ ID NO: 126108 - protein, 10 aa, Artificial Sequence
  Description of Artificial Sequence: Synthetic peptide
  Seed: VPLIVGILLV (PMEL_HUMAN)
VYLIVGILLV

SEQ ID NO: 126109 - protein, 10 aa, Artificial Sequence
  Description of Artificial Sequence: Synthetic peptide
  Seed: LVLMAVVLAS (PMEL_HUMAN)
LFLMAVVLAA

SEQ ID NO: 126110 - protein, 10 aa, Artificial Sequence
  Description of Artificial Sequence: Synthetic peptide
  Seed: MTPAEVSIVV (PMEL_HUMAN)
MHPAEVSIVY

SEQ ID NO: 126111 - protein, 10 aa, Artificial Sequence
  Description of Artificial Sequence: Synthetic peptide
  Seed: VSLADTNSLA (PMEL_HUMAN)
VWLADTNSLM

SEQ ID NO: 126112 - protein, 9 aa, Artificial Sequence
  Description of Artificial Sequence: Synthetic peptide
  Seed: AVGATKVPR (PMEL_HUMAN)
AAGATKVPL

SEQ ID NO: 126113 - protein, 9 aa, Artificial Sequence
  Description of Artificial Sequence: Synthetic peptide
  Seed: VMGTTLAEM (PMEL_HUMAN)
VMGTTLAEL

SEQ ID NO: 126114 - protein, 9 aa, Artificial Sequence
  Description of Artificial Sequence: Synthetic peptide
  Seed: YHRRGSRSY (PMEL_HUMAN)
YMRRGSRSY

SEQ ID NO: 126115 - protein, 9 aa, Artificial Sequence
  Description of Artificial Sequence: Synthetic peptide
  Seed: RNQPLTFAL (PMEL_HUMAN)
RMQPLTFAI

SEQ ID NO: 126116 - protein, 9 aa, Artificial Sequence
  Description of Artificial Sequence: Synthetic peptide
  Seed: RALVVTHTY (PMEL_HUMAN)
RILVVTHTF

SEQ ID NO: 126117 - protein, 9 aa, Artificial Sequence
  Description of Artificial Sequence: Synthetic peptide
  Seed: SVQVPTTEV (PMEL_HUMAN)
SLQVPTTEI

SEQ ID NO: 126118 - protein, 9 aa, Artificial Sequence
  Description of Artificial Sequence: Synthetic peptide
  Seed: TTPGQAPTA (PMEL_HUMAN)
TMPGQAPTM

SEQ ID NO: 126119 - protein, 9 aa, Artificial Sequence
  Description of Artificial Sequence: Synthetic peptide
  Seed: IMPGQEAGL (PMEL_HUMAN)
IFPGQEAGM

SEQ ID NO: 126120 - protein, 9 aa, Artificial Sequence
  Description of Artificial Sequence: Synthetic peptide
  Seed: EAQRLDCWR (PMEL_HUMAN)
EVQRLDCWR

SEQ ID NO: 126121 - protein, 9 aa, Artificial Sequence
  Description of Artificial Sequence: Synthetic peptide
  Seed: VLMAVVLAS (PMEL_HUMAN)
VIMAVVLAL

SEQ ID NO: 126122 - protein, 9 aa, Artificial Sequence
  Description of Artificial Sequence: Synthetic peptide
  Seed: VVLASLIYR (PMEL_HUMAN)
VNLASLIYK

SEQ ID NO: 126123 - protein, 9 aa, Artificial Sequence
  Description of Artificial Sequence: Synthetic peptide
  Seed: RNQPLTFAL (PMEL_HUMAN)
RSQPLTFAM

SEQ ID NO: 126124 - protein, 10 aa, Artificial Sequence
  Description of Artificial Sequence: Synthetic peptide
  Seed: LVLMAVVLAS (PMEL_HUMAN)
LMLMAVVLAA

SEQ ID NO: 126125 - protein, 8 aa, Artificial Sequence
  Description of Artificial Sequence: Synthetic peptide
  Seed: FGDSSGTL (PMEL_HUMAN)
FFDSSGTV

SEQ ID NO: 126126 - protein, 9 aa, Artificial Sequence
  Description of Artificial Sequence: Synthetic peptide
  Seed: GSSPVPGTT (PMEL_HUMAN)
GVSPVPGTL

SEQ ID NO: 126127 - protein, 9 aa, Artificial Sequence
  Description of Artificial Sequence: Synthetic peptide
  Seed: ITGSLGPLL (PMEL_HUMAN)
IAGSLGPLW

SEQ ID NO: 126128 - protein, 9 aa, Artificial Sequence
  Description of Artificial Sequence: Synthetic peptide
  Seed: KVLPDGQVI (PMEL_HUMAN)
KMLPDGQVW

SEQ ID NO: 126129 - protein, 11 aa, Artificial Sequence
  Description of Artificial Sequence: Synthetic peptide
  Seed: ITDQVPFSVSV (PMEL_HUMAN)
ILDQVPFSVSI

SEQ ID NO: 126130 - protein, 10 aa, Artificial Sequence
  Description of Artificial Sequence: Synthetic peptide
  Seed: KVLPDGQVIW (PMEL_HUMAN)
KTLPDGQVIF

SEQ ID NO: 126131 - protein, 9 aa, Artificial Sequence
  Description of Artificial Sequence: Synthetic peptide
  Seed: SRALVVTHT (PMEL_HUMAN)
SHALVVTHI

SEQ ID NO: 126132 - protein, 9 aa, Artificial Sequence
  Description of Artificial Sequence: Synthetic peptide
  Seed: SQKRSFVYV (PMEL_HUMAN)
STKRSFVYY

SEQ ID NO: 126133 - protein, 10 aa, Artificial Sequence
  Description of Artificial Sequence: Synthetic peptide
  Seed: VLMAVVLASL (PMEL_HUMAN)
VIMAVVLASR

SEQ ID NO: 126134 - protein, 9 aa, Artificial Sequence
  Description of Artificial Sequence: Synthetic peptide
  Seed: MAVVLASLI (PMEL_HUMAN)
MAVVLASLW

SEQ ID NO: 126135 - protein, 10 aa, Artificial Sequence
  Description of Artificial Sequence: Synthetic peptide
  Seed: GPLLDGTATL (PMEL_HUMAN)
GILLDGTATA

SEQ ID NO: 126136 - protein, 10 aa, Artificial Sequence
  Description of Artificial Sequence: Synthetic peptide
  Seed: HLAVIGALLA (PMEL_HUMAN)
HMAVIGALLV

SEQ ID NO: 126137 - protein, 11 aa, Artificial Sequence
  Description of Artificial Sequence: Synthetic peptide
  Seed: KAWNRQLYPEW (PMEL_HUMAN)
KTWNRQLYPEM

SEQ ID NO: 126138 - protein, 11 aa, Artificial Sequence
  Description of Artificial Sequence: Synthetic peptide
  Seed: YPQETDDACIF (PMEL_HUMAN)
YPQETDDACIM

SEQ ID NO: 126139 - protein, 9 aa, Artificial Sequence
  Description of Artificial Sequence: Synthetic peptide
  Seed: VQVPTTEVI (PMEL_HUMAN)
VAVPTTEVI

SEQ ID NO: 126140 - protein, 10 aa, Artificial Sequence
  Description of Artificial Sequence: Synthetic peptide
  Seed: AVIGALLAVG (PMEL_HUMAN)
ALIGALLAVG

SEQ ID NO: 126141 - protein, 9 aa, Artificial Sequence
  Description of Artificial Sequence: Synthetic peptide
  Seed: LNFPGSQKV (PMEL_HUMAN)
LLFPGSQKT

SEQ ID NO: 126142 - protein, 9 aa, Artificial Sequence
  Description of Artificial Sequence: Synthetic peptide
  Seed: AEPSGTTSV (PMEL_HUMAN)
AEPSGTTSA

SEQ ID NO: 126143 - protein, 9 aa, Artificial Sequence
  Description of Artificial Sequence: Synthetic peptide
  Seed: KVLPDGQVI (PMEL_HUMAN)
KGLPDGQVW

SEQ ID NO: 126144 - protein, 10 aa, Artificial Sequence
  Description of Artificial Sequence: Synthetic peptide
  Seed: LIYRRRLMKQ (PMEL_HUMAN)
LMYRRRLMKY

SEQ ID NO: 126145 - protein, 9 aa, Artificial Sequence
  Description of Artificial Sequence: Synthetic peptide
  Seed: YHRRGSRSY (PMEL_HUMAN)
YSRRGSRSY

SEQ ID NO: 126146 - protein, 9 aa, Artificial Sequence
  Description of Artificial Sequence: Synthetic peptide
  Seed: AQVTTTEWV (PMEL_HUMAN)
AMVTTTEWL

SEQ ID NO: 126147 - protein, 9 aa, Artificial Sequence
  Description of Artificial Sequence: Synthetic peptide
  Seed: AVVLASLIY (PMEL_HUMAN)
AHVLASLIY

SEQ ID NO: 126148 - protein, 9 aa, Artificial Sequence
  Description of Artificial Sequence: Synthetic peptide
  Seed: MAVVLASLI (PMEL_HUMAN)
MPVVLASLA

SEQ ID NO: 126149 - protein, 9 aa, Artificial Sequence
  Description of Artificial Sequence: Synthetic peptide
  Seed: RTKAWNRQL (PMEL_HUMAN)
RVKAWNRQG

SEQ ID NO: 126150 - protein, 10 aa, Artificial Sequence
  Description of Artificial Sequence: Synthetic peptide
  Seed: SVPQLPHSSS (PMEL_HUMAN)
SMPQLPHSSA

SEQ ID NO: 126151 - protein, 9 aa, Artificial Sequence
  Description of Artificial Sequence: Synthetic peptide
  Seed: AEPSGTTSV (PMEL_HUMAN)
AIPSGTTSV

SEQ ID NO: 126152 - protein, 9 aa, Artificial Sequence
  Description of Artificial Sequence: Synthetic peptide
  Seed: KVSNDGPTL (PMEL_HUMAN)
KSSNDGPTM

SEQ ID NO: 126153 - protein, 11 aa, Artificial Sequence
  Description of Artificial Sequence: Synthetic peptide
  Seed: TTAAQVTTTEW (PMEL_HUMAN)
TSAAQVTTTEW

SEQ ID NO: 126154 - protein, 9 aa, Artificial Sequence
  Description of Artificial Sequence: Synthetic peptide
  Seed: GQVPTTEVV (PMEL_HUMAN)
GLVPTTEVW

SEQ ID NO: 126155 - protein, 9 aa, Artificial Sequence
  Description of Artificial Sequence: Synthetic peptide
  Seed: KVLPDGQVI (PMEL_HUMAN)
KQLPDGQVV

SEQ ID NO: 126156 - protein, 9 aa, Artificial Sequence
  Description of Artificial Sequence: Synthetic peptide
  Seed: LPDGQVIWV (PMEL_HUMAN)
LSDGQVIWM

SEQ ID NO: 126157 - protein, 9 aa, Artificial Sequence
  Description of Artificial Sequence: Synthetic peptide
  Seed: KVSNDGPTL (PMEL_HUMAN)
KASNDGPTY

SEQ ID NO: 126158 - protein, 10 aa, Artificial Sequence
  Description of Artificial Sequence: Synthetic peptide
  Seed: AEADLSYTWD (PMEL_HUMAN)
AEADLSYTWH

SEQ ID NO: 126159 - protein, 11 aa, Artificial Sequence
  Description of Artificial Sequence: Synthetic peptide
  Seed: NQDWLGVSRQL (PMEL_HUMAN)
NHDWLGVSRQM

SEQ ID NO: 126160 - protein, 9 aa, Artificial Sequence
  Description of Artificial Sequence: Synthetic peptide
  Seed: KHFLRNQPL (PMEL_HUMAN)
KMFLRNQPI

SEQ ID NO: 126161 - protein, 9 aa, Artificial Sequence
  Description of Artificial Sequence: Synthetic peptide
  Seed: VQVPTTEVI (PMEL_HUMAN)
VLVPTTEVL

SEQ ID NO: 126162 - protein, 9 aa, Artificial Sequence
  Description of Artificial Sequence: Synthetic peptide
  Seed: GSRSYVPLA (PMEL_HUMAN)
GVRSYVPLM

SEQ ID NO: 126163 - protein, 9 aa, Artificial Sequence
  Description of Artificial Sequence: Synthetic peptide
  Seed: RALVVTHTY (PMEL_HUMAN)
RSLVVTHTK

SEQ ID NO: 126164 - protein, 10 aa, Artificial Sequence
  Description of Artificial Sequence: Synthetic peptide
  Seed: LHLAVIGALL (PMEL_HUMAN)
LCLAVIGALV

SEQ ID NO: 126165 - protein, 10 aa, Artificial Sequence
  Description of Artificial Sequence: Synthetic peptide
  Seed: VLPDGQVIWV (PMEL_HUMAN)
VMPDGQVIWV

SEQ ID NO: 126166 - protein, 10 aa, Artificial Sequence
  Description of Artificial Sequence: Synthetic peptide
  Seed: VLMAVVLASL (PMEL_HUMAN)
VCMAVVLASF

SEQ ID NO: 126167 - protein, 9 aa, Artificial Sequence
  Description of Artificial Sequence: Synthetic peptide
  Seed: TPAEVSIVV (PMEL_HUMAN)
TPAEVSIVI

SEQ ID NO: 126168 - protein, 10 aa, Artificial Sequence
  Description of Artificial Sequence: Synthetic peptide
  Seed: THTMEVTVYH (PMEL_HUMAN)
TPTMEVTVYY

SEQ ID NO: 126169 - protein, 9 aa, Artificial Sequence
  Description of Artificial Sequence: Synthetic peptide
  Seed: KTWGQYWQV (PMEL_HUMAN)
KVWGQYWQV

SEQ ID NO: 126170 - protein, 9 aa, Artificial Sequence
  Description of Artificial Sequence: Synthetic peptide
  Seed: MAVVLASLI (PMEL_HUMAN)
MKVVLASLF

SEQ ID NO: 126171 - protein, 9 aa, Artificial Sequence
  Description of Artificial Sequence: Synthetic peptide
  Seed: QLVLHQILK (PMEL_HUMAN)
QLVLHQILR

SEQ ID NO: 126172 - protein, 9 aa, Artificial Sequence
  Description of Artificial Sequence: Synthetic peptide
  Seed: ASFSIALNF (PMEL_HUMAN)
AIFSIALNK

SEQ ID NO: 126173 - protein, 10 aa, Artificial Sequence
  Description of Artificial Sequence: Synthetic peptide
  Seed: KTWGQYWQVL (PMEL_HUMAN)
KYWGQYWQVF

SEQ ID NO: 126174 - protein, 10 aa, Artificial Sequence
  Description of Artificial Sequence: Synthetic peptide
  Seed: GPLLDGTATL (PMEL_HUMAN)
GSLLDGTATL

SEQ ID NO: 126175 - protein, 9 aa, Artificial Sequence
  Description of Artificial Sequence: Synthetic peptide
  Seed: FPDGGPCPS (PMEL_HUMAN)
FPDGGPCPV

SEQ ID NO: 126176 - protein, 10 aa, Artificial Sequence
  Description of Artificial Sequence: Synthetic peptide
  Seed: VYVWKTWGQY (PMEL_HUMAN)
VYVWKTWGQI

SEQ ID NO: 126177 - protein, 9 aa, Artificial Sequence
  Description of Artificial Sequence: Synthetic peptide
  Seed: ISRALVVTH (PMEL_HUMAN)
IQRALVVTY

SEQ ID NO: 126178 - protein, 10 aa, Artificial Sequence
  Description of Artificial Sequence: Synthetic peptide
  Seed: GPLLDGTATL (PMEL_HUMAN)
GTLLDGTATM

SEQ ID NO: 126179 - protein, 10 aa, Artificial Sequence
  Description of Artificial Sequence: Synthetic peptide
  Seed: KRQVPLDCVL (PMEL_HUMAN)
KQQVPLDCVY

SEQ ID NO: 126180 - protein, 9 aa, Artificial Sequence
  Description of Artificial Sequence: Synthetic peptide
  Seed: ASFSIALNF (PMEL_HUMAN)
AQFSIALNI

SEQ ID NO: 126181 - protein, 10 aa, Artificial Sequence
  Description of Artificial Sequence: Synthetic peptide
  Seed: KTWGQYWQVL (PMEL_HUMAN)
KVWGQYWQVI

SEQ ID NO: 126182 - protein, 9 aa, Artificial Sequence
  Description of Artificial Sequence: Synthetic peptide
  Seed: RAMLGTHTM (PMEL_HUMAN)
REMLGTHTM

SEQ ID NO: 126183 - protein, 9 aa, Artificial Sequence
  Description of Artificial Sequence: Synthetic peptide
  Seed: AQRLCQPVL (PMEL_HUMAN)
AVRLCQPVY

SEQ ID NO: 126184 - protein, 8 aa, Artificial Sequence
  Description of Artificial Sequence: Synthetic peptide
  Seed: SHWLRLPR (PMEL_HUMAN)
STWLRLPR

SEQ ID NO: 126185 - protein, 8 aa, Artificial Sequence
  Description of Artificial Sequence: Synthetic peptide
  Seed: YRYGSFSV (PMEL_HUMAN)
YHYGSFSA

SEQ ID NO: 126186 - protein, 9 aa, Artificial Sequence
  Description of Artificial Sequence: Synthetic peptide
  Seed: SQKRSFVYV (PMEL_HUMAN)
SAKRSFVYK

SEQ ID NO: 126187 - protein, 10 aa, Artificial Sequence
  Description of Artificial Sequence: Synthetic peptide
  Seed: DSSGTLISRA (PMEL_HUMAN)
DTSGTLISRI

SEQ ID NO: 126188 - protein, 9 aa, Artificial Sequence
  Description of Artificial Sequence: Synthetic peptide
  Seed: IMPGQEAGL (PMEL_HUMAN)
IMPGQEAGV

SEQ ID NO: 126189 - protein, 10 aa, Artificial Sequence
  Description of Artificial Sequence: Synthetic peptide
  Seed: RGSRSYVPLA (PMEL_HUMAN)
RYSRSYVPLS

SEQ ID NO: 126190 - protein, 9 aa, Artificial Sequence
  Description of Artificial Sequence: Synthetic peptide
  Seed: LNFPGSQKV (PMEL_HUMAN)
LMFPGSQKF

SEQ ID NO: 126191 - protein, 9 aa, Artificial Sequence
  Description of Artificial Sequence: Synthetic peptide
  Seed: SLAVVSTQL (PMEL_HUMAN)
SQAVVSTQL

SEQ ID NO: 126192 - protein, 9 aa, Artificial Sequence
  Description of Artificial Sequence: Synthetic peptide
  Seed: VSRQLRTKA (PMEL_HUMAN)
VTRQLRTKV

SEQ ID NO: 126193 - protein, 10 aa, Artificial Sequence
  Description of Artificial Sequence: Synthetic peptide
  Seed: KRQVPLDCVL (PMEL_HUMAN)
KLQVPLDCVY

SEQ ID NO: 126194 - protein, 9 aa, Artificial Sequence
  Description of Artificial Sequence: Synthetic peptide
  Seed: LAVVSTQLI (PMEL_HUMAN)
LMVVSTQLW

SEQ ID NO: 126195 - protein, 9 aa, Artificial Sequence
  Description of Artificial Sequence: Synthetic peptide
  Seed: KQDFSVPQL (PMEL_HUMAN)
KTDFSVPQM

SEQ ID NO: 126196 - protein, 9 aa, Artificial Sequence
  Description of Artificial Sequence: Synthetic peptide
  Seed: YPQETDDAC (PMEL_HUMAN)
YSQETDDAF

SEQ ID NO: 126197 - protein, 9 aa, Artificial Sequence
  Description of Artificial Sequence: Synthetic peptide
  Seed: LSIGTGRAM (PMEL_HUMAN)
LSIGTGRAF

SEQ ID NO: 126198 - protein, 10 aa, Artificial Sequence
  Description of Artificial Sequence: Synthetic peptide
  Seed: VPQLPHSSSH (PMEL_HUMAN)
VWQLPHSSSL

SEQ ID NO: 126199 - protein, 9 aa, Artificial Sequence
  Description of Artificial Sequence: Synthetic peptide
  Seed: VLASLIYRR (PMEL_HUMAN)
VAASLIYRK

SEQ ID NO: 126200 - protein, 10 aa, Artificial Sequence
  Description of Artificial Sequence: Synthetic peptide
  Seed: VSLADTNSLA (PMEL_HUMAN)
VCLADTNSLI

SEQ ID NO: 126201 - protein, 8 aa, Artificial Sequence
  Description of Artificial Sequence: Synthetic peptide
  Seed: LADTNSLA (PMEL_HUMAN)
LIDTNSLM

SEQ ID NO: 126202 - protein, 9 aa, Artificial Sequence
  Description of Artificial Sequence: Synthetic peptide
  Seed: ISRALVVTH (PMEL_HUMAN)
ISRALVVTA

SEQ ID NO: 126203 - protein, 10 aa, Artificial Sequence
  Description of Artificial Sequence: Synthetic peptide
  Seed: KRQVPLDCVL (PMEL_HUMAN)
KIQVPLDCVF

SEQ ID NO: 126204 - protein, 9 aa, Artificial Sequence
  Description of Artificial Sequence: Synthetic peptide
  Seed: RNQPLTFAL (PMEL_HUMAN)
RTQPLTFAY

SEQ ID NO: 126205 - protein, 9 aa, Artificial Sequence
  Description of Artificial Sequence: Synthetic peptide
  Seed: SQKRSFVYV (PMEL_HUMAN)
SHKRSFVYF

SEQ ID NO: 126206 - protein, 9 aa, Artificial Sequence
  Description of Artificial Sequence: Synthetic peptide
  Seed: MLGTHTMEV (PMEL_HUMAN)
MAGTHTMEY

SEQ ID NO: 126207 - protein, 10 aa, Artificial Sequence
  Description of Artificial Sequence: Synthetic peptide
  Seed: LQLHDPSGYL (PMEL_HUMAN)
LLLHDPSGYI

SEQ ID NO: 126208 - protein, 9 aa, Artificial Sequence
  Description of Artificial Sequence: Synthetic peptide
  Seed: MTPEKVPVS (PMEL_HUMAN)
MCPEKVPVL

SEQ ID NO: 126209 - protein, 9 aa, Artificial Sequence
  Description of Artificial Sequence: Synthetic peptide
  Seed: YLAEADLSY (PMEL_HUMAN)
YWAEADLSF

SEQ ID NO: 126210 - protein, 10 aa, Artificial Sequence
  Description of Artificial Sequence: Synthetic peptide
  Seed: RRLMKQDFSV (PMEL_HUMAN)
RLLMKQDFSL

SEQ ID NO: 126211 - protein, 10 aa, Artificial Sequence
  Description of Artificial Sequence: Synthetic peptide
  Seed: LADTNSLAVV (PMEL_HUMAN)
LVDTNSLAVL

SEQ ID NO: 126212 - protein, 10 aa, Artificial Sequence
  Description of Artificial Sequence: Synthetic peptide
  Seed: YLAEADLSYT (PMEL_HUMAN)
YMAEADLSYQ

SEQ ID NO: 126213 - protein, 9 aa, Artificial Sequence
  Description of Artificial Sequence: Synthetic peptide
  Seed: MAVVLASLI (PMEL_HUMAN)
MPVVLASLV

SEQ ID NO: 126214 - protein, 10 aa, Artificial Sequence
  Description of Artificial Sequence: Synthetic peptide
  Seed: VPQLPHSSSH (PMEL_HUMAN)
VQQLPHSSSF

SEQ ID NO: 126215 - protein, 10 aa, Artificial Sequence
  Description of Artificial Sequence: Synthetic peptide
  Seed: EVISTAPVQM (PMEL_HUMAN)
ELISTAPVQR

SEQ ID NO: 126216 - protein, 9 aa, Artificial Sequence
  Description of Artificial Sequence: Synthetic peptide
  Seed: RLVKRQVPL (PMEL_HUMAN)
RFVKRQVPK

SEQ ID NO: 126217 - protein, 9 aa, Artificial Sequence
  Description of Artificial Sequence: Synthetic peptide
  Seed: ALNFPGSQK (PMEL_HUMAN)
AMNFPGSQR

SEQ ID NO: 126218 - protein, 10 aa, Artificial Sequence
  Description of Artificial Sequence: Synthetic peptide
  Seed: GPLLDGTATL (PMEL_HUMAN)
GQLLDGTATI

SEQ ID NO: 126219 - protein, 9 aa, Artificial Sequence
  Description of Artificial Sequence: Synthetic peptide
  Seed: GSRSYVPLA (PMEL_HUMAN)
GTRSYVPLA

SEQ ID NO: 126220 - protein, 10 aa, Artificial Sequence
  Description of Artificial Sequence: Synthetic peptide
  Seed: VSLADTNSLA (PMEL_HUMAN)
VPLADTNSLV

SEQ ID NO: 126221 - protein, 10 aa, Artificial Sequence
  Description of Artificial Sequence: Synthetic peptide
  Seed: ALLAVGATKV (PMEL_HUMAN)
AMLAVGATKR

SEQ ID NO: 126222 - protein, 9 aa, Artificial Sequence
  Description of Artificial Sequence: Synthetic peptide
  Seed: LYPEWTEAQ (PMEL_HUMAN)
LFPEWTEAV

SEQ ID NO: 126223 - protein, 11 aa, Artificial Sequence
  Description of Artificial Sequence: Synthetic peptide
  Seed: YLAEADLSYTW (PMEL_HUMAN)
YVAEADLSYTW

SEQ ID NO: 126224 - protein, 10 aa, Artificial Sequence
  Description of Artificial Sequence: Synthetic peptide
  Seed: RRLMKQDFSV (PMEL_HUMAN)
RALMKQDFSL

SEQ ID NO: 126225 - protein, 11 aa, Artificial Sequence
  Description of Artificial Sequence: Synthetic peptide
  Seed: IALNFPGSQKV (PMEL_HUMAN)
IFLNFPGSQKV

SEQ ID NO: 126226 - protein, 9 aa, Artificial Sequence
  Description of Artificial Sequence: Synthetic peptide
  Seed: QVIWVNNTI (PMEL_HUMAN)
QLIWVNNTR

SEQ ID NO: 126227 - protein, 9 aa, Artificial Sequence
  Description of Artificial Sequence: Synthetic peptide
  Seed: GQVPLIVGI (PMEL_HUMAN)
GEVPLIVGC

SEQ ID NO: 126228 - protein, 9 aa, Artificial Sequence
  Description of Artificial Sequence: Synthetic peptide
  Seed: VSVSQLRAL (PMEL_HUMAN)
VVVSQLRAM

SEQ ID NO: 126229 - protein, 9 aa, Artificial Sequence
  Description of Artificial Sequence: Synthetic peptide
  Seed: VQVPTTEVI (PMEL_HUMAN)
VYVPTTEVL

SEQ ID NO: 126230 - protein, 11 aa, Artificial Sequence
  Description of Artificial Sequence: Synthetic peptide
  Seed: GYLAEADLSYT (PMEL_HUMAN)
GMLAEADLSYL

SEQ ID NO: 126231 - protein, 9 aa, Artificial Sequence
  Description of Artificial Sequence: Synthetic peptide
  Seed: GTYCLNVSL (PMEL_HUMAN)
GMYCLNVSL

SEQ ID NO: 126232 - protein, 10 aa, Artificial Sequence
  Description of Artificial Sequence: Synthetic peptide
  Seed: SVPQLPHSSS (PMEL_HUMAN)
STPQLPHSSL

SEQ ID NO: 126233 - protein, 9 aa, Artificial Sequence
  Description of Artificial Sequence: Synthetic peptide
  Seed: TLISRALVV (PMEL_HUMAN)
TMISRALVM

SEQ ID NO: 126234 - protein, 9 aa, Artificial Sequence
  Description of Artificial Sequence: Synthetic peptide
  Seed: LPIPEPEGP (PMEL_HUMAN)
LPIPEPEGI

SEQ ID NO: 126235 - protein, 10 aa, Artificial Sequence
  Description of Artificial Sequence: Synthetic peptide
  Seed: MTPAEVSIVV (PMEL_HUMAN)
MKPAEVSIVV

SEQ ID NO: 126236 - protein, 9 aa, Artificial Sequence
  Description of Artificial Sequence: Synthetic peptide
  Seed: ISRALVVTH (PMEL_HUMAN)
IYRALVVTK

SEQ ID NO: 126237 - protein, 11 aa, Artificial Sequence
  Description of Artificial Sequence: Synthetic peptide
  Seed: TWDFGDSSGTL (PMEL_HUMAN)
TTDFGDSSGTM

SEQ ID NO: 126238 - protein, 10 aa, Artificial Sequence
  Description of Artificial Sequence: Synthetic peptide
  Seed: TYLEPGPVTA (PMEL_HUMAN)
TYLEPGPVTY

SEQ ID NO: 126239 - protein, 9 aa, Artificial Sequence
  Description of Artificial Sequence: Synthetic peptide
  Seed: VQMPTAEST (PMEL_HUMAN)
VIMPTAESI

SEQ ID NO: 126240 - protein, 8 aa, Artificial Sequence
  Description of Artificial Sequence: Synthetic peptide
  Seed: FGDSSGTL (PMEL_HUMAN)
FTDSSGTL

SEQ ID NO: 126241 - protein, 10 aa, Artificial Sequence
  Description of Artificial Sequence: Synthetic peptide
  Seed: STAPVQMPTA (PMEL_HUMAN)
SLAPVQMPTL

SEQ ID NO: 126242 - protein, 9 aa, Artificial Sequence
  Description of Artificial Sequence: Synthetic peptide
  Seed: VPLAHSSSA (PMEL_HUMAN)
VALAHSSSM

SEQ ID NO: 126243 - protein, 9 aa, Artificial Sequence
  Description of Artificial Sequence: Synthetic peptide
  Seed: RTKAWNRQL (PMEL_HUMAN)
RFKAWNRQA

SEQ ID NO: 126244 - protein, 9 aa, Artificial Sequence
  Description of Artificial Sequence: Synthetic peptide
  Seed: VLMAVVLAS (PMEL_HUMAN)
VMMAVVLAC

SEQ ID NO: 126245 - protein, 9 aa, Artificial Sequence
  Description of Artificial Sequence: Synthetic peptide
  Seed: AVIGALLAV (PMEL_HUMAN)
AQIGALLAM

SEQ ID NO: 126246 - protein, 9 aa, Artificial Sequence
  Description of Artificial Sequence: Synthetic peptide
  Seed: SLAVVSTQL (PMEL_HUMAN)
STAVVSTQV

SEQ ID NO: 126247 - protein, 10 aa, Artificial Sequence
  Description of Artificial Sequence: Synthetic peptide
  Seed: LLDGTATLRL (PMEL_HUMAN)
LADGTATLRL

SEQ ID NO: 126248 - protein, 9 aa, Artificial Sequence
  Description of Artificial Sequence: Synthetic peptide
  Seed: ITDQVPFSV (PMEL_HUMAN)
IYDQVPFSY

SEQ ID NO: 126249 - protein, 9 aa, Artificial Sequence
  Description of Artificial Sequence: Synthetic peptide
  Seed: LTVSCQGGL (PMEL_HUMAN)
LSVSCQGGW

SEQ ID NO: 126250 - protein, 10 aa, Artificial Sequence
  Description of Artificial Sequence: Synthetic peptide
  Seed: RQVPLDCVLY (PMEL_HUMAN)
RVVPLDCVLF

SEQ ID NO: 126251 - protein, 10 aa, Artificial Sequence
  Description of Artificial Sequence: Synthetic peptide
  Seed: SGTYCLNVSL (PMEL_HUMAN)
SGTYCLNVSV

SEQ ID NO: 126252 - protein, 10 aa, Artificial Sequence
  Description of Artificial Sequence: Synthetic peptide
  Seed: RRLMKQDFSV (PMEL_HUMAN)
RVLMKQDFSV

SEQ ID NO: 126253 - protein, 9 aa, Artificial Sequence
  Description of Artificial Sequence: Synthetic peptide
  Seed: LMAVVLASL (PMEL_HUMAN)
LVAVVLASA

SEQ ID NO: 126254 - protein, 9 aa, Artificial Sequence
  Description of Artificial Sequence: Synthetic peptide
  Seed: DAFELTVSC (PMEL_HUMAN)
DRFELTVSL

SEQ ID NO: 126255 - protein, 9 aa, Artificial Sequence
  Description of Artificial Sequence: Synthetic peptide
  Seed: YLAEADLSY (PMEL_HUMAN)
YPAEADLSH

SEQ ID NO: 126256 - protein, 9 aa, Artificial Sequence
  Description of Artificial Sequence: Synthetic peptide
  Seed: ITDQVPFSV (PMEL_HUMAN)
IVDQVPFSL

SEQ ID NO: 126257 - protein, 10 aa, Artificial Sequence
  Description of Artificial Sequence: Synthetic peptide
  Seed: EVISTAPVQM (PMEL_HUMAN)
EAISTAPVQV

SEQ ID NO: 126258 - protein, 9 aa, Artificial Sequence
  Description of Artificial Sequence: Synthetic peptide
  Seed: GTYCLNVSL (PMEL_HUMAN)
GSYCLNVSM

SEQ ID NO: 126259 - protein, 9 aa, Artificial Sequence
  Description of Artificial Sequence: Synthetic peptide
  Seed: ALVVTHTYL (PMEL_HUMAN)
AQVVTHTYW

SEQ ID NO: 126260 - protein, 9 aa, Artificial Sequence
  Description of Artificial Sequence: Synthetic peptide
  Seed: AQVTTTEWV (PMEL_HUMAN)
AVVTTTEWI

SEQ ID NO: 126261 - protein, 9 aa, Artificial Sequence
  Description of Artificial Sequence: Synthetic peptide
  Seed: VSLADTNSL (PMEL_HUMAN)
VKLADTNSL

SEQ ID NO: 126262 - protein, 9 aa, Artificial Sequence
  Description of Artificial Sequence: Synthetic peptide
  Seed: SQVWGGQPV (PMEL_HUMAN)
SHVWGGQPL

SEQ ID NO: 126263 - protein, 9 aa, Artificial Sequence
  Description of Artificial Sequence: Synthetic peptide
  Seed: RTKAWNRQL (PMEL_HUMAN)
RWKAWNRQK

SEQ ID NO: 126264 - protein, 10 aa, Artificial Sequence
  Description of Artificial Sequence: Synthetic peptide
  Seed: LVLMAVVLAS (PMEL_HUMAN)
LQLMAVVLAV

SEQ ID NO: 126265 - protein, 9 aa, Artificial Sequence
  Description of Artificial Sequence: Synthetic peptide
  Seed: VISTAPVQM (PMEL_HUMAN)
VVSTAPVQV

SEQ ID NO: 126266 - protein, 10 aa, Artificial Sequence
  Description of Artificial Sequence: Synthetic peptide
  Seed: RGSRSYVPLA (PMEL_HUMAN)
RNSRSYVPLM

SEQ ID NO: 126267 - protein, 10 aa, Artificial Sequence
  Description of Artificial Sequence: Synthetic peptide
  Seed: RQLYPEWTEA (PMEL_HUMAN)
RSLYPEWTEL

SEQ ID NO: 126268 - protein, 9 aa, Artificial Sequence
  Description of Artificial Sequence: Synthetic peptide
  Seed: AQRLCQPVL (PMEL_HUMAN)
ASRLCQPVI

SEQ ID NO: 126269 - protein, 9 aa, Artificial Sequence
  Description of Artificial Sequence: Synthetic peptide
  Seed: SQKRSFVYV (PMEL_HUMAN)
SSKRSFVYS

SEQ ID NO: 126270 - protein, 10 aa, Artificial Sequence
  Description of Artificial Sequence: Synthetic peptide
  Seed: YVPLAHSSSA (PMEL_HUMAN)
YAPLAHSSSA

SEQ ID NO: 126271 - protein, 9 aa, Artificial Sequence
  Description of Artificial Sequence: Synthetic peptide
  Seed: EGDAFELTV (PMEL_HUMAN)
EVDAFELTL

SEQ ID NO: 126272 - protein, 10 aa, Artificial Sequence
  Description of Artificial Sequence: Synthetic peptide
  Seed: LNFPGSQKVL (PMEL_HUMAN)
LAFPGSQKVM

SEQ ID NO: 126273 - protein, 11 aa, Artificial Sequence
  Description of Artificial Sequence: Synthetic peptide
  Seed: QAVPSGEGDAF (PMEL_HUMAN)
QLVPSGEGDAW

SEQ ID NO: 126274 - protein, 8 aa, Artificial Sequence
  Description of Artificial Sequence: Synthetic peptide
  Seed: QDFSVPQL (PMEL_HUMAN)
QSFSVPQV

SEQ ID NO: 126275 - protein, 9 aa, Artificial Sequence
  Description of Artificial Sequence: Synthetic peptide
  Seed: CPSGSWSQK (PMEL_HUMAN)
CTSGSWSQR

SEQ ID NO: 126276 - protein, 9 aa, Artificial Sequence
  Description of Artificial Sequence: Synthetic peptide
  Seed: FSVSVSQLR (PMEL_HUMAN)
FGVSVSQLR

SEQ ID NO: 126277 - protein, 10 aa, Artificial Sequence
  Description of Artificial Sequence: Synthetic peptide
  Seed: GDSSGTLISR (PMEL_HUMAN)
GWSSGTLISK

SEQ ID NO: 126278 - protein, 9 aa, Artificial Sequence
  Description of Artificial Sequence: Synthetic peptide
  Seed: SSPGCQPPA (PMEL_HUMAN)
SLPGCQPPV

SEQ ID NO: 126279 - protein, 9 aa, Artificial Sequence
  Description of Artificial Sequence: Synthetic peptide
  Seed: VQMPTAEST (PMEL_HUMAN)
VGMPTAESF

SEQ ID NO: 126280 - protein, 9 aa, Artificial Sequence
  Description of Artificial Sequence: Synthetic peptide
  Seed: YRYGSFSVT (PMEL_HUMAN)
YQYGSFSVY

SEQ ID NO: 126281 - protein, 10 aa, Artificial Sequence
  Description of Artificial Sequence: Synthetic peptide
  Seed: ALQLHDPSGY (PMEL_HUMAN)
ATQLHDPSGY

SEQ ID NO: 126282 - protein, 9 aa, Artificial Sequence
  Description of Artificial Sequence: Synthetic peptide
  Seed: YLAEADLSY (PMEL_HUMAN)
YRAEADLSF

SEQ ID NO: 126283 - protein, 11 aa, Artificial Sequence
  Description of Artificial Sequence: Synthetic peptide
  Seed: MAVVLASLIYR (PMEL_HUMAN)
MHVVLASLIYR

SEQ ID NO: 126284 - protein, 10 aa, Artificial Sequence
  Description of Artificial Sequence: Synthetic peptide
  Seed: SSAFTITDQV (PMEL_HUMAN)
SVAFTITDQV

SEQ ID NO: 126285 - protein, 9 aa, Artificial Sequence
  Description of Artificial Sequence: Synthetic peptide
  Seed: VLKRCLLHL (PMEL_HUMAN)
VMKRCLLHA

SEQ ID NO: 126286 - protein, 10 aa, Artificial Sequence
  Description of Artificial Sequence: Synthetic peptide
  Seed: RYGSFSVTLD (PMEL_HUMAN)
RFGSFSVTLF

SEQ ID NO: 126287 - protein, 9 aa, Artificial Sequence
  Description of Artificial Sequence: Synthetic peptide
  Seed: LQAAIPLTS (PMEL_HUMAN)
LEAAIPLTY

SEQ ID NO: 126288 - protein, 9 aa, Artificial Sequence
  Description of Artificial Sequence: Synthetic peptide
  Seed: LQAAIPLTS (PMEL_HUMAN)
LHAAIPLTF

SEQ ID NO: 126289 - protein, 10 aa, Artificial Sequence
  Description of Artificial Sequence: Synthetic peptide
  Seed: YGSFSVTLDI (PMEL_HUMAN)
YFSFSVTLDF

SEQ ID NO: 126290 - protein, 11 aa, Artificial Sequence
  Description of Artificial Sequence: Synthetic peptide
  Seed: FGDSSGTLISR (PMEL_HUMAN)
FIDSSGTLISL

SEQ ID NO: 126291 - protein, 9 aa, Artificial Sequence
  Description of Artificial Sequence: Synthetic peptide
  Seed: YVWKTWGQY (PMEL_HUMAN)
YVWKTWGQW

SEQ ID NO: 126292 - protein, 9 aa, Artificial Sequence
  Description of Artificial Sequence: Synthetic peptide
  Seed: RLMKQDFSV (PMEL_HUMAN)
RQMKQDFSI

SEQ ID NO: 126293 - protein, 8 aa, Artificial Sequence
  Description of Artificial Sequence: Synthetic peptide
  Seed: LADTNSLA (PMEL_HUMAN)
LQDTNSLL

SEQ ID NO: 126294 - protein, 9 aa, Artificial Sequence
  Description of Artificial Sequence: Synthetic peptide
  Seed: HTMEVTVYH (PMEL_HUMAN)
HPMEVTVYV

SEQ ID NO: 126295 - protein, 9 aa, Artificial Sequence
  Description of Artificial Sequence: Synthetic peptide
  Seed: RIFCSCPIG (PMEL_HUMAN)
RVFCSCPIK

SEQ ID NO: 126296 - protein, 10 aa, Artificial Sequence
  Description of Artificial Sequence: Synthetic peptide
  Seed: AVPSGEGDAF (PMEL_HUMAN)
AIPSGEGDAY

SEQ ID NO: 126297 - protein, 9 aa, Artificial Sequence
  Description of Artificial Sequence: Synthetic peptide
  Seed: ALDGGNKHF (PMEL_HUMAN)
AVDGGNKHL

SEQ ID NO: 126298 - protein, 9 aa, Artificial Sequence
  Description of Artificial Sequence: Synthetic peptide
  Seed: SQVWGGQPV (PMEL_HUMAN)
SLVWGGQPA

SEQ ID NO: 126299 - protein, 10 aa, Artificial Sequence
  Description of Artificial Sequence: Synthetic peptide
  Seed: SGTYCLNVSL (PMEL_HUMAN)
SFTYCLNVSV

SEQ ID NO: 126300 - protein, 9 aa, Artificial Sequence
  Description of Artificial Sequence: Synthetic peptide
  Seed: HTMEVTVYH (PMEL_HUMAN)
HSMEVTVYR

SEQ ID NO: 126301 - protein, 9 aa, Artificial Sequence
  Description of Artificial Sequence: Synthetic peptide
  Seed: TTPGQAPTA (PMEL_HUMAN)
TQPGQAPTL

SEQ ID NO: 126302 - protein, 10 aa, Artificial Sequence
  Description of Artificial Sequence: Synthetic peptide
  Seed: SCPIGENSPL (PMEL_HUMAN)
SWPIGENSPM

SEQ ID NO: 126303 - protein, 10 aa, Artificial Sequence
  Description of Artificial Sequence: Synthetic peptide
  Seed: MTPAEVSIVV (PMEL_HUMAN)
MWPAEVSIVL

SEQ ID NO: 126304 - protein, 9 aa, Artificial Sequence
  Description of Artificial Sequence: Synthetic peptide
  Seed: LAVVSTQLI (PMEL_HUMAN)
LAVVSTQLF

SEQ ID NO: 126305 - protein, 9 aa, Artificial Sequence
  Description of Artificial Sequence: Synthetic peptide
  Seed: QGIESAEIL (PMEL_HUMAN)
QAIESAEIM

SEQ ID NO: 126306 - protein, 9 aa, Artificial Sequence
  Description of Artificial Sequence: Synthetic peptide
  Seed: AGLGQVPLI (PMEL_HUMAN)
AALGQVPLM

SEQ ID NO: 126307 - protein, 11 aa, Artificial Sequence
  Description of Artificial Sequence: Synthetic peptide
  Seed: RELPIPEPEGP (PMEL_HUMAN)
RELPIPEPEGV

SEQ ID NO: 126308 - protein, 9 aa, Artificial Sequence
  Description of Artificial Sequence: Synthetic peptide
  Seed: MLGTHTMEV (PMEL_HUMAN)
MAGTHTMEF

SEQ ID NO: 126309 - protein, 9 aa, Artificial Sequence
  Description of Artificial Sequence: Synthetic peptide
  Seed: VLPSPACQL (PMEL_HUMAN)
VLPSPACQM

SEQ ID NO: 126310 - protein, 10 aa, Artificial Sequence
  Description of Artificial Sequence: Synthetic peptide
  Seed: EVVGTTPGQA (PMEL_HUMAN)
ETVGTTPGQL

SEQ ID NO: 126311 - protein, 10 aa, Artificial Sequence
  Description of Artificial Sequence: Synthetic peptide
  Seed: TITDQVPFSV (PMEL_HUMAN)
TLTDQVPFSV

SEQ ID NO: 126312 - protein, 10 aa, Artificial Sequence
  Description of Artificial Sequence: Synthetic peptide
  Seed: YVPLAHSSSA (PMEL_HUMAN)
YRPLAHSSSA

SEQ ID NO: 126313 - protein, 10 aa, Artificial Sequence
  Description of Artificial Sequence: Synthetic peptide
  Seed: AEILQAVPSG (PMEL_HUMAN)
AEILQAVPSI

SEQ ID NO: 126314 - protein, 9 aa, Artificial Sequence
  Description of Artificial Sequence: Synthetic peptide
  Seed: ESAEILQAV (PMEL_HUMAN)
ESAEILQAI

SEQ ID NO: 126315 - protein, 10 aa, Artificial Sequence
  Description of Artificial Sequence: Synthetic peptide
  Seed: MKQDFSVPQL (PMEL_HUMAN)
MEQDFSVPQF

SEQ ID NO: 126316 - protein, 10 aa, Artificial Sequence
  Description of Artificial Sequence: Synthetic peptide
  Seed: VLMAVVLASL (PMEL_HUMAN)
VMMAVVLASL

SEQ ID NO: 126317 - protein, 9 aa, Artificial Sequence
  Description of Artificial Sequence: Synthetic peptide
  Seed: MSTPEATGM (PMEL_HUMAN)
MMTPEATGW

SEQ ID NO: 126318 - protein, 9 aa, Artificial Sequence
  Description of Artificial Sequence: Synthetic peptide
  Seed: VTLDIVQGI (PMEL_HUMAN)
VILDIVQGR

SEQ ID NO: 126319 - protein, 9 aa, Artificial Sequence
  Description of Artificial Sequence: Synthetic peptide
  Seed: YRYGSFSVT (PMEL_HUMAN)
YAYGSFSVL

SEQ ID NO: 126320 - protein, 10 aa, Artificial Sequence
  Description of Artificial Sequence: Synthetic peptide
  Seed: LSIGTGRAML (PMEL_HUMAN)
LSIGTGRAMW

SEQ ID NO: 126321 - protein, 10 aa, Artificial Sequence
  Description of Artificial Sequence: Synthetic peptide
  Seed: GPLLDGTATL (PMEL_HUMAN)
GVLLDGTATA

SEQ ID NO: 126322 - protein, 9 aa, Artificial Sequence
  Description of Artificial Sequence: Synthetic peptide
  Seed: KEACMEISS (PMEL_HUMAN)
KEACMEISA

SEQ ID NO: 126323 - protein, 9 aa, Artificial Sequence
  Description of Artificial Sequence: Synthetic peptide
  Seed: IGANASFSI (PMEL_HUMAN)
IAANASFSL

SEQ ID NO: 126324 - protein, 9 aa, Artificial Sequence
  Description of Artificial Sequence: Synthetic peptide
  Seed: LPDGQVIWV (PMEL_HUMAN)
LIDGQVIWI

SEQ ID NO: 126325 - protein, 10 aa, Artificial Sequence
  Description of Artificial Sequence: Synthetic peptide
  Seed: RALDGGNKHF (PMEL_HUMAN)
RYLDGGNKHY

SEQ ID NO: 126326 - protein, 9 aa, Artificial Sequence
  Description of Artificial Sequence: Synthetic peptide
  Seed: YLEPGPVTA (PMEL_HUMAN)
YAEPGPVTH

SEQ ID NO: 126327 - protein, 9 aa, Artificial Sequence
  Description of Artificial Sequence: Synthetic peptide
  Seed: HTMEVTVYH (PMEL_HUMAN)
HLMEVTVYY

SEQ ID NO: 126328 - protein, 10 aa, Artificial Sequence
  Description of Artificial Sequence: Synthetic peptide
  Seed: MPTAESTGMT (PMEL_HUMAN)
MGTAESTGMA

SEQ ID NO: 126329 - protein, 10 aa, Artificial Sequence
  Description of Artificial Sequence: Synthetic peptide
  Seed: ALNFPGSQKV (PMEL_HUMAN)
ALNFPGSQKL

SEQ ID NO: 126330 - protein, 9 aa, Artificial Sequence
  Description of Artificial Sequence: Synthetic peptide
  Seed: LYRYGSFSV (PMEL_HUMAN)
LARYGSFSK

SEQ ID NO: 126331 - protein, 9 aa, Artificial Sequence
  Description of Artificial Sequence: Synthetic peptide
  Seed: LMAVVLASL (PMEL_HUMAN)
LSAVVLASL

SEQ ID NO: 126332 - protein, 9 aa, Artificial Sequence
  Description of Artificial Sequence: Synthetic peptide
  Seed: SSHWLRLPR (PMEL_HUMAN)
SAHWLRLPR

SEQ ID NO: 126333 - protein, 9 aa, Artificial Sequence
  Description of Artificial Sequence: Synthetic peptide
  Seed: AHSSSAFTI (PMEL_HUMAN)
AESSSAFTF

SEQ ID NO: 126334 - protein, 10 aa, Artificial Sequence
  Description of Artificial Sequence: Synthetic peptide
  Seed: AMLGTHTMEV (PMEL_HUMAN)
AYLGTHTMEV

SEQ ID NO: 126335 - protein, 10 aa, Artificial Sequence
  Description of Artificial Sequence: Synthetic peptide
  Seed: RQLYPEWTEA (PMEL_HUMAN)
RKLYPEWTEY

SEQ ID NO: 126336 - protein, 9 aa, Artificial Sequence
  Description of Artificial Sequence: Synthetic peptide
  Seed: VLPSPACQL (PMEL_HUMAN)
VAPSPACQM

SEQ ID NO: 126337 - protein, 10 aa, Artificial Sequence
  Description of Artificial Sequence: Synthetic peptide
  Seed: GYLAEADLSY (PMEL_HUMAN)
GRLAEADLSY

SEQ ID NO: 126338 - protein, 8 aa, Artificial Sequence
  Description of Artificial Sequence: Synthetic peptide
  Seed: HTMEVTVY (PMEL_HUMAN)
HMMEVTVY

SEQ ID NO: 126339 - protein, 9 aa, Artificial Sequence
  Description of Artificial Sequence: Synthetic peptide
  Seed: LADTNSLAV (PMEL_HUMAN)
LGDTNSLAM

SEQ ID NO: 126340 - protein, 11 aa, Artificial Sequence
  Description of Artificial Sequence: Synthetic peptide
  Seed: TWDFGDSSGTL (PMEL_HUMAN)
TVDFGDSSGTM

SEQ ID NO: 126341 - protein, 10 aa, Artificial Sequence
  Description of Artificial Sequence: Synthetic peptide
  Seed: LHLAVIGALL (PMEL_HUMAN)
LRLAVIGALL

SEQ ID NO: 126342 - protein, 10 aa, Artificial Sequence
  Description of Artificial Sequence: Synthetic peptide
  Seed: RGSRSYVPLA (PMEL_HUMAN)
RISRSYVPLY

SEQ ID NO: 126343 - protein, 10 aa, Artificial Sequence
  Description of Artificial Sequence: Synthetic peptide
  Seed: GLSIGTGRAM (PMEL_HUMAN)
GMSIGTGRAY

SEQ ID NO: 126344 - protein, 9 aa, Artificial Sequence
  Description of Artificial Sequence: Synthetic peptide
  Seed: YLAEADLSY (PMEL_HUMAN)
YLAEADLSA

SEQ ID NO: 126345 - protein, 10 aa, Artificial Sequence
  Description of Artificial Sequence: Synthetic peptide
  Seed: CQLVLHQILK (PMEL_HUMAN)
CYLVLHQILR

SEQ ID NO: 126346 - protein, 9 aa, Artificial Sequence
  Description of Artificial Sequence: Synthetic peptide
  Seed: AEPSGTTSV (PMEL_HUMAN)
AGPSGTTSI

SEQ ID NO: 126347 - protein, 11 aa, Artificial Sequence
  Description of Artificial Sequence: Synthetic peptide
  Seed: SGLSIGTGRAM (PMEL_HUMAN)
SSLSIGTGRAY

SEQ ID NO: 126348 - protein, 11 aa, Artificial Sequence
  Description of Artificial Sequence: Synthetic peptide
  Seed: FGDSSGTLISR (PMEL_HUMAN)
FIDSSGTLISV

SEQ ID NO: 126349 - protein, 10 aa, Artificial Sequence
  Description of Artificial Sequence: Synthetic peptide
  Seed: ALDGGNKHFL (PMEL_HUMAN)
ALDGGNKHFY

SEQ ID NO: 126350 - protein, 10 aa, Artificial Sequence
  Description of Artificial Sequence: Synthetic peptide
  Seed: EVSIVVLSGT (PMEL_HUMAN)
ECSIVVLSGV

SEQ ID NO: 126351 - protein, 9 aa, Artificial Sequence
  Description of Artificial Sequence: Synthetic peptide
  Seed: ASFSIALNF (PMEL_HUMAN)
AWFSIALNW

SEQ ID NO: 126352 - protein, 9 aa, Artificial Sequence
  Description of Artificial Sequence: Synthetic peptide
  Seed: ASFSIALNF (PMEL_HUMAN)
APFSIALNF

SEQ ID NO: 126353 - protein, 10 aa, Artificial Sequence
  Description of Artificial Sequence: Synthetic peptide
  Seed: MPTAESTGMT (PMEL_HUMAN)
MVTAESTGMV

SEQ ID NO: 126354 - protein, 8 aa, Artificial Sequence
  Description of Artificial Sequence: Synthetic peptide
  Seed: LADTNSLA (PMEL_HUMAN)
LIDTNSLF

SEQ ID NO: 126355 - protein, 9 aa, Artificial Sequence
  Description of Artificial Sequence: Synthetic peptide
  Seed: AEVSIVVLS (PMEL_HUMAN)
AEVSIVVLI

SEQ ID NO: 126356 - protein, 10 aa, Artificial Sequence
  Description of Artificial Sequence: Synthetic peptide
  Seed: ESAEILQAVP (PMEL_HUMAN)
ESAEILQAVV

SEQ ID NO: 126357 - protein, 9 aa, Artificial Sequence
  Description of Artificial Sequence: Synthetic peptide
  Seed: LTSCGSSPV (PMEL_HUMAN)
LLSCGSSPV

SEQ ID NO: 126358 - protein, 9 aa, Artificial Sequence
  Description of Artificial Sequence: Synthetic peptide
  Seed: SAFTITDQV (PMEL_HUMAN)
SVFTITDQM

SEQ ID NO: 126359 - protein, 9 aa, Artificial Sequence
  Description of Artificial Sequence: Synthetic peptide
  Seed: MTPEKVPVS (PMEL_HUMAN)
MCPEKVPVI

SEQ ID NO: 126360 - protein, 9 aa, Artificial Sequence
  Description of Artificial Sequence: Synthetic peptide
  Seed: FGDSSGTLI (PMEL_HUMAN)
FMDSSGTLL

SEQ ID NO: 126361 - protein, 9 aa, Artificial Sequence
  Description of Artificial Sequence: Synthetic peptide
  Seed: VISTAPVQM (PMEL_HUMAN)
VMSTAPVQI

SEQ ID NO: 126362 - protein, 9 aa, Artificial Sequence
  Description of Artificial Sequence: Synthetic peptide
  Seed: LNFPGSQKV (PMEL_HUMAN)
LTFPGSQKF

SEQ ID NO: 126363 - protein, 9 aa, Artificial Sequence
  Description of Artificial Sequence: Synthetic peptide
  Seed: PLLDGTATL (PMEL_HUMAN)
PMLDGTATF

SEQ ID NO: 126364 - protein, 10 aa, Artificial Sequence
  Description of Artificial Sequence: Synthetic peptide
  Seed: MTPAEVSIVV (PMEL_HUMAN)
MDPAEVSIVM

SEQ ID NO: 126365 - protein, 9 aa, Artificial Sequence
  Description of Artificial Sequence: Synthetic peptide
  Seed: SGTLISRAL (PMEL_HUMAN)
SQTLISRAV

SEQ ID NO: 126366 - protein, 8 aa, Artificial Sequence
  Description of Artificial Sequence: Synthetic peptide
  Seed: TEVVGTTP (PMEL_HUMAN)
TEVVGTTV

SEQ ID NO: 126367 - protein, 9 aa, Artificial Sequence
  Description of Artificial Sequence: Synthetic peptide
  Seed: AEPSGTTSV (PMEL_HUMAN)
AIPSGTTSI

SEQ ID NO: 126368 - protein, 9 aa, Artificial Sequence
  Description of Artificial Sequence: Synthetic peptide
  Seed: LIYRRRLMK (PMEL_HUMAN)
LMYRRRLMR

SEQ ID NO: 126369 - protein, 10 aa, Artificial Sequence
  Description of Artificial Sequence: Synthetic peptide
  Seed: VLMAVVLASL (PMEL_HUMAN)
VTMAVVLASR

SEQ ID NO: 126370 - protein, 10 aa, Artificial Sequence
  Description of Artificial Sequence: Synthetic peptide
  Seed: YLAEADLSYT (PMEL_HUMAN)
YQAEADLSYL

SEQ ID NO: 126371 - protein, 9 aa, Artificial Sequence
  Description of Artificial Sequence: Synthetic peptide
  Seed: KTWGQYWQV (PMEL_HUMAN)
KKWGQYWQY

SEQ ID NO: 126372 - protein, 10 aa, Artificial Sequence
  Description of Artificial Sequence: Synthetic peptide
  Seed: KTWGQYWQVL (PMEL_HUMAN)
KLWGQYWQVA

SEQ ID NO: 126373 - protein, 9 aa, Artificial Sequence
  Description of Artificial Sequence: Synthetic peptide
  Seed: SFVYVWKTW (PMEL_HUMAN)
SWVYVWKTI

SEQ ID NO: 126374 - protein, 9 aa, Artificial Sequence
  Description of Artificial Sequence: Synthetic peptide
  Seed: SVQVPTTEV (PMEL_HUMAN)
SVQVPTTEF

SEQ ID NO: 126375 - protein, 9 aa, Artificial Sequence
  Description of Artificial Sequence: Synthetic peptide
  Seed: LADTNSLAV (PMEL_HUMAN)
LLDTNSLAI

SEQ ID NO: 126376 - protein, 10 aa, Artificial Sequence
  Description of Artificial Sequence: Synthetic peptide
  Seed: AVIGALLAVG (PMEL_HUMAN)
AMIGALLAVW

SEQ ID NO: 126377 - protein, 11 aa, Artificial Sequence
  Description of Artificial Sequence: Synthetic peptide
  Seed: QAVPSGEGDAF (PMEL_HUMAN)
QQVPSGEGDAF

SEQ ID NO: 126378 - protein, 11 aa, Artificial Sequence
  Description of Artificial Sequence: Synthetic peptide
  Seed: AMLGTHTMEVT (PMEL_HUMAN)
AMLGTHTMEVV

SEQ ID NO: 126379 - protein, 11 aa, Artificial Sequence
  Description of Artificial Sequence: Synthetic peptide
  Seed: RALDGGNKHFL (PMEL_HUMAN)
RALDGGNKHFF

SEQ ID NO: 126380 - protein, 9 aa, Artificial Sequence
  Description of Artificial Sequence: Synthetic peptide
  Seed: VTLDIVQGI (PMEL_HUMAN)
VILDIVQGY

SEQ ID NO: 126381 - protein, 9 aa, Artificial Sequence
  Description of Artificial Sequence: Synthetic peptide
  Seed: KTWGQYWQV (PMEL_HUMAN)
KVWGQYWQK

SEQ ID NO: 126382 - protein, 10 aa, Artificial Sequence
  Description of Artificial Sequence: Synthetic peptide
  Seed: MTPAEVSIVV (PMEL_HUMAN)
MEPAEVSIVM

SEQ ID NO: 126383 - protein, 10 aa, Artificial Sequence
  Description of Artificial Sequence: Synthetic peptide
  Seed: RALVVTHTYL (PMEL_HUMAN)
RHLVVTHTYY

SEQ ID NO: 126384 - protein, 9 aa, Artificial Sequence
  Description of Artificial Sequence: Synthetic peptide
  Seed: RAMLGTHTM (PMEL_HUMAN)
RVMLGTHTK

SEQ ID NO: 126385 - protein, 9 aa, Artificial Sequence
  Description of Artificial Sequence: Synthetic peptide
  Seed: VSLADTNSL (PMEL_HUMAN)
VMLADTNSL

SEQ ID NO: 126386 - protein, 10 aa, Artificial Sequence
  Description of Artificial Sequence: Synthetic peptide
  Seed: YLAEADLSYT (PMEL_HUMAN)
YIAEADLSYA

SEQ ID NO: 126387 - protein, 9 aa, Artificial Sequence
  Description of Artificial Sequence: Synthetic peptide
  Seed: VTLDIVQGI (PMEL_HUMAN)
VILDIVQGV

SEQ ID NO: 126388 - protein, 10 aa, Artificial Sequence
  Description of Artificial Sequence: Synthetic peptide
  Seed: LVLMAVVLAS (PMEL_HUMAN)
LNLMAVVLAV

SEQ ID NO: 126389 - protein, 9 aa, Artificial Sequence
  Description of Artificial Sequence: Synthetic peptide
  Seed: YVWKTWGQY (PMEL_HUMAN)
YIWKTWGQK

SEQ ID NO: 126390 - protein, 11 aa, Artificial Sequence
  Description of Artificial Sequence: Synthetic peptide
  Seed: YVPLAHSSSAF (PMEL_HUMAN)
YNPLAHSSSAY

SEQ ID NO: 126391 - protein, 9 aa, Artificial Sequence
  Description of Artificial Sequence: Synthetic peptide
  Seed: SQKRSFVYV (PMEL_HUMAN)
SMKRSFVYK

SEQ ID NO: 126392 - protein, 10 aa, Artificial Sequence
  Description of Artificial Sequence: Synthetic peptide
  Seed: LIMPGQEAGL (PMEL_HUMAN)
LQMPGQEAGV

SEQ ID NO: 126393 - protein, 9 aa, Artificial Sequence
  Description of Artificial Sequence: Synthetic peptide
  Seed: RLMKQDFSV (PMEL_HUMAN)
RVMKQDFSL

SEQ ID NO: 126394 - protein, 9 aa, Artificial Sequence
  Description of Artificial Sequence: Synthetic peptide
  Seed: HQILKGGSG (PMEL_HUMAN)
HHILKGGSA

SEQ ID NO: 126395 - protein, 11 aa, Artificial Sequence
  Description of Artificial Sequence: Synthetic peptide
  Seed: AEMSTPEATGM (PMEL_HUMAN)
AEMSTPEATGV

SEQ ID NO: 126396 - protein, 9 aa, Artificial Sequence
  Description of Artificial Sequence: Synthetic peptide
  Seed: STAPVQMPT (PMEL_HUMAN)
STAPVQMPL

SEQ ID NO: 126397 - protein, 9 aa, Artificial Sequence
  Description of Artificial Sequence: Synthetic peptide
  Seed: CQLVLHQIL (PMEL_HUMAN)
CQLVLHQIF

SEQ ID NO: 126398 - protein, 9 aa, Artificial Sequence
  Description of Artificial Sequence: Synthetic peptide
  Seed: TLIGANASF (PMEL_HUMAN)
TYIGANASL

SEQ ID NO: 126399 - protein, 10 aa, Artificial Sequence
  Description of Artificial Sequence: Synthetic peptide
  Seed: YVPLAHSSSA (PMEL_HUMAN)
YNPLAHSSSM

SEQ ID NO: 126400 - protein, 9 aa, Artificial Sequence
  Description of Artificial Sequence: Synthetic peptide
  Seed: MLGTHTMEV (PMEL_HUMAN)
MQGTHTMEL

SEQ ID NO: 126401 - protein, 9 aa, Artificial Sequence
  Description of Artificial Sequence: Synthetic peptide
  Seed: TTDGHRPTA (PMEL_HUMAN)
TWDGHRPTM

SEQ ID NO: 126402 - protein, 9 aa, Artificial Sequence
  Description of Artificial Sequence: Synthetic peptide
  Seed: GTYCLNVSL (PMEL_HUMAN)
GAYCLNVSY

SEQ ID NO: 126403 - protein, 9 aa, Artificial Sequence
  Description of Artificial Sequence: Synthetic peptide
  Seed: KVLPDGQVI (PMEL_HUMAN)
KLLPDGQVV

SEQ ID NO: 126404 - protein, 9 aa, Artificial Sequence
  Description of Artificial Sequence: Synthetic peptide
  Seed: RYGSFSVTL (PMEL_HUMAN)
RAGSFSVTW

SEQ ID NO: 126405 - protein, 10 aa, Artificial Sequence
  Description of Artificial Sequence: Synthetic peptide
  Seed: MTPAEVSIVV (PMEL_HUMAN)
MNPAEVSIVL

SEQ ID NO: 126406 - protein, 9 aa, Artificial Sequence
  Description of Artificial Sequence: Synthetic peptide
  Seed: AVVLASLIY (PMEL_HUMAN)
AKVLASLIL

SEQ ID NO: 126407 - protein, 10 aa, Artificial Sequence
  Description of Artificial Sequence: Synthetic peptide
  Seed: YRYGSFSVTL (PMEL_HUMAN)
YSYGSFSVTI

SEQ ID NO: 126408 - protein, 9 aa, Artificial Sequence
  Description of Artificial Sequence: Synthetic peptide
  Seed: SVPQLPHSS (PMEL_HUMAN)
SVPQLPHSF

SEQ ID NO: 126409 - protein, 9 aa, Artificial Sequence
  Description of Artificial Sequence: Synthetic peptide
  Seed: VLASLIYRR (PMEL_HUMAN)
VAASLIYRR

SEQ ID NO: 126410 - protein, 9 aa, Artificial Sequence
  Description of Artificial Sequence: Synthetic peptide
  Seed: VTAQVVLQA (PMEL_HUMAN)
VVAQVVLQA

SEQ ID NO: 126411 - protein, 9 aa, Artificial Sequence
  Description of Artificial Sequence: Synthetic peptide
  Seed: MAVVLASLI (PMEL_HUMAN)
MKVVLASLY

SEQ ID NO: 126412 - protein, 10 aa, Artificial Sequence
  Description of Artificial Sequence: Synthetic peptide
  Seed: MTPAEVSIVV (PMEL_HUMAN)
MNPAEVSIVS

SEQ ID NO: 126413 - protein, 9 aa, Artificial Sequence
  Description of Artificial Sequence: Synthetic peptide
  Seed: VVLSGTTAA (PMEL_HUMAN)
VLLSGTTAA

SEQ ID NO: 126414 - protein, 9 aa, Artificial Sequence
  Description of Artificial Sequence: Synthetic peptide
  Seed: LIVGILLVL (PMEL_HUMAN)
LSVGILLVM

SEQ ID NO: 126415 - protein, 9 aa, Artificial Sequence
  Description of Artificial Sequence: Synthetic peptide
  Seed: SVPQLPHSS (PMEL_HUMAN)
STPQLPHSV

SEQ ID NO: 126416 - protein, 10 aa, Artificial Sequence
  Description of Artificial Sequence: Synthetic peptide
  Seed: SQKRSFVYVW (PMEL_HUMAN)
SMKRSFVYVM

SEQ ID NO: 126417 - protein, 9 aa, Artificial Sequence
  Description of Artificial Sequence: Synthetic peptide
  Seed: VSEVMGTTL (PMEL_HUMAN)
VAEVMGTTM

SEQ ID NO: 126418 - protein, 9 aa, Artificial Sequence
  Description of Artificial Sequence: Synthetic peptide
  Seed: GSWSQKRSF (PMEL_HUMAN)
GAWSQKRSY

SEQ ID NO: 126419 - protein, 10 aa, Artificial Sequence
  Description of Artificial Sequence: Synthetic peptide
  Seed: VLMAVVLASL (PMEL_HUMAN)
VVMAVVLASL

SEQ ID NO: 126420 - protein, 9 aa, Artificial Sequence
  Description of Artificial Sequence: Synthetic peptide
  Seed: MSTPEATGM (PMEL_HUMAN)
MITPEATGF

SEQ ID NO: 126421 - protein, 11 aa, Artificial Sequence
  Description of Artificial Sequence: Synthetic peptide
  Seed: VPFSVSVSQLR (PMEL_HUMAN)
VTFSVSVSQLR

SEQ ID NO: 126422 - protein, 11 aa, Artificial Sequence
  Description of Artificial Sequence: Synthetic peptide
  Seed: SLKVSNDGPTL (PMEL_HUMAN)
SAKVSNDGPTF

SEQ ID NO: 126423 - protein, 9 aa, Artificial Sequence
  Description of Artificial Sequence: Synthetic peptide
  Seed: AHSSSAFTI (PMEL_HUMAN)
AKSSSAFTF

SEQ ID NO: 126424 - protein, 10 aa, Artificial Sequence
  Description of Artificial Sequence: Synthetic peptide
  Seed: LIYRRRLMKQ (PMEL_HUMAN)
LVYRRRLMKK

SEQ ID NO: 126425 - protein, 10 aa, Artificial Sequence
  Description of Artificial Sequence: Synthetic peptide
  Seed: IALNFPGSQK (PMEL_HUMAN)
IMLNFPGSQK

SEQ ID NO: 126426 - protein, 9 aa, Artificial Sequence
  Description of Artificial Sequence: Synthetic peptide
  Seed: RAMLGTHTM (PMEL_HUMAN)
RYMLGTHTI

SEQ ID NO: 126427 - protein, 11 aa, Artificial Sequence
  Description of Artificial Sequence: Synthetic peptide
  Seed: CVLYRYGSFSV (PMEL_HUMAN)
CFLYRYGSFSI

SEQ ID NO: 126428 - protein, 8 aa, Artificial Sequence
  Description of Artificial Sequence: Synthetic peptide
  Seed: HTMEVTVY (PMEL_HUMAN)
HMMEVTVM

SEQ ID NO: 126429 - protein, 10 aa, Artificial Sequence
  Description of Artificial Sequence: Synthetic peptide
  Seed: RGSRSYVPLA (PMEL_HUMAN)
RTSRSYVPLF

SEQ ID NO: 126430 - protein, 10 aa, Artificial Sequence
  Description of Artificial Sequence: Synthetic peptide
  Seed: KVLPDGQVIW (PMEL_HUMAN)
KMLPDGQVIF

SEQ ID NO: 126431 - protein, 11 aa, Artificial Sequence
  Description of Artificial Sequence: Synthetic peptide
  Seed: RALDGGNKHFL (PMEL_HUMAN)
RSLDGGNKHFY

SEQ ID NO: 126432 - protein, 10 aa, Artificial Sequence
  Description of Artificial Sequence: Synthetic peptide
  Seed: ILKGGSGTYC (PMEL_HUMAN)
ILKGGSGTYF

SEQ ID NO: 126433 - protein, 9 aa, Artificial Sequence
  Description of Artificial Sequence: Synthetic peptide
  Seed: YVWKTWGQY (PMEL_HUMAN)
YLWKTWGQW

SEQ ID NO: 126434 - protein, 10 aa, Artificial Sequence
  Description of Artificial Sequence: Synthetic peptide
  Seed: YVPLAHSSSA (PMEL_HUMAN)
YQPLAHSSSI

SEQ ID NO: 126435 - protein, 9 aa, Artificial Sequence
  Description of Artificial Sequence: Synthetic peptide
  Seed: KHFLRNQPL (PMEL_HUMAN)
KFFLRNQPM

SEQ ID NO: 126436 - protein, 10 aa, Artificial Sequence
  Description of Artificial Sequence: Synthetic peptide
  Seed: VYHRRGSRSY (PMEL_HUMAN)
VMHRRGSRSF

SEQ ID NO: 126437 - protein, 9 aa, Artificial Sequence
  Description of Artificial Sequence: Synthetic peptide
  Seed: RLMKQDFSV (PMEL_HUMAN)
RTMKQDFSK

SEQ ID NO: 126438 - protein, 9 aa, Artificial Sequence
  Description of Artificial Sequence: Synthetic peptide
  Seed: KQDFSVPQL (PMEL_HUMAN)
KLDFSVPQV

SEQ ID NO: 126439 - protein, 9 aa, Artificial Sequence
  Description of Artificial Sequence: Synthetic peptide
  Seed: SQKRSFVYV (PMEL_HUMAN)
STKRSFVYS

SEQ ID NO: 126440 - protein, 10 aa, Artificial Sequence
  Description of Artificial Sequence: Synthetic peptide
  Seed: EVMGTTLAEM (PMEL_HUMAN)
EMMGTTLAEL

SEQ ID NO: 126441 - protein, 10 aa, Artificial Sequence
  Description of Artificial Sequence: Synthetic peptide
  Seed: RQVPLDCVLY (PMEL_HUMAN)
RWVPLDCVLY

SEQ ID NO: 126442 - protein, 10 aa, Artificial Sequence
  Description of Artificial Sequence: Synthetic peptide
  Seed: TLAEMSTPEA (PMEL_HUMAN)
TLAEMSTPEI

SEQ ID NO: 126443 - protein, 9 aa, Artificial Sequence
  Description of Artificial Sequence: Synthetic peptide
  Seed: YLAEADLSY (PMEL_HUMAN)
YKAEADLSL

SEQ ID NO: 126444 - protein, 10 aa, Artificial Sequence
  Description of Artificial Sequence: Synthetic peptide
  Seed: RGSRSYVPLA (PMEL_HUMAN)
RKSRSYVPLI

SEQ ID NO: 126445 - protein, 9 aa, Artificial Sequence
  Description of Artificial Sequence: Synthetic peptide
  Seed: LNFPGSQKV (PMEL_HUMAN)
LAFPGSQKV

SEQ ID NO: 126446 - protein, 11 aa, Artificial Sequence
  Description of Artificial Sequence: Synthetic peptide
  Seed: HSSSHWLRLPR (PMEL_HUMAN)
HGSSHWLRLPR

SEQ ID NO: 126447 - protein, 10 aa, Artificial Sequence
  Description of Artificial Sequence: Synthetic peptide
  Seed: AFTITDQVPF (PMEL_HUMAN)
ATTITDQVPW

SEQ ID NO: 126448 - protein, 9 aa, Artificial Sequence
  Description of Artificial Sequence: Synthetic peptide
  Seed: QLRTKAWNR (PMEL_HUMAN)
QSRTKAWNR

SEQ ID NO: 126449 - protein, 9 aa, Artificial Sequence
  Description of Artificial Sequence: Synthetic peptide
  Seed: QLYPEWTEA (PMEL_HUMAN)
QTYPEWTEV

SEQ ID NO: 126450 - protein, 9 aa, Artificial Sequence
  Description of Artificial Sequence: Synthetic peptide
  Seed: APVQMPTAE (PMEL_HUMAN)
APVQMPTAA

SEQ ID NO: 126451 - protein, 9 aa, Artificial Sequence
  Description of Artificial Sequence: Synthetic peptide
  Seed: SLAVVSTQL (PMEL_HUMAN)
SIAVVSTQL

SEQ ID NO: 126452 - protein, 9 aa, Artificial Sequence
  Description of Artificial Sequence: Synthetic peptide
  Seed: KTWGQYWQV (PMEL_HUMAN)
KMWGQYWQV

SEQ ID NO: 126453 - protein, 10 aa, Artificial Sequence
  Description of Artificial Sequence: Synthetic peptide
  Seed: HDPSGYLAEA (PMEL_HUMAN)
HEPSGYLAEV

SEQ ID NO: 126454 - protein, 10 aa, Artificial Sequence
  Description of Artificial Sequence: Synthetic peptide
  Seed: AEADLSYTWD (PMEL_HUMAN)
AEADLSYTWP

SEQ ID NO: 126455 - protein, 9 aa, Artificial Sequence
  Description of Artificial Sequence: Synthetic peptide
  Seed: VSNDGPTLI (PMEL_HUMAN)
VVNDGPTLF

SEQ ID NO: 126456 - protein, 9 aa, Artificial Sequence
  Description of Artificial Sequence: Synthetic peptide
  Seed: IESAEILQA (PMEL_HUMAN)
IESAEILQP

SEQ ID NO: 126457 - protein, 9 aa, Artificial Sequence
  Description of Artificial Sequence: Synthetic peptide
  Seed: MLGTHTMEV (PMEL_HUMAN)
MVGTHTMEM

SEQ ID NO: 126458 - protein, 9 aa, Artificial Sequence
  Description of Artificial Sequence: Synthetic peptide
  Seed: YLEPGPVTA (PMEL_HUMAN)
YFEPGPVTI

SEQ ID NO: 126459 - protein, 10 aa, Artificial Sequence
  Description of Artificial Sequence: Synthetic peptide
  Seed: YRYGSFSVTL (PMEL_HUMAN)
YIYGSFSVTI

SEQ ID NO: 126460 - protein, 9 aa, Artificial Sequence
  Description of Artificial Sequence: Synthetic peptide
  Seed: NFPGSQKVL (PMEL_HUMAN)
NAPGSQKVI

SEQ ID NO: 126461 - protein, 10 aa, Artificial Sequence
  Description of Artificial Sequence: Synthetic peptide
  Seed: YVPLAHSSSA (PMEL_HUMAN)
YGPLAHSSSA

SEQ ID NO: 126462 - protein, 10 aa, Artificial Sequence
  Description of Artificial Sequence: Synthetic peptide
  Seed: VLYRYGSFSV (PMEL_HUMAN)
VMYRYGSFSK

SEQ ID NO: 126463 - protein, 8 aa, Artificial Sequence
  Description of Artificial Sequence: Synthetic peptide
  Seed: SNDGPTLI (PMEL_HUMAN)
SYDGPTLL

SEQ ID NO: 126464 - protein, 9 aa, Artificial Sequence
  Description of Artificial Sequence: Synthetic peptide
  Seed: VTAQVVLQA (PMEL_HUMAN)
VSAQVVLQM

SEQ ID NO: 126465 - protein, 9 aa, Artificial Sequence
  Description of Artificial Sequence: Synthetic peptide
  Seed: YVWKTWGQY (PMEL_HUMAN)
YSWKTWGQI

SEQ ID NO: 126466 - protein, 10 aa, Artificial Sequence
  Description of Artificial Sequence: Synthetic peptide
  Seed: AVIGALLAVG (PMEL_HUMAN)
ALIGALLAVS

SEQ ID NO: 126467 - protein, 9 aa, Artificial Sequence
  Description of Artificial Sequence: Synthetic peptide
  Seed: LIYRRRLMK (PMEL_HUMAN)
LAYRRRLMK

SEQ ID NO: 126468 - protein, 9 aa, Artificial Sequence
  Description of Artificial Sequence: Synthetic peptide
  Seed: VSLADTNSL (PMEL_HUMAN)
VVLADTNSW

SEQ ID NO: 126469 - protein, 9 aa, Artificial Sequence
  Description of Artificial Sequence: Synthetic peptide
  Seed: RYGSFSVTL (PMEL_HUMAN)
RLGSFSVTF

SEQ ID NO: 126470 - protein, 9 aa, Artificial Sequence
  Description of Artificial Sequence: Synthetic peptide
  Seed: AVVLASLIY (PMEL_HUMAN)
AQVLASLIM

SEQ ID NO: 126471 - protein, 10 aa, Artificial Sequence
  Description of Artificial Sequence: Synthetic peptide
  Seed: SSSHWLRLPR (PMEL_HUMAN)
SCSHWLRLPK

SEQ ID NO: 126472 - protein, 9 aa, Artificial Sequence
  Description of Artificial Sequence: Synthetic peptide
  Seed: VLMAVVLAS (PMEL_HUMAN)
VTMAVVLAI

SEQ ID NO: 126473 - protein, 9 aa, Artificial Sequence
  Description of Artificial Sequence: Synthetic peptide
  Seed: RALDGGNKH (PMEL_HUMAN)
RYLDGGNKY

SEQ ID NO: 126474 - protein, 9 aa, Artificial Sequence
  Description of Artificial Sequence: Synthetic peptide
  Seed: YLEPGPVTA (PMEL_HUMAN)
YSEPGPVTA

SEQ ID NO: 126475 - protein, 9 aa, Artificial Sequence
  Description of Artificial Sequence: Synthetic peptide
  Seed: SAFTITDQV (PMEL_HUMAN)
SMFTITDQF

SEQ ID NO: 126476 - protein, 9 aa, Artificial Sequence
  Description of Artificial Sequence: Synthetic peptide
  Seed: GSRSYVPLA (PMEL_HUMAN)
GMRSYVPLK

SEQ ID NO: 126477 - protein, 10 aa, Artificial Sequence
  Description of Artificial Sequence: Synthetic peptide
  Seed: ASFSIALNFP (PMEL_HUMAN)
AAFSIALNFY

SEQ ID NO: 126478 - protein, 9 aa, Artificial Sequence
  Description of Artificial Sequence: Synthetic peptide
  Seed: YPQETDDAC (PMEL_HUMAN)
YIQETDDAY

SEQ ID NO: 126479 - protein, 10 aa, Artificial Sequence
  Description of Artificial Sequence: Synthetic peptide
  Seed: LAHSSSAFTI (PMEL_HUMAN)
LSHSSSAFTL

SEQ ID NO: 126480 - protein, 9 aa, Artificial Sequence
  Description of Artificial Sequence: Synthetic peptide
  Seed: VQVPTTEVI (PMEL_HUMAN)
VKVPTTEVY

SEQ ID NO: 126481 - protein, 10 aa, Artificial Sequence
  Description of Artificial Sequence: Synthetic peptide
  Seed: VPQLPHSSSH (PMEL_HUMAN)
VFQLPHSSSF

SEQ ID NO: 126482 - protein, 10 aa, Artificial Sequence
  Description of Artificial Sequence: Synthetic peptide
  Seed: IESAEILQAV (PMEL_HUMAN)
ILSAEILQAA

SEQ ID NO: 126483 - protein, 9 aa, Artificial Sequence
  Description of Artificial Sequence: Synthetic peptide
  Seed: VLPSPACQL (PMEL_HUMAN)
VMPSPACQI

SEQ ID NO: 126484 - protein, 9 aa, Artificial Sequence
  Description of Artificial Sequence: Synthetic peptide
  Seed: KVSNDGPTL (PMEL_HUMAN)
KMSNDGPTW

SEQ ID NO: 126485 - protein, 9 aa, Artificial Sequence
  Description of Artificial Sequence: Synthetic peptide
  Seed: TEWVETTAR (PMEL_HUMAN)
TEWVETTAS

SEQ ID NO: 126486 - protein, 8 aa, Artificial Sequence
  Description of Artificial Sequence: Synthetic peptide
  Seed: LADTNSLA (PMEL_HUMAN)
LVDTNSLL

SEQ ID NO: 126487 - protein, 9 aa, Artificial Sequence
  Description of Artificial Sequence: Synthetic peptide
  Seed: SLADTNSLA (PMEL_HUMAN)
SVADTNSLA

SEQ ID NO: 126488 - protein, 9 aa, Artificial Sequence
  Description of Artificial Sequence: Synthetic peptide
  Seed: VSEVMGTTL (PMEL_HUMAN)
VSEVMGTTV

SEQ ID NO: 126489 - protein, 9 aa, Artificial Sequence
  Description of Artificial Sequence: Synthetic peptide
  Seed: AQVVLQAAI (PMEL_HUMAN)
ALVVLQAAY

SEQ ID NO: 126490 - protein, 11 aa, Artificial Sequence
  Description of Artificial Sequence: Synthetic peptide
  Seed: FGDSSGTLISR (PMEL_HUMAN)
FVDSSGTLISF

SEQ ID NO: 126491 - protein, 9 aa, Artificial Sequence
  Description of Artificial Sequence: Synthetic peptide
  Seed: VTLDIVQGI (PMEL_HUMAN)
VMLDIVQGK

SEQ ID NO: 126492 - protein, 10 aa, Artificial Sequence
  Description of Artificial Sequence: Synthetic peptide
  Seed: RGSRSYVPLA (PMEL_HUMAN)
RISRSYVPLI

SEQ ID NO: 126493 - protein, 10 aa, Artificial Sequence
  Description of Artificial Sequence: Synthetic peptide
  Seed: RGSRSYVPLA (PMEL_HUMAN)
RMSRSYVPLL

SEQ ID NO: 126494 - protein, 9 aa, Artificial Sequence
  Description of Artificial Sequence: Synthetic peptide
  Seed: TTPGQAPTA (PMEL_HUMAN)
TAPGQAPTM

SEQ ID NO: 126495 - protein, 9 aa, Artificial Sequence
  Description of Artificial Sequence: Synthetic peptide
  Seed: VSVSQLRAL (PMEL_HUMAN)
VMVSQLRAL

SEQ ID NO: 126496 - protein, 9 aa, Artificial Sequence
  Description of Artificial Sequence: Synthetic peptide
  Seed: SLADTNSLA (PMEL_HUMAN)
SSADTNSLL

SEQ ID NO: 126497 - protein, 10 aa, Artificial Sequence
  Description of Artificial Sequence: Synthetic peptide
  Seed: VLMAVVLASL (PMEL_HUMAN)
VLMAVVLASV

SEQ ID NO: 126498 - protein, 9 aa, Artificial Sequence
  Description of Artificial Sequence: Synthetic peptide
  Seed: AEMSTPEAT (PMEL_HUMAN)
ADMSTPEAI

SEQ ID NO: 126499 - protein, 10 aa, Artificial Sequence
  Description of Artificial Sequence: Synthetic peptide
  Seed: SRALVVTHTY (PMEL_HUMAN)
SDALVVTHTW

SEQ ID NO: 126500 - protein, 9 aa, Artificial Sequence
  Description of Artificial Sequence: Synthetic peptide
  Seed: LMAVVLASL (PMEL_HUMAN)
LPAVVLASL

SEQ ID NO: 126501 - protein, 9 aa, Artificial Sequence
  Description of Artificial Sequence: Synthetic peptide
  Seed: SQKRSFVYV (PMEL_HUMAN)
SVKRSFVYV

SEQ ID NO: 126502 - protein, 10 aa, Artificial Sequence
  Description of Artificial Sequence: Synthetic peptide
  Seed: MTPAEVSIVV (PMEL_HUMAN)
MMPAEVSIVF

SEQ ID NO: 126503 - protein, 10 aa, Artificial Sequence
  Description of Artificial Sequence: Synthetic peptide
  Seed: VLMAVVLASL (PMEL_HUMAN)
VWMAVVLASL

SEQ ID NO: 126504 - protein, 9 aa, Artificial Sequence
  Description of Artificial Sequence: Synthetic peptide
  Seed: RQVPLDCVL (PMEL_HUMAN)
RTVPLDCVF

SEQ ID NO: 126505 - protein, 9 aa, Artificial Sequence
  Description of Artificial Sequence: Synthetic peptide
  Seed: AEPSGTTSV (PMEL_HUMAN)
AFPSGTTSI

SEQ ID NO: 126506 - protein, 11 aa, Artificial Sequence
  Description of Artificial Sequence: Synthetic peptide
  Seed: FGDSSGTLISR (PMEL_HUMAN)
FQDSSGTLISV

SEQ ID NO: 126507 - protein, 9 aa, Artificial Sequence
  Description of Artificial Sequence: Synthetic peptide
  Seed: LMAVVLASL (PMEL_HUMAN)
LLAVVLASI

SEQ ID NO: 126508 - protein, 9 aa, Artificial Sequence
  Description of Artificial Sequence: Synthetic peptide
  Seed: AGQVPTTEV (PMEL_HUMAN)
AMQVPTTEL

SEQ ID NO: 126509 - protein, 10 aa, Artificial Sequence
  Description of Artificial Sequence: Synthetic peptide
  Seed: SQKRSFVYVW (PMEL_HUMAN)
SHKRSFVYVY

SEQ ID NO: 126510 - protein, 10 aa, Artificial Sequence
  Description of Artificial Sequence: Synthetic peptide
  Seed: VLMAVVLASL (PMEL_HUMAN)
VKMAVVLASI

SEQ ID NO: 126511 - protein, 10 aa, Artificial Sequence
  Description of Artificial Sequence: Synthetic peptide
  Seed: STAPVQMPTA (PMEL_HUMAN)
SAAPVQMPTV

SEQ ID NO: 126512 - protein, 9 aa, Artificial Sequence
  Description of Artificial Sequence: Synthetic peptide
  Seed: RALVVTHTY (PMEL_HUMAN)
RKLVVTHTL

SEQ ID NO: 126513 - protein, 9 aa, Artificial Sequence
  Description of Artificial Sequence: Synthetic peptide
  Seed: VSNDGPTLI (PMEL_HUMAN)
VYNDGPTLM

SEQ ID NO: 126514 - protein, 10 aa, Artificial Sequence
  Description of Artificial Sequence: Synthetic peptide
  Seed: AFTITDQVPF (PMEL_HUMAN)
AMTITDQVPF

SEQ ID NO: 126515 - protein, 9 aa, Artificial Sequence
  Description of Artificial Sequence: Synthetic peptide
  Seed: TTDGHRPTA (PMEL_HUMAN)
TEDGHRPTL

SEQ ID NO: 126516 - protein, 8 aa, Artificial Sequence
  Description of Artificial Sequence: Synthetic peptide
  Seed: LHDPSGYL (PMEL_HUMAN)
LLDPSGYM

SEQ ID NO: 126517 - protein, 9 aa, Artificial Sequence
  Description of Artificial Sequence: Synthetic peptide
  Seed: GQVPTTEVV (PMEL_HUMAN)
GQVPTTEVM

SEQ ID NO: 126518 - protein, 9 aa, Artificial Sequence
  Description of Artificial Sequence: Synthetic peptide
  Seed: ALDGGNKHF (PMEL_HUMAN)
ALDGGNKHV

SEQ ID NO: 126519 - protein, 10 aa, Artificial Sequence
  Description of Artificial Sequence: Synthetic peptide
  Seed: YRYGSFSVTL (PMEL_HUMAN)
YKYGSFSVTM

SEQ ID NO: 126520 - protein, 10 aa, Artificial Sequence
  Description of Artificial Sequence: Synthetic peptide
  Seed: LAVVSTQLIM (PMEL_HUMAN)
LMVVSTQLIY

SEQ ID NO: 126521 - protein, 9 aa, Artificial Sequence
  Description of Artificial Sequence: Synthetic peptide
  Seed: MLGTHTMEV (PMEL_HUMAN)
MIGTHTMEM

SEQ ID NO: 126522 - protein, 10 aa, Artificial Sequence
  Description of Artificial Sequence: Synthetic peptide
  Seed: MKQDFSVPQL (PMEL_HUMAN)
MKQDFSVPQF

SEQ ID NO: 126523 - protein, 9 aa, Artificial Sequence
  Description of Artificial Sequence: Synthetic peptide
  Seed: RALDGGNKH (PMEL_HUMAN)
RILDGGNKF

SEQ ID NO: 126524 - protein, 9 aa, Artificial Sequence
  Description of Artificial Sequence: Synthetic peptide
  Seed: AEPSGTTSV (PMEL_HUMAN)
AVPSGTTSL

SEQ ID NO: 126525 - protein, 9 aa, Artificial Sequence
  Description of Artificial Sequence: Synthetic peptide
  Seed: GTYCLNVSL (PMEL_HUMAN)
GLYCLNVSL

SEQ ID NO: 126526 - protein, 11 aa, Artificial Sequence
  Description of Artificial Sequence: Synthetic peptide
  Seed: LGPLLDGTATL (PMEL_HUMAN)
LRPLLDGTATV

SEQ ID NO: 126527 - protein, 10 aa, Artificial Sequence
  Description of Artificial Sequence: Synthetic peptide
  Seed: RQLRTKAWNR (PMEL_HUMAN)
RSLRTKAWNR

SEQ ID NO: 126528 - protein, 10 aa, Artificial Sequence
  Description of Artificial Sequence: Synthetic peptide
  Seed: KTWGQYWQVL (PMEL_HUMAN)
KWWGQYWQVM

SEQ ID NO: 126529 - protein, 10 aa, Artificial Sequence
  Description of Artificial Sequence: Synthetic peptide
  Seed: MPTAESTGMT (PMEL_HUMAN)
MKTAESTGMI

SEQ ID NO: 126530 - protein, 11 aa, Artificial Sequence
  Description of Artificial Sequence: Synthetic peptide
  Seed: MAVVLASLIYR (PMEL_HUMAN)
MVVVLASLIYR

SEQ ID NO: 126531 - protein, 9 aa, Artificial Sequence
  Description of Artificial Sequence: Synthetic peptide
  Seed: HTYLEPGPV (PMEL_HUMAN)
HLYLEPGPV

SEQ ID NO: 126532 - protein, 11 aa, Artificial Sequence
  Description of Artificial Sequence: Synthetic peptide
  Seed: SGYLAEADLSY (PMEL_HUMAN)
SAYLAEADLSY

SEQ ID NO: 126533 - protein, 9 aa, Artificial Sequence
  Description of Artificial Sequence: Synthetic peptide
  Seed: GGPVSGLSI (PMEL_HUMAN)
GYPVSGLSL

SEQ ID NO: 126534 - protein, 10 aa, Artificial Sequence
  Description of Artificial Sequence: Synthetic peptide
  Seed: ALDGGNKHFL (PMEL_HUMAN)
ASDGGNKHFW

SEQ ID NO: 126535 - protein, 9 aa, Artificial Sequence
  Description of Artificial Sequence: Synthetic peptide
  Seed: YHRRGSRSY (PMEL_HUMAN)
YIRRGSRSF

SEQ ID NO: 126536 - protein, 10 aa, Artificial Sequence
  Description of Artificial Sequence: Synthetic peptide
  Seed: KVLPDGQVIW (PMEL_HUMAN)
KLLPDGQVIL

SEQ ID NO: 126537 - protein, 8 aa, Artificial Sequence
  Description of Artificial Sequence: Synthetic peptide
  Seed: LADTNSLA (PMEL_HUMAN)
LVDTNSLI

SEQ ID NO: 126538 - protein, 9 aa, Artificial Sequence
  Description of Artificial Sequence: Synthetic peptide
  Seed: VLGGPVSGL (PMEL_HUMAN)
VQGGPVSGF

SEQ ID NO: 126539 - protein, 9 aa, Artificial Sequence
  Description of Artificial Sequence: Synthetic peptide
  Seed: RQVPLDCVL (PMEL_HUMAN)
RQVPLDCVF

SEQ ID NO: 126540 - protein, 9 aa, Artificial Sequence
  Description of Artificial Sequence: Synthetic peptide
  Seed: KTWGQYWQV (PMEL_HUMAN)
KLWGQYWQR

SEQ ID NO: 126541 - protein, 10 aa, Artificial Sequence
  Description of Artificial Sequence: Synthetic peptide
  Seed: VPQLPHSSSH (PMEL_HUMAN)
VYQLPHSSSY

SEQ ID NO: 126542 - protein, 10 aa, Artificial Sequence
  Description of Artificial Sequence: Synthetic peptide
  Seed: YVPLAHSSSA (PMEL_HUMAN)
YRPLAHSSSM

SEQ ID NO: 126543 - protein, 11 aa, Artificial Sequence
  Description of Artificial Sequence: Synthetic peptide
  Seed: RAMLGTHTMEV (PMEL_HUMAN)
RYMLGTHTMEI

SEQ ID NO: 126544 - protein, 11 aa, Artificial Sequence
  Description of Artificial Sequence: Synthetic peptide
  Seed: KHFLRNQPLTF (PMEL_HUMAN)
KKFLRNQPLTF

SEQ ID NO: 126545 - protein, 9 aa, Artificial Sequence
  Description of Artificial Sequence: Synthetic peptide
  Seed: LHLAVIGAL (PMEL_HUMAN)
LQLAVIGAH

SEQ ID NO: 126546 - protein, 9 aa, Artificial Sequence
  Description of Artificial Sequence: Synthetic peptide
  Seed: RAMLGTHTM (PMEL_HUMAN)
RFMLGTHTV

SEQ ID NO: 126547 - protein, 9 aa, Artificial Sequence
  Description of Artificial Sequence: Synthetic peptide
  Seed: TLIGANASF (PMEL_HUMAN)
TEIGANASF

SEQ ID NO: 126548 - protein, 9 aa, Artificial Sequence
  Description of Artificial Sequence: Synthetic peptide
  Seed: HTMEVTVYH (PMEL_HUMAN)
HQMEVTVYY

SEQ ID NO: 126549 - protein, 11 aa, Artificial Sequence
  Description of Artificial Sequence: Synthetic peptide
  Seed: SPVPGTTDGHR (PMEL_HUMAN)
SSVPGTTDGHR

SEQ ID NO: 126550 - protein, 9 aa, Artificial Sequence
  Description of Artificial Sequence: Synthetic peptide
  Seed: YLAEADLSY (PMEL_HUMAN)
YMAEADLSW

SEQ ID NO: 126551 - protein, 9 aa, Artificial Sequence
  Description of Artificial Sequence: Synthetic peptide
  Seed: GQVPTTEVV (PMEL_HUMAN)
GEVPTTEVV

SEQ ID NO: 126552 - protein, 10 aa, Artificial Sequence
  Description of Artificial Sequence: Synthetic peptide
  Seed: ESITGSLGPL (PMEL_HUMAN)
EVITGSLGPW

SEQ ID NO: 126553 - protein, 9 aa, Artificial Sequence
  Description of Artificial Sequence: Synthetic peptide
  Seed: QVIWVNNTI (PMEL_HUMAN)
QTIWVNNTR

SEQ ID NO: 126554 - protein, 10 aa, Artificial Sequence
  Description of Artificial Sequence: Synthetic peptide
  Seed: IESAEILQAV (PMEL_HUMAN)
ILSAEILQAM

SEQ ID NO: 126555 - protein, 11 aa, Artificial Sequence
  Description of Artificial Sequence: Synthetic peptide
  Seed: SQVWGGQPVYP (PMEL_HUMAN)
SMVWGGQPVYY

SEQ ID NO: 126556 - protein, 10 aa, Artificial Sequence
  Description of Artificial Sequence: Synthetic peptide
  Seed: EVVGTTPGQA (PMEL_HUMAN)
EVVGTTPGQV

SEQ ID NO: 126557 - protein, 10 aa, Artificial Sequence
  Description of Artificial Sequence: Synthetic peptide
  Seed: MTPAEVSIVV (PMEL_HUMAN)
MAPAEVSIVH

SEQ ID NO: 126558 - protein, 9 aa, Artificial Sequence
  Description of Artificial Sequence: Synthetic peptide
  Seed: SSIMSTESI (PMEL_HUMAN)
SMIMSTESA

SEQ ID NO: 126559 - protein, 10 aa, Artificial Sequence
  Description of Artificial Sequence: Synthetic peptide
  Seed: HTMEVTVYHR (PMEL_HUMAN)
HMMEVTVYHK

SEQ ID NO: 126560 - protein, 10 aa, Artificial Sequence
  Description of Artificial Sequence: Synthetic peptide
  Seed: LAVGATKVPR (PMEL_HUMAN)
LMVGATKVPR

SEQ ID NO: 126561 - protein, 9 aa, Artificial Sequence
  Description of Artificial Sequence: Synthetic peptide
  Seed: AQRLCQPVL (PMEL_HUMAN)
AERLCQPVY

SEQ ID NO: 126562 - protein, 9 aa, Artificial Sequence
  Description of Artificial Sequence: Synthetic peptide
  Seed: FPDGGPCPS (PMEL_HUMAN)
FMDGGPCPM

SEQ ID NO: 126563 - protein, 10 aa, Artificial Sequence
  Description of Artificial Sequence: Synthetic peptide
  Seed: ASSIMSTESI (PMEL_HUMAN)
AKSIMSTESW

SEQ ID NO: 126564 - protein, 9 aa, Artificial Sequence
  Description of Artificial Sequence: Synthetic peptide
  Seed: HLAVIGALL (PMEL_HUMAN)
HSAVIGALA

SEQ ID NO: 126565 - protein, 11 aa, Artificial Sequence
  Description of Artificial Sequence: Synthetic peptide
  Seed: SLADTNSLAVV (PMEL_HUMAN)
SLADTNSLAVL

SEQ ID NO: 126566 - protein, 9 aa, Artificial Sequence
  Description of Artificial Sequence: Synthetic peptide
  Seed: FLRNQPLTF (PMEL_HUMAN)
FTRNQPLTF

SEQ ID NO: 126567 - protein, 9 aa, Artificial Sequence
  Description of Artificial Sequence: Synthetic peptide
  Seed: CWRGGQVSL (PMEL_HUMAN)
CFRGGQVSL

SEQ ID NO: 126568 - protein, 9 aa, Artificial Sequence
  Description of Artificial Sequence: Synthetic peptide
  Seed: IYRRRLMKQ (PMEL_HUMAN)
ITRRRLMKV

SEQ ID NO: 126569 - protein, 11 aa, Artificial Sequence
  Description of Artificial Sequence: Synthetic peptide
  Seed: RRGSRSYVPLA (PMEL_HUMAN)
RPGSRSYVPLV

SEQ ID NO: 126570 - protein, 9 aa, Artificial Sequence
  Description of Artificial Sequence: Synthetic peptide
  Seed: DAFELTVSC (PMEL_HUMAN)
DGFELTVSI

SEQ ID NO: 126571 - protein, 9 aa, Artificial Sequence
  Description of Artificial Sequence: Synthetic peptide
  Seed: QVIWVNNTI (PMEL_HUMAN)
QTIWVNNTW

SEQ ID NO: 126572 - protein, 9 aa, Artificial Sequence
  Description of Artificial Sequence: Synthetic peptide
  Seed: VLMAVVLAS (PMEL_HUMAN)
VSMAVVLAV

SEQ ID NO: 126573 - protein, 9 aa, Artificial Sequence
  Description of Artificial Sequence: Synthetic peptide
  Seed: RGSRSYVPL (PMEL_HUMAN)
RMSRSYVPK

SEQ ID NO: 126574 - protein, 9 aa, Artificial Sequence
  Description of Artificial Sequence: Synthetic peptide
  Seed: LIVGILLVL (PMEL_HUMAN)
LQVGILLVY

SEQ ID NO: 126575 - protein, 11 aa, Artificial Sequence
  Description of Artificial Sequence: Synthetic peptide
  Seed: SYVPLAHSSSA (PMEL_HUMAN)
SEVPLAHSSSL

SEQ ID NO: 126576 - protein, 9 aa, Artificial Sequence
  Description of Artificial Sequence: Synthetic peptide
  Seed: HTMEVTVYH (PMEL_HUMAN)
HPMEVTVYK

SEQ ID NO: 126577 - protein, 9 aa, Artificial Sequence
  Description of Artificial Sequence: Synthetic peptide
  Seed: RAMLGTHTM (PMEL_HUMAN)
REMLGTHTL

SEQ ID NO: 126578 - protein, 9 aa, Artificial Sequence
  Description of Artificial Sequence: Synthetic peptide
  Seed: WSQKRSFVY (PMEL_HUMAN)
WLQKRSFVY

SEQ ID NO: 126579 - protein, 9 aa, Artificial Sequence
  Description of Artificial Sequence: Synthetic peptide
  Seed: ESAEILQAV (PMEL_HUMAN)
EIAEILQAR

SEQ ID NO: 126580 - protein, 9 aa, Artificial Sequence
  Description of Artificial Sequence: Synthetic peptide
  Seed: ISRALVVTH (PMEL_HUMAN)
IQRALVVTF

SEQ ID NO: 126581 - protein, 10 aa, Artificial Sequence
  Description of Artificial Sequence: Synthetic peptide
  Seed: RGSRSYVPLA (PMEL_HUMAN)
RVSRSYVPLK

SEQ ID NO: 126582 - protein, 10 aa, Artificial Sequence
  Description of Artificial Sequence: Synthetic peptide
  Seed: SVPQLPHSSS (PMEL_HUMAN)
SVPQLPHSSF

SEQ ID NO: 126583 - protein, 10 aa, Artificial Sequence
  Description of Artificial Sequence: Synthetic peptide
  Seed: LQLHDPSGYL (PMEL_HUMAN)
LELHDPSGYV

SEQ ID NO: 126584 - protein, 9 aa, Artificial Sequence
  Description of Artificial Sequence: Synthetic peptide
  Seed: LIYRRRLMK (PMEL_HUMAN)
LLYRRRLMK

SEQ ID NO: 126585 - protein, 9 aa, Artificial Sequence
  Description of Artificial Sequence: Synthetic peptide
  Seed: VQVPTTEVI (PMEL_HUMAN)
VQVPTTEVF

SEQ ID NO: 126586 - protein, 9 aa, Artificial Sequence
  Description of Artificial Sequence: Synthetic peptide
  Seed: CPIGENSPL (PMEL_HUMAN)
CPIGENSPW

SEQ ID NO: 126587 - protein, 9 aa, Artificial Sequence
  Description of Artificial Sequence: Synthetic peptide
  Seed: SYVPLAHSS (PMEL_HUMAN)
SWVPLAHSY

SEQ ID NO: 126588 - protein, 9 aa, Artificial Sequence
  Description of Artificial Sequence: Synthetic peptide
  Seed: TTDGHRPTA (PMEL_HUMAN)
TCDGHRPTL

SEQ ID NO: 126589 - protein, 9 aa, Artificial Sequence
  Description of Artificial Sequence: Synthetic peptide
  Seed: LMAVVLASL (PMEL_HUMAN)
LSAVVLASY

SEQ ID NO: 126590 - protein, 10 aa, Artificial Sequence
  Description of Artificial Sequence: Synthetic peptide
  Seed: SQVWGGQPVY (PMEL_HUMAN)
SLVWGGQPVY

SEQ ID NO: 126591 - protein, 9 aa, Artificial Sequence
  Description of Artificial Sequence: Synthetic peptide
  Seed: VQVPTTEVI (PMEL_HUMAN)
VIVPTTEVL

SEQ ID NO: 126592 - protein, 9 aa, Artificial Sequence
  Description of Artificial Sequence: Synthetic peptide
  Seed: HTMEVTVYH (PMEL_HUMAN)
HIMEVTVYK

SEQ ID NO: 126593 - protein, 10 aa, Artificial Sequence
  Description of Artificial Sequence: Synthetic peptide
  Seed: LVLMAVVLAS (PMEL_HUMAN)
LWLMAVVLAA

SEQ ID NO: 126594 - protein, 10 aa, Artificial Sequence
  Description of Artificial Sequence: Synthetic peptide
  Seed: YLAEADLSYT (PMEL_HUMAN)
YAAEADLSYV

SEQ ID NO: 126595 - protein, 9 aa, Artificial Sequence
  Description of Artificial Sequence: Synthetic peptide
  Seed: AQRLCQPVL (PMEL_HUMAN)
ATRLCQPVT

SEQ ID NO: 126596 - protein, 11 aa, Artificial Sequence
  Description of Artificial Sequence: Synthetic peptide
  Seed: LVLMAVVLASL (PMEL_HUMAN)
LVLMAVVLASV

SEQ ID NO: 126597 - protein, 10 aa, Artificial Sequence
  Description of Artificial Sequence: Synthetic peptide
  Seed: VYVWKTWGQY (PMEL_HUMAN)
VQVWKTWGQY

SEQ ID NO: 126598 - protein, 10 aa, Artificial Sequence
  Description of Artificial Sequence: Synthetic peptide
  Seed: YRYGSFSVTL (PMEL_HUMAN)
YMYGSFSVTY

SEQ ID NO: 126599 - protein, 9 aa, Artificial Sequence
  Description of Artificial Sequence: Synthetic peptide
  Seed: ALDGGNKHF (PMEL_HUMAN)
AMDGGNKHL

SEQ ID NO: 126600 - protein, 11 aa, Artificial Sequence
  Description of Artificial Sequence: Synthetic peptide
  Seed: KHFLRNQPLTF (PMEL_HUMAN)
KYFLRNQPLTW

SEQ ID NO: 126601 - protein, 9 aa, Artificial Sequence
  Description of Artificial Sequence: Synthetic peptide
  Seed: RLMKQDFSV (PMEL_HUMAN)
RVMKQDFSI

SEQ ID NO: 126602 - protein, 8 aa, Artificial Sequence
  Description of Artificial Sequence: Synthetic peptide
  Seed: LADTNSLA (PMEL_HUMAN)
LADTNSLF

SEQ ID NO: 126603 - protein, 10 aa, Artificial Sequence
  Description of Artificial Sequence: Synthetic peptide
  Seed: YLAEADLSYT (PMEL_HUMAN)
YTAEADLSYM

SEQ ID NO: 126604 - protein, 9 aa, Artificial Sequence
  Description of Artificial Sequence: Synthetic peptide
  Seed: VVLSGTTAA (PMEL_HUMAN)
VLLSGTTAT

SEQ ID NO: 126605 - protein, 9 aa, Artificial Sequence
  Description of Artificial Sequence: Synthetic peptide
  Seed: SQKRSFVYV (PMEL_HUMAN)
SSKRSFVYI

SEQ ID NO: 126606 - protein, 10 aa, Artificial Sequence
  Description of Artificial Sequence: Synthetic peptide
  Seed: GPLLDGTATL (PMEL_HUMAN)
GHLLDGTATA

SEQ ID NO: 126607 - protein, 9 aa, Artificial Sequence
  Description of Artificial Sequence: Synthetic peptide
  Seed: SLADTNSLA (PMEL_HUMAN)
SQADTNSLL

SEQ ID NO: 126608 - protein, 9 aa, Artificial Sequence
  Description of Artificial Sequence: Synthetic peptide
  Seed: QVIWVNNTI (PMEL_HUMAN)
QSIWVNNTL

SEQ ID NO: 126609 - protein, 9 aa, Artificial Sequence
  Description of Artificial Sequence: Synthetic peptide
  Seed: QKRSFVYVW (PMEL_HUMAN)
QKRSFVYVM

SEQ ID NO: 126610 - protein, 10 aa, Artificial Sequence
  Description of Artificial Sequence: Synthetic peptide
  Seed: SSSHWLRLPR (PMEL_HUMAN)
SMSHWLRLPK

SEQ ID NO: 126611 - protein, 9 aa, Artificial Sequence
  Description of Artificial Sequence: Synthetic peptide
  Seed: ALVVTHTYL (PMEL_HUMAN)
AIVVTHTYV

SEQ ID NO: 126612 - protein, 9 aa, Artificial Sequence
  Description of Artificial Sequence: Synthetic peptide
  Seed: LNFPGSQKV (PMEL_HUMAN)
LIFPGSQKA

SEQ ID NO: 126613 - protein, 9 aa, Artificial Sequence
  Description of Artificial Sequence: Synthetic peptide
  Seed: QLRTKAWNR (PMEL_HUMAN)
QTRTKAWNK

SEQ ID NO: 126614 - protein, 8 aa, Artificial Sequence
  Description of Artificial Sequence: Synthetic peptide
  Seed: SIGTGRAM (PMEL_HUMAN)
SAGTGRAY

SEQ ID NO: 126615 - protein, 10 aa, Artificial Sequence
  Description of Artificial Sequence: Synthetic peptide
  Seed: GTATLRLVKR (PMEL_HUMAN)
GVATLRLVKK

SEQ ID NO: 126616 - protein, 9 aa, Artificial Sequence
  Description of Artificial Sequence: Synthetic peptide
  Seed: LPHSSSHWL (PMEL_HUMAN)
LPHSSSHWM

SEQ ID NO: 126617 - protein, 9 aa, Artificial Sequence
  Description of Artificial Sequence: Synthetic peptide
  Seed: KHFLRNQPL (PMEL_HUMAN)
KRFLRNQPF

SEQ ID NO: 126618 - protein, 9 aa, Artificial Sequence
  Description of Artificial Sequence: Synthetic peptide
  Seed: SSIMSTESI (PMEL_HUMAN)
SLIMSTESA

SEQ ID NO: 126619 - protein, 9 aa, Artificial Sequence
  Description of Artificial Sequence: Synthetic peptide
  Seed: ESAEILQAV (PMEL_HUMAN)
ETAEILQAR

SEQ ID NO: 126620 - protein, 9 aa, Artificial Sequence
  Description of Artificial Sequence: Synthetic peptide
  Seed: LTSCGSSPV (PMEL_HUMAN)
LASCGSSPL

SEQ ID NO: 126621 - protein, 10 aa, Artificial Sequence
  Description of Artificial Sequence: Synthetic peptide
  Seed: MTPAEVSIVV (PMEL_HUMAN)
MWPAEVSIVA

SEQ ID NO: 126622 - protein, 9 aa, Artificial Sequence
  Description of Artificial Sequence: Synthetic peptide
  Seed: RTKAWNRQL (PMEL_HUMAN)
RMKAWNRQF

SEQ ID NO: 126623 - protein, 10 aa, Artificial Sequence
  Description of Artificial Sequence: Synthetic peptide
  Seed: RQLYPEWTEA (PMEL_HUMAN)
RNLYPEWTEY

SEQ ID NO: 126624 - protein, 10 aa, Artificial Sequence
  Description of Artificial Sequence: Synthetic peptide
  Seed: VVLASLIYRR (PMEL_HUMAN)
VVLASLIYRK

SEQ ID NO: 126625 - protein, 9 aa, Artificial Sequence
  Description of Artificial Sequence: Synthetic peptide
  Seed: TAEAPNTTA (PMEL_HUMAN)
TTEAPNTTM

SEQ ID NO: 126626 - protein, 9 aa, Artificial Sequence
  Description of Artificial Sequence: Synthetic peptide
  Seed: IPEPEGPDA (PMEL_HUMAN)
IPEPEGPDY

SEQ ID NO: 126627 - protein, 10 aa, Artificial Sequence
  Description of Artificial Sequence: Synthetic peptide
  Seed: VLMAVVLASL (PMEL_HUMAN)
VLMAVVLASR

SEQ ID NO: 126628 - protein, 9 aa, Artificial Sequence
  Description of Artificial Sequence: Synthetic peptide
  Seed: YHRRGSRSY (PMEL_HUMAN)
YFRRGSRSI

SEQ ID NO: 126629 - protein, 9 aa, Artificial Sequence
  Description of Artificial Sequence: Synthetic peptide
  Seed: AAQVTTTEW (PMEL_HUMAN)
AQQVTTTEM

SEQ ID NO: 126630 - protein, 8 aa, Artificial Sequence
  Description of Artificial Sequence: Synthetic peptide
  Seed: AEVSIVVL (PMEL_HUMAN)
AQVSIVVV

SEQ ID NO: 126631 - protein, 11 aa, Artificial Sequence
  Description of Artificial Sequence: Synthetic peptide
  Seed: GPTLIGANASF (PMEL_HUMAN)
GPTLIGANASA

SEQ ID NO: 126632 - protein, 11 aa, Artificial Sequence
  Description of Artificial Sequence: Synthetic peptide
  Seed: SGYLAEADLSY (PMEL_HUMAN)
SVYLAEADLSY

SEQ ID NO: 126633 - protein, 9 aa, Artificial Sequence
  Description of Artificial Sequence: Synthetic peptide
  Seed: TLISRALVV (PMEL_HUMAN)
TLISRALVY

SEQ ID NO: 126634 - protein, 9 aa, Artificial Sequence
  Description of Artificial Sequence: Synthetic peptide
  Seed: VQMPTAEST (PMEL_HUMAN)
VEMPTAESF

SEQ ID NO: 126635 - protein, 8 aa, Artificial Sequence
  Description of Artificial Sequence: Synthetic peptide
  Seed: LIYRRRLM (PMEL_HUMAN)
LPYRRRLL

SEQ ID NO: 126636 - protein, 10 aa, Artificial Sequence
  Description of Artificial Sequence: Synthetic peptide
  Seed: HTMEVTVYHR (PMEL_HUMAN)
HVMEVTVYHR

SEQ ID NO: 126637 - protein, 10 aa, Artificial Sequence
  Description of Artificial Sequence: Synthetic peptide
  Seed: GPLLDGTATL (PMEL_HUMAN)
GMLLDGTATI

SEQ ID NO: 126638 - protein, 10 aa, Artificial Sequence
  Description of Artificial Sequence: Synthetic peptide
  Seed: SGTYCLNVSL (PMEL_HUMAN)
SMTYCLNVSY

SEQ ID NO: 126639 - protein, 10 aa, Artificial Sequence
  Description of Artificial Sequence: Synthetic peptide
  Seed: YVPLAHSSSA (PMEL_HUMAN)
YAPLAHSSSF

SEQ ID NO: 126640 - protein, 9 aa, Artificial Sequence
  Description of Artificial Sequence: Synthetic peptide
  Seed: AVIGALLAV (PMEL_HUMAN)
AKIGALLAY

SEQ ID NO: 126641 - protein, 9 aa, Artificial Sequence
  Description of Artificial Sequence: Synthetic peptide
  Seed: SAFTITDQV (PMEL_HUMAN)
SMFTITDQM

SEQ ID NO: 126642 - protein, 9 aa, Artificial Sequence
  Description of Artificial Sequence: Synthetic peptide
  Seed: DSSGTLISR (PMEL_HUMAN)
DVSGTLISY

SEQ ID NO: 126643 - protein, 9 aa, Artificial Sequence
  Description of Artificial Sequence: Synthetic peptide
  Seed: QVWGGQPVY (PMEL_HUMAN)
QMWGGQPVR

SEQ ID NO: 126644 - protein, 9 aa, Artificial Sequence
  Description of Artificial Sequence: Synthetic peptide
  Seed: ITDQVPFSV (PMEL_HUMAN)
ISDQVPFSF

SEQ ID NO: 126645 - protein, 9 aa, Artificial Sequence
  Description of Artificial Sequence: Synthetic peptide
  Seed: TTDGHRPTA (PMEL_HUMAN)
TRDGHRPTM

SEQ ID NO: 126646 - protein, 10 aa, Artificial Sequence
  Description of Artificial Sequence: Synthetic peptide
  Seed: IALNFPGSQK (PMEL_HUMAN)
ISLNFPGSQR

SEQ ID NO: 126647 - protein, 9 aa, Artificial Sequence
  Description of Artificial Sequence: Synthetic peptide
  Seed: WQVLGGPVS (PMEL_HUMAN)
WQVLGGPVW

SEQ ID NO: 126648 - protein, 10 aa, Artificial Sequence
  Description of Artificial Sequence: Synthetic peptide
  Seed: SSHWLRLPRI (PMEL_HUMAN)
SAHWLRLPRK

SEQ ID NO: 126649 - protein, 9 aa, Artificial Sequence
  Description of Artificial Sequence: Synthetic peptide
  Seed: VLPDGQVIW (PMEL_HUMAN)
VSPDGQVII

SEQ ID NO: 126650 - protein, 10 aa, Artificial Sequence
  Description of Artificial Sequence: Synthetic peptide
  Seed: THTMEVTVYH (PMEL_HUMAN)
TDTMEVTVYR

SEQ ID NO: 126651 - protein, 10 aa, Artificial Sequence
  Description of Artificial Sequence: Synthetic peptide
  Seed: VSGLSIGTGR (PMEL_HUMAN)
VTGLSIGTGR

SEQ ID NO: 126652 - protein, 9 aa, Artificial Sequence
  Description of Artificial Sequence: Synthetic peptide
  Seed: LSIGTGRAM (PMEL_HUMAN)
LQIGTGRAH

SEQ ID NO: 126653 - protein, 10 aa, Artificial Sequence
  Description of Artificial Sequence: Synthetic peptide
  Seed: ASSIMSTESI (PMEL_HUMAN)
ASSIMSTESW

SEQ ID NO: 126654 - protein, 10 aa, Artificial Sequence
  Description of Artificial Sequence: Synthetic peptide
  Seed: RQLYPEWTEA (PMEL_HUMAN)
RCLYPEWTEI

SEQ ID NO: 126655 - protein, 10 aa, Artificial Sequence
  Description of Artificial Sequence: Synthetic peptide
  Seed: EVSIVVLSGT (PMEL_HUMAN)
ETSIVVLSGA

SEQ ID NO: 126656 - protein, 10 aa, Artificial Sequence
  Description of Artificial Sequence: Synthetic peptide
  Seed: ESAEILQAVP (PMEL_HUMAN)
ETAEILQAVS

SEQ ID NO: 126657 - protein, 9 aa, Artificial Sequence
  Description of Artificial Sequence: Synthetic peptide
  Seed: VVLQAAIPL (PMEL_HUMAN)
VILQAAIPY

SEQ ID NO: 126658 - protein, 9 aa, Artificial Sequence
  Description of Artificial Sequence: Synthetic peptide
  Seed: RYGSFSVTL (PMEL_HUMAN)
RLGSFSVTW

SEQ ID NO: 126659 - protein, 10 aa, Artificial Sequence
  Description of Artificial Sequence: Synthetic peptide
  Seed: ALDGGNKHFL (PMEL_HUMAN)
AQDGGNKHFW

SEQ ID NO: 126660 - protein, 10 aa, Artificial Sequence
  Description of Artificial Sequence: Synthetic peptide
  Seed: MAVVLASLIY (PMEL_HUMAN)
MCVVLASLIW

SEQ ID NO: 126661 - protein, 9 aa, Artificial Sequence
  Description of Artificial Sequence: Synthetic peptide
  Seed: RELPIPEPE (PMEL_HUMAN)
RELPIPEPV

SEQ ID NO: 126662 - protein, 9 aa, Artificial Sequence
  Description of Artificial Sequence: Synthetic peptide
  Seed: STAPVQMPT (PMEL_HUMAN)
SLAPVQMPA

SEQ ID NO: 126663 - protein, 10 aa, Artificial Sequence
  Description of Artificial Sequence: Synthetic peptide
  Seed: SQVWGGQPVY (PMEL_HUMAN)
SSVWGGQPVY

SEQ ID NO: 126664 - protein, 9 aa, Artificial Sequence
  Description of Artificial Sequence: Synthetic peptide
  Seed: VISTAPVQM (PMEL_HUMAN)
VLSTAPVQL

SEQ ID NO: 126665 - protein, 9 aa, Artificial Sequence
  Description of Artificial Sequence: Synthetic peptide
  Seed: AVVLASLIY (PMEL_HUMAN)
APVLASLIF

SEQ ID NO: 126666 - protein, 10 aa, Artificial Sequence
  Description of Artificial Sequence: Synthetic peptide
  Seed: GSRSYVPLAH (PMEL_HUMAN)
GARSYVPLAK

SEQ ID NO: 126667 - protein, 9 aa, Artificial Sequence
  Description of Artificial Sequence: Synthetic peptide
  Seed: VLMAVVLAS (PMEL_HUMAN)
VLMAVVLAI

SEQ ID NO: 126668 - protein, 9 aa, Artificial Sequence
  Description of Artificial Sequence: Synthetic peptide
  Seed: DIVQGIESA (PMEL_HUMAN)
DTVQGIESL

SEQ ID NO: 126669 - protein, 9 aa, Artificial Sequence
  Description of Artificial Sequence: Synthetic peptide
  Seed: STESITGSL (PMEL_HUMAN)
SMESITGSV

SEQ ID NO: 126670 - protein, 9 aa, Artificial Sequence
  Description of Artificial Sequence: Synthetic peptide
  Seed: STESITGSL (PMEL_HUMAN)
SVESITGSY

SEQ ID NO: 126671 - protein, 9 aa, Artificial Sequence
  Description of Artificial Sequence: Synthetic peptide
  Seed: VIWVNNTII (PMEL_HUMAN)
VLWVNNTIV

SEQ ID NO: 126672 - protein, 9 aa, Artificial Sequence
  Description of Artificial Sequence: Synthetic peptide
  Seed: LADTNSLAV (PMEL_HUMAN)
LWDTNSLAI

SEQ ID NO: 126673 - protein, 10 aa, Artificial Sequence
  Description of Artificial Sequence: Synthetic peptide
  Seed: YGSFSVTLDI (PMEL_HUMAN)
YASFSVTLDF

SEQ ID NO: 126674 - protein, 10 aa, Artificial Sequence
  Description of Artificial Sequence: Synthetic peptide
  Seed: EVVGTTPGQA (PMEL_HUMAN)
EAVGTTPGQK

SEQ ID NO: 126675 - protein, 9 aa, Artificial Sequence
  Description of Artificial Sequence: Synthetic peptide
  Seed: QAAIPLTSC (PMEL_HUMAN)
QAAIPLTSM

SEQ ID NO: 126676 - protein, 9 aa, Artificial Sequence
  Description of Artificial Sequence: Synthetic peptide
  Seed: RALDGGNKH (PMEL_HUMAN)
RSLDGGNKL

SEQ ID NO: 126677 - protein, 9 aa, Artificial Sequence
  Description of Artificial Sequence: Synthetic peptide
  Seed: AQRLCQPVL (PMEL_HUMAN)
ASRLCQPVY

SEQ ID NO: 126678 - protein, 9 aa, Artificial Sequence
  Description of Artificial Sequence: Synthetic peptide
  Seed: MAVVLASLI (PMEL_HUMAN)
MNVVLASLW

SEQ ID NO: 126679 - protein, 11 aa, Artificial Sequence
  Description of Artificial Sequence: Synthetic peptide
  Seed: RTKAWNRQLYP (PMEL_HUMAN)
RIKAWNRQLYK

SEQ ID NO: 126680 - protein, 9 aa, Artificial Sequence
  Description of Artificial Sequence: Synthetic peptide
  Seed: SVQVPTTEV (PMEL_HUMAN)
SPQVPTTEA

SEQ ID NO: 126681 - protein, 9 aa, Artificial Sequence
  Description of Artificial Sequence: Synthetic peptide
  Seed: KTWGQYWQV (PMEL_HUMAN)
KTWGQYWQW

SEQ ID NO: 126682 - protein, 11 aa, Artificial Sequence
  Description of Artificial Sequence: Synthetic peptide
  Seed: RTKAWNRQLYP (PMEL_HUMAN)
RMKAWNRQLYA

SEQ ID NO: 126683 - protein, 9 aa, Artificial Sequence
  Description of Artificial Sequence: Synthetic peptide
  Seed: ALDGGNKHF (PMEL_HUMAN)
AIDGGNKHM

SEQ ID NO: 126684 - protein, 9 aa, Artificial Sequence
  Description of Artificial Sequence: Synthetic peptide
  Seed: TTDGHRPTA (PMEL_HUMAN)
TTDGHRPTV

SEQ ID NO: 126685 - protein, 9 aa, Artificial Sequence
  Description of Artificial Sequence: Synthetic peptide
  Seed: VLMAVVLAS (PMEL_HUMAN)
VMMAVVLAV

SEQ ID NO: 126686 - protein, 10 aa, Artificial Sequence
  Description of Artificial Sequence: Synthetic peptide
  Seed: RNQDWLGVSR (PMEL_HUMAN)
RIQDWLGVSR

SEQ ID NO: 126687 - protein, 9 aa, Artificial Sequence
  Description of Artificial Sequence: Synthetic peptide
  Seed: RNQPLTFAL (PMEL_HUMAN)
RRQPLTFAV

SEQ ID NO: 126688 - protein, 9 aa, Artificial Sequence
  Description of Artificial Sequence: Synthetic peptide
  Seed: VLASLIYRR (PMEL_HUMAN)
VTASLIYRK

SEQ ID NO: 126689 - protein, 9 aa, Artificial Sequence
  Description of Artificial Sequence: Synthetic peptide
  Seed: SLAVVSTQL (PMEL_HUMAN)
SAAVVSTQI

SEQ ID NO: 126690 - protein, 11 aa, Artificial Sequence
  Description of Artificial Sequence: Synthetic peptide
  Seed: RRRLMKQDFSV (PMEL_HUMAN)
RRRLMKQDFSY

SEQ ID NO: 126691 - protein, 10 aa, Artificial Sequence
  Description of Artificial Sequence: Synthetic peptide
  Seed: LVLMAVVLAS (PMEL_HUMAN)
LLLMAVVLAA

SEQ ID NO: 126692 - protein, 10 aa, Artificial Sequence
  Description of Artificial Sequence: Synthetic peptide
  Seed: HTMEVTVYHR (PMEL_HUMAN)
HAMEVTVYHK

SEQ ID NO: 126693 - protein, 9 aa, Artificial Sequence
  Description of Artificial Sequence: Synthetic peptide
  Seed: QKRSFVYVW (PMEL_HUMAN)
QKRSFVYVY

SEQ ID NO: 126694 - protein, 9 aa, Artificial Sequence
  Description of Artificial Sequence: Synthetic peptide
  Seed: LQLHDPSGY (PMEL_HUMAN)
LALHDPSGY

SEQ ID NO: 126695 - protein, 9 aa, Artificial Sequence
  Description of Artificial Sequence: Synthetic peptide
  Seed: KQDFSVPQL (PMEL_HUMAN)
KMDFSVPQA

SEQ ID NO: 126696 - protein, 10 aa, Artificial Sequence
  Description of Artificial Sequence: Synthetic peptide
  Seed: YVPLAHSSSA (PMEL_HUMAN)
YNPLAHSSSI

SEQ ID NO: 126697 - protein, 9 aa, Artificial Sequence
  Description of Artificial Sequence: Synthetic peptide
  Seed: HTMEVTVYH (PMEL_HUMAN)
HMMEVTVYW

SEQ ID NO: 126698 - protein, 9 aa, Artificial Sequence
  Description of Artificial Sequence: Synthetic peptide
  Seed: YLEPGPVTA (PMEL_HUMAN)
YSEPGPVTL

SEQ ID NO: 126699 - protein, 10 aa, Artificial Sequence
  Description of Artificial Sequence: Synthetic peptide
  Seed: MKQDFSVPQL (PMEL_HUMAN)
MMQDFSVPQI

SEQ ID NO: 126700 - protein, 9 aa, Artificial Sequence
  Description of Artificial Sequence: Synthetic peptide
  Seed: RALVVTHTY (PMEL_HUMAN)
RMLVVTHTY

SEQ ID NO: 126701 - protein, 9 aa, Artificial Sequence
  Description of Artificial Sequence: Synthetic peptide
  Seed: LLDGTATLR (PMEL_HUMAN)
LTDGTATLY

SEQ ID NO: 126702 - protein, 10 aa, Artificial Sequence
  Description of Artificial Sequence: Synthetic peptide
  Seed: RALVVTHTYL (PMEL_HUMAN)
RTLVVTHTYF

SEQ ID NO: 126703 - protein, 9 aa, Artificial Sequence
  Description of Artificial Sequence: Synthetic peptide
  Seed: RLVKRQVPL (PMEL_HUMAN)
RPVKRQVPS

SEQ ID NO: 126704 - protein, 11 aa, Artificial Sequence
  Description of Artificial Sequence: Synthetic peptide
  Seed: DCWRGGQVSLK (PMEL_HUMAN)
DSWRGGQVSLR

SEQ ID NO: 126705 - protein, 10 aa, Artificial Sequence
  Description of Artificial Sequence: Synthetic peptide
  Seed: SGTYCLNVSL (PMEL_HUMAN)
SSTYCLNVSW

SEQ ID NO: 126706 - protein, 9 aa, Artificial Sequence
  Description of Artificial Sequence: Synthetic peptide
  Seed: KAWNRQLYP (PMEL_HUMAN)
KGWNRQLYK

SEQ ID NO: 126707 - protein, 9 aa, Artificial Sequence
  Description of Artificial Sequence: Synthetic peptide
  Seed: SVQVPTTEV (PMEL_HUMAN)
SQQVPTTEY

SEQ ID NO: 126708 - protein, 10 aa, Artificial Sequence
  Description of Artificial Sequence: Synthetic peptide
  Seed: GYLAEADLSY (PMEL_HUMAN)
GLLAEADLSF

SEQ ID NO: 126709 - protein, 9 aa, Artificial Sequence
  Description of Artificial Sequence: Synthetic peptide
  Seed: LVLMAVVLA (PMEL_HUMAN)
LQLMAVVLV

SEQ ID NO: 126710 - protein, 10 aa, Artificial Sequence
  Description of Artificial Sequence: Synthetic peptide
  Seed: RTKAWNRQLY (PMEL_HUMAN)
RTKAWNRQLT

SEQ ID NO: 126711 - protein, 10 aa, Artificial Sequence
  Description of Artificial Sequence: Synthetic peptide
  Seed: SVPQLPHSSS (PMEL_HUMAN)
SWPQLPHSSA

SEQ ID NO: 126712 - protein, 9 aa, Artificial Sequence
  Description of Artificial Sequence: Synthetic peptide
  Seed: VVLASLIYR (PMEL_HUMAN)
VSLASLIYR

SEQ ID NO: 126713 - protein, 8 aa, Artificial Sequence
  Description of Artificial Sequence: Synthetic peptide
  Seed: VLMAVVLA (PMEL_HUMAN)
VMMAVVLV

SEQ ID NO: 126714 - protein, 9 aa, Artificial Sequence
  Description of Artificial Sequence: Synthetic peptide
  Seed: ILKGGSGTY (PMEL_HUMAN)
IYKGGSGTY

SEQ ID NO: 126715 - protein, 10 aa, Artificial Sequence
  Description of Artificial Sequence: Synthetic peptide
  Seed: QVLGGPVSGL (PMEL_HUMAN)
QILGGPVSGR

SEQ ID NO: 126716 - protein, 11 aa, Artificial Sequence
  Description of Artificial Sequence: Synthetic peptide
  Seed: YRYGSFSVTLD (PMEL_HUMAN)
YRYGSFSVTLM

SEQ ID NO: 126717 - protein, 11 aa, Artificial Sequence
  Description of Artificial Sequence: Synthetic peptide
  Seed: VLGGPVSGLSI (PMEL_HUMAN)
VAGGPVSGLSM

SEQ ID NO: 126718 - protein, 11 aa, Artificial Sequence
  Description of Artificial Sequence: Synthetic peptide
  Seed: THTMEVTVYHR (PMEL_HUMAN)
TQTMEVTVYHR

SEQ ID NO: 126719 - protein, 10 aa, Artificial Sequence
  Description of Artificial Sequence: Synthetic peptide
  Seed: MPTAESTGMT (PMEL_HUMAN)
MWTAESTGMV

SEQ ID NO: 126720 - protein, 9 aa, Artificial Sequence
  Description of Artificial Sequence: Synthetic peptide
  Seed: KVLPDGQVI (PMEL_HUMAN)
KLLPDGQVL

SEQ ID NO: 126721 - protein, 11 aa, Artificial Sequence
  Description of Artificial Sequence: Synthetic peptide
  Seed: GPCPSGSWSQK (PMEL_HUMAN)
GPCPSGSWSQA

SEQ ID NO: 126722 - protein, 10 aa, Artificial Sequence
  Description of Artificial Sequence: Synthetic peptide
  Seed: SCPIGENSPL (PMEL_HUMAN)
SCPIGENSPM

SEQ ID NO: 126723 - protein, 9 aa, Artificial Sequence
  Description of Artificial Sequence: Synthetic peptide
  Seed: GSRSYVPLA (PMEL_HUMAN)
GTRSYVPLT

SEQ ID NO: 126724 - protein, 9 aa, Artificial Sequence
  Description of Artificial Sequence: Synthetic peptide
  Seed: TTPGQAPTA (PMEL_HUMAN)
TLPGQAPTM

SEQ ID NO: 126725 - protein, 9 aa, Artificial Sequence
  Description of Artificial Sequence: Synthetic peptide
  Seed: AAQVTTTEW (PMEL_HUMAN)
ATQVTTTEY

SEQ ID NO: 126726 - protein, 9 aa, Artificial Sequence
  Description of Artificial Sequence: Synthetic peptide
  Seed: VTLDIVQGI (PMEL_HUMAN)
VQLDIVQGI

SEQ ID NO: 126727 - protein, 9 aa, Artificial Sequence
  Description of Artificial Sequence: Synthetic peptide
  Seed: KQDFSVPQL (PMEL_HUMAN)
KYDFSVPQV

SEQ ID NO: 126728 - protein, 9 aa, Artificial Sequence
  Description of Artificial Sequence: Synthetic peptide
  Seed: LHLAVIGAL (PMEL_HUMAN)
LKLAVIGAM

SEQ ID NO: 126729 - protein, 9 aa, Artificial Sequence
  Description of Artificial Sequence: Synthetic peptide
  Seed: VSNDGPTLI (PMEL_HUMAN)
VANDGPTLI

SEQ ID NO: 126730 - protein, 9 aa, Artificial Sequence
  Description of Artificial Sequence: Synthetic peptide
  Seed: MPTAESTGM (PMEL_HUMAN)
MATAESTGY

SEQ ID NO: 126731 - protein, 10 aa, Artificial Sequence
  Description of Artificial Sequence: Synthetic peptide
  Seed: SVTLDIVQGI (PMEL_HUMAN)
SLTLDIVQGI

SEQ ID NO: 126732 - protein, 10 aa, Artificial Sequence
  Description of Artificial Sequence: Synthetic peptide
  Seed: YLAEADLSYT (PMEL_HUMAN)
YSAEADLSYA

SEQ ID NO: 126733 - protein, 9 aa, Artificial Sequence
  Description of Artificial Sequence: Synthetic peptide
  Seed: ISRALVVTH (PMEL_HUMAN)
ITRALVVTF

SEQ ID NO: 126734 - protein, 11 aa, Artificial Sequence
  Description of Artificial Sequence: Synthetic peptide
  Seed: RRGSRSYVPLA (PMEL_HUMAN)
RKGSRSYVPLA

SEQ ID NO: 126735 - protein, 10 aa, Artificial Sequence
  Description of Artificial Sequence: Synthetic peptide
  Seed: RQLYPEWTEA (PMEL_HUMAN)
RMLYPEWTEV

SEQ ID NO: 126736 - protein, 9 aa, Artificial Sequence
  Description of Artificial Sequence: Synthetic peptide
  Seed: SQKRSFVYV (PMEL_HUMAN)
SYKRSFVYK

SEQ ID NO: 126737 - protein, 9 aa, Artificial Sequence
  Description of Artificial Sequence: Synthetic peptide
  Seed: AQVVLQAAI (PMEL_HUMAN)
AMVVLQAAF

SEQ ID NO: 126738 - protein, 9 aa, Artificial Sequence
  Description of Artificial Sequence: Synthetic peptide
  Seed: KAWNRQLYP (PMEL_HUMAN)
KMWNRQLYA

SEQ ID NO: 126739 - protein, 8 aa, Artificial Sequence
  Description of Artificial Sequence: Synthetic peptide
  Seed: SQKRSFVY (PMEL_HUMAN)
SQKRSFVF

SEQ ID NO: 126740 - protein, 9 aa, Artificial Sequence
  Description of Artificial Sequence: Synthetic peptide
  Seed: LQAAIPLTS (PMEL_HUMAN)
LNAAIPLTY

SEQ ID NO: 126741 - protein, 10 aa, Artificial Sequence
  Description of Artificial Sequence: Synthetic peptide
  Seed: LKVSNDGPTL (PMEL_HUMAN)
LMVSNDGPTY

SEQ ID NO: 126742 - protein, 10 aa, Artificial Sequence
  Description of Artificial Sequence: Synthetic peptide
  Seed: YVPLAHSSSA (PMEL_HUMAN)
YNPLAHSSSV

SEQ ID NO: 126743 - protein, 9 aa, Artificial Sequence
  Description of Artificial Sequence: Synthetic peptide
  Seed: GENSPLLSG (PMEL_HUMAN)
GENSPLLSF

SEQ ID NO: 126744 - protein, 9 aa, Artificial Sequence
  Description of Artificial Sequence: Synthetic peptide
  Seed: MEVTVYHRR (PMEL_HUMAN)
MNVTVYHRK

SEQ ID NO: 126745 - protein, 9 aa, Artificial Sequence
  Description of Artificial Sequence: Synthetic peptide
  Seed: VSEVMGTTL (PMEL_HUMAN)
VTEVMGTTM

SEQ ID NO: 126746 - protein, 11 aa, Artificial Sequence
  Description of Artificial Sequence: Synthetic peptide
  Seed: RYGSFSVTLDI (PMEL_HUMAN)
REGSFSVTLDY

SEQ ID NO: 126747 - protein, 10 aa, Artificial Sequence
  Description of Artificial Sequence: Synthetic peptide
  Seed: ALDGGNKHFL (PMEL_HUMAN)
AADGGNKHFV

SEQ ID NO: 126748 - protein, 9 aa, Artificial Sequence
  Description of Artificial Sequence: Synthetic peptide
  Seed: ANASFSIAL (PMEL_HUMAN)
AEASFSIAY

SEQ ID NO: 126749 - protein, 10 aa, Artificial Sequence
  Description of Artificial Sequence: Synthetic peptide
  Seed: MTPAEVSIVV (PMEL_HUMAN)
MFPAEVSIVM

SEQ ID NO: 126750 - protein, 10 aa, Artificial Sequence
  Description of Artificial Sequence: Synthetic peptide
  Seed: YLAEADLSYT (PMEL_HUMAN)
YMAEADLSYL

SEQ ID NO: 126751 - protein, 10 aa, Artificial Sequence
  Description of Artificial Sequence: Synthetic peptide
  Seed: HFLRNQPLTF (PMEL_HUMAN)
HYLRNQPLTL

SEQ ID NO: 126752 - protein, 9 aa, Artificial Sequence
  Description of Artificial Sequence: Synthetic peptide
  Seed: VETTARELP (PMEL_HUMAN)
VETTARELA

SEQ ID NO: 126753 - protein, 9 aa, Artificial Sequence
  Description of Artificial Sequence: Synthetic peptide
  Seed: LYRYGSFSV (PMEL_HUMAN)
LYRYGSFSF

SEQ ID NO: 126754 - protein, 10 aa, Artificial Sequence
  Description of Artificial Sequence: Synthetic peptide
  Seed: AVIGALLAVG (PMEL_HUMAN)
AVIGALLAVK

SEQ ID NO: 126755 - protein, 11 aa, Artificial Sequence
  Description of Artificial Sequence: Synthetic peptide
  Seed: MAVVLASLIYR (PMEL_HUMAN)
MWVVLASLIYR

SEQ ID NO: 126756 - protein, 9 aa, Artificial Sequence
  Description of Artificial Sequence: Synthetic peptide
  Seed: VTAQVVLQA (PMEL_HUMAN)
VNAQVVLQL

SEQ ID NO: 126757 - protein, 9 aa, Artificial Sequence
  Description of Artificial Sequence: Synthetic peptide
  Seed: RAMLGTHTM (PMEL_HUMAN)
RKMLGTHTV

SEQ ID NO: 126758 - protein, 9 aa, Artificial Sequence
  Description of Artificial Sequence: Synthetic peptide
  Seed: LMAVVLASL (PMEL_HUMAN)
LMAVVLASV

SEQ ID NO: 126759 - protein, 9 aa, Artificial Sequence
  Description of Artificial Sequence: Synthetic peptide
  Seed: SQKRSFVYV (PMEL_HUMAN)
STKRSFVYA

SEQ ID NO: 126760 - protein, 10 aa, Artificial Sequence
  Description of Artificial Sequence: Synthetic peptide
  Seed: KRSFVYVWKT (PMEL_HUMAN)
KRSFVYVWKM

SEQ ID NO: 126761 - protein, 9 aa, Artificial Sequence
  Description of Artificial Sequence: Synthetic peptide
  Seed: VPLAHSSSA (PMEL_HUMAN)
VPLAHSSSY

SEQ ID NO: 126762 - protein, 9 aa, Artificial Sequence
  Description of Artificial Sequence: Synthetic peptide
  Seed: VLPSPACQL (PMEL_HUMAN)
VCPSPACQM

SEQ ID NO: 126763 - protein, 9 aa, Artificial Sequence
  Description of Artificial Sequence: Synthetic peptide
  Seed: RTKAWNRQL (PMEL_HUMAN)
RYKAWNRQV

SEQ ID NO: 126764 - protein, 9 aa, Artificial Sequence
  Description of Artificial Sequence: Synthetic peptide
  Seed: SEVMGTTLA (PMEL_HUMAN)
SEVMGTTLM

SEQ ID NO: 126765 - protein, 9 aa, Artificial Sequence
  Description of Artificial Sequence: Synthetic peptide
  Seed: YRYGSFSVT (PMEL_HUMAN)
YYYGSFSVL

SEQ ID NO: 126766 - protein, 10 aa, Artificial Sequence
  Description of Artificial Sequence: Synthetic peptide
  Seed: AVIGALLAVG (PMEL_HUMAN)
ALIGALLAVR

SEQ ID NO: 126767 - protein, 9 aa, Artificial Sequence
  Description of Artificial Sequence: Synthetic peptide
  Seed: DQVPFSVSV (PMEL_HUMAN)
DSVPFSVSI

SEQ ID NO: 126768 - protein, 11 aa, Artificial Sequence
  Description of Artificial Sequence: Synthetic peptide
  Seed: AEMSTPEATGM (PMEL_HUMAN)
AKMSTPEATGF

SEQ ID NO: 126769 - protein, 9 aa, Artificial Sequence
  Description of Artificial Sequence: Synthetic peptide
  Seed: RNQPLTFAL (PMEL_HUMAN)
RVQPLTFAL

SEQ ID NO: 126770 - protein, 10 aa, Artificial Sequence
  Description of Artificial Sequence: Synthetic peptide
  Seed: SITGSLGPLL (PMEL_HUMAN)
SMTGSLGPLA

SEQ ID NO: 126771 - protein, 10 aa, Artificial Sequence
  Description of Artificial Sequence: Synthetic peptide
  Seed: HTMEVTVYHR (PMEL_HUMAN)
HIMEVTVYHK

SEQ ID NO: 126772 - protein, 11 aa, Artificial Sequence
  Description of Artificial Sequence: Synthetic peptide
  Seed: RRRLMKQDFSV (PMEL_HUMAN)
RTRLMKQDFSV

SEQ ID NO: 126773 - protein, 10 aa, Artificial Sequence
  Description of Artificial Sequence: Synthetic peptide
  Seed: YVWKTWGQYW (PMEL_HUMAN)
YAWKTWGQYW

SEQ ID NO: 126774 - protein, 10 aa, Artificial Sequence
  Description of Artificial Sequence: Synthetic peptide
  Seed: LIMPGQEAGL (PMEL_HUMAN)
LIMPGQEAGI

SEQ ID NO: 126775 - protein, 10 aa, Artificial Sequence
  Description of Artificial Sequence: Synthetic peptide
  Seed: ESAEILQAVP (PMEL_HUMAN)
ETAEILQAVT

SEQ ID NO: 126776 - protein, 10 aa, Artificial Sequence
  Description of Artificial Sequence: Synthetic peptide
  Seed: AVPSGEGDAF (PMEL_HUMAN)
AAPSGEGDAL

SEQ ID NO: 126777 - protein, 9 aa, Artificial Sequence
  Description of Artificial Sequence: Synthetic peptide
  Seed: RALDGGNKH (PMEL_HUMAN)
RTLDGGNKF

SEQ ID NO: 126778 - protein, 10 aa, Artificial Sequence
  Description of Artificial Sequence: Synthetic peptide
  Seed: GPLLDGTATL (PMEL_HUMAN)
GWLLDGTATA

SEQ ID NO: 126779 - protein, 10 aa, Artificial Sequence
  Description of Artificial Sequence: Synthetic peptide
  Seed: SQVWGGQPVY (PMEL_HUMAN)
SKVWGGQPVM

SEQ ID NO: 126780 - protein, 11 aa, Artificial Sequence
  Description of Artificial Sequence: Synthetic peptide
  Seed: FGDSSGTLISR (PMEL_HUMAN)
FFDSSGTLISF

SEQ ID NO: 126781 - protein, 9 aa, Artificial Sequence
  Description of Artificial Sequence: Synthetic peptide
  Seed: ALVVTHTYL (PMEL_HUMAN)
AQVVTHTYL

SEQ ID NO: 126782 - protein, 9 aa, Artificial Sequence
  Description of Artificial Sequence: Synthetic peptide
  Seed: AVIGALLAV (PMEL_HUMAN)
ARIGALLAV

SEQ ID NO: 126783 - protein, 9 aa, Artificial Sequence
  Description of Artificial Sequence: Synthetic peptide
  Seed: FSIALNFPG (PMEL_HUMAN)
FCIALNFPW

SEQ ID NO: 126784 - protein, 9 aa, Artificial Sequence
  Description of Artificial Sequence: Synthetic peptide
  Seed: RAMLGTHTM (PMEL_HUMAN)
RVMLGTHTY

SEQ ID NO: 126785 - protein, 10 aa, Artificial Sequence
  Description of Artificial Sequence: Synthetic peptide
  Seed: YRYGSFSVTL (PMEL_HUMAN)
YDYGSFSVTF

SEQ ID NO: 126786 - protein, 10 aa, Artificial Sequence
  Description of Artificial Sequence: Synthetic peptide
  Seed: NSLAVVSTQL (PMEL_HUMAN)
NMLAVVSTQV

SEQ ID NO: 126787 - protein, 9 aa, Artificial Sequence
  Description of Artificial Sequence: Synthetic peptide
  Seed: AGQVPTTEV (PMEL_HUMAN)
AIQVPTTEL

SEQ ID NO: 126788 - protein, 9 aa, Artificial Sequence
  Description of Artificial Sequence: Synthetic peptide
  Seed: ALNFPGSQK (PMEL_HUMAN)
AINFPGSQM

SEQ ID NO: 126789 - protein, 9 aa, Artificial Sequence
  Description of Artificial Sequence: Synthetic peptide
  Seed: LHLAVIGAL (PMEL_HUMAN)
LQLAVIGAW

SEQ ID NO: 126790 - protein, 10 aa, Artificial Sequence
  Description of Artificial Sequence: Synthetic peptide
  Seed: FLRNQPLTFA (PMEL_HUMAN)
FQRNQPLTFV

SEQ ID NO: 126791 - protein, 10 aa, Artificial Sequence
  Description of Artificial Sequence: Synthetic peptide
  Seed: VPLAHSSSAF (PMEL_HUMAN)
VELAHSSSAY

SEQ ID NO: 126792 - protein, 9 aa, Artificial Sequence
  Description of Artificial Sequence: Synthetic peptide
  Seed: MLGTHTMEV (PMEL_HUMAN)
MTGTHTMEL

SEQ ID NO: 126793 - protein, 11 aa, Artificial Sequence
  Description of Artificial Sequence: Synthetic peptide
  Seed: RALDGGNKHFL (PMEL_HUMAN)
RMLDGGNKHFV

SEQ ID NO: 126794 - protein, 9 aa, Artificial Sequence
  Description of Artificial Sequence: Synthetic peptide
  Seed: KTWGQYWQV (PMEL_HUMAN)
KNWGQYWQR

SEQ ID NO: 126795 - protein, 11 aa, Artificial Sequence
  Description of Artificial Sequence: Synthetic peptide
  Seed: GYLAEADLSYT (PMEL_HUMAN)
GYLAEADLSYA

SEQ ID NO: 126796 - protein, 10 aa, Artificial Sequence
  Description of Artificial Sequence: Synthetic peptide
  Seed: RALVVTHTYL (PMEL_HUMAN)
RMLVVTHTYV

SEQ ID NO: 126797 - protein, 8 aa, Artificial Sequence
  Description of Artificial Sequence: Synthetic peptide
  Seed: SEVMGTTL (PMEL_HUMAN)
SQVMGTTV

SEQ ID NO: 126798 - protein, 9 aa, Artificial Sequence
  Description of Artificial Sequence: Synthetic peptide
  Seed: KHFLRNQPL (PMEL_HUMAN)
KHFLRNQPM

SEQ ID NO: 126799 - protein, 9 aa, Artificial Sequence
  Description of Artificial Sequence: Synthetic peptide
  Seed: FTITDQVPF (PMEL_HUMAN)
FEITDQVPF

SEQ ID NO: 126800 - protein, 9 aa, Artificial Sequence
  Description of Artificial Sequence: Synthetic peptide
  Seed: VMGTTLAEM (PMEL_HUMAN)
VQGTTLAEM

SEQ ID NO: 126801 - protein, 8 aa, Artificial Sequence
  Description of Artificial Sequence: Synthetic peptide
  Seed: LADTNSLA (PMEL_HUMAN)
LSDTNSLL

SEQ ID NO: 126802 - protein, 10 aa, Artificial Sequence
  Description of Artificial Sequence: Synthetic peptide
  Seed: YGSFSVTLDI (PMEL_HUMAN)
YESFSVTLDF

SEQ ID NO: 126803 - protein, 9 aa, Artificial Sequence
  Description of Artificial Sequence: Synthetic peptide
  Seed: LADTNSLAV (PMEL_HUMAN)
LIDTNSLAY

SEQ ID NO: 126804 - protein, 10 aa, Artificial Sequence
  Description of Artificial Sequence: Synthetic peptide
  Seed: YGSFSVTLDI (PMEL_HUMAN)
YLSFSVTLDF

SEQ ID NO: 126805 - protein, 9 aa, Artificial Sequence
  Description of Artificial Sequence: Synthetic peptide
  Seed: TTPGQAPTA (PMEL_HUMAN)
TIPGQAPTI

SEQ ID NO: 126806 - protein, 9 aa, Artificial Sequence
  Description of Artificial Sequence: Synthetic peptide
  Seed: TLIGANASF (PMEL_HUMAN)
TIIGANASF

SEQ ID NO: 126807 - protein, 10 aa, Artificial Sequence
  Description of Artificial Sequence: Synthetic peptide
  Seed: LNFPGSQKVL (PMEL_HUMAN)
LVFPGSQKVF

SEQ ID NO: 126808 - protein, 9 aa, Artificial Sequence
  Description of Artificial Sequence: Synthetic peptide
  Seed: VIWVNNTII (PMEL_HUMAN)
VLWVNNTIL

SEQ ID NO: 126809 - protein, 9 aa, Artificial Sequence
  Description of Artificial Sequence: Synthetic peptide
  Seed: ITDQVPFSV (PMEL_HUMAN)
ISDQVPFSI

SEQ ID NO: 126810 - protein, 10 aa, Artificial Sequence
  Description of Artificial Sequence: Synthetic peptide
  Seed: LRNQPLTFAL (PMEL_HUMAN)
LRNQPLTFAI

SEQ ID NO: 126811 - protein, 9 aa, Artificial Sequence
  Description of Artificial Sequence: Synthetic peptide
  Seed: MAVVLASLI (PMEL_HUMAN)
MSVVLASLV

SEQ ID NO: 126812 - protein, 9 aa, Artificial Sequence
  Description of Artificial Sequence: Synthetic peptide
  Seed: FLRNQPLTF (PMEL_HUMAN)
FYRNQPLTW

SEQ ID NO: 126813 - protein, 9 aa, Artificial Sequence
  Description of Artificial Sequence: Synthetic peptide
  Seed: FLRNQPLTF (PMEL_HUMAN)
FPRNQPLTT

SEQ ID NO: 126814 - protein, 9 aa, Artificial Sequence
  Description of Artificial Sequence: Synthetic peptide
  Seed: IMPGQEAGL (PMEL_HUMAN)
ILPGQEAGL

SEQ ID NO: 126815 - protein, 9 aa, Artificial Sequence
  Description of Artificial Sequence: Synthetic peptide
  Seed: SAFTITDQV (PMEL_HUMAN)
SMFTITDQW

SEQ ID NO: 126816 - protein, 9 aa, Artificial Sequence
  Description of Artificial Sequence: Synthetic peptide
  Seed: MPTAESTGM (PMEL_HUMAN)
MATAESTGW

SEQ ID NO: 126817 - protein, 10 aa, Artificial Sequence
  Description of Artificial Sequence: Synthetic peptide
  Seed: LAVIGALLAV (PMEL_HUMAN)
LYVIGALLAI

SEQ ID NO: 126818 - protein, 10 aa, Artificial Sequence
  Description of Artificial Sequence: Synthetic peptide
  Seed: RALVVTHTYL (PMEL_HUMAN)
RLLVVTHTYV

SEQ ID NO: 126819 - protein, 10 aa, Artificial Sequence
  Description of Artificial Sequence: Synthetic peptide
  Seed: STAPVQMPTA (PMEL_HUMAN)
SLAPVQMPTI

SEQ ID NO: 126820 - protein, 9 aa, Artificial Sequence
  Description of Artificial Sequence: Synthetic peptide
  Seed: FGDSSGTLI (PMEL_HUMAN)
FSDSSGTLV

SEQ ID NO: 126821 - protein, 10 aa, Artificial Sequence
  Description of Artificial Sequence: Synthetic peptide
  Seed: TMEVTVYHRR (PMEL_HUMAN)
TTEVTVYHRR

SEQ ID NO: 126822 - protein, 8 aa, Artificial Sequence
  Description of Artificial Sequence: Synthetic peptide
  Seed: TLDIVQGI (PMEL_HUMAN)
TADIVQGF

SEQ ID NO: 126823 - protein, 9 aa, Artificial Sequence
  Description of Artificial Sequence: Synthetic peptide
  Seed: LIVGILLVL (PMEL_HUMAN)
LMVGILLVI

SEQ ID NO: 126824 - protein, 9 aa, Artificial Sequence
  Description of Artificial Sequence: Synthetic peptide
  Seed: ASFSIALNF (PMEL_HUMAN)
ALFSIALNY

SEQ ID NO: 126825 - protein, 9 aa, Artificial Sequence
  Description of Artificial Sequence: Synthetic peptide
  Seed: RYGSFSVTL (PMEL_HUMAN)
RWGSFSVTY

SEQ ID NO: 126826 - protein, 9 aa, Artificial Sequence
  Description of Artificial Sequence: Synthetic peptide
  Seed: SGLSIGTGR (PMEL_HUMAN)
SSLSIGTGY

SEQ ID NO: 126827 - protein, 9 aa, Artificial Sequence
  Description of Artificial Sequence: Synthetic peptide
  Seed: AVIGALLAV (PMEL_HUMAN)
AMIGALLAA

SEQ ID NO: 126828 - protein, 9 aa, Artificial Sequence
  Description of Artificial Sequence: Synthetic peptide
  Seed: FGDSSGTLI (PMEL_HUMAN)
FNDSSGTLF

SEQ ID NO: 126829 - protein, 10 aa, Artificial Sequence
  Description of Artificial Sequence: Synthetic peptide
  Seed: KTWGQYWQVL (PMEL_HUMAN)
KLWGQYWQVC

SEQ ID NO: 126830 - protein, 11 aa, Artificial Sequence
  Description of Artificial Sequence: Synthetic peptide
  Seed: YVPLAHSSSAF (PMEL_HUMAN)
YMPLAHSSSAY

SEQ ID NO: 126831 - protein, 10 aa, Artificial Sequence
  Description of Artificial Sequence: Synthetic peptide
  Seed: AFTITDQVPF (PMEL_HUMAN)
AQTITDQVPY

SEQ ID NO: 126832 - protein, 9 aa, Artificial Sequence
  Description of Artificial Sequence: Synthetic peptide
  Seed: RAMLGTHTM (PMEL_HUMAN)
RWMLGTHTM

SEQ ID NO: 126833 - protein, 10 aa, Artificial Sequence
  Description of Artificial Sequence: Synthetic peptide
  Seed: RGSRSYVPLA (PMEL_HUMAN)
RMSRSYVPLA

SEQ ID NO: 126834 - protein, 9 aa, Artificial Sequence
  Description of Artificial Sequence: Synthetic peptide
  Seed: TIINGSQVW (PMEL_HUMAN)
TTINGSQVF

SEQ ID NO: 126835 - protein, 9 aa, Artificial Sequence
  Description of Artificial Sequence: Synthetic peptide
  Seed: YHRRGSRSY (PMEL_HUMAN)
YQRRGSRSM

SEQ ID NO: 126836 - protein, 11 aa, Artificial Sequence
  Description of Artificial Sequence: Synthetic peptide
  Seed: RRGSRSYVPLA (PMEL_HUMAN)
RYGSRSYVPLV

SEQ ID NO: 126837 - protein, 9 aa, Artificial Sequence
  Description of Artificial Sequence: Synthetic peptide
  Seed: LIVGILLVL (PMEL_HUMAN)
LIVGILLVI

SEQ ID NO: 126838 - protein, 9 aa, Artificial Sequence
  Description of Artificial Sequence: Synthetic peptide
  Seed: FLRNQPLTF (PMEL_HUMAN)
FFRNQPLTI

SEQ ID NO: 126839 - protein, 11 aa, Artificial Sequence
  Description of Artificial Sequence: Synthetic peptide
  Seed: QLYPEWTEAQR (PMEL_HUMAN)
QIYPEWTEAQR

SEQ ID NO: 126840 - protein, 9 aa, Artificial Sequence
  Description of Artificial Sequence: Synthetic peptide
  Seed: EKVPVSEVM (PMEL_HUMAN)
ETVPVSEVY

SEQ ID NO: 126841 - protein, 10 aa, Artificial Sequence
  Description of Artificial Sequence: Synthetic peptide
  Seed: AVPSGEGDAF (PMEL_HUMAN)
AFPSGEGDAF

SEQ ID NO: 126842 - protein, 9 aa, Artificial Sequence
  Description of Artificial Sequence: Synthetic peptide
  Seed: VMGTTLAEM (PMEL_HUMAN)
VLGTTLAEV

SEQ ID NO: 126843 - protein, 9 aa, Artificial Sequence
  Description of Artificial Sequence: Synthetic peptide
  Seed: GQVPLIVGI (PMEL_HUMAN)
GRVPLIVGF

SEQ ID NO: 126844 - protein, 9 aa, Artificial Sequence
  Description of Artificial Sequence: Synthetic peptide
  Seed: RSYVPLAHS (PMEL_HUMAN)
RVYVPLAHV

SEQ ID NO: 126845 - protein, 9 aa, Artificial Sequence
  Description of Artificial Sequence: Synthetic peptide
  Seed: LVLKRCLLH (PMEL_HUMAN)
LTLKRCLLR

SEQ ID NO: 126846 - protein, 10 aa, Artificial Sequence
  Description of Artificial Sequence: Synthetic peptide
  Seed: AVPSGEGDAF (PMEL_HUMAN)
AAPSGEGDAF

SEQ ID NO: 126847 - protein, 11 aa, Artificial Sequence
  Description of Artificial Sequence: Synthetic peptide
  Seed: GYLAEADLSYT (PMEL_HUMAN)
GWLAEADLSYI

SEQ ID NO: 126848 - protein, 9 aa, Artificial Sequence
  Description of Artificial Sequence: Synthetic peptide
  Seed: HTMEVTVYH (PMEL_HUMAN)
HCMEVTVYF

SEQ ID NO: 126849 - protein, 9 aa, Artificial Sequence
  Description of Artificial Sequence: Synthetic peptide
  Seed: KVLPDGQVI (PMEL_HUMAN)
KTLPDGQVY

SEQ ID NO: 126850 - protein, 11 aa, Artificial Sequence
  Description of Artificial Sequence: Synthetic peptide
  Seed: RYGSFSVTLDI (PMEL_HUMAN)
RMGSFSVTLDW

SEQ ID NO: 126851 - protein, 9 aa, Artificial Sequence
  Description of Artificial Sequence: Synthetic peptide
  Seed: SLADTNSLA (PMEL_HUMAN)
SMADTNSLV

SEQ ID NO: 126852 - protein, 9 aa, Artificial Sequence
  Description of Artificial Sequence: Synthetic peptide
  Seed: FTITDQVPF (PMEL_HUMAN)
FPITDQVPL

SEQ ID NO: 126853 - protein, 9 aa, Artificial Sequence
  Description of Artificial Sequence: Synthetic peptide
  Seed: VSNDGPTLI (PMEL_HUMAN)
VMNDGPTLL

SEQ ID NO: 126854 - protein, 10 aa, Artificial Sequence
  Description of Artificial Sequence: Synthetic peptide
  Seed: VPLAHSSSAF (PMEL_HUMAN)
VGLAHSSSAF

SEQ ID NO: 126855 - protein, 9 aa, Artificial Sequence
  Description of Artificial Sequence: Synthetic peptide
  Seed: AGQVPTTEV (PMEL_HUMAN)
ASQVPTTEY

SEQ ID NO: 126856 - protein, 10 aa, Artificial Sequence
  Description of Artificial Sequence: Synthetic peptide
  Seed: GYLAEADLSY (PMEL_HUMAN)
GQLAEADLSF

SEQ ID NO: 126857 - protein, 10 aa, Artificial Sequence
  Description of Artificial Sequence: Synthetic peptide
  Seed: ESITGSLGPL (PMEL_HUMAN)
EVITGSLGPV

SEQ ID NO: 126858 - protein, 10 aa, Artificial Sequence
  Description of Artificial Sequence: Synthetic peptide
  Seed: ALNFPGSQKV (PMEL_HUMAN)
AMNFPGSQKV

SEQ ID NO: 126859 - protein, 9 aa, Artificial Sequence
  Description of Artificial Sequence: Synthetic peptide
  Seed: AQVVLQAAI (PMEL_HUMAN)
AVVVLQAAY

SEQ ID NO: 126860 - protein, 10 aa, Artificial Sequence
  Description of Artificial Sequence: Synthetic peptide
  Seed: EVSIVVLSGT (PMEL_HUMAN)
EDSIVVLSGI

SEQ ID NO: 126861 - protein, 10 aa, Artificial Sequence
  Description of Artificial Sequence: Synthetic peptide
  Seed: IALNFPGSQK (PMEL_HUMAN)
IDLNFPGSQK

SEQ ID NO: 126862 - protein, 11 aa, Artificial Sequence
  Description of Artificial Sequence: Synthetic peptide
  Seed: RRGSRSYVPLA (PMEL_HUMAN)
RPGSRSYVPLK

SEQ ID NO: 126863 - protein, 11 aa, Artificial Sequence
  Description of Artificial Sequence: Synthetic peptide
  Seed: SQVWGGQPVYP (PMEL_HUMAN)
SQVWGGQPVYM

SEQ ID NO: 126864 - protein, 9 aa, Artificial Sequence
  Description of Artificial Sequence: Synthetic peptide
  Seed: QPVLPSPAC (PMEL_HUMAN)
QHVLPSPAI

SEQ ID NO: 126865 - protein, 9 aa, Artificial Sequence
  Description of Artificial Sequence: Synthetic peptide
  Seed: VSNDGPTLI (PMEL_HUMAN)
VVNDGPTLY

SEQ ID NO: 126866 - protein, 9 aa, Artificial Sequence
  Description of Artificial Sequence: Synthetic peptide
  Seed: RTKAWNRQL (PMEL_HUMAN)
RTKAWNRQI

SEQ ID NO: 126867 - protein, 9 aa, Artificial Sequence
  Description of Artificial Sequence: Synthetic peptide
  Seed: VLPDGQVIW (PMEL_HUMAN)
VFPDGQVIW

SEQ ID NO: 126868 - protein, 9 aa, Artificial Sequence
  Description of Artificial Sequence: Synthetic peptide
  Seed: KHFLRNQPL (PMEL_HUMAN)
KMFLRNQPV

SEQ ID NO: 126869 - protein, 9 aa, Artificial Sequence
  Description of Artificial Sequence: Synthetic peptide
  Seed: FTITDQVPF (PMEL_HUMAN)
FMITDQVPT

SEQ ID NO: 126870 - protein, 9 aa, Artificial Sequence
  Description of Artificial Sequence: Synthetic peptide
  Seed: MLGTHTMEV (PMEL_HUMAN)
MAGTHTMEL

SEQ ID NO: 126871 - protein, 9 aa, Artificial Sequence
  Description of Artificial Sequence: Synthetic peptide
  Seed: LIVGILLVL (PMEL_HUMAN)
LMVGILLVY

SEQ ID NO: 126872 - protein, 10 aa, Artificial Sequence
  Description of Artificial Sequence: Synthetic peptide
  Seed: SVPQLPHSSS (PMEL_HUMAN)
SKPQLPHSSF

SEQ ID NO: 126873 - protein, 10 aa, Artificial Sequence
  Description of Artificial Sequence: Synthetic peptide
  Seed: AWNRQLYPEW (PMEL_HUMAN)
AYNRQLYPEF

SEQ ID NO: 126874 - protein, 10 aa, Artificial Sequence
  Description of Artificial Sequence: Synthetic peptide
  Seed: VLSGTTAAQV (PMEL_HUMAN)
VMSGTTAAQI

SEQ ID NO: 126875 - protein, 11 aa, Artificial Sequence
  Description of Artificial Sequence: Synthetic peptide
  Seed: MAVVLASLIYR (PMEL_HUMAN)
MEVVLASLIYK

SEQ ID NO: 126876 - protein, 11 aa, Artificial Sequence
  Description of Artificial Sequence: Synthetic peptide
  Seed: SAFTITDQVPF (PMEL_HUMAN)
SPFTITDQVPF

SEQ ID NO: 126877 - protein, 9 aa, Artificial Sequence
  Description of Artificial Sequence: Synthetic peptide
  Seed: QPVLPSPAC (PMEL_HUMAN)
QAVLPSPAY

SEQ ID NO: 126878 - protein, 9 aa, Artificial Sequence
  Description of Artificial Sequence: Synthetic peptide
  Seed: LAVVSTQLI (PMEL_HUMAN)
LGVVSTQLW

SEQ ID NO: 126879 - protein, 9 aa, Artificial Sequence
  Description of Artificial Sequence: Synthetic peptide
  Seed: GMTPAEVSI (PMEL_HUMAN)
GMTPAEVSW

SEQ ID NO: 126880 - protein, 9 aa, Artificial Sequence
  Description of Artificial Sequence: Synthetic peptide
  Seed: QVWGGQPVY (PMEL_HUMAN)
QWWGGQPVY

SEQ ID NO: 126881 - protein, 9 aa, Artificial Sequence
  Description of Artificial Sequence: Synthetic peptide
  Seed: VLYRYGSFS (PMEL_HUMAN)
VIYRYGSFV

SEQ ID NO: 126882 - protein, 9 aa, Artificial Sequence
  Description of Artificial Sequence: Synthetic peptide
  Seed: HTMEVTVYH (PMEL_HUMAN)
HSMEVTVYF

SEQ ID NO: 126883 - protein, 10 aa, Artificial Sequence
  Description of Artificial Sequence: Synthetic peptide
  Seed: ALLAVGATKV (PMEL_HUMAN)
ATLAVGATKR

SEQ ID NO: 126884 - protein, 10 aa, Artificial Sequence
  Description of Artificial Sequence: Synthetic peptide
  Seed: RALVVTHTYL (PMEL_HUMAN)
RMLVVTHTYY

SEQ ID NO: 126885 - protein, 11 aa, Artificial Sequence
  Description of Artificial Sequence: Synthetic peptide
  Seed: ALDGGNKHFLR (PMEL_HUMAN)
AMDGGNKHFLR

SEQ ID NO: 126886 - protein, 9 aa, Artificial Sequence
  Description of Artificial Sequence: Synthetic peptide
  Seed: LPHSSSHWL (PMEL_HUMAN)
LPHSSSHWI

SEQ ID NO: 126887 - protein, 10 aa, Artificial Sequence
  Description of Artificial Sequence: Synthetic peptide
  Seed: SPVPGTTDGH (PMEL_HUMAN)
SAVPGTTDGY

SEQ ID NO: 126888 - protein, 10 aa, Artificial Sequence
  Description of Artificial Sequence: Synthetic peptide
  Seed: YLAEADLSYT (PMEL_HUMAN)
YMAEADLSYY

SEQ ID NO: 126889 - protein, 9 aa, Artificial Sequence
  Description of Artificial Sequence: Synthetic peptide
  Seed: HTMEVTVYH (PMEL_HUMAN)
HPMEVTVYL

SEQ ID NO: 126890 - protein, 9 aa, Artificial Sequence
  Description of Artificial Sequence: Synthetic peptide
  Seed: TTDGHRPTA (PMEL_HUMAN)
TADGHRPTC

SEQ ID NO: 126891 - protein, 9 aa, Artificial Sequence
  Description of Artificial Sequence: Synthetic peptide
  Seed: TWGQYWQVL (PMEL_HUMAN)
TWGQYWQVF

SEQ ID NO: 126892 - protein, 8 aa, Artificial Sequence
  Description of Artificial Sequence: Synthetic peptide
  Seed: KAWNRQLY (PMEL_HUMAN)
KTWNRQLF

SEQ ID NO: 126893 - protein, 9 aa, Artificial Sequence
  Description of Artificial Sequence: Synthetic peptide
  Seed: LADTNSLAV (PMEL_HUMAN)
LNDTNSLAL

SEQ ID NO: 126894 - protein, 9 aa, Artificial Sequence
  Description of Artificial Sequence: Synthetic peptide
  Seed: AHSSSAFTI (PMEL_HUMAN)
AVSSSAFTF

SEQ ID NO: 126895 - protein, 8 aa, Artificial Sequence
  Description of Artificial Sequence: Synthetic peptide
  Seed: SNDGPTLI (PMEL_HUMAN)
SYDGPTLI

SEQ ID NO: 126896 - protein, 11 aa, Artificial Sequence
  Description of Artificial Sequence: Synthetic peptide
  Seed: FGDSSGTLISR (PMEL_HUMAN)
FADSSGTLISY

SEQ ID NO: 126897 - protein, 10 aa, Artificial Sequence
  Description of Artificial Sequence: Synthetic peptide
  Seed: VLPDGQVIWV (PMEL_HUMAN)
VIPDGQVIWV

SEQ ID NO: 126898 - protein, 9 aa, Artificial Sequence
  Description of Artificial Sequence: Synthetic peptide
  Seed: AAQVTTTEW (PMEL_HUMAN)
ASQVTTTEL

SEQ ID NO: 126899 - protein, 9 aa, Artificial Sequence
  Description of Artificial Sequence: Synthetic peptide
  Seed: FTITDQVPF (PMEL_HUMAN)
FTITDQVPV

SEQ ID NO: 126900 - protein, 10 aa, Artificial Sequence
  Description of Artificial Sequence: Synthetic peptide
  Seed: HTMEVTVYHR (PMEL_HUMAN)
HGMEVTVYHR

SEQ ID NO: 126901 - protein, 10 aa, Artificial Sequence
  Description of Artificial Sequence: Synthetic peptide
  Seed: ESAEILQAVP (PMEL_HUMAN)
ETAEILQAVP

SEQ ID NO: 126902 - protein, 10 aa, Artificial Sequence
  Description of Artificial Sequence: Synthetic peptide
  Seed: QVLGGPVSGL (PMEL_HUMAN)
QILGGPVSGK

SEQ ID NO: 126903 - protein, 8 aa, Artificial Sequence
  Description of Artificial Sequence: Synthetic peptide
  Seed: TDQVPFSV (PMEL_HUMAN)
TEQVPFSL

SEQ ID NO: 126904 - protein, 9 aa, Artificial Sequence
  Description of Artificial Sequence: Synthetic peptide
  Seed: GQVPTTEVV (PMEL_HUMAN)
GKVPTTEVY

SEQ ID NO: 126905 - protein, 9 aa, Artificial Sequence
  Description of Artificial Sequence: Synthetic peptide
  Seed: RAMLGTHTM (PMEL_HUMAN)
RLMLGTHTF

SEQ ID NO: 126906 - protein, 9 aa, Artificial Sequence
  Description of Artificial Sequence: Synthetic peptide
  Seed: QVWGGQPVY (PMEL_HUMAN)
QMWGGQPVL

SEQ ID NO: 126907 - protein, 9 aa, Artificial Sequence
  Description of Artificial Sequence: Synthetic peptide
  Seed: RTKAWNRQL (PMEL_HUMAN)
RAKAWNRQA

SEQ ID NO: 126908 - protein, 9 aa, Artificial Sequence
  Description of Artificial Sequence: Synthetic peptide
  Seed: RLMKQDFSV (PMEL_HUMAN)
RMMKQDFSR

SEQ ID NO: 126909 - protein, 10 aa, Artificial Sequence
  Description of Artificial Sequence: Synthetic peptide
  Seed: RSFVYVWKTW (PMEL_HUMAN)
RAFVYVWKTF

SEQ ID NO: 126910 - protein, 10 aa, Artificial Sequence
  Description of Artificial Sequence: Synthetic peptide
  Seed: SCPIGENSPL (PMEL_HUMAN)
SPPIGENSPM

SEQ ID NO: 126911 - protein, 9 aa, Artificial Sequence
  Description of Artificial Sequence: Synthetic peptide
  Seed: ITGSLGPLL (PMEL_HUMAN)
IMGSLGPLW

SEQ ID NO: 126912 - protein, 9 aa, Artificial Sequence
  Description of Artificial Sequence: Synthetic peptide
  Seed: YLEPGPVTA (PMEL_HUMAN)
YYEPGPVTM

SEQ ID NO: 126913 - protein, 9 aa, Artificial Sequence
  Description of Artificial Sequence: Synthetic peptide
  Seed: GSRSYVPLA (PMEL_HUMAN)
GVRSYVPLI

SEQ ID NO: 126914 - protein, 10 aa, Artificial Sequence
  Description of Artificial Sequence: Synthetic peptide
  Seed: FLRNQPLTFA (PMEL_HUMAN)
FIRNQPLTFI

SEQ ID NO: 126915 - protein, 11 aa, Artificial Sequence
  Description of Artificial Sequence: Synthetic peptide
  Seed: MAVVLASLIYR (PMEL_HUMAN)
MYVVLASLIYK

SEQ ID NO: 126916 - protein, 9 aa, Artificial Sequence
  Description of Artificial Sequence: Synthetic peptide
  Seed: RYGSFSVTL (PMEL_HUMAN)
RVGSFSVTL

SEQ ID NO: 126917 - protein, 9 aa, Artificial Sequence
  Description of Artificial Sequence: Synthetic peptide
  Seed: ASFSIALNF (PMEL_HUMAN)
AHFSIALNM

SEQ ID NO: 126918 - protein, 9 aa, Artificial Sequence
  Description of Artificial Sequence: Synthetic peptide
  Seed: TAPVQMPTA (PMEL_HUMAN)
TSPVQMPTI

SEQ ID NO: 126919 - protein, 9 aa, Artificial Sequence
  Description of Artificial Sequence: Synthetic peptide
  Seed: GENSPLLSG (PMEL_HUMAN)
GENSPLLSA

SEQ ID NO: 126920 - protein, 10 aa, Artificial Sequence
  Description of Artificial Sequence: Synthetic peptide
  Seed: RSFVYVWKTW (PMEL_HUMAN)
RLFVYVWKTF

SEQ ID NO: 126921 - protein, 11 aa, Artificial Sequence
  Description of Artificial Sequence: Synthetic peptide
  Seed: RAMLGTHTMEV (PMEL_HUMAN)
RLMLGTHTMEV

SEQ ID NO: 126922 - protein, 9 aa, Artificial Sequence
  Description of Artificial Sequence: Synthetic peptide
  Seed: VPFSVSVSQ (PMEL_HUMAN)
VPFSVSVSF

SEQ ID NO: 126923 - protein, 9 aa, Artificial Sequence
  Description of Artificial Sequence: Synthetic peptide
  Seed: DGGNKHFLR (PMEL_HUMAN)
DAGNKHFLK

SEQ ID NO: 126924 - protein, 9 aa, Artificial Sequence
  Description of Artificial Sequence: Synthetic peptide
  Seed: ESAEILQAV (PMEL_HUMAN)
EGAEILQAR

SEQ ID NO: 126925 - protein, 9 aa, Artificial Sequence
  Description of Artificial Sequence: Synthetic peptide
  Seed: GQVPLIVGI (PMEL_HUMAN)
GEVPLIVGF

SEQ ID NO: 126926 - protein, 11 aa, Artificial Sequence
  Description of Artificial Sequence: Synthetic peptide
  Seed: LPIPEPEGPDA (PMEL_HUMAN)
LPIPEPEGPDL

SEQ ID NO: 126927 - protein, 9 aa, Artificial Sequence
  Description of Artificial Sequence: Synthetic peptide
  Seed: TMEVTVYHR (PMEL_HUMAN)
TSEVTVYHY

SEQ ID NO: 126928 - protein, 9 aa, Artificial Sequence
  Description of Artificial Sequence: Synthetic peptide
  Seed: TAEAPNTTA (PMEL_HUMAN)
TVEAPNTTM

SEQ ID NO: 126929 - protein, 11 aa, Artificial Sequence
  Description of Artificial Sequence: Synthetic peptide
  Seed: VPVSEVMGTTL (PMEL_HUMAN)
VPVSEVMGTTW

SEQ ID NO: 126930 - protein, 10 aa, Artificial Sequence
  Description of Artificial Sequence: Synthetic peptide
  Seed: GPLLDGTATL (PMEL_HUMAN)
GLLLDGTATL

SEQ ID NO: 126931 - protein, 9 aa, Artificial Sequence
  Description of Artificial Sequence: Synthetic peptide
  Seed: SSHWLRLPR (PMEL_HUMAN)
SWHWLRLPK

SEQ ID NO: 126932 - protein, 9 aa, Artificial Sequence
  Description of Artificial Sequence: Synthetic peptide
  Seed: RQVPLDCVL (PMEL_HUMAN)
RSVPLDCVL

SEQ ID NO: 126933 - protein, 11 aa, Artificial Sequence
  Description of Artificial Sequence: Synthetic peptide
  Seed: HSSSHWLRLPR (PMEL_HUMAN)
HQSSHWLRLPR

SEQ ID NO: 126934 - protein, 9 aa, Artificial Sequence
  Description of Artificial Sequence: Synthetic peptide
  Seed: RQVPLDCVL (PMEL_HUMAN)
RMVPLDCVH

SEQ ID NO: 126935 - protein, 10 aa, Artificial Sequence
  Description of Artificial Sequence: Synthetic peptide
  Seed: LAVIGALLAV (PMEL_HUMAN)
LQVIGALLAL

SEQ ID NO: 126936 - protein, 9 aa, Artificial Sequence
  Description of Artificial Sequence: Synthetic peptide
  Seed: KVSNDGPTL (PMEL_HUMAN)
KASNDGPTF

SEQ ID NO: 126937 - protein, 9 aa, Artificial Sequence
  Description of Artificial Sequence: Synthetic peptide
  Seed: RALVVTHTY (PMEL_HUMAN)
RSLVVTHTV

SEQ ID NO: 126938 - protein, 9 aa, Artificial Sequence
  Description of Artificial Sequence: Synthetic peptide
  Seed: RLMKQDFSV (PMEL_HUMAN)
RLMKQDFSA

SEQ ID NO: 126939 - protein, 9 aa, Artificial Sequence
  Description of Artificial Sequence: Synthetic peptide
  Seed: SGTLISRAL (PMEL_HUMAN)
SATLISRAV

SEQ ID NO: 126940 - protein, 9 aa, Artificial Sequence
  Description of Artificial Sequence: Synthetic peptide
  Seed: DIVQGIESA (PMEL_HUMAN)
DAVQGIESV

SEQ ID NO: 126941 - protein, 10 aa, Artificial Sequence
  Description of Artificial Sequence: Synthetic peptide
  Seed: SGTYCLNVSL (PMEL_HUMAN)
SETYCLNVSV

SEQ ID NO: 126942 - protein, 9 aa, Artificial Sequence
  Description of Artificial Sequence: Synthetic peptide
  Seed: WQVLGGPVS (PMEL_HUMAN)
WLVLGGPVY

SEQ ID NO: 126943 - protein, 11 aa, Artificial Sequence
  Description of Artificial Sequence: Synthetic peptide
  Seed: YVPLAHSSSAF (PMEL_HUMAN)
YFPLAHSSSAY

SEQ ID NO: 126944 - protein, 9 aa, Artificial Sequence
  Description of Artificial Sequence: Synthetic peptide
  Seed: ANASFSIAL (PMEL_HUMAN)
AMASFSIAW

SEQ ID NO: 126945 - protein, 9 aa, Artificial Sequence
  Description of Artificial Sequence: Synthetic peptide
  Seed: TIINGSQVW (PMEL_HUMAN)
TGINGSQVY

SEQ ID NO: 126946 - protein, 9 aa, Artificial Sequence
  Description of Artificial Sequence: Synthetic peptide
  Seed: AVVSTQLIM (PMEL_HUMAN)
AMVSTQLIW

SEQ ID NO: 126947 - protein, 9 aa, Artificial Sequence
  Description of Artificial Sequence: Synthetic peptide
  Seed: ISRALVVTH (PMEL_HUMAN)
INRALVVTY

SEQ ID NO: 126948 - protein, 9 aa, Artificial Sequence
  Description of Artificial Sequence: Synthetic peptide
  Seed: STAPVQMPT (PMEL_HUMAN)
SMAPVQMPL

SEQ ID NO: 126949 - protein, 10 aa, Artificial Sequence
  Description of Artificial Sequence: Synthetic peptide
  Seed: TAAQVTTTEW (PMEL_HUMAN)
TTAQVTTTEY

SEQ ID NO: 126950 - protein, 9 aa, Artificial Sequence
  Description of Artificial Sequence: Synthetic peptide
  Seed: MSTPEATGM (PMEL_HUMAN)
MATPEATGV

SEQ ID NO: 126951 - protein, 10 aa, Artificial Sequence
  Description of Artificial Sequence: Synthetic peptide
  Seed: MAVVLASLIY (PMEL_HUMAN)
MPVVLASLIR

SEQ ID NO: 126952 - protein, 9 aa, Artificial Sequence
  Description of Artificial Sequence: Synthetic peptide
  Seed: WNRQLYPEW (PMEL_HUMAN)
WARQLYPEW

SEQ ID NO: 126953 - protein, 9 aa, Artificial Sequence
  Description of Artificial Sequence: Synthetic peptide
  Seed: VVLASLIYR (PMEL_HUMAN)
VILASLIYR

SEQ ID NO: 126954 - protein, 9 aa, Artificial Sequence
  Description of Artificial Sequence: Synthetic peptide
  Seed: ILLVLMAVV (PMEL_HUMAN)
ILLVLMAVL

SEQ ID NO: 126955 - protein, 10 aa, Artificial Sequence
  Description of Artificial Sequence: Synthetic peptide
  Seed: EVVGTTPGQA (PMEL_HUMAN)
ETVGTTPGQI

SEQ ID NO: 126956 - protein, 9 aa, Artificial Sequence
  Description of Artificial Sequence: Synthetic peptide
  Seed: KAWNRQLYP (PMEL_HUMAN)
KSWNRQLYI

SEQ ID NO: 126957 - protein, 10 aa, Artificial Sequence
  Description of Artificial Sequence: Synthetic peptide
  Seed: KRQVPLDCVL (PMEL_HUMAN)
KWQVPLDCVF

SEQ ID NO: 126958 - protein, 9 aa, Artificial Sequence
  Description of Artificial Sequence: Synthetic peptide
  Seed: FSVSVSQLR (PMEL_HUMAN)
FLVSVSQLR

SEQ ID NO: 126959 - protein, 10 aa, Artificial Sequence
  Description of Artificial Sequence: Synthetic peptide
  Seed: YGSFSVTLDI (PMEL_HUMAN)
YSSFSVTLDF

SEQ ID NO: 126960 - protein, 10 aa, Artificial Sequence
  Description of Artificial Sequence: Synthetic peptide
  Seed: LNFPGSQKVL (PMEL_HUMAN)
LSFPGSQKVF

SEQ ID NO: 126961 - protein, 10 aa, Artificial Sequence
  Description of Artificial Sequence: Synthetic peptide
  Seed: THTMEVTVYH (PMEL_HUMAN)
TYTMEVTVYY

SEQ ID NO: 126962 - protein, 9 aa, Artificial Sequence
  Description of Artificial Sequence: Synthetic peptide
  Seed: VLMAVVLAS (PMEL_HUMAN)
VMMAVVLAL

SEQ ID NO: 126963 - protein, 9 aa, Artificial Sequence
  Description of Artificial Sequence: Synthetic peptide
  Seed: TEVVGTTPG (PMEL_HUMAN)
TEVVGTTPL

SEQ ID NO: 126964 - protein, 10 aa, Artificial Sequence
  Description of Artificial Sequence: Synthetic peptide
  Seed: MPTAESTGMT (PMEL_HUMAN)
MWTAESTGMI

SEQ ID NO: 126965 - protein, 11 aa, Artificial Sequence
  Description of Artificial Sequence: Synthetic peptide
  Seed: FGDSSGTLISR (PMEL_HUMAN)
FMDSSGTLISC

SEQ ID NO: 126966 - protein, 9 aa, Artificial Sequence
  Description of Artificial Sequence: Synthetic peptide
  Seed: LADTNSLAV (PMEL_HUMAN)
LNDTNSLAF

SEQ ID NO: 126967 - protein, 9 aa, Artificial Sequence
  Description of Artificial Sequence: Synthetic peptide
  Seed: VSEVMGTTL (PMEL_HUMAN)
VFEVMGTTV

SEQ ID NO: 126968 - protein, 10 aa, Artificial Sequence
  Description of Artificial Sequence: Synthetic peptide
  Seed: NSLAVVSTQL (PMEL_HUMAN)
NMLAVVSTQI

SEQ ID NO: 126969 - protein, 9 aa, Artificial Sequence
  Description of Artificial Sequence: Synthetic peptide
  Seed: AVIGALLAV (PMEL_HUMAN)
AGIGALLAL

SEQ ID NO: 126970 - protein, 9 aa, Artificial Sequence
  Description of Artificial Sequence: Synthetic peptide
  Seed: ITDQVPFSV (PMEL_HUMAN)
ILDQVPFSV

SEQ ID NO: 126971 - protein, 11 aa, Artificial Sequence
  Description of Artificial Sequence: Synthetic peptide
  Seed: RALDGGNKHFL (PMEL_HUMAN)
RILDGGNKHFY

SEQ ID NO: 126972 - protein, 11 aa, Artificial Sequence
  Description of Artificial Sequence: Synthetic peptide
  Seed: HTMEVTVYHRR (PMEL_HUMAN)
HTMEVTVYHRK

SEQ ID NO: 126973 - protein, 10 aa, Artificial Sequence
  Description of Artificial Sequence: Synthetic peptide
  Seed: VPQLPHSSSH (PMEL_HUMAN)
VAQLPHSSSL

SEQ ID NO: 126974 - protein, 10 aa, Artificial Sequence
  Description of Artificial Sequence: Synthetic peptide
  Seed: VLMAVVLASL (PMEL_HUMAN)
VPMAVVLASI

SEQ ID NO: 126975 - protein, 8 aa, Artificial Sequence
  Description of Artificial Sequence: Synthetic peptide
  Seed: FGDSSGTL (PMEL_HUMAN)
FADSSGTF

SEQ ID NO: 126976 - protein, 11 aa, Artificial Sequence
  Description of Artificial Sequence: Synthetic peptide
  Seed: KHFLRNQPLTF (PMEL_HUMAN)
KLFLRNQPLTY

SEQ ID NO: 126977 - protein, 9 aa, Artificial Sequence
  Description of Artificial Sequence: Synthetic peptide
  Seed: QLHDPSGYL (PMEL_HUMAN)
QAHDPSGYM

SEQ ID NO: 126978 - protein, 11 aa, Artificial Sequence
  Description of Artificial Sequence: Synthetic peptide
  Seed: LGPLLDGTATL (PMEL_HUMAN)
LYPLLDGTATV

SEQ ID NO: 126979 - protein, 9 aa, Artificial Sequence
  Description of Artificial Sequence: Synthetic peptide
  Seed: AEILQAVPS (PMEL_HUMAN)
AEILQAVPP

SEQ ID NO: 126980 - protein, 10 aa, Artificial Sequence
  Description of Artificial Sequence: Synthetic peptide
  Seed: GPLLDGTATL (PMEL_HUMAN)
GTLLDGTATA

SEQ ID NO: 126981 - protein, 10 aa, Artificial Sequence
  Description of Artificial Sequence: Synthetic peptide
  Seed: ALDGGNKHFL (PMEL_HUMAN)
ALDGGNKHFF

SEQ ID NO: 126982 - protein, 9 aa, Artificial Sequence
  Description of Artificial Sequence: Synthetic peptide
  Seed: GSFSVTLDI (PMEL_HUMAN)
GAFSVTLDY

SEQ ID NO: 126983 - protein, 10 aa, Artificial Sequence
  Description of Artificial Sequence: Synthetic peptide
  Seed: VLMAVVLASL (PMEL_HUMAN)
VWMAVVLASY

SEQ ID NO: 126984 - protein, 9 aa, Artificial Sequence
  Description of Artificial Sequence: Synthetic peptide
  Seed: QLRTKAWNR (PMEL_HUMAN)
QLRTKAWNK

SEQ ID NO: 126985 - protein, 9 aa, Artificial Sequence
  Description of Artificial Sequence: Synthetic peptide
  Seed: TAPVQMPTA (PMEL_HUMAN)
TTPVQMPTM

SEQ ID NO: 126986 - protein, 9 aa, Artificial Sequence
  Description of Artificial Sequence: Synthetic peptide
  Seed: YLEPGPVTA (PMEL_HUMAN)
YMEPGPVTA

SEQ ID NO: 126987 - protein, 9 aa, Artificial Sequence
  Description of Artificial Sequence: Synthetic peptide
  Seed: VSNDGPTLI (PMEL_HUMAN)
VVNDGPTLI

SEQ ID NO: 126988 - protein, 10 aa, Artificial Sequence
  Description of Artificial Sequence: Synthetic peptide
  Seed: LQLHDPSGYL (PMEL_HUMAN)
LTLHDPSGYV

SEQ ID NO: 126989 - protein, 10 aa, Artificial Sequence
  Description of Artificial Sequence: Synthetic peptide
  Seed: SSAFTITDQV (PMEL_HUMAN)
STAFTITDQI

SEQ ID NO: 126990 - protein, 11 aa, Artificial Sequence
  Description of Artificial Sequence: Synthetic peptide
  Seed: GYLAEADLSYT (PMEL_HUMAN)
GLLAEADLSYV

SEQ ID NO: 126991 - protein, 9 aa, Artificial Sequence
  Description of Artificial Sequence: Synthetic peptide
  Seed: HTMEVTVYH (PMEL_HUMAN)
HTMEVTVYL

SEQ ID NO: 126992 - protein, 11 aa, Artificial Sequence
  Description of Artificial Sequence: Synthetic peptide
  Seed: FSVTLDIVQGI (PMEL_HUMAN)
FAVTLDIVQGV

SEQ ID NO: 126993 - protein, 10 aa, Artificial Sequence
  Description of Artificial Sequence: Synthetic peptide
  Seed: RGSRSYVPLA (PMEL_HUMAN)
RTSRSYVPLM

SEQ ID NO: 126994 - protein, 9 aa, Artificial Sequence
  Description of Artificial Sequence: Synthetic peptide
  Seed: ALDGGNKHF (PMEL_HUMAN)
AIDGGNKHV

SEQ ID NO: 126995 - protein, 9 aa, Artificial Sequence
  Description of Artificial Sequence: Synthetic peptide
  Seed: ASFSIALNF (PMEL_HUMAN)
APFSIALNY

SEQ ID NO: 126996 - protein, 10 aa, Artificial Sequence
  Description of Artificial Sequence: Synthetic peptide
  Seed: MKQDFSVPQL (PMEL_HUMAN)
MKQDFSVPQY

SEQ ID NO: 126997 - protein, 9 aa, Artificial Sequence
  Description of Artificial Sequence: Synthetic peptide
  Seed: VLPDGQVIW (PMEL_HUMAN)
VAPDGQVIL

SEQ ID NO: 126998 - protein, 11 aa, Artificial Sequence
  Description of Artificial Sequence: Synthetic peptide
  Seed: LGPLLDGTATL (PMEL_HUMAN)
LCPLLDGTATI

SEQ ID NO: 126999 - protein, 9 aa, Artificial Sequence
  Description of Artificial Sequence: Synthetic peptide
  Seed: RAMLGTHTM (PMEL_HUMAN)
RSMLGTHTA

SEQ ID NO: 127000 - protein, 9 aa, Artificial Sequence
  Description of Artificial Sequence: Synthetic peptide
  Seed: RTKAWNRQL (PMEL_HUMAN)
RIKAWNRQM

SEQ ID NO: 127001 - protein, 10 aa, Artificial Sequence
  Description of Artificial Sequence: Synthetic peptide
  Seed: LNFPGSQKVL (PMEL_HUMAN)
LSFPGSQKVY

SEQ ID NO: 127002 - protein, 9 aa, Artificial Sequence
  Description of Artificial Sequence: Synthetic peptide
  Seed: AVIGALLAV (PMEL_HUMAN)
AGIGALLAF

SEQ ID NO: 127003 - protein, 9 aa, Artificial Sequence
  Description of Artificial Sequence: Synthetic peptide
  Seed: ASFSIALNF (PMEL_HUMAN)
ARFSIALNF

SEQ ID NO: 127004 - protein, 9 aa, Artificial Sequence
  Description of Artificial Sequence: Synthetic peptide
  Seed: SPGCQPPAQ (PMEL_HUMAN)
SPGCQPPAA

SEQ ID NO: 127005 - protein, 11 aa, Artificial Sequence
  Description of Artificial Sequence: Synthetic peptide
  Seed: ITDQVPFSVSV (PMEL_HUMAN)
IIDQVPFSVSL

SEQ ID NO: 127006 - protein, 10 aa, Artificial Sequence
  Description of Artificial Sequence: Synthetic peptide
  Seed: LIVGILLVLM (PMEL_HUMAN)
LMVGILLVLL

SEQ ID NO: 127007 - protein, 9 aa, Artificial Sequence
  Description of Artificial Sequence: Synthetic peptide
  Seed: VLPDGQVIW (PMEL_HUMAN)
VLPDGQVIL

SEQ ID NO: 127008 - protein, 9 aa, Artificial Sequence
  Description of Artificial Sequence: Synthetic peptide
  Seed: LTSCGSSPV (PMEL_HUMAN)
LVSCGSSPL

SEQ ID NO: 127009 - protein, 10 aa, Artificial Sequence
  Description of Artificial Sequence: Synthetic peptide
  Seed: MTPAEVSIVV (PMEL_HUMAN)
MRPAEVSIVM

SEQ ID NO: 127010 - protein, 9 aa, Artificial Sequence
  Description of Artificial Sequence: Synthetic peptide
  Seed: TAQVVLQAA (PMEL_HUMAN)
TSQVVLQAY

SEQ ID NO: 127011 - protein, 9 aa, Artificial Sequence
  Description of Artificial Sequence: Synthetic peptide
  Seed: HSSSHWLRL (PMEL_HUMAN)
HMSSHWLRF

SEQ ID NO: 127012 - protein, 11 aa, Artificial Sequence
  Description of Artificial Sequence: Synthetic peptide
  Seed: FALQLHDPSGY (PMEL_HUMAN)
FPLQLHDPSGM

SEQ ID NO: 127013 - protein, 9 aa, Artificial Sequence
  Description of Artificial Sequence: Synthetic peptide
  Seed: RTKAWNRQL (PMEL_HUMAN)
RTKAWNRQA

SEQ ID NO: 127014 - protein, 9 aa, Artificial Sequence
  Description of Artificial Sequence: Synthetic peptide
  Seed: LPKEACMEI (PMEL_HUMAN)
LPKEACMEY

SEQ ID NO: 127015 - protein, 10 aa, Artificial Sequence
  Description of Artificial Sequence: Synthetic peptide
  Seed: THTMEVTVYH (PMEL_HUMAN)
TITMEVTVYK

SEQ ID NO: 127016 - protein, 9 aa, Artificial Sequence
  Description of Artificial Sequence: Synthetic peptide
  Seed: RNQPLTFAL (PMEL_HUMAN)
RVQPLTFAM

SEQ ID NO: 127017 - protein, 10 aa, Artificial Sequence
  Description of Artificial Sequence: Synthetic peptide
  Seed: STAPVQMPTA (PMEL_HUMAN)
SMAPVQMPTA

SEQ ID NO: 127018 - protein, 9 aa, Artificial Sequence
  Description of Artificial Sequence: Synthetic peptide
  Seed: HLAVIGALL (PMEL_HUMAN)
HAAVIGALM

SEQ ID NO: 127019 - protein, 9 aa, Artificial Sequence
  Description of Artificial Sequence: Synthetic peptide
  Seed: ASFSIALNF (PMEL_HUMAN)
AAFSIALNF

SEQ ID NO: 127020 - protein, 9 aa, Artificial Sequence
  Description of Artificial Sequence: Synthetic peptide
  Seed: LIVGILLVL (PMEL_HUMAN)
LLVGILLVV

SEQ ID NO: 127021 - protein, 9 aa, Artificial Sequence
  Description of Artificial Sequence: Synthetic peptide
  Seed: STESITGSL (PMEL_HUMAN)
SFESITGSL

SEQ ID NO: 127022 - protein, 9 aa, Artificial Sequence
  Description of Artificial Sequence: Synthetic peptide
  Seed: ITDQVPFSV (PMEL_HUMAN)
IMDQVPFST

SEQ ID NO: 127023 - protein, 10 aa, Artificial Sequence
  Description of Artificial Sequence: Synthetic peptide
  Seed: LGQVPLIVGI (PMEL_HUMAN)
LMQVPLIVGA

SEQ ID NO: 127024 - protein, 10 aa, Artificial Sequence
  Description of Artificial Sequence: Synthetic peptide
  Seed: VPQLPHSSSH (PMEL_HUMAN)
VSQLPHSSSF

SEQ ID NO: 127025 - protein, 10 aa, Artificial Sequence
  Description of Artificial Sequence: Synthetic peptide
  Seed: VYVWKTWGQY (PMEL_HUMAN)
VSVWKTWGQY

SEQ ID NO: 127026 - protein, 8 aa, Artificial Sequence
  Description of Artificial Sequence: Synthetic peptide
  Seed: VSNDGPTL (PMEL_HUMAN)
VANDGPTM

SEQ ID NO: 127027 - protein, 11 aa, Artificial Sequence
  Description of Artificial Sequence: Synthetic peptide
  Seed: HTMEVTVYHRR (PMEL_HUMAN)
HTMEVTVYHRQ

SEQ ID NO: 127028 - protein, 9 aa, Artificial Sequence
  Description of Artificial Sequence: Synthetic peptide
  Seed: HTMEVTVYH (PMEL_HUMAN)
HWMEVTVYY

SEQ ID NO: 127029 - protein, 10 aa, Artificial Sequence
  Description of Artificial Sequence: Synthetic peptide
  Seed: LLHLAVIGAL (PMEL_HUMAN)
LMHLAVIGAA

SEQ ID NO: 127030 - protein, 10 aa, Artificial Sequence
  Description of Artificial Sequence: Synthetic peptide
  Seed: STAPVQMPTA (PMEL_HUMAN)
STAPVQMPTV

SEQ ID NO: 127031 - protein, 9 aa, Artificial Sequence
  Description of Artificial Sequence: Synthetic peptide
  Seed: VLPDGQVIW (PMEL_HUMAN)
VSPDGQVIF

SEQ ID NO: 127032 - protein, 9 aa, Artificial Sequence
  Description of Artificial Sequence: Synthetic peptide
  Seed: TTDGHRPTA (PMEL_HUMAN)
TNDGHRPTI

SEQ ID NO: 127033 - protein, 11 aa, Artificial Sequence
  Description of Artificial Sequence: Synthetic peptide
  Seed: RLPRIFCSCPI (PMEL_HUMAN)
RTPRIFCSCPL

SEQ ID NO: 127034 - protein, 9 aa, Artificial Sequence
  Description of Artificial Sequence: Synthetic peptide
  Seed: ADTNSLAVV (PMEL_HUMAN)
AETNSLAVI

SEQ ID NO: 127035 - protein, 9 aa, Artificial Sequence
  Description of Artificial Sequence: Synthetic peptide
  Seed: SITGSLGPL (PMEL_HUMAN)
SMTGSLGPF

SEQ ID NO: 127036 - protein, 10 aa, Artificial Sequence
  Description of Artificial Sequence: Synthetic peptide
  Seed: GPLLDGTATL (PMEL_HUMAN)
GILLDGTATL

SEQ ID NO: 127037 - protein, 9 aa, Artificial Sequence
  Description of Artificial Sequence: Synthetic peptide
  Seed: TEWVETTAR (PMEL_HUMAN)
TEWVETTAA

SEQ ID NO: 127038 - protein, 9 aa, Artificial Sequence
  Description of Artificial Sequence: Synthetic peptide
  Seed: YLAEADLSY (PMEL_HUMAN)
YMAEADLSF

SEQ ID NO: 127039 - protein, 10 aa, Artificial Sequence
  Description of Artificial Sequence: Synthetic peptide
  Seed: RGSRSYVPLA (PMEL_HUMAN)
RGSRSYVPLI

SEQ ID NO: 127040 - protein, 9 aa, Artificial Sequence
  Description of Artificial Sequence: Synthetic peptide
  Seed: THTMEVTVY (PMEL_HUMAN)
TITMEVTVY

SEQ ID NO: 127041 - protein, 9 aa, Artificial Sequence
  Description of Artificial Sequence: Synthetic peptide
  Seed: LAVVSTQLI (PMEL_HUMAN)
LCVVSTQLW

SEQ ID NO: 127042 - protein, 9 aa, Artificial Sequence
  Description of Artificial Sequence: Synthetic peptide
  Seed: LMAVVLASL (PMEL_HUMAN)
LLAVVLASA

SEQ ID NO: 127043 - protein, 9 aa, Artificial Sequence
  Description of Artificial Sequence: Synthetic peptide
  Seed: KAWNRQLYP (PMEL_HUMAN)
KVWNRQLYG

SEQ ID NO: 127044 - protein, 9 aa, Artificial Sequence
  Description of Artificial Sequence: Synthetic peptide
  Seed: LNFPGSQKV (PMEL_HUMAN)
LIFPGSQKI

SEQ ID NO: 127045 - protein, 9 aa, Artificial Sequence
  Description of Artificial Sequence: Synthetic peptide
  Seed: ATGMTPAEV (PMEL_HUMAN)
AAGMTPAEF

SEQ ID NO: 127046 - protein, 9 aa, Artificial Sequence
  Description of Artificial Sequence: Synthetic peptide
  Seed: LYPEWTEAQ (PMEL_HUMAN)
LWPEWTEAM

SEQ ID NO: 127047 - protein, 8 aa, Artificial Sequence
  Description of Artificial Sequence: Synthetic peptide
  Seed: LLDGTATL (PMEL_HUMAN)
LIDGTATI

SEQ ID NO: 127048 - protein, 11 aa, Artificial Sequence
  Description of Artificial Sequence: Synthetic peptide
  Seed: HTMEVTVYHRR (PMEL_HUMAN)
HAMEVTVYHRK

SEQ ID NO: 127049 - protein, 10 aa, Artificial Sequence
  Description of Artificial Sequence: Synthetic peptide
  Seed: MPTAESTGMT (PMEL_HUMAN)
MPTAESTGMA

SEQ ID NO: 127050 - protein, 10 aa, Artificial Sequence
  Description of Artificial Sequence: Synthetic peptide
  Seed: NSLAVVSTQL (PMEL_HUMAN)
NFLAVVSTQV

SEQ ID NO: 127051 - protein, 11 aa, Artificial Sequence
  Description of Artificial Sequence: Synthetic peptide
  Seed: VQMPTAESTGM (PMEL_HUMAN)
VHMPTAESTGI

SEQ ID NO: 127052 - protein, 10 aa, Artificial Sequence
  Description of Artificial Sequence: Synthetic peptide
  Seed: TYLEPGPVTA (PMEL_HUMAN)
TRLEPGPVTL

SEQ ID NO: 127053 - protein, 9 aa, Artificial Sequence
  Description of Artificial Sequence: Synthetic peptide
  Seed: KVLPDGQVI (PMEL_HUMAN)
KSLPDGQVW

SEQ ID NO: 127054 - protein, 10 aa, Artificial Sequence
  Description of Artificial Sequence: Synthetic peptide
  Seed: YGSFSVTLDI (PMEL_HUMAN)
YNSFSVTLDY

SEQ ID NO: 127055 - protein, 9 aa, Artificial Sequence
  Description of Artificial Sequence: Synthetic peptide
  Seed: VSCQGGLPK (PMEL_HUMAN)
VLCQGGLPR

SEQ ID NO: 127056 - protein, 10 aa, Artificial Sequence
  Description of Artificial Sequence: Synthetic peptide
  Seed: SRALVVTHTY (PMEL_HUMAN)
SSALVVTHTW

SEQ ID NO: 127057 - protein, 9 aa, Artificial Sequence
  Description of Artificial Sequence: Synthetic peptide
  Seed: LASLIYRRR (PMEL_HUMAN)
LYSLIYRRR

SEQ ID NO: 127058 - protein, 10 aa, Artificial Sequence
  Description of Artificial Sequence: Synthetic peptide
  Seed: KTWGQYWQVL (PMEL_HUMAN)
KMWGQYWQVG

SEQ ID NO: 127059 - protein, 10 aa, Artificial Sequence
  Description of Artificial Sequence: Synthetic peptide
  Seed: MEISSPGCQP (PMEL_HUMAN)
MEISSPGCQV

SEQ ID NO: 127060 - protein, 10 aa, Artificial Sequence
  Description of Artificial Sequence: Synthetic peptide
  Seed: AVPSGEGDAF (PMEL_HUMAN)
ATPSGEGDAL

SEQ ID NO: 127061 - protein, 8 aa, Artificial Sequence
  Description of Artificial Sequence: Synthetic peptide
  Seed: FGDSSGTL (PMEL_HUMAN)
FLDSSGTI

SEQ ID NO: 127062 - protein, 9 aa, Artificial Sequence
  Description of Artificial Sequence: Synthetic peptide
  Seed: FSIALNFPG (PMEL_HUMAN)
FMIALNFPW

SEQ ID NO: 127063 - protein, 10 aa, Artificial Sequence
  Description of Artificial Sequence: Synthetic peptide
  Seed: RGSRSYVPLA (PMEL_HUMAN)
RPSRSYVPLA

SEQ ID NO: 127064 - protein, 9 aa, Artificial Sequence
  Description of Artificial Sequence: Synthetic peptide
  Seed: YRYGSFSVT (PMEL_HUMAN)
YMYGSFSVL

SEQ ID NO: 127065 - protein, 9 aa, Artificial Sequence
  Description of Artificial Sequence: Synthetic peptide
  Seed: DQVPFSVSV (PMEL_HUMAN)
DVVPFSVSF

SEQ ID NO: 127066 - protein, 9 aa, Artificial Sequence
  Description of Artificial Sequence: Synthetic peptide
  Seed: VTLDIVQGI (PMEL_HUMAN)
VLLDIVQGV

SEQ ID NO: 127067 - protein, 10 aa, Artificial Sequence
  Description of Artificial Sequence: Synthetic peptide
  Seed: AVVLASLIYR (PMEL_HUMAN)
AQVLASLIYR

SEQ ID NO: 127068 - protein, 10 aa, Artificial Sequence
  Description of Artificial Sequence: Synthetic peptide
  Seed: RELPIPEPEG (PMEL_HUMAN)
RELPIPEPET

SEQ ID NO: 127069 - protein, 9 aa, Artificial Sequence
  Description of Artificial Sequence: Synthetic peptide
  Seed: FTITDQVPF (PMEL_HUMAN)
FAITDQVPH

SEQ ID NO: 127070 - protein, 10 aa, Artificial Sequence
  Description of Artificial Sequence: Synthetic peptide
  Seed: EVISTAPVQM (PMEL_HUMAN)
ETISTAPVQF

SEQ ID NO: 127071 - protein, 10 aa, Artificial Sequence
  Description of Artificial Sequence: Synthetic peptide
  Seed: YLAEADLSYT (PMEL_HUMAN)
YTAEADLSYA

SEQ ID NO: 127072 - protein, 10 aa, Artificial Sequence
  Description of Artificial Sequence: Synthetic peptide
  Seed: LVLMAVVLAS (PMEL_HUMAN)
LALMAVVLAM

SEQ ID NO: 127073 - protein, 10 aa, Artificial Sequence
  Description of Artificial Sequence: Synthetic peptide
  Seed: AEADLSYTWD (PMEL_HUMAN)
AEADLSYTWK

SEQ ID NO: 127074 - protein, 9 aa, Artificial Sequence
  Description of Artificial Sequence: Synthetic peptide
  Seed: TTDGHRPTA (PMEL_HUMAN)
TQDGHRPTV

SEQ ID NO: 127075 - protein, 11 aa, Artificial Sequence
  Description of Artificial Sequence: Synthetic peptide
  Seed: SLKVSNDGPTL (PMEL_HUMAN)
SAKVSNDGPTY

SEQ ID NO: 127076 - protein, 9 aa, Artificial Sequence
  Description of Artificial Sequence: Synthetic peptide
  Seed: TWGQYWQVL (PMEL_HUMAN)
TWGQYWQVW

SEQ ID NO: 127077 - protein, 9 aa, Artificial Sequence
  Description of Artificial Sequence: Synthetic peptide
  Seed: RQVPLDCVL (PMEL_HUMAN)
RKVPLDCVY

SEQ ID NO: 127078 - protein, 10 aa, Artificial Sequence
  Description of Artificial Sequence: Synthetic peptide
  Seed: RGSRSYVPLA (PMEL_HUMAN)
RYSRSYVPLV

SEQ ID NO: 127079 - protein, 11 aa, Artificial Sequence
  Description of Artificial Sequence: Synthetic peptide
  Seed: VVLASLIYRRR (PMEL_HUMAN)
VSLASLIYRRK

SEQ ID NO: 127080 - protein, 9 aa, Artificial Sequence
  Description of Artificial Sequence: Synthetic peptide
  Seed: TLIGANASF (PMEL_HUMAN)
TPIGANASY

SEQ ID NO: 127081 - protein, 10 aa, Artificial Sequence
  Description of Artificial Sequence: Synthetic peptide
  Seed: VSLADTNSLA (PMEL_HUMAN)
VKLADTNSLL

SEQ ID NO: 127082 - protein, 9 aa, Artificial Sequence
  Description of Artificial Sequence: Synthetic peptide
  Seed: KQDFSVPQL (PMEL_HUMAN)
KFDFSVPQF

SEQ ID NO: 127083 - protein, 9 aa, Artificial Sequence
  Description of Artificial Sequence: Synthetic peptide
  Seed: FTITDQVPF (PMEL_HUMAN)
FFITDQVPV

SEQ ID NO: 127084 - protein, 10 aa, Artificial Sequence
  Description of Artificial Sequence: Synthetic peptide
  Seed: MTPAEVSIVV (PMEL_HUMAN)
MTPAEVSIVF

SEQ ID NO: 127085 - protein, 9 aa, Artificial Sequence
  Description of Artificial Sequence: Synthetic peptide
  Seed: VSEVMGTTL (PMEL_HUMAN)
VAEVMGTTV

SEQ ID NO: 127086 - protein, 10 aa, Artificial Sequence
  Description of Artificial Sequence: Synthetic peptide
  Seed: SLIYRRRLMK (PMEL_HUMAN)
SNIYRRRLMR

SEQ ID NO: 127087 - protein, 8 aa, Artificial Sequence
  Description of Artificial Sequence: Synthetic peptide
  Seed: LHDPSGYL (PMEL_HUMAN)
LYDPSGYI

SEQ ID NO: 127088 - protein, 9 aa, Artificial Sequence
  Description of Artificial Sequence: Synthetic peptide
  Seed: QAAIPLTSC (PMEL_HUMAN)
QPAIPLTSM

SEQ ID NO: 127089 - protein, 10 aa, Artificial Sequence
  Description of Artificial Sequence: Synthetic peptide
  Seed: STAPVQMPTA (PMEL_HUMAN)
SMAPVQMPTM

SEQ ID NO: 127090 - protein, 11 aa, Artificial Sequence
  Description of Artificial Sequence: Synthetic peptide
  Seed: HFLRNQPLTFA (PMEL_HUMAN)
HFLRNQPLTFV

SEQ ID NO: 127091 - protein, 9 aa, Artificial Sequence
  Description of Artificial Sequence: Synthetic peptide
  Seed: VSNDGPTLI (PMEL_HUMAN)
VWNDGPTLF

SEQ ID NO: 127092 - protein, 10 aa, Artificial Sequence
  Description of Artificial Sequence: Synthetic peptide
  Seed: RTKAWNRQLY (PMEL_HUMAN)
RSKAWNRQLS

SEQ ID NO: 127093 - protein, 9 aa, Artificial Sequence
  Description of Artificial Sequence: Synthetic peptide
  Seed: VLPSPACQL (PMEL_HUMAN)
VQPSPACQL

SEQ ID NO: 127094 - protein, 9 aa, Artificial Sequence
  Description of Artificial Sequence: Synthetic peptide
  Seed: RAMLGTHTM (PMEL_HUMAN)
RTMLGTHTV

SEQ ID NO: 127095 - protein, 9 aa, Artificial Sequence
  Description of Artificial Sequence: Synthetic peptide
  Seed: HTMEVTVYH (PMEL_HUMAN)
HVMEVTVYM

SEQ ID NO: 127096 - protein, 10 aa, Artificial Sequence
  Description of Artificial Sequence: Synthetic peptide
  Seed: ELTVSCQGGL (PMEL_HUMAN)
ECTVSCQGGV

SEQ ID NO: 127097 - protein, 10 aa, Artificial Sequence
  Description of Artificial Sequence: Synthetic peptide
  Seed: LGQVPLIVGI (PMEL_HUMAN)
LFQVPLIVGV

SEQ ID NO: 127098 - protein, 10 aa, Artificial Sequence
  Description of Artificial Sequence: Synthetic peptide
  Seed: LQLHDPSGYL (PMEL_HUMAN)
LYLHDPSGYL

SEQ ID NO: 127099 - protein, 10 aa, Artificial Sequence
  Description of Artificial Sequence: Synthetic peptide
  Seed: SSSHWLRLPR (PMEL_HUMAN)
SDSHWLRLPR

SEQ ID NO: 127100 - protein, 9 aa, Artificial Sequence
  Description of Artificial Sequence: Synthetic peptide
  Seed: SSPGCQPPA (PMEL_HUMAN)
STPGCQPPI

SEQ ID NO: 127101 - protein, 9 aa, Artificial Sequence
  Description of Artificial Sequence: Synthetic peptide
  Seed: ASFSIALNF (PMEL_HUMAN)
AIFSIALNW

SEQ ID NO: 127102 - protein, 9 aa, Artificial Sequence
  Description of Artificial Sequence: Synthetic peptide
  Seed: RALVVTHTY (PMEL_HUMAN)
RKLVVTHTY

SEQ ID NO: 127103 - protein, 9 aa, Artificial Sequence
  Description of Artificial Sequence: Synthetic peptide
  Seed: ALDGGNKHF (PMEL_HUMAN)
AQDGGNKHM

SEQ ID NO: 127104 - protein, 10 aa, Artificial Sequence
  Description of Artificial Sequence: Synthetic peptide
  Seed: SGTYCLNVSL (PMEL_HUMAN)
SHTYCLNVSY

SEQ ID NO: 127105 - protein, 10 aa, Artificial Sequence
  Description of Artificial Sequence: Synthetic peptide
  Seed: FSVSVSQLRA (PMEL_HUMAN)
FTVSVSQLRA

SEQ ID NO: 127106 - protein, 9 aa, Artificial Sequence
  Description of Artificial Sequence: Synthetic peptide
  Seed: GQVPLIVGI (PMEL_HUMAN)
GEVPLIVGT

SEQ ID NO: 127107 - protein, 9 aa, Artificial Sequence
  Description of Artificial Sequence: Synthetic peptide
  Seed: ISRALVVTH (PMEL_HUMAN)
ILRALVVTF

SEQ ID NO: 127108 - protein, 9 aa, Artificial Sequence
  Description of Artificial Sequence: Synthetic peptide
  Seed: AVGATKVPR (PMEL_HUMAN)
AIGATKVPR

SEQ ID NO: 127109 - protein, 9 aa, Artificial Sequence
  Description of Artificial Sequence: Synthetic peptide
  Seed: VPTTEVIST (PMEL_HUMAN)
VPTTEVISL

SEQ ID NO: 127110 - protein, 9 aa, Artificial Sequence
  Description of Artificial Sequence: Synthetic peptide
  Seed: VPLDCVLYR (PMEL_HUMAN)
VALDCVLYK

SEQ ID NO: 127111 - protein, 9 aa, Artificial Sequence
  Description of Artificial Sequence: Synthetic peptide
  Seed: RLVKRQVPL (PMEL_HUMAN)
RIVKRQVPR

SEQ ID NO: 127112 - protein, 11 aa, Artificial Sequence
  Description of Artificial Sequence: Synthetic peptide
  Seed: VPSGEGDAFEL (PMEL_HUMAN)
VPSGEGDAFEW

SEQ ID NO: 127113 - protein, 9 aa, Artificial Sequence
  Description of Artificial Sequence: Synthetic peptide
  Seed: ASFSIALNF (PMEL_HUMAN)
AVFSIALNF

SEQ ID NO: 127114 - protein, 9 aa, Artificial Sequence
  Description of Artificial Sequence: Synthetic peptide
  Seed: VVLSGTTAA (PMEL_HUMAN)
VTLSGTTAF

SEQ ID NO: 127115 - protein, 11 aa, Artificial Sequence
  Description of Artificial Sequence: Synthetic peptide
  Seed: FSVTLDIVQGI (PMEL_HUMAN)
FYVTLDIVQGV

SEQ ID NO: 127116 - protein, 10 aa, Artificial Sequence
  Description of Artificial Sequence: Synthetic peptide
  Seed: MKQDFSVPQL (PMEL_HUMAN)
MSQDFSVPQV

SEQ ID NO: 127117 - protein, 10 aa, Artificial Sequence
  Description of Artificial Sequence: Synthetic peptide
  Seed: VPQLPHSSSH (PMEL_HUMAN)
VGQLPHSSSF

SEQ ID NO: 127118 - protein, 9 aa, Artificial Sequence
  Description of Artificial Sequence: Synthetic peptide
  Seed: FLRNQPLTF (PMEL_HUMAN)
FVRNQPLTL

SEQ ID NO: 127119 - protein, 9 aa, Artificial Sequence
  Description of Artificial Sequence: Synthetic peptide
  Seed: FGDSSGTLI (PMEL_HUMAN)
FLDSSGTLL

SEQ ID NO: 127120 - protein, 8 aa, Artificial Sequence
  Description of Artificial Sequence: Synthetic peptide
  Seed: AQVTTTEW (PMEL_HUMAN)
AQVTTTEF

SEQ ID NO: 127121 - protein, 9 aa, Artificial Sequence
  Description of Artificial Sequence: Synthetic peptide
  Seed: VLPSPACQL (PMEL_HUMAN)
VGPSPACQM

SEQ ID NO: 127122 - protein, 9 aa, Artificial Sequence
  Description of Artificial Sequence: Synthetic peptide
  Seed: SSPGCQPPA (PMEL_HUMAN)
SAPGCQPPL

SEQ ID NO: 127123 - protein, 9 aa, Artificial Sequence
  Description of Artificial Sequence: Synthetic peptide
  Seed: VMGTTLAEM (PMEL_HUMAN)
VVGTTLAEV

SEQ ID NO: 127124 - protein, 10 aa, Artificial Sequence
  Description of Artificial Sequence: Synthetic peptide
  Seed: VLYRYGSFSV (PMEL_HUMAN)
VVYRYGSFSK

SEQ ID NO: 127125 - protein, 9 aa, Artificial Sequence
  Description of Artificial Sequence: Synthetic peptide
  Seed: VSNDGPTLI (PMEL_HUMAN)
VLNDGPTLI

SEQ ID NO: 127126 - protein, 11 aa, Artificial Sequence
  Description of Artificial Sequence: Synthetic peptide
  Seed: SPVPGTTDGHR (PMEL_HUMAN)
SAVPGTTDGHR

SEQ ID NO: 127127 - protein, 9 aa, Artificial Sequence
  Description of Artificial Sequence: Synthetic peptide
  Seed: VLQAAIPLT (PMEL_HUMAN)
VVQAAIPLL

SEQ ID NO: 127128 - protein, 9 aa, Artificial Sequence
  Description of Artificial Sequence: Synthetic peptide
  Seed: SSIMSTESI (PMEL_HUMAN)
SKIMSTESM

SEQ ID NO: 127129 - protein, 10 aa, Artificial Sequence
  Description of Artificial Sequence: Synthetic peptide
  Seed: TLAEMSTPEA (PMEL_HUMAN)
TQAEMSTPEV

SEQ ID NO: 127130 - protein, 9 aa, Artificial Sequence
  Description of Artificial Sequence: Synthetic peptide
  Seed: EKVPVSEVM (PMEL_HUMAN)
EQVPVSEVY

SEQ ID NO: 127131 - protein, 10 aa, Artificial Sequence
  Description of Artificial Sequence: Synthetic peptide
  Seed: DWLGVSRQLR (PMEL_HUMAN)
DYLGVSRQLK

SEQ ID NO: 127132 - protein, 9 aa, Artificial Sequence
  Description of Artificial Sequence: Synthetic peptide
  Seed: RALVVTHTY (PMEL_HUMAN)
RELVVTHTI

SEQ ID NO: 127133 - protein, 10 aa, Artificial Sequence
  Description of Artificial Sequence: Synthetic peptide
  Seed: LGQVPLIVGI (PMEL_HUMAN)
LDQVPLIVGV

SEQ ID NO: 127134 - protein, 10 aa, Artificial Sequence
  Description of Artificial Sequence: Synthetic peptide
  Seed: RSFVYVWKTW (PMEL_HUMAN)
RMFVYVWKTL

SEQ ID NO: 127135 - protein, 9 aa, Artificial Sequence
  Description of Artificial Sequence: Synthetic peptide
  Seed: RTKAWNRQL (PMEL_HUMAN)
RGKAWNRQK

SEQ ID NO: 127136 - protein, 10 aa, Artificial Sequence
  Description of Artificial Sequence: Synthetic peptide
  Seed: YVPLAHSSSA (PMEL_HUMAN)
YYPLAHSSSL

SEQ ID NO: 127137 - protein, 9 aa, Artificial Sequence
  Description of Artificial Sequence: Synthetic peptide
  Seed: TTPGQAPTA (PMEL_HUMAN)
TAPGQAPTV

SEQ ID NO: 127138 - protein, 10 aa, Artificial Sequence
  Description of Artificial Sequence: Synthetic peptide
  Seed: VLMAVVLASL (PMEL_HUMAN)
VGMAVVLASI

SEQ ID NO: 127139 - protein, 9 aa, Artificial Sequence
  Description of Artificial Sequence: Synthetic peptide
  Seed: RLVKRQVPL (PMEL_HUMAN)
RVVKRQVPF

SEQ ID NO: 127140 - protein, 9 aa, Artificial Sequence
  Description of Artificial Sequence: Synthetic peptide
  Seed: AEPSGTTSV (PMEL_HUMAN)
ATPSGTTSV

SEQ ID NO: 127141 - protein, 8 aa, Artificial Sequence
  Description of Artificial Sequence: Synthetic peptide
  Seed: LHDPSGYL (PMEL_HUMAN)
LTDPSGYM

SEQ ID NO: 127142 - protein, 9 aa, Artificial Sequence
  Description of Artificial Sequence: Synthetic peptide
  Seed: YLEPGPVTA (PMEL_HUMAN)
YQEPGPVTM

SEQ ID NO: 127143 - protein, 9 aa, Artificial Sequence
  Description of Artificial Sequence: Synthetic peptide
  Seed: AHSSSAFTI (PMEL_HUMAN)
AHSSSAFTY

SEQ ID NO: 127144 - protein, 9 aa, Artificial Sequence
  Description of Artificial Sequence: Synthetic peptide
  Seed: VPFSVSVSQ (PMEL_HUMAN)
VPFSVSVSL

SEQ ID NO: 127145 - protein, 9 aa, Artificial Sequence
  Description of Artificial Sequence: Synthetic peptide
  Seed: TIINGSQVW (PMEL_HUMAN)
TIINGSQVY

SEQ ID NO: 127146 - protein, 10 aa, Artificial Sequence
  Description of Artificial Sequence: Synthetic peptide
  Seed: THTMEVTVYH (PMEL_HUMAN)
TETMEVTVYR

SEQ ID NO: 127147 - protein, 9 aa, Artificial Sequence
  Description of Artificial Sequence: Synthetic peptide
  Seed: FGDSSGTLI (PMEL_HUMAN)
FVDSSGTLV

SEQ ID NO: 127148 - protein, 9 aa, Artificial Sequence
  Description of Artificial Sequence: Synthetic peptide
  Seed: DQVPFSVSV (PMEL_HUMAN)
DIVPFSVSY

SEQ ID NO: 127149 - protein, 10 aa, Artificial Sequence
  Description of Artificial Sequence: Synthetic peptide
  Seed: LPRIFCSCPI (PMEL_HUMAN)
LPRIFCSCPV

SEQ ID NO: 127150 - protein, 10 aa, Artificial Sequence
  Description of Artificial Sequence: Synthetic peptide
  Seed: LIMPGQEAGL (PMEL_HUMAN)
LIMPGQEAGV

SEQ ID NO: 127151 - protein, 10 aa, Artificial Sequence
  Description of Artificial Sequence: Synthetic peptide
  Seed: CPIGENSPLL (PMEL_HUMAN)
CPIGENSPLF

SEQ ID NO: 127152 - protein, 9 aa, Artificial Sequence
  Description of Artificial Sequence: Synthetic peptide
  Seed: LSIGTGRAM (PMEL_HUMAN)
LWIGTGRAL

SEQ ID NO: 127153 - protein, 9 aa, Artificial Sequence
  Description of Artificial Sequence: Synthetic peptide
  Seed: LSIGTGRAM (PMEL_HUMAN)
LKIGTGRAL

SEQ ID NO: 127154 - protein, 9 aa, Artificial Sequence
  Description of Artificial Sequence: Synthetic peptide
  Seed: ITGSLGPLL (PMEL_HUMAN)
ISGSLGPLY

SEQ ID NO: 127155 - protein, 9 aa, Artificial Sequence
  Description of Artificial Sequence: Synthetic peptide
  Seed: DAFELTVSC (PMEL_HUMAN)
DTFELTVSF

SEQ ID NO: 127156 - protein, 9 aa, Artificial Sequence
  Description of Artificial Sequence: Synthetic peptide
  Seed: GEGDAFELT (PMEL_HUMAN)
GEGDAFELM

SEQ ID NO: 127157 - protein, 10 aa, Artificial Sequence
  Description of Artificial Sequence: Synthetic peptide
  Seed: THTMEVTVYH (PMEL_HUMAN)
THTMEVTVYY

SEQ ID NO: 127158 - protein, 8 aa, Artificial Sequence
  Description of Artificial Sequence: Synthetic peptide
  Seed: LHDPSGYL (PMEL_HUMAN)
LVDPSGYV

SEQ ID NO: 127159 - protein, 9 aa, Artificial Sequence
  Description of Artificial Sequence: Synthetic peptide
  Seed: AEADLSYTW (PMEL_HUMAN)
AAADLSYTL

SEQ ID NO: 127160 - protein, 9 aa, Artificial Sequence
  Description of Artificial Sequence: Synthetic peptide
  Seed: SPACQLVLH (PMEL_HUMAN)
SPACQLVLF

SEQ ID NO: 127161 - protein, 10 aa, Artificial Sequence
  Description of Artificial Sequence: Synthetic peptide
  Seed: LAVIGALLAV (PMEL_HUMAN)
LYVIGALLAL

SEQ ID NO: 127162 - protein, 9 aa, Artificial Sequence
  Description of Artificial Sequence: Synthetic peptide
  Seed: QVWGGQPVY (PMEL_HUMAN)
QLWGGQPVW

SEQ ID NO: 127163 - protein, 11 aa, Artificial Sequence
  Description of Artificial Sequence: Synthetic peptide
  Seed: VWKTWGQYWQV (PMEL_HUMAN)
VLKTWGQYWQI

SEQ ID NO: 127164 - protein, 8 aa, Artificial Sequence
  Description of Artificial Sequence: Synthetic peptide
  Seed: TLDIVQGI (PMEL_HUMAN)
TTDIVQGL

SEQ ID NO: 127165 - protein, 9 aa, Artificial Sequence
  Description of Artificial Sequence: Synthetic peptide
  Seed: QKRSFVYVW (PMEL_HUMAN)
QMRSFVYVM

SEQ ID NO: 127166 - protein, 9 aa, Artificial Sequence
  Description of Artificial Sequence: Synthetic peptide
  Seed: VMGTTLAEM (PMEL_HUMAN)
VQGTTLAEF

SEQ ID NO: 127167 - protein, 10 aa, Artificial Sequence
  Description of Artificial Sequence: Synthetic peptide
  Seed: EVVGTTPGQA (PMEL_HUMAN)
EMVGTTPGQK

SEQ ID NO: 127168 - protein, 8 aa, Artificial Sequence
  Description of Artificial Sequence: Synthetic peptide
  Seed: LHDPSGYL (PMEL_HUMAN)
LFDPSGYI

SEQ ID NO: 127169 - protein, 10 aa, Artificial Sequence
  Description of Artificial Sequence: Synthetic peptide
  Seed: QVLGGPVSGL (PMEL_HUMAN)
QALGGPVSGR

SEQ ID NO: 127170 - protein, 10 aa, Artificial Sequence
  Description of Artificial Sequence: Synthetic peptide
  Seed: RQLYPEWTEA (PMEL_HUMAN)
RFLYPEWTEY

SEQ ID NO: 127171 - protein, 9 aa, Artificial Sequence
  Description of Artificial Sequence: Synthetic peptide
  Seed: SVPQLPHSS (PMEL_HUMAN)
SVPQLPHSI

SEQ ID NO: 127172 - protein, 9 aa, Artificial Sequence
  Description of Artificial Sequence: Synthetic peptide
  Seed: ANASFSIAL (PMEL_HUMAN)
ANASFSIAY

SEQ ID NO: 127173 - protein, 9 aa, Artificial Sequence
  Description of Artificial Sequence: Synthetic peptide
  Seed: RAMLGTHTM (PMEL_HUMAN)
RTMLGTHTY

SEQ ID NO: 127174 - protein, 9 aa, Artificial Sequence
  Description of Artificial Sequence: Synthetic peptide
  Seed: QLHDPSGYL (PMEL_HUMAN)
QMHDPSGYI

SEQ ID NO: 127175 - protein, 10 aa, Artificial Sequence
  Description of Artificial Sequence: Synthetic peptide
  Seed: VYVWKTWGQY (PMEL_HUMAN)
VYVWKTWGQW

SEQ ID NO: 127176 - protein, 10 aa, Artificial Sequence
  Description of Artificial Sequence: Synthetic peptide
  Seed: YGSFSVTLDI (PMEL_HUMAN)
YRSFSVTLDY

SEQ ID NO: 127177 - protein, 10 aa, Artificial Sequence
  Description of Artificial Sequence: Synthetic peptide
  Seed: GQVPLIVGIL (PMEL_HUMAN)
GMVPLIVGIY

SEQ ID NO: 127178 - protein, 9 aa, Artificial Sequence
  Description of Artificial Sequence: Synthetic peptide
  Seed: QVIWVNNTI (PMEL_HUMAN)
QTIWVNNTT

SEQ ID NO: 127179 - protein, 10 aa, Artificial Sequence
  Description of Artificial Sequence: Synthetic peptide
  Seed: FSVSVSQLRA (PMEL_HUMAN)
FTVSVSQLRV

SEQ ID NO: 127180 - protein, 9 aa, Artificial Sequence
  Description of Artificial Sequence: Synthetic peptide
  Seed: RGSRSYVPL (PMEL_HUMAN)
RMSRSYVPA

SEQ ID NO: 127181 - protein, 9 aa, Artificial Sequence
  Description of Artificial Sequence: Synthetic peptide
  Seed: GSRSYVPLA (PMEL_HUMAN)
GSRSYVPLK

SEQ ID NO: 127182 - protein, 9 aa, Artificial Sequence
  Description of Artificial Sequence: Synthetic peptide
  Seed: QAAIPLTSC (PMEL_HUMAN)
QTAIPLTSL

SEQ ID NO: 127183 - protein, 10 aa, Artificial Sequence
  Description of Artificial Sequence: Synthetic peptide
  Seed: ASSIMSTESI (PMEL_HUMAN)
AASIMSTESF

SEQ ID NO: 127184 - protein, 10 aa, Artificial Sequence
  Description of Artificial Sequence: Synthetic peptide
  Seed: YRYGSFSVTL (PMEL_HUMAN)
YVYGSFSVTW

SEQ ID NO: 127185 - protein, 10 aa, Artificial Sequence
  Description of Artificial Sequence: Synthetic peptide
  Seed: FSVSVSQLRA (PMEL_HUMAN)
FAVSVSQLRR

SEQ ID NO: 127186 - protein, 11 aa, Artificial Sequence
  Description of Artificial Sequence: Synthetic peptide
  Seed: RALDGGNKHFL (PMEL_HUMAN)
RNLDGGNKHFY

SEQ ID NO: 127187 - protein, 9 aa, Artificial Sequence
  Description of Artificial Sequence: Synthetic peptide
  Seed: RALDGGNKH (PMEL_HUMAN)
RTLDGGNKM

SEQ ID NO: 127188 - protein, 10 aa, Artificial Sequence
  Description of Artificial Sequence: Synthetic peptide
  Seed: EVMGTTLAEM (PMEL_HUMAN)
EVMGTTLAEI

SEQ ID NO: 127189 - protein, 10 aa, Artificial Sequence
  Description of Artificial Sequence: Synthetic peptide
  Seed: YVWKTWGQYW (PMEL_HUMAN)
YTWKTWGQYM

SEQ ID NO: 127190 - protein, 8 aa, Artificial Sequence
  Description of Artificial Sequence: Synthetic peptide
  Seed: SNDGPTLI (PMEL_HUMAN)
SIDGPTLV

SEQ ID NO: 127191 - protein, 9 aa, Artificial Sequence
  Description of Artificial Sequence: Synthetic peptide
  Seed: TLIGANASF (PMEL_HUMAN)
TAIGANASF

SEQ ID NO: 127192 - protein, 9 aa, Artificial Sequence
  Description of Artificial Sequence: Synthetic peptide
  Seed: MAVVLASLI (PMEL_HUMAN)
MIVVLASLW

SEQ ID NO: 127193 - protein, 10 aa, Artificial Sequence
  Description of Artificial Sequence: Synthetic peptide
  Seed: EVVGTTPGQA (PMEL_HUMAN)
EVVGTTPGQM

SEQ ID NO: 127194 - protein, 9 aa, Artificial Sequence
  Description of Artificial Sequence: Synthetic peptide
  Seed: TMEVTVYHR (PMEL_HUMAN)
TTEVTVYHY

SEQ ID NO: 127195 - protein, 9 aa, Artificial Sequence
  Description of Artificial Sequence: Synthetic peptide
  Seed: QLVLHQILK (PMEL_HUMAN)
QTVLHQILK

SEQ ID NO: 127196 - protein, 9 aa, Artificial Sequence
  Description of Artificial Sequence: Synthetic peptide
  Seed: QVWGGQPVY (PMEL_HUMAN)
QPWGGQPVL

SEQ ID NO: 127197 - protein, 9 aa, Artificial Sequence
  Description of Artificial Sequence: Synthetic peptide
  Seed: RALVVTHTY (PMEL_HUMAN)
RPLVVTHTW

SEQ ID NO: 127198 - protein, 9 aa, Artificial Sequence
  Description of Artificial Sequence: Synthetic peptide
  Seed: VLPDGQVIW (PMEL_HUMAN)
VLPDGQVIF

SEQ ID NO: 127199 - protein, 9 aa, Artificial Sequence
  Description of Artificial Sequence: Synthetic peptide
  Seed: LADTNSLAV (PMEL_HUMAN)
LPDTNSLAM

SEQ ID NO: 127200 - protein, 9 aa, Artificial Sequence
  Description of Artificial Sequence: Synthetic peptide
  Seed: KQDFSVPQL (PMEL_HUMAN)
KWDFSVPQL

SEQ ID NO: 127201 - protein, 9 aa, Artificial Sequence
  Description of Artificial Sequence: Synthetic peptide
  Seed: KVLPDGQVI (PMEL_HUMAN)
KILPDGQVI

SEQ ID NO: 127202 - protein, 11 aa, Artificial Sequence
  Description of Artificial Sequence: Synthetic peptide
  Seed: FGDSSGTLISR (PMEL_HUMAN)
FVDSSGTLISM

SEQ ID NO: 127203 - protein, 10 aa, Artificial Sequence
  Description of Artificial Sequence: Synthetic peptide
  Seed: AVIGALLAVG (PMEL_HUMAN)
AQIGALLAVC

SEQ ID NO: 127204 - protein, 11 aa, Artificial Sequence
  Description of Artificial Sequence: Synthetic peptide
  Seed: GIESAEILQAV (PMEL_HUMAN)
GLESAEILQAI

SEQ ID NO: 127205 - protein, 9 aa, Artificial Sequence
  Description of Artificial Sequence: Synthetic peptide
  Seed: LSIGTGRAM (PMEL_HUMAN)
LQIGTGRAI

SEQ ID NO: 127206 - protein, 9 aa, Artificial Sequence
  Description of Artificial Sequence: Synthetic peptide
  Seed: SITGSLGPL (PMEL_HUMAN)
SATGSLGPL

SEQ ID NO: 127207 - protein, 11 aa, Artificial Sequence
  Description of Artificial Sequence: Synthetic peptide
  Seed: KVLPDGQVIWV (PMEL_HUMAN)
KGLPDGQVIWW

SEQ ID NO: 127208 - protein, 10 aa, Artificial Sequence
  Description of Artificial Sequence: Synthetic peptide
  Seed: FSVSVSQLRA (PMEL_HUMAN)
FTVSVSQLRP

SEQ ID NO: 127209 - protein, 10 aa, Artificial Sequence
  Description of Artificial Sequence: Synthetic peptide
  Seed: RQLRTKAWNR (PMEL_HUMAN)
RFLRTKAWNK

SEQ ID NO: 127210 - protein, 9 aa, Artificial Sequence
  Description of Artificial Sequence: Synthetic peptide
  Seed: LHLAVIGAL (PMEL_HUMAN)
LALAVIGAY

SEQ ID NO: 127211 - protein, 10 aa, Artificial Sequence
  Description of Artificial Sequence: Synthetic peptide
  Seed: LVLMAVVLAS (PMEL_HUMAN)
LMLMAVVLAL

SEQ ID NO: 127212 - protein, 10 aa, Artificial Sequence
  Description of Artificial Sequence: Synthetic peptide
  Seed: SAEILQAVPS (PMEL_HUMAN)
SFEILQAVPA

SEQ ID NO: 127213 - protein, 9 aa, Artificial Sequence
  Description of Artificial Sequence: Synthetic peptide
  Seed: LAVGATKVP (PMEL_HUMAN)
LIVGATKVY

SEQ ID NO: 127214 - protein, 9 aa, Artificial Sequence
  Description of Artificial Sequence: Synthetic peptide
  Seed: ISRALVVTH (PMEL_HUMAN)
IARALVVTK

SEQ ID NO: 127215 - protein, 9 aa, Artificial Sequence
  Description of Artificial Sequence: Synthetic peptide
  Seed: AEVSIVVLS (PMEL_HUMAN)
ADVSIVVLL

SEQ ID NO: 127216 - protein, 9 aa, Artificial Sequence
  Description of Artificial Sequence: Synthetic peptide
  Seed: SQVWGGQPV (PMEL_HUMAN)
SMVWGGQPF

SEQ ID NO: 127217 - protein, 9 aa, Artificial Sequence
  Description of Artificial Sequence: Synthetic peptide
  Seed: QPLTFALQL (PMEL_HUMAN)
QHLTFALQL

SEQ ID NO: 127218 - protein, 10 aa, Artificial Sequence
  Description of Artificial Sequence: Synthetic peptide
  Seed: MSTESITGSL (PMEL_HUMAN)
MTTESITGSV

SEQ ID NO: 127219 - protein, 9 aa, Artificial Sequence
  Description of Artificial Sequence: Synthetic peptide
  Seed: SVPQLPHSS (PMEL_HUMAN)
SLPQLPHSI

SEQ ID NO: 127220 - protein, 9 aa, Artificial Sequence
  Description of Artificial Sequence: Synthetic peptide
  Seed: TPAEVSIVV (PMEL_HUMAN)
TQAEVSIVV

SEQ ID NO: 127221 - protein, 11 aa, Artificial Sequence
  Description of Artificial Sequence: Synthetic peptide
  Seed: RRGSRSYVPLA (PMEL_HUMAN)
RTGSRSYVPLK

SEQ ID NO: 127222 - protein, 8 aa, Artificial Sequence
  Description of Artificial Sequence: Synthetic peptide
  Seed: VETTAREL (PMEL_HUMAN)
VETTAREY

SEQ ID NO: 127223 - protein, 9 aa, Artificial Sequence
  Description of Artificial Sequence: Synthetic peptide
  Seed: VLPDGQVIW (PMEL_HUMAN)
VGPDGQVII

SEQ ID NO: 127224 - protein, 9 aa, Artificial Sequence
  Description of Artificial Sequence: Synthetic peptide
  Seed: RALDGGNKH (PMEL_HUMAN)
RALDGGNKY

SEQ ID NO: 127225 - protein, 10 aa, Artificial Sequence
  Description of Artificial Sequence: Synthetic peptide
  Seed: RQLYPEWTEA (PMEL_HUMAN)
RRLYPEWTEL

SEQ ID NO: 127226 - protein, 10 aa, Artificial Sequence
  Description of Artificial Sequence: Synthetic peptide
  Seed: SVPQLPHSSS (PMEL_HUMAN)
SSPQLPHSSM

SEQ ID NO: 127227 - protein, 9 aa, Artificial Sequence
  Description of Artificial Sequence: Synthetic peptide
  Seed: ANASFSIAL (PMEL_HUMAN)
ASASFSIAL

SEQ ID NO: 127228 - protein, 10 aa, Artificial Sequence
  Description of Artificial Sequence: Synthetic peptide
  Seed: WKTWGQYWQV (PMEL_HUMAN)
WHTWGQYWQV

SEQ ID NO: 127229 - protein, 11 aa, Artificial Sequence
  Description of Artificial Sequence: Synthetic peptide
  Seed: AEMSTPEATGM (PMEL_HUMAN)
AKMSTPEATGY

SEQ ID NO: 127230 - protein, 10 aa, Artificial Sequence
  Description of Artificial Sequence: Synthetic peptide
  Seed: EVMGTTLAEM (PMEL_HUMAN)
EVMGTTLAEW

SEQ ID NO: 127231 - protein, 10 aa, Artificial Sequence
  Description of Artificial Sequence: Synthetic peptide
  Seed: RGSRSYVPLA (PMEL_HUMAN)
RWSRSYVPLF

SEQ ID NO: 127232 - protein, 10 aa, Artificial Sequence
  Description of Artificial Sequence: Synthetic peptide
  Seed: TDQVPFSVSV (PMEL_HUMAN)
TLQVPFSVSI

SEQ ID NO: 127233 - protein, 9 aa, Artificial Sequence
  Description of Artificial Sequence: Synthetic peptide
  Seed: TIINGSQVW (PMEL_HUMAN)
TPINGSQVF

SEQ ID NO: 127234 - protein, 9 aa, Artificial Sequence
  Description of Artificial Sequence: Synthetic peptide
  Seed: FSVSVSQLR (PMEL_HUMAN)
FIVSVSQLL

SEQ ID NO: 127235 - protein, 9 aa, Artificial Sequence
  Description of Artificial Sequence: Synthetic peptide
  Seed: TMEVTVYHR (PMEL_HUMAN)
TFEVTVYHR

SEQ ID NO: 127236 - protein, 10 aa, Artificial Sequence
  Description of Artificial Sequence: Synthetic peptide
  Seed: IESAEILQAV (PMEL_HUMAN)
IQSAEILQAL

SEQ ID NO: 127237 - protein, 9 aa, Artificial Sequence
  Description of Artificial Sequence: Synthetic peptide
  Seed: TTDGHRPTA (PMEL_HUMAN)
TFDGHRPTI

SEQ ID NO: 127238 - protein, 9 aa, Artificial Sequence
  Description of Artificial Sequence: Synthetic peptide
  Seed: KTWGQYWQV (PMEL_HUMAN)
KCWGQYWQR

SEQ ID NO: 127239 - protein, 11 aa, Artificial Sequence
  Description of Artificial Sequence: Synthetic peptide
  Seed: ITDQVPFSVSV (PMEL_HUMAN)
ISDQVPFSVSM

SEQ ID NO: 127240 - protein, 9 aa, Artificial Sequence
  Description of Artificial Sequence: Synthetic peptide
  Seed: DQVPFSVSV (PMEL_HUMAN)
DRVPFSVSM

SEQ ID NO: 127241 - protein, 9 aa, Artificial Sequence
  Description of Artificial Sequence: Synthetic peptide
  Seed: VLKRCLLHL (PMEL_HUMAN)
VVKRCLLHY

SEQ ID NO: 127242 - protein, 9 aa, Artificial Sequence
  Description of Artificial Sequence: Synthetic peptide
  Seed: TAQVVLQAA (PMEL_HUMAN)
TPQVVLQAV

SEQ ID NO: 127243 - protein, 9 aa, Artificial Sequence
  Description of Artificial Sequence: Synthetic peptide
  Seed: QKRSFVYVW (PMEL_HUMAN)
QQRSFVYVI

SEQ ID NO: 127244 - protein, 9 aa, Artificial Sequence
  Description of Artificial Sequence: Synthetic peptide
  Seed: DAFELTVSC (PMEL_HUMAN)
DPFELTVSY

SEQ ID NO: 127245 - protein, 9 aa, Artificial Sequence
  Description of Artificial Sequence: Synthetic peptide
  Seed: MTPEKVPVS (PMEL_HUMAN)
MNPEKVPVM

SEQ ID NO: 127246 - protein, 9 aa, Artificial Sequence
  Description of Artificial Sequence: Synthetic peptide
  Seed: ITDQVPFSV (PMEL_HUMAN)
IWDQVPFSL

SEQ ID NO: 127247 - protein, 9 aa, Artificial Sequence
  Description of Artificial Sequence: Synthetic peptide
  Seed: LAVGATKVP (PMEL_HUMAN)
LVVGATKVF

SEQ ID NO: 127248 - protein, 9 aa, Artificial Sequence
  Description of Artificial Sequence: Synthetic peptide
  Seed: AQRLCQPVL (PMEL_HUMAN)
AIRLCQPVK

SEQ ID NO: 127249 - protein, 10 aa, Artificial Sequence
  Description of Artificial Sequence: Synthetic peptide
  Seed: SCPIGENSPL (PMEL_HUMAN)
SDPIGENSPM

SEQ ID NO: 127250 - protein, 11 aa, Artificial Sequence
  Description of Artificial Sequence: Synthetic peptide
  Seed: HTMEVTVYHRR (PMEL_HUMAN)
HMMEVTVYHRR

SEQ ID NO: 127251 - protein, 9 aa, Artificial Sequence
  Description of Artificial Sequence: Synthetic peptide
  Seed: RTKAWNRQL (PMEL_HUMAN)
RNKAWNRQK

SEQ ID NO: 127252 - protein, 9 aa, Artificial Sequence
  Description of Artificial Sequence: Synthetic peptide
  Seed: RAMLGTHTM (PMEL_HUMAN)
RAMLGTHTW

SEQ ID NO: 127253 - protein, 9 aa, Artificial Sequence
  Description of Artificial Sequence: Synthetic peptide
  Seed: ALDGGNKHF (PMEL_HUMAN)
ASDGGNKHW

SEQ ID NO: 127254 - protein, 10 aa, Artificial Sequence
  Description of Artificial Sequence: Synthetic peptide
  Seed: RALVVTHTYL (PMEL_HUMAN)
RNLVVTHTYW

SEQ ID NO: 127255 - protein, 9 aa, Artificial Sequence
  Description of Artificial Sequence: Synthetic peptide
  Seed: FSVSVSQLR (PMEL_HUMAN)
FGVSVSQLY

SEQ ID NO: 127256 - protein, 9 aa, Artificial Sequence
  Description of Artificial Sequence: Synthetic peptide
  Seed: ISRALVVTH (PMEL_HUMAN)
ITRALVVTL

SEQ ID NO: 127257 - protein, 10 aa, Artificial Sequence
  Description of Artificial Sequence: Synthetic peptide
  Seed: KTWGQYWQVL (PMEL_HUMAN)
KIWGQYWQVT

SEQ ID NO: 127258 - protein, 9 aa, Artificial Sequence
  Description of Artificial Sequence: Synthetic peptide
  Seed: QKRSFVYVW (PMEL_HUMAN)
QSRSFVYVF

SEQ ID NO: 127259 - protein, 9 aa, Artificial Sequence
  Description of Artificial Sequence: Synthetic peptide
  Seed: GGPVSGLSI (PMEL_HUMAN)
GAPVSGLSY

SEQ ID NO: 127260 - protein, 10 aa, Artificial Sequence
  Description of Artificial Sequence: Synthetic peptide
  Seed: QVPLDCVLYR (PMEL_HUMAN)
QSPLDCVLYR

SEQ ID NO: 127261 - protein, 10 aa, Artificial Sequence
  Description of Artificial Sequence: Synthetic peptide
  Seed: NSLAVVSTQL (PMEL_HUMAN)
NTLAVVSTQV

SEQ ID NO: 127262 - protein, 9 aa, Artificial Sequence
  Description of Artificial Sequence: Synthetic peptide
  Seed: RAMLGTHTM (PMEL_HUMAN)
RMMLGTHTA

SEQ ID NO: 127263 - protein, 10 aa, Artificial Sequence
  Description of Artificial Sequence: Synthetic peptide
  Seed: SSAFTITDQV (PMEL_HUMAN)
SLAFTITDQL

SEQ ID NO: 127264 - protein, 9 aa, Artificial Sequence
  Description of Artificial Sequence: Synthetic peptide
  Seed: SQKRSFVYV (PMEL_HUMAN)
SMKRSFVYF

SEQ ID NO: 127265 - protein, 11 aa, Artificial Sequence
  Description of Artificial Sequence: Synthetic peptide
  Seed: YVPLAHSSSAF (PMEL_HUMAN)
YFPLAHSSSAF

SEQ ID NO: 127266 - protein, 9 aa, Artificial Sequence
  Description of Artificial Sequence: Synthetic peptide
  Seed: YVWKTWGQY (PMEL_HUMAN)
YLWKTWGQF

SEQ ID NO: 127267 - protein, 9 aa, Artificial Sequence
  Description of Artificial Sequence: Synthetic peptide
  Seed: VSNDGPTLI (PMEL_HUMAN)
VTNDGPTLV

SEQ ID NO: 127268 - protein, 9 aa, Artificial Sequence
  Description of Artificial Sequence: Synthetic peptide
  Seed: ITDQVPFSV (PMEL_HUMAN)
ICDQVPFSV

SEQ ID NO: 127269 - protein, 10 aa, Artificial Sequence
  Description of Artificial Sequence: Synthetic peptide
  Seed: MTPAEVSIVV (PMEL_HUMAN)
MRPAEVSIVY

SEQ ID NO: 127270 - protein, 9 aa, Artificial Sequence
  Description of Artificial Sequence: Synthetic peptide
  Seed: TLISRALVV (PMEL_HUMAN)
TQISRALVV

SEQ ID NO: 127271 - protein, 11 aa, Artificial Sequence
  Description of Artificial Sequence: Synthetic peptide
  Seed: RYGSFSVTLDI (PMEL_HUMAN)
RDGSFSVTLDW

SEQ ID NO: 127272 - protein, 9 aa, Artificial Sequence
  Description of Artificial Sequence: Synthetic peptide
  Seed: GMTPAEVSI (PMEL_HUMAN)
GSTPAEVSY

SEQ ID NO: 127273 - protein, 9 aa, Artificial Sequence
  Description of Artificial Sequence: Synthetic peptide
  Seed: RQVPLDCVL (PMEL_HUMAN)
RMVPLDCVA

SEQ ID NO: 127274 - protein, 10 aa, Artificial Sequence
  Description of Artificial Sequence: Synthetic peptide
  Seed: KTWGQYWQVL (PMEL_HUMAN)
KVWGQYWQVW

SEQ ID NO: 127275 - protein, 9 aa, Artificial Sequence
  Description of Artificial Sequence: Synthetic peptide
  Seed: VVLQAAIPL (PMEL_HUMAN)
VSLQAAIPF

SEQ ID NO: 127276 - protein, 9 aa, Artificial Sequence
  Description of Artificial Sequence: Synthetic peptide
  Seed: VSRQLRTKA (PMEL_HUMAN)
VTRQLRTKL

SEQ ID NO: 127277 - protein, 10 aa, Artificial Sequence
  Description of Artificial Sequence: Synthetic peptide
  Seed: MAVVLASLIY (PMEL_HUMAN)
MTVVLASLIR

SEQ ID NO: 127278 - protein, 9 aa, Artificial Sequence
  Description of Artificial Sequence: Synthetic peptide
  Seed: ALDGGNKHF (PMEL_HUMAN)
ANDGGNKHM

SEQ ID NO: 127279 - protein, 8 aa, Artificial Sequence
  Description of Artificial Sequence: Synthetic peptide
  Seed: LNFPGSQK (PMEL_HUMAN)
LAFPGSQF

SEQ ID NO: 127280 - protein, 10 aa, Artificial Sequence
  Description of Artificial Sequence: Synthetic peptide
  Seed: LIYRRRLMKQ (PMEL_HUMAN)
LIYRRRLMKK

SEQ ID NO: 127281 - protein, 9 aa, Artificial Sequence
  Description of Artificial Sequence: Synthetic peptide
  Seed: LTSCGSSPV (PMEL_HUMAN)
LVSCGSSPY

SEQ ID NO: 127282 - protein, 9 aa, Artificial Sequence
  Description of Artificial Sequence: Synthetic peptide
  Seed: FLRNQPLTF (PMEL_HUMAN)
FMRNQPLTW

SEQ ID NO: 127283 - protein, 11 aa, Artificial Sequence
  Description of Artificial Sequence: Synthetic peptide
  Seed: HTMEVTVYHRR (PMEL_HUMAN)
HTMEVTVYHRD

SEQ ID NO: 127284 - protein, 10 aa, Artificial Sequence
  Description of Artificial Sequence: Synthetic peptide
  Seed: GPLLDGTATL (PMEL_HUMAN)
GPLLDGTATI

SEQ ID NO: 127285 - protein, 10 aa, Artificial Sequence
  Description of Artificial Sequence: Synthetic peptide
  Seed: ALDGGNKHFL (PMEL_HUMAN)
ATDGGNKHFM

SEQ ID NO: 127286 - protein, 10 aa, Artificial Sequence
  Description of Artificial Sequence: Synthetic peptide
  Seed: SLADTNSLAV (PMEL_HUMAN)
SMADTNSLAF

SEQ ID NO: 127287 - protein, 9 aa, Artificial Sequence
  Description of Artificial Sequence: Synthetic peptide
  Seed: KHFLRNQPL (PMEL_HUMAN)
KWFLRNQPF

SEQ ID NO: 127288 - protein, 10 aa, Artificial Sequence
  Description of Artificial Sequence: Synthetic peptide
  Seed: YRYGSFSVTL (PMEL_HUMAN)
YGYGSFSVTI

SEQ ID NO: 127289 - protein, 10 aa, Artificial Sequence
  Description of Artificial Sequence: Synthetic peptide
  Seed: QVLGGPVSGL (PMEL_HUMAN)
QSLGGPVSGK

SEQ ID NO: 127290 - protein, 9 aa, Artificial Sequence
  Description of Artificial Sequence: Synthetic peptide
  Seed: SGEGDAFEL (PMEL_HUMAN)
SVEGDAFEL

SEQ ID NO: 127291 - protein, 9 aa, Artificial Sequence
  Description of Artificial Sequence: Synthetic peptide
  Seed: YVWKTWGQY (PMEL_HUMAN)
YQWKTWGQL

SEQ ID NO: 127292 - protein, 10 aa, Artificial Sequence
  Description of Artificial Sequence: Synthetic peptide
  Seed: AMLGTHTMEV (PMEL_HUMAN)
ALLGTHTMEM

SEQ ID NO: 127293 - protein, 9 aa, Artificial Sequence
  Description of Artificial Sequence: Synthetic peptide
  Seed: YLEPGPVTA (PMEL_HUMAN)
YIEPGPVTV

SEQ ID NO: 127294 - protein, 9 aa, Artificial Sequence
  Description of Artificial Sequence: Synthetic peptide
  Seed: YLAEADLSY (PMEL_HUMAN)
YTAEADLSV

SEQ ID NO: 127295 - protein, 9 aa, Artificial Sequence
  Description of Artificial Sequence: Synthetic peptide
  Seed: GQVPTTEVV (PMEL_HUMAN)
GVVPTTEVY

SEQ ID NO: 127296 - protein, 9 aa, Artificial Sequence
  Description of Artificial Sequence: Synthetic peptide
  Seed: MSTPEATGM (PMEL_HUMAN)
MMTPEATGM

SEQ ID NO: 127297 - protein, 9 aa, Artificial Sequence
  Description of Artificial Sequence: Synthetic peptide
  Seed: KVLPDGQVI (PMEL_HUMAN)
KQLPDGQVM

SEQ ID NO: 127298 - protein, 9 aa, Artificial Sequence
  Description of Artificial Sequence: Synthetic peptide
  Seed: GQVPTTEVV (PMEL_HUMAN)
GTVPTTEVL

SEQ ID NO: 127299 - protein, 10 aa, Artificial Sequence
  Description of Artificial Sequence: Synthetic peptide
  Seed: YVWKTWGQYW (PMEL_HUMAN)
YSWKTWGQYM

SEQ ID NO: 127300 - protein, 10 aa, Artificial Sequence
  Description of Artificial Sequence: Synthetic peptide
  Seed: VLYRYGSFSV (PMEL_HUMAN)
VFYRYGSFSK

SEQ ID NO: 127301 - protein, 9 aa, Artificial Sequence
  Description of Artificial Sequence: Synthetic peptide
  Seed: RYGSFSVTL (PMEL_HUMAN)
RMGSFSVTY

SEQ ID NO: 127302 - protein, 10 aa, Artificial Sequence
  Description of Artificial Sequence: Synthetic peptide
  Seed: SGTYCLNVSL (PMEL_HUMAN)
SRTYCLNVSY

SEQ ID NO: 127303 - protein, 9 aa, Artificial Sequence
  Description of Artificial Sequence: Synthetic peptide
  Seed: FTITDQVPF (PMEL_HUMAN)
FSITDQVPI

SEQ ID NO: 127304 - protein, 9 aa, Artificial Sequence
  Description of Artificial Sequence: Synthetic peptide
  Seed: STESITGSL (PMEL_HUMAN)
SFESITGSM

SEQ ID NO: 127305 - protein, 10 aa, Artificial Sequence
  Description of Artificial Sequence: Synthetic peptide
  Seed: MAVVLASLIY (PMEL_HUMAN)
MNVVLASLIY

SEQ ID NO: 127306 - protein, 10 aa, Artificial Sequence
  Description of Artificial Sequence: Synthetic peptide
  Seed: FPDGGPCPSG (PMEL_HUMAN)
FPDGGPCPSY

SEQ ID NO: 127307 - protein, 11 aa, Artificial Sequence
  Description of Artificial Sequence: Synthetic peptide
  Seed: RQVPLDCVLYR (PMEL_HUMAN)
RTVPLDCVLYK

SEQ ID NO: 127308 - protein, 9 aa, Artificial Sequence
  Description of Artificial Sequence: Synthetic peptide
  Seed: VISTAPVQM (PMEL_HUMAN)
VRSTAPVQF

SEQ ID NO: 127309 - protein, 9 aa, Artificial Sequence
  Description of Artificial Sequence: Synthetic peptide
  Seed: RLMKQDFSV (PMEL_HUMAN)
RMMKQDFSL

SEQ ID NO: 127310 - protein, 10 aa, Artificial Sequence
  Description of Artificial Sequence: Synthetic peptide
  Seed: RGSRSYVPLA (PMEL_HUMAN)
RDSRSYVPLV

SEQ ID NO: 127311 - protein, 9 aa, Artificial Sequence
  Description of Artificial Sequence: Synthetic peptide
  Seed: LADTNSLAV (PMEL_HUMAN)
LQDTNSLAM

SEQ ID NO: 127312 - protein, 10 aa, Artificial Sequence
  Description of Artificial Sequence: Synthetic peptide
  Seed: LAVVSTQLIM (PMEL_HUMAN)
LLVVSTQLIY

SEQ ID NO: 127313 - protein, 9 aa, Artificial Sequence
  Description of Artificial Sequence: Synthetic peptide
  Seed: VVLSGTTAA (PMEL_HUMAN)
VQLSGTTAI

SEQ ID NO: 127314 - protein, 10 aa, Artificial Sequence
  Description of Artificial Sequence: Synthetic peptide
  Seed: MTPAEVSIVV (PMEL_HUMAN)
MRPAEVSIVS

SEQ ID NO: 127315 - protein, 10 aa, Artificial Sequence
  Description of Artificial Sequence: Synthetic peptide
  Seed: RGSRSYVPLA (PMEL_HUMAN)
RASRSYVPLT

SEQ ID NO: 127316 - protein, 11 aa, Artificial Sequence
  Description of Artificial Sequence: Synthetic peptide
  Seed: VLMAVVLASLI (PMEL_HUMAN)
VLMAVVLASLL

SEQ ID NO: 127317 - protein, 11 aa, Artificial Sequence
  Description of Artificial Sequence: Synthetic peptide
  Seed: SYVPLAHSSSA (PMEL_HUMAN)
SAVPLAHSSSL

SEQ ID NO: 127318 - protein, 9 aa, Artificial Sequence
  Description of Artificial Sequence: Synthetic peptide
  Seed: TTPGQAPTA (PMEL_HUMAN)
TYPGQAPTM

SEQ ID NO: 127319 - protein, 11 aa, Artificial Sequence
  Description of Artificial Sequence: Synthetic peptide
  Seed: LGPLLDGTATL (PMEL_HUMAN)
LLPLLDGTATL

SEQ ID NO: 127320 - protein, 9 aa, Artificial Sequence
  Description of Artificial Sequence: Synthetic peptide
  Seed: RLVKRQVPL (PMEL_HUMAN)
RPVKRQVPV

SEQ ID NO: 127321 - protein, 9 aa, Artificial Sequence
  Description of Artificial Sequence: Synthetic peptide
  Seed: KHFLRNQPL (PMEL_HUMAN)
KTFLRNQPY

SEQ ID NO: 127322 - protein, 10 aa, Artificial Sequence
  Description of Artificial Sequence: Synthetic peptide
  Seed: YPQETDDACI (PMEL_HUMAN)
YPQETDDACL

SEQ ID NO: 127323 - protein, 10 aa, Artificial Sequence
  Description of Artificial Sequence: Synthetic peptide
  Seed: VPQLPHSSSH (PMEL_HUMAN)
VAQLPHSSSM

SEQ ID NO: 127324 - protein, 9 aa, Artificial Sequence
  Description of Artificial Sequence: Synthetic peptide
  Seed: MAVVLASLI (PMEL_HUMAN)
MQVVLASLF

SEQ ID NO: 127325 - protein, 9 aa, Artificial Sequence
  Description of Artificial Sequence: Synthetic peptide
  Seed: AVGATKVPR (PMEL_HUMAN)
AAGATKVPK

SEQ ID NO: 127326 - protein, 10 aa, Artificial Sequence
  Description of Artificial Sequence: Synthetic peptide
  Seed: SSSHWLRLPR (PMEL_HUMAN)
SMSHWLRLPR

SEQ ID NO: 127327 - protein, 9 aa, Artificial Sequence
  Description of Artificial Sequence: Synthetic peptide
  Seed: QAAIPLTSC (PMEL_HUMAN)
QPAIPLTSV

SEQ ID NO: 127328 - protein, 9 aa, Artificial Sequence
  Description of Artificial Sequence: Synthetic peptide
  Seed: TDQVPFSVS (PMEL_HUMAN)
TEQVPFSVV

SEQ ID NO: 127329 - protein, 10 aa, Artificial Sequence
  Description of Artificial Sequence: Synthetic peptide
  Seed: QILKGGSGTY (PMEL_HUMAN)
QTLKGGSGTR

SEQ ID NO: 127330 - protein, 9 aa, Artificial Sequence
  Description of Artificial Sequence: Synthetic peptide
  Seed: ASFSIALNF (PMEL_HUMAN)
AQFSIALNR

SEQ ID NO: 127331 - protein, 9 aa, Artificial Sequence
  Description of Artificial Sequence: Synthetic peptide
  Seed: QEAGLGQVP (PMEL_HUMAN)
QEAGLGQVA

SEQ ID NO: 127332 - protein, 9 aa, Artificial Sequence
  Description of Artificial Sequence: Synthetic peptide
  Seed: AQRLCQPVL (PMEL_HUMAN)
AMRLCQPVK

SEQ ID NO: 127333 - protein, 10 aa, Artificial Sequence
  Description of Artificial Sequence: Synthetic peptide
  Seed: MTPAEVSIVV (PMEL_HUMAN)
MIPAEVSIVH

SEQ ID NO: 127334 - protein, 10 aa, Artificial Sequence
  Description of Artificial Sequence: Synthetic peptide
  Seed: YVPLAHSSSA (PMEL_HUMAN)
YWPLAHSSSF

SEQ ID NO: 127335 - protein, 9 aa, Artificial Sequence
  Description of Artificial Sequence: Synthetic peptide
  Seed: RQVPLDCVL (PMEL_HUMAN)
RMVPLDCVV

SEQ ID NO: 127336 - protein, 9 aa, Artificial Sequence
  Description of Artificial Sequence: Synthetic peptide
  Seed: LADTNSLAV (PMEL_HUMAN)
LSDTNSLAV

SEQ ID NO: 127337 - protein, 8 aa, Artificial Sequence
  Description of Artificial Sequence: Synthetic peptide
  Seed: LADTNSLA (PMEL_HUMAN)
LNDTNSLL

SEQ ID NO: 127338 - protein, 11 aa, Artificial Sequence
  Description of Artificial Sequence: Synthetic peptide
  Seed: RYGSFSVTLDI (PMEL_HUMAN)
RKGSFSVTLDF

SEQ ID NO: 127339 - protein, 10 aa, Artificial Sequence
  Description of Artificial Sequence: Synthetic peptide
  Seed: RSFVYVWKTW (PMEL_HUMAN)
RMFVYVWKTI

SEQ ID NO: 127340 - protein, 10 aa, Artificial Sequence
  Description of Artificial Sequence: Synthetic peptide
  Seed: SQVWGGQPVY (PMEL_HUMAN)
SMVWGGQPVY

SEQ ID NO: 127341 - protein, 10 aa, Artificial Sequence
  Description of Artificial Sequence: Synthetic peptide
  Seed: RGSRSYVPLA (PMEL_HUMAN)
RKSRSYVPLR

SEQ ID NO: 127342 - protein, 11 aa, Artificial Sequence
  Description of Artificial Sequence: Synthetic peptide
  Seed: RAMLGTHTMEV (PMEL_HUMAN)
RVMLGTHTMEV

SEQ ID NO: 127343 - protein, 10 aa, Artificial Sequence
  Description of Artificial Sequence: Synthetic peptide
  Seed: RQLYPEWTEA (PMEL_HUMAN)
RSLYPEWTEF

SEQ ID NO: 127344 - protein, 10 aa, Artificial Sequence
  Description of Artificial Sequence: Synthetic peptide
  Seed: RALVVTHTYL (PMEL_HUMAN)
RALVVTHTYF

SEQ ID NO: 127345 - protein, 9 aa, Artificial Sequence
  Description of Artificial Sequence: Synthetic peptide
  Seed: ESAEILQAV (PMEL_HUMAN)
EIAEILQAI

SEQ ID NO: 127346 - protein, 9 aa, Artificial Sequence
  Description of Artificial Sequence: Synthetic peptide
  Seed: QVIWVNNTI (PMEL_HUMAN)
QVIWVNNTW

SEQ ID NO: 127347 - protein, 10 aa, Artificial Sequence
  Description of Artificial Sequence: Synthetic peptide
  Seed: VPFSVSVSQL (PMEL_HUMAN)
VPFSVSVSQA

SEQ ID NO: 127348 - protein, 9 aa, Artificial Sequence
  Description of Artificial Sequence: Synthetic peptide
  Seed: SLAVVSTQL (PMEL_HUMAN)
SIAVVSTQA

SEQ ID NO: 127349 - protein, 9 aa, Artificial Sequence
  Description of Artificial Sequence: Synthetic peptide
  Seed: DGTATLRLV (PMEL_HUMAN)
DATATLRLV

SEQ ID NO: 127350 - protein, 9 aa, Artificial Sequence
  Description of Artificial Sequence: Synthetic peptide
  Seed: SLAVVSTQL (PMEL_HUMAN)
SMAVVSTQF

SEQ ID NO: 127351 - protein, 8 aa, Artificial Sequence
  Description of Artificial Sequence: Synthetic peptide
  Seed: SEVMGTTL (PMEL_HUMAN)
SQVMGTTI

SEQ ID NO: 127352 - protein, 10 aa, Artificial Sequence
  Description of Artificial Sequence: Synthetic peptide
  Seed: LHLAVIGALL (PMEL_HUMAN)
LYLAVIGALL

SEQ ID NO: 127353 - protein, 10 aa, Artificial Sequence
  Description of Artificial Sequence: Synthetic peptide
  Seed: RQLYPEWTEA (PMEL_HUMAN)
RHLYPEWTEY

SEQ ID NO: 127354 - protein, 9 aa, Artificial Sequence
  Description of Artificial Sequence: Synthetic peptide
  Seed: QLYPEWTEA (PMEL_HUMAN)
QLYPEWTEM

SEQ ID NO: 127355 - protein, 10 aa, Artificial Sequence
  Description of Artificial Sequence: Synthetic peptide
  Seed: SGTYCLNVSL (PMEL_HUMAN)
SATYCLNVSF

SEQ ID NO: 127356 - protein, 9 aa, Artificial Sequence
  Description of Artificial Sequence: Synthetic peptide
  Seed: SSHWLRLPR (PMEL_HUMAN)
STHWLRLPS

SEQ ID NO: 127357 - protein, 9 aa, Artificial Sequence
  Description of Artificial Sequence: Synthetic peptide
  Seed: YWQVLGGPV (PMEL_HUMAN)
YWQVLGGPM

SEQ ID NO: 127358 - protein, 10 aa, Artificial Sequence
  Description of Artificial Sequence: Synthetic peptide
  Seed: FPDGGPCPSG (PMEL_HUMAN)
FPDGGPCPSI

SEQ ID NO: 127359 - protein, 9 aa, Artificial Sequence
  Description of Artificial Sequence: Synthetic peptide
  Seed: LPDGQVIWV (PMEL_HUMAN)
LYDGQVIWI

SEQ ID NO: 127360 - protein, 9 aa, Artificial Sequence
  Description of Artificial Sequence: Synthetic peptide
  Seed: TTDGHRPTA (PMEL_HUMAN)
TMDGHRPTI

SEQ ID NO: 127361 - protein, 9 aa, Artificial Sequence
  Description of Artificial Sequence: Synthetic peptide
  Seed: VTAQVVLQA (PMEL_HUMAN)
VSAQVVLQI

SEQ ID NO: 127362 - protein, 9 aa, Artificial Sequence
  Description of Artificial Sequence: Synthetic peptide
  Seed: KTWGQYWQV (PMEL_HUMAN)
KAWGQYWQF

SEQ ID NO: 127363 - protein, 10 aa, Artificial Sequence
  Description of Artificial Sequence: Synthetic peptide
  Seed: LHLAVIGALL (PMEL_HUMAN)
LGLAVIGALL

SEQ ID NO: 127364 - protein, 10 aa, Artificial Sequence
  Description of Artificial Sequence: Synthetic peptide
  Seed: RQLYPEWTEA (PMEL_HUMAN)
RMLYPEWTEM

SEQ ID NO: 127365 - protein, 10 aa, Artificial Sequence
  Description of Artificial Sequence: Synthetic peptide
  Seed: SAEILQAVPS (PMEL_HUMAN)
SVEILQAVPA

SEQ ID NO: 127366 - protein, 10 aa, Artificial Sequence
  Description of Artificial Sequence: Synthetic peptide
  Seed: SVTLDIVQGI (PMEL_HUMAN)
SLTLDIVQGM

SEQ ID NO: 127367 - protein, 9 aa, Artificial Sequence
  Description of Artificial Sequence: Synthetic peptide
  Seed: RAMLGTHTM (PMEL_HUMAN)
RTMLGTHTH

SEQ ID NO: 127368 - protein, 9 aa, Artificial Sequence
  Description of Artificial Sequence: Synthetic peptide
  Seed: QVWGGQPVY (PMEL_HUMAN)
QRWGGQPVF

SEQ ID NO: 127369 - protein, 9 aa, Artificial Sequence
  Description of Artificial Sequence: Synthetic peptide
  Seed: LADTNSLAV (PMEL_HUMAN)
LNDTNSLAM

SEQ ID NO: 127370 - protein, 10 aa, Artificial Sequence
  Description of Artificial Sequence: Synthetic peptide
  Seed: YGSFSVTLDI (PMEL_HUMAN)
YVSFSVTLDY

SEQ ID NO: 127371 - protein, 9 aa, Artificial Sequence
  Description of Artificial Sequence: Synthetic peptide
  Seed: RTKAWNRQL (PMEL_HUMAN)
RVKAWNRQY

SEQ ID NO: 127372 - protein, 9 aa, Artificial Sequence
  Description of Artificial Sequence: Synthetic peptide
  Seed: LIVGILLVL (PMEL_HUMAN)
LQVGILLVV

SEQ ID NO: 127373 - protein, 9 aa, Artificial Sequence
  Description of Artificial Sequence: Synthetic peptide
  Seed: SLAVVSTQL (PMEL_HUMAN)
SLAVVSTQY

SEQ ID NO: 127374 - protein, 9 aa, Artificial Sequence
  Description of Artificial Sequence: Synthetic peptide
  Seed: VTLDIVQGI (PMEL_HUMAN)
VALDIVQGI

SEQ ID NO: 127375 - protein, 10 aa, Artificial Sequence
  Description of Artificial Sequence: Synthetic peptide
  Seed: EVMGTTLAEM (PMEL_HUMAN)
EVMGTTLAEY

SEQ ID NO: 127376 - protein, 10 aa, Artificial Sequence
  Description of Artificial Sequence: Synthetic peptide
  Seed: MPTAESTGMT (PMEL_HUMAN)
MSTAESTGMI

SEQ ID NO: 127377 - protein, 9 aa, Artificial Sequence
  Description of Artificial Sequence: Synthetic peptide
  Seed: RALVVTHTY (PMEL_HUMAN)
RLLVVTHTW

SEQ ID NO: 127378 - protein, 11 aa, Artificial Sequence
  Description of Artificial Sequence: Synthetic peptide
  Seed: SSHWLRLPRIF (PMEL_HUMAN)
SYHWLRLPRIF

SEQ ID NO: 127379 - protein, 10 aa, Artificial Sequence
  Description of Artificial Sequence: Synthetic peptide
  Seed: VPLAHSSSAF (PMEL_HUMAN)
VLLAHSSSAF

SEQ ID NO: 127380 - protein, 11 aa, Artificial Sequence
  Description of Artificial Sequence: Synthetic peptide
  Seed: FGDSSGTLISR (PMEL_HUMAN)
FCDSSGTLISI

SEQ ID NO: 127381 - protein, 10 aa, Artificial Sequence
  Description of Artificial Sequence: Synthetic peptide
  Seed: LAVIGALLAV (PMEL_HUMAN)
LYVIGALLAA

SEQ ID NO: 127382 - protein, 10 aa, Artificial Sequence
  Description of Artificial Sequence: Synthetic peptide
  Seed: STAPVQMPTA (PMEL_HUMAN)
SVAPVQMPTL

SEQ ID NO: 127383 - protein, 10 aa, Artificial Sequence
  Description of Artificial Sequence: Synthetic peptide
  Seed: VPLDCVLYRY (PMEL_HUMAN)
VPLDCVLYRW

SEQ ID NO: 127384 - protein, 9 aa, Artificial Sequence
  Description of Artificial Sequence: Synthetic peptide
  Seed: RELPIPEPE (PMEL_HUMAN)
RELPIPEPL

SEQ ID NO: 127385 - protein, 11 aa, Artificial Sequence
  Description of Artificial Sequence: Synthetic peptide
  Seed: RRGSRSYVPLA (PMEL_HUMAN)
RLGSRSYVPLV

SEQ ID NO: 127386 - protein, 10 aa, Artificial Sequence
  Description of Artificial Sequence: Synthetic peptide
  Seed: YVWKTWGQYW (PMEL_HUMAN)
YSWKTWGQYL

SEQ ID NO: 127387 - protein, 10 aa, Artificial Sequence
  Description of Artificial Sequence: Synthetic peptide
  Seed: TITDQVPFSV (PMEL_HUMAN)
TMTDQVPFSI

SEQ ID NO: 127388 - protein, 9 aa, Artificial Sequence
  Description of Artificial Sequence: Synthetic peptide
  Seed: STAPVQMPT (PMEL_HUMAN)
SVAPVQMPM

SEQ ID NO: 127389 - protein, 10 aa, Artificial Sequence
  Description of Artificial Sequence: Synthetic peptide
  Seed: MAVVLASLIY (PMEL_HUMAN)
MGVVLASLIR

SEQ ID NO: 127390 - protein, 10 aa, Artificial Sequence
  Description of Artificial Sequence: Synthetic peptide
  Seed: ALDGGNKHFL (PMEL_HUMAN)
AMDGGNKHFV

SEQ ID NO: 127391 - protein, 9 aa, Artificial Sequence
  Description of Artificial Sequence: Synthetic peptide
  Seed: ALNFPGSQK (PMEL_HUMAN)
AGNFPGSQY

SEQ ID NO: 127392 - protein, 10 aa, Artificial Sequence
  Description of Artificial Sequence: Synthetic peptide
  Seed: KVLPDGQVIW (PMEL_HUMAN)
KELPDGQVIF

SEQ ID NO: 127393 - protein, 9 aa, Artificial Sequence
  Description of Artificial Sequence: Synthetic peptide
  Seed: TTDGHRPTA (PMEL_HUMAN)
TDDGHRPTM

SEQ ID NO: 127394 - protein, 9 aa, Artificial Sequence
  Description of Artificial Sequence: Synthetic peptide
  Seed: VPFSVSVSQ (PMEL_HUMAN)
VPFSVSVSS

SEQ ID NO: 127395 - protein, 9 aa, Artificial Sequence
  Description of Artificial Sequence: Synthetic peptide
  Seed: VTLDIVQGI (PMEL_HUMAN)
VVLDIVQGI

SEQ ID NO: 127396 - protein, 9 aa, Artificial Sequence
  Description of Artificial Sequence: Synthetic peptide
  Seed: ALDGGNKHF (PMEL_HUMAN)
AADGGNKHM

SEQ ID NO: 127397 - protein, 10 aa, Artificial Sequence
  Description of Artificial Sequence: Synthetic peptide
  Seed: SRALVVTHTY (PMEL_HUMAN)
SQALVVTHTW

SEQ ID NO: 127398 - protein, 10 aa, Artificial Sequence
  Description of Artificial Sequence: Synthetic peptide
  Seed: RQLYPEWTEA (PMEL_HUMAN)
RDLYPEWTEY

SEQ ID NO: 127399 - protein, 9 aa, Artificial Sequence
  Description of Artificial Sequence: Synthetic peptide
  Seed: ALDGGNKHF (PMEL_HUMAN)
AQDGGNKHY

SEQ ID NO: 127400 - protein, 10 aa, Artificial Sequence
  Description of Artificial Sequence: Synthetic peptide
  Seed: NASFSIALNF (PMEL_HUMAN)
NFSFSIALNW

SEQ ID NO: 127401 - protein, 9 aa, Artificial Sequence
  Description of Artificial Sequence: Synthetic peptide
  Seed: IESAEILQA (PMEL_HUMAN)
IESAEILQM

SEQ ID NO: 127402 - protein, 9 aa, Artificial Sequence
  Description of Artificial Sequence: Synthetic peptide
  Seed: KAWNRQLYP (PMEL_HUMAN)
KVWNRQLYM

SEQ ID NO: 127403 - protein, 10 aa, Artificial Sequence
  Description of Artificial Sequence: Synthetic peptide
  Seed: YVWKTWGQYW (PMEL_HUMAN)
YWWKTWGQYL

SEQ ID NO: 127404 - protein, 10 aa, Artificial Sequence
  Description of Artificial Sequence: Synthetic peptide
  Seed: TLAEMSTPEA (PMEL_HUMAN)
TIAEMSTPEV

SEQ ID NO: 127405 - protein, 8 aa, Artificial Sequence
  Description of Artificial Sequence: Synthetic peptide
  Seed: LVKRQVPL (PMEL_HUMAN)
LLKRQVPM

SEQ ID NO: 127406 - protein, 11 aa, Artificial Sequence
  Description of Artificial Sequence: Synthetic peptide
  Seed: LGPLLDGTATL (PMEL_HUMAN)
LNPLLDGTATV

SEQ ID NO: 127407 - protein, 10 aa, Artificial Sequence
  Description of Artificial Sequence: Synthetic peptide
  Seed: AVIGALLAVG (PMEL_HUMAN)
AQIGALLAVI

SEQ ID NO: 127408 - protein, 10 aa, Artificial Sequence
  Description of Artificial Sequence: Synthetic peptide
  Seed: RTKAWNRQLY (PMEL_HUMAN)
RAKAWNRQLA

SEQ ID NO: 127409 - protein, 9 aa, Artificial Sequence
  Description of Artificial Sequence: Synthetic peptide
  Seed: FGDSSGTLI (PMEL_HUMAN)
FTDSSGTLY

SEQ ID NO: 127410 - protein, 10 aa, Artificial Sequence
  Description of Artificial Sequence: Synthetic peptide
  Seed: LAVIGALLAV (PMEL_HUMAN)
LVVIGALLAI

SEQ ID NO: 127411 - protein, 10 aa, Artificial Sequence
  Description of Artificial Sequence: Synthetic peptide
  Seed: MAVVLASLIY (PMEL_HUMAN)
MHVVLASLIY

SEQ ID NO: 127412 - protein, 9 aa, Artificial Sequence
  Description of Artificial Sequence: Synthetic peptide
  Seed: VSNDGPTLI (PMEL_HUMAN)
VMNDGPTLF

SEQ ID NO: 127413 - protein, 11 aa, Artificial Sequence
  Description of Artificial Sequence: Synthetic peptide
  Seed: AVIGALLAVGA (PMEL_HUMAN)
AIIGALLAVGV

SEQ ID NO: 127414 - protein, 10 aa, Artificial Sequence
  Description of Artificial Sequence: Synthetic peptide
  Seed: SQKRSFVYVW (PMEL_HUMAN)
SVKRSFVYVY

SEQ ID NO: 127415 - protein, 9 aa, Artificial Sequence
  Description of Artificial Sequence: Synthetic peptide
  Seed: VMGTTLAEM (PMEL_HUMAN)
VIGTTLAEA

SEQ ID NO: 127416 - protein, 9 aa, Artificial Sequence
  Description of Artificial Sequence: Synthetic peptide
  Seed: KVSNDGPTL (PMEL_HUMAN)
KQSNDGPTI

SEQ ID NO: 127417 - protein, 11 aa, Artificial Sequence
  Description of Artificial Sequence: Synthetic peptide
  Seed: GYLAEADLSYT (PMEL_HUMAN)
GWLAEADLSYV

SEQ ID NO: 127418 - protein, 9 aa, Artificial Sequence
  Description of Artificial Sequence: Synthetic peptide
  Seed: ASFSIALNF (PMEL_HUMAN)
ASFSIALNW

SEQ ID NO: 127419 - protein, 9 aa, Artificial Sequence
  Description of Artificial Sequence: Synthetic peptide
  Seed: FTITDQVPF (PMEL_HUMAN)
FQITDQVPL

SEQ ID NO: 127420 - protein, 9 aa, Artificial Sequence
  Description of Artificial Sequence: Synthetic peptide
  Seed: VVLSGTTAA (PMEL_HUMAN)
VLLSGTTAI

SEQ ID NO: 127421 - protein, 9 aa, Artificial Sequence
  Description of Artificial Sequence: Synthetic peptide
  Seed: LMAVVLASL (PMEL_HUMAN)
LQAVVLASV

SEQ ID NO: 127422 - protein, 9 aa, Artificial Sequence
  Description of Artificial Sequence: Synthetic peptide
  Seed: KQDFSVPQL (PMEL_HUMAN)
KGDFSVPQF

SEQ ID NO: 127423 - protein, 10 aa, Artificial Sequence
  Description of Artificial Sequence: Synthetic peptide
  Seed: SVTLDIVQGI (PMEL_HUMAN)
SMTLDIVQGA

SEQ ID NO: 127424 - protein, 9 aa, Artificial Sequence
  Description of Artificial Sequence: Synthetic peptide
  Seed: KQDFSVPQL (PMEL_HUMAN)
KYDFSVPQI

SEQ ID NO: 127425 - protein, 10 aa, Artificial Sequence
  Description of Artificial Sequence: Synthetic peptide
  Seed: GEGDAFELTV (PMEL_HUMAN)
GEGDAFELTT

SEQ ID NO: 127426 - protein, 9 aa, Artificial Sequence
  Description of Artificial Sequence: Synthetic peptide
  Seed: GTYCLNVSL (PMEL_HUMAN)
GQYCLNVSV

SEQ ID NO: 127427 - protein, 10 aa, Artificial Sequence
  Description of Artificial Sequence: Synthetic peptide
  Seed: VPLAHSSSAF (PMEL_HUMAN)
VMLAHSSSAF

SEQ ID NO: 127428 - protein, 11 aa, Artificial Sequence
  Description of Artificial Sequence: Synthetic peptide
  Seed: RALDGGNKHFL (PMEL_HUMAN)
RQLDGGNKHFY

SEQ ID NO: 127429 - protein, 9 aa, Artificial Sequence
  Description of Artificial Sequence: Synthetic peptide
  Seed: MSTPEATGM (PMEL_HUMAN)
MPTPEATGF

SEQ ID NO: 127430 - protein, 9 aa, Artificial Sequence
  Description of Artificial Sequence: Synthetic peptide
  Seed: STESITGSL (PMEL_HUMAN)
SSESITGSL

SEQ ID NO: 127431 - protein, 9 aa, Artificial Sequence
  Description of Artificial Sequence: Synthetic peptide
  Seed: SQKRSFVYV (PMEL_HUMAN)
STKRSFVYH

SEQ ID NO: 127432 - protein, 9 aa, Artificial Sequence
  Description of Artificial Sequence: Synthetic peptide
  Seed: FLRNQPLTF (PMEL_HUMAN)
FIRNQPLTM

SEQ ID NO: 127433 - protein, 9 aa, Artificial Sequence
  Description of Artificial Sequence: Synthetic peptide
  Seed: YLAEADLSY (PMEL_HUMAN)
YRAEADLSM

SEQ ID NO: 127434 - protein, 9 aa, Artificial Sequence
  Description of Artificial Sequence: Synthetic peptide
  Seed: LLDGTATLR (PMEL_HUMAN)
LLDGTATLY

SEQ ID NO: 127435 - protein, 10 aa, Artificial Sequence
  Description of Artificial Sequence: Synthetic peptide
  Seed: VPQLPHSSSH (PMEL_HUMAN)
VFQLPHSSSM

SEQ ID NO: 127436 - protein, 10 aa, Artificial Sequence
  Description of Artificial Sequence: Synthetic peptide
  Seed: AVIGALLAVG (PMEL_HUMAN)
AVIGALLAVL

SEQ ID NO: 127437 - protein, 11 aa, Artificial Sequence
  Description of Artificial Sequence: Synthetic peptide
  Seed: RLPRIFCSCPI (PMEL_HUMAN)
RKPRIFCSCPL

SEQ ID NO: 127438 - protein, 9 aa, Artificial Sequence
  Description of Artificial Sequence: Synthetic peptide
  Seed: AEPSGTTSV (PMEL_HUMAN)
ARPSGTTSM

SEQ ID NO: 127439 - protein, 9 aa, Artificial Sequence
  Description of Artificial Sequence: Synthetic peptide
  Seed: EVVGTTPGQ (PMEL_HUMAN)
EMVGTTPGR

SEQ ID NO: 127440 - protein, 11 aa, Artificial Sequence
  Description of Artificial Sequence: Synthetic peptide
  Seed: DCWRGGQVSLK (PMEL_HUMAN)
DVWRGGQVSLK

SEQ ID NO: 127441 - protein, 9 aa, Artificial Sequence
  Description of Artificial Sequence: Synthetic peptide
  Seed: VSVSQLRAL (PMEL_HUMAN)
VLVSQLRAI

SEQ ID NO: 127442 - protein, 8 aa, Artificial Sequence
  Description of Artificial Sequence: Synthetic peptide
  Seed: LHDPSGYL (PMEL_HUMAN)
LIDPSGYM

SEQ ID NO: 127443 - protein, 10 aa, Artificial Sequence
  Description of Artificial Sequence: Synthetic peptide
  Seed: LAVIGALLAV (PMEL_HUMAN)
LFVIGALLAI

SEQ ID NO: 127444 - protein, 10 aa, Artificial Sequence
  Description of Artificial Sequence: Synthetic peptide
  Seed: LMAVVLASLI (PMEL_HUMAN)
LLAVVLASLN

SEQ ID NO: 127445 - protein, 9 aa, Artificial Sequence
  Description of Artificial Sequence: Synthetic peptide
  Seed: RLVKRQVPL (PMEL_HUMAN)
RRVKRQVPF

SEQ ID NO: 127446 - protein, 9 aa, Artificial Sequence
  Description of Artificial Sequence: Synthetic peptide
  Seed: MAVVLASLI (PMEL_HUMAN)
MQVVLASLH

SEQ ID NO: 127447 - protein, 10 aa, Artificial Sequence
  Description of Artificial Sequence: Synthetic peptide
  Seed: SVPQLPHSSS (PMEL_HUMAN)
SPPQLPHSSF

SEQ ID NO: 127448 - protein, 10 aa, Artificial Sequence
  Description of Artificial Sequence: Synthetic peptide
  Seed: YVPLAHSSSA (PMEL_HUMAN)
YDPLAHSSSI

SEQ ID NO: 127449 - protein, 9 aa, Artificial Sequence
  Description of Artificial Sequence: Synthetic peptide
  Seed: DQVPFSVSV (PMEL_HUMAN)
DQVPFSVSA

SEQ ID NO: 127450 - protein, 10 aa, Artificial Sequence
  Description of Artificial Sequence: Synthetic peptide
  Seed: MPTAESTGMT (PMEL_HUMAN)
MITAESTGMV

SEQ ID NO: 127451 - protein, 10 aa, Artificial Sequence
  Description of Artificial Sequence: Synthetic peptide
  Seed: NSLAVVSTQL (PMEL_HUMAN)
NLLAVVSTQV

SEQ ID NO: 127452 - protein, 11 aa, Artificial Sequence
  Description of Artificial Sequence: Synthetic peptide
  Seed: APNTTAGQVPT (PMEL_HUMAN)
APNTTAGQVPA

SEQ ID NO: 127453 - protein, 10 aa, Artificial Sequence
  Description of Artificial Sequence: Synthetic peptide
  Seed: GPLLDGTATL (PMEL_HUMAN)
GNLLDGTATI

SEQ ID NO: 127454 - protein, 10 aa, Artificial Sequence
  Description of Artificial Sequence: Synthetic peptide
  Seed: RRLMKQDFSV (PMEL_HUMAN)
RYLMKQDFSI

SEQ ID NO: 127455 - protein, 9 aa, Artificial Sequence
  Description of Artificial Sequence: Synthetic peptide
  Seed: RNQPLTFAL (PMEL_HUMAN)
REQPLTFAM

SEQ ID NO: 127456 - protein, 9 aa, Artificial Sequence
  Description of Artificial Sequence: Synthetic peptide
  Seed: RGGQVSLKV (PMEL_HUMAN)
RQGQVSLKI

SEQ ID NO: 127457 - protein, 8 aa, Artificial Sequence
  Description of Artificial Sequence: Synthetic peptide
  Seed: TLDIVQGI (PMEL_HUMAN)
TYDIVQGI

SEQ ID NO: 127458 - protein, 9 aa, Artificial Sequence
  Description of Artificial Sequence: Synthetic peptide
  Seed: VVLSGTTAA (PMEL_HUMAN)
VGLSGTTAY

SEQ ID NO: 127459 - protein, 9 aa, Artificial Sequence
  Description of Artificial Sequence: Synthetic peptide
  Seed: LLDGTATLR (PMEL_HUMAN)
LMDGTATLY

SEQ ID NO: 127460 - protein, 10 aa, Artificial Sequence
  Description of Artificial Sequence: Synthetic peptide
  Seed: MPTAESTGMT (PMEL_HUMAN)
MSTAESTGMA

SEQ ID NO: 127461 - protein, 9 aa, Artificial Sequence
  Description of Artificial Sequence: Synthetic peptide
  Seed: RNQPLTFAL (PMEL_HUMAN)
RNQPLTFAY

SEQ ID NO: 127462 - protein, 10 aa, Artificial Sequence
  Description of Artificial Sequence: Synthetic peptide
  Seed: KTWGQYWQVL (PMEL_HUMAN)
KHWGQYWQVF

SEQ ID NO: 127463 - protein, 11 aa, Artificial Sequence
  Description of Artificial Sequence: Synthetic peptide
  Seed: RRGSRSYVPLA (PMEL_HUMAN)
RFGSRSYVPLK

SEQ ID NO: 127464 - protein, 9 aa, Artificial Sequence
  Description of Artificial Sequence: Synthetic peptide
  Seed: SAFTITDQV (PMEL_HUMAN)
SLFTITDQF

SEQ ID NO: 127465 - protein, 10 aa, Artificial Sequence
  Description of Artificial Sequence: Synthetic peptide
  Seed: THTMEVTVYH (PMEL_HUMAN)
TNTMEVTVYK

SEQ ID NO: 127466 - protein, 10 aa, Artificial Sequence
  Description of Artificial Sequence: Synthetic peptide
  Seed: RTKAWNRQLY (PMEL_HUMAN)
RTKAWNRQLL

SEQ ID NO: 127467 - protein, 10 aa, Artificial Sequence
  Description of Artificial Sequence: Synthetic peptide
  Seed: YRYGSFSVTL (PMEL_HUMAN)
YSYGSFSVTY

SEQ ID NO: 127468 - protein, 9 aa, Artificial Sequence
  Description of Artificial Sequence: Synthetic peptide
  Seed: KQDFSVPQL (PMEL_HUMAN)
KCDFSVPQM

SEQ ID NO: 127469 - protein, 9 aa, Artificial Sequence
  Description of Artificial Sequence: Synthetic peptide
  Seed: ASFSIALNF (PMEL_HUMAN)
AYFSIALNW

SEQ ID NO: 127470 - protein, 9 aa, Artificial Sequence
  Description of Artificial Sequence: Synthetic peptide
  Seed: LSIGTGRAM (PMEL_HUMAN)
LLIGTGRAM

SEQ ID NO: 127471 - protein, 9 aa, Artificial Sequence
  Description of Artificial Sequence: Synthetic peptide
  Seed: TMEVTVYHR (PMEL_HUMAN)
TYEVTVYHR

SEQ ID NO: 127472 - protein, 10 aa, Artificial Sequence
  Description of Artificial Sequence: Synthetic peptide
  Seed: MPTAESTGMT (PMEL_HUMAN)
MRTAESTGMV

SEQ ID NO: 127473 - protein, 9 aa, Artificial Sequence
  Description of Artificial Sequence: Synthetic peptide
  Seed: EVMGTTLAE (PMEL_HUMAN)
EVMGTTLAF

SEQ ID NO: 127474 - protein, 9 aa, Artificial Sequence
  Description of Artificial Sequence: Synthetic peptide
  Seed: KHFLRNQPL (PMEL_HUMAN)
KGFLRNQPF

SEQ ID NO: 127475 - protein, 10 aa, Artificial Sequence
  Description of Artificial Sequence: Synthetic peptide
  Seed: RTKAWNRQLY (PMEL_HUMAN)
RVKAWNRQLV

SEQ ID NO: 127476 - protein, 10 aa, Artificial Sequence
  Description of Artificial Sequence: Synthetic peptide
  Seed: IALNFPGSQK (PMEL_HUMAN)
IALNFPGSQL

SEQ ID NO: 127477 - protein, 10 aa, Artificial Sequence
  Description of Artificial Sequence: Synthetic peptide
  Seed: VPQLPHSSSH (PMEL_HUMAN)
VIQLPHSSSL

SEQ ID NO: 127478 - protein, 10 aa, Artificial Sequence
  Description of Artificial Sequence: Synthetic peptide
  Seed: SWSQKRSFVY (PMEL_HUMAN)
SSSQKRSFVW

SEQ ID NO: 127479 - protein, 10 aa, Artificial Sequence
  Description of Artificial Sequence: Synthetic peptide
  Seed: RGSRSYVPLA (PMEL_HUMAN)
RWSRSYVPLY

SEQ ID NO: 127480 - protein, 11 aa, Artificial Sequence
  Description of Artificial Sequence: Synthetic peptide
  Seed: GPTLIGANASF (PMEL_HUMAN)
GMTLIGANASY

SEQ ID NO: 127481 - protein, 10 aa, Artificial Sequence
  Description of Artificial Sequence: Synthetic peptide
  Seed: LPHSSSHWLR (PMEL_HUMAN)
LLHSSSHWLR

SEQ ID NO: 127482 - protein, 10 aa, Artificial Sequence
  Description of Artificial Sequence: Synthetic peptide
  Seed: THTMEVTVYH (PMEL_HUMAN)
THTMEVTVYK

SEQ ID NO: 127483 - protein, 10 aa, Artificial Sequence
  Description of Artificial Sequence: Synthetic peptide
  Seed: LAEADLSYTW (PMEL_HUMAN)
LVEADLSYTW

SEQ ID NO: 127484 - protein, 9 aa, Artificial Sequence
  Description of Artificial Sequence: Synthetic peptide
  Seed: VSVSQLRAL (PMEL_HUMAN)
VTVSQLRAI

SEQ ID NO: 127485 - protein, 9 aa, Artificial Sequence
  Description of Artificial Sequence: Synthetic peptide
  Seed: HLAVIGALL (PMEL_HUMAN)
HTAVIGALA

SEQ ID NO: 127486 - protein, 10 aa, Artificial Sequence
  Description of Artificial Sequence: Synthetic peptide
  Seed: VLMAVVLASL (PMEL_HUMAN)
VNMAVVLASI

SEQ ID NO: 127487 - protein, 9 aa, Artificial Sequence
  Description of Artificial Sequence: Synthetic peptide
  Seed: AAQVTTTEW (PMEL_HUMAN)
AMQVTTTEM

SEQ ID NO: 127488 - protein, 10 aa, Artificial Sequence
  Description of Artificial Sequence: Synthetic peptide
  Seed: FLRNQPLTFA (PMEL_HUMAN)
FLRNQPLTFV

SEQ ID NO: 127489 - protein, 9 aa, Artificial Sequence
  Description of Artificial Sequence: Synthetic peptide
  Seed: MPTAESTGM (PMEL_HUMAN)
MPTAESTGF

SEQ ID NO: 127490 - protein, 9 aa, Artificial Sequence
  Description of Artificial Sequence: Synthetic peptide
  Seed: EKVPVSEVM (PMEL_HUMAN)
EHVPVSEVM

SEQ ID NO: 127491 - protein, 9 aa, Artificial Sequence
  Description of Artificial Sequence: Synthetic peptide
  Seed: ITDQVPFSV (PMEL_HUMAN)
ICDQVPFSI

SEQ ID NO: 127492 - protein, 9 aa, Artificial Sequence
  Description of Artificial Sequence: Synthetic peptide
  Seed: VQVPTTEVI (PMEL_HUMAN)
VAVPTTEVL

SEQ ID NO: 127493 - protein, 9 aa, Artificial Sequence
  Description of Artificial Sequence: Synthetic peptide
  Seed: HTYLEPGPV (PMEL_HUMAN)
HIYLEPGPY

SEQ ID NO: 127494 - protein, 11 aa, Artificial Sequence
  Description of Artificial Sequence: Synthetic peptide
  Seed: TWDFGDSSGTL (PMEL_HUMAN)
TSDFGDSSGTM

SEQ ID NO: 127495 - protein, 9 aa, Artificial Sequence
  Description of Artificial Sequence: Synthetic peptide
  Seed: FLRNQPLTF (PMEL_HUMAN)
FARNQPLTW

SEQ ID NO: 127496 - protein, 9 aa, Artificial Sequence
  Description of Artificial Sequence: Synthetic peptide
  Seed: YLAEADLSY (PMEL_HUMAN)
YVAEADLSY

SEQ ID NO: 127497 - protein, 10 aa, Artificial Sequence
  Description of Artificial Sequence: Synthetic peptide
  Seed: MTPAEVSIVV (PMEL_HUMAN)
MHPAEVSIVM

SEQ ID NO: 127498 - protein, 9 aa, Artificial Sequence
  Description of Artificial Sequence: Synthetic peptide
  Seed: CVLYRYGSF (PMEL_HUMAN)
CKLYRYGSF

SEQ ID NO: 127499 - protein, 9 aa, Artificial Sequence
  Description of Artificial Sequence: Synthetic peptide
  Seed: GQVPLIVGI (PMEL_HUMAN)
GQVPLIVGW

SEQ ID NO: 127500 - protein, 10 aa, Artificial Sequence
  Description of Artificial Sequence: Synthetic peptide
  Seed: SGTYCLNVSL (PMEL_HUMAN)
SATYCLNVSV

SEQ ID NO: 127501 - protein, 10 aa, Artificial Sequence
  Description of Artificial Sequence: Synthetic peptide
  Seed: GPVSGLSIGT (PMEL_HUMAN)
GPVSGLSIGA

SEQ ID NO: 127502 - protein, 10 aa, Artificial Sequence
  Description of Artificial Sequence: Synthetic peptide
  Seed: TGMTPAEVSI (PMEL_HUMAN)
TYMTPAEVSV

SEQ ID NO: 127503 - protein, 11 aa, Artificial Sequence
  Description of Artificial Sequence: Synthetic peptide
  Seed: YLEPGPVTAQV (PMEL_HUMAN)
YLEPGPVTAQL

SEQ ID NO: 127504 - protein, 9 aa, Artificial Sequence
  Description of Artificial Sequence: Synthetic peptide
  Seed: RALVVTHTY (PMEL_HUMAN)
RSLVVTHTR

SEQ ID NO: 127505 - protein, 9 aa, Artificial Sequence
  Description of Artificial Sequence: Synthetic peptide
  Seed: HLAVIGALL (PMEL_HUMAN)
HMAVIGALA

SEQ ID NO: 127506 - protein, 9 aa, Artificial Sequence
  Description of Artificial Sequence: Synthetic peptide
  Seed: RAMLGTHTM (PMEL_HUMAN)
RSMLGTHTF

SEQ ID NO: 127507 - protein, 9 aa, Artificial Sequence
  Description of Artificial Sequence: Synthetic peptide
  Seed: RNQPLTFAL (PMEL_HUMAN)
RSQPLTFAF

SEQ ID NO: 127508 - protein, 9 aa, Artificial Sequence
  Description of Artificial Sequence: Synthetic peptide
  Seed: YLAEADLSY (PMEL_HUMAN)
YTAEADLSM

SEQ ID NO: 127509 - protein, 9 aa, Artificial Sequence
  Description of Artificial Sequence: Synthetic peptide
  Seed: HSSSHWLRL (PMEL_HUMAN)
HMSSHWLRW

SEQ ID NO: 127510 - protein, 9 aa, Artificial Sequence
  Description of Artificial Sequence: Synthetic peptide
  Seed: VWKTWGQYW (PMEL_HUMAN)
VWKTWGQYI

SEQ ID NO: 127511 - protein, 8 aa, Artificial Sequence
  Description of Artificial Sequence: Synthetic peptide
  Seed: SNDGPTLI (PMEL_HUMAN)
SFDGPTLV

SEQ ID NO: 127512 - protein, 9 aa, Artificial Sequence
  Description of Artificial Sequence: Synthetic peptide
  Seed: DGGNKHFLR (PMEL_HUMAN)
DVGNKHFLK

SEQ ID NO: 127513 - protein, 11 aa, Artificial Sequence
  Description of Artificial Sequence: Synthetic peptide
  Seed: LGPLLDGTATL (PMEL_HUMAN)
LMPLLDGTATI

SEQ ID NO: 127514 - protein, 9 aa, Artificial Sequence
  Description of Artificial Sequence: Synthetic peptide
  Seed: AAQVTTTEW (PMEL_HUMAN)
AAQVTTTEM

SEQ ID NO: 127515 - protein, 9 aa, Artificial Sequence
  Description of Artificial Sequence: Synthetic peptide
  Seed: SLAVVSTQL (PMEL_HUMAN)
SLAVVSTQV

SEQ ID NO: 127516 - protein, 9 aa, Artificial Sequence
  Description of Artificial Sequence: Synthetic peptide
  Seed: QPVLPSPAC (PMEL_HUMAN)
QHVLPSPAT

SEQ ID NO: 127517 - protein, 9 aa, Artificial Sequence
  Description of Artificial Sequence: Synthetic peptide
  Seed: MTPEKVPVS (PMEL_HUMAN)
MPPEKVPVL

SEQ ID NO: 127518 - protein, 10 aa, Artificial Sequence
  Description of Artificial Sequence: Synthetic peptide
  Seed: AVIGALLAVG (PMEL_HUMAN)
ALIGALLAVI

SEQ ID NO: 127519 - protein, 10 aa, Artificial Sequence
  Description of Artificial Sequence: Synthetic peptide
  Seed: ESITGSLGPL (PMEL_HUMAN)
EIITGSLGPM

SEQ ID NO: 127520 - protein, 10 aa, Artificial Sequence
  Description of Artificial Sequence: Synthetic peptide
  Seed: GQVPLIVGIL (PMEL_HUMAN)
GMVPLIVGIL

SEQ ID NO: 127521 - protein, 9 aa, Artificial Sequence
  Description of Artificial Sequence: Synthetic peptide
  Seed: GGPVSGLSI (PMEL_HUMAN)
GLPVSGLSL

SEQ ID NO: 127522 - protein, 11 aa, Artificial Sequence
  Description of Artificial Sequence: Synthetic peptide
  Seed: LVLMAVVLASL (PMEL_HUMAN)
LSLMAVVLASV

SEQ ID NO: 127523 - protein, 9 aa, Artificial Sequence
  Description of Artificial Sequence: Synthetic peptide
  Seed: RYGSFSVTL (PMEL_HUMAN)
RRGSFSVTF

SEQ ID NO: 127524 - protein, 10 aa, Artificial Sequence
  Description of Artificial Sequence: Synthetic peptide
  Seed: RNQDWLGVSR (PMEL_HUMAN)
RWQDWLGVSK

SEQ ID NO: 127525 - protein, 10 aa, Artificial Sequence
  Description of Artificial Sequence: Synthetic peptide
  Seed: VPQLPHSSSH (PMEL_HUMAN)
VHQLPHSSSL

SEQ ID NO: 127526 - protein, 9 aa, Artificial Sequence
  Description of Artificial Sequence: Synthetic peptide
  Seed: SVQVPTTEV (PMEL_HUMAN)
SQQVPTTEI

SEQ ID NO: 127527 - protein, 10 aa, Artificial Sequence
  Description of Artificial Sequence: Synthetic peptide
  Seed: NSLAVVSTQL (PMEL_HUMAN)
NLLAVVSTQL

SEQ ID NO: 127528 - protein, 9 aa, Artificial Sequence
  Description of Artificial Sequence: Synthetic peptide
  Seed: RTKAWNRQL (PMEL_HUMAN)
RMKAWNRQV

SEQ ID NO: 127529 - protein, 9 aa, Artificial Sequence
  Description of Artificial Sequence: Synthetic peptide
  Seed: RAMLGTHTM (PMEL_HUMAN)
RYMLGTHTW

SEQ ID NO: 127530 - protein, 11 aa, Artificial Sequence
  Description of Artificial Sequence: Synthetic peptide
  Seed: SAFTITDQVPF (PMEL_HUMAN)
SQFTITDQVPY

SEQ ID NO: 127531 - protein, 9 aa, Artificial Sequence
  Description of Artificial Sequence: Synthetic peptide
  Seed: TLIGANASF (PMEL_HUMAN)
TYIGANASY

SEQ ID NO: 127532 - protein, 9 aa, Artificial Sequence
  Description of Artificial Sequence: Synthetic peptide
  Seed: VSVSQLRAL (PMEL_HUMAN)
VAVSQLRAY

SEQ ID NO: 127533 - protein, 10 aa, Artificial Sequence
  Description of Artificial Sequence: Synthetic peptide
  Seed: THTMEVTVYH (PMEL_HUMAN)
TITMEVTVYY

SEQ ID NO: 127534 - protein, 10 aa, Artificial Sequence
  Description of Artificial Sequence: Synthetic peptide
  Seed: KVLPDGQVIW (PMEL_HUMAN)
KSLPDGQVIM

SEQ ID NO: 127535 - protein, 10 aa, Artificial Sequence
  Description of Artificial Sequence: Synthetic peptide
  Seed: MTPAEVSIVV (PMEL_HUMAN)
MYPAEVSIVF

SEQ ID NO: 127536 - protein, 10 aa, Artificial Sequence
  Description of Artificial Sequence: Synthetic peptide
  Seed: THTMEVTVYH (PMEL_HUMAN)
TWTMEVTVYR

SEQ ID NO: 127537 - protein, 11 aa, Artificial Sequence
  Description of Artificial Sequence: Synthetic peptide
  Seed: LYRYGSFSVTL (PMEL_HUMAN)
LCRYGSFSVTF

SEQ ID NO: 127538 - protein, 9 aa, Artificial Sequence
  Description of Artificial Sequence: Synthetic peptide
  Seed: SVPQLPHSS (PMEL_HUMAN)
SSPQLPHSI

SEQ ID NO: 127539 - protein, 9 aa, Artificial Sequence
  Description of Artificial Sequence: Synthetic peptide
  Seed: KEACMEISS (PMEL_HUMAN)
KEACMEISP

SEQ ID NO: 127540 - protein, 9 aa, Artificial Sequence
  Description of Artificial Sequence: Synthetic peptide
  Seed: VLPDGQVIW (PMEL_HUMAN)
VAPDGQVIY

SEQ ID NO: 127541 - protein, 10 aa, Artificial Sequence
  Description of Artificial Sequence: Synthetic peptide
  Seed: GRAMLGTHTM (PMEL_HUMAN)
GRAMLGTHTF

SEQ ID NO: 127542 - protein, 9 aa, Artificial Sequence
  Description of Artificial Sequence: Synthetic peptide
  Seed: LQAAIPLTS (PMEL_HUMAN)
LAAAIPLTY

SEQ ID NO: 127543 - protein, 9 aa, Artificial Sequence
  Description of Artificial Sequence: Synthetic peptide
  Seed: GQVPLIVGI (PMEL_HUMAN)
GHVPLIVGF

SEQ ID NO: 127544 - protein, 9 aa, Artificial Sequence
  Description of Artificial Sequence: Synthetic peptide
  Seed: KAWNRQLYP (PMEL_HUMAN)
KVWNRQLYA

SEQ ID NO: 127545 - protein, 9 aa, Artificial Sequence
  Description of Artificial Sequence: Synthetic peptide
  Seed: GILLVLMAV (PMEL_HUMAN)
GLLLVLMAI

SEQ ID NO: 127546 - protein, 11 aa, Artificial Sequence
  Description of Artificial Sequence: Synthetic peptide
  Seed: RRGSRSYVPLA (PMEL_HUMAN)
REGSRSYVPLA

SEQ ID NO: 127547 - protein, 11 aa, Artificial Sequence
  Description of Artificial Sequence: Synthetic peptide
  Seed: RYGSFSVTLDI (PMEL_HUMAN)
RPGSFSVTLDF

SEQ ID NO: 127548 - protein, 10 aa, Artificial Sequence
  Description of Artificial Sequence: Synthetic peptide
  Seed: SVPQLPHSSS (PMEL_HUMAN)
SYPQLPHSSM

SEQ ID NO: 127549 - protein, 10 aa, Artificial Sequence
  Description of Artificial Sequence: Synthetic peptide
  Seed: LHLAVIGALL (PMEL_HUMAN)
LFLAVIGALL

SEQ ID NO: 127550 - protein, 8 aa, Artificial Sequence
  Description of Artificial Sequence: Synthetic peptide
  Seed: RSFVYVWK (PMEL_HUMAN)
RIFVYVWR

SEQ ID NO: 127551 - protein, 10 aa, Artificial Sequence
  Description of Artificial Sequence: Synthetic peptide
  Seed: VLMAVVLASL (PMEL_HUMAN)
VKMAVVLASY

SEQ ID NO: 127552 - protein, 10 aa, Artificial Sequence
  Description of Artificial Sequence: Synthetic peptide
  Seed: MAVVLASLIY (PMEL_HUMAN)
MMVVLASLIM

SEQ ID NO: 127553 - protein, 10 aa, Artificial Sequence
  Description of Artificial Sequence: Synthetic peptide
  Seed: LVLKRCLLHL (PMEL_HUMAN)
LNLKRCLLHV

SEQ ID NO: 127554 - protein, 11 aa, Artificial Sequence
  Description of Artificial Sequence: Synthetic peptide
  Seed: MAVVLASLIYR (PMEL_HUMAN)
MSVVLASLIYR

SEQ ID NO: 127555 - protein, 9 aa, Artificial Sequence
  Description of Artificial Sequence: Synthetic peptide
  Seed: VLMAVVLAS (PMEL_HUMAN)
VMMAVVLAM

SEQ ID NO: 127556 - protein, 11 aa, Artificial Sequence
  Description of Artificial Sequence: Synthetic peptide
  Seed: HTMEVTVYHRR (PMEL_HUMAN)
HVMEVTVYHRR

SEQ ID NO: 127557 - protein, 9 aa, Artificial Sequence
  Description of Artificial Sequence: Synthetic peptide
  Seed: VLQAAIPLT (PMEL_HUMAN)
VMQAAIPLM

SEQ ID NO: 127558 - protein, 9 aa, Artificial Sequence
  Description of Artificial Sequence: Synthetic peptide
  Seed: SSIMSTESI (PMEL_HUMAN)
SEIMSTESM

SEQ ID NO: 127559 - protein, 9 aa, Artificial Sequence
  Description of Artificial Sequence: Synthetic peptide
  Seed: GSSPVPGTT (PMEL_HUMAN)
GASPVPGTH

SEQ ID NO: 127560 - protein, 11 aa, Artificial Sequence
  Description of Artificial Sequence: Synthetic peptide
  Seed: SYVPLAHSSSA (PMEL_HUMAN)
STVPLAHSSSM

SEQ ID NO: 127561 - protein, 9 aa, Artificial Sequence
  Description of Artificial Sequence: Synthetic peptide
  Seed: VVLSGTTAA (PMEL_HUMAN)
VTLSGTTAI

SEQ ID NO: 127562 - protein, 9 aa, Artificial Sequence
  Description of Artificial Sequence: Synthetic peptide
  Seed: YLEPGPVTA (PMEL_HUMAN)
YTEPGPVTI

SEQ ID NO: 127563 - protein, 9 aa, Artificial Sequence
  Description of Artificial Sequence: Synthetic peptide
  Seed: GTYCLNVSL (PMEL_HUMAN)
GLYCLNVSV

SEQ ID NO: 127564 - protein, 8 aa, Artificial Sequence
  Description of Artificial Sequence: Synthetic peptide
  Seed: LHDPSGYL (PMEL_HUMAN)
LIDPSGYI

SEQ ID NO: 127565 - protein, 9 aa, Artificial Sequence
  Description of Artificial Sequence: Synthetic peptide
  Seed: RYGSFSVTL (PMEL_HUMAN)
RRGSFSVTY

SEQ ID NO: 127566 - protein, 10 aa, Artificial Sequence
  Description of Artificial Sequence: Synthetic peptide
  Seed: LLDGTATLRL (PMEL_HUMAN)
LTDGTATLRL

SEQ ID NO: 127567 - protein, 11 aa, Artificial Sequence
  Description of Artificial Sequence: Synthetic peptide
  Seed: YVPLAHSSSAF (PMEL_HUMAN)
YMPLAHSSSAF

SEQ ID NO: 127568 - protein, 9 aa, Artificial Sequence
  Description of Artificial Sequence: Synthetic peptide
  Seed: LIYRRRLMK (PMEL_HUMAN)
LMYRRRLMY

SEQ ID NO: 127569 - protein, 11 aa, Artificial Sequence
  Description of Artificial Sequence: Synthetic peptide
  Seed: IPEPEGPDASS (PMEL_HUMAN)
IPEPEGPDASM

SEQ ID NO: 127570 - protein, 9 aa, Artificial Sequence
  Description of Artificial Sequence: Synthetic peptide
  Seed: HWLRLPRIF (PMEL_HUMAN)
HFLRLPRIF

SEQ ID NO: 127571 - protein, 9 aa, Artificial Sequence
  Description of Artificial Sequence: Synthetic peptide
  Seed: DQVPFSVSV (PMEL_HUMAN)
DEVPFSVSV

SEQ ID NO: 127572 - protein, 10 aa, Artificial Sequence
  Description of Artificial Sequence: Synthetic peptide
  Seed: ASFSIALNFP (PMEL_HUMAN)
ASFSIALNFY

SEQ ID NO: 127573 - protein, 9 aa, Artificial Sequence
  Description of Artificial Sequence: Synthetic peptide
  Seed: LYRYGSFSV (PMEL_HUMAN)
LQRYGSFSK

SEQ ID NO: 127574 - protein, 9 aa, Artificial Sequence
  Description of Artificial Sequence: Synthetic peptide
  Seed: TLIGANASF (PMEL_HUMAN)
TWIGANASY

SEQ ID NO: 127575 - protein, 10 aa, Artificial Sequence
  Description of Artificial Sequence: Synthetic peptide
  Seed: VPQLPHSSSH (PMEL_HUMAN)
VWQLPHSSSF

SEQ ID NO: 127576 - protein, 9 aa, Artificial Sequence
  Description of Artificial Sequence: Synthetic peptide
  Seed: ASFSIALNF (PMEL_HUMAN)
ALFSIALNK

SEQ ID NO: 127577 - protein, 9 aa, Artificial Sequence
  Description of Artificial Sequence: Synthetic peptide
  Seed: FGDSSGTLI (PMEL_HUMAN)
FHDSSGTLM

SEQ ID NO: 127578 - protein, 10 aa, Artificial Sequence
  Description of Artificial Sequence: Synthetic peptide
  Seed: YRYGSFSVTL (PMEL_HUMAN)
YGYGSFSVTM

SEQ ID NO: 127579 - protein, 9 aa, Artificial Sequence
  Description of Artificial Sequence: Synthetic peptide
  Seed: VVLSGTTAA (PMEL_HUMAN)
VALSGTTAY

SEQ ID NO: 127580 - protein, 9 aa, Artificial Sequence
  Description of Artificial Sequence: Synthetic peptide
  Seed: ANASFSIAL (PMEL_HUMAN)
AGASFSIAY

SEQ ID NO: 127581 - protein, 10 aa, Artificial Sequence
  Description of Artificial Sequence: Synthetic peptide
  Seed: RSYVPLAHSS (PMEL_HUMAN)
RSYVPLAHSK

SEQ ID NO: 127582 - protein, 10 aa, Artificial Sequence
  Description of Artificial Sequence: Synthetic peptide
  Seed: WKTWGQYWQV (PMEL_HUMAN)
WETWGQYWQV

SEQ ID NO: 127583 - protein, 9 aa, Artificial Sequence
  Description of Artificial Sequence: Synthetic peptide
  Seed: SVQVPTTEV (PMEL_HUMAN)
SAQVPTTEY

SEQ ID NO: 127584 - protein, 10 aa, Artificial Sequence
  Description of Artificial Sequence: Synthetic peptide
  Seed: RALDGGNKHF (PMEL_HUMAN)
RLLDGGNKHY

SEQ ID NO: 127585 - protein, 9 aa, Artificial Sequence
  Description of Artificial Sequence: Synthetic peptide
  Seed: RLVKRQVPL (PMEL_HUMAN)
RLVKRQVPW

SEQ ID NO: 127586 - protein, 10 aa, Artificial Sequence
  Description of Artificial Sequence: Synthetic peptide
  Seed: STAPVQMPTA (PMEL_HUMAN)
SQAPVQMPTL

SEQ ID NO: 127587 - protein, 9 aa, Artificial Sequence
  Description of Artificial Sequence: Synthetic peptide
  Seed: TLISRALVV (PMEL_HUMAN)
TQISRALVY

SEQ ID NO: 127588 - protein, 9 aa, Artificial Sequence
  Description of Artificial Sequence: Synthetic peptide
  Seed: TTDGHRPTA (PMEL_HUMAN)
TYDGHRPTL

SEQ ID NO: 127589 - protein, 10 aa, Artificial Sequence
  Description of Artificial Sequence: Synthetic peptide
  Seed: GPLLDGTATL (PMEL_HUMAN)
GNLLDGTATM

SEQ ID NO: 127590 - protein, 9 aa, Artificial Sequence
  Description of Artificial Sequence: Synthetic peptide
  Seed: VLPDGQVIW (PMEL_HUMAN)
VYPDGQVIM

SEQ ID NO: 127591 - protein, 9 aa, Artificial Sequence
  Description of Artificial Sequence: Synthetic peptide
  Seed: SRSYVPLAH (PMEL_HUMAN)
SRSYVPLAL

SEQ ID NO: 127592 - protein, 10 aa, Artificial Sequence
  Description of Artificial Sequence: Synthetic peptide
  Seed: YVPLAHSSSA (PMEL_HUMAN)
YYPLAHSSSV

SEQ ID NO: 127593 - protein, 9 aa, Artificial Sequence
  Description of Artificial Sequence: Synthetic peptide
  Seed: SSHWLRLPR (PMEL_HUMAN)
SFHWLRLPR

SEQ ID NO: 127594 - protein, 10 aa, Artificial Sequence
  Description of Artificial Sequence: Synthetic peptide
  Seed: MSTESITGSL (PMEL_HUMAN)
MSTESITGSV

SEQ ID NO: 127595 - protein, 9 aa, Artificial Sequence
  Description of Artificial Sequence: Synthetic peptide
  Seed: KVSNDGPTL (PMEL_HUMAN)
KLSNDGPTM

SEQ ID NO: 127596 - protein, 9 aa, Artificial Sequence
  Description of Artificial Sequence: Synthetic peptide
  Seed: VTLDIVQGI (PMEL_HUMAN)
VMLDIVQGR

SEQ ID NO: 127597 - protein, 9 aa, Artificial Sequence
  Description of Artificial Sequence: Synthetic peptide
  Seed: YLAEADLSY (PMEL_HUMAN)
YPAEADLSG

SEQ ID NO: 127598 - protein, 9 aa, Artificial Sequence
  Description of Artificial Sequence: Synthetic peptide
  Seed: TMEVTVYHR (PMEL_HUMAN)
TAEVTVYHY

SEQ ID NO: 127599 - protein, 9 aa, Artificial Sequence
  Description of Artificial Sequence: Synthetic peptide
  Seed: ESAEILQAV (PMEL_HUMAN)
EMAEILQAY

SEQ ID NO: 127600 - protein, 9 aa, Artificial Sequence
  Description of Artificial Sequence: Synthetic peptide
  Seed: RLMKQDFSV (PMEL_HUMAN)
RRMKQDFSA

SEQ ID NO: 127601 - protein, 9 aa, Artificial Sequence
  Description of Artificial Sequence: Synthetic peptide
  Seed: ITGSLGPLL (PMEL_HUMAN)
ITGSLGPLF

SEQ ID NO: 127602 - protein, 9 aa, Artificial Sequence
  Description of Artificial Sequence: Synthetic peptide
  Seed: FSVSVSQLR (PMEL_HUMAN)
FAVSVSQLL

SEQ ID NO: 127603 - protein, 10 aa, Artificial Sequence
  Description of Artificial Sequence: Synthetic peptide
  Seed: RSFVYVWKTW (PMEL_HUMAN)
RYFVYVWKTF

SEQ ID NO: 127604 - protein, 11 aa, Artificial Sequence
  Description of Artificial Sequence: Synthetic peptide
  Seed: RTKAWNRQLYP (PMEL_HUMAN)
RAKAWNRQLYK

SEQ ID NO: 127605 - protein, 9 aa, Artificial Sequence
  Description of Artificial Sequence: Synthetic peptide
  Seed: ASFSIALNF (PMEL_HUMAN)
AEFSIALNY

SEQ ID NO: 127606 - protein, 10 aa, Artificial Sequence
  Description of Artificial Sequence: Synthetic peptide
  Seed: YVPLAHSSSA (PMEL_HUMAN)
YNPLAHSSSA

SEQ ID NO: 127607 - protein, 10 aa, Artificial Sequence
  Description of Artificial Sequence: Synthetic peptide
  Seed: ESAEILQAVP (PMEL_HUMAN)
ELAEILQAVV

SEQ ID NO: 127608 - protein, 9 aa, Artificial Sequence
  Description of Artificial Sequence: Synthetic peptide
  Seed: SSPGCQPPA (PMEL_HUMAN)
SSPGCQPPL

SEQ ID NO: 127609 - protein, 9 aa, Artificial Sequence
  Description of Artificial Sequence: Synthetic peptide
  Seed: ESAEILQAV (PMEL_HUMAN)
EIAEILQAF

SEQ ID NO: 127610 - protein, 9 aa, Artificial Sequence
  Description of Artificial Sequence: Synthetic peptide
  Seed: LSIGTGRAM (PMEL_HUMAN)
LQIGTGRAA

SEQ ID NO: 127611 - protein, 9 aa, Artificial Sequence
  Description of Artificial Sequence: Synthetic peptide
  Seed: AEVSIVVLS (PMEL_HUMAN)
AEVSIVVLV

SEQ ID NO: 127612 - protein, 9 aa, Artificial Sequence
  Description of Artificial Sequence: Synthetic peptide
  Seed: SVQVPTTEV (PMEL_HUMAN)
SPQVPTTEV

SEQ ID NO: 127613 - protein, 9 aa, Artificial Sequence
  Description of Artificial Sequence: Synthetic peptide
  Seed: AGLGQVPLI (PMEL_HUMAN)
ALLGQVPLA

SEQ ID NO: 127614 - protein, 10 aa, Artificial Sequence
  Description of Artificial Sequence: Synthetic peptide
  Seed: YVPLAHSSSA (PMEL_HUMAN)
YVPLAHSSSM

SEQ ID NO: 127615 - protein, 11 aa, Artificial Sequence
  Description of Artificial Sequence: Synthetic peptide
  Seed: LGPLLDGTATL (PMEL_HUMAN)
LIPLLDGTATI

SEQ ID NO: 127616 - protein, 9 aa, Artificial Sequence
  Description of Artificial Sequence: Synthetic peptide
  Seed: EVMGTTLAE (PMEL_HUMAN)
ESMGTTLAR

SEQ ID NO: 127617 - protein, 9 aa, Artificial Sequence
  Description of Artificial Sequence: Synthetic peptide
  Seed: AVIGALLAV (PMEL_HUMAN)
ANIGALLAF

SEQ ID NO: 127618 - protein, 9 aa, Artificial Sequence
  Description of Artificial Sequence: Synthetic peptide
  Seed: ESAEILQAV (PMEL_HUMAN)
EAAEILQAY

SEQ ID NO: 127619 - protein, 9 aa, Artificial Sequence
  Description of Artificial Sequence: Synthetic peptide
  Seed: SLIYRRRLM (PMEL_HUMAN)
SFIYRRRLL

SEQ ID NO: 127620 - protein, 11 aa, Artificial Sequence
  Description of Artificial Sequence: Synthetic peptide
  Seed: FTITDQVPFSV (PMEL_HUMAN)
FSITDQVPFSF

SEQ ID NO: 127621 - protein, 9 aa, Artificial Sequence
  Description of Artificial Sequence: Synthetic peptide
  Seed: KHFLRNQPL (PMEL_HUMAN)
KWFLRNQPY

SEQ ID NO: 127622 - protein, 9 aa, Artificial Sequence
  Description of Artificial Sequence: Synthetic peptide
  Seed: PLLDGTATL (PMEL_HUMAN)
PLLDGTATY

SEQ ID NO: 127623 - protein, 9 aa, Artificial Sequence
  Description of Artificial Sequence: Synthetic peptide
  Seed: LSIGTGRAM (PMEL_HUMAN)
LGIGTGRAY

SEQ ID NO: 127624 - protein, 9 aa, Artificial Sequence
  Description of Artificial Sequence: Synthetic peptide
  Seed: VQVPTTEVI (PMEL_HUMAN)
VHVPTTEVF

SEQ ID NO: 127625 - protein, 10 aa, Artificial Sequence
  Description of Artificial Sequence: Synthetic peptide
  Seed: VPQLPHSSSH (PMEL_HUMAN)
VQQLPHSSSL

SEQ ID NO: 127626 - protein, 10 aa, Artificial Sequence
  Description of Artificial Sequence: Synthetic peptide
  Seed: KTWGQYWQVL (PMEL_HUMAN)
KWWGQYWQVW

SEQ ID NO: 127627 - protein, 9 aa, Artificial Sequence
  Description of Artificial Sequence: Synthetic peptide
  Seed: ANASFSIAL (PMEL_HUMAN)
AHASFSIAM

SEQ ID NO: 127628 - protein, 9 aa, Artificial Sequence
  Description of Artificial Sequence: Synthetic peptide
  Seed: AGQVPTTEV (PMEL_HUMAN)
ATQVPTTEV

SEQ ID NO: 127629 - protein, 9 aa, Artificial Sequence
  Description of Artificial Sequence: Synthetic peptide
  Seed: AVIGALLAV (PMEL_HUMAN)
AVIGALLAF

SEQ ID NO: 127630 - protein, 10 aa, Artificial Sequence
  Description of Artificial Sequence: Synthetic peptide
  Seed: KVLPDGQVIW (PMEL_HUMAN)
KMLPDGQVIW

SEQ ID NO: 127631 - protein, 9 aa, Artificial Sequence
  Description of Artificial Sequence: Synthetic peptide
  Seed: MPTAESTGM (PMEL_HUMAN)
MPTAESTGW

SEQ ID NO: 127632 - protein, 10 aa, Artificial Sequence
  Description of Artificial Sequence: Synthetic peptide
  Seed: RGSRSYVPLA (PMEL_HUMAN)
RHSRSYVPLA

SEQ ID NO: 127633 - protein, 10 aa, Artificial Sequence
  Description of Artificial Sequence: Synthetic peptide
  Seed: SSSHWLRLPR (PMEL_HUMAN)
SKSHWLRLPR

SEQ ID NO: 127634 - protein, 10 aa, Artificial Sequence
  Description of Artificial Sequence: Synthetic peptide
  Seed: RALDGGNKHF (PMEL_HUMAN)
RILDGGNKHV

SEQ ID NO: 127635 - protein, 9 aa, Artificial Sequence
  Description of Artificial Sequence: Synthetic peptide
  Seed: RALDGGNKH (PMEL_HUMAN)
RMLDGGNKY

SEQ ID NO: 127636 - protein, 9 aa, Artificial Sequence
  Description of Artificial Sequence: Synthetic peptide
  Seed: SQVWGGQPV (PMEL_HUMAN)
SSVWGGQPY

SEQ ID NO: 127637 - protein, 9 aa, Artificial Sequence
  Description of Artificial Sequence: Synthetic peptide
  Seed: MTPEKVPVS (PMEL_HUMAN)
MMPEKVPVL

SEQ ID NO: 127638 - protein, 10 aa, Artificial Sequence
  Description of Artificial Sequence: Synthetic peptide
  Seed: ESAEILQAVP (PMEL_HUMAN)
ETAEILQAVV

SEQ ID NO: 127639 - protein, 9 aa, Artificial Sequence
  Description of Artificial Sequence: Synthetic peptide
  Seed: VWKTWGQYW (PMEL_HUMAN)
VTKTWGQYF

SEQ ID NO: 127640 - protein, 10 aa, Artificial Sequence
  Description of Artificial Sequence: Synthetic peptide
  Seed: RTKAWNRQLY (PMEL_HUMAN)
RSKAWNRQLA

SEQ ID NO: 127641 - protein, 11 aa, Artificial Sequence
  Description of Artificial Sequence: Synthetic peptide
  Seed: SLKVSNDGPTL (PMEL_HUMAN)
SQKVSNDGPTY

SEQ ID NO: 127642 - protein, 10 aa, Artificial Sequence
  Description of Artificial Sequence: Synthetic peptide
  Seed: EVMGTTLAEM (PMEL_HUMAN)
ELMGTTLAEY

SEQ ID NO: 127643 - protein, 9 aa, Artificial Sequence
  Description of Artificial Sequence: Synthetic peptide
  Seed: LQLHDPSGY (PMEL_HUMAN)
LALHDPSGF

SEQ ID NO: 127644 - protein, 10 aa, Artificial Sequence
  Description of Artificial Sequence: Synthetic peptide
  Seed: LVLMAVVLAS (PMEL_HUMAN)
LFLMAVVLAV

SEQ ID NO: 127645 - protein, 10 aa, Artificial Sequence
  Description of Artificial Sequence: Synthetic peptide
  Seed: ASSIMSTESI (PMEL_HUMAN)
AHSIMSTESW

SEQ ID NO: 127646 - protein, 9 aa, Artificial Sequence
  Description of Artificial Sequence: Synthetic peptide
  Seed: YRYGSFSVT (PMEL_HUMAN)
YRYGSFSVF

SEQ ID NO: 127647 - protein, 9 aa, Artificial Sequence
  Description of Artificial Sequence: Synthetic peptide
  Seed: ALDGGNKHF (PMEL_HUMAN)
ACDGGNKHL

SEQ ID NO: 127648 - protein, 9 aa, Artificial Sequence
  Description of Artificial Sequence: Synthetic peptide
  Seed: ALVVTHTYL (PMEL_HUMAN)
AMVVTHTYR

SEQ ID NO: 127649 - protein, 9 aa, Artificial Sequence
  Description of Artificial Sequence: Synthetic peptide
  Seed: GHRPTAEAP (PMEL_HUMAN)
GHRPTAEAA

SEQ ID NO: 127650 - protein, 10 aa, Artificial Sequence
  Description of Artificial Sequence: Synthetic peptide
  Seed: ESITGSLGPL (PMEL_HUMAN)
ETITGSLGPR

SEQ ID NO: 127651 - protein, 9 aa, Artificial Sequence
  Description of Artificial Sequence: Synthetic peptide
  Seed: KQDFSVPQL (PMEL_HUMAN)
KADFSVPQM

SEQ ID NO: 127652 - protein, 9 aa, Artificial Sequence
  Description of Artificial Sequence: Synthetic peptide
  Seed: VLMAVVLAS (PMEL_HUMAN)
VQMAVVLAI

SEQ ID NO: 127653 - protein, 9 aa, Artificial Sequence
  Description of Artificial Sequence: Synthetic peptide
  Seed: DQVPFSVSV (PMEL_HUMAN)
DGVPFSVSI

SEQ ID NO: 127654 - protein, 11 aa, Artificial Sequence
  Description of Artificial Sequence: Synthetic peptide
  Seed: GLGQVPLIVGI (PMEL_HUMAN)
GLGQVPLIVGV

SEQ ID NO: 127655 - protein, 9 aa, Artificial Sequence
  Description of Artificial Sequence: Synthetic peptide
  Seed: THTMEVTVY (PMEL_HUMAN)
TQTMEVTVY

SEQ ID NO: 127656 - protein, 10 aa, Artificial Sequence
  Description of Artificial Sequence: Synthetic peptide
  Seed: YRYGSFSVTL (PMEL_HUMAN)
YGYGSFSVTY

SEQ ID NO: 127657 - protein, 10 aa, Artificial Sequence
  Description of Artificial Sequence: Synthetic peptide
  Seed: VSLADTNSLA (PMEL_HUMAN)
VELADTNSLV

SEQ ID NO: 127658 - protein, 9 aa, Artificial Sequence
  Description of Artificial Sequence: Synthetic peptide
  Seed: ALVVTHTYL (PMEL_HUMAN)
ALVVTHTYY

SEQ ID NO: 127659 - protein, 9 aa, Artificial Sequence
  Description of Artificial Sequence: Synthetic peptide
  Seed: TTAGQVPTT (PMEL_HUMAN)
TVAGQVPTV

SEQ ID NO: 127660 - protein, 9 aa, Artificial Sequence
  Description of Artificial Sequence: Synthetic peptide
  Seed: VVLSGTTAA (PMEL_HUMAN)
VPLSGTTAA

SEQ ID NO: 127661 - protein, 9 aa, Artificial Sequence
  Description of Artificial Sequence: Synthetic peptide
  Seed: ANASFSIAL (PMEL_HUMAN)
ARASFSIAY

SEQ ID NO: 127662 - protein, 9 aa, Artificial Sequence
  Description of Artificial Sequence: Synthetic peptide
  Seed: AAQVTTTEW (PMEL_HUMAN)
AMQVTTTEW

SEQ ID NO: 127663 - protein, 9 aa, Artificial Sequence
  Description of Artificial Sequence: Synthetic peptide
  Seed: GQVPTTEVV (PMEL_HUMAN)
GMVPTTEVW

SEQ ID NO: 127664 - protein, 10 aa, Artificial Sequence
  Description of Artificial Sequence: Synthetic peptide
  Seed: KTWGQYWQVL (PMEL_HUMAN)
KTWGQYWQVM

SEQ ID NO: 127665 - protein, 11 aa, Artificial Sequence
  Description of Artificial Sequence: Synthetic peptide
  Seed: SAFTITDQVPF (PMEL_HUMAN)
STFTITDQVPW

SEQ ID NO: 127666 - protein, 9 aa, Artificial Sequence
  Description of Artificial Sequence: Synthetic peptide
  Seed: VTLDIVQGI (PMEL_HUMAN)
VLLDIVQGM

SEQ ID NO: 127667 - protein, 10 aa, Artificial Sequence
  Description of Artificial Sequence: Synthetic peptide
  Seed: YGSFSVTLDI (PMEL_HUMAN)
YESFSVTLDW

SEQ ID NO: 127668 - protein, 8 aa, Artificial Sequence
  Description of Artificial Sequence: Synthetic peptide
  Seed: LHDPSGYL (PMEL_HUMAN)
LFDPSGYM

SEQ ID NO: 127669 - protein, 10 aa, Artificial Sequence
  Description of Artificial Sequence: Synthetic peptide
  Seed: IVQGIESAEI (PMEL_HUMAN)
ILQGIESAEV

SEQ ID NO: 127670 - protein, 9 aa, Artificial Sequence
  Description of Artificial Sequence: Synthetic peptide
  Seed: SITGSLGPL (PMEL_HUMAN)
SVTGSLGPR

SEQ ID NO: 127671 - protein, 9 aa, Artificial Sequence
  Description of Artificial Sequence: Synthetic peptide
  Seed: CPIGENSPL (PMEL_HUMAN)
CTIGENSPY

SEQ ID NO: 127672 - protein, 10 aa, Artificial Sequence
  Description of Artificial Sequence: Synthetic peptide
  Seed: GDSSGTLISR (PMEL_HUMAN)
GFSSGTLISK

SEQ ID NO: 127673 - protein, 9 aa, Artificial Sequence
  Description of Artificial Sequence: Synthetic peptide
  Seed: FGDSSGTLI (PMEL_HUMAN)
FADSSGTLM

SEQ ID NO: 127674 - protein, 9 aa, Artificial Sequence
  Description of Artificial Sequence: Synthetic peptide
  Seed: YHRRGSRSY (PMEL_HUMAN)
YLRRGSRSF

SEQ ID NO: 127675 - protein, 11 aa, Artificial Sequence
  Description of Artificial Sequence: Synthetic peptide
  Seed: SYVPLAHSSSA (PMEL_HUMAN)
SPVPLAHSSSI

SEQ ID NO: 127676 - protein, 10 aa, Artificial Sequence
  Description of Artificial Sequence: Synthetic peptide
  Seed: VLMAVVLASL (PMEL_HUMAN)
VYMAVVLASI

SEQ ID NO: 127677 - protein, 9 aa, Artificial Sequence
  Description of Artificial Sequence: Synthetic peptide
  Seed: STAPVQMPT (PMEL_HUMAN)
SMAPVQMPM

SEQ ID NO: 127678 - protein, 9 aa, Artificial Sequence
  Description of Artificial Sequence: Synthetic peptide
  Seed: VMGTTLAEM (PMEL_HUMAN)
VLGTTLAEY

SEQ ID NO: 127679 - protein, 9 aa, Artificial Sequence
  Description of Artificial Sequence: Synthetic peptide
  Seed: RNQPLTFAL (PMEL_HUMAN)
RWQPLTFAF

SEQ ID NO: 127680 - protein, 9 aa, Artificial Sequence
  Description of Artificial Sequence: Synthetic peptide
  Seed: SPLLSGQQV (PMEL_HUMAN)
SALLSGQQY

SEQ ID NO: 127681 - protein, 9 aa, Artificial Sequence
  Description of Artificial Sequence: Synthetic peptide
  Seed: VQVPTTEVI (PMEL_HUMAN)
VDVPTTEVF

SEQ ID NO: 127682 - protein, 10 aa, Artificial Sequence
  Description of Artificial Sequence: Synthetic peptide
  Seed: ALDGGNKHFL (PMEL_HUMAN)
AWDGGNKHFF

SEQ ID NO: 127683 - protein, 9 aa, Artificial Sequence
  Description of Artificial Sequence: Synthetic peptide
  Seed: VVLSGTTAA (PMEL_HUMAN)
VLLSGTTAM

SEQ ID NO: 127684 - protein, 9 aa, Artificial Sequence
  Description of Artificial Sequence: Synthetic peptide
  Seed: KHFLRNQPL (PMEL_HUMAN)
KAFLRNQPM

SEQ ID NO: 127685 - protein, 11 aa, Artificial Sequence
  Description of Artificial Sequence: Synthetic peptide
  Seed: RYGSFSVTLDI (PMEL_HUMAN)
RDGSFSVTLDY

SEQ ID NO: 127686 - protein, 11 aa, Artificial Sequence
  Description of Artificial Sequence: Synthetic peptide
  Seed: HTMEVTVYHRR (PMEL_HUMAN)
HTMEVTVYHRI

SEQ ID NO: 127687 - protein, 10 aa, Artificial Sequence
  Description of Artificial Sequence: Synthetic peptide
  Seed: AVPSGEGDAF (PMEL_HUMAN)
AVPSGEGDAY

SEQ ID NO: 127688 - protein, 9 aa, Artificial Sequence
  Description of Artificial Sequence: Synthetic peptide
  Seed: RAMLGTHTM (PMEL_HUMAN)
RQMLGTHTM

SEQ ID NO: 127689 - protein, 9 aa, Artificial Sequence
  Description of Artificial Sequence: Synthetic peptide
  Seed: VQMPTAEST (PMEL_HUMAN)
VHMPTAESY

SEQ ID NO: 127690 - protein, 10 aa, Artificial Sequence
  Description of Artificial Sequence: Synthetic peptide
  Seed: EVSIVVLSGT (PMEL_HUMAN)
EASIVVLSGI

SEQ ID NO: 127691 - protein, 9 aa, Artificial Sequence
  Description of Artificial Sequence: Synthetic peptide
  Seed: TTDGHRPTA (PMEL_HUMAN)
TLDGHRPTY

SEQ ID NO: 127692 - protein, 9 aa, Artificial Sequence
  Description of Artificial Sequence: Synthetic peptide
  Seed: ANASFSIAL (PMEL_HUMAN)
ALASFSIAM

SEQ ID NO: 127693 - protein, 10 aa, Artificial Sequence
  Description of Artificial Sequence: Synthetic peptide
  Seed: FSVSVSQLRA (PMEL_HUMAN)
FSVSVSQLRV

SEQ ID NO: 127694 - protein, 10 aa, Artificial Sequence
  Description of Artificial Sequence: Synthetic peptide
  Seed: RQLYPEWTEA (PMEL_HUMAN)
RLLYPEWTEI

SEQ ID NO: 127695 - protein, 9 aa, Artificial Sequence
  Description of Artificial Sequence: Synthetic peptide
  Seed: SLAVVSTQL (PMEL_HUMAN)
SSAVVSTQM

SEQ ID NO: 127696 - protein, 9 aa, Artificial Sequence
  Description of Artificial Sequence: Synthetic peptide
  Seed: TLIGANASF (PMEL_HUMAN)
TAIGANASL

SEQ ID NO: 127697 - protein, 10 aa, Artificial Sequence
  Description of Artificial Sequence: Synthetic peptide
  Seed: RELPIPEPEG (PMEL_HUMAN)
RELPIPEPEV

SEQ ID NO: 127698 - protein, 11 aa, Artificial Sequence
  Description of Artificial Sequence: Synthetic peptide
  Seed: RQLRTKAWNRQ (PMEL_HUMAN)
RSLRTKAWNRR

SEQ ID NO: 127699 - protein, 10 aa, Artificial Sequence
  Description of Artificial Sequence: Synthetic peptide
  Seed: RTKAWNRQLY (PMEL_HUMAN)
RMKAWNRQLY

SEQ ID NO: 127700 - protein, 9 aa, Artificial Sequence
  Description of Artificial Sequence: Synthetic peptide
  Seed: YLAEADLSY (PMEL_HUMAN)
YLAEADLSF

SEQ ID NO: 127701 - protein, 9 aa, Artificial Sequence
  Description of Artificial Sequence: Synthetic peptide
  Seed: YRYGSFSVT (PMEL_HUMAN)
YHYGSFSVC

SEQ ID NO: 127702 - protein, 11 aa, Artificial Sequence
  Description of Artificial Sequence: Synthetic peptide
  Seed: RRGSRSYVPLA (PMEL_HUMAN)
RVGSRSYVPLI

SEQ ID NO: 127703 - protein, 9 aa, Artificial Sequence
  Description of Artificial Sequence: Synthetic peptide
  Seed: GTATLRLVK (PMEL_HUMAN)
GSATLRLVR

SEQ ID NO: 127704 - protein, 9 aa, Artificial Sequence
  Description of Artificial Sequence: Synthetic peptide
  Seed: RGSRSYVPL (PMEL_HUMAN)
RTSRSYVPY

SEQ ID NO: 127705 - protein, 10 aa, Artificial Sequence
  Description of Artificial Sequence: Synthetic peptide
  Seed: LHLAVIGALL (PMEL_HUMAN)
LGLAVIGALV

SEQ ID NO: 127706 - protein, 11 aa, Artificial Sequence
  Description of Artificial Sequence: Synthetic peptide
  Seed: FGDSSGTLISR (PMEL_HUMAN)
FCDSSGTLISM

SEQ ID NO: 127707 - protein, 8 aa, Artificial Sequence
  Description of Artificial Sequence: Synthetic peptide
  Seed: RELPIPEP (PMEL_HUMAN)
RELPIPEC

SEQ ID NO: 127708 - protein, 10 aa, Artificial Sequence
  Description of Artificial Sequence: Synthetic peptide
  Seed: IESAEILQAV (PMEL_HUMAN)
ILSAEILQAI

SEQ ID NO: 127709 - protein, 9 aa, Artificial Sequence
  Description of Artificial Sequence: Synthetic peptide
  Seed: LMAVVLASL (PMEL_HUMAN)
LQAVVLASH

SEQ ID NO: 127710 - protein, 9 aa, Artificial Sequence
  Description of Artificial Sequence: Synthetic peptide
  Seed: TTDGHRPTA (PMEL_HUMAN)
TIDGHRPTC

SEQ ID NO: 127711 - protein, 9 aa, Artificial Sequence
  Description of Artificial Sequence: Synthetic peptide
  Seed: TAPVQMPTA (PMEL_HUMAN)
TAPVQMPTI

SEQ ID NO: 127712 - protein, 10 aa, Artificial Sequence
  Description of Artificial Sequence: Synthetic peptide
  Seed: MAVVLASLIY (PMEL_HUMAN)
MRVVLASLIF

SEQ ID NO: 127713 - protein, 9 aa, Artificial Sequence
  Description of Artificial Sequence: Synthetic peptide
  Seed: YVWKTWGQY (PMEL_HUMAN)
YTWKTWGQW

SEQ ID NO: 127714 - protein, 9 aa, Artificial Sequence
  Description of Artificial Sequence: Synthetic peptide
  Seed: FTITDQVPF (PMEL_HUMAN)
FPITDQVPW

SEQ ID NO: 127715 - protein, 9 aa, Artificial Sequence
  Description of Artificial Sequence: Synthetic peptide
  Seed: MPTAESTGM (PMEL_HUMAN)
MPTAESTGI

SEQ ID NO: 127716 - protein, 8 aa, Artificial Sequence
  Description of Artificial Sequence: Synthetic peptide
  Seed: TLDIVQGI (PMEL_HUMAN)
TVDIVQGM

SEQ ID NO: 127717 - protein, 10 aa, Artificial Sequence
  Description of Artificial Sequence: Synthetic peptide
  Seed: AEADLSYTWD (PMEL_HUMAN)
AEADLSYTWY

SEQ ID NO: 127718 - protein, 10 aa, Artificial Sequence
  Description of Artificial Sequence: Synthetic peptide
  Seed: LVLMAVVLAS (PMEL_HUMAN)
LDLMAVVLAA

SEQ ID NO: 127719 - protein, 9 aa, Artificial Sequence
  Description of Artificial Sequence: Synthetic peptide
  Seed: ILKGGSGTY (PMEL_HUMAN)
IGKGGSGTY

SEQ ID NO: 127720 - protein, 9 aa, Artificial Sequence
  Description of Artificial Sequence: Synthetic peptide
  Seed: MPTAESTGM (PMEL_HUMAN)
MITAESTGY

SEQ ID NO: 127721 - protein, 9 aa, Artificial Sequence
  Description of Artificial Sequence: Synthetic peptide
  Seed: MTPAEVSIV (PMEL_HUMAN)
MAPAEVSIM

SEQ ID NO: 127722 - protein, 9 aa, Artificial Sequence
  Description of Artificial Sequence: Synthetic peptide
  Seed: SVQVPTTEV (PMEL_HUMAN)
SAQVPTTEM

SEQ ID NO: 127723 - protein, 9 aa, Artificial Sequence
  Description of Artificial Sequence: Synthetic peptide
  Seed: AVIGALLAV (PMEL_HUMAN)
ALIGALLAA

SEQ ID NO: 127724 - protein, 8 aa, Artificial Sequence
  Description of Artificial Sequence: Synthetic peptide
  Seed: LLDGTATL (PMEL_HUMAN)
LADGTATL

SEQ ID NO: 127725 - protein, 11 aa, Artificial Sequence
  Description of Artificial Sequence: Synthetic peptide
  Seed: FLRNQPLTFAL (PMEL_HUMAN)
FMRNQPLTFAI

SEQ ID NO: 127726 - protein, 9 aa, Artificial Sequence
  Description of Artificial Sequence: Synthetic peptide
  Seed: AAQVTTTEW (PMEL_HUMAN)
AQQVTTTEY

SEQ ID NO: 127727 - protein, 9 aa, Artificial Sequence
  Description of Artificial Sequence: Synthetic peptide
  Seed: AEPSGTTSV (PMEL_HUMAN)
AMPSGTTSM

SEQ ID NO: 127728 - protein, 9 aa, Artificial Sequence
  Description of Artificial Sequence: Synthetic peptide
  Seed: SVQVPTTEV (PMEL_HUMAN)
STQVPTTEY

SEQ ID NO: 127729 - protein, 9 aa, Artificial Sequence
  Description of Artificial Sequence: Synthetic peptide
  Seed: VTLDIVQGI (PMEL_HUMAN)
VQLDIVQGW

SEQ ID NO: 127730 - protein, 9 aa, Artificial Sequence
  Description of Artificial Sequence: Synthetic peptide
  Seed: VVLSGTTAA (PMEL_HUMAN)
VTLSGTTAL

SEQ ID NO: 127731 - protein, 9 aa, Artificial Sequence
  Description of Artificial Sequence: Synthetic peptide
  Seed: VLKRCLLHL (PMEL_HUMAN)
VVKRCLLHK

SEQ ID NO: 127732 - protein, 9 aa, Artificial Sequence
  Description of Artificial Sequence: Synthetic peptide
  Seed: WSQKRSFVY (PMEL_HUMAN)
WFQKRSFVL

SEQ ID NO: 127733 - protein, 9 aa, Artificial Sequence
  Description of Artificial Sequence: Synthetic peptide
  Seed: VLKRCLLHL (PMEL_HUMAN)
VLKRCLLHY

SEQ ID NO: 127734 - protein, 9 aa, Artificial Sequence
  Description of Artificial Sequence: Synthetic peptide
  Seed: QKRSFVYVW (PMEL_HUMAN)
QKRSFVYVF

SEQ ID NO: 127735 - protein, 9 aa, Artificial Sequence
  Description of Artificial Sequence: Synthetic peptide
  Seed: YVWKTWGQY (PMEL_HUMAN)
YYWKTWGQY

SEQ ID NO: 127736 - protein, 11 aa, Artificial Sequence
  Description of Artificial Sequence: Synthetic peptide
  Seed: FGDSSGTLISR (PMEL_HUMAN)
FFDSSGTLISL

SEQ ID NO: 127737 - protein, 10 aa, Artificial Sequence
  Description of Artificial Sequence: Synthetic peptide
  Seed: NASFSIALNF (PMEL_HUMAN)
NGSFSIALNW

SEQ ID NO: 127738 - protein, 11 aa, Artificial Sequence
  Description of Artificial Sequence: Synthetic peptide
  Seed: SEVMGTTLAEM (PMEL_HUMAN)
SEVMGTTLAEW

SEQ ID NO: 127739 - protein, 9 aa, Artificial Sequence
  Description of Artificial Sequence: Synthetic peptide
  Seed: AVIGALLAV (PMEL_HUMAN)
AQIGALLAA

SEQ ID NO: 127740 - protein, 9 aa, Artificial Sequence
  Description of Artificial Sequence: Synthetic peptide
  Seed: AVVSTQLIM (PMEL_HUMAN)
ATVSTQLIL

SEQ ID NO: 127741 - protein, 11 aa, Artificial Sequence
  Description of Artificial Sequence: Synthetic peptide
  Seed: CVLYRYGSFSV (PMEL_HUMAN)
CKLYRYGSFSV

SEQ ID NO: 127742 - protein, 10 aa, Artificial Sequence
  Description of Artificial Sequence: Synthetic peptide
  Seed: SGTYCLNVSL (PMEL_HUMAN)
SYTYCLNVSW

SEQ ID NO: 127743 - protein, 10 aa, Artificial Sequence
  Description of Artificial Sequence: Synthetic peptide
  Seed: YVPLAHSSSA (PMEL_HUMAN)
YPPLAHSSSI

SEQ ID NO: 127744 - protein, 9 aa, Artificial Sequence
  Description of Artificial Sequence: Synthetic peptide
  Seed: MTPAEVSIV (PMEL_HUMAN)
MMPAEVSIV

SEQ ID NO: 127745 - protein, 10 aa, Artificial Sequence
  Description of Artificial Sequence: Synthetic peptide
  Seed: TAEPSGTTSV (PMEL_HUMAN)
TAEPSGTTSM

SEQ ID NO: 127746 - protein, 9 aa, Artificial Sequence
  Description of Artificial Sequence: Synthetic peptide
  Seed: SQKRSFVYV (PMEL_HUMAN)
SVKRSFVYC

SEQ ID NO: 127747 - protein, 9 aa, Artificial Sequence
  Description of Artificial Sequence: Synthetic peptide
  Seed: KQDFSVPQL (PMEL_HUMAN)
KMDFSVPQW

SEQ ID NO: 127748 - protein, 9 aa, Artificial Sequence
  Description of Artificial Sequence: Synthetic peptide
  Seed: GQVPLIVGI (PMEL_HUMAN)
GLVPLIVGT

SEQ ID NO: 127749 - protein, 9 aa, Artificial Sequence
  Description of Artificial Sequence: Synthetic peptide
  Seed: MTPEKVPVS (PMEL_HUMAN)
MQPEKVPVF

SEQ ID NO: 127750 - protein, 10 aa, Artificial Sequence
  Description of Artificial Sequence: Synthetic peptide
  Seed: RSFVYVWKTW (PMEL_HUMAN)
RTFVYVWKTL

SEQ ID NO: 127751 - protein, 10 aa, Artificial Sequence
  Description of Artificial Sequence: Synthetic peptide
  Seed: SQKRSFVYVW (PMEL_HUMAN)
SYKRSFVYVF

SEQ ID NO: 127752 - protein, 9 aa, Artificial Sequence
  Description of Artificial Sequence: Synthetic peptide
  Seed: QVWGGQPVY (PMEL_HUMAN)
QTWGGQPVL

SEQ ID NO: 127753 - protein, 9 aa, Artificial Sequence
  Description of Artificial Sequence: Synthetic peptide
  Seed: VLKRCLLHL (PMEL_HUMAN)
VIKRCLLHK

SEQ ID NO: 127754 - protein, 8 aa, Artificial Sequence
  Description of Artificial Sequence: Synthetic peptide
  Seed: LLDGTATL (PMEL_HUMAN)
LVDGTATL

SEQ ID NO: 127755 - protein, 8 aa, Artificial Sequence
  Description of Artificial Sequence: Synthetic peptide
  Seed: IVGILLVL (PMEL_HUMAN)
IAGILLVL

SEQ ID NO: 127756 - protein, 9 aa, Artificial Sequence
  Description of Artificial Sequence: Synthetic peptide
  Seed: VPLDCVLYR (PMEL_HUMAN)
VYLDCVLYR

SEQ ID NO: 127757 - protein, 9 aa, Artificial Sequence
  Description of Artificial Sequence: Synthetic peptide
  Seed: TYLEPGPVT (PMEL_HUMAN)
TYLEPGPVV

SEQ ID NO: 127758 - protein, 9 aa, Artificial Sequence
  Description of Artificial Sequence: Synthetic peptide
  Seed: RAMLGTHTM (PMEL_HUMAN)
RSMLGTHTV

SEQ ID NO: 127759 - protein, 10 aa, Artificial Sequence
  Description of Artificial Sequence: Synthetic peptide
  Seed: MTPAEVSIVV (PMEL_HUMAN)
MDPAEVSIVV

SEQ ID NO: 127760 - protein, 9 aa, Artificial Sequence
  Description of Artificial Sequence: Synthetic peptide
  Seed: SVPQLPHSS (PMEL_HUMAN)
SIPQLPHSV

SEQ ID NO: 127761 - protein, 9 aa, Artificial Sequence
  Description of Artificial Sequence: Synthetic peptide
  Seed: VPSGEGDAF (PMEL_HUMAN)
VLSGEGDAY

SEQ ID NO: 127762 - protein, 9 aa, Artificial Sequence
  Description of Artificial Sequence: Synthetic peptide
  Seed: VLKRCLLHL (PMEL_HUMAN)
VAKRCLLHY

SEQ ID NO: 127763 - protein, 11 aa, Artificial Sequence
  Description of Artificial Sequence: Synthetic peptide
  Seed: AVVLASLIYRR (PMEL_HUMAN)
ARVLASLIYRR

SEQ ID NO: 127764 - protein, 9 aa, Artificial Sequence
  Description of Artificial Sequence: Synthetic peptide
  Seed: TESITGSLG (PMEL_HUMAN)
TESITGSLL

SEQ ID NO: 127765 - protein, 9 aa, Artificial Sequence
  Description of Artificial Sequence: Synthetic peptide
  Seed: AHSSSAFTI (PMEL_HUMAN)
AISSSAFTF

SEQ ID NO: 127766 - protein, 8 aa, Artificial Sequence
  Description of Artificial Sequence: Synthetic peptide
  Seed: AEILQAVP (PMEL_HUMAN)
AEILQAVA

SEQ ID NO: 127767 - protein, 9 aa, Artificial Sequence
  Description of Artificial Sequence: Synthetic peptide
  Seed: DQVPFSVSV (PMEL_HUMAN)
DPVPFSVSI

SEQ ID NO: 127768 - protein, 9 aa, Artificial Sequence
  Description of Artificial Sequence: Synthetic peptide
  Seed: ILKGGSGTY (PMEL_HUMAN)
IMKGGSGTY

SEQ ID NO: 127769 - protein, 10 aa, Artificial Sequence
  Description of Artificial Sequence: Synthetic peptide
  Seed: KVLPDGQVIW (PMEL_HUMAN)
KTLPDGQVIM

SEQ ID NO: 127770 - protein, 9 aa, Artificial Sequence
  Description of Artificial Sequence: Synthetic peptide
  Seed: IMPGQEAGL (PMEL_HUMAN)
IVPGQEAGM

SEQ ID NO: 127771 - protein, 9 aa, Artificial Sequence
  Description of Artificial Sequence: Synthetic peptide
  Seed: LLAVGATKV (PMEL_HUMAN)
LQAVGATKL

SEQ ID NO: 127772 - protein, 9 aa, Artificial Sequence
  Description of Artificial Sequence: Synthetic peptide
  Seed: YLEPGPVTA (PMEL_HUMAN)
YREPGPVTF

SEQ ID NO: 127773 - protein, 9 aa, Artificial Sequence
  Description of Artificial Sequence: Synthetic peptide
  Seed: VSEVMGTTL (PMEL_HUMAN)
VTEVMGTTY

SEQ ID NO: 127774 - protein, 9 aa, Artificial Sequence
  Description of Artificial Sequence: Synthetic peptide
  Seed: ITGSLGPLL (PMEL_HUMAN)
IIGSLGPLW

SEQ ID NO: 127775 - protein, 9 aa, Artificial Sequence
  Description of Artificial Sequence: Synthetic peptide
  Seed: SGTLISRAL (PMEL_HUMAN)
SSTLISRAI

SEQ ID NO: 127776 - protein, 10 aa, Artificial Sequence
  Description of Artificial Sequence: Synthetic peptide
  Seed: SVTLDIVQGI (PMEL_HUMAN)
SLTLDIVQGA

SEQ ID NO: 127777 - protein, 10 aa, Artificial Sequence
  Description of Artificial Sequence: Synthetic peptide
  Seed: EVMGTTLAEM (PMEL_HUMAN)
ETMGTTLAET

SEQ ID NO: 127778 - protein, 9 aa, Artificial Sequence
  Description of Artificial Sequence: Synthetic peptide
  Seed: AEADLSYTW (PMEL_HUMAN)
ASADLSYTW

SEQ ID NO: 127779 - protein, 11 aa, Artificial Sequence
  Description of Artificial Sequence: Synthetic peptide
  Seed: RAMLGTHTMEV (PMEL_HUMAN)
RFMLGTHTMEV

SEQ ID NO: 127780 - protein, 9 aa, Artificial Sequence
  Description of Artificial Sequence: Synthetic peptide
  Seed: ITDQVPFSV (PMEL_HUMAN)
IRDQVPFSF

SEQ ID NO: 127781 - protein, 11 aa, Artificial Sequence
  Description of Artificial Sequence: Synthetic peptide
  Seed: RALDGGNKHFL (PMEL_HUMAN)
RGLDGGNKHFW

SEQ ID NO: 127782 - protein, 10 aa, Artificial Sequence
  Description of Artificial Sequence: Synthetic peptide
  Seed: YLAEADLSYT (PMEL_HUMAN)
YIAEADLSYL

SEQ ID NO: 127783 - protein, 11 aa, Artificial Sequence
  Description of Artificial Sequence: Synthetic peptide
  Seed: ITDQVPFSVSV (PMEL_HUMAN)
IIDQVPFSVSM

SEQ ID NO: 127784 - protein, 9 aa, Artificial Sequence
  Description of Artificial Sequence: Synthetic peptide
  Seed: GSRSYVPLA (PMEL_HUMAN)
GVRSYVPLS

SEQ ID NO: 127785 - protein, 9 aa, Artificial Sequence
  Description of Artificial Sequence: Synthetic peptide
  Seed: AEADLSYTW (PMEL_HUMAN)
AQADLSYTW

SEQ ID NO: 127786 - protein, 9 aa, Artificial Sequence
  Description of Artificial Sequence: Synthetic peptide
  Seed: YLEPGPVTA (PMEL_HUMAN)
YIEPGPVTL

SEQ ID NO: 127787 - protein, 9 aa, Artificial Sequence
  Description of Artificial Sequence: Synthetic peptide
  Seed: VLKRCLLHL (PMEL_HUMAN)
VTKRCLLHL

SEQ ID NO: 127788 - protein, 10 aa, Artificial Sequence
  Description of Artificial Sequence: Synthetic peptide
  Seed: VPLAHSSSAF (PMEL_HUMAN)
VLLAHSSSAY

SEQ ID NO: 127789 - protein, 9 aa, Artificial Sequence
  Description of Artificial Sequence: Synthetic peptide
  Seed: VSLADTNSL (PMEL_HUMAN)
VQLADTNSI

SEQ ID NO: 127790 - protein, 10 aa, Artificial Sequence
  Description of Artificial Sequence: Synthetic peptide
  Seed: RALDGGNKHF (PMEL_HUMAN)
RFLDGGNKHY

SEQ ID NO: 127791 - protein, 8 aa, Artificial Sequence
  Description of Artificial Sequence: Synthetic peptide
  Seed: QDFSVPQL (PMEL_HUMAN)
QAFSVPQI

SEQ ID NO: 127792 - protein, 9 aa, Artificial Sequence
  Description of Artificial Sequence: Synthetic peptide
  Seed: SQKRSFVYV (PMEL_HUMAN)
SYKRSFVYV

SEQ ID NO: 127793 - protein, 9 aa, Artificial Sequence
  Description of Artificial Sequence: Synthetic peptide
  Seed: RAMLGTHTM (PMEL_HUMAN)
RHMLGTHTY

SEQ ID NO: 127794 - protein, 10 aa, Artificial Sequence
  Description of Artificial Sequence: Synthetic peptide
  Seed: SQVWGGQPVY (PMEL_HUMAN)
SAVWGGQPVM

SEQ ID NO: 127795 - protein, 9 aa, Artificial Sequence
  Description of Artificial Sequence: Synthetic peptide
  Seed: GTYCLNVSL (PMEL_HUMAN)
GKYCLNVSY

SEQ ID NO: 127796 - protein, 9 aa, Artificial Sequence
  Description of Artificial Sequence: Synthetic peptide
  Seed: ITGSLGPLL (PMEL_HUMAN)
ITGSLGPLY

SEQ ID NO: 127797 - protein, 9 aa, Artificial Sequence
  Description of Artificial Sequence: Synthetic peptide
  Seed: SITGSLGPL (PMEL_HUMAN)
SATGSLGPM

SEQ ID NO: 127798 - protein, 9 aa, Artificial Sequence
  Description of Artificial Sequence: Synthetic peptide
  Seed: TWGQYWQVL (PMEL_HUMAN)
TWGQYWQVM

SEQ ID NO: 127799 - protein, 9 aa, Artificial Sequence
  Description of Artificial Sequence: Synthetic peptide
  Seed: IVVLSGTTA (PMEL_HUMAN)
IAVLSGTTF

SEQ ID NO: 127800 - protein, 11 aa, Artificial Sequence
  Description of Artificial Sequence: Synthetic peptide
  Seed: RRGSRSYVPLA (PMEL_HUMAN)
REGSRSYVPLK

SEQ ID NO: 127801 - protein, 11 aa, Artificial Sequence
  Description of Artificial Sequence: Synthetic peptide
  Seed: RELPIPEPEGP (PMEL_HUMAN)
RELPIPEPEGL

SEQ ID NO: 127802 - protein, 9 aa, Artificial Sequence
  Description of Artificial Sequence: Synthetic peptide
  Seed: QVWGGQPVY (PMEL_HUMAN)
QLWGGQPVY

SEQ ID NO: 127803 - protein, 11 aa, Artificial Sequence
  Description of Artificial Sequence: Synthetic peptide
  Seed: RTKAWNRQLYP (PMEL_HUMAN)
RTKAWNRQLYI

SEQ ID NO: 127804 - protein, 9 aa, Artificial Sequence
  Description of Artificial Sequence: Synthetic peptide
  Seed: ITDQVPFSV (PMEL_HUMAN)
IADQVPFSV

SEQ ID NO: 127805 - protein, 11 aa, Artificial Sequence
  Description of Artificial Sequence: Synthetic peptide
  Seed: AEMSTPEATGM (PMEL_HUMAN)
ARMSTPEATGY

SEQ ID NO: 127806 - protein, 11 aa, Artificial Sequence
  Description of Artificial Sequence: Synthetic peptide
  Seed: RRRLMKQDFSV (PMEL_HUMAN)
RHRLMKQDFSV

SEQ ID NO: 127807 - protein, 9 aa, Artificial Sequence
  Description of Artificial Sequence: Synthetic peptide
  Seed: AVIGALLAV (PMEL_HUMAN)
ALIGALLAL

SEQ ID NO: 127808 - protein, 11 aa, Artificial Sequence
  Description of Artificial Sequence: Synthetic peptide
  Seed: YLAEADLSYTW (PMEL_HUMAN)
YYAEADLSYTF

SEQ ID NO: 127809 - protein, 10 aa, Artificial Sequence
  Description of Artificial Sequence: Synthetic peptide
  Seed: RNQDWLGVSR (PMEL_HUMAN)
RTQDWLGVSR

SEQ ID NO: 127810 - protein, 11 aa, Artificial Sequence
  Description of Artificial Sequence: Synthetic peptide
  Seed: ITDQVPFSVSV (PMEL_HUMAN)
IMDQVPFSVSL

SEQ ID NO: 127811 - protein, 9 aa, Artificial Sequence
  Description of Artificial Sequence: Synthetic peptide
  Seed: ALLAVGATK (PMEL_HUMAN)
AALAVGATV

SEQ ID NO: 127812 - protein, 9 aa, Artificial Sequence
  Description of Artificial Sequence: Synthetic peptide
  Seed: VSEVMGTTL (PMEL_HUMAN)
VEEVMGTTF

SEQ ID NO: 127813 - protein, 11 aa, Artificial Sequence
  Description of Artificial Sequence: Synthetic peptide
  Seed: TWDFGDSSGTL (PMEL_HUMAN)
TFDFGDSSGTL

SEQ ID NO: 127814 - protein, 9 aa, Artificial Sequence
  Description of Artificial Sequence: Synthetic peptide
  Seed: VLPSPACQL (PMEL_HUMAN)
VVPSPACQM

SEQ ID NO: 127815 - protein, 9 aa, Artificial Sequence
  Description of Artificial Sequence: Synthetic peptide
  Seed: ALVVTHTYL (PMEL_HUMAN)
AMVVTHTYV

SEQ ID NO: 127816 - protein, 9 aa, Artificial Sequence
  Description of Artificial Sequence: Synthetic peptide
  Seed: RTKAWNRQL (PMEL_HUMAN)
RAKAWNRQW

SEQ ID NO: 127817 - protein, 9 aa, Artificial Sequence
  Description of Artificial Sequence: Synthetic peptide
  Seed: TEVISTAPV (PMEL_HUMAN)
TEVISTAPL

SEQ ID NO: 127818 - protein, 9 aa, Artificial Sequence
  Description of Artificial Sequence: Synthetic peptide
  Seed: AVIGALLAV (PMEL_HUMAN)
AKIGALLAF

SEQ ID NO: 127819 - protein, 9 aa, Artificial Sequence
  Description of Artificial Sequence: Synthetic peptide
  Seed: VPLDCVLYR (PMEL_HUMAN)
VMLDCVLYY

SEQ ID NO: 127820 - protein, 10 aa, Artificial Sequence
  Description of Artificial Sequence: Synthetic peptide
  Seed: FSVSVSQLRA (PMEL_HUMAN)
FTVSVSQLRM

SEQ ID NO: 127821 - protein, 9 aa, Artificial Sequence
  Description of Artificial Sequence: Synthetic peptide
  Seed: VSNDGPTLI (PMEL_HUMAN)
VRNDGPTLF

SEQ ID NO: 127822 - protein, 9 aa, Artificial Sequence
  Description of Artificial Sequence: Synthetic peptide
  Seed: DSSGTLISR (PMEL_HUMAN)
DASGTLISY

SEQ ID NO: 127823 - protein, 9 aa, Artificial Sequence
  Description of Artificial Sequence: Synthetic peptide
  Seed: AEADLSYTW (PMEL_HUMAN)
AEADLSYTV

SEQ ID NO: 127824 - protein, 10 aa, Artificial Sequence
  Description of Artificial Sequence: Synthetic peptide
  Seed: RGSRSYVPLA (PMEL_HUMAN)
RLSRSYVPLI

SEQ ID NO: 127825 - protein, 10 aa, Artificial Sequence
  Description of Artificial Sequence: Synthetic peptide
  Seed: ALDGGNKHFL (PMEL_HUMAN)
AMDGGNKHFF

SEQ ID NO: 127826 - protein, 8 aa, Artificial Sequence
  Description of Artificial Sequence: Synthetic peptide
  Seed: LLDGTATL (PMEL_HUMAN)
LSDGTATV

SEQ ID NO: 127827 - protein, 9 aa, Artificial Sequence
  Description of Artificial Sequence: Synthetic peptide
  Seed: GSSPVPGTT (PMEL_HUMAN)
GTSPVPGTY

SEQ ID NO: 127828 - protein, 10 aa, Artificial Sequence
  Description of Artificial Sequence: Synthetic peptide
  Seed: IALNFPGSQK (PMEL_HUMAN)
IGLNFPGSQK

SEQ ID NO: 127829 - protein, 9 aa, Artificial Sequence
  Description of Artificial Sequence: Synthetic peptide
  Seed: DQVPFSVSV (PMEL_HUMAN)
DLVPFSVSY

SEQ ID NO: 127830 - protein, 9 aa, Artificial Sequence
  Description of Artificial Sequence: Synthetic peptide
  Seed: CVLYRYGSF (PMEL_HUMAN)
CMLYRYGSF

SEQ ID NO: 127831 - protein, 10 aa, Artificial Sequence
  Description of Artificial Sequence: Synthetic peptide
  Seed: SITGSLGPLL (PMEL_HUMAN)
SVTGSLGPLV

SEQ ID NO: 127832 - protein, 9 aa, Artificial Sequence
  Description of Artificial Sequence: Synthetic peptide
  Seed: YLEPGPVTA (PMEL_HUMAN)
YNEPGPVTI

SEQ ID NO: 127833 - protein, 10 aa, Artificial Sequence
  Description of Artificial Sequence: Synthetic peptide
  Seed: YGSFSVTLDI (PMEL_HUMAN)
YPSFSVTLDY

SEQ ID NO: 127834 - protein, 9 aa, Artificial Sequence
  Description of Artificial Sequence: Synthetic peptide
  Seed: HTMEVTVYH (PMEL_HUMAN)
HMMEVTVYF

SEQ ID NO: 127835 - protein, 10 aa, Artificial Sequence
  Description of Artificial Sequence: Synthetic peptide
  Seed: LAHSSSAFTI (PMEL_HUMAN)
LYHSSSAFTL

SEQ ID NO: 127836 - protein, 9 aa, Artificial Sequence
  Description of Artificial Sequence: Synthetic peptide
  Seed: EGDAFELTV (PMEL_HUMAN)
ETDAFELTI

SEQ ID NO: 127837 - protein, 10 aa, Artificial Sequence
  Description of Artificial Sequence: Synthetic peptide
  Seed: MTPAEVSIVV (PMEL_HUMAN)
MHPAEVSIVH

SEQ ID NO: 127838 - protein, 10 aa, Artificial Sequence
  Description of Artificial Sequence: Synthetic peptide
  Seed: MPTAESTGMT (PMEL_HUMAN)
MITAESTGMI

SEQ ID NO: 127839 - protein, 9 aa, Artificial Sequence
  Description of Artificial Sequence: Synthetic peptide
  Seed: FTITDQVPF (PMEL_HUMAN)
FQITDQVPV

SEQ ID NO: 127840 - protein, 9 aa, Artificial Sequence
  Description of Artificial Sequence: Synthetic peptide
  Seed: VVLQAAIPL (PMEL_HUMAN)
VHLQAAIPY

SEQ ID NO: 127841 - protein, 9 aa, Artificial Sequence
  Description of Artificial Sequence: Synthetic peptide
  Seed: AQRLCQPVL (PMEL_HUMAN)
ASRLCQPVV

SEQ ID NO: 127842 - protein, 10 aa, Artificial Sequence
  Description of Artificial Sequence: Synthetic peptide
  Seed: MPTAESTGMT (PMEL_HUMAN)
MTTAESTGML

SEQ ID NO: 127843 - protein, 9 aa, Artificial Sequence
  Description of Artificial Sequence: Synthetic peptide
  Seed: KVSNDGPTL (PMEL_HUMAN)
KMSNDGPTY

SEQ ID NO: 127844 - protein, 10 aa, Artificial Sequence
  Description of Artificial Sequence: Synthetic peptide
  Seed: MAVVLASLIY (PMEL_HUMAN)
MTVVLASLIF

SEQ ID NO: 127845 - protein, 10 aa, Artificial Sequence
  Description of Artificial Sequence: Synthetic peptide
  Seed: LAVVSTQLIM (PMEL_HUMAN)
LAVVSTQLIF

SEQ ID NO: 127846 - protein, 9 aa, Artificial Sequence
  Description of Artificial Sequence: Synthetic peptide
  Seed: RAMLGTHTM (PMEL_HUMAN)
RNMLGTHTR

SEQ ID NO: 127847 - protein, 9 aa, Artificial Sequence
  Description of Artificial Sequence: Synthetic peptide
  Seed: YLEPGPVTA (PMEL_HUMAN)
YIEPGPVTM

SEQ ID NO: 127848 - protein, 9 aa, Artificial Sequence
  Description of Artificial Sequence: Synthetic peptide
  Seed: YLEPGPVTA (PMEL_HUMAN)
YHEPGPVTM

SEQ ID NO: 127849 - protein, 9 aa, Artificial Sequence
  Description of Artificial Sequence: Synthetic peptide
  Seed: AGLGQVPLI (PMEL_HUMAN)
ALLGQVPLI

SEQ ID NO: 127850 - protein, 9 aa, Artificial Sequence
  Description of Artificial Sequence: Synthetic peptide
  Seed: DAFELTVSC (PMEL_HUMAN)
DRFELTVSV

SEQ ID NO: 127851 - protein, 11 aa, Artificial Sequence
  Description of Artificial Sequence: Synthetic peptide
  Seed: RYGSFSVTLDI (PMEL_HUMAN)
RYGSFSVTLDL

SEQ ID NO: 127852 - protein, 9 aa, Artificial Sequence
  Description of Artificial Sequence: Synthetic peptide
  Seed: VWKTWGQYW (PMEL_HUMAN)
VYKTWGQYF

SEQ ID NO: 127853 - protein, 9 aa, Artificial Sequence
  Description of Artificial Sequence: Synthetic peptide
  Seed: ALNFPGSQK (PMEL_HUMAN)
ASNFPGSQK

SEQ ID NO: 127854 - protein, 9 aa, Artificial Sequence
  Description of Artificial Sequence: Synthetic peptide
  Seed: LADTNSLAV (PMEL_HUMAN)
LIDTNSLAI

SEQ ID NO: 127855 - protein, 10 aa, Artificial Sequence
  Description of Artificial Sequence: Synthetic peptide
  Seed: KTWGQYWQVL (PMEL_HUMAN)
KMWGQYWQVR

SEQ ID NO: 127856 - protein, 11 aa, Artificial Sequence
  Description of Artificial Sequence: Synthetic peptide
  Seed: WQVLGGPVSGL (PMEL_HUMAN)
WQVLGGPVSGF

SEQ ID NO: 127857 - protein, 8 aa, Artificial Sequence
  Description of Artificial Sequence: Synthetic peptide
  Seed: LHDPSGYL (PMEL_HUMAN)
LGDPSGYL

SEQ ID NO: 127858 - protein, 9 aa, Artificial Sequence
  Description of Artificial Sequence: Synthetic peptide
  Seed: TTPGQAPTA (PMEL_HUMAN)
TLPGQAPTF

SEQ ID NO: 127859 - protein, 9 aa, Artificial Sequence
  Description of Artificial Sequence: Synthetic peptide
  Seed: AQVTTTEWV (PMEL_HUMAN)
AQVTTTEWL

SEQ ID NO: 127860 - protein, 10 aa, Artificial Sequence
  Description of Artificial Sequence: Synthetic peptide
  Seed: YLAEADLSYT (PMEL_HUMAN)
YLAEADLSYG

SEQ ID NO: 127861 - protein, 9 aa, Artificial Sequence
  Description of Artificial Sequence: Synthetic peptide
  Seed: RQVPLDCVL (PMEL_HUMAN)
RSVPLDCVF

SEQ ID NO: 127862 - protein, 10 aa, Artificial Sequence
  Description of Artificial Sequence: Synthetic peptide
  Seed: ALDGGNKHFL (PMEL_HUMAN)
AFDGGNKHFI

SEQ ID NO: 127863 - protein, 10 aa, Artificial Sequence
  Description of Artificial Sequence: Synthetic peptide
  Seed: IALNFPGSQK (PMEL_HUMAN)
IALNFPGSQF

SEQ ID NO: 127864 - protein, 9 aa, Artificial Sequence
  Description of Artificial Sequence: Synthetic peptide
  Seed: KTWGQYWQV (PMEL_HUMAN)
KSWGQYWQY

SEQ ID NO: 127865 - protein, 10 aa, Artificial Sequence
  Description of Artificial Sequence: Synthetic peptide
  Seed: NNTIINGSQV (PMEL_HUMAN)
NTTIINGSQV

SEQ ID NO: 127866 - protein, 10 aa, Artificial Sequence
  Description of Artificial Sequence: Synthetic peptide
  Seed: SRALVVTHTY (PMEL_HUMAN)
STALVVTHTF

SEQ ID NO: 127867 - protein, 9 aa, Artificial Sequence
  Description of Artificial Sequence: Synthetic peptide
  Seed: VVLQAAIPL (PMEL_HUMAN)
VRLQAAIPM

SEQ ID NO: 127868 - protein, 9 aa, Artificial Sequence
  Description of Artificial Sequence: Synthetic peptide
  Seed: VVLSGTTAA (PMEL_HUMAN)
VPLSGTTAT

SEQ ID NO: 127869 - protein, 10 aa, Artificial Sequence
  Description of Artificial Sequence: Synthetic peptide
  Seed: AWNRQLYPEW (PMEL_HUMAN)
AYNRQLYPEL

SEQ ID NO: 127870 - protein, 9 aa, Artificial Sequence
  Description of Artificial Sequence: Synthetic peptide
  Seed: AGQVPTTEV (PMEL_HUMAN)
AGQVPTTEY

SEQ ID NO: 127871 - protein, 10 aa, Artificial Sequence
  Description of Artificial Sequence: Synthetic peptide
  Seed: FSVSVSQLRA (PMEL_HUMAN)
FSVSVSQLRR

SEQ ID NO: 127872 - protein, 10 aa, Artificial Sequence
  Description of Artificial Sequence: Synthetic peptide
  Seed: KTWGQYWQVL (PMEL_HUMAN)
KIWGQYWQVK

SEQ ID NO: 127873 - protein, 8 aa, Artificial Sequence
  Description of Artificial Sequence: Synthetic peptide
  Seed: SHWLRLPR (PMEL_HUMAN)
SSWLRLPR

SEQ ID NO: 127874 - protein, 9 aa, Artificial Sequence
  Description of Artificial Sequence: Synthetic peptide
  Seed: TLIGANASF (PMEL_HUMAN)
TLIGANASM

SEQ ID NO: 127875 - protein, 9 aa, Artificial Sequence
  Description of Artificial Sequence: Synthetic peptide
  Seed: YLAEADLSY (PMEL_HUMAN)
YVAEADLSF

SEQ ID NO: 127876 - protein, 9 aa, Artificial Sequence
  Description of Artificial Sequence: Synthetic peptide
  Seed: DAFELTVSC (PMEL_HUMAN)
DSFELTVSI

SEQ ID NO: 127877 - protein, 9 aa, Artificial Sequence
  Description of Artificial Sequence: Synthetic peptide
  Seed: QLYPEWTEA (PMEL_HUMAN)
QIYPEWTEL

SEQ ID NO: 127878 - protein, 10 aa, Artificial Sequence
  Description of Artificial Sequence: Synthetic peptide
  Seed: KTWGQYWQVL (PMEL_HUMAN)
KYWGQYWQVW

SEQ ID NO: 127879 - protein, 9 aa, Artificial Sequence
  Description of Artificial Sequence: Synthetic peptide
  Seed: VVLASLIYR (PMEL_HUMAN)
VQLASLIYK

SEQ ID NO: 127880 - protein, 10 aa, Artificial Sequence
  Description of Artificial Sequence: Synthetic peptide
  Seed: TTEWVETTAR (PMEL_HUMAN)
TIEWVETTAR

SEQ ID NO: 127881 - protein, 10 aa, Artificial Sequence
  Description of Artificial Sequence: Synthetic peptide
  Seed: YVPLAHSSSA (PMEL_HUMAN)
YCPLAHSSSF

SEQ ID NO: 127882 - protein, 9 aa, Artificial Sequence
  Description of Artificial Sequence: Synthetic peptide
  Seed: WQVLGGPVS (PMEL_HUMAN)
WAVLGGPVF

SEQ ID NO: 127883 - protein, 10 aa, Artificial Sequence
  Description of Artificial Sequence: Synthetic peptide
  Seed: RGSRSYVPLA (PMEL_HUMAN)
RKSRSYVPLK

SEQ ID NO: 127884 - protein, 10 aa, Artificial Sequence
  Description of Artificial Sequence: Synthetic peptide
  Seed: AVIGALLAVG (PMEL_HUMAN)
ALIGALLAVE

SEQ ID NO: 127885 - protein, 11 aa, Artificial Sequence
  Description of Artificial Sequence: Synthetic peptide
  Seed: FSVTLDIVQGI (PMEL_HUMAN)
FLVTLDIVQGM

SEQ ID NO: 127886 - protein, 9 aa, Artificial Sequence
  Description of Artificial Sequence: Synthetic peptide
  Seed: GSRSYVPLA (PMEL_HUMAN)
GVRSYVPLV

SEQ ID NO: 127887 - protein, 9 aa, Artificial Sequence
  Description of Artificial Sequence: Synthetic peptide
  Seed: LHLAVIGAL (PMEL_HUMAN)
LQLAVIGAF

SEQ ID NO: 127888 - protein, 10 aa, Artificial Sequence
  Description of Artificial Sequence: Synthetic peptide
  Seed: AVIGALLAVG (PMEL_HUMAN)
AMIGALLAVG

SEQ ID NO: 127889 - protein, 9 aa, Artificial Sequence
  Description of Artificial Sequence: Synthetic peptide
  Seed: FGDSSGTLI (PMEL_HUMAN)
FQDSSGTLL

SEQ ID NO: 127890 - protein, 10 aa, Artificial Sequence
  Description of Artificial Sequence: Synthetic peptide
  Seed: MAVVLASLIY (PMEL_HUMAN)
MAVVLASLIK

SEQ ID NO: 127891 - protein, 9 aa, Artificial Sequence
  Description of Artificial Sequence: Synthetic peptide
  Seed: VSLADTNSL (PMEL_HUMAN)
VILADTNSW

SEQ ID NO: 127892 - protein, 11 aa, Artificial Sequence
  Description of Artificial Sequence: Synthetic peptide
  Seed: FGDSSGTLISR (PMEL_HUMAN)
FTDSSGTLISC

SEQ ID NO: 127893 - protein, 8 aa, Artificial Sequence
  Description of Artificial Sequence: Synthetic peptide
  Seed: FGDSSGTL (PMEL_HUMAN)
FVDSSGTF

SEQ ID NO: 127894 - protein, 8 aa, Artificial Sequence
  Description of Artificial Sequence: Synthetic peptide
  Seed: TLDIVQGI (PMEL_HUMAN)
TWDIVQGL

SEQ ID NO: 127895 - protein, 10 aa, Artificial Sequence
  Description of Artificial Sequence: Synthetic peptide
  Seed: RRLMKQDFSV (PMEL_HUMAN)
RILMKQDFSV

SEQ ID NO: 127896 - protein, 10 aa, Artificial Sequence
  Description of Artificial Sequence: Synthetic peptide
  Seed: RQLRTKAWNR (PMEL_HUMAN)
RYLRTKAWNK

SEQ ID NO: 127897 - protein, 9 aa, Artificial Sequence
  Description of Artificial Sequence: Synthetic peptide
  Seed: RLMKQDFSV (PMEL_HUMAN)
RTMKQDFSF

SEQ ID NO: 127898 - protein, 9 aa, Artificial Sequence
  Description of Artificial Sequence: Synthetic peptide
  Seed: ANASFSIAL (PMEL_HUMAN)
ATASFSIAV

SEQ ID NO: 127899 - protein, 9 aa, Artificial Sequence
  Description of Artificial Sequence: Synthetic peptide
  Seed: FTITDQVPF (PMEL_HUMAN)
FFITDQVPY

SEQ ID NO: 127900 - protein, 10 aa, Artificial Sequence
  Description of Artificial Sequence: Synthetic peptide
  Seed: EVISTAPVQM (PMEL_HUMAN)
EMISTAPVQK

SEQ ID NO: 127901 - protein, 9 aa, Artificial Sequence
  Description of Artificial Sequence: Synthetic peptide
  Seed: FTITDQVPF (PMEL_HUMAN)
FPITDQVPT

SEQ ID NO: 127902 - protein, 10 aa, Artificial Sequence
  Description of Artificial Sequence: Synthetic peptide
  Seed: YGSFSVTLDI (PMEL_HUMAN)
YMSFSVTLDY

SEQ ID NO: 127903 - protein, 11 aa, Artificial Sequence
  Description of Artificial Sequence: Synthetic peptide
  Seed: KVLPDGQVIWV (PMEL_HUMAN)
KQLPDGQVIWL

SEQ ID NO: 127904 - protein, 9 aa, Artificial Sequence
  Description of Artificial Sequence: Synthetic peptide
  Seed: KVLPDGQVI (PMEL_HUMAN)
KQLPDGQVW

SEQ ID NO: 127905 - protein, 11 aa, Artificial Sequence
  Description of Artificial Sequence: Synthetic peptide
  Seed: TVYHRRGSRSY (PMEL_HUMAN)
TKYHRRGSRSF

SEQ ID NO: 127906 - protein, 9 aa, Artificial Sequence
  Description of Artificial Sequence: Synthetic peptide
  Seed: HTMEVTVYH (PMEL_HUMAN)
HTMEVTVYQ

SEQ ID NO: 127907 - protein, 11 aa, Artificial Sequence
  Description of Artificial Sequence: Synthetic peptide
  Seed: LVLMAVVLASL (PMEL_HUMAN)
LYLMAVVLASL

SEQ ID NO: 127908 - protein, 9 aa, Artificial Sequence
  Description of Artificial Sequence: Synthetic peptide
  Seed: LPSPACQLV (PMEL_HUMAN)
LASPACQLL

SEQ ID NO: 127909 - protein, 9 aa, Artificial Sequence
  Description of Artificial Sequence: Synthetic peptide
  Seed: VQMPTAEST (PMEL_HUMAN)
VEMPTAESY

SEQ ID NO: 127910 - protein, 10 aa, Artificial Sequence
  Description of Artificial Sequence: Synthetic peptide
  Seed: SIVVLSGTTA (PMEL_HUMAN)
SMVVLSGTTV

SEQ ID NO: 127911 - protein, 11 aa, Artificial Sequence
  Description of Artificial Sequence: Synthetic peptide
  Seed: VQMPTAESTGM (PMEL_HUMAN)
VKMPTAESTGF

SEQ ID NO: 127912 - protein, 9 aa, Artificial Sequence
  Description of Artificial Sequence: Synthetic peptide
  Seed: TLIGANASF (PMEL_HUMAN)
TIIGANASV

SEQ ID NO: 127913 - protein, 10 aa, Artificial Sequence
  Description of Artificial Sequence: Synthetic peptide
  Seed: AMLGTHTMEV (PMEL_HUMAN)
AMLGTHTMEM

SEQ ID NO: 127914 - protein, 11 aa, Artificial Sequence
  Description of Artificial Sequence: Synthetic peptide
  Seed: FSVTLDIVQGI (PMEL_HUMAN)
FDVTLDIVQGV

SEQ ID NO: 127915 - protein, 9 aa, Artificial Sequence
  Description of Artificial Sequence: Synthetic peptide
  Seed: LQAAIPLTS (PMEL_HUMAN)
LKAAIPLTM

SEQ ID NO: 127916 - protein, 9 aa, Artificial Sequence
  Description of Artificial Sequence: Synthetic peptide
  Seed: VPQLPHSSS (PMEL_HUMAN)
VPQLPHSSV

SEQ ID NO: 127917 - protein, 11 aa, Artificial Sequence
  Description of Artificial Sequence: Synthetic peptide
  Seed: RSYVPLAHSSS (PMEL_HUMAN)
RMYVPLAHSSK

SEQ ID NO: 127918 - protein, 11 aa, Artificial Sequence
  Description of Artificial Sequence: Synthetic peptide
  Seed: RRGSRSYVPLA (PMEL_HUMAN)
RTGSRSYVPLI

SEQ ID NO: 127919 - protein, 9 aa, Artificial Sequence
  Description of Artificial Sequence: Synthetic peptide
  Seed: KVLPDGQVI (PMEL_HUMAN)
KALPDGQVM

SEQ ID NO: 127920 - protein, 10 aa, Artificial Sequence
  Description of Artificial Sequence: Synthetic peptide
  Seed: SGTYCLNVSL (PMEL_HUMAN)
SDTYCLNVSY

SEQ ID NO: 127921 - protein, 9 aa, Artificial Sequence
  Description of Artificial Sequence: Synthetic peptide
  Seed: VLPDGQVIW (PMEL_HUMAN)
VQPDGQVIY

SEQ ID NO: 127922 - protein, 9 aa, Artificial Sequence
  Description of Artificial Sequence: Synthetic peptide
  Seed: LLAVGATKV (PMEL_HUMAN)
LMAVGATKI

SEQ ID NO: 127923 - protein, 10 aa, Artificial Sequence
  Description of Artificial Sequence: Synthetic peptide
  Seed: YLAEADLSYT (PMEL_HUMAN)
YIAEADLSYM

SEQ ID NO: 127924 - protein, 10 aa, Artificial Sequence
  Description of Artificial Sequence: Synthetic peptide
  Seed: SGTYCLNVSL (PMEL_HUMAN)
SCTYCLNVSF

SEQ ID NO: 127925 - protein, 9 aa, Artificial Sequence
  Description of Artificial Sequence: Synthetic peptide
  Seed: SVQVPTTEV (PMEL_HUMAN)
SSQVPTTEI

SEQ ID NO: 127926 - protein, 9 aa, Artificial Sequence
  Description of Artificial Sequence: Synthetic peptide
  Seed: MTPAEVSIV (PMEL_HUMAN)
MSPAEVSIL

SEQ ID NO: 127927 - protein, 9 aa, Artificial Sequence
  Description of Artificial Sequence: Synthetic peptide
  Seed: RLMKQDFSV (PMEL_HUMAN)
RRMKQDFSF

SEQ ID NO: 127928 - protein, 9 aa, Artificial Sequence
  Description of Artificial Sequence: Synthetic peptide
  Seed: VSNDGPTLI (PMEL_HUMAN)
VSNDGPTLV

SEQ ID NO: 127929 - protein, 9 aa, Artificial Sequence
  Description of Artificial Sequence: Synthetic peptide
  Seed: VTLDIVQGI (PMEL_HUMAN)
VALDIVQGL

SEQ ID NO: 127930 - protein, 9 aa, Artificial Sequence
  Description of Artificial Sequence: Synthetic peptide
  Seed: ALLAVGATK (PMEL_HUMAN)
ATLAVGATL

SEQ ID NO: 127931 - protein, 9 aa, Artificial Sequence
  Description of Artificial Sequence: Synthetic peptide
  Seed: AEADLSYTW (PMEL_HUMAN)
AQADLSYTM

SEQ ID NO: 127932 - protein, 9 aa, Artificial Sequence
  Description of Artificial Sequence: Synthetic peptide
  Seed: AVVSTQLIM (PMEL_HUMAN)
AMVSTQLIM

SEQ ID NO: 127933 - protein, 10 aa, Artificial Sequence
  Description of Artificial Sequence: Synthetic peptide
  Seed: MAVVLASLIY (PMEL_HUMAN)
MLVVLASLIF

SEQ ID NO: 127934 - protein, 9 aa, Artificial Sequence
  Description of Artificial Sequence: Synthetic peptide
  Seed: SSIMSTESI (PMEL_HUMAN)
SNIMSTESY

SEQ ID NO: 127935 - protein, 9 aa, Artificial Sequence
  Description of Artificial Sequence: Synthetic peptide
  Seed: SQKRSFVYV (PMEL_HUMAN)
SQKRSFVYI

SEQ ID NO: 127936 - protein, 9 aa, Artificial Sequence
  Description of Artificial Sequence: Synthetic peptide
  Seed: GQVPTTEVV (PMEL_HUMAN)
GDVPTTEVL

SEQ ID NO: 127937 - protein, 10 aa, Artificial Sequence
  Description of Artificial Sequence: Synthetic peptide
  Seed: MTPAEVSIVV (PMEL_HUMAN)
MFPAEVSIVI

SEQ ID NO: 127938 - protein, 10 aa, Artificial Sequence
  Description of Artificial Sequence: Synthetic peptide
  Seed: MTPAEVSIVV (PMEL_HUMAN)
MLPAEVSIVY

SEQ ID NO: 127939 - protein, 9 aa, Artificial Sequence
  Description of Artificial Sequence: Synthetic peptide
  Seed: AQVTTTEWV (PMEL_HUMAN)
AMVTTTEWV

SEQ ID NO: 127940 - protein, 10 aa, Artificial Sequence
  Description of Artificial Sequence: Synthetic peptide
  Seed: TYLEPGPVTA (PMEL_HUMAN)
TRLEPGPVTY

SEQ ID NO: 127941 - protein, 9 aa, Artificial Sequence
  Description of Artificial Sequence: Synthetic peptide
  Seed: TTPGQAPTA (PMEL_HUMAN)
TTPGQAPTV

SEQ ID NO: 127942 - protein, 9 aa, Artificial Sequence
  Description of Artificial Sequence: Synthetic peptide
  Seed: VWKTWGQYW (PMEL_HUMAN)
VSKTWGQYF

SEQ ID NO: 127943 - protein, 10 aa, Artificial Sequence
  Description of Artificial Sequence: Synthetic peptide
  Seed: IESAEILQAV (PMEL_HUMAN)
IISAEILQAI

SEQ ID NO: 127944 - protein, 10 aa, Artificial Sequence
  Description of Artificial Sequence: Synthetic peptide
  Seed: RALDGGNKHF (PMEL_HUMAN)
RRLDGGNKHF

SEQ ID NO: 127945 - protein, 9 aa, Artificial Sequence
  Description of Artificial Sequence: Synthetic peptide
  Seed: TAEAPNTTA (PMEL_HUMAN)
TGEAPNTTM

SEQ ID NO: 127946 - protein, 10 aa, Artificial Sequence
  Description of Artificial Sequence: Synthetic peptide
  Seed: TDQVPFSVSV (PMEL_HUMAN)
TIQVPFSVSV

SEQ ID NO: 127947 - protein, 10 aa, Artificial Sequence
  Description of Artificial Sequence: Synthetic peptide
  Seed: VLMAVVLASL (PMEL_HUMAN)
VQMAVVLASM

SEQ ID NO: 127948 - protein, 9 aa, Artificial Sequence
  Description of Artificial Sequence: Synthetic peptide
  Seed: GTYCLNVSL (PMEL_HUMAN)
GYYCLNVSY

SEQ ID NO: 127949 - protein, 8 aa, Artificial Sequence
  Description of Artificial Sequence: Synthetic peptide
  Seed: KAWNRQLY (PMEL_HUMAN)
KTWNRQLW

SEQ ID NO: 127950 - protein, 9 aa, Artificial Sequence
  Description of Artificial Sequence: Synthetic peptide
  Seed: RALVVTHTY (PMEL_HUMAN)
RYLVVTHTF

SEQ ID NO: 127951 - protein, 9 aa, Artificial Sequence
  Description of Artificial Sequence: Synthetic peptide
  Seed: DQVPFSVSV (PMEL_HUMAN)
DAVPFSVSY

SEQ ID NO: 127952 - protein, 9 aa, Artificial Sequence
  Description of Artificial Sequence: Synthetic peptide
  Seed: SITGSLGPL (PMEL_HUMAN)
SLTGSLGPA

SEQ ID NO: 127953 - protein, 11 aa, Artificial Sequence
  Description of Artificial Sequence: Synthetic peptide
  Seed: ITDQVPFSVSV (PMEL_HUMAN)
IMDQVPFSVSI

SEQ ID NO: 127954 - protein, 10 aa, Artificial Sequence
  Description of Artificial Sequence: Synthetic peptide
  Seed: MTPAEVSIVV (PMEL_HUMAN)
MPPAEVSIVT

SEQ ID NO: 127955 - protein, 9 aa, Artificial Sequence
  Description of Artificial Sequence: Synthetic peptide
  Seed: RTKAWNRQL (PMEL_HUMAN)
RFKAWNRQK

SEQ ID NO: 127956 - protein, 10 aa, Artificial Sequence
  Description of Artificial Sequence: Synthetic peptide
  Seed: VLYRYGSFSV (PMEL_HUMAN)
VIYRYGSFSV

SEQ ID NO: 127957 - protein, 10 aa, Artificial Sequence
  Description of Artificial Sequence: Synthetic peptide
  Seed: FSVSVSQLRA (PMEL_HUMAN)
FGVSVSQLRR

SEQ ID NO: 127958 - protein, 9 aa, Artificial Sequence
  Description of Artificial Sequence: Synthetic peptide
  Seed: AEMSTPEAT (PMEL_HUMAN)
ADMSTPEAL

SEQ ID NO: 127959 - protein, 9 aa, Artificial Sequence
  Description of Artificial Sequence: Synthetic peptide
  Seed: AQVVLQAAI (PMEL_HUMAN)
AMVVLQAAI

SEQ ID NO: 127960 - protein, 9 aa, Artificial Sequence
  Description of Artificial Sequence: Synthetic peptide
  Seed: MAVVLASLI (PMEL_HUMAN)
MRVVLASLM

SEQ ID NO: 127961 - protein, 9 aa, Artificial Sequence
  Description of Artificial Sequence: Synthetic peptide
  Seed: VTLDIVQGI (PMEL_HUMAN)
VMLDIVQGA

SEQ ID NO: 127962 - protein, 9 aa, Artificial Sequence
  Description of Artificial Sequence: Synthetic peptide
  Seed: IYRRRLMKQ (PMEL_HUMAN)
ITRRRLMKM

SEQ ID NO: 127963 - protein, 9 aa, Artificial Sequence
  Description of Artificial Sequence: Synthetic peptide
  Seed: AEPSGTTSV (PMEL_HUMAN)
ACPSGTTSF

SEQ ID NO: 127964 - protein, 9 aa, Artificial Sequence
  Description of Artificial Sequence: Synthetic peptide
  Seed: LADTNSLAV (PMEL_HUMAN)
LSDTNSLAM

SEQ ID NO: 127965 - protein, 11 aa, Artificial Sequence
  Description of Artificial Sequence: Synthetic peptide
  Seed: RRGSRSYVPLA (PMEL_HUMAN)
RTGSRSYVPLA

SEQ ID NO: 127966 - protein, 9 aa, Artificial Sequence
  Description of Artificial Sequence: Synthetic peptide
  Seed: QVWGGQPVY (PMEL_HUMAN)
QSWGGQPVK

SEQ ID NO: 127967 - protein, 9 aa, Artificial Sequence
  Description of Artificial Sequence: Synthetic peptide
  Seed: GSRSYVPLA (PMEL_HUMAN)
GSRSYVPLR

SEQ ID NO: 127968 - protein, 10 aa, Artificial Sequence
  Description of Artificial Sequence: Synthetic peptide
  Seed: LAVVSTQLIM (PMEL_HUMAN)
LTVVSTQLIM

SEQ ID NO: 127969 - protein, 9 aa, Artificial Sequence
  Description of Artificial Sequence: Synthetic peptide
  Seed: YPQETDDAC (PMEL_HUMAN)
YPQETDDAL

SEQ ID NO: 127970 - protein, 10 aa, Artificial Sequence
  Description of Artificial Sequence: Synthetic peptide
  Seed: GPLLDGTATL (PMEL_HUMAN)
GCLLDGTATV

SEQ ID NO: 127971 - protein, 10 aa, Artificial Sequence
  Description of Artificial Sequence: Synthetic peptide
  Seed: RGSRSYVPLA (PMEL_HUMAN)
RHSRSYVPLR

SEQ ID NO: 127972 - protein, 11 aa, Artificial Sequence
  Description of Artificial Sequence: Synthetic peptide
  Seed: TWDFGDSSGTL (PMEL_HUMAN)
TSDFGDSSGTL

SEQ ID NO: 127973 - protein, 9 aa, Artificial Sequence
  Description of Artificial Sequence: Synthetic peptide
  Seed: HTMEVTVYH (PMEL_HUMAN)
HYMEVTVYF

SEQ ID NO: 127974 - protein, 9 aa, Artificial Sequence
  Description of Artificial Sequence: Synthetic peptide
  Seed: FSVSVSQLR (PMEL_HUMAN)
FTVSVSQLY

SEQ ID NO: 127975 - protein, 9 aa, Artificial Sequence
  Description of Artificial Sequence: Synthetic peptide
  Seed: YHRRGSRSY (PMEL_HUMAN)
YQRRGSRSL

SEQ ID NO: 127976 - protein, 10 aa, Artificial Sequence
  Description of Artificial Sequence: Synthetic peptide
  Seed: AEAPNTTAGQ (PMEL_HUMAN)
AEAPNTTAGV

SEQ ID NO: 127977 - protein, 9 aa, Artificial Sequence
  Description of Artificial Sequence: Synthetic peptide
  Seed: ISRALVVTH (PMEL_HUMAN)
IIRALVVTY

SEQ ID NO: 127978 - protein, 9 aa, Artificial Sequence
  Description of Artificial Sequence: Synthetic peptide
  Seed: FSVSVSQLR (PMEL_HUMAN)
FIVSVSQLY

SEQ ID NO: 127979 - protein, 10 aa, Artificial Sequence
  Description of Artificial Sequence: Synthetic peptide
  Seed: SLIYRRRLMK (PMEL_HUMAN)
SYIYRRRLMK

SEQ ID NO: 127980 - protein, 9 aa, Artificial Sequence
  Description of Artificial Sequence: Synthetic peptide
  Seed: TPAEVSIVV (PMEL_HUMAN)
TTAEVSIVF

SEQ ID NO: 127981 - protein, 9 aa, Artificial Sequence
  Description of Artificial Sequence: Synthetic peptide
  Seed: VLYRYGSFS (PMEL_HUMAN)
VLYRYGSFA

SEQ ID NO: 127982 - protein, 9 aa, Artificial Sequence
  Description of Artificial Sequence: Synthetic peptide
  Seed: MSTPEATGM (PMEL_HUMAN)
MVTPEATGY

SEQ ID NO: 127983 - protein, 9 aa, Artificial Sequence
  Description of Artificial Sequence: Synthetic peptide
  Seed: KAWNRQLYP (PMEL_HUMAN)
KMWNRQLYI

SEQ ID NO: 127984 - protein, 9 aa, Artificial Sequence
  Description of Artificial Sequence: Synthetic peptide
  Seed: SSIMSTESI (PMEL_HUMAN)
SQIMSTESF

SEQ ID NO: 127985 - protein, 9 aa, Artificial Sequence
  Description of Artificial Sequence: Synthetic peptide
  Seed: SQKRSFVYV (PMEL_HUMAN)
SQKRSFVYK

SEQ ID NO: 127986 - protein, 9 aa, Artificial Sequence
  Description of Artificial Sequence: Synthetic peptide
  Seed: ALNFPGSQK (PMEL_HUMAN)
AANFPGSQM

SEQ ID NO: 127987 - protein, 9 aa, Artificial Sequence
  Description of Artificial Sequence: Synthetic peptide
  Seed: LADTNSLAV (PMEL_HUMAN)
LFDTNSLAM

SEQ ID NO: 127988 - protein, 10 aa, Artificial Sequence
  Description of Artificial Sequence: Synthetic peptide
  Seed: TLAEMSTPEA (PMEL_HUMAN)
TLAEMSTPEL

SEQ ID NO: 127989 - protein, 9 aa, Artificial Sequence
  Description of Artificial Sequence: Synthetic peptide
  Seed: AVIGALLAV (PMEL_HUMAN)
ATIGALLAW

SEQ ID NO: 127990 - protein, 9 aa, Artificial Sequence
  Description of Artificial Sequence: Synthetic peptide
  Seed: AHSSSAFTI (PMEL_HUMAN)
AMSSSAFTM

SEQ ID NO: 127991 - protein, 10 aa, Artificial Sequence
  Description of Artificial Sequence: Synthetic peptide
  Seed: YRYGSFSVTL (PMEL_HUMAN)
YPYGSFSVTF

SEQ ID NO: 127992 - protein, 9 aa, Artificial Sequence
  Description of Artificial Sequence: Synthetic peptide
  Seed: VTAQVVLQA (PMEL_HUMAN)
VLAQVVLQI

SEQ ID NO: 127993 - protein, 10 aa, Artificial Sequence
  Description of Artificial Sequence: Synthetic peptide
  Seed: SLADTNSLAV (PMEL_HUMAN)
SLADTNSLAF

SEQ ID NO: 127994 - protein, 9 aa, Artificial Sequence
  Description of Artificial Sequence: Synthetic peptide
  Seed: AEPSGTTSV (PMEL_HUMAN)
AMPSGTTSV

SEQ ID NO: 127995 - protein, 10 aa, Artificial Sequence
  Description of Artificial Sequence: Synthetic peptide
  Seed: MTPAEVSIVV (PMEL_HUMAN)
MQPAEVSIVS

SEQ ID NO: 127996 - protein, 10 aa, Artificial Sequence
  Description of Artificial Sequence: Synthetic peptide
  Seed: YLAEADLSYT (PMEL_HUMAN)
YLAEADLSYA

SEQ ID NO: 127997 - protein, 9 aa, Artificial Sequence
  Description of Artificial Sequence: Synthetic peptide
  Seed: LPDGQVIWV (PMEL_HUMAN)
LYDGQVIWL

SEQ ID NO: 127998 - protein, 11 aa, Artificial Sequence
  Description of Artificial Sequence: Synthetic peptide
  Seed: SQVWGGQPVYP (PMEL_HUMAN)
SMVWGGQPVYF

SEQ ID NO: 127999 - protein, 9 aa, Artificial Sequence
  Description of Artificial Sequence: Synthetic peptide
  Seed: AQRLCQPVL (PMEL_HUMAN)
ALRLCQPVF

SEQ ID NO: 128000 - protein, 10 aa, Artificial Sequence
  Description of Artificial Sequence: Synthetic peptide
  Seed: KRQVPLDCVL (PMEL_HUMAN)
KSQVPLDCVM

SEQ ID NO: 128001 - protein, 9 aa, Artificial Sequence
  Description of Artificial Sequence: Synthetic peptide
  Seed: LIYRRRLMK (PMEL_HUMAN)
LLYRRRLMY

SEQ ID NO: 128002 - protein, 10 aa, Artificial Sequence
  Description of Artificial Sequence: Synthetic peptide
  Seed: AEADLSYTWD (PMEL_HUMAN)
AEADLSYTWQ

SEQ ID NO: 128003 - protein, 9 aa, Artificial Sequence
  Description of Artificial Sequence: Synthetic peptide
  Seed: LSIGTGRAM (PMEL_HUMAN)
LNIGTGRAM

SEQ ID NO: 128004 - protein, 10 aa, Artificial Sequence
  Description of Artificial Sequence: Synthetic peptide
  Seed: YRYGSFSVTL (PMEL_HUMAN)
YCYGSFSVTI

SEQ ID NO: 128005 - protein, 11 aa, Artificial Sequence
  Description of Artificial Sequence: Synthetic peptide
  Seed: VYVWKTWGQYW (PMEL_HUMAN)
VWVWKTWGQYF

SEQ ID NO: 128006 - protein, 9 aa, Artificial Sequence
  Description of Artificial Sequence: Synthetic peptide
  Seed: GSSPVPGTT (PMEL_HUMAN)
GSSPVPGTY

SEQ ID NO: 128007 - protein, 9 aa, Artificial Sequence
  Description of Artificial Sequence: Synthetic peptide
  Seed: VSVSQLRAL (PMEL_HUMAN)
VAVSQLRAW

SEQ ID NO: 128008 - protein, 10 aa, Artificial Sequence
  Description of Artificial Sequence: Synthetic peptide
  Seed: MTPAEVSIVV (PMEL_HUMAN)
MCPAEVSIVA

SEQ ID NO: 128009 - protein, 10 aa, Artificial Sequence
  Description of Artificial Sequence: Synthetic peptide
  Seed: LGQVPLIVGI (PMEL_HUMAN)
LPQVPLIVGV

SEQ ID NO: 128010 - protein, 9 aa, Artificial Sequence
  Description of Artificial Sequence: Synthetic peptide
  Seed: MAVVLASLI (PMEL_HUMAN)
MNVVLASLF

SEQ ID NO: 128011 - protein, 11 aa, Artificial Sequence
  Description of Artificial Sequence: Synthetic peptide
  Seed: SYVPLAHSSSA (PMEL_HUMAN)
SIVPLAHSSSF

SEQ ID NO: 128012 - protein, 9 aa, Artificial Sequence
  Description of Artificial Sequence: Synthetic peptide
  Seed: YLAEADLSY (PMEL_HUMAN)
YPAEADLSS

SEQ ID NO: 128013 - protein, 10 aa, Artificial Sequence
  Description of Artificial Sequence: Synthetic peptide
  Seed: SGTYCLNVSL (PMEL_HUMAN)
SYTYCLNVSY

SEQ ID NO: 128014 - protein, 9 aa, Artificial Sequence
  Description of Artificial Sequence: Synthetic peptide
  Seed: VLYRYGSFS (PMEL_HUMAN)
VMYRYGSFL

SEQ ID NO: 128015 - protein, 10 aa, Artificial Sequence
  Description of Artificial Sequence: Synthetic peptide
  Seed: VPLIVGILLV (PMEL_HUMAN)
VKLIVGILLV

SEQ ID NO: 128016 - protein, 9 aa, Artificial Sequence
  Description of Artificial Sequence: Synthetic peptide
  Seed: EGDAFELTV (PMEL_HUMAN)
EMDAFELTL

SEQ ID NO: 128017 - protein, 10 aa, Artificial Sequence
  Description of Artificial Sequence: Synthetic peptide
  Seed: KRQVPLDCVL (PMEL_HUMAN)
KAQVPLDCVM

SEQ ID NO: 128018 - protein, 9 aa, Artificial Sequence
  Description of Artificial Sequence: Synthetic peptide
  Seed: VISTAPVQM (PMEL_HUMAN)
VASTAPVQH

SEQ ID NO: 128019 - protein, 9 aa, Artificial Sequence
  Description of Artificial Sequence: Synthetic peptide
  Seed: ALNFPGSQK (PMEL_HUMAN)
ALNFPGSQR

SEQ ID NO: 128020 - protein, 9 aa, Artificial Sequence
  Description of Artificial Sequence: Synthetic peptide
  Seed: SPLLSGQQV (PMEL_HUMAN)
SPLLSGQQW

SEQ ID NO: 128021 - protein, 9 aa, Artificial Sequence
  Description of Artificial Sequence: Synthetic peptide
  Seed: LSIGTGRAM (PMEL_HUMAN)
LTIGTGRAL

SEQ ID NO: 128022 - protein, 9 aa, Artificial Sequence
  Description of Artificial Sequence: Synthetic peptide
  Seed: GGPVSGLSI (PMEL_HUMAN)
GAPVSGLSM

SEQ ID NO: 128023 - protein, 10 aa, Artificial Sequence
  Description of Artificial Sequence: Synthetic peptide
  Seed: YRYGSFSVTL (PMEL_HUMAN)
YTYGSFSVTM

SEQ ID NO: 128024 - protein, 10 aa, Artificial Sequence
  Description of Artificial Sequence: Synthetic peptide
  Seed: AVIGALLAVG (PMEL_HUMAN)
AMIGALLAVC

SEQ ID NO: 128025 - protein, 10 aa, Artificial Sequence
  Description of Artificial Sequence: Synthetic peptide
  Seed: AVIGALLAVG (PMEL_HUMAN)
AQIGALLAVH

SEQ ID NO: 128026 - protein, 9 aa, Artificial Sequence
  Description of Artificial Sequence: Synthetic peptide
  Seed: MAVVLASLI (PMEL_HUMAN)
MEVVLASLM

SEQ ID NO: 128027 - protein, 10 aa, Artificial Sequence
  Description of Artificial Sequence: Synthetic peptide
  Seed: VLMAVVLASL (PMEL_HUMAN)
VDMAVVLASA

SEQ ID NO: 128028 - protein, 10 aa, Artificial Sequence
  Description of Artificial Sequence: Synthetic peptide
  Seed: YRYGSFSVTL (PMEL_HUMAN)
YTYGSFSVTW

SEQ ID NO: 128029 - protein, 9 aa, Artificial Sequence
  Description of Artificial Sequence: Synthetic peptide
  Seed: ALVVTHTYL (PMEL_HUMAN)
AMVVTHTYF

SEQ ID NO: 128030 - protein, 9 aa, Artificial Sequence
  Description of Artificial Sequence: Synthetic peptide
  Seed: AEADLSYTW (PMEL_HUMAN)
AAADLSYTF

SEQ ID NO: 128031 - protein, 9 aa, Artificial Sequence
  Description of Artificial Sequence: Synthetic peptide
  Seed: KTWGQYWQV (PMEL_HUMAN)
KLWGQYWQL

SEQ ID NO: 128032 - protein, 9 aa, Artificial Sequence
  Description of Artificial Sequence: Synthetic peptide
  Seed: AAQVTTTEW (PMEL_HUMAN)
AAQVTTTEF

SEQ ID NO: 128033 - protein, 9 aa, Artificial Sequence
  Description of Artificial Sequence: Synthetic peptide
  Seed: VLASLIYRR (PMEL_HUMAN)
VFASLIYRK

SEQ ID NO: 128034 - protein, 9 aa, Artificial Sequence
  Description of Artificial Sequence: Synthetic peptide
  Seed: GANASFSIA (PMEL_HUMAN)
GMNASFSIK

SEQ ID NO: 128035 - protein, 8 aa, Artificial Sequence
  Description of Artificial Sequence: Synthetic peptide
  Seed: TLDIVQGI (PMEL_HUMAN)
TIDIVQGI

SEQ ID NO: 128036 - protein, 9 aa, Artificial Sequence
  Description of Artificial Sequence: Synthetic peptide
  Seed: MTPAEVSIV (PMEL_HUMAN)
MCPAEVSIL

SEQ ID NO: 128037 - protein, 9 aa, Artificial Sequence
  Description of Artificial Sequence: Synthetic peptide
  Seed: DAFELTVSC (PMEL_HUMAN)
DAFELTVSM

SEQ ID NO: 128038 - protein, 10 aa, Artificial Sequence
  Description of Artificial Sequence: Synthetic peptide
  Seed: MPTAESTGMT (PMEL_HUMAN)
MGTAESTGMV

SEQ ID NO: 128039 - protein, 10 aa, Artificial Sequence
  Description of Artificial Sequence: Synthetic peptide
  Seed: PTLIGANASF (PMEL_HUMAN)
PMLIGANASF

SEQ ID NO: 128040 - protein, 10 aa, Artificial Sequence
  Description of Artificial Sequence: Synthetic peptide
  Seed: ESITGSLGPL (PMEL_HUMAN)
EIITGSLGPI

SEQ ID NO: 128041 - protein, 10 aa, Artificial Sequence
  Description of Artificial Sequence: Synthetic peptide
  Seed: MSTESITGSL (PMEL_HUMAN)
MATESITGSV

SEQ ID NO: 128042 - protein, 10 aa, Artificial Sequence
  Description of Artificial Sequence: Synthetic peptide
  Seed: RRLMKQDFSV (PMEL_HUMAN)
RHLMKQDFSI

SEQ ID NO: 128043 - protein, 10 aa, Artificial Sequence
  Description of Artificial Sequence: Synthetic peptide
  Seed: RQLRTKAWNR (PMEL_HUMAN)
RRLRTKAWNL

SEQ ID NO: 128044 - protein, 9 aa, Artificial Sequence
  Description of Artificial Sequence: Synthetic peptide
  Seed: KHFLRNQPL (PMEL_HUMAN)
KRFLRNQPI

SEQ ID NO: 128045 - protein, 10 aa, Artificial Sequence
  Description of Artificial Sequence: Synthetic peptide
  Seed: EVSIVVLSGT (PMEL_HUMAN)
EWSIVVLSGV

SEQ ID NO: 128046 - protein, 10 aa, Artificial Sequence
  Description of Artificial Sequence: Synthetic peptide
  Seed: KRSFVYVWKT (PMEL_HUMAN)
KRSFVYVWKV

SEQ ID NO: 128047 - protein, 10 aa, Artificial Sequence
  Description of Artificial Sequence: Synthetic peptide
  Seed: RRLMKQDFSV (PMEL_HUMAN)
RRLMKQDFSR

SEQ ID NO: 128048 - protein, 10 aa, Artificial Sequence
  Description of Artificial Sequence: Synthetic peptide
  Seed: YVPLAHSSSA (PMEL_HUMAN)
YEPLAHSSSF

SEQ ID NO: 128049 - protein, 9 aa, Artificial Sequence
  Description of Artificial Sequence: Synthetic peptide
  Seed: HLAVIGALL (PMEL_HUMAN)
HQAVIGALW

SEQ ID NO: 128050 - protein, 9 aa, Artificial Sequence
  Description of Artificial Sequence: Synthetic peptide
  Seed: SPLLSGQQV (PMEL_HUMAN)
SPLLSGQQY

SEQ ID NO: 128051 - protein, 8 aa, Artificial Sequence
  Description of Artificial Sequence: Synthetic peptide
  Seed: VIWVNNTI (PMEL_HUMAN)
VQWVNNTV

SEQ ID NO: 128052 - protein, 10 aa, Artificial Sequence
  Description of Artificial Sequence: Synthetic peptide
  Seed: MKQDFSVPQL (PMEL_HUMAN)
MKQDFSVPQM

SEQ ID NO: 128053 - protein, 10 aa, Artificial Sequence
  Description of Artificial Sequence: Synthetic peptide
  Seed: RQLYPEWTEA (PMEL_HUMAN)
RLLYPEWTEY

SEQ ID NO: 128054 - protein, 10 aa, Artificial Sequence
  Description of Artificial Sequence: Synthetic peptide
  Seed: SQKRSFVYVW (PMEL_HUMAN)
SLKRSFVYVY

SEQ ID NO: 128055 - protein, 9 aa, Artificial Sequence
  Description of Artificial Sequence: Synthetic peptide
  Seed: AGQVPTTEV (PMEL_HUMAN)
ASQVPTTEL

SEQ ID NO: 128056 - protein, 9 aa, Artificial Sequence
  Description of Artificial Sequence: Synthetic peptide
  Seed: LADTNSLAV (PMEL_HUMAN)
LQDTNSLAF

SEQ ID NO: 128057 - protein, 9 aa, Artificial Sequence
  Description of Artificial Sequence: Synthetic peptide
  Seed: TLIGANASF (PMEL_HUMAN)
TSIGANASM

SEQ ID NO: 128058 - protein, 11 aa, Artificial Sequence
  Description of Artificial Sequence: Synthetic peptide
  Seed: LVLMAVVLASL (PMEL_HUMAN)
LRLMAVVLASI

SEQ ID NO: 128059 - protein, 10 aa, Artificial Sequence
  Description of Artificial Sequence: Synthetic peptide
  Seed: GDSSGTLISR (PMEL_HUMAN)
GKSSGTLISK

SEQ ID NO: 128060 - protein, 9 aa, Artificial Sequence
  Description of Artificial Sequence: Synthetic peptide
  Seed: VTLDIVQGI (PMEL_HUMAN)
VRLDIVQGF

SEQ ID NO: 128061 - protein, 10 aa, Artificial Sequence
  Description of Artificial Sequence: Synthetic peptide
  Seed: AVVLASLIYR (PMEL_HUMAN)
ATVLASLIYR

SEQ ID NO: 128062 - protein, 10 aa, Artificial Sequence
  Description of Artificial Sequence: Synthetic peptide
  Seed: LLVLMAVVLA (PMEL_HUMAN)
LLVLMAVVLV

SEQ ID NO: 128063 - protein, 10 aa, Artificial Sequence
  Description of Artificial Sequence: Synthetic peptide
  Seed: RRLMKQDFSV (PMEL_HUMAN)
RNLMKQDFSL

SEQ ID NO: 128064 - protein, 10 aa, Artificial Sequence
  Description of Artificial Sequence: Synthetic peptide
  Seed: RQLYPEWTEA (PMEL_HUMAN)
RMLYPEWTEY

SEQ ID NO: 128065 - protein, 10 aa, Artificial Sequence
  Description of Artificial Sequence: Synthetic peptide
  Seed: YLAEADLSYT (PMEL_HUMAN)
YMAEADLSYH

SEQ ID NO: 128066 - protein, 9 aa, Artificial Sequence
  Description of Artificial Sequence: Synthetic peptide
  Seed: STAPVQMPT (PMEL_HUMAN)
SQAPVQMPL

SEQ ID NO: 128067 - protein, 10 aa, Artificial Sequence
  Description of Artificial Sequence: Synthetic peptide
  Seed: ALDGGNKHFL (PMEL_HUMAN)
AVDGGNKHFM

SEQ ID NO: 128068 - protein, 10 aa, Artificial Sequence
  Description of Artificial Sequence: Synthetic peptide
  Seed: RQVPLDCVLY (PMEL_HUMAN)
RFVPLDCVLY

SEQ ID NO: 128069 - protein, 9 aa, Artificial Sequence
  Description of Artificial Sequence: Synthetic peptide
  Seed: GTATLRLVK (PMEL_HUMAN)
GLATLRLVK

SEQ ID NO: 128070 - protein, 11 aa, Artificial Sequence
  Description of Artificial Sequence: Synthetic peptide
  Seed: RRGSRSYVPLA (PMEL_HUMAN)
RWGSRSYVPLA

SEQ ID NO: 128071 - protein, 11 aa, Artificial Sequence
  Description of Artificial Sequence: Synthetic peptide
  Seed: KVLPDGQVIWV (PMEL_HUMAN)
KILPDGQVIWW

SEQ ID NO: 128072 - protein, 10 aa, Artificial Sequence
  Description of Artificial Sequence: Synthetic peptide
  Seed: VSLADTNSLA (PMEL_HUMAN)
VPLADTNSLL

SEQ ID NO: 128073 - protein, 9 aa, Artificial Sequence
  Description of Artificial Sequence: Synthetic peptide
  Seed: TPAEVSIVV (PMEL_HUMAN)
TLAEVSIVV

SEQ ID NO: 128074 - protein, 9 aa, Artificial Sequence
  Description of Artificial Sequence: Synthetic peptide
  Seed: TTDGHRPTA (PMEL_HUMAN)
TADGHRPTM

SEQ ID NO: 128075 - protein, 9 aa, Artificial Sequence
  Description of Artificial Sequence: Synthetic peptide
  Seed: VLYRYGSFS (PMEL_HUMAN)
VQYRYGSFV

SEQ ID NO: 128076 - protein, 11 aa, Artificial Sequence
  Description of Artificial Sequence: Synthetic peptide
  Seed: RALDGGNKHFL (PMEL_HUMAN)
RMLDGGNKHFY

SEQ ID NO: 128077 - protein, 10 aa, Artificial Sequence
  Description of Artificial Sequence: Synthetic peptide
  Seed: KTWGQYWQVL (PMEL_HUMAN)
KVWGQYWQVL

SEQ ID NO: 128078 - protein, 9 aa, Artificial Sequence
  Description of Artificial Sequence: Synthetic peptide
  Seed: LTVSCQGGL (PMEL_HUMAN)
LSVSCQGGY

SEQ ID NO: 128079 - protein, 9 aa, Artificial Sequence
  Description of Artificial Sequence: Synthetic peptide
  Seed: VQMPTAEST (PMEL_HUMAN)
VSMPTAESF

SEQ ID NO: 128080 - protein, 10 aa, Artificial Sequence
  Description of Artificial Sequence: Synthetic peptide
  Seed: YRYGSFSVTL (PMEL_HUMAN)
YYYGSFSVTF

SEQ ID NO: 128081 - protein, 9 aa, Artificial Sequence
  Description of Artificial Sequence: Synthetic peptide
  Seed: MSTPEATGM (PMEL_HUMAN)
MVTPEATGL

SEQ ID NO: 128082 - protein, 9 aa, Artificial Sequence
  Description of Artificial Sequence: Synthetic peptide
  Seed: VSLADTNSL (PMEL_HUMAN)
VPLADTNSY

SEQ ID NO: 128083 - protein, 10 aa, Artificial Sequence
  Description of Artificial Sequence: Synthetic peptide
  Seed: VTAQVVLQAA (PMEL_HUMAN)
VTAQVVLQAV

SEQ ID NO: 128084 - protein, 10 aa, Artificial Sequence
  Description of Artificial Sequence: Synthetic peptide
  Seed: AVVLASLIYR (PMEL_HUMAN)
ATVLASLIYY

SEQ ID NO: 128085 - protein, 10 aa, Artificial Sequence
  Description of Artificial Sequence: Synthetic peptide
  Seed: GSFSVTLDIV (PMEL_HUMAN)
GLFSVTLDIV

SEQ ID NO: 128086 - protein, 10 aa, Artificial Sequence
  Description of Artificial Sequence: Synthetic peptide
  Seed: GTYCLNVSLA (PMEL_HUMAN)
GMYCLNVSLI

SEQ ID NO: 128087 - protein, 9 aa, Artificial Sequence
  Description of Artificial Sequence: Synthetic peptide
  Seed: VLKRCLLHL (PMEL_HUMAN)
VLKRCLLHK

SEQ ID NO: 128088 - protein, 9 aa, Artificial Sequence
  Description of Artificial Sequence: Synthetic peptide
  Seed: KTWGQYWQV (PMEL_HUMAN)
KIWGQYWQV

SEQ ID NO: 128089 - protein, 9 aa, Artificial Sequence
  Description of Artificial Sequence: Synthetic peptide
  Seed: YHRRGSRSY (PMEL_HUMAN)
YFRRGSRSM

SEQ ID NO: 128090 - protein, 9 aa, Artificial Sequence
  Description of Artificial Sequence: Synthetic peptide
  Seed: VQVPTTEVI (PMEL_HUMAN)
VSVPTTEVF

SEQ ID NO: 128091 - protein, 10 aa, Artificial Sequence
  Description of Artificial Sequence: Synthetic peptide
  Seed: TAAQVTTTEW (PMEL_HUMAN)
TPAQVTTTEW

SEQ ID NO: 128092 - protein, 11 aa, Artificial Sequence
  Description of Artificial Sequence: Synthetic peptide
  Seed: SLKVSNDGPTL (PMEL_HUMAN)
SLKVSNDGPTY

SEQ ID NO: 128093 - protein, 10 aa, Artificial Sequence
  Description of Artificial Sequence: Synthetic peptide
  Seed: GPLLDGTATL (PMEL_HUMAN)
GGLLDGTATA

SEQ ID NO: 128094 - protein, 9 aa, Artificial Sequence
  Description of Artificial Sequence: Synthetic peptide
  Seed: TPAEVSIVV (PMEL_HUMAN)
THAEVSIVV

SEQ ID NO: 128095 - protein, 9 aa, Artificial Sequence
  Description of Artificial Sequence: Synthetic peptide
  Seed: FSVSVSQLR (PMEL_HUMAN)
FFVSVSQLR

SEQ ID NO: 128096 - protein, 9 aa, Artificial Sequence
  Description of Artificial Sequence: Synthetic peptide
  Seed: YLAEADLSY (PMEL_HUMAN)
YMAEADLSR

SEQ ID NO: 128097 - protein, 10 aa, Artificial Sequence
  Description of Artificial Sequence: Synthetic peptide
  Seed: VYHRRGSRSY (PMEL_HUMAN)
VKHRRGSRSY

SEQ ID NO: 128098 - protein, 9 aa, Artificial Sequence
  Description of Artificial Sequence: Synthetic peptide
  Seed: RTKAWNRQL (PMEL_HUMAN)
RIKAWNRQF

SEQ ID NO: 128099 - protein, 9 aa, Artificial Sequence
  Description of Artificial Sequence: Synthetic peptide
  Seed: SVQVPTTEV (PMEL_HUMAN)
SLQVPTTEY

SEQ ID NO: 128100 - protein, 9 aa, Artificial Sequence
  Description of Artificial Sequence: Synthetic peptide
  Seed: ALNFPGSQK (PMEL_HUMAN)
AANFPGSQF

SEQ ID NO: 128101 - protein, 11 aa, Artificial Sequence
  Description of Artificial Sequence: Synthetic peptide
  Seed: VPQLPHSSSHW (PMEL_HUMAN)
VSQLPHSSSHW

SEQ ID NO: 128102 - protein, 10 aa, Artificial Sequence
  Description of Artificial Sequence: Synthetic peptide
  Seed: SSSHWLRLPR (PMEL_HUMAN)
SYSHWLRLPK

SEQ ID NO: 128103 - protein, 9 aa, Artificial Sequence
  Description of Artificial Sequence: Synthetic peptide
  Seed: LNFPGSQKV (PMEL_HUMAN)
LEFPGSQKL

SEQ ID NO: 128104 - protein, 9 aa, Artificial Sequence
  Description of Artificial Sequence: Synthetic peptide
  Seed: RALVVTHTY (PMEL_HUMAN)
RQLVVTHTH

SEQ ID NO: 128105 - protein, 9 aa, Artificial Sequence
  Description of Artificial Sequence: Synthetic peptide
  Seed: IMPGQEAGL (PMEL_HUMAN)
IMPGQEAGY

SEQ ID NO: 128106 - protein, 9 aa, Artificial Sequence
  Description of Artificial Sequence: Synthetic peptide
  Seed: SSPGCQPPA (PMEL_HUMAN)
SAPGCQPPM

SEQ ID NO: 128107 - protein, 10 aa, Artificial Sequence
  Description of Artificial Sequence: Synthetic peptide
  Seed: KRCLLHLAVI (PMEL_HUMAN)
KRCLLHLAVF

SEQ ID NO: 128108 - protein, 10 aa, Artificial Sequence
  Description of Artificial Sequence: Synthetic peptide
  Seed: LPHSSSHWLR (PMEL_HUMAN)
LIHSSSHWLR

SEQ ID NO: 128109 - protein, 9 aa, Artificial Sequence
  Description of Artificial Sequence: Synthetic peptide
  Seed: RSYVPLAHS (PMEL_HUMAN)
RLYVPLAHK

SEQ ID NO: 128110 - protein, 9 aa, Artificial Sequence
  Description of Artificial Sequence: Synthetic peptide
  Seed: WQVLGGPVS (PMEL_HUMAN)
WAVLGGPVY

SEQ ID NO: 128111 - protein, 10 aa, Artificial Sequence
  Description of Artificial Sequence: Synthetic peptide
  Seed: AVIGALLAVG (PMEL_HUMAN)
AQIGALLAVS

SEQ ID NO: 128112 - protein, 9 aa, Artificial Sequence
  Description of Artificial Sequence: Synthetic peptide
  Seed: SLAVVSTQL (PMEL_HUMAN)
SMAVVSTQV

SEQ ID NO: 128113 - protein, 11 aa, Artificial Sequence
  Description of Artificial Sequence: Synthetic peptide
  Seed: MAVVLASLIYR (PMEL_HUMAN)
MQVVLASLIYR

SEQ ID NO: 128114 - protein, 11 aa, Artificial Sequence
  Description of Artificial Sequence: Synthetic peptide
  Seed: RALDGGNKHFL (PMEL_HUMAN)
RRLDGGNKHFL

SEQ ID NO: 128115 - protein, 9 aa, Artificial Sequence
  Description of Artificial Sequence: Synthetic peptide
  Seed: RALVVTHTY (PMEL_HUMAN)
RLLVVTHTI

SEQ ID NO: 128116 - protein, 10 aa, Artificial Sequence
  Description of Artificial Sequence: Synthetic peptide
  Seed: VLMAVVLASL (PMEL_HUMAN)
VFMAVVLASF

SEQ ID NO: 128117 - protein, 9 aa, Artificial Sequence
  Description of Artificial Sequence: Synthetic peptide
  Seed: VSLADTNSL (PMEL_HUMAN)
VMLADTNSY

SEQ ID NO: 128118 - protein, 11 aa, Artificial Sequence
  Description of Artificial Sequence: Synthetic peptide
  Seed: SAFTITDQVPF (PMEL_HUMAN)
SKFTITDQVPF

SEQ ID NO: 128119 - protein, 9 aa, Artificial Sequence
  Description of Artificial Sequence: Synthetic peptide
  Seed: FGDSSGTLI (PMEL_HUMAN)
FFDSSGTLV

SEQ ID NO: 128120 - protein, 10 aa, Artificial Sequence
  Description of Artificial Sequence: Synthetic peptide
  Seed: ESAEILQAVP (PMEL_HUMAN)
EVAEILQAVW

SEQ ID NO: 128121 - protein, 10 aa, Artificial Sequence
  Description of Artificial Sequence: Synthetic peptide
  Seed: RRLMKQDFSV (PMEL_HUMAN)
RMLMKQDFSV

SEQ ID NO: 128122 - protein, 10 aa, Artificial Sequence
  Description of Artificial Sequence: Synthetic peptide
  Seed: AEMSTPEATG (PMEL_HUMAN)
AEMSTPEATI

SEQ ID NO: 128123 - protein, 11 aa, Artificial Sequence
  Description of Artificial Sequence: Synthetic peptide
  Seed: VSLADTNSLAV (PMEL_HUMAN)
VFLADTNSLAL

SEQ ID NO: 128124 - protein, 9 aa, Artificial Sequence
  Description of Artificial Sequence: Synthetic peptide
  Seed: MLGTHTMEV (PMEL_HUMAN)
MTGTHTMEI

SEQ ID NO: 128125 - protein, 9 aa, Artificial Sequence
  Description of Artificial Sequence: Synthetic peptide
  Seed: AVGATKVPR (PMEL_HUMAN)
ATGATKVPK

SEQ ID NO: 128126 - protein, 8 aa, Artificial Sequence
  Description of Artificial Sequence: Synthetic peptide
  Seed: HTMEVTVY (PMEL_HUMAN)
HMMEVTVF

SEQ ID NO: 128127 - protein, 8 aa, Artificial Sequence
  Description of Artificial Sequence: Synthetic peptide
  Seed: LAHSSSAF (PMEL_HUMAN)
LLHSSSAY

SEQ ID NO: 128128 - protein, 10 aa, Artificial Sequence
  Description of Artificial Sequence: Synthetic peptide
  Seed: VLMAVVLASL (PMEL_HUMAN)
VNMAVVLASY

SEQ ID NO: 128129 - protein, 11 aa, Artificial Sequence
  Description of Artificial Sequence: Synthetic peptide
  Seed: RRLMKQDFSVP (PMEL_HUMAN)
RRLMKQDFSVL

SEQ ID NO: 128130 - protein, 10 aa, Artificial Sequence
  Description of Artificial Sequence: Synthetic peptide
  Seed: YVPLAHSSSA (PMEL_HUMAN)
YDPLAHSSSM

SEQ ID NO: 128131 - protein, 10 aa, Artificial Sequence
  Description of Artificial Sequence: Synthetic peptide
  Seed: VSLADTNSLA (PMEL_HUMAN)
VMLADTNSLM

SEQ ID NO: 128132 - protein, 9 aa, Artificial Sequence
  Description of Artificial Sequence: Synthetic peptide
  Seed: YPQETDDAC (PMEL_HUMAN)
YAQETDDAF

SEQ ID NO: 128133 - protein, 9 aa, Artificial Sequence
  Description of Artificial Sequence: Synthetic peptide
  Seed: ESAEILQAV (PMEL_HUMAN)
EEAEILQAL

SEQ ID NO: 128134 - protein, 9 aa, Artificial Sequence
  Description of Artificial Sequence: Synthetic peptide
  Seed: ESAEILQAV (PMEL_HUMAN)
ECAEILQAV

SEQ ID NO: 128135 - protein, 9 aa, Artificial Sequence
  Description of Artificial Sequence: Synthetic peptide
  Seed: LQLHDPSGY (PMEL_HUMAN)
LMLHDPSGM

SEQ ID NO: 128136 - protein, 10 aa, Artificial Sequence
  Description of Artificial Sequence: Synthetic peptide
  Seed: MPTAESTGMT (PMEL_HUMAN)
MATAESTGMA

SEQ ID NO: 128137 - protein, 9 aa, Artificial Sequence
  Description of Artificial Sequence: Synthetic peptide
  Seed: SQVWGGQPV (PMEL_HUMAN)
SQVWGGQPF

SEQ ID NO: 128138 - protein, 10 aa, Artificial Sequence
  Description of Artificial Sequence: Synthetic peptide
  Seed: YLAEADLSYT (PMEL_HUMAN)
YIAEADLSYV

SEQ ID NO: 128139 - protein, 9 aa, Artificial Sequence
  Description of Artificial Sequence: Synthetic peptide
  Seed: TTPGQAPTA (PMEL_HUMAN)
TAPGQAPTY

SEQ ID NO: 128140 - protein, 9 aa, Artificial Sequence
  Description of Artificial Sequence: Synthetic peptide
  Seed: SVQVPTTEV (PMEL_HUMAN)
SQQVPTTEL

SEQ ID NO: 128141 - protein, 10 aa, Artificial Sequence
  Description of Artificial Sequence: Synthetic peptide
  Seed: RGSRSYVPLA (PMEL_HUMAN)
RMSRSYVPLV

SEQ ID NO: 128142 - protein, 10 aa, Artificial Sequence
  Description of Artificial Sequence: Synthetic peptide
  Seed: GDSSGTLISR (PMEL_HUMAN)
GGSSGTLISK

SEQ ID NO: 128143 - protein, 10 aa, Artificial Sequence
  Description of Artificial Sequence: Synthetic peptide
  Seed: ESAEILQAVP (PMEL_HUMAN)
ESAEILQAVA

SEQ ID NO: 128144 - protein, 10 aa, Artificial Sequence
  Description of Artificial Sequence: Synthetic peptide
  Seed: LVLMAVVLAS (PMEL_HUMAN)
LGLMAVVLAI

SEQ ID NO: 128145 - protein, 10 aa, Artificial Sequence
  Description of Artificial Sequence: Synthetic peptide
  Seed: KTWGQYWQVL (PMEL_HUMAN)
KFWGQYWQVI

SEQ ID NO: 128146 - protein, 10 aa, Artificial Sequence
  Description of Artificial Sequence: Synthetic peptide
  Seed: LLHLAVIGAL (PMEL_HUMAN)
LMHLAVIGAV

SEQ ID NO: 128147 - protein, 10 aa, Artificial Sequence
  Description of Artificial Sequence: Synthetic peptide
  Seed: VLMAVVLASL (PMEL_HUMAN)
VTMAVVLASL

SEQ ID NO: 128148 - protein, 10 aa, Artificial Sequence
  Description of Artificial Sequence: Synthetic peptide
  Seed: GDSSGTLISR (PMEL_HUMAN)
GVSSGTLISR

SEQ ID NO: 128149 - protein, 9 aa, Artificial Sequence
  Description of Artificial Sequence: Synthetic peptide
  Seed: LPDGQVIWV (PMEL_HUMAN)
LADGQVIWM

SEQ ID NO: 128150 - protein, 11 aa, Artificial Sequence
  Description of Artificial Sequence: Synthetic peptide
  Seed: LGPLLDGTATL (PMEL_HUMAN)
LTPLLDGTATV

SEQ ID NO: 128151 - protein, 10 aa, Artificial Sequence
  Description of Artificial Sequence: Synthetic peptide
  Seed: VLMAVVLASL (PMEL_HUMAN)
VAMAVVLASL

SEQ ID NO: 128152 - protein, 10 aa, Artificial Sequence
  Description of Artificial Sequence: Synthetic peptide
  Seed: VLYRYGSFSV (PMEL_HUMAN)
VMYRYGSFSA

SEQ ID NO: 128153 - protein, 9 aa, Artificial Sequence
  Description of Artificial Sequence: Synthetic peptide
  Seed: ESAEILQAV (PMEL_HUMAN)
ENAEILQAR

SEQ ID NO: 128154 - protein, 10 aa, Artificial Sequence
  Description of Artificial Sequence: Synthetic peptide
  Seed: YLAEADLSYT (PMEL_HUMAN)
YMAEADLSYT

SEQ ID NO: 128155 - protein, 9 aa, Artificial Sequence
  Description of Artificial Sequence: Synthetic peptide
  Seed: KQDFSVPQL (PMEL_HUMAN)
KHDFSVPQM

SEQ ID NO: 128156 - protein, 9 aa, Artificial Sequence
  Description of Artificial Sequence: Synthetic peptide
  Seed: RLVKRQVPL (PMEL_HUMAN)
RRVKRQVPI

SEQ ID NO: 128157 - protein, 9 aa, Artificial Sequence
  Description of Artificial Sequence: Synthetic peptide
  Seed: AVVLASLIY (PMEL_HUMAN)
ATVLASLIM

SEQ ID NO: 128158 - protein, 9 aa, Artificial Sequence
  Description of Artificial Sequence: Synthetic peptide
  Seed: HLAVIGALL (PMEL_HUMAN)
HQAVIGALL

SEQ ID NO: 128159 - protein, 9 aa, Artificial Sequence
  Description of Artificial Sequence: Synthetic peptide
  Seed: SVPQLPHSS (PMEL_HUMAN)
SCPQLPHSM

SEQ ID NO: 128160 - protein, 11 aa, Artificial Sequence
  Description of Artificial Sequence: Synthetic peptide
  Seed: RYGSFSVTLDI (PMEL_HUMAN)
RAGSFSVTLDY

SEQ ID NO: 128161 - protein, 11 aa, Artificial Sequence
  Description of Artificial Sequence: Synthetic peptide
  Seed: RQVPLDCVLYR (PMEL_HUMAN)
RQVPLDCVLYM

SEQ ID NO: 128162 - protein, 10 aa, Artificial Sequence
  Description of Artificial Sequence: Synthetic peptide
  Seed: RQLYPEWTEA (PMEL_HUMAN)
RWLYPEWTEY

SEQ ID NO: 128163 - protein, 9 aa, Artificial Sequence
  Description of Artificial Sequence: Synthetic peptide
  Seed: ALDGGNKHF (PMEL_HUMAN)
AFDGGNKHL

SEQ ID NO: 128164 - protein, 9 aa, Artificial Sequence
  Description of Artificial Sequence: Synthetic peptide
  Seed: RLMKQDFSV (PMEL_HUMAN)
RAMKQDFSR

SEQ ID NO: 128165 - protein, 11 aa, Artificial Sequence
  Description of Artificial Sequence: Synthetic peptide
  Seed: ALDGGNKHFLR (PMEL_HUMAN)
ATDGGNKHFLF

SEQ ID NO: 128166 - protein, 10 aa, Artificial Sequence
  Description of Artificial Sequence: Synthetic peptide
  Seed: SLADTNSLAV (PMEL_HUMAN)
SYADTNSLAL

SEQ ID NO: 128167 - protein, 9 aa, Artificial Sequence
  Description of Artificial Sequence: Synthetic peptide
  Seed: VVLASLIYR (PMEL_HUMAN)
VVLASLIYK

SEQ ID NO: 128168 - protein, 10 aa, Artificial Sequence
  Description of Artificial Sequence: Synthetic peptide
  Seed: ALDGGNKHFL (PMEL_HUMAN)
AVDGGNKHFW

SEQ ID NO: 128169 - protein, 8 aa, Artificial Sequence
  Description of Artificial Sequence: Synthetic peptide
  Seed: ISTAPVQM (PMEL_HUMAN)
IATAPVQL

SEQ ID NO: 128170 - protein, 9 aa, Artificial Sequence
  Description of Artificial Sequence: Synthetic peptide
  Seed: VISTAPVQM (PMEL_HUMAN)
VMSTAPVQM

SEQ ID NO: 128171 - protein, 9 aa, Artificial Sequence
  Description of Artificial Sequence: Synthetic peptide
  Seed: ADLSYTWDF (PMEL_HUMAN)
AELSYTWDL

SEQ ID NO: 128172 - protein, 10 aa, Artificial Sequence
  Description of Artificial Sequence: Synthetic peptide
  Seed: ILKGGSGTYC (PMEL_HUMAN)
IQKGGSGTYM

SEQ ID NO: 128173 - protein, 9 aa, Artificial Sequence
  Description of Artificial Sequence: Synthetic peptide
  Seed: QVWGGQPVY (PMEL_HUMAN)
QSWGGQPVF

SEQ ID NO: 128174 - protein, 10 aa, Artificial Sequence
  Description of Artificial Sequence: Synthetic peptide
  Seed: AVIGALLAVG (PMEL_HUMAN)
AMIGALLAVN

SEQ ID NO: 128175 - protein, 9 aa, Artificial Sequence
  Description of Artificial Sequence: Synthetic peptide
  Seed: AQVVLQAAI (PMEL_HUMAN)
AHVVLQAAL

SEQ ID NO: 128176 - protein, 9 aa, Artificial Sequence
  Description of Artificial Sequence: Synthetic peptide
  Seed: VLGGPVSGL (PMEL_HUMAN)
VTGGPVSGV

SEQ ID NO: 128177 - protein, 9 aa, Artificial Sequence
  Description of Artificial Sequence: Synthetic peptide
  Seed: VLKRCLLHL (PMEL_HUMAN)
VMKRCLLHK

SEQ ID NO: 128178 - protein, 10 aa, Artificial Sequence
  Description of Artificial Sequence: Synthetic peptide
  Seed: LVLMAVVLAS (PMEL_HUMAN)
LFLMAVVLAT

SEQ ID NO: 128179 - protein, 9 aa, Artificial Sequence
  Description of Artificial Sequence: Synthetic peptide
  Seed: SRALVVTHT (PMEL_HUMAN)
SRALVVTHI

SEQ ID NO: 128180 - protein, 9 aa, Artificial Sequence
  Description of Artificial Sequence: Synthetic peptide
  Seed: KVLPDGQVI (PMEL_HUMAN)
KVLPDGQVL

SEQ ID NO: 128181 - protein, 9 aa, Artificial Sequence
  Description of Artificial Sequence: Synthetic peptide
  Seed: RALVVTHTY (PMEL_HUMAN)
RGLVVTHTF

SEQ ID NO: 128182 - protein, 9 aa, Artificial Sequence
  Description of Artificial Sequence: Synthetic peptide
  Seed: KTWGQYWQV (PMEL_HUMAN)
KIWGQYWQW

SEQ ID NO: 128183 - protein, 9 aa, Artificial Sequence
  Description of Artificial Sequence: Synthetic peptide
  Seed: FLRNQPLTF (PMEL_HUMAN)
FSRNQPLTL

SEQ ID NO: 128184 - protein, 10 aa, Artificial Sequence
  Description of Artificial Sequence: Synthetic peptide
  Seed: GLSIGTGRAM (PMEL_HUMAN)
GVSIGTGRAY

SEQ ID NO: 128185 - protein, 9 aa, Artificial Sequence
  Description of Artificial Sequence: Synthetic peptide
  Seed: HTMEVTVYH (PMEL_HUMAN)
HIMEVTVYF

SEQ ID NO: 128186 - protein, 10 aa, Artificial Sequence
  Description of Artificial Sequence: Synthetic peptide
  Seed: RQLYPEWTEA (PMEL_HUMAN)
RDLYPEWTEV

SEQ ID NO: 128187 - protein, 11 aa, Artificial Sequence
  Description of Artificial Sequence: Synthetic peptide
  Seed: SYVPLAHSSSA (PMEL_HUMAN)
SAVPLAHSSSF

SEQ ID NO: 128188 - protein, 9 aa, Artificial Sequence
  Description of Artificial Sequence: Synthetic peptide
  Seed: GMTPAEVSI (PMEL_HUMAN)
GITPAEVSY

SEQ ID NO: 128189 - protein, 9 aa, Artificial Sequence
  Description of Artificial Sequence: Synthetic peptide
  Seed: QVIWVNNTI (PMEL_HUMAN)
QVIWVNNTY

SEQ ID NO: 128190 - protein, 9 aa, Artificial Sequence
  Description of Artificial Sequence: Synthetic peptide
  Seed: RNQPLTFAL (PMEL_HUMAN)
RQQPLTFAV

SEQ ID NO: 128191 - protein, 10 aa, Artificial Sequence
  Description of Artificial Sequence: Synthetic peptide
  Seed: RGSRSYVPLA (PMEL_HUMAN)
RWSRSYVPLT

SEQ ID NO: 128192 - protein, 9 aa, Artificial Sequence
  Description of Artificial Sequence: Synthetic peptide
  Seed: VQMPTAEST (PMEL_HUMAN)
VVMPTAESF

SEQ ID NO: 128193 - protein, 9 aa, Artificial Sequence
  Description of Artificial Sequence: Synthetic peptide
  Seed: SQVWGGQPV (PMEL_HUMAN)
SHVWGGQPM

SEQ ID NO: 128194 - protein, 11 aa, Artificial Sequence
  Description of Artificial Sequence: Synthetic peptide
  Seed: SYVPLAHSSSA (PMEL_HUMAN)
SQVPLAHSSSF

SEQ ID NO: 128195 - protein, 11 aa, Artificial Sequence
  Description of Artificial Sequence: Synthetic peptide
  Seed: LGPLLDGTATL (PMEL_HUMAN)
LFPLLDGTATI

SEQ ID NO: 128196 - protein, 8 aa, Artificial Sequence
  Description of Artificial Sequence: Synthetic peptide
  Seed: LHDPSGYL (PMEL_HUMAN)
LVDPSGYL

SEQ ID NO: 128197 - protein, 9 aa, Artificial Sequence
  Description of Artificial Sequence: Synthetic peptide
  Seed: AVIGALLAV (PMEL_HUMAN)
ATIGALLAM

SEQ ID NO: 128198 - protein, 10 aa, Artificial Sequence
  Description of Artificial Sequence: Synthetic peptide
  Seed: QVLGGPVSGL (PMEL_HUMAN)
QALGGPVSGV

SEQ ID NO: 128199 - protein, 11 aa, Artificial Sequence
  Description of Artificial Sequence: Synthetic peptide
  Seed: RYGSFSVTLDI (PMEL_HUMAN)
RIGSFSVTLDW

SEQ ID NO: 128200 - protein, 10 aa, Artificial Sequence
  Description of Artificial Sequence: Synthetic peptide
  Seed: SLADTNSLAV (PMEL_HUMAN)
SFADTNSLAM

SEQ ID NO: 128201 - protein, 9 aa, Artificial Sequence
  Description of Artificial Sequence: Synthetic peptide
  Seed: RGGQVSLKV (PMEL_HUMAN)
RSGQVSLKI

SEQ ID NO: 128202 - protein, 9 aa, Artificial Sequence
  Description of Artificial Sequence: Synthetic peptide
  Seed: TTPGQAPTA (PMEL_HUMAN)
TTPGQAPTL

SEQ ID NO: 128203 - protein, 9 aa, Artificial Sequence
  Description of Artificial Sequence: Synthetic peptide
  Seed: LPDGQVIWV (PMEL_HUMAN)
LIDGQVIWV

SEQ ID NO: 128204 - protein, 10 aa, Artificial Sequence
  Description of Artificial Sequence: Synthetic peptide
  Seed: TMEVTVYHRR (PMEL_HUMAN)
TFEVTVYHRR

SEQ ID NO: 128205 - protein, 10 aa, Artificial Sequence
  Description of Artificial Sequence: Synthetic peptide
  Seed: RGSRSYVPLA (PMEL_HUMAN)
RQSRSYVPLY

SEQ ID NO: 128206 - protein, 9 aa, Artificial Sequence
  Description of Artificial Sequence: Synthetic peptide
  Seed: SQVWGGQPV (PMEL_HUMAN)
SLVWGGQPM

SEQ ID NO: 128207 - protein, 9 aa, Artificial Sequence
  Description of Artificial Sequence: Synthetic peptide
  Seed: LSIGTGRAM (PMEL_HUMAN)
LVIGTGRAY

SEQ ID NO: 128208 - protein, 9 aa, Artificial Sequence
  Description of Artificial Sequence: Synthetic peptide
  Seed: RTKAWNRQL (PMEL_HUMAN)
RLKAWNRQK

SEQ ID NO: 128209 - protein, 9 aa, Artificial Sequence
  Description of Artificial Sequence: Synthetic peptide
  Seed: QEAGLGQVP (PMEL_HUMAN)
QEAGLGQVM

SEQ ID NO: 128210 - protein, 9 aa, Artificial Sequence
  Description of Artificial Sequence: Synthetic peptide
  Seed: VLASLIYRR (PMEL_HUMAN)
VTASLIYRR

SEQ ID NO: 128211 - protein, 10 aa, Artificial Sequence
  Description of Artificial Sequence: Synthetic peptide
  Seed: VLMAVVLASL (PMEL_HUMAN)
VHMAVVLASV

SEQ ID NO: 128212 - protein, 11 aa, Artificial Sequence
  Description of Artificial Sequence: Synthetic peptide
  Seed: KVLPDGQVIWV (PMEL_HUMAN)
KALPDGQVIWF

SEQ ID NO: 128213 - protein, 9 aa, Artificial Sequence
  Description of Artificial Sequence: Synthetic peptide
  Seed: MLGTHTMEV (PMEL_HUMAN)
MRGTHTMEL

SEQ ID NO: 128214 - protein, 9 aa, Artificial Sequence
  Description of Artificial Sequence: Synthetic peptide
  Seed: AQRLCQPVL (PMEL_HUMAN)
AVRLCQPVK

SEQ ID NO: 128215 - protein, 9 aa, Artificial Sequence
  Description of Artificial Sequence: Synthetic peptide
  Seed: VVLASLIYR (PMEL_HUMAN)
VGLASLIYR

SEQ ID NO: 128216 - protein, 9 aa, Artificial Sequence
  Description of Artificial Sequence: Synthetic peptide
  Seed: YLEPGPVTA (PMEL_HUMAN)
YMEPGPVTV

SEQ ID NO: 128217 - protein, 9 aa, Artificial Sequence
  Description of Artificial Sequence: Synthetic peptide
  Seed: DAFELTVSC (PMEL_HUMAN)
DAFELTVSL

SEQ ID NO: 128218 - protein, 9 aa, Artificial Sequence
  Description of Artificial Sequence: Synthetic peptide
  Seed: QPVLPSPAC (PMEL_HUMAN)
QPVLPSPAS

SEQ ID NO: 128219 - protein, 11 aa, Artificial Sequence
  Description of Artificial Sequence: Synthetic peptide
  Seed: RLPRIFCSCPI (PMEL_HUMAN)
RDPRIFCSCPL

SEQ ID NO: 128220 - protein, 10 aa, Artificial Sequence
  Description of Artificial Sequence: Synthetic peptide
  Seed: RTKAWNRQLY (PMEL_HUMAN)
RHKAWNRQLY

SEQ ID NO: 128221 - protein, 9 aa, Artificial Sequence
  Description of Artificial Sequence: Synthetic peptide
  Seed: LLDGTATLR (PMEL_HUMAN)
LTDGTATLM

SEQ ID NO: 128222 - protein, 9 aa, Artificial Sequence
  Description of Artificial Sequence: Synthetic peptide
  Seed: AGQVPTTEV (PMEL_HUMAN)
AAQVPTTEI

SEQ ID NO: 128223 - protein, 10 aa, Artificial Sequence
  Description of Artificial Sequence: Synthetic peptide
  Seed: KTWGQYWQVL (PMEL_HUMAN)
KIWGQYWQVF

SEQ ID NO: 128224 - protein, 10 aa, Artificial Sequence
  Description of Artificial Sequence: Synthetic peptide
  Seed: LPHSSSHWLR (PMEL_HUMAN)
LMHSSSHWLK

SEQ ID NO: 128225 - protein, 9 aa, Artificial Sequence
  Description of Artificial Sequence: Synthetic peptide
  Seed: GQVPTTEVV (PMEL_HUMAN)
GKVPTTEVM

SEQ ID NO: 128226 - protein, 9 aa, Artificial Sequence
  Description of Artificial Sequence: Synthetic peptide
  Seed: QVIWVNNTI (PMEL_HUMAN)
QLIWVNNTI

SEQ ID NO: 128227 - protein, 10 aa, Artificial Sequence
  Description of Artificial Sequence: Synthetic peptide
  Seed: RSFVYVWKTW (PMEL_HUMAN)
RLFVYVWKTW

SEQ ID NO: 128228 - protein, 9 aa, Artificial Sequence
  Description of Artificial Sequence: Synthetic peptide
  Seed: ALVVTHTYL (PMEL_HUMAN)
ALVVTHTYI

SEQ ID NO: 128229 - protein, 10 aa, Artificial Sequence
  Description of Artificial Sequence: Synthetic peptide
  Seed: RALVVTHTYL (PMEL_HUMAN)
RSLVVTHTYI

SEQ ID NO: 128230 - protein, 11 aa, Artificial Sequence
  Description of Artificial Sequence: Synthetic peptide
  Seed: ISRALVVTHTY (PMEL_HUMAN)
ICRALVVTHTW

SEQ ID NO: 128231 - protein, 11 aa, Artificial Sequence
  Description of Artificial Sequence: Synthetic peptide
  Seed: YVPLAHSSSAF (PMEL_HUMAN)
YWPLAHSSSAY

SEQ ID NO: 128232 - protein, 10 aa, Artificial Sequence
  Description of Artificial Sequence: Synthetic peptide
  Seed: RQLYPEWTEA (PMEL_HUMAN)
RGLYPEWTEY

SEQ ID NO: 128233 - protein, 9 aa, Artificial Sequence
  Description of Artificial Sequence: Synthetic peptide
  Seed: VLYRYGSFS (PMEL_HUMAN)
VLYRYGSFV

SEQ ID NO: 128234 - protein, 9 aa, Artificial Sequence
  Description of Artificial Sequence: Synthetic peptide
  Seed: GCQPPAQRL (PMEL_HUMAN)
GAQPPAQRF

SEQ ID NO: 128235 - protein, 9 aa, Artificial Sequence
  Description of Artificial Sequence: Synthetic peptide
  Seed: WQVLGGPVS (PMEL_HUMAN)
WSVLGGPVY

SEQ ID NO: 128236 - protein, 10 aa, Artificial Sequence
  Description of Artificial Sequence: Synthetic peptide
  Seed: YVPLAHSSSA (PMEL_HUMAN)
YLPLAHSSSA

SEQ ID NO: 128237 - protein, 10 aa, Artificial Sequence
  Description of Artificial Sequence: Synthetic peptide
  Seed: DWLGVSRQLR (PMEL_HUMAN)
DYLGVSRQLR

SEQ ID NO: 128238 - protein, 9 aa, Artificial Sequence
  Description of Artificial Sequence: Synthetic peptide
  Seed: CVLYRYGSF (PMEL_HUMAN)
CALYRYGSW

SEQ ID NO: 128239 - protein, 9 aa, Artificial Sequence
  Description of Artificial Sequence: Synthetic peptide
  Seed: ESAEILQAV (PMEL_HUMAN)
ETAEILQAS

SEQ ID NO: 128240 - protein, 10 aa, Artificial Sequence
  Description of Artificial Sequence: Synthetic peptide
  Seed: LADTNSLAVV (PMEL_HUMAN)
LSDTNSLAVF

SEQ ID NO: 128241 - protein, 10 aa, Artificial Sequence
  Description of Artificial Sequence: Synthetic peptide
  Seed: VLMAVVLASL (PMEL_HUMAN)
VAMAVVLASI

SEQ ID NO: 128242 - protein, 11 aa, Artificial Sequence
  Description of Artificial Sequence: Synthetic peptide
  Seed: QAVPSGEGDAF (PMEL_HUMAN)
QRVPSGEGDAF

SEQ ID NO: 128243 - protein, 10 aa, Artificial Sequence
  Description of Artificial Sequence: Synthetic peptide
  Seed: NSLAVVSTQL (PMEL_HUMAN)
NWLAVVSTQL

SEQ ID NO: 128244 - protein, 11 aa, Artificial Sequence
  Description of Artificial Sequence: Synthetic peptide
  Seed: SGYLAEADLSY (PMEL_HUMAN)
SMYLAEADLSM

SEQ ID NO: 128245 - protein, 9 aa, Artificial Sequence
  Description of Artificial Sequence: Synthetic peptide
  Seed: AEMSTPEAT (PMEL_HUMAN)
AEMSTPEAP

SEQ ID NO: 128246 - protein, 10 aa, Artificial Sequence
  Description of Artificial Sequence: Synthetic peptide
  Seed: SGTYCLNVSL (PMEL_HUMAN)
SLTYCLNVSV

SEQ ID NO: 128247 - protein, 9 aa, Artificial Sequence
  Description of Artificial Sequence: Synthetic peptide
  Seed: VLPSPACQL (PMEL_HUMAN)
VMPSPACQV

SEQ ID NO: 128248 - protein, 9 aa, Artificial Sequence
  Description of Artificial Sequence: Synthetic peptide
  Seed: GQVPTTEVV (PMEL_HUMAN)
GEVPTTEVY

SEQ ID NO: 128249 - protein, 9 aa, Artificial Sequence
  Description of Artificial Sequence: Synthetic peptide
  Seed: AVIGALLAV (PMEL_HUMAN)
ARIGALLAY

SEQ ID NO: 128250 - protein, 9 aa, Artificial Sequence
  Description of Artificial Sequence: Synthetic peptide
  Seed: LLHLAVIGA (PMEL_HUMAN)
LMHLAVIGI

SEQ ID NO: 128251 - protein, 11 aa, Artificial Sequence
  Description of Artificial Sequence: Synthetic peptide
  Seed: HLAVIGALLAV (PMEL_HUMAN)
HTAVIGALLAV

SEQ ID NO: 128252 - protein, 9 aa, Artificial Sequence
  Description of Artificial Sequence: Synthetic peptide
  Seed: HLAVIGALL (PMEL_HUMAN)
HQAVIGALY

SEQ ID NO: 128253 - protein, 9 aa, Artificial Sequence
  Description of Artificial Sequence: Synthetic peptide
  Seed: MLGTHTMEV (PMEL_HUMAN)
MQGTHTMEV

SEQ ID NO: 128254 - protein, 9 aa, Artificial Sequence
  Description of Artificial Sequence: Synthetic peptide
  Seed: QAAIPLTSC (PMEL_HUMAN)
QAAIPLTSF

SEQ ID NO: 128255 - protein, 9 aa, Artificial Sequence
  Description of Artificial Sequence: Synthetic peptide
  Seed: SVPQLPHSS (PMEL_HUMAN)
SIPQLPHSF

SEQ ID NO: 128256 - protein, 9 aa, Artificial Sequence
  Description of Artificial Sequence: Synthetic peptide
  Seed: GGPVSGLSI (PMEL_HUMAN)
GAPVSGLSI

SEQ ID NO: 128257 - protein, 10 aa, Artificial Sequence
  Description of Artificial Sequence: Synthetic peptide
  Seed: LPRIFCSCPI (PMEL_HUMAN)
LPRIFCSCPF

SEQ ID NO: 128258 - protein, 9 aa, Artificial Sequence
  Description of Artificial Sequence: Synthetic peptide
  Seed: HTMEVTVYH (PMEL_HUMAN)
HLMEVTVYM

SEQ ID NO: 128259 - protein, 10 aa, Artificial Sequence
  Description of Artificial Sequence: Synthetic peptide
  Seed: YVWKTWGQYW (PMEL_HUMAN)
YYWKTWGQYI

SEQ ID NO: 128260 - protein, 9 aa, Artificial Sequence
  Description of Artificial Sequence: Synthetic peptide
  Seed: YPQETDDAC (PMEL_HUMAN)
YAQETDDAL

SEQ ID NO: 128261 - protein, 10 aa, Artificial Sequence
  Description of Artificial Sequence: Synthetic peptide
  Seed: SVPQLPHSSS (PMEL_HUMAN)
SIPQLPHSSI

SEQ ID NO: 128262 - protein, 10 aa, Artificial Sequence
  Description of Artificial Sequence: Synthetic peptide
  Seed: YRYGSFSVTL (PMEL_HUMAN)
YVYGSFSVTI

SEQ ID NO: 128263 - protein, 9 aa, Artificial Sequence
  Description of Artificial Sequence: Synthetic peptide
  Seed: HTMEVTVYH (PMEL_HUMAN)
HMMEVTVYK

SEQ ID NO: 128264 - protein, 9 aa, Artificial Sequence
  Description of Artificial Sequence: Synthetic peptide
  Seed: TVYHRRGSR (PMEL_HUMAN)
TAYHRRGSK

SEQ ID NO: 128265 - protein, 9 aa, Artificial Sequence
  Description of Artificial Sequence: Synthetic peptide
  Seed: VQVPTTEVI (PMEL_HUMAN)
VEVPTTEVT

SEQ ID NO: 128266 - protein, 9 aa, Artificial Sequence
  Description of Artificial Sequence: Synthetic peptide
  Seed: YLAEADLSY (PMEL_HUMAN)
YKAEADLSY

SEQ ID NO: 128267 - protein, 9 aa, Artificial Sequence
  Description of Artificial Sequence: Synthetic peptide
  Seed: VMGTTLAEM (PMEL_HUMAN)
VVGTTLAEF

SEQ ID NO: 128268 - protein, 10 aa, Artificial Sequence
  Description of Artificial Sequence: Synthetic peptide
  Seed: MSTESITGSL (PMEL_HUMAN)
MMTESITGSW

SEQ ID NO: 128269 - protein, 9 aa, Artificial Sequence
  Description of Artificial Sequence: Synthetic peptide
  Seed: ESAEILQAV (PMEL_HUMAN)
EVAEILQAR

SEQ ID NO: 128270 - protein, 10 aa, Artificial Sequence
  Description of Artificial Sequence: Synthetic peptide
  Seed: VLMAVVLASL (PMEL_HUMAN)
VDMAVVLASF

SEQ ID NO: 128271 - protein, 9 aa, Artificial Sequence
  Description of Artificial Sequence: Synthetic peptide
  Seed: VTAQVVLQA (PMEL_HUMAN)
VLAQVVLQL

SEQ ID NO: 128272 - protein, 9 aa, Artificial Sequence
  Description of Artificial Sequence: Synthetic peptide
  Seed: VSEVMGTTL (PMEL_HUMAN)
VEEVMGTTI

SEQ ID NO: 128273 - protein, 9 aa, Artificial Sequence
  Description of Artificial Sequence: Synthetic peptide
  Seed: LAVVSTQLI (PMEL_HUMAN)
LTVVSTQLL

SEQ ID NO: 128274 - protein, 11 aa, Artificial Sequence
  Description of Artificial Sequence: Synthetic peptide
  Seed: HTMEVTVYHRR (PMEL_HUMAN)
HLMEVTVYHRR

SEQ ID NO: 128275 - protein, 9 aa, Artificial Sequence
  Description of Artificial Sequence: Synthetic peptide
  Seed: RLVKRQVPL (PMEL_HUMAN)
RRVKRQVPL

SEQ ID NO: 128276 - protein, 9 aa, Artificial Sequence
  Description of Artificial Sequence: Synthetic peptide
  Seed: TAQVVLQAA (PMEL_HUMAN)
TAQVVLQAV

SEQ ID NO: 128277 - protein, 9 aa, Artificial Sequence
  Description of Artificial Sequence: Synthetic peptide
  Seed: SSHWLRLPR (PMEL_HUMAN)
STHWLRLPK

SEQ ID NO: 128278 - protein, 9 aa, Artificial Sequence
  Description of Artificial Sequence: Synthetic peptide
  Seed: TLISRALVV (PMEL_HUMAN)
TAISRALVL

SEQ ID NO: 128279 - protein, 10 aa, Artificial Sequence
  Description of Artificial Sequence: Synthetic peptide
  Seed: GDSSGTLISR (PMEL_HUMAN)
GPSSGTLISK

SEQ ID NO: 128280 - protein, 8 aa, Artificial Sequence
  Description of Artificial Sequence: Synthetic peptide
  Seed: FGDSSGTL (PMEL_HUMAN)
FVDSSGTM

SEQ ID NO: 128281 - protein, 9 aa, Artificial Sequence
  Description of Artificial Sequence: Synthetic peptide
  Seed: TTDGHRPTA (PMEL_HUMAN)
TADGHRPTF

SEQ ID NO: 128282 - protein, 10 aa, Artificial Sequence
  Description of Artificial Sequence: Synthetic peptide
  Seed: LSIGTGRAML (PMEL_HUMAN)
LTIGTGRAMY

SEQ ID NO: 128283 - protein, 10 aa, Artificial Sequence
  Description of Artificial Sequence: Synthetic peptide
  Seed: LPSPACQLVL (PMEL_HUMAN)
LPSPACQLVM

SEQ ID NO: 128284 - protein, 9 aa, Artificial Sequence
  Description of Artificial Sequence: Synthetic peptide
  Seed: LNFPGSQKV (PMEL_HUMAN)
LGFPGSQKL

SEQ ID NO: 128285 - protein, 9 aa, Artificial Sequence
  Description of Artificial Sequence: Synthetic peptide
  Seed: RLMKQDFSV (PMEL_HUMAN)
RRMKQDFSV

SEQ ID NO: 128286 - protein, 9 aa, Artificial Sequence
  Description of Artificial Sequence: Synthetic peptide
  Seed: SSIMSTESI (PMEL_HUMAN)
SSIMSTESV

SEQ ID NO: 128287 - protein, 9 aa, Artificial Sequence
  Description of Artificial Sequence: Synthetic peptide
  Seed: CVLYRYGSF (PMEL_HUMAN)
CALYRYGSY

SEQ ID NO: 128288 - protein, 10 aa, Artificial Sequence
  Description of Artificial Sequence: Synthetic peptide
  Seed: RNQDWLGVSR (PMEL_HUMAN)
RFQDWLGVSR

SEQ ID NO: 128289 - protein, 10 aa, Artificial Sequence
  Description of Artificial Sequence: Synthetic peptide
  Seed: MKQDFSVPQL (PMEL_HUMAN)
MSQDFSVPQY

SEQ ID NO: 128290 - protein, 9 aa, Artificial Sequence
  Description of Artificial Sequence: Synthetic peptide
  Seed: LPDGQVIWV (PMEL_HUMAN)
LADGQVIWF

SEQ ID NO: 128291 - protein, 9 aa, Artificial Sequence
  Description of Artificial Sequence: Synthetic peptide
  Seed: SSIMSTESI (PMEL_HUMAN)
SQIMSTESI

SEQ ID NO: 128292 - protein, 8 aa, Artificial Sequence
  Description of Artificial Sequence: Synthetic peptide
  Seed: TLDIVQGI (PMEL_HUMAN)
TLDIVQGL

SEQ ID NO: 128293 - protein, 9 aa, Artificial Sequence
  Description of Artificial Sequence: Synthetic peptide
  Seed: VSNDGPTLI (PMEL_HUMAN)
VRNDGPTLM

SEQ ID NO: 128294 - protein, 9 aa, Artificial Sequence
  Description of Artificial Sequence: Synthetic peptide
  Seed: YLEPGPVTA (PMEL_HUMAN)
YLEPGPVTV

SEQ ID NO: 128295 - protein, 9 aa, Artificial Sequence
  Description of Artificial Sequence: Synthetic peptide
  Seed: AEPSGTTSV (PMEL_HUMAN)
AQPSGTTSM

SEQ ID NO: 128296 - protein, 10 aa, Artificial Sequence
  Description of Artificial Sequence: Synthetic peptide
  Seed: SQKRSFVYVW (PMEL_HUMAN)
SAKRSFVYVY

SEQ ID NO: 128297 - protein, 9 aa, Artificial Sequence
  Description of Artificial Sequence: Synthetic peptide
  Seed: AVGATKVPR (PMEL_HUMAN)
ALGATKVPR

SEQ ID NO: 128298 - protein, 9 aa, Artificial Sequence
  Description of Artificial Sequence: Synthetic peptide
  Seed: GTYCLNVSL (PMEL_HUMAN)
GQYCLNVSI

SEQ ID NO: 128299 - protein, 10 aa, Artificial Sequence
  Description of Artificial Sequence: Synthetic peptide
  Seed: SSSHWLRLPR (PMEL_HUMAN)
SPSHWLRLPR

SEQ ID NO: 128300 - protein, 11 aa, Artificial Sequence
  Description of Artificial Sequence: Synthetic peptide
  Seed: AEAPNTTAGQV (PMEL_HUMAN)
AEAPNTTAGQM

SEQ ID NO: 128301 - protein, 11 aa, Artificial Sequence
  Description of Artificial Sequence: Synthetic peptide
  Seed: GYLAEADLSYT (PMEL_HUMAN)
GYLAEADLSYV

SEQ ID NO: 128302 - protein, 9 aa, Artificial Sequence
  Description of Artificial Sequence: Synthetic peptide
  Seed: GSRSYVPLA (PMEL_HUMAN)
GARSYVPLI

SEQ ID NO: 128303 - protein, 9 aa, Artificial Sequence
  Description of Artificial Sequence: Synthetic peptide
  Seed: HTMEVTVYH (PMEL_HUMAN)
HAMEVTVYV

SEQ ID NO: 128304 - protein, 9 aa, Artificial Sequence
  Description of Artificial Sequence: Synthetic peptide
  Seed: GTYCLNVSL (PMEL_HUMAN)
GTYCLNVSM

SEQ ID NO: 128305 - protein, 9 aa, Artificial Sequence
  Description of Artificial Sequence: Synthetic peptide
  Seed: GANASFSIA (PMEL_HUMAN)
GVNASFSIK

SEQ ID NO: 128306 - protein, 11 aa, Artificial Sequence
  Description of Artificial Sequence: Synthetic peptide
  Seed: RRRLMKQDFSV (PMEL_HUMAN)
RDRLMKQDFSV

SEQ ID NO: 128307 - protein, 9 aa, Artificial Sequence
  Description of Artificial Sequence: Synthetic peptide
  Seed: LYRYGSFSV (PMEL_HUMAN)
LYRYGSFSA

SEQ ID NO: 128308 - protein, 9 aa, Artificial Sequence
  Description of Artificial Sequence: Synthetic peptide
  Seed: YHRRGSRSY (PMEL_HUMAN)
YQRRGSRSV

SEQ ID NO: 128309 - protein, 10 aa, Artificial Sequence
  Description of Artificial Sequence: Synthetic peptide
  Seed: GPLLDGTATL (PMEL_HUMAN)
GHLLDGTATL

SEQ ID NO: 128310 - protein, 9 aa, Artificial Sequence
  Description of Artificial Sequence: Synthetic peptide
  Seed: GQVPTTEVV (PMEL_HUMAN)
GHVPTTEVA

SEQ ID NO: 128311 - protein, 9 aa, Artificial Sequence
  Description of Artificial Sequence: Synthetic peptide
  Seed: ASFSIALNF (PMEL_HUMAN)
ATFSIALNY

SEQ ID NO: 128312 - protein, 9 aa, Artificial Sequence
  Description of Artificial Sequence: Synthetic peptide
  Seed: SVQVPTTEV (PMEL_HUMAN)
SFQVPTTEL

SEQ ID NO: 128313 - protein, 9 aa, Artificial Sequence
  Description of Artificial Sequence: Synthetic peptide
  Seed: SSPGCQPPA (PMEL_HUMAN)
SVPGCQPPM

SEQ ID NO: 128314 - protein, 9 aa, Artificial Sequence
  Description of Artificial Sequence: Synthetic peptide
  Seed: RYGSFSVTL (PMEL_HUMAN)
RMGSFSVTV

SEQ ID NO: 128315 - protein, 10 aa, Artificial Sequence
  Description of Artificial Sequence: Synthetic peptide
  Seed: ALDGGNKHFL (PMEL_HUMAN)
AMDGGNKHFI

SEQ ID NO: 128316 - protein, 9 aa, Artificial Sequence
  Description of Artificial Sequence: Synthetic peptide
  Seed: MTPEKVPVS (PMEL_HUMAN)
MVPEKVPVI

SEQ ID NO: 128317 - protein, 9 aa, Artificial Sequence
  Description of Artificial Sequence: Synthetic peptide
  Seed: AQVVLQAAI (PMEL_HUMAN)
AVVVLQAAF

SEQ ID NO: 128318 - protein, 9 aa, Artificial Sequence
  Description of Artificial Sequence: Synthetic peptide
  Seed: AHSSSAFTI (PMEL_HUMAN)
AASSSAFTF

SEQ ID NO: 128319 - protein, 9 aa, Artificial Sequence
  Description of Artificial Sequence: Synthetic peptide
  Seed: RALVVTHTY (PMEL_HUMAN)
RALVVTHTL

SEQ ID NO: 128320 - protein, 9 aa, Artificial Sequence
  Description of Artificial Sequence: Synthetic peptide
  Seed: RNQPLTFAL (PMEL_HUMAN)
RYQPLTFAF

SEQ ID NO: 128321 - protein, 9 aa, Artificial Sequence
  Description of Artificial Sequence: Synthetic peptide
  Seed: GSSPVPGTT (PMEL_HUMAN)
GVSPVPGTF

SEQ ID NO: 128322 - protein, 9 aa, Artificial Sequence
  Description of Artificial Sequence: Synthetic peptide
  Seed: VSNDGPTLI (PMEL_HUMAN)
VNNDGPTLL

SEQ ID NO: 128323 - protein, 11 aa, Artificial Sequence
  Description of Artificial Sequence: Synthetic peptide
  Seed: RQLRTKAWNRQ (PMEL_HUMAN)
RLLRTKAWNRR

SEQ ID NO: 128324 - protein, 9 aa, Artificial Sequence
  Description of Artificial Sequence: Synthetic peptide
  Seed: QDFSVPQLP (PMEL_HUMAN)
QEFSVPQLA

SEQ ID NO: 128325 - protein, 9 aa, Artificial Sequence
  Description of Artificial Sequence: Synthetic peptide
  Seed: TAEAPNTTA (PMEL_HUMAN)
TVEAPNTTL

SEQ ID NO: 128326 - protein, 9 aa, Artificial Sequence
  Description of Artificial Sequence: Synthetic peptide
  Seed: RYGSFSVTL (PMEL_HUMAN)
RVGSFSVTI

SEQ ID NO: 128327 - protein, 9 aa, Artificial Sequence
  Description of Artificial Sequence: Synthetic peptide
  Seed: DQVPFSVSV (PMEL_HUMAN)
DVVPFSVSL

SEQ ID NO: 128328 - protein, 9 aa, Artificial Sequence
  Description of Artificial Sequence: Synthetic peptide
  Seed: RNQPLTFAL (PMEL_HUMAN)
RQQPLTFAF

SEQ ID NO: 128329 - protein, 9 aa, Artificial Sequence
  Description of Artificial Sequence: Synthetic peptide
  Seed: GSFSVTLDI (PMEL_HUMAN)
GVFSVTLDV

SEQ ID NO: 128330 - protein, 9 aa, Artificial Sequence
  Description of Artificial Sequence: Synthetic peptide
  Seed: ILKGGSGTY (PMEL_HUMAN)
ITKGGSGTM

SEQ ID NO: 128331 - protein, 9 aa, Artificial Sequence
  Description of Artificial Sequence: Synthetic peptide
  Seed: AQRLCQPVL (PMEL_HUMAN)
AVRLCQPVI

SEQ ID NO: 128332 - protein, 9 aa, Artificial Sequence
  Description of Artificial Sequence: Synthetic peptide
  Seed: VLPSPACQL (PMEL_HUMAN)
VQPSPACQM

SEQ ID NO: 128333 - protein, 10 aa, Artificial Sequence
  Description of Artificial Sequence: Synthetic peptide
  Seed: YLAEADLSYT (PMEL_HUMAN)
YMAEADLSYC

SEQ ID NO: 128334 - protein, 9 aa, Artificial Sequence
  Description of Artificial Sequence: Synthetic peptide
  Seed: RGSRSYVPL (PMEL_HUMAN)
RYSRSYVPA

SEQ ID NO: 128335 - protein, 10 aa, Artificial Sequence
  Description of Artificial Sequence: Synthetic peptide
  Seed: EVVGTTPGQA (PMEL_HUMAN)
EVVGTTPGQY

SEQ ID NO: 128336 - protein, 9 aa, Artificial Sequence
  Description of Artificial Sequence: Synthetic peptide
  Seed: AEADLSYTW (PMEL_HUMAN)
APADLSYTY

SEQ ID NO: 128337 - protein, 10 aa, Artificial Sequence
  Description of Artificial Sequence: Synthetic peptide
  Seed: MKQDFSVPQL (PMEL_HUMAN)
MQQDFSVPQV

SEQ ID NO: 128338 - protein, 9 aa, Artificial Sequence
  Description of Artificial Sequence: Synthetic peptide
  Seed: SLIYRRRLM (PMEL_HUMAN)
SFIYRRRLF

SEQ ID NO: 128339 - protein, 9 aa, Artificial Sequence
  Description of Artificial Sequence: Synthetic peptide
  Seed: RYGSFSVTL (PMEL_HUMAN)
RIGSFSVTL

SEQ ID NO: 128340 - protein, 9 aa, Artificial Sequence
  Description of Artificial Sequence: Synthetic peptide
  Seed: TTPGQAPTA (PMEL_HUMAN)
TFPGQAPTM

SEQ ID NO: 128341 - protein, 10 aa, Artificial Sequence
  Description of Artificial Sequence: Synthetic peptide
  Seed: VLMAVVLASL (PMEL_HUMAN)
VIMAVVLASV

SEQ ID NO: 128342 - protein, 10 aa, Artificial Sequence
  Description of Artificial Sequence: Synthetic peptide
  Seed: FPDGGPCPSG (PMEL_HUMAN)
FPDGGPCPSV

SEQ ID NO: 128343 - protein, 9 aa, Artificial Sequence
  Description of Artificial Sequence: Synthetic peptide
  Seed: ALNFPGSQK (PMEL_HUMAN)
AANFPGSQI

SEQ ID NO: 128344 - protein, 11 aa, Artificial Sequence
  Description of Artificial Sequence: Synthetic peptide
  Seed: RTKAWNRQLYP (PMEL_HUMAN)
RLKAWNRQLYK

SEQ ID NO: 128345 - protein, 9 aa, Artificial Sequence
  Description of Artificial Sequence: Synthetic peptide
  Seed: LPHSSSHWL (PMEL_HUMAN)
LPHSSSHWY

SEQ ID NO: 128346 - protein, 9 aa, Artificial Sequence
  Description of Artificial Sequence: Synthetic peptide
  Seed: SQKRSFVYV (PMEL_HUMAN)
SAKRSFVYR

SEQ ID NO: 128347 - protein, 9 aa, Artificial Sequence
  Description of Artificial Sequence: Synthetic peptide
  Seed: YLAEADLSY (PMEL_HUMAN)
YPAEADLSV

SEQ ID NO: 128348 - protein, 9 aa, Artificial Sequence
  Description of Artificial Sequence: Synthetic peptide
  Seed: KVLPDGQVI (PMEL_HUMAN)
KALPDGQVL

SEQ ID NO: 128349 - protein, 11 aa, Artificial Sequence
  Description of Artificial Sequence: Synthetic peptide
  Seed: LGPLLDGTATL (PMEL_HUMAN)
LCPLLDGTATV

SEQ ID NO: 128350 - protein, 10 aa, Artificial Sequence
  Description of Artificial Sequence: Synthetic peptide
  Seed: RTKAWNRQLY (PMEL_HUMAN)
RQKAWNRQLF

SEQ ID NO: 128351 - protein, 11 aa, Artificial Sequence
  Description of Artificial Sequence: Synthetic peptide
  Seed: LGPLLDGTATL (PMEL_HUMAN)
LYPLLDGTATI

SEQ ID NO: 128352 - protein, 10 aa, Artificial Sequence
  Description of Artificial Sequence: Synthetic peptide
  Seed: QVPLDCVLYR (PMEL_HUMAN)
QTPLDCVLYR

SEQ ID NO: 128353 - protein, 10 aa, Artificial Sequence
  Description of Artificial Sequence: Synthetic peptide
  Seed: RGSRSYVPLA (PMEL_HUMAN)
RHSRSYVPLV

SEQ ID NO: 128354 - protein, 9 aa, Artificial Sequence
  Description of Artificial Sequence: Synthetic peptide
  Seed: RLVKRQVPL (PMEL_HUMAN)
RLVKRQVPM

SEQ ID NO: 128355 - protein, 9 aa, Artificial Sequence
  Description of Artificial Sequence: Synthetic peptide
  Seed: VVLQAAIPL (PMEL_HUMAN)
VTLQAAIPW

SEQ ID NO: 128356 - protein, 9 aa, Artificial Sequence
  Description of Artificial Sequence: Synthetic peptide
  Seed: ALDGGNKHF (PMEL_HUMAN)
AVDGGNKHI

SEQ ID NO: 128357 - protein, 10 aa, Artificial Sequence
  Description of Artificial Sequence: Synthetic peptide
  Seed: LADTNSLAVV (PMEL_HUMAN)
LSDTNSLAVM

SEQ ID NO: 128358 - protein, 9 aa, Artificial Sequence
  Description of Artificial Sequence: Synthetic peptide
  Seed: MLGTHTMEV (PMEL_HUMAN)
MRGTHTMEV

SEQ ID NO: 128359 - protein, 10 aa, Artificial Sequence
  Description of Artificial Sequence: Synthetic peptide
  Seed: LRLVKRQVPL (PMEL_HUMAN)
LFLVKRQVPV

SEQ ID NO: 128360 - protein, 10 aa, Artificial Sequence
  Description of Artificial Sequence: Synthetic peptide
  Seed: SAEILQAVPS (PMEL_HUMAN)
SSEILQAVPA

SEQ ID NO: 128361 - protein, 9 aa, Artificial Sequence
  Description of Artificial Sequence: Synthetic peptide
  Seed: MAVVLASLI (PMEL_HUMAN)
MPVVLASLY

SEQ ID NO: 128362 - protein, 9 aa, Artificial Sequence
  Description of Artificial Sequence: Synthetic peptide
  Seed: VLPSPACQL (PMEL_HUMAN)
VNPSPACQL

SEQ ID NO: 128363 - protein, 9 aa, Artificial Sequence
  Description of Artificial Sequence: Synthetic peptide
  Seed: RAMLGTHTM (PMEL_HUMAN)
RFMLGTHTK

SEQ ID NO: 128364 - protein, 10 aa, Artificial Sequence
  Description of Artificial Sequence: Synthetic peptide
  Seed: EVMGTTLAEM (PMEL_HUMAN)
EMMGTTLAEF

SEQ ID NO: 128365 - protein, 9 aa, Artificial Sequence
  Description of Artificial Sequence: Synthetic peptide
  Seed: RGSRSYVPL (PMEL_HUMAN)
RVSRSYVPL

SEQ ID NO: 128366 - protein, 9 aa, Artificial Sequence
  Description of Artificial Sequence: Synthetic peptide
  Seed: LIVGILLVL (PMEL_HUMAN)
LMVGILLVL

SEQ ID NO: 128367 - protein, 9 aa, Artificial Sequence
  Description of Artificial Sequence: Synthetic peptide
  Seed: SSHWLRLPR (PMEL_HUMAN)
SNHWLRLPR

SEQ ID NO: 128368 - protein, 10 aa, Artificial Sequence
  Description of Artificial Sequence: Synthetic peptide
  Seed: LVLMAVVLAS (PMEL_HUMAN)
LVLMAVVLAV

SEQ ID NO: 128369 - protein, 10 aa, Artificial Sequence
  Description of Artificial Sequence: Synthetic peptide
  Seed: RQLYPEWTEA (PMEL_HUMAN)
RQLYPEWTEI

SEQ ID NO: 128370 - protein, 11 aa, Artificial Sequence
  Description of Artificial Sequence: Synthetic peptide
  Seed: YLAEADLSYTW (PMEL_HUMAN)
YGAEADLSYTW

SEQ ID NO: 128371 - protein, 9 aa, Artificial Sequence
  Description of Artificial Sequence: Synthetic peptide
  Seed: ESTGMTPEK (PMEL_HUMAN)
ELTGMTPER

SEQ ID NO: 128372 - protein, 9 aa, Artificial Sequence
  Description of Artificial Sequence: Synthetic peptide
  Seed: KHFLRNQPL (PMEL_HUMAN)
KYFLRNQPF

SEQ ID NO: 128373 - protein, 9 aa, Artificial Sequence
  Description of Artificial Sequence: Synthetic peptide
  Seed: LPDGQVIWV (PMEL_HUMAN)
LLDGQVIWV

SEQ ID NO: 128374 - protein, 11 aa, Artificial Sequence
  Description of Artificial Sequence: Synthetic peptide
  Seed: RYGSFSVTLDI (PMEL_HUMAN)
RVGSFSVTLDF

SEQ ID NO: 128375 - protein, 9 aa, Artificial Sequence
  Description of Artificial Sequence: Synthetic peptide
  Seed: GLGQVPLIV (PMEL_HUMAN)
GMGQVPLIV

SEQ ID NO: 128376 - protein, 9 aa, Artificial Sequence
  Description of Artificial Sequence: Synthetic peptide
  Seed: ALLAVGATK (PMEL_HUMAN)
ASLAVGATR

SEQ ID NO: 128377 - protein, 9 aa, Artificial Sequence
  Description of Artificial Sequence: Synthetic peptide
  Seed: KVLPDGQVI (PMEL_HUMAN)
KILPDGQVW

SEQ ID NO: 128378 - protein, 9 aa, Artificial Sequence
  Description of Artificial Sequence: Synthetic peptide
  Seed: MAVVLASLI (PMEL_HUMAN)
MQVVLASLW

SEQ ID NO: 128379 - protein, 9 aa, Artificial Sequence
  Description of Artificial Sequence: Synthetic peptide
  Seed: VTAQVVLQA (PMEL_HUMAN)
VSAQVVLQF

SEQ ID NO: 128380 - protein, 10 aa, Artificial Sequence
  Description of Artificial Sequence: Synthetic peptide
  Seed: SSSHWLRLPR (PMEL_HUMAN)
SFSHWLRLPR

SEQ ID NO: 128381 - protein, 9 aa, Artificial Sequence
  Description of Artificial Sequence: Synthetic peptide
  Seed: ESAEILQAV (PMEL_HUMAN)
EMAEILQAF

SEQ ID NO: 128382 - protein, 9 aa, Artificial Sequence
  Description of Artificial Sequence: Synthetic peptide
  Seed: TLIGANASF (PMEL_HUMAN)
TQIGANASY

SEQ ID NO: 128383 - protein, 9 aa, Artificial Sequence
  Description of Artificial Sequence: Synthetic peptide
  Seed: CWRGGQVSL (PMEL_HUMAN)
CYRGGQVSV

SEQ ID NO: 128384 - protein, 9 aa, Artificial Sequence
  Description of Artificial Sequence: Synthetic peptide
  Seed: HLAVIGALL (PMEL_HUMAN)
HTAVIGALR

SEQ ID NO: 128385 - protein, 11 aa, Artificial Sequence
  Description of Artificial Sequence: Synthetic peptide
  Seed: LGPLLDGTATL (PMEL_HUMAN)
LMPLLDGTATL

SEQ ID NO: 128386 - protein, 10 aa, Artificial Sequence
  Description of Artificial Sequence: Synthetic peptide
  Seed: VSLADTNSLA (PMEL_HUMAN)
VNLADTNSLL

SEQ ID NO: 128387 - protein, 9 aa, Artificial Sequence
  Description of Artificial Sequence: Synthetic peptide
  Seed: MAVVLASLI (PMEL_HUMAN)
MLVVLASLF

SEQ ID NO: 128388 - protein, 10 aa, Artificial Sequence
  Description of Artificial Sequence: Synthetic peptide
  Seed: RQLYPEWTEA (PMEL_HUMAN)
RCLYPEWTEL

SEQ ID NO: 128389 - protein, 9 aa, Artificial Sequence
  Description of Artificial Sequence: Synthetic peptide
  Seed: VMGTTLAEM (PMEL_HUMAN)
VYGTTLAEL

SEQ ID NO: 128390 - protein, 10 aa, Artificial Sequence
  Description of Artificial Sequence: Synthetic peptide
  Seed: SHWLRLPRIF (PMEL_HUMAN)
SQWLRLPRIM

SEQ ID NO: 128391 - protein, 10 aa, Artificial Sequence
  Description of Artificial Sequence: Synthetic peptide
  Seed: KTWGQYWQVL (PMEL_HUMAN)
KMWGQYWQVQ

SEQ ID NO: 128392 - protein, 11 aa, Artificial Sequence
  Description of Artificial Sequence: Synthetic peptide
  Seed: RRRLMKQDFSV (PMEL_HUMAN)
RFRLMKQDFSV

SEQ ID NO: 128393 - protein, 9 aa, Artificial Sequence
  Description of Artificial Sequence: Synthetic peptide
  Seed: SGLSIGTGR (PMEL_HUMAN)
SVLSIGTGY

SEQ ID NO: 128394 - protein, 10 aa, Artificial Sequence
  Description of Artificial Sequence: Synthetic peptide
  Seed: EVISTAPVQM (PMEL_HUMAN)
ETISTAPVQI

SEQ ID NO: 128395 - protein, 9 aa, Artificial Sequence
  Description of Artificial Sequence: Synthetic peptide
  Seed: AEPSGTTSV (PMEL_HUMAN)
AQPSGTTSI

SEQ ID NO: 128396 - protein, 9 aa, Artificial Sequence
  Description of Artificial Sequence: Synthetic peptide
  Seed: SVQVPTTEV (PMEL_HUMAN)
SSQVPTTEY

SEQ ID NO: 128397 - protein, 11 aa, Artificial Sequence
  Description of Artificial Sequence: Synthetic peptide
  Seed: LVLMAVVLASL (PMEL_HUMAN)
LMLMAVVLASI

SEQ ID NO: 128398 - protein, 9 aa, Artificial Sequence
  Description of Artificial Sequence: Synthetic peptide
  Seed: FPDGGPCPS (PMEL_HUMAN)
FPDGGPCPA

SEQ ID NO: 128399 - protein, 9 aa, Artificial Sequence
  Description of Artificial Sequence: Synthetic peptide
  Seed: SVQVPTTEV (PMEL_HUMAN)
SPQVPTTET

SEQ ID NO: 128400 - protein, 9 aa, Artificial Sequence
  Description of Artificial Sequence: Synthetic peptide
  Seed: LLAVGATKV (PMEL_HUMAN)
LTAVGATKV

SEQ ID NO: 128401 - protein, 9 aa, Artificial Sequence
  Description of Artificial Sequence: Synthetic peptide
  Seed: SLADTNSLA (PMEL_HUMAN)
SVADTNSLM

SEQ ID NO: 128402 - protein, 9 aa, Artificial Sequence
  Description of Artificial Sequence: Synthetic peptide
  Seed: FSVSVSQLR (PMEL_HUMAN)
FAVSVSQLF

SEQ ID NO: 128403 - protein, 8 aa, Artificial Sequence
  Description of Artificial Sequence: Synthetic peptide
  Seed: VLPDGQVI (PMEL_HUMAN)
VAPDGQVM

SEQ ID NO: 128404 - protein, 10 aa, Artificial Sequence
  Description of Artificial Sequence: Synthetic peptide
  Seed: LSIGTGRAML (PMEL_HUMAN)
LTIGTGRAMF

SEQ ID NO: 128405 - protein, 9 aa, Artificial Sequence
  Description of Artificial Sequence: Synthetic peptide
  Seed: RLMKQDFSV (PMEL_HUMAN)
RLMKQDFSI

SEQ ID NO: 128406 - protein, 9 aa, Artificial Sequence
  Description of Artificial Sequence: Synthetic peptide
  Seed: SITGSLGPL (PMEL_HUMAN)
STTGSLGPR

SEQ ID NO: 128407 - protein, 9 aa, Artificial Sequence
  Description of Artificial Sequence: Synthetic peptide
  Seed: VPLDCVLYR (PMEL_HUMAN)
VWLDCVLYR

SEQ ID NO: 128408 - protein, 9 aa, Artificial Sequence
  Description of Artificial Sequence: Synthetic peptide
  Seed: AHSSSAFTI (PMEL_HUMAN)
AKSSSAFTY

SEQ ID NO: 128409 - protein, 9 aa, Artificial Sequence
  Description of Artificial Sequence: Synthetic peptide
  Seed: FLRNQPLTF (PMEL_HUMAN)
FTRNQPLTL

SEQ ID NO: 128410 - protein, 9 aa, Artificial Sequence
  Description of Artificial Sequence: Synthetic peptide
  Seed: LYRYGSFSV (PMEL_HUMAN)
LTRYGSFSK

SEQ ID NO: 128411 - protein, 9 aa, Artificial Sequence
  Description of Artificial Sequence: Synthetic peptide
  Seed: RYGSFSVTL (PMEL_HUMAN)
RFGSFSVTY

SEQ ID NO: 128412 - protein, 10 aa, Artificial Sequence
  Description of Artificial Sequence: Synthetic peptide
  Seed: TDQVPFSVSV (PMEL_HUMAN)
TSQVPFSVSV

SEQ ID NO: 128413 - protein, 11 aa, Artificial Sequence
  Description of Artificial Sequence: Synthetic peptide
  Seed: AEMSTPEATGM (PMEL_HUMAN)
AVMSTPEATGY

SEQ ID NO: 128414 - protein, 9 aa, Artificial Sequence
  Description of Artificial Sequence: Synthetic peptide
  Seed: VSVSQLRAL (PMEL_HUMAN)
VTVSQLRAL

SEQ ID NO: 128415 - protein, 9 aa, Artificial Sequence
  Description of Artificial Sequence: Synthetic peptide
  Seed: KQDFSVPQL (PMEL_HUMAN)
KTDFSVPQW

SEQ ID NO: 128416 - protein, 10 aa, Artificial Sequence
  Description of Artificial Sequence: Synthetic peptide
  Seed: MTPAEVSIVV (PMEL_HUMAN)
MHPAEVSIVI

SEQ ID NO: 128417 - protein, 9 aa, Artificial Sequence
  Description of Artificial Sequence: Synthetic peptide
  Seed: LTSCGSSPV (PMEL_HUMAN)
LASCGSSPV

SEQ ID NO: 128418 - protein, 10 aa, Artificial Sequence
  Description of Artificial Sequence: Synthetic peptide
  Seed: EVMGTTLAEM (PMEL_HUMAN)
EVMGTTLAEV

SEQ ID NO: 128419 - protein, 10 aa, Artificial Sequence
  Description of Artificial Sequence: Synthetic peptide
  Seed: KRQVPLDCVL (PMEL_HUMAN)
KCQVPLDCVM

SEQ ID NO: 128420 - protein, 10 aa, Artificial Sequence
  Description of Artificial Sequence: Synthetic peptide
  Seed: GTYCLNVSLA (PMEL_HUMAN)
GMYCLNVSLL

SEQ ID NO: 128421 - protein, 10 aa, Artificial Sequence
  Description of Artificial Sequence: Synthetic peptide
  Seed: RALDGGNKHF (PMEL_HUMAN)
RQLDGGNKHW

SEQ ID NO: 128422 - protein, 10 aa, Artificial Sequence
  Description of Artificial Sequence: Synthetic peptide
  Seed: SLADTNSLAV (PMEL_HUMAN)
STADTNSLAV

SEQ ID NO: 128423 - protein, 10 aa, Artificial Sequence
  Description of Artificial Sequence: Synthetic peptide
  Seed: KRQVPLDCVL (PMEL_HUMAN)
KLQVPLDCVF

SEQ ID NO: 128424 - protein, 9 aa, Artificial Sequence
  Description of Artificial Sequence: Synthetic peptide
  Seed: MTPAEVSIV (PMEL_HUMAN)
MPPAEVSIV

SEQ ID NO: 128425 - protein, 11 aa, Artificial Sequence
  Description of Artificial Sequence: Synthetic peptide
  Seed: MAVVLASLIYR (PMEL_HUMAN)
MQVVLASLIYK

SEQ ID NO: 128426 - protein, 9 aa, Artificial Sequence
  Description of Artificial Sequence: Synthetic peptide
  Seed: SVPQLPHSS (PMEL_HUMAN)
SAPQLPHSF

SEQ ID NO: 128427 - protein, 10 aa, Artificial Sequence
  Description of Artificial Sequence: Synthetic peptide
  Seed: SVPQLPHSSS (PMEL_HUMAN)
SNPQLPHSSL

SEQ ID NO: 128428 - protein, 10 aa, Artificial Sequence
  Description of Artificial Sequence: Synthetic peptide
  Seed: MAVVLASLIY (PMEL_HUMAN)
MSVVLASLIY

SEQ ID NO: 128429 - protein, 10 aa, Artificial Sequence
  Description of Artificial Sequence: Synthetic peptide
  Seed: RGSRSYVPLA (PMEL_HUMAN)
RFSRSYVPLT

SEQ ID NO: 128430 - protein, 10 aa, Artificial Sequence
  Description of Artificial Sequence: Synthetic peptide
  Seed: AVIGALLAVG (PMEL_HUMAN)
ALIGALLAVA

SEQ ID NO: 128431 - protein, 10 aa, Artificial Sequence
  Description of Artificial Sequence: Synthetic peptide
  Seed: GPLLDGTATL (PMEL_HUMAN)
GYLLDGTATL

SEQ ID NO: 128432 - protein, 9 aa, Artificial Sequence
  Description of Artificial Sequence: Synthetic peptide
  Seed: DGGNKHFLR (PMEL_HUMAN)
DSGNKHFLK

SEQ ID NO: 128433 - protein, 9 aa, Artificial Sequence
  Description of Artificial Sequence: Synthetic peptide
  Seed: TAPVQMPTA (PMEL_HUMAN)
TTPVQMPTL

SEQ ID NO: 128434 - protein, 8 aa, Artificial Sequence
  Description of Artificial Sequence: Synthetic peptide
  Seed: SNDGPTLI (PMEL_HUMAN)
SVDGPTLL

SEQ ID NO: 128435 - protein, 10 aa, Artificial Sequence
  Description of Artificial Sequence: Synthetic peptide
  Seed: LAVIGALLAV (PMEL_HUMAN)
LIVIGALLAV

SEQ ID NO: 128436 - protein, 9 aa, Artificial Sequence
  Description of Artificial Sequence: Synthetic peptide
  Seed: SGEGDAFEL (PMEL_HUMAN)
SVEGDAFEM

SEQ ID NO: 128437 - protein, 10 aa, Artificial Sequence
  Description of Artificial Sequence: Synthetic peptide
  Seed: KTWGQYWQVL (PMEL_HUMAN)
KAWGQYWQVY

SEQ ID NO: 128438 - protein, 10 aa, Artificial Sequence
  Description of Artificial Sequence: Synthetic peptide
  Seed: QVLGGPVSGL (PMEL_HUMAN)
QFLGGPVSGV

SEQ ID NO: 128439 - protein, 10 aa, Artificial Sequence
  Description of Artificial Sequence: Synthetic peptide
  Seed: RGSRSYVPLA (PMEL_HUMAN)
RQSRSYVPLM

SEQ ID NO: 128440 - protein, 10 aa, Artificial Sequence
  Description of Artificial Sequence: Synthetic peptide
  Seed: ELTVSCQGGL (PMEL_HUMAN)
EVTVSCQGGV

SEQ ID NO: 128441 - protein, 9 aa, Artificial Sequence
  Description of Artificial Sequence: Synthetic peptide
  Seed: QKRSFVYVW (PMEL_HUMAN)
QQRSFVYVY

SEQ ID NO: 128442 - protein, 9 aa, Artificial Sequence
  Description of Artificial Sequence: Synthetic peptide
  Seed: AGLGQVPLI (PMEL_HUMAN)
AVLGQVPLM

SEQ ID NO: 128443 - protein, 9 aa, Artificial Sequence
  Description of Artificial Sequence: Synthetic peptide
  Seed: YHRRGSRSY (PMEL_HUMAN)
YYRRGSRSV

SEQ ID NO: 128444 - protein, 9 aa, Artificial Sequence
  Description of Artificial Sequence: Synthetic peptide
  Seed: RGGQVSLKV (PMEL_HUMAN)
RMGQVSLKI

SEQ ID NO: 128445 - protein, 9 aa, Artificial Sequence
  Description of Artificial Sequence: Synthetic peptide
  Seed: QVWGGQPVY (PMEL_HUMAN)
QSWGGQPVY

SEQ ID NO: 128446 - protein, 9 aa, Artificial Sequence
  Description of Artificial Sequence: Synthetic peptide
  Seed: EVMGTTLAE (PMEL_HUMAN)
ESMGTTLAY

SEQ ID NO: 128447 - protein, 9 aa, Artificial Sequence
  Description of Artificial Sequence: Synthetic peptide
  Seed: VSNDGPTLI (PMEL_HUMAN)
VWNDGPTLM

SEQ ID NO: 128448 - protein, 10 aa, Artificial Sequence
  Description of Artificial Sequence: Synthetic peptide
  Seed: FPDGGPCPSG (PMEL_HUMAN)
FADGGPCPSF

SEQ ID NO: 128449 - protein, 9 aa, Artificial Sequence
  Description of Artificial Sequence: Synthetic peptide
  Seed: LPIPEPEGP (PMEL_HUMAN)
LPIPEPEGM

SEQ ID NO: 128450 - protein, 9 aa, Artificial Sequence
  Description of Artificial Sequence: Synthetic peptide
  Seed: SIGTGRAML (PMEL_HUMAN)
SAGTGRAMM

SEQ ID NO: 128451 - protein, 9 aa, Artificial Sequence
  Description of Artificial Sequence: Synthetic peptide
  Seed: SLGPLLDGT (PMEL_HUMAN)
SIGPLLDGV

SEQ ID NO: 128452 - protein, 9 aa, Artificial Sequence
  Description of Artificial Sequence: Synthetic peptide
  Seed: YLAEADLSY (PMEL_HUMAN)
YAAEADLSF

SEQ ID NO: 128453 - protein, 10 aa, Artificial Sequence
  Description of Artificial Sequence: Synthetic peptide
  Seed: SSSHWLRLPR (PMEL_HUMAN)
SDSHWLRLPK

SEQ ID NO: 128454 - protein, 9 aa, Artificial Sequence
  Description of Artificial Sequence: Synthetic peptide
  Seed: GQVPTTEVV (PMEL_HUMAN)
GEVPTTEVT

SEQ ID NO: 128455 - protein, 9 aa, Artificial Sequence
  Description of Artificial Sequence: Synthetic peptide
  Seed: QLYPEWTEA (PMEL_HUMAN)
QVYPEWTEV

SEQ ID NO: 128456 - protein, 9 aa, Artificial Sequence
  Description of Artificial Sequence: Synthetic peptide
  Seed: LNFPGSQKV (PMEL_HUMAN)
LRFPGSQKM

SEQ ID NO: 128457 - protein, 8 aa, Artificial Sequence
  Description of Artificial Sequence: Synthetic peptide
  Seed: VSNDGPTL (PMEL_HUMAN)
VINDGPTL

SEQ ID NO: 128458 - protein, 9 aa, Artificial Sequence
  Description of Artificial Sequence: Synthetic peptide
  Seed: TAPVQMPTA (PMEL_HUMAN)
TVPVQMPTI

SEQ ID NO: 128459 - protein, 9 aa, Artificial Sequence
  Description of Artificial Sequence: Synthetic peptide
  Seed: HTMEVTVYH (PMEL_HUMAN)
HHMEVTVYR

SEQ ID NO: 128460 - protein, 10 aa, Artificial Sequence
  Description of Artificial Sequence: Synthetic peptide
  Seed: MTPAEVSIVV (PMEL_HUMAN)
MAPAEVSIVA

SEQ ID NO: 128461 - protein, 10 aa, Artificial Sequence
  Description of Artificial Sequence: Synthetic peptide
  Seed: KTWGQYWQVL (PMEL_HUMAN)
KLWGQYWQVV

SEQ ID NO: 128462 - protein, 10 aa, Artificial Sequence
  Description of Artificial Sequence: Synthetic peptide
  Seed: RLMKQDFSVP (PMEL_HUMAN)
RMMKQDFSVL

SEQ ID NO: 128463 - protein, 9 aa, Artificial Sequence
  Description of Artificial Sequence: Synthetic peptide
  Seed: ESAEILQAV (PMEL_HUMAN)
ESAEILQAM

SEQ ID NO: 128464 - protein, 10 aa, Artificial Sequence
  Description of Artificial Sequence: Synthetic peptide
  Seed: RQLYPEWTEA (PMEL_HUMAN)
RSLYPEWTEV

SEQ ID NO: 128465 - protein, 10 aa, Artificial Sequence
  Description of Artificial Sequence: Synthetic peptide
  Seed: VLYRYGSFSV (PMEL_HUMAN)
VTYRYGSFSK

SEQ ID NO: 128466 - protein, 9 aa, Artificial Sequence
  Description of Artificial Sequence: Synthetic peptide
  Seed: FGDSSGTLI (PMEL_HUMAN)
FMDSSGTLF

SEQ ID NO: 128467 - protein, 9 aa, Artificial Sequence
  Description of Artificial Sequence: Synthetic peptide
  Seed: VLMAVVLAS (PMEL_HUMAN)
VAMAVVLAV

SEQ ID NO: 128468 - protein, 11 aa, Artificial Sequence
  Description of Artificial Sequence: Synthetic peptide
  Seed: AVIGALLAVGA (PMEL_HUMAN)
AMIGALLAVGV

SEQ ID NO: 128469 - protein, 11 aa, Artificial Sequence
  Description of Artificial Sequence: Synthetic peptide
  Seed: YVPLAHSSSAF (PMEL_HUMAN)
YMPLAHSSSAM

SEQ ID NO: 128470 - protein, 9 aa, Artificial Sequence
  Description of Artificial Sequence: Synthetic peptide
  Seed: SSIMSTESI (PMEL_HUMAN)
SMIMSTESV

SEQ ID NO: 128471 - protein, 9 aa, Artificial Sequence
  Description of Artificial Sequence: Synthetic peptide
  Seed: RYGSFSVTL (PMEL_HUMAN)
RIGSFSVTF

SEQ ID NO: 128472 - protein, 11 aa, Artificial Sequence
  Description of Artificial Sequence: Synthetic peptide
  Seed: LGPLLDGTATL (PMEL_HUMAN)
LWPLLDGTATV

SEQ ID NO: 128473 - protein, 9 aa, Artificial Sequence
  Description of Artificial Sequence: Synthetic peptide
  Seed: LYRYGSFSV (PMEL_HUMAN)
LFRYGSFSK

SEQ ID NO: 128474 - protein, 11 aa, Artificial Sequence
  Description of Artificial Sequence: Synthetic peptide
  Seed: HTMEVTVYHRR (PMEL_HUMAN)
HLMEVTVYHRK

SEQ ID NO: 128475 - protein, 9 aa, Artificial Sequence
  Description of Artificial Sequence: Synthetic peptide
  Seed: RLMKQDFSV (PMEL_HUMAN)
RAMKQDFSL

SEQ ID NO: 128476 - protein, 11 aa, Artificial Sequence
  Description of Artificial Sequence: Synthetic peptide
  Seed: TYLEPGPVTAQ (PMEL_HUMAN)
TFLEPGPVTAM

SEQ ID NO: 128477 - protein, 9 aa, Artificial Sequence
  Description of Artificial Sequence: Synthetic peptide
  Seed: GSWSQKRSF (PMEL_HUMAN)
GMWSQKRSY

SEQ ID NO: 128478 - protein, 9 aa, Artificial Sequence
  Description of Artificial Sequence: Synthetic peptide
  Seed: GSFSVTLDI (PMEL_HUMAN)
GLFSVTLDI

SEQ ID NO: 128479 - protein, 9 aa, Artificial Sequence
  Description of Artificial Sequence: Synthetic peptide
  Seed: MSTPEATGM (PMEL_HUMAN)
MKTPEATGY

SEQ ID NO: 128480 - protein, 9 aa, Artificial Sequence
  Description of Artificial Sequence: Synthetic peptide
  Seed: FTITDQVPF (PMEL_HUMAN)
FMITDQVPM

SEQ ID NO: 128481 - protein, 9 aa, Artificial Sequence
  Description of Artificial Sequence: Synthetic peptide
  Seed: SLIYRRRLM (PMEL_HUMAN)
SFIYRRRLY

SEQ ID NO: 128482 - protein, 10 aa, Artificial Sequence
  Description of Artificial Sequence: Synthetic peptide
  Seed: VLYRYGSFSV (PMEL_HUMAN)
VLYRYGSFSA

SEQ ID NO: 128483 - protein, 9 aa, Artificial Sequence
  Description of Artificial Sequence: Synthetic peptide
  Seed: RALVVTHTY (PMEL_HUMAN)
RFLVVTHTL

SEQ ID NO: 128484 - protein, 11 aa, Artificial Sequence
  Description of Artificial Sequence: Synthetic peptide
  Seed: RNQPLTFALQL (PMEL_HUMAN)
RPQPLTFALQI

SEQ ID NO: 128485 - protein, 9 aa, Artificial Sequence
  Description of Artificial Sequence: Synthetic peptide
  Seed: VQVPTTEVI (PMEL_HUMAN)
VHVPTTEVM

SEQ ID NO: 128486 - protein, 10 aa, Artificial Sequence
  Description of Artificial Sequence: Synthetic peptide
  Seed: KRQVPLDCVL (PMEL_HUMAN)
KLQVPLDCVM

SEQ ID NO: 128487 - protein, 9 aa, Artificial Sequence
  Description of Artificial Sequence: Synthetic peptide
  Seed: VQVPTTEVI (PMEL_HUMAN)
VEVPTTEVP

SEQ ID NO: 128488 - protein, 9 aa, Artificial Sequence
  Description of Artificial Sequence: Synthetic peptide
  Seed: ANASFSIAL (PMEL_HUMAN)
AAASFSIAF

SEQ ID NO: 128489 - protein, 10 aa, Artificial Sequence
  Description of Artificial Sequence: Synthetic peptide
  Seed: VLPSPACQLV (PMEL_HUMAN)
VLPSPACQLL

SEQ ID NO: 128490 - protein, 9 aa, Artificial Sequence
  Description of Artificial Sequence: Synthetic peptide
  Seed: WSQKRSFVY (PMEL_HUMAN)
WQQKRSFVW

SEQ ID NO: 128491 - protein, 8 aa, Artificial Sequence
  Description of Artificial Sequence: Synthetic peptide
  Seed: TGMTPAEV (PMEL_HUMAN)
TQMTPAEV

SEQ ID NO: 128492 - protein, 9 aa, Artificial Sequence
  Description of Artificial Sequence: Synthetic peptide
  Seed: SQKRSFVYV (PMEL_HUMAN)
SWKRSFVYK

SEQ ID NO: 128493 - protein, 10 aa, Artificial Sequence
  Description of Artificial Sequence: Synthetic peptide
  Seed: MPTAESTGMT (PMEL_HUMAN)
MDTAESTGMI

SEQ ID NO: 128494 - protein, 10 aa, Artificial Sequence
  Description of Artificial Sequence: Synthetic peptide
  Seed: MSTESITGSL (PMEL_HUMAN)
MSTESITGSI

SEQ ID NO: 128495 - protein, 9 aa, Artificial Sequence
  Description of Artificial Sequence: Synthetic peptide
  Seed: RAMLGTHTM (PMEL_HUMAN)
RMMLGTHTM

SEQ ID NO: 128496 - protein, 9 aa, Artificial Sequence
  Description of Artificial Sequence: Synthetic peptide
  Seed: FGDSSGTLI (PMEL_HUMAN)
FNDSSGTLM

SEQ ID NO: 128497 - protein, 9 aa, Artificial Sequence
  Description of Artificial Sequence: Synthetic peptide
  Seed: AVIGALLAV (PMEL_HUMAN)
AAIGALLAI

SEQ ID NO: 128498 - protein, 10 aa, Artificial Sequence
  Description of Artificial Sequence: Synthetic peptide
  Seed: VPQLPHSSSH (PMEL_HUMAN)
VEQLPHSSSL

SEQ ID NO: 128499 - protein, 11 aa, Artificial Sequence
  Description of Artificial Sequence: Synthetic peptide
  Seed: VQMPTAESTGM (PMEL_HUMAN)
VQMPTAESTGY

SEQ ID NO: 128500 - protein, 10 aa, Artificial Sequence
  Description of Artificial Sequence: Synthetic peptide
  Seed: EAPNTTAGQV (PMEL_HUMAN)
EVPNTTAGQV

SEQ ID NO: 128501 - protein, 9 aa, Artificial Sequence
  Description of Artificial Sequence: Synthetic peptide
  Seed: VPLAHSSSA (PMEL_HUMAN)
VVLAHSSSY

SEQ ID NO: 128502 - protein, 9 aa, Artificial Sequence
  Description of Artificial Sequence: Synthetic peptide
  Seed: GTYCLNVSL (PMEL_HUMAN)
GQYCLNVSW

SEQ ID NO: 128503 - protein, 9 aa, Artificial Sequence
  Description of Artificial Sequence: Synthetic peptide
  Seed: TPAEVSIVV (PMEL_HUMAN)
TPAEVSIVT

SEQ ID NO: 128504 - protein, 9 aa, Artificial Sequence
  Description of Artificial Sequence: Synthetic peptide
  Seed: FTITDQVPF (PMEL_HUMAN)
FVITDQVPY

SEQ ID NO: 128505 - protein, 9 aa, Artificial Sequence
  Description of Artificial Sequence: Synthetic peptide
  Seed: TLIGANASF (PMEL_HUMAN)
TIIGANASW

SEQ ID NO: 128506 - protein, 9 aa, Artificial Sequence
  Description of Artificial Sequence: Synthetic peptide
  Seed: SSPGCQPPA (PMEL_HUMAN)
SAPGCQPPF

SEQ ID NO: 128507 - protein, 11 aa, Artificial Sequence
  Description of Artificial Sequence: Synthetic peptide
  Seed: FGDSSGTLISR (PMEL_HUMAN)
FSDSSGTLISV

SEQ ID NO: 128508 - protein, 9 aa, Artificial Sequence
  Description of Artificial Sequence: Synthetic peptide
  Seed: ALDGGNKHF (PMEL_HUMAN)
ASDGGNKHI

SEQ ID NO: 128509 - protein, 9 aa, Artificial Sequence
  Description of Artificial Sequence: Synthetic peptide
  Seed: VISTAPVQM (PMEL_HUMAN)
VFSTAPVQF

SEQ ID NO: 128510 - protein, 9 aa, Artificial Sequence
  Description of Artificial Sequence: Synthetic peptide
  Seed: TAPVQMPTA (PMEL_HUMAN)
TGPVQMPTM

SEQ ID NO: 128511 - protein, 10 aa, Artificial Sequence
  Description of Artificial Sequence: Synthetic peptide
  Seed: SQVWGGQPVY (PMEL_HUMAN)
SKVWGGQPVF

SEQ ID NO: 128512 - protein, 10 aa, Artificial Sequence
  Description of Artificial Sequence: Synthetic peptide
  Seed: KTWGQYWQVL (PMEL_HUMAN)
KYWGQYWQVI

SEQ ID NO: 128513 - protein, 11 aa, Artificial Sequence
  Description of Artificial Sequence: Synthetic peptide
  Seed: ALDGGNKHFLR (PMEL_HUMAN)
AIDGGNKHFLY

SEQ ID NO: 128514 - protein, 9 aa, Artificial Sequence
  Description of Artificial Sequence: Synthetic peptide
  Seed: VQVPTTEVI (PMEL_HUMAN)
VEVPTTEVC

SEQ ID NO: 128515 - protein, 9 aa, Artificial Sequence
  Description of Artificial Sequence: Synthetic peptide
  Seed: LMAVVLASL (PMEL_HUMAN)
LGAVVLASY

SEQ ID NO: 128516 - protein, 10 aa, Artificial Sequence
  Description of Artificial Sequence: Synthetic peptide
  Seed: MTPAEVSIVV (PMEL_HUMAN)
MPPAEVSIVI

SEQ ID NO: 128517 - protein, 11 aa, Artificial Sequence
  Description of Artificial Sequence: Synthetic peptide
  Seed: RRGSRSYVPLA (PMEL_HUMAN)
RLGSRSYVPLK

SEQ ID NO: 128518 - protein, 9 aa, Artificial Sequence
  Description of Artificial Sequence: Synthetic peptide
  Seed: AVIGALLAV (PMEL_HUMAN)
AMIGALLAL

SEQ ID NO: 128519 - protein, 9 aa, Artificial Sequence
  Description of Artificial Sequence: Synthetic peptide
  Seed: VLGGPVSGL (PMEL_HUMAN)
VAGGPVSGL

SEQ ID NO: 128520 - protein, 9 aa, Artificial Sequence
  Description of Artificial Sequence: Synthetic peptide
  Seed: ASFSIALNF (PMEL_HUMAN)
AKFSIALNM

SEQ ID NO: 128521 - protein, 11 aa, Artificial Sequence
  Description of Artificial Sequence: Synthetic peptide
  Seed: FGDSSGTLISR (PMEL_HUMAN)
FVDSSGTLISI

SEQ ID NO: 128522 - protein, 10 aa, Artificial Sequence
  Description of Artificial Sequence: Synthetic peptide
  Seed: STAPVQMPTA (PMEL_HUMAN)
SQAPVQMPTI

SEQ ID NO: 128523 - protein, 9 aa, Artificial Sequence
  Description of Artificial Sequence: Synthetic peptide
  Seed: DGGNKHFLR (PMEL_HUMAN)
DFGNKHFLK

SEQ ID NO: 128524 - protein, 9 aa, Artificial Sequence
  Description of Artificial Sequence: Synthetic peptide
  Seed: FGDSSGTLI (PMEL_HUMAN)
FNDSSGTLL

SEQ ID NO: 128525 - protein, 10 aa, Artificial Sequence
  Description of Artificial Sequence: Synthetic peptide
  Seed: RLMKQDFSVP (PMEL_HUMAN)
RLMKQDFSVI

SEQ ID NO: 128526 - protein, 10 aa, Artificial Sequence
  Description of Artificial Sequence: Synthetic peptide
  Seed: LQLHDPSGYL (PMEL_HUMAN)
LLLHDPSGYY

SEQ ID NO: 128527 - protein, 11 aa, Artificial Sequence
  Description of Artificial Sequence: Synthetic peptide
  Seed: THTMEVTVYHR (PMEL_HUMAN)
TETMEVTVYHK

SEQ ID NO: 128528 - protein, 10 aa, Artificial Sequence
  Description of Artificial Sequence: Synthetic peptide
  Seed: VSLADTNSLA (PMEL_HUMAN)
VWLADTNSLV

SEQ ID NO: 128529 - protein, 9 aa, Artificial Sequence
  Description of Artificial Sequence: Synthetic peptide
  Seed: RALVVTHTY (PMEL_HUMAN)
RSLVVTHTM

SEQ ID NO: 128530 - protein, 9 aa, Artificial Sequence
  Description of Artificial Sequence: Synthetic peptide
  Seed: QLYPEWTEA (PMEL_HUMAN)
QQYPEWTEL

SEQ ID NO: 128531 - protein, 9 aa, Artificial Sequence
  Description of Artificial Sequence: Synthetic peptide
  Seed: QDFSVPQLP (PMEL_HUMAN)
QEFSVPQLC

SEQ ID NO: 128532 - protein, 9 aa, Artificial Sequence
  Description of Artificial Sequence: Synthetic peptide
  Seed: FTITDQVPF (PMEL_HUMAN)
FRITDQVPF

SEQ ID NO: 128533 - protein, 11 aa, Artificial Sequence
  Description of Artificial Sequence: Synthetic peptide
  Seed: YLAEADLSYTW (PMEL_HUMAN)
YMAEADLSYTM

SEQ ID NO: 128534 - protein, 9 aa, Artificial Sequence
  Description of Artificial Sequence: Synthetic peptide
  Seed: DQVPFSVSV (PMEL_HUMAN)
DHVPFSVSM

SEQ ID NO: 128535 - protein, 10 aa, Artificial Sequence
  Description of Artificial Sequence: Synthetic peptide
  Seed: AVIGALLAVG (PMEL_HUMAN)
ALIGALLAVQ

SEQ ID NO: 128536 - protein, 10 aa, Artificial Sequence
  Description of Artificial Sequence: Synthetic peptide
  Seed: VSLADTNSLA (PMEL_HUMAN)
VRLADTNSLV

SEQ ID NO: 128537 - protein, 10 aa, Artificial Sequence
  Description of Artificial Sequence: Synthetic peptide
  Seed: NSLAVVSTQL (PMEL_HUMAN)
NALAVVSTQV

SEQ ID NO: 128538 - protein, 10 aa, Artificial Sequence
  Description of Artificial Sequence: Synthetic peptide
  Seed: WKTWGQYWQV (PMEL_HUMAN)
WVTWGQYWQI

SEQ ID NO: 128539 - protein, 11 aa, Artificial Sequence
  Description of Artificial Sequence: Synthetic peptide
  Seed: KHFLRNQPLTF (PMEL_HUMAN)
KYFLRNQPLTM

SEQ ID NO: 128540 - protein, 9 aa, Artificial Sequence
  Description of Artificial Sequence: Synthetic peptide
  Seed: VISTAPVQM (PMEL_HUMAN)
VVSTAPVQF

SEQ ID NO: 128541 - protein, 10 aa, Artificial Sequence
  Description of Artificial Sequence: Synthetic peptide
  Seed: MLGTHTMEVT (PMEL_HUMAN)
MMGTHTMEVI

SEQ ID NO: 128542 - protein, 9 aa, Artificial Sequence
  Description of Artificial Sequence: Synthetic peptide
  Seed: VVLASLIYR (PMEL_HUMAN)
VFLASLIYR

SEQ ID NO: 128543 - protein, 9 aa, Artificial Sequence
  Description of Artificial Sequence: Synthetic peptide
  Seed: VLQAAIPLT (PMEL_HUMAN)
VVQAAIPLI

SEQ ID NO: 128544 - protein, 11 aa, Artificial Sequence
  Description of Artificial Sequence: Synthetic peptide
  Seed: YVPLAHSSSAF (PMEL_HUMAN)
YIPLAHSSSAY

SEQ ID NO: 128545 - protein, 11 aa, Artificial Sequence
  Description of Artificial Sequence: Synthetic peptide
  Seed: GYLAEADLSYT (PMEL_HUMAN)
GWLAEADLSYL

SEQ ID NO: 128546 - protein, 10 aa, Artificial Sequence
  Description of Artificial Sequence: Synthetic peptide
  Seed: QVLGGPVSGL (PMEL_HUMAN)
QILGGPVSGL

SEQ ID NO: 128547 - protein, 9 aa, Artificial Sequence
  Description of Artificial Sequence: Synthetic peptide
  Seed: LSIGTGRAM (PMEL_HUMAN)
LVIGTGRAL

SEQ ID NO: 128548 - protein, 9 aa, Artificial Sequence
  Description of Artificial Sequence: Synthetic peptide
  Seed: ITDQVPFSV (PMEL_HUMAN)
IIDQVPFSI

SEQ ID NO: 128549 - protein, 11 aa, Artificial Sequence
  Description of Artificial Sequence: Synthetic peptide
  Seed: RLPRIFCSCPI (PMEL_HUMAN)
RHPRIFCSCPL

SEQ ID NO: 128550 - protein, 9 aa, Artificial Sequence
  Description of Artificial Sequence: Synthetic peptide
  Seed: AVIGALLAV (PMEL_HUMAN)
APIGALLAC

SEQ ID NO: 128551 - protein, 11 aa, Artificial Sequence
  Description of Artificial Sequence: Synthetic peptide
  Seed: RRRLMKQDFSV (PMEL_HUMAN)
RYRLMKQDFSV

SEQ ID NO: 128552 - protein, 9 aa, Artificial Sequence
  Description of Artificial Sequence: Synthetic peptide
  Seed: VVLSGTTAA (PMEL_HUMAN)
VPLSGTTAC

SEQ ID NO: 128553 - protein, 9 aa, Artificial Sequence
  Description of Artificial Sequence: Synthetic peptide
  Seed: AVIGALLAV (PMEL_HUMAN)
ARIGALLAL

SEQ ID NO: 128554 - protein, 9 aa, Artificial Sequence
  Description of Artificial Sequence: Synthetic peptide
  Seed: VLPDGQVIW (PMEL_HUMAN)
VVPDGQVIM

SEQ ID NO: 128555 - protein, 9 aa, Artificial Sequence
  Description of Artificial Sequence: Synthetic peptide
  Seed: YLAEADLSY (PMEL_HUMAN)
YWAEADLSI

SEQ ID NO: 128556 - protein, 10 aa, Artificial Sequence
  Description of Artificial Sequence: Synthetic peptide
  Seed: GLSIGTGRAM (PMEL_HUMAN)
GQSIGTGRAF

SEQ ID NO: 128557 - protein, 9 aa, Artificial Sequence
  Description of Artificial Sequence: Synthetic peptide
  Seed: AEADLSYTW (PMEL_HUMAN)
AGADLSYTW

SEQ ID NO: 128558 - protein, 9 aa, Artificial Sequence
  Description of Artificial Sequence: Synthetic peptide
  Seed: RALVVTHTY (PMEL_HUMAN)
RNLVVTHTK

SEQ ID NO: 128559 - protein, 10 aa, Artificial Sequence
  Description of Artificial Sequence: Synthetic peptide
  Seed: GEGDAFELTV (PMEL_HUMAN)
GEGDAFELTF

SEQ ID NO: 128560 - protein, 8 aa, Artificial Sequence
  Description of Artificial Sequence: Synthetic peptide
  Seed: SNDGPTLI (PMEL_HUMAN)
SVDGPTLF

SEQ ID NO: 128561 - protein, 9 aa, Artificial Sequence
  Description of Artificial Sequence: Synthetic peptide
  Seed: DQVPFSVSV (PMEL_HUMAN)
DRVPFSVSV

SEQ ID NO: 128562 - protein, 9 aa, Artificial Sequence
  Description of Artificial Sequence: Synthetic peptide
  Seed: STAPVQMPT (PMEL_HUMAN)
SSAPVQMPI

SEQ ID NO: 128563 - protein, 10 aa, Artificial Sequence
  Description of Artificial Sequence: Synthetic peptide
  Seed: KRQVPLDCVL (PMEL_HUMAN)
KGQVPLDCVF

SEQ ID NO: 128564 - protein, 11 aa, Artificial Sequence
  Description of Artificial Sequence: Synthetic peptide
  Seed: RALDGGNKHFL (PMEL_HUMAN)
RQLDGGNKHFW

SEQ ID NO: 128565 - protein, 9 aa, Artificial Sequence
  Description of Artificial Sequence: Synthetic peptide
  Seed: TEWVETTAR (PMEL_HUMAN)
TMWVETTAR

SEQ ID NO: 128566 - protein, 9 aa, Artificial Sequence
  Description of Artificial Sequence: Synthetic peptide
  Seed: RGSRSYVPL (PMEL_HUMAN)
RVSRSYVPG

SEQ ID NO: 128567 - protein, 9 aa, Artificial Sequence
  Description of Artificial Sequence: Synthetic peptide
  Seed: KQDFSVPQL (PMEL_HUMAN)
KWDFSVPQF

SEQ ID NO: 128568 - protein, 9 aa, Artificial Sequence
  Description of Artificial Sequence: Synthetic peptide
  Seed: QKRSFVYVW (PMEL_HUMAN)
QMRSFVYVF

SEQ ID NO: 128569 - protein, 10 aa, Artificial Sequence
  Description of Artificial Sequence: Synthetic peptide
  Seed: GPLLDGTATL (PMEL_HUMAN)
GFLLDGTATM

SEQ ID NO: 128570 - protein, 10 aa, Artificial Sequence
  Description of Artificial Sequence: Synthetic peptide
  Seed: MPTAESTGMT (PMEL_HUMAN)
MVTAESTGMI

SEQ ID NO: 128571 - protein, 10 aa, Artificial Sequence
  Description of Artificial Sequence: Synthetic peptide
  Seed: RTKAWNRQLY (PMEL_HUMAN)
RLKAWNRQLW

SEQ ID NO: 128572 - protein, 10 aa, Artificial Sequence
  Description of Artificial Sequence: Synthetic peptide
  Seed: SLADTNSLAV (PMEL_HUMAN)
SAADTNSLAL

SEQ ID NO: 128573 - protein, 9 aa, Artificial Sequence
  Description of Artificial Sequence: Synthetic peptide
  Seed: VLKRCLLHL (PMEL_HUMAN)
VIKRCLLHV

SEQ ID NO: 128574 - protein, 9 aa, Artificial Sequence
  Description of Artificial Sequence: Synthetic peptide
  Seed: EGDAFELTV (PMEL_HUMAN)
ESDAFELTL

SEQ ID NO: 128575 - protein, 9 aa, Artificial Sequence
  Description of Artificial Sequence: Synthetic peptide
  Seed: RTKAWNRQL (PMEL_HUMAN)
RTKAWNRQV

SEQ ID NO: 128576 - protein, 9 aa, Artificial Sequence
  Description of Artificial Sequence: Synthetic peptide
  Seed: KAWNRQLYP (PMEL_HUMAN)
KSWNRQLYY

SEQ ID NO: 128577 - protein, 9 aa, Artificial Sequence
  Description of Artificial Sequence: Synthetic peptide
  Seed: VVLSGTTAA (PMEL_HUMAN)
VMLSGTTAV

SEQ ID NO: 128578 - protein, 9 aa, Artificial Sequence
  Description of Artificial Sequence: Synthetic peptide
  Seed: VVLSGTTAA (PMEL_HUMAN)
VGLSGTTAL

SEQ ID NO: 128579 - protein, 9 aa, Artificial Sequence
  Description of Artificial Sequence: Synthetic peptide
  Seed: SITGSLGPL (PMEL_HUMAN)
SLTGSLGPF

SEQ ID NO: 128580 - protein, 10 aa, Artificial Sequence
  Description of Artificial Sequence: Synthetic peptide
  Seed: YVPLAHSSSA (PMEL_HUMAN)
YYPLAHSSSA

SEQ ID NO: 128581 - protein, 9 aa, Artificial Sequence
  Description of Artificial Sequence: Synthetic peptide
  Seed: TLISRALVV (PMEL_HUMAN)
TMISRALVY

SEQ ID NO: 128582 - protein, 9 aa, Artificial Sequence
  Description of Artificial Sequence: Synthetic peptide
  Seed: ITDQVPFSV (PMEL_HUMAN)
ISDQVPFSW

SEQ ID NO: 128583 - protein, 10 aa, Artificial Sequence
  Description of Artificial Sequence: Synthetic peptide
  Seed: VLMAVVLASL (PMEL_HUMAN)
VSMAVVLASL

SEQ ID NO: 128584 - protein, 10 aa, Artificial Sequence
  Description of Artificial Sequence: Synthetic peptide
  Seed: RLMKQDFSVP (PMEL_HUMAN)
RLMKQDFSVA

SEQ ID NO: 128585 - protein, 9 aa, Artificial Sequence
  Description of Artificial Sequence: Synthetic peptide
  Seed: APVQMPTAE (PMEL_HUMAN)
APVQMPTAI

SEQ ID NO: 128586 - protein, 9 aa, Artificial Sequence
  Description of Artificial Sequence: Synthetic peptide
  Seed: DQVPFSVSV (PMEL_HUMAN)
DTVPFSVSI

SEQ ID NO: 128587 - protein, 9 aa, Artificial Sequence
  Description of Artificial Sequence: Synthetic peptide
  Seed: GTATLRLVK (PMEL_HUMAN)
GTATLRLVR

SEQ ID NO: 128588 - protein, 9 aa, Artificial Sequence
  Description of Artificial Sequence: Synthetic peptide
  Seed: DAFELTVSC (PMEL_HUMAN)
DSFELTVSL

SEQ ID NO: 128589 - protein, 10 aa, Artificial Sequence
  Description of Artificial Sequence: Synthetic peptide
  Seed: ESAEILQAVP (PMEL_HUMAN)
EVAEILQAVR

SEQ ID NO: 128590 - protein, 9 aa, Artificial Sequence
  Description of Artificial Sequence: Synthetic peptide
  Seed: GMTPAEVSI (PMEL_HUMAN)
GMTPAEVSF

SEQ ID NO: 128591 - protein, 9 aa, Artificial Sequence
  Description of Artificial Sequence: Synthetic peptide
  Seed: YVWKTWGQY (PMEL_HUMAN)
YEWKTWGQF

SEQ ID NO: 128592 - protein, 9 aa, Artificial Sequence
  Description of Artificial Sequence: Synthetic peptide
  Seed: FTITDQVPF (PMEL_HUMAN)
FMITDQVPF

SEQ ID NO: 128593 - protein, 11 aa, Artificial Sequence
  Description of Artificial Sequence: Synthetic peptide
  Seed: FTITDQVPFSV (PMEL_HUMAN)
FMITDQVPFSI

SEQ ID NO: 128594 - protein, 9 aa, Artificial Sequence
  Description of Artificial Sequence: Synthetic peptide
  Seed: ASFSIALNF (PMEL_HUMAN)
ARFSIALNY

SEQ ID NO: 128595 - protein, 9 aa, Artificial Sequence
  Description of Artificial Sequence: Synthetic peptide
  Seed: SAFTITDQV (PMEL_HUMAN)
SLFTITDQL

SEQ ID NO: 128596 - protein, 9 aa, Artificial Sequence
  Description of Artificial Sequence: Synthetic peptide
  Seed: AVVSTQLIM (PMEL_HUMAN)
AAVSTQLIF

SEQ ID NO: 128597 - protein, 9 aa, Artificial Sequence
  Description of Artificial Sequence: Synthetic peptide
  Seed: SQKRSFVYV (PMEL_HUMAN)
SVKRSFVYF

SEQ ID NO: 128598 - protein, 10 aa, Artificial Sequence
  Description of Artificial Sequence: Synthetic peptide
  Seed: AEMSTPEATG (PMEL_HUMAN)
AEMSTPEATF

SEQ ID NO: 128599 - protein, 10 aa, Artificial Sequence
  Description of Artificial Sequence: Synthetic peptide
  Seed: GPLLDGTATL (PMEL_HUMAN)
GQLLDGTATA

SEQ ID NO: 128600 - protein, 9 aa, Artificial Sequence
  Description of Artificial Sequence: Synthetic peptide
  Seed: RALDGGNKH (PMEL_HUMAN)
RQLDGGNKL

SEQ ID NO: 128601 - protein, 9 aa, Artificial Sequence
  Description of Artificial Sequence: Synthetic peptide
  Seed: VVLQAAIPL (PMEL_HUMAN)
VPLQAAIPA

SEQ ID NO: 128602 - protein, 10 aa, Artificial Sequence
  Description of Artificial Sequence: Synthetic peptide
  Seed: YVWKTWGQYW (PMEL_HUMAN)
YQWKTWGQYW

SEQ ID NO: 128603 - protein, 10 aa, Artificial Sequence
  Description of Artificial Sequence: Synthetic peptide
  Seed: MTPAEVSIVV (PMEL_HUMAN)
MPPAEVSIVY

SEQ ID NO: 128604 - protein, 10 aa, Artificial Sequence
  Description of Artificial Sequence: Synthetic peptide
  Seed: RGSRSYVPLA (PMEL_HUMAN)
RVSRSYVPLP

SEQ ID NO: 128605 - protein, 11 aa, Artificial Sequence
  Description of Artificial Sequence: Synthetic peptide
  Seed: RQLRTKAWNRQ (PMEL_HUMAN)
RYLRTKAWNRR

SEQ ID NO: 128606 - protein, 11 aa, Artificial Sequence
  Description of Artificial Sequence: Synthetic peptide
  Seed: RQLRTKAWNRQ (PMEL_HUMAN)
RMLRTKAWNRR

SEQ ID NO: 128607 - protein, 9 aa, Artificial Sequence
  Description of Artificial Sequence: Synthetic peptide
  Seed: TPAEVSIVV (PMEL_HUMAN)
TPAEVSIVY

SEQ ID NO: 128608 - protein, 9 aa, Artificial Sequence
  Description of Artificial Sequence: Synthetic peptide
  Seed: VLPSPACQL (PMEL_HUMAN)
VYPSPACQY

SEQ ID NO: 128609 - protein, 10 aa, Artificial Sequence
  Description of Artificial Sequence: Synthetic peptide
  Seed: KRQVPLDCVL (PMEL_HUMAN)
KVQVPLDCVF

SEQ ID NO: 128610 - protein, 10 aa, Artificial Sequence
  Description of Artificial Sequence: Synthetic peptide
  Seed: QVLGGPVSGL (PMEL_HUMAN)
QALGGPVSGK

SEQ ID NO: 128611 - protein, 9 aa, Artificial Sequence
  Description of Artificial Sequence: Synthetic peptide
  Seed: YLEPGPVTA (PMEL_HUMAN)
YMEPGPVTY

SEQ ID NO: 128612 - protein, 9 aa, Artificial Sequence
  Description of Artificial Sequence: Synthetic peptide
  Seed: RQVPLDCVL (PMEL_HUMAN)
RKVPLDCVF

SEQ ID NO: 128613 - protein, 10 aa, Artificial Sequence
  Description of Artificial Sequence: Synthetic peptide
  Seed: MTPAEVSIVV (PMEL_HUMAN)
MWPAEVSIVY

SEQ ID NO: 128614 - protein, 10 aa, Artificial Sequence
  Description of Artificial Sequence: Synthetic peptide
  Seed: VSLADTNSLA (PMEL_HUMAN)
VCLADTNSLV

SEQ ID NO: 128615 - protein, 9 aa, Artificial Sequence
  Description of Artificial Sequence: Synthetic peptide
  Seed: LHDPSGYLA (PMEL_HUMAN)
LQDPSGYLL

SEQ ID NO: 128616 - protein, 9 aa, Artificial Sequence
  Description of Artificial Sequence: Synthetic peptide
  Seed: KHFLRNQPL (PMEL_HUMAN)
KQFLRNQPF

SEQ ID NO: 128617 - protein, 9 aa, Artificial Sequence
  Description of Artificial Sequence: Synthetic peptide
  Seed: KQDFSVPQL (PMEL_HUMAN)
KYDFSVPQF

SEQ ID NO: 128618 - protein, 9 aa, Artificial Sequence
  Description of Artificial Sequence: Synthetic peptide
  Seed: SAFTITDQV (PMEL_HUMAN)
SIFTITDQW

SEQ ID NO: 128619 - protein, 9 aa, Artificial Sequence
  Description of Artificial Sequence: Synthetic peptide
  Seed: TIINGSQVW (PMEL_HUMAN)
TAINGSQVV

SEQ ID NO: 128620 - protein, 11 aa, Artificial Sequence
  Description of Artificial Sequence: Synthetic peptide
  Seed: RALDGGNKHFL (PMEL_HUMAN)
RILDGGNKHFI

SEQ ID NO: 128621 - protein, 9 aa, Artificial Sequence
  Description of Artificial Sequence: Synthetic peptide
  Seed: AEADLSYTW (PMEL_HUMAN)
AKADLSYTY

SEQ ID NO: 128622 - protein, 9 aa, Artificial Sequence
  Description of Artificial Sequence: Synthetic peptide
  Seed: FSVSVSQLR (PMEL_HUMAN)
FAVSVSQLK

SEQ ID NO: 128623 - protein, 9 aa, Artificial Sequence
  Description of Artificial Sequence: Synthetic peptide
  Seed: ESAEILQAV (PMEL_HUMAN)
EIAEILQAV

SEQ ID NO: 128624 - protein, 11 aa, Artificial Sequence
  Description of Artificial Sequence: Synthetic peptide
  Seed: ISRALVVTHTY (PMEL_HUMAN)
INRALVVTHTW

SEQ ID NO: 128625 - protein, 9 aa, Artificial Sequence
  Description of Artificial Sequence: Synthetic peptide
  Seed: AVVLASLIY (PMEL_HUMAN)
AKVLASLIF

SEQ ID NO: 128626 - protein, 11 aa, Artificial Sequence
  Description of Artificial Sequence: Synthetic peptide
  Seed: MPGQEAGLGQV (PMEL_HUMAN)
MPGQEAGLGQL

SEQ ID NO: 128627 - protein, 9 aa, Artificial Sequence
  Description of Artificial Sequence: Synthetic peptide
  Seed: SHWLRLPRI (PMEL_HUMAN)
SQWLRLPRV

SEQ ID NO: 128628 - protein, 9 aa, Artificial Sequence
  Description of Artificial Sequence: Synthetic peptide
  Seed: ESAEILQAV (PMEL_HUMAN)
EPAEILQAV

SEQ ID NO: 128629 - protein, 9 aa, Artificial Sequence
  Description of Artificial Sequence: Synthetic peptide
  Seed: AEPSGTTSV (PMEL_HUMAN)
AEPSGTTSL

SEQ ID NO: 128630 - protein, 9 aa, Artificial Sequence
  Description of Artificial Sequence: Synthetic peptide
  Seed: SAFTITDQV (PMEL_HUMAN)
SQFTITDQA

SEQ ID NO: 128631 - protein, 9 aa, Artificial Sequence
  Description of Artificial Sequence: Synthetic peptide
  Seed: YLEPGPVTA (PMEL_HUMAN)
YPEPGPVTP

SEQ ID NO: 128632 - protein, 10 aa, Artificial Sequence
  Description of Artificial Sequence: Synthetic peptide
  Seed: MTPAEVSIVV (PMEL_HUMAN)
MMPAEVSIVY

SEQ ID NO: 128633 - protein, 9 aa, Artificial Sequence
  Description of Artificial Sequence: Synthetic peptide
  Seed: FTITDQVPF (PMEL_HUMAN)
FWITDQVPL

SEQ ID NO: 128634 - protein, 10 aa, Artificial Sequence
  Description of Artificial Sequence: Synthetic peptide
  Seed: EVMGTTLAEM (PMEL_HUMAN)
ETMGTTLAEL

SEQ ID NO: 128635 - protein, 9 aa, Artificial Sequence
  Description of Artificial Sequence: Synthetic peptide
  Seed: HTMEVTVYH (PMEL_HUMAN)
HTMEVTVYF

SEQ ID NO: 128636 - protein, 9 aa, Artificial Sequence
  Description of Artificial Sequence: Synthetic peptide
  Seed: FGDSSGTLI (PMEL_HUMAN)
FVDSSGTLF

SEQ ID NO: 128637 - protein, 10 aa, Artificial Sequence
  Description of Artificial Sequence: Synthetic peptide
  Seed: RQLYPEWTEA (PMEL_HUMAN)
RTLYPEWTEY

SEQ ID NO: 128638 - protein, 10 aa, Artificial Sequence
  Description of Artificial Sequence: Synthetic peptide
  Seed: RSYVPLAHSS (PMEL_HUMAN)
RFYVPLAHSK

SEQ ID NO: 128639 - protein, 10 aa, Artificial Sequence
  Description of Artificial Sequence: Synthetic peptide
  Seed: MAVVLASLIY (PMEL_HUMAN)
MMVVLASLIF

SEQ ID NO: 128640 - protein, 10 aa, Artificial Sequence
  Description of Artificial Sequence: Synthetic peptide
  Seed: VSLADTNSLA (PMEL_HUMAN)
VELADTNSLI

SEQ ID NO: 128641 - protein, 9 aa, Artificial Sequence
  Description of Artificial Sequence: Synthetic peptide
  Seed: FGDSSGTLI (PMEL_HUMAN)
FVDSSGTLC

SEQ ID NO: 128642 - protein, 9 aa, Artificial Sequence
  Description of Artificial Sequence: Synthetic peptide
  Seed: ANASFSIAL (PMEL_HUMAN)
AEASFSIAF

SEQ ID NO: 128643 - protein, 9 aa, Artificial Sequence
  Description of Artificial Sequence: Synthetic peptide
  Seed: SEVMGTTLA (PMEL_HUMAN)
SEVMGTTLT

SEQ ID NO: 128644 - protein, 9 aa, Artificial Sequence
  Description of Artificial Sequence: Synthetic peptide
  Seed: NDGPTLIGA (PMEL_HUMAN)
NEGPTLIGV

SEQ ID NO: 128645 - protein, 10 aa, Artificial Sequence
  Description of Artificial Sequence: Synthetic peptide
  Seed: LIMPGQEAGL (PMEL_HUMAN)
LTMPGQEAGV

SEQ ID NO: 128646 - protein, 9 aa, Artificial Sequence
  Description of Artificial Sequence: Synthetic peptide
  Seed: VLPSPACQL (PMEL_HUMAN)
VVPSPACQV

SEQ ID NO: 128647 - protein, 10 aa, Artificial Sequence
  Description of Artificial Sequence: Synthetic peptide
  Seed: LVLMAVVLAS (PMEL_HUMAN)
LKLMAVVLAL

SEQ ID NO: 128648 - protein, 9 aa, Artificial Sequence
  Description of Artificial Sequence: Synthetic peptide
  Seed: VLPSPACQL (PMEL_HUMAN)
VWPSPACQL

SEQ ID NO: 128649 - protein, 9 aa, Artificial Sequence
  Description of Artificial Sequence: Synthetic peptide
  Seed: SAFTITDQV (PMEL_HUMAN)
SLFTITDQT

SEQ ID NO: 128650 - protein, 9 aa, Artificial Sequence
  Description of Artificial Sequence: Synthetic peptide
  Seed: VSCQGGLPK (PMEL_HUMAN)
VACQGGLPM

SEQ ID NO: 128651 - protein, 10 aa, Artificial Sequence
  Description of Artificial Sequence: Synthetic peptide
  Seed: GPLLDGTATL (PMEL_HUMAN)
GALLDGTATI

SEQ ID NO: 128652 - protein, 10 aa, Artificial Sequence
  Description of Artificial Sequence: Synthetic peptide
  Seed: MAVVLASLIY (PMEL_HUMAN)
MHVVLASLIR

SEQ ID NO: 128653 - protein, 9 aa, Artificial Sequence
  Description of Artificial Sequence: Synthetic peptide
  Seed: MLGTHTMEV (PMEL_HUMAN)
MSGTHTMEM

SEQ ID NO: 128654 - protein, 10 aa, Artificial Sequence
  Description of Artificial Sequence: Synthetic peptide
  Seed: FSVSVSQLRA (PMEL_HUMAN)
FTVSVSQLRY

SEQ ID NO: 128655 - protein, 9 aa, Artificial Sequence
  Description of Artificial Sequence: Synthetic peptide
  Seed: DQVPFSVSV (PMEL_HUMAN)
DMVPFSVSY

SEQ ID NO: 128656 - protein, 10 aa, Artificial Sequence
  Description of Artificial Sequence: Synthetic peptide
  Seed: LVLMAVVLAS (PMEL_HUMAN)
LQLMAVVLAM

SEQ ID NO: 128657 - protein, 9 aa, Artificial Sequence
  Description of Artificial Sequence: Synthetic peptide
  Seed: RNQPLTFAL (PMEL_HUMAN)
RSQPLTFAL

SEQ ID NO: 128658 - protein, 9 aa, Artificial Sequence
  Description of Artificial Sequence: Synthetic peptide
  Seed: MAVVLASLI (PMEL_HUMAN)
MSVVLASLW

SEQ ID NO: 128659 - protein, 9 aa, Artificial Sequence
  Description of Artificial Sequence: Synthetic peptide
  Seed: VTLDIVQGI (PMEL_HUMAN)
VVLDIVQGL

SEQ ID NO: 128660 - protein, 10 aa, Artificial Sequence
  Description of Artificial Sequence: Synthetic peptide
  Seed: THTMEVTVYH (PMEL_HUMAN)
TKTMEVTVYR

SEQ ID NO: 128661 - protein, 10 aa, Artificial Sequence
  Description of Artificial Sequence: Synthetic peptide
  Seed: WKTWGQYWQV (PMEL_HUMAN)
WSTWGQYWQV

SEQ ID NO: 128662 - protein, 9 aa, Artificial Sequence
  Description of Artificial Sequence: Synthetic peptide
  Seed: AGLGQVPLI (PMEL_HUMAN)
AMLGQVPLM

SEQ ID NO: 128663 - protein, 9 aa, Artificial Sequence
  Description of Artificial Sequence: Synthetic peptide
  Seed: KHFLRNQPL (PMEL_HUMAN)
KSFLRNQPM

SEQ ID NO: 128664 - protein, 9 aa, Artificial Sequence
  Description of Artificial Sequence: Synthetic peptide
  Seed: SQVWGGQPV (PMEL_HUMAN)
SSVWGGQPI

SEQ ID NO: 128665 - protein, 10 aa, Artificial Sequence
  Description of Artificial Sequence: Synthetic peptide
  Seed: VLMAVVLASL (PMEL_HUMAN)
VNMAVVLASF

SEQ ID NO: 128666 - protein, 9 aa, Artificial Sequence
  Description of Artificial Sequence: Synthetic peptide
  Seed: DQVPFSVSV (PMEL_HUMAN)
DGVPFSVSY

SEQ ID NO: 128667 - protein, 10 aa, Artificial Sequence
  Description of Artificial Sequence: Synthetic peptide
  Seed: LIMPGQEAGL (PMEL_HUMAN)
LLMPGQEAGA

SEQ ID NO: 128668 - protein, 9 aa, Artificial Sequence
  Description of Artificial Sequence: Synthetic peptide
  Seed: VETTARELP (PMEL_HUMAN)
VETTARELV

SEQ ID NO: 128669 - protein, 9 aa, Artificial Sequence
  Description of Artificial Sequence: Synthetic peptide
  Seed: GSRSYVPLA (PMEL_HUMAN)
GTRSYVPLL

SEQ ID NO: 128670 - protein, 10 aa, Artificial Sequence
  Description of Artificial Sequence: Synthetic peptide
  Seed: AVIGALLAVG (PMEL_HUMAN)
AMIGALLAVF

SEQ ID NO: 128671 - protein, 9 aa, Artificial Sequence
  Description of Artificial Sequence: Synthetic peptide
  Seed: SLAVVSTQL (PMEL_HUMAN)
SLAVVSTQA

SEQ ID NO: 128672 - protein, 9 aa, Artificial Sequence
  Description of Artificial Sequence: Synthetic peptide
  Seed: VSLADTNSL (PMEL_HUMAN)
VGLADTNSW

SEQ ID NO: 128673 - protein, 10 aa, Artificial Sequence
  Description of Artificial Sequence: Synthetic peptide
  Seed: EVISTAPVQM (PMEL_HUMAN)
ETISTAPVQL

SEQ ID NO: 128674 - protein, 9 aa, Artificial Sequence
  Description of Artificial Sequence: Synthetic peptide
  Seed: VPFSVSVSQ (PMEL_HUMAN)
VPFSVSVST

SEQ ID NO: 128675 - protein, 10 aa, Artificial Sequence
  Description of Artificial Sequence: Synthetic peptide
  Seed: YGSFSVTLDI (PMEL_HUMAN)
YSSFSVTLDW

SEQ ID NO: 128676 - protein, 10 aa, Artificial Sequence
  Description of Artificial Sequence: Synthetic peptide
  Seed: KRQVPLDCVL (PMEL_HUMAN)
KYQVPLDCVM

SEQ ID NO: 128677 - protein, 9 aa, Artificial Sequence
  Description of Artificial Sequence: Synthetic peptide
  Seed: QVWGGQPVY (PMEL_HUMAN)
QEWGGQPVF

SEQ ID NO: 128678 - protein, 9 aa, Artificial Sequence
  Description of Artificial Sequence: Synthetic peptide
  Seed: RLMKQDFSV (PMEL_HUMAN)
RAMKQDFSM

SEQ ID NO: 128679 - protein, 9 aa, Artificial Sequence
  Description of Artificial Sequence: Synthetic peptide
  Seed: VSNDGPTLI (PMEL_HUMAN)
VFNDGPTLY

SEQ ID NO: 128680 - protein, 9 aa, Artificial Sequence
  Description of Artificial Sequence: Synthetic peptide
  Seed: VQMPTAEST (PMEL_HUMAN)
VVMPTAESA

SEQ ID NO: 128681 - protein, 10 aa, Artificial Sequence
  Description of Artificial Sequence: Synthetic peptide
  Seed: YVPLAHSSSA (PMEL_HUMAN)
YKPLAHSSSM

SEQ ID NO: 128682 - protein, 9 aa, Artificial Sequence
  Description of Artificial Sequence: Synthetic peptide
  Seed: RLVKRQVPL (PMEL_HUMAN)
RSVKRQVPF

SEQ ID NO: 128683 - protein, 9 aa, Artificial Sequence
  Description of Artificial Sequence: Synthetic peptide
  Seed: VLPSPACQL (PMEL_HUMAN)
VTPSPACQV

SEQ ID NO: 128684 - protein, 9 aa, Artificial Sequence
  Description of Artificial Sequence: Synthetic peptide
  Seed: HTMEVTVYH (PMEL_HUMAN)
HLMEVTVYF

SEQ ID NO: 128685 - protein, 9 aa, Artificial Sequence
  Description of Artificial Sequence: Synthetic peptide
  Seed: TEWVETTAR (PMEL_HUMAN)
TVWVETTAK

SEQ ID NO: 128686 - protein, 10 aa, Artificial Sequence
  Description of Artificial Sequence: Synthetic peptide
  Seed: FSVSVSQLRA (PMEL_HUMAN)
FTVSVSQLRD

SEQ ID NO: 128687 - protein, 9 aa, Artificial Sequence
  Description of Artificial Sequence: Synthetic peptide
  Seed: VSRQLRTKA (PMEL_HUMAN)
VMRQLRTKK

SEQ ID NO: 128688 - protein, 11 aa, Artificial Sequence
  Description of Artificial Sequence: Synthetic peptide
  Seed: ISRALVVTHTY (PMEL_HUMAN)
IIRALVVTHTW

SEQ ID NO: 128689 - protein, 9 aa, Artificial Sequence
  Description of Artificial Sequence: Synthetic peptide
  Seed: AEPSGTTSV (PMEL_HUMAN)
AIPSGTTSF

SEQ ID NO: 128690 - protein, 9 aa, Artificial Sequence
  Description of Artificial Sequence: Synthetic peptide
  Seed: SITGSLGPL (PMEL_HUMAN)
SLTGSLGPV

SEQ ID NO: 128691 - protein, 11 aa, Artificial Sequence
  Description of Artificial Sequence: Synthetic peptide
  Seed: KVLPDGQVIWV (PMEL_HUMAN)
KQLPDGQVIWI

SEQ ID NO: 128692 - protein, 9 aa, Artificial Sequence
  Description of Artificial Sequence: Synthetic peptide
  Seed: VLKRCLLHL (PMEL_HUMAN)
VQKRCLLHF

SEQ ID NO: 128693 - protein, 9 aa, Artificial Sequence
  Description of Artificial Sequence: Synthetic peptide
  Seed: GQVPTTEVV (PMEL_HUMAN)
GKVPTTEVF

SEQ ID NO: 128694 - protein, 10 aa, Artificial Sequence
  Description of Artificial Sequence: Synthetic peptide
  Seed: RALDGGNKHF (PMEL_HUMAN)
RLLDGGNKHL

SEQ ID NO: 128695 - protein, 9 aa, Artificial Sequence
  Description of Artificial Sequence: Synthetic peptide
  Seed: GQVPLIVGI (PMEL_HUMAN)
GVVPLIVGI

SEQ ID NO: 128696 - protein, 10 aa, Artificial Sequence
  Description of Artificial Sequence: Synthetic peptide
  Seed: RGSRSYVPLA (PMEL_HUMAN)
RVSRSYVPLV

SEQ ID NO: 128697 - protein, 10 aa, Artificial Sequence
  Description of Artificial Sequence: Synthetic peptide
  Seed: GRAMLGTHTM (PMEL_HUMAN)
GMAMLGTHTY

SEQ ID NO: 128698 - protein, 10 aa, Artificial Sequence
  Description of Artificial Sequence: Synthetic peptide
  Seed: SGTYCLNVSL (PMEL_HUMAN)
SPTYCLNVSF

SEQ ID NO: 128699 - protein, 10 aa, Artificial Sequence
  Description of Artificial Sequence: Synthetic peptide
  Seed: VPLAHSSSAF (PMEL_HUMAN)
VVLAHSSSAY

SEQ ID NO: 128700 - protein, 9 aa, Artificial Sequence
  Description of Artificial Sequence: Synthetic peptide
  Seed: ILKGGSGTY (PMEL_HUMAN)
IQKGGSGTL

SEQ ID NO: 128701 - protein, 10 aa, Artificial Sequence
  Description of Artificial Sequence: Synthetic peptide
  Seed: THTMEVTVYH (PMEL_HUMAN)
TMTMEVTVYK

SEQ ID NO: 128702 - protein, 10 aa, Artificial Sequence
  Description of Artificial Sequence: Synthetic peptide
  Seed: YVPLAHSSSA (PMEL_HUMAN)
YIPLAHSSSF

SEQ ID NO: 128703 - protein, 9 aa, Artificial Sequence
  Description of Artificial Sequence: Synthetic peptide
  Seed: AESTGMTPE (PMEL_HUMAN)
AESTGMTPA

SEQ ID NO: 128704 - protein, 9 aa, Artificial Sequence
  Description of Artificial Sequence: Synthetic peptide
  Seed: ASLIYRRRL (PMEL_HUMAN)
ATLIYRRRW

SEQ ID NO: 128705 - protein, 11 aa, Artificial Sequence
  Description of Artificial Sequence: Synthetic peptide
  Seed: FTITDQVPFSV (PMEL_HUMAN)
FTITDQVPFSW

SEQ ID NO: 128706 - protein, 10 aa, Artificial Sequence
  Description of Artificial Sequence: Synthetic peptide
  Seed: KTWGQYWQVL (PMEL_HUMAN)
KLWGQYWQVD

SEQ ID NO: 128707 - protein, 11 aa, Artificial Sequence
  Description of Artificial Sequence: Synthetic peptide
  Seed: RSFVYVWKTWG (PMEL_HUMAN)
RTFVYVWKTWW

SEQ ID NO: 128708 - protein, 10 aa, Artificial Sequence
  Description of Artificial Sequence: Synthetic peptide
  Seed: RSFVYVWKTW (PMEL_HUMAN)
RWFVYVWKTI

SEQ ID NO: 128709 - protein, 10 aa, Artificial Sequence
  Description of Artificial Sequence: Synthetic peptide
  Seed: STAPVQMPTA (PMEL_HUMAN)
SSAPVQMPTV

SEQ ID NO: 128710 - protein, 9 aa, Artificial Sequence
  Description of Artificial Sequence: Synthetic peptide
  Seed: VVLASLIYR (PMEL_HUMAN)
VALASLIYR

SEQ ID NO: 128711 - protein, 8 aa, Artificial Sequence
  Description of Artificial Sequence: Synthetic peptide
  Seed: LLDGTATL (PMEL_HUMAN)
LNDGTATL

SEQ ID NO: 128712 - protein, 9 aa, Artificial Sequence
  Description of Artificial Sequence: Synthetic peptide
  Seed: VSEVMGTTL (PMEL_HUMAN)
VLEVMGTTL

SEQ ID NO: 128713 - protein, 10 aa, Artificial Sequence
  Description of Artificial Sequence: Synthetic peptide
  Seed: SVTLDIVQGI (PMEL_HUMAN)
SNTLDIVQGV

SEQ ID NO: 128714 - protein, 10 aa, Artificial Sequence
  Description of Artificial Sequence: Synthetic peptide
  Seed: VLMAVVLASL (PMEL_HUMAN)
VMMAVVLASK

SEQ ID NO: 128715 - protein, 10 aa, Artificial Sequence
  Description of Artificial Sequence: Synthetic peptide
  Seed: RGSRSYVPLA (PMEL_HUMAN)
RDSRSYVPLL

SEQ ID NO: 128716 - protein, 9 aa, Artificial Sequence
  Description of Artificial Sequence: Synthetic peptide
  Seed: DAFELTVSC (PMEL_HUMAN)
DQFELTVSV

SEQ ID NO: 128717 - protein, 8 aa, Artificial Sequence
  Description of Artificial Sequence: Synthetic peptide
  Seed: VSNDGPTL (PMEL_HUMAN)
VANDGPTL

SEQ ID NO: 128718 - protein, 9 aa, Artificial Sequence
  Description of Artificial Sequence: Synthetic peptide
  Seed: ASFSIALNF (PMEL_HUMAN)
AAFSIALNW

SEQ ID NO: 128719 - protein, 9 aa, Artificial Sequence
  Description of Artificial Sequence: Synthetic peptide
  Seed: TTDGHRPTA (PMEL_HUMAN)
TADGHRPTV

SEQ ID NO: 128720 - protein, 9 aa, Artificial Sequence
  Description of Artificial Sequence: Synthetic peptide
  Seed: LEPGPVTAQ (PMEL_HUMAN)
LEPGPVTAI

SEQ ID NO: 128721 - protein, 10 aa, Artificial Sequence
  Description of Artificial Sequence: Synthetic peptide
  Seed: LAVIGALLAV (PMEL_HUMAN)
LPVIGALLAA

SEQ ID NO: 128722 - protein, 10 aa, Artificial Sequence
  Description of Artificial Sequence: Synthetic peptide
  Seed: RGSRSYVPLA (PMEL_HUMAN)
RMSRSYVPLI

SEQ ID NO: 128723 - protein, 10 aa, Artificial Sequence
  Description of Artificial Sequence: Synthetic peptide
  Seed: SCPIGENSPL (PMEL_HUMAN)
SAPIGENSPL

SEQ ID NO: 128724 - protein, 11 aa, Artificial Sequence
  Description of Artificial Sequence: Synthetic peptide
  Seed: RAMLGTHTMEV (PMEL_HUMAN)
RSMLGTHTMEV

SEQ ID NO: 128725 - protein, 10 aa, Artificial Sequence
  Description of Artificial Sequence: Synthetic peptide
  Seed: ELTVSCQGGL (PMEL_HUMAN)
EQTVSCQGGV

SEQ ID NO: 128726 - protein, 9 aa, Artificial Sequence
  Description of Artificial Sequence: Synthetic peptide
  Seed: VSVSQLRAL (PMEL_HUMAN)
VLVSQLRAY

SEQ ID NO: 128727 - protein, 9 aa, Artificial Sequence
  Description of Artificial Sequence: Synthetic peptide
  Seed: SLGPLLDGT (PMEL_HUMAN)
SMGPLLDGI

SEQ ID NO: 128728 - protein, 10 aa, Artificial Sequence
  Description of Artificial Sequence: Synthetic peptide
  Seed: VLMAVVLASL (PMEL_HUMAN)
VVMAVVLASF

SEQ ID NO: 128729 - protein, 9 aa, Artificial Sequence
  Description of Artificial Sequence: Synthetic peptide
  Seed: LADTNSLAV (PMEL_HUMAN)
LLDTNSLAF

SEQ ID NO: 128730 - protein, 10 aa, Artificial Sequence
  Description of Artificial Sequence: Synthetic peptide
  Seed: VTAQVVLQAA (PMEL_HUMAN)
VIAQVVLQAV

SEQ ID NO: 128731 - protein, 9 aa, Artificial Sequence
  Description of Artificial Sequence: Synthetic peptide
  Seed: TTAAQVTTT (PMEL_HUMAN)
TVAAQVTTL

SEQ ID NO: 128732 - protein, 11 aa, Artificial Sequence
  Description of Artificial Sequence: Synthetic peptide
  Seed: VLMAVVLASLI (PMEL_HUMAN)
VLMAVVLASLV

SEQ ID NO: 128733 - protein, 9 aa, Artificial Sequence
  Description of Artificial Sequence: Synthetic peptide
  Seed: RALVVTHTY (PMEL_HUMAN)
RWLVVTHTF

SEQ ID NO: 128734 - protein, 9 aa, Artificial Sequence
  Description of Artificial Sequence: Synthetic peptide
  Seed: MLGTHTMEV (PMEL_HUMAN)
MVGTHTMEY

SEQ ID NO: 128735 - protein, 9 aa, Artificial Sequence
  Description of Artificial Sequence: Synthetic peptide
  Seed: TIINGSQVW (PMEL_HUMAN)
TAINGSQVY

SEQ ID NO: 128736 - protein, 9 aa, Artificial Sequence
  Description of Artificial Sequence: Synthetic peptide
  Seed: SLAVVSTQL (PMEL_HUMAN)
SQAVVSTQV

SEQ ID NO: 128737 - protein, 10 aa, Artificial Sequence
  Description of Artificial Sequence: Synthetic peptide
  Seed: YVPLAHSSSA (PMEL_HUMAN)
YLPLAHSSSF

SEQ ID NO: 128738 - protein, 10 aa, Artificial Sequence
  Description of Artificial Sequence: Synthetic peptide
  Seed: DGTATLRLVK (PMEL_HUMAN)
DMTATLRLVR

SEQ ID NO: 128739 - protein, 8 aa, Artificial Sequence
  Description of Artificial Sequence: Synthetic peptide
  Seed: QDFSVPQL (PMEL_HUMAN)
QEFSVPQV

SEQ ID NO: 128740 - protein, 10 aa, Artificial Sequence
  Description of Artificial Sequence: Synthetic peptide
  Seed: YLAEADLSYT (PMEL_HUMAN)
YMAEADLSYN

SEQ ID NO: 128741 - protein, 9 aa, Artificial Sequence
  Description of Artificial Sequence: Synthetic peptide
  Seed: RLMKQDFSV (PMEL_HUMAN)
RMMKQDFSF

SEQ ID NO: 128742 - protein, 9 aa, Artificial Sequence
  Description of Artificial Sequence: Synthetic peptide
  Seed: TAQVVLQAA (PMEL_HUMAN)
THQVVLQAA

SEQ ID NO: 128743 - protein, 9 aa, Artificial Sequence
  Description of Artificial Sequence: Synthetic peptide
  Seed: VQVPTTEVI (PMEL_HUMAN)
VHVPTTEVI

SEQ ID NO: 128744 - protein, 10 aa, Artificial Sequence
  Description of Artificial Sequence: Synthetic peptide
  Seed: VLMAVVLASL (PMEL_HUMAN)
VHMAVVLASF

SEQ ID NO: 128745 - protein, 10 aa, Artificial Sequence
  Description of Artificial Sequence: Synthetic peptide
  Seed: QILKGGSGTY (PMEL_HUMAN)
QQLKGGSGTM

SEQ ID NO: 128746 - protein, 11 aa, Artificial Sequence
  Description of Artificial Sequence: Synthetic peptide
  Seed: TWDFGDSSGTL (PMEL_HUMAN)
TIDFGDSSGTM

SEQ ID NO: 128747 - protein, 9 aa, Artificial Sequence
  Description of Artificial Sequence: Synthetic peptide
  Seed: ANASFSIAL (PMEL_HUMAN)
AQASFSIAM

SEQ ID NO: 128748 - protein, 10 aa, Artificial Sequence
  Description of Artificial Sequence: Synthetic peptide
  Seed: TTTEWVETTA (PMEL_HUMAN)
TTTEWVETTV

SEQ ID NO: 128749 - protein, 9 aa, Artificial Sequence
  Description of Artificial Sequence: Synthetic peptide
  Seed: HLAVIGALL (PMEL_HUMAN)
HIAVIGALI

SEQ ID NO: 128750 - protein, 9 aa, Artificial Sequence
  Description of Artificial Sequence: Synthetic peptide
  Seed: LRNQPLTFA (PMEL_HUMAN)
LRNQPLTFY

SEQ ID NO: 128751 - protein, 10 aa, Artificial Sequence
  Description of Artificial Sequence: Synthetic peptide
  Seed: SITGSLGPLL (PMEL_HUMAN)
SMTGSLGPLL

SEQ ID NO: 128752 - protein, 10 aa, Artificial Sequence
  Description of Artificial Sequence: Synthetic peptide
  Seed: KTWGQYWQVL (PMEL_HUMAN)
KWWGQYWQVL

SEQ ID NO: 128753 - protein, 10 aa, Artificial Sequence
  Description of Artificial Sequence: Synthetic peptide
  Seed: NSLAVVSTQL (PMEL_HUMAN)
NYLAVVSTQL

SEQ ID NO: 128754 - protein, 9 aa, Artificial Sequence
  Description of Artificial Sequence: Synthetic peptide
  Seed: YWQVLGGPV (PMEL_HUMAN)
YYQVLGGPY

SEQ ID NO: 128755 - protein, 9 aa, Artificial Sequence
  Description of Artificial Sequence: Synthetic peptide
  Seed: DAFELTVSC (PMEL_HUMAN)
DMFELTVSY

SEQ ID NO: 128756 - protein, 9 aa, Artificial Sequence
  Description of Artificial Sequence: Synthetic peptide
  Seed: GENSPLLSG (PMEL_HUMAN)
GENSPLLSW

SEQ ID NO: 128757 - protein, 11 aa, Artificial Sequence
  Description of Artificial Sequence: Synthetic peptide
  Seed: GLGQVPLIVGI (PMEL_HUMAN)
GMGQVPLIVGV

SEQ ID NO: 128758 - protein, 9 aa, Artificial Sequence
  Description of Artificial Sequence: Synthetic peptide
  Seed: QVIWVNNTI (PMEL_HUMAN)
QMIWVNNTI

SEQ ID NO: 128759 - protein, 10 aa, Artificial Sequence
  Description of Artificial Sequence: Synthetic peptide
  Seed: KVLPDGQVIW (PMEL_HUMAN)
KVLPDGQVIF

SEQ ID NO: 128760 - protein, 9 aa, Artificial Sequence
  Description of Artificial Sequence: Synthetic peptide
  Seed: AVIGALLAV (PMEL_HUMAN)
ARIGALLAI

SEQ ID NO: 128761 - protein, 11 aa, Artificial Sequence
  Description of Artificial Sequence: Synthetic peptide
  Seed: RYGSFSVTLDI (PMEL_HUMAN)
RNGSFSVTLDF

SEQ ID NO: 128762 - protein, 11 aa, Artificial Sequence
  Description of Artificial Sequence: Synthetic peptide
  Seed: RQVPLDCVLYR (PMEL_HUMAN)
RFVPLDCVLYK

SEQ ID NO: 128763 - protein, 10 aa, Artificial Sequence
  Description of Artificial Sequence: Synthetic peptide
  Seed: RQLYPEWTEA (PMEL_HUMAN)
RRLYPEWTEI

SEQ ID NO: 128764 - protein, 9 aa, Artificial Sequence
  Description of Artificial Sequence: Synthetic peptide
  Seed: SVPQLPHSS (PMEL_HUMAN)
SSPQLPHSF

SEQ ID NO: 128765 - protein, 10 aa, Artificial Sequence
  Description of Artificial Sequence: Synthetic peptide
  Seed: MSTESITGSL (PMEL_HUMAN)
MDTESITGSV

SEQ ID NO: 128766 - protein, 10 aa, Artificial Sequence
  Description of Artificial Sequence: Synthetic peptide
  Seed: RLMKQDFSVP (PMEL_HUMAN)
RLMKQDFSVL

SEQ ID NO: 128767 - protein, 9 aa, Artificial Sequence
  Description of Artificial Sequence: Synthetic peptide
  Seed: TTDGHRPTA (PMEL_HUMAN)
TQDGHRPTL

SEQ ID NO: 128768 - protein, 9 aa, Artificial Sequence
  Description of Artificial Sequence: Synthetic peptide
  Seed: SQKRSFVYV (PMEL_HUMAN)
SIKRSFVYS

SEQ ID NO: 128769 - protein, 10 aa, Artificial Sequence
  Description of Artificial Sequence: Synthetic peptide
  Seed: VLMAVVLASL (PMEL_HUMAN)
VLMAVVLAST

SEQ ID NO: 128770 - protein, 10 aa, Artificial Sequence
  Description of Artificial Sequence: Synthetic peptide
  Seed: YRYGSFSVTL (PMEL_HUMAN)
YNYGSFSVTF

SEQ ID NO: 128771 - protein, 11 aa, Artificial Sequence
  Description of Artificial Sequence: Synthetic peptide
  Seed: LYPEWTEAQRL (PMEL_HUMAN)
LFPEWTEAQRF

SEQ ID NO: 128772 - protein, 9 aa, Artificial Sequence
  Description of Artificial Sequence: Synthetic peptide
  Seed: YVWKTWGQY (PMEL_HUMAN)
YMWKTWGQM

SEQ ID NO: 128773 - protein, 9 aa, Artificial Sequence
  Description of Artificial Sequence: Synthetic peptide
  Seed: HTMEVTVYH (PMEL_HUMAN)
HSMEVTVYV

SEQ ID NO: 128774 - protein, 9 aa, Artificial Sequence
  Description of Artificial Sequence: Synthetic peptide
  Seed: TIINGSQVW (PMEL_HUMAN)
TPINGSQVW

SEQ ID NO: 128775 - protein, 10 aa, Artificial Sequence
  Description of Artificial Sequence: Synthetic peptide
  Seed: FLRNQPLTFA (PMEL_HUMAN)
FVRNQPLTFI

SEQ ID NO: 128776 - protein, 9 aa, Artificial Sequence
  Description of Artificial Sequence: Synthetic peptide
  Seed: FTITDQVPF (PMEL_HUMAN)
FAITDQVPY

SEQ ID NO: 128777 - protein, 10 aa, Artificial Sequence
  Description of Artificial Sequence: Synthetic peptide
  Seed: MSTESITGSL (PMEL_HUMAN)
MVTESITGSV

SEQ ID NO: 128778 - protein, 9 aa, Artificial Sequence
  Description of Artificial Sequence: Synthetic peptide
  Seed: HTMEVTVYH (PMEL_HUMAN)
HNMEVTVYY

SEQ ID NO: 128779 - protein, 9 aa, Artificial Sequence
  Description of Artificial Sequence: Synthetic peptide
  Seed: KTWGQYWQV (PMEL_HUMAN)
KLWGQYWQA

SEQ ID NO: 128780 - protein, 9 aa, Artificial Sequence
  Description of Artificial Sequence: Synthetic peptide
  Seed: YRYGSFSVT (PMEL_HUMAN)
YYYGSFSVM

SEQ ID NO: 128781 - protein, 9 aa, Artificial Sequence
  Description of Artificial Sequence: Synthetic peptide
  Seed: SGLSIGTGR (PMEL_HUMAN)
SVLSIGTGK

SEQ ID NO: 128782 - protein, 10 aa, Artificial Sequence
  Description of Artificial Sequence: Synthetic peptide
  Seed: VYVWKTWGQY (PMEL_HUMAN)
VTVWKTWGQY

SEQ ID NO: 128783 - protein, 11 aa, Artificial Sequence
  Description of Artificial Sequence: Synthetic peptide
  Seed: RRGSRSYVPLA (PMEL_HUMAN)
RDGSRSYVPLK

SEQ ID NO: 128784 - protein, 9 aa, Artificial Sequence
  Description of Artificial Sequence: Synthetic peptide
  Seed: LYRYGSFSV (PMEL_HUMAN)
LIRYGSFSK

SEQ ID NO: 128785 - protein, 9 aa, Artificial Sequence
  Description of Artificial Sequence: Synthetic peptide
  Seed: AEPSGTTSV (PMEL_HUMAN)
AFPSGTTSL

SEQ ID NO: 128786 - protein, 10 aa, Artificial Sequence
  Description of Artificial Sequence: Synthetic peptide
  Seed: LAEADLSYTW (PMEL_HUMAN)
LPEADLSYTY

SEQ ID NO: 128787 - protein, 9 aa, Artificial Sequence
  Description of Artificial Sequence: Synthetic peptide
  Seed: ALNFPGSQK (PMEL_HUMAN)
AANFPGSQR

SEQ ID NO: 128788 - protein, 11 aa, Artificial Sequence
  Description of Artificial Sequence: Synthetic peptide
  Seed: FGDSSGTLISR (PMEL_HUMAN)
FNDSSGTLISL

SEQ ID NO: 128789 - protein, 9 aa, Artificial Sequence
  Description of Artificial Sequence: Synthetic peptide
  Seed: KQDFSVPQL (PMEL_HUMAN)
KADFSVPQF

SEQ ID NO: 128790 - protein, 11 aa, Artificial Sequence
  Description of Artificial Sequence: Synthetic peptide
  Seed: VQMPTAESTGM (PMEL_HUMAN)
VLMPTAESTGY

SEQ ID NO: 128791 - protein, 9 aa, Artificial Sequence
  Description of Artificial Sequence: Synthetic peptide
  Seed: KVSNDGPTL (PMEL_HUMAN)
KMSNDGPTM

SEQ ID NO: 128792 - protein, 10 aa, Artificial Sequence
  Description of Artificial Sequence: Synthetic peptide
  Seed: VPQLPHSSSH (PMEL_HUMAN)
VNQLPHSSSM

SEQ ID NO: 128793 - protein, 9 aa, Artificial Sequence
  Description of Artificial Sequence: Synthetic peptide
  Seed: KAWNRQLYP (PMEL_HUMAN)
KFWNRQLYA

SEQ ID NO: 128794 - protein, 9 aa, Artificial Sequence
  Description of Artificial Sequence: Synthetic peptide
  Seed: LLDGTATLR (PMEL_HUMAN)
LADGTATLM

SEQ ID NO: 128795 - protein, 9 aa, Artificial Sequence
  Description of Artificial Sequence: Synthetic peptide
  Seed: RELPIPEPE (PMEL_HUMAN)
RELPIPEPM

SEQ ID NO: 128796 - protein, 9 aa, Artificial Sequence
  Description of Artificial Sequence: Synthetic peptide
  Seed: ALNFPGSQK (PMEL_HUMAN)
ATNFPGSQK

SEQ ID NO: 128797 - protein, 9 aa, Artificial Sequence
  Description of Artificial Sequence: Synthetic peptide
  Seed: WSQKRSFVY (PMEL_HUMAN)
WQQKRSFVF

SEQ ID NO: 128798 - protein, 8 aa, Artificial Sequence
  Description of Artificial Sequence: Synthetic peptide
  Seed: RQLRTKAW (PMEL_HUMAN)
RQLRTKAY

SEQ ID NO: 128799 - protein, 8 aa, Artificial Sequence
  Description of Artificial Sequence: Synthetic peptide
  Seed: VLYRYGSF (PMEL_HUMAN)
VMYRYGSF

SEQ ID NO: 128800 - protein, 9 aa, Artificial Sequence
  Description of Artificial Sequence: Synthetic peptide
  Seed: RNQPLTFAL (PMEL_HUMAN)
RIQPLTFAL

SEQ ID NO: 128801 - protein, 9 aa, Artificial Sequence
  Description of Artificial Sequence: Synthetic peptide
  Seed: AVVSTQLIM (PMEL_HUMAN)
AIVSTQLIW

SEQ ID NO: 128802 - protein, 10 aa, Artificial Sequence
  Description of Artificial Sequence: Synthetic peptide
  Seed: DGTATLRLVK (PMEL_HUMAN)
DHTATLRLVR

SEQ ID NO: 128803 - protein, 9 aa, Artificial Sequence
  Description of Artificial Sequence: Synthetic peptide
  Seed: TLIGANASF (PMEL_HUMAN)
TMIGANASM

SEQ ID NO: 128804 - protein, 11 aa, Artificial Sequence
  Description of Artificial Sequence: Synthetic peptide
  Seed: LYRYGSFSVTL (PMEL_HUMAN)
LYRYGSFSVTW

SEQ ID NO: 128805 - protein, 10 aa, Artificial Sequence
  Description of Artificial Sequence: Synthetic peptide
  Seed: VLMAVVLASL (PMEL_HUMAN)
VAMAVVLASF

SEQ ID NO: 128806 - protein, 9 aa, Artificial Sequence
  Description of Artificial Sequence: Synthetic peptide
  Seed: ISRALVVTH (PMEL_HUMAN)
ITRALVVTV

SEQ ID NO: 128807 - protein, 9 aa, Artificial Sequence
  Description of Artificial Sequence: Synthetic peptide
  Seed: LLVLMAVVL (PMEL_HUMAN)
LLVLMAVVY

SEQ ID NO: 128808 - protein, 9 aa, Artificial Sequence
  Description of Artificial Sequence: Synthetic peptide
  Seed: MSTPEATGM (PMEL_HUMAN)
MATPEATGI

SEQ ID NO: 128809 - protein, 11 aa, Artificial Sequence
  Description of Artificial Sequence: Synthetic peptide
  Seed: RRGSRSYVPLA (PMEL_HUMAN)
RQGSRSYVPLK

SEQ ID NO: 128810 - protein, 9 aa, Artificial Sequence
  Description of Artificial Sequence: Synthetic peptide
  Seed: RYGSFSVTL (PMEL_HUMAN)
RIGSFSVTW

SEQ ID NO: 128811 - protein, 9 aa, Artificial Sequence
  Description of Artificial Sequence: Synthetic peptide
  Seed: SLGPLLDGT (PMEL_HUMAN)
SVGPLLDGV

SEQ ID NO: 128812 - protein, 9 aa, Artificial Sequence
  Description of Artificial Sequence: Synthetic peptide
  Seed: AVVLASLIY (PMEL_HUMAN)
ASVLASLII

SEQ ID NO: 128813 - protein, 9 aa, Artificial Sequence
  Description of Artificial Sequence: Synthetic peptide
  Seed: VQMPTAEST (PMEL_HUMAN)
VKMPTAESI

SEQ ID NO: 128814 - protein, 9 aa, Artificial Sequence
  Description of Artificial Sequence: Synthetic peptide
  Seed: THTMEVTVY (PMEL_HUMAN)
TATMEVTVF

SEQ ID NO: 128815 - protein, 9 aa, Artificial Sequence
  Description of Artificial Sequence: Synthetic peptide
  Seed: ISRALVVTH (PMEL_HUMAN)
IVRALVVTA

SEQ ID NO: 128816 - protein, 10 aa, Artificial Sequence
  Description of Artificial Sequence: Synthetic peptide
  Seed: SCPIGENSPL (PMEL_HUMAN)
SFPIGENSPL

SEQ ID NO: 128817 - protein, 10 aa, Artificial Sequence
  Description of Artificial Sequence: Synthetic peptide
  Seed: VLMAVVLASL (PMEL_HUMAN)
VQMAVVLASL

SEQ ID NO: 128818 - protein, 11 aa, Artificial Sequence
  Description of Artificial Sequence: Synthetic peptide
  Seed: RRGSRSYVPLA (PMEL_HUMAN)
RDGSRSYVPLV

SEQ ID NO: 128819 - protein, 10 aa, Artificial Sequence
  Description of Artificial Sequence: Synthetic peptide
  Seed: VPQLPHSSSH (PMEL_HUMAN)
VTQLPHSSSY

SEQ ID NO: 128820 - protein, 8 aa, Artificial Sequence
  Description of Artificial Sequence: Synthetic peptide
  Seed: SNDGPTLI (PMEL_HUMAN)
SLDGPTLV

SEQ ID NO: 128821 - protein, 8 aa, Artificial Sequence
  Description of Artificial Sequence: Synthetic peptide
  Seed: SEVMGTTL (PMEL_HUMAN)
SQVMGTTY

SEQ ID NO: 128822 - protein, 11 aa, Artificial Sequence
  Description of Artificial Sequence: Synthetic peptide
  Seed: FGDSSGTLISR (PMEL_HUMAN)
FQDSSGTLISF

SEQ ID NO: 128823 - protein, 9 aa, Artificial Sequence
  Description of Artificial Sequence: Synthetic peptide
  Seed: VSNDGPTLI (PMEL_HUMAN)
VRNDGPTLL

SEQ ID NO: 128824 - protein, 10 aa, Artificial Sequence
  Description of Artificial Sequence: Synthetic peptide
  Seed: QLHDPSGYLA (PMEL_HUMAN)
QMHDPSGYLL

SEQ ID NO: 128825 - protein, 9 aa, Artificial Sequence
  Description of Artificial Sequence: Synthetic peptide
  Seed: VLGGPVSGL (PMEL_HUMAN)
VTGGPVSGL

SEQ ID NO: 128826 - protein, 9 aa, Artificial Sequence
  Description of Artificial Sequence: Synthetic peptide
  Seed: RQVPLDCVL (PMEL_HUMAN)
RMVPLDCVM

SEQ ID NO: 128827 - protein, 9 aa, Artificial Sequence
  Description of Artificial Sequence: Synthetic peptide
  Seed: ASFSIALNF (PMEL_HUMAN)
AMFSIALNI

SEQ ID NO: 128828 - protein, 10 aa, Artificial Sequence
  Description of Artificial Sequence: Synthetic peptide
  Seed: AEVSIVVLSG (PMEL_HUMAN)
AEVSIVVLSL

SEQ ID NO: 128829 - protein, 11 aa, Artificial Sequence
  Description of Artificial Sequence: Synthetic peptide
  Seed: RALDGGNKHFL (PMEL_HUMAN)
RQLDGGNKHFL

SEQ ID NO: 128830 - protein, 10 aa, Artificial Sequence
  Description of Artificial Sequence: Synthetic peptide
  Seed: RGSRSYVPLA (PMEL_HUMAN)
RGSRSYVPLS

SEQ ID NO: 128831 - protein, 9 aa, Artificial Sequence
  Description of Artificial Sequence: Synthetic peptide
  Seed: SSIMSTESI (PMEL_HUMAN)
SMIMSTESM

SEQ ID NO: 128832 - protein, 10 aa, Artificial Sequence
  Description of Artificial Sequence: Synthetic peptide
  Seed: LGQVPLIVGI (PMEL_HUMAN)
LIQVPLIVGV

SEQ ID NO: 128833 - protein, 9 aa, Artificial Sequence
  Description of Artificial Sequence: Synthetic peptide
  Seed: VTAQVVLQA (PMEL_HUMAN)
VIAQVVLQI

SEQ ID NO: 128834 - protein, 9 aa, Artificial Sequence
  Description of Artificial Sequence: Synthetic peptide
  Seed: RLVKRQVPL (PMEL_HUMAN)
RHVKRQVPY

SEQ ID NO: 128835 - protein, 10 aa, Artificial Sequence
  Description of Artificial Sequence: Synthetic peptide
  Seed: RQLYPEWTEA (PMEL_HUMAN)
RILYPEWTEL

SEQ ID NO: 128836 - protein, 9 aa, Artificial Sequence
  Description of Artificial Sequence: Synthetic peptide
  Seed: VLMAVVLAS (PMEL_HUMAN)
VMMAVVLAS

SEQ ID NO: 128837 - protein, 10 aa, Artificial Sequence
  Description of Artificial Sequence: Synthetic peptide
  Seed: VPQLPHSSSH (PMEL_HUMAN)
VQQLPHSSSY

SEQ ID NO: 128838 - protein, 10 aa, Artificial Sequence
  Description of Artificial Sequence: Synthetic peptide
  Seed: ALQLHDPSGY (PMEL_HUMAN)
AQQLHDPSGY

SEQ ID NO: 128839 - protein, 9 aa, Artificial Sequence
  Description of Artificial Sequence: Synthetic peptide
  Seed: AAQVTTTEW (PMEL_HUMAN)
ALQVTTTEY

SEQ ID NO: 128840 - protein, 10 aa, Artificial Sequence
  Description of Artificial Sequence: Synthetic peptide
  Seed: SVPQLPHSSS (PMEL_HUMAN)
SVPQLPHSSI

SEQ ID NO: 128841 - protein, 9 aa, Artificial Sequence
  Description of Artificial Sequence: Synthetic peptide
  Seed: VMGTTLAEM (PMEL_HUMAN)
VYGTTLAEM

SEQ ID NO: 128842 - protein, 9 aa, Artificial Sequence
  Description of Artificial Sequence: Synthetic peptide
  Seed: TESITGSLG (PMEL_HUMAN)
TESITGSLA

SEQ ID NO: 128843 - protein, 10 aa, Artificial Sequence
  Description of Artificial Sequence: Synthetic peptide
  Seed: AMLGTHTMEV (PMEL_HUMAN)
AMLGTHTMEI

SEQ ID NO: 128844 - protein, 9 aa, Artificial Sequence
  Description of Artificial Sequence: Synthetic peptide
  Seed: LLAVGATKV (PMEL_HUMAN)
LIAVGATKV

SEQ ID NO: 128845 - protein, 9 aa, Artificial Sequence
  Description of Artificial Sequence: Synthetic peptide
  Seed: VLKRCLLHL (PMEL_HUMAN)
VMKRCLLHF

SEQ ID NO: 128846 - protein, 9 aa, Artificial Sequence
  Description of Artificial Sequence: Synthetic peptide
  Seed: LQLHDPSGY (PMEL_HUMAN)
LFLHDPSGY

SEQ ID NO: 128847 - protein, 9 aa, Artificial Sequence
  Description of Artificial Sequence: Synthetic peptide
  Seed: VLPSPACQL (PMEL_HUMAN)
VGPSPACQI

SEQ ID NO: 128848 - protein, 9 aa, Artificial Sequence
  Description of Artificial Sequence: Synthetic peptide
  Seed: TLISRALVV (PMEL_HUMAN)
TAISRALVY

SEQ ID NO: 128849 - protein, 9 aa, Artificial Sequence
  Description of Artificial Sequence: Synthetic peptide
  Seed: VPTTEVIST (PMEL_HUMAN)
VPTTEVISI

SEQ ID NO: 128850 - protein, 9 aa, Artificial Sequence
  Description of Artificial Sequence: Synthetic peptide
  Seed: EVMGTTLAE (PMEL_HUMAN)
EIMGTTLAR

SEQ ID NO: 128851 - protein, 9 aa, Artificial Sequence
  Description of Artificial Sequence: Synthetic peptide
  Seed: LNFPGSQKV (PMEL_HUMAN)
LSFPGSQKM

SEQ ID NO: 128852 - protein, 10 aa, Artificial Sequence
  Description of Artificial Sequence: Synthetic peptide
  Seed: RGSRSYVPLA (PMEL_HUMAN)
RDSRSYVPLK

SEQ ID NO: 128853 - protein, 9 aa, Artificial Sequence
  Description of Artificial Sequence: Synthetic peptide
  Seed: AQVVLQAAI (PMEL_HUMAN)
AKVVLQAAF

SEQ ID NO: 128854 - protein, 9 aa, Artificial Sequence
  Description of Artificial Sequence: Synthetic peptide
  Seed: ALDGGNKHF (PMEL_HUMAN)
AVDGGNKHM

SEQ ID NO: 128855 - protein, 9 aa, Artificial Sequence
  Description of Artificial Sequence: Synthetic peptide
  Seed: ESAEILQAV (PMEL_HUMAN)
EAAEILQAH

SEQ ID NO: 128856 - protein, 9 aa, Artificial Sequence
  Description of Artificial Sequence: Synthetic peptide
  Seed: RYGSFSVTL (PMEL_HUMAN)
RWGSFSVTW

SEQ ID NO: 128857 - protein, 9 aa, Artificial Sequence
  Description of Artificial Sequence: Synthetic peptide
  Seed: AGLGQVPLI (PMEL_HUMAN)
ATLGQVPLL

SEQ ID NO: 128858 - protein, 10 aa, Artificial Sequence
  Description of Artificial Sequence: Synthetic peptide
  Seed: MAVVLASLIY (PMEL_HUMAN)
MIVVLASLIK

SEQ ID NO: 128859 - protein, 9 aa, Artificial Sequence
  Description of Artificial Sequence: Synthetic peptide
  Seed: AAQVTTTEW (PMEL_HUMAN)
AQQVTTTEW

SEQ ID NO: 128860 - protein, 9 aa, Artificial Sequence
  Description of Artificial Sequence: Synthetic peptide
  Seed: RLVKRQVPL (PMEL_HUMAN)
RIVKRQVPW

SEQ ID NO: 128861 - protein, 9 aa, Artificial Sequence
  Description of Artificial Sequence: Synthetic peptide
  Seed: LPDGQVIWV (PMEL_HUMAN)
LSDGQVIWV

SEQ ID NO: 128862 - protein, 9 aa, Artificial Sequence
  Description of Artificial Sequence: Synthetic peptide
  Seed: GMTPAEVSI (PMEL_HUMAN)
GMTPAEVSV

SEQ ID NO: 128863 - protein, 9 aa, Artificial Sequence
  Description of Artificial Sequence: Synthetic peptide
  Seed: RALVVTHTY (PMEL_HUMAN)
RRLVVTHTF

SEQ ID NO: 128864 - protein, 9 aa, Artificial Sequence
  Description of Artificial Sequence: Synthetic peptide
  Seed: YHRRGSRSY (PMEL_HUMAN)
YYRRGSRSW

SEQ ID NO: 128865 - protein, 9 aa, Artificial Sequence
  Description of Artificial Sequence: Synthetic peptide
  Seed: ANASFSIAL (PMEL_HUMAN)
ASASFSIAY

SEQ ID NO: 128866 - protein, 9 aa, Artificial Sequence
  Description of Artificial Sequence: Synthetic peptide
  Seed: RYGSFSVTL (PMEL_HUMAN)
RQGSFSVTF

SEQ ID NO: 128867 - protein, 11 aa, Artificial Sequence
  Description of Artificial Sequence: Synthetic peptide
  Seed: RRRLMKQDFSV (PMEL_HUMAN)
RYRLMKQDFSI

SEQ ID NO: 128868 - protein, 9 aa, Artificial Sequence
  Description of Artificial Sequence: Synthetic peptide
  Seed: VSCQGGLPK (PMEL_HUMAN)
VMCQGGLPR

SEQ ID NO: 128869 - protein, 9 aa, Artificial Sequence
  Description of Artificial Sequence: Synthetic peptide
  Seed: DLVLKRCLL (PMEL_HUMAN)
DMVLKRCLL

SEQ ID NO: 128870 - protein, 11 aa, Artificial Sequence
  Description of Artificial Sequence: Synthetic peptide
  Seed: AEMSTPEATGM (PMEL_HUMAN)
AIMSTPEATGF

SEQ ID NO: 128871 - protein, 10 aa, Artificial Sequence
  Description of Artificial Sequence: Synthetic peptide
  Seed: LRNQPLTFAL (PMEL_HUMAN)
LHNQPLTFAL

SEQ ID NO: 128872 - protein, 9 aa, Artificial Sequence
  Description of Artificial Sequence: Synthetic peptide
  Seed: GMTPAEVSI (PMEL_HUMAN)
GATPAEVSY

SEQ ID NO: 128873 - protein, 9 aa, Artificial Sequence
  Description of Artificial Sequence: Synthetic peptide
  Seed: RYGSFSVTL (PMEL_HUMAN)
RLGSFSVTM

SEQ ID NO: 128874 - protein, 9 aa, Artificial Sequence
  Description of Artificial Sequence: Synthetic peptide
  Seed: ITDQVPFSV (PMEL_HUMAN)
IYDQVPFSM

SEQ ID NO: 128875 - protein, 9 aa, Artificial Sequence
  Description of Artificial Sequence: Synthetic peptide
  Seed: TAEAPNTTA (PMEL_HUMAN)
TLEAPNTTF

SEQ ID NO: 128876 - protein, 11 aa, Artificial Sequence
  Description of Artificial Sequence: Synthetic peptide
  Seed: LYRYGSFSVTL (PMEL_HUMAN)
LWRYGSFSVTF

SEQ ID NO: 128877 - protein, 10 aa, Artificial Sequence
  Description of Artificial Sequence: Synthetic peptide
  Seed: GPLLDGTATL (PMEL_HUMAN)
GNLLDGTATA

SEQ ID NO: 128878 - protein, 10 aa, Artificial Sequence
  Description of Artificial Sequence: Synthetic peptide
  Seed: LMAVVLASLI (PMEL_HUMAN)
LMAVVLASLP

SEQ ID NO: 128879 - protein, 9 aa, Artificial Sequence
  Description of Artificial Sequence: Synthetic peptide
  Seed: ILKGGSGTY (PMEL_HUMAN)
ITKGGSGTF

SEQ ID NO: 128880 - protein, 10 aa, Artificial Sequence
  Description of Artificial Sequence: Synthetic peptide
  Seed: ASSIMSTESI (PMEL_HUMAN)
ACSIMSTESF

SEQ ID NO: 128881 - protein, 9 aa, Artificial Sequence
  Description of Artificial Sequence: Synthetic peptide
  Seed: SQKRSFVYV (PMEL_HUMAN)
SQKRSFVYM

SEQ ID NO: 128882 - protein, 9 aa, Artificial Sequence
  Description of Artificial Sequence: Synthetic peptide
  Seed: YLAEADLSY (PMEL_HUMAN)
YAAEADLSI

SEQ ID NO: 128883 - protein, 10 aa, Artificial Sequence
  Description of Artificial Sequence: Synthetic peptide
  Seed: GTHTMEVTVY (PMEL_HUMAN)
GKHTMEVTVY

SEQ ID NO: 128884 - protein, 10 aa, Artificial Sequence
  Description of Artificial Sequence: Synthetic peptide
  Seed: RGSRSYVPLA (PMEL_HUMAN)
RRSRSYVPLA

SEQ ID NO: 128885 - protein, 9 aa, Artificial Sequence
  Description of Artificial Sequence: Synthetic peptide
  Seed: TLIGANASF (PMEL_HUMAN)
TVIGANASY

SEQ ID NO: 128886 - protein, 9 aa, Artificial Sequence
  Description of Artificial Sequence: Synthetic peptide
  Seed: SITGSLGPL (PMEL_HUMAN)
STTGSLGPV

SEQ ID NO: 128887 - protein, 9 aa, Artificial Sequence
  Description of Artificial Sequence: Synthetic peptide
  Seed: GQVPLIVGI (PMEL_HUMAN)
GMVPLIVGI

SEQ ID NO: 128888 - protein, 9 aa, Artificial Sequence
  Description of Artificial Sequence: Synthetic peptide
  Seed: ISRALVVTH (PMEL_HUMAN)
ILRALVVTM

SEQ ID NO: 128889 - protein, 11 aa, Artificial Sequence
  Description of Artificial Sequence: Synthetic peptide
  Seed: VQMPTAESTGM (PMEL_HUMAN)
VAMPTAESTGF

SEQ ID NO: 128890 - protein, 10 aa, Artificial Sequence
  Description of Artificial Sequence: Synthetic peptide
  Seed: TLAEMSTPEA (PMEL_HUMAN)
TLAEMSTPEV

SEQ ID NO: 128891 - protein, 9 aa, Artificial Sequence
  Description of Artificial Sequence: Synthetic peptide
  Seed: TTDGHRPTA (PMEL_HUMAN)
TWDGHRPTL

SEQ ID NO: 128892 - protein, 9 aa, Artificial Sequence
  Description of Artificial Sequence: Synthetic peptide
  Seed: RLMKQDFSV (PMEL_HUMAN)
RLMKQDFSY

SEQ ID NO: 128893 - protein, 11 aa, Artificial Sequence
  Description of Artificial Sequence: Synthetic peptide
  Seed: GIESAEILQAV (PMEL_HUMAN)
GLESAEILQAL

SEQ ID NO: 128894 - protein, 9 aa, Artificial Sequence
  Description of Artificial Sequence: Synthetic peptide
  Seed: AEADLSYTW (PMEL_HUMAN)
AIADLSYTY

SEQ ID NO: 128895 - protein, 9 aa, Artificial Sequence
  Description of Artificial Sequence: Synthetic peptide
  Seed: RQVPLDCVL (PMEL_HUMAN)
RKVPLDCVL

SEQ ID NO: 128896 - protein, 9 aa, Artificial Sequence
  Description of Artificial Sequence: Synthetic peptide
  Seed: FGDSSGTLI (PMEL_HUMAN)
FFDSSGTLL

SEQ ID NO: 128897 - protein, 9 aa, Artificial Sequence
  Description of Artificial Sequence: Synthetic peptide
  Seed: ILKGGSGTY (PMEL_HUMAN)
ILKGGSGTM

SEQ ID NO: 128898 - protein, 10 aa, Artificial Sequence
  Description of Artificial Sequence: Synthetic peptide
  Seed: NASFSIALNF (PMEL_HUMAN)
NMSFSIALNY

SEQ ID NO: 128899 - protein, 10 aa, Artificial Sequence
  Description of Artificial Sequence: Synthetic peptide
  Seed: RALDGGNKHF (PMEL_HUMAN)
RQLDGGNKHY

SEQ ID NO: 128900 - protein, 9 aa, Artificial Sequence
  Description of Artificial Sequence: Synthetic peptide
  Seed: ANASFSIAL (PMEL_HUMAN)
ATASFSIAY

SEQ ID NO: 128901 - protein, 9 aa, Artificial Sequence
  Description of Artificial Sequence: Synthetic peptide
  Seed: RGGQVSLKV (PMEL_HUMAN)
RTGQVSLKV

SEQ ID NO: 128902 - protein, 9 aa, Artificial Sequence
  Description of Artificial Sequence: Synthetic peptide
  Seed: SQVWGGQPV (PMEL_HUMAN)
SIVWGGQPI

SEQ ID NO: 128903 - protein, 9 aa, Artificial Sequence
  Description of Artificial Sequence: Synthetic peptide
  Seed: LMAVVLASL (PMEL_HUMAN)
LKAVVLASL

SEQ ID NO: 128904 - protein, 10 aa, Artificial Sequence
  Description of Artificial Sequence: Synthetic peptide
  Seed: SVPQLPHSSS (PMEL_HUMAN)
SQPQLPHSSA

SEQ ID NO: 128905 - protein, 9 aa, Artificial Sequence
  Description of Artificial Sequence: Synthetic peptide
  Seed: AEMSTPEAT (PMEL_HUMAN)
AEMSTPEAF

SEQ ID NO: 128906 - protein, 9 aa, Artificial Sequence
  Description of Artificial Sequence: Synthetic peptide
  Seed: GILLVLMAV (PMEL_HUMAN)
GTLLVLMAV

SEQ ID NO: 128907 - protein, 9 aa, Artificial Sequence
  Description of Artificial Sequence: Synthetic peptide
  Seed: IVVLSGTTA (PMEL_HUMAN)
ITVLSGTTY

SEQ ID NO: 128908 - protein, 9 aa, Artificial Sequence
  Description of Artificial Sequence: Synthetic peptide
  Seed: VISTAPVQM (PMEL_HUMAN)
VASTAPVQF

SEQ ID NO: 128909 - protein, 11 aa, Artificial Sequence
  Description of Artificial Sequence: Synthetic peptide
  Seed: TWDFGDSSGTL (PMEL_HUMAN)
TVDFGDSSGTL

SEQ ID NO: 128910 - protein, 9 aa, Artificial Sequence
  Description of Artificial Sequence: Synthetic peptide
  Seed: VQMPTAEST (PMEL_HUMAN)
VIMPTAESA

SEQ ID NO: 128911 - protein, 10 aa, Artificial Sequence
  Description of Artificial Sequence: Synthetic peptide
  Seed: YGSFSVTLDI (PMEL_HUMAN)
YLSFSVTLDW

SEQ ID NO: 128912 - protein, 10 aa, Artificial Sequence
  Description of Artificial Sequence: Synthetic peptide
  Seed: GDSSGTLISR (PMEL_HUMAN)
GSSSGTLISK

SEQ ID NO: 128913 - protein, 10 aa, Artificial Sequence
  Description of Artificial Sequence: Synthetic peptide
  Seed: RGSRSYVPLA (PMEL_HUMAN)
RASRSYVPLV

SEQ ID NO: 128914 - protein, 9 aa, Artificial Sequence
  Description of Artificial Sequence: Synthetic peptide
  Seed: TTAGQVPTT (PMEL_HUMAN)
TVAGQVPTI

SEQ ID NO: 128915 - protein, 9 aa, Artificial Sequence
  Description of Artificial Sequence: Synthetic peptide
  Seed: FLRNQPLTF (PMEL_HUMAN)
FFRNQPLTM

SEQ ID NO: 128916 - protein, 10 aa, Artificial Sequence
  Description of Artificial Sequence: Synthetic peptide
  Seed: RGSRSYVPLA (PMEL_HUMAN)
RCSRSYVPLM

SEQ ID NO: 128917 - protein, 9 aa, Artificial Sequence
  Description of Artificial Sequence: Synthetic peptide
  Seed: HSSSHWLRL (PMEL_HUMAN)
HTSSHWLRW

SEQ ID NO: 128918 - protein, 9 aa, Artificial Sequence
  Description of Artificial Sequence: Synthetic peptide
  Seed: MLGTHTMEV (PMEL_HUMAN)
MGGTHTMEF

SEQ ID NO: 128919 - protein, 9 aa, Artificial Sequence
  Description of Artificial Sequence: Synthetic peptide
  Seed: SSIMSTESI (PMEL_HUMAN)
SVIMSTESM

SEQ ID NO: 128920 - protein, 11 aa, Artificial Sequence
  Description of Artificial Sequence: Synthetic peptide
  Seed: YLEPGPVTAQV (PMEL_HUMAN)
YMEPGPVTAQV

SEQ ID NO: 128921 - protein, 9 aa, Artificial Sequence
  Description of Artificial Sequence: Synthetic peptide
  Seed: GQVPLIVGI (PMEL_HUMAN)
GAVPLIVGF

SEQ ID NO: 128922 - protein, 9 aa, Artificial Sequence
  Description of Artificial Sequence: Synthetic peptide
  Seed: VLPDGQVIW (PMEL_HUMAN)
VVPDGQVIF

SEQ ID NO: 128923 - protein, 9 aa, Artificial Sequence
  Description of Artificial Sequence: Synthetic peptide
  Seed: RYGSFSVTL (PMEL_HUMAN)
RYGSFSVTF

SEQ ID NO: 128924 - protein, 9 aa, Artificial Sequence
  Description of Artificial Sequence: Synthetic peptide
  Seed: VLKRCLLHL (PMEL_HUMAN)
VSKRCLLHK

SEQ ID NO: 128925 - protein, 9 aa, Artificial Sequence
  Description of Artificial Sequence: Synthetic peptide
  Seed: KTWGQYWQV (PMEL_HUMAN)
KQWGQYWQM

SEQ ID NO: 128926 - protein, 9 aa, Artificial Sequence
  Description of Artificial Sequence: Synthetic peptide
  Seed: SGEGDAFEL (PMEL_HUMAN)
SFEGDAFEM

SEQ ID NO: 128927 - protein, 10 aa, Artificial Sequence
  Description of Artificial Sequence: Synthetic peptide
  Seed: TTEWVETTAR (PMEL_HUMAN)
TTEWVETTAK

SEQ ID NO: 128928 - protein, 8 aa, Artificial Sequence
  Description of Artificial Sequence: Synthetic peptide
  Seed: FGDSSGTL (PMEL_HUMAN)
FMDSSGTL

SEQ ID NO: 128929 - protein, 11 aa, Artificial Sequence
  Description of Artificial Sequence: Synthetic peptide
  Seed: RALDGGNKHFL (PMEL_HUMAN)
RALDGGNKHFY

SEQ ID NO: 128930 - protein, 11 aa, Artificial Sequence
  Description of Artificial Sequence: Synthetic peptide
  Seed: RTKAWNRQLYP (PMEL_HUMAN)
RSKAWNRQLYA

SEQ ID NO: 128931 - protein, 10 aa, Artificial Sequence
  Description of Artificial Sequence: Synthetic peptide
  Seed: GDSSGTLISR (PMEL_HUMAN)
GYSSGTLISK

SEQ ID NO: 128932 - protein, 9 aa, Artificial Sequence
  Description of Artificial Sequence: Synthetic peptide
  Seed: EVVGTTPGQ (PMEL_HUMAN)
ETVGTTPGY

SEQ ID NO: 128933 - protein, 9 aa, Artificial Sequence
  Description of Artificial Sequence: Synthetic peptide
  Seed: VVLSGTTAA (PMEL_HUMAN)
VGLSGTTAF

SEQ ID NO: 128934 - protein, 9 aa, Artificial Sequence
  Description of Artificial Sequence: Synthetic peptide
  Seed: YVWKTWGQY (PMEL_HUMAN)
YAWKTWGQM

SEQ ID NO: 128935 - protein, 9 aa, Artificial Sequence
  Description of Artificial Sequence: Synthetic peptide
  Seed: AQVVLQAAI (PMEL_HUMAN)
ARVVLQAAL

SEQ ID NO: 128936 - protein, 10 aa, Artificial Sequence
  Description of Artificial Sequence: Synthetic peptide
  Seed: VSLADTNSLA (PMEL_HUMAN)
VLLADTNSLL

SEQ ID NO: 128937 - protein, 9 aa, Artificial Sequence
  Description of Artificial Sequence: Synthetic peptide
  Seed: SGEGDAFEL (PMEL_HUMAN)
STEGDAFEL

SEQ ID NO: 128938 - protein, 11 aa, Artificial Sequence
  Description of Artificial Sequence: Synthetic peptide
  Seed: SYVPLAHSSSA (PMEL_HUMAN)
SRVPLAHSSSL

SEQ ID NO: 128939 - protein, 10 aa, Artificial Sequence
  Description of Artificial Sequence: Synthetic peptide
  Seed: QVLGGPVSGL (PMEL_HUMAN)
QILGGPVSGV

SEQ ID NO: 128940 - protein, 9 aa, Artificial Sequence
  Description of Artificial Sequence: Synthetic peptide
  Seed: HTMEVTVYH (PMEL_HUMAN)
HIMEVTVYM

SEQ ID NO: 128941 - protein, 10 aa, Artificial Sequence
  Description of Artificial Sequence: Synthetic peptide
  Seed: LVLMAVVLAS (PMEL_HUMAN)
LELMAVVLAV

SEQ ID NO: 128942 - protein, 10 aa, Artificial Sequence
  Description of Artificial Sequence: Synthetic peptide
  Seed: YVPLAHSSSA (PMEL_HUMAN)
YMPLAHSSSM

SEQ ID NO: 128943 - protein, 9 aa, Artificial Sequence
  Description of Artificial Sequence: Synthetic peptide
  Seed: ESAEILQAV (PMEL_HUMAN)
EAAEILQAA

SEQ ID NO: 128944 - protein, 9 aa, Artificial Sequence
  Description of Artificial Sequence: Synthetic peptide
  Seed: AVIGALLAV (PMEL_HUMAN)
APIGALLAV

SEQ ID NO: 128945 - protein, 10 aa, Artificial Sequence
  Description of Artificial Sequence: Synthetic peptide
  Seed: LMAVVLASLI (PMEL_HUMAN)
LMAVVLASLW

SEQ ID NO: 128946 - protein, 9 aa, Artificial Sequence
  Description of Artificial Sequence: Synthetic peptide
  Seed: VPFSVSVSQ (PMEL_HUMAN)
VCFSVSVSY

SEQ ID NO: 128947 - protein, 10 aa, Artificial Sequence
  Description of Artificial Sequence: Synthetic peptide
  Seed: RSFVYVWKTW (PMEL_HUMAN)
RSFVYVWKTF

SEQ ID NO: 128948 - protein, 11 aa, Artificial Sequence
  Description of Artificial Sequence: Synthetic peptide
  Seed: VSLADTNSLAV (PMEL_HUMAN)
VWLADTNSLAL

SEQ ID NO: 128949 - protein, 9 aa, Artificial Sequence
  Description of Artificial Sequence: Synthetic peptide
  Seed: IMPGQEAGL (PMEL_HUMAN)
IYPGQEAGF

SEQ ID NO: 128950 - protein, 9 aa, Artificial Sequence
  Description of Artificial Sequence: Synthetic peptide
  Seed: MSTPEATGM (PMEL_HUMAN)
MLTPEATGF

SEQ ID NO: 128951 - protein, 10 aa, Artificial Sequence
  Description of Artificial Sequence: Synthetic peptide
  Seed: TYLEPGPVTA (PMEL_HUMAN)
THLEPGPVTV

SEQ ID NO: 128952 - protein, 10 aa, Artificial Sequence
  Description of Artificial Sequence: Synthetic peptide
  Seed: LAHSSSAFTI (PMEL_HUMAN)
LTHSSSAFTY

SEQ ID NO: 128953 - protein, 9 aa, Artificial Sequence
  Description of Artificial Sequence: Synthetic peptide
  Seed: AVVSTQLIM (PMEL_HUMAN)
ASVSTQLIY

SEQ ID NO: 128954 - protein, 9 aa, Artificial Sequence
  Description of Artificial Sequence: Synthetic peptide
  Seed: STAPVQMPT (PMEL_HUMAN)
STAPVQMPM

SEQ ID NO: 128955 - protein, 11 aa, Artificial Sequence
  Description of Artificial Sequence: Synthetic peptide
  Seed: SQKRSFVYVWK (PMEL_HUMAN)
SVKRSFVYVWR

SEQ ID NO: 128956 - protein, 9 aa, Artificial Sequence
  Description of Artificial Sequence: Synthetic peptide
  Seed: ITDQVPFSV (PMEL_HUMAN)
ILDQVPFSA

SEQ ID NO: 128957 - protein, 11 aa, Artificial Sequence
  Description of Artificial Sequence: Synthetic peptide
  Seed: SLADTNSLAVV (PMEL_HUMAN)
SMADTNSLAVL

SEQ ID NO: 128958 - protein, 9 aa, Artificial Sequence
  Description of Artificial Sequence: Synthetic peptide
  Seed: LMAVVLASL (PMEL_HUMAN)
LLAVVLASF

SEQ ID NO: 128959 - protein, 9 aa, Artificial Sequence
  Description of Artificial Sequence: Synthetic peptide
  Seed: SITGSLGPL (PMEL_HUMAN)
SLTGSLGPY

SEQ ID NO: 128960 - protein, 9 aa, Artificial Sequence
  Description of Artificial Sequence: Synthetic peptide
  Seed: RLVKRQVPL (PMEL_HUMAN)
RMVKRQVPR

SEQ ID NO: 128961 - protein, 9 aa, Artificial Sequence
  Description of Artificial Sequence: Synthetic peptide
  Seed: AQVVLQAAI (PMEL_HUMAN)
AMVVLQAAY

SEQ ID NO: 128962 - protein, 10 aa, Artificial Sequence
  Description of Artificial Sequence: Synthetic peptide
  Seed: ESITGSLGPL (PMEL_HUMAN)
EVITGSLGPF

SEQ ID NO: 128963 - protein, 9 aa, Artificial Sequence
  Description of Artificial Sequence: Synthetic peptide
  Seed: HTYLEPGPV (PMEL_HUMAN)
HAYLEPGPV

SEQ ID NO: 128964 - protein, 9 aa, Artificial Sequence
  Description of Artificial Sequence: Synthetic peptide
  Seed: RAMLGTHTM (PMEL_HUMAN)
RHMLGTHTM

SEQ ID NO: 128965 - protein, 9 aa, Artificial Sequence
  Description of Artificial Sequence: Synthetic peptide
  Seed: VTAQVVLQA (PMEL_HUMAN)
VVAQVVLQM

SEQ ID NO: 128966 - protein, 9 aa, Artificial Sequence
  Description of Artificial Sequence: Synthetic peptide
  Seed: HLAVIGALL (PMEL_HUMAN)
HAAVIGALY

SEQ ID NO: 128967 - protein, 9 aa, Artificial Sequence
  Description of Artificial Sequence: Synthetic peptide
  Seed: AGQVPTTEV (PMEL_HUMAN)
AMQVPTTEY

SEQ ID NO: 128968 - protein, 9 aa, Artificial Sequence
  Description of Artificial Sequence: Synthetic peptide
  Seed: TTPGQAPTA (PMEL_HUMAN)
TIPGQAPTF

SEQ ID NO: 128969 - protein, 10 aa, Artificial Sequence
  Description of Artificial Sequence: Synthetic peptide
  Seed: AVPSGEGDAF (PMEL_HUMAN)
AMPSGEGDAY

SEQ ID NO: 128970 - protein, 10 aa, Artificial Sequence
  Description of Artificial Sequence: Synthetic peptide
  Seed: AVPSGEGDAF (PMEL_HUMAN)
AVPSGEGDAL

SEQ ID NO: 128971 - protein, 9 aa, Artificial Sequence
  Description of Artificial Sequence: Synthetic peptide
  Seed: VVLSGTTAA (PMEL_HUMAN)
VLLSGTTAY

SEQ ID NO: 128972 - protein, 8 aa, Artificial Sequence
  Description of Artificial Sequence: Synthetic peptide
  Seed: QDFSVPQL (PMEL_HUMAN)
QSFSVPQI

SEQ ID NO: 128973 - protein, 9 aa, Artificial Sequence
  Description of Artificial Sequence: Synthetic peptide
  Seed: RTKAWNRQL (PMEL_HUMAN)
RTKAWNRQP

SEQ ID NO: 128974 - protein, 9 aa, Artificial Sequence
  Description of Artificial Sequence: Synthetic peptide
  Seed: SLAVVSTQL (PMEL_HUMAN)
SGAVVSTQY

SEQ ID NO: 128975 - protein, 10 aa, Artificial Sequence
  Description of Artificial Sequence: Synthetic peptide
  Seed: LQLHDPSGYL (PMEL_HUMAN)
LDLHDPSGYV

SEQ ID NO: 128976 - protein, 10 aa, Artificial Sequence
  Description of Artificial Sequence: Synthetic peptide
  Seed: AEAPNTTAGQ (PMEL_HUMAN)
AEAPNTTAGI

SEQ ID NO: 128977 - protein, 10 aa, Artificial Sequence
  Description of Artificial Sequence: Synthetic peptide
  Seed: EVMGTTLAEM (PMEL_HUMAN)
ETMGTTLAEA

SEQ ID NO: 128978 - protein, 9 aa, Artificial Sequence
  Description of Artificial Sequence: Synthetic peptide
  Seed: VSCQGGLPK (PMEL_HUMAN)
VTCQGGLPK

SEQ ID NO: 128979 - protein, 9 aa, Artificial Sequence
  Description of Artificial Sequence: Synthetic peptide
  Seed: TTDGHRPTA (PMEL_HUMAN)
TSDGHRPTF

SEQ ID NO: 128980 - protein, 10 aa, Artificial Sequence
  Description of Artificial Sequence: Synthetic peptide
  Seed: MPTAESTGMT (PMEL_HUMAN)
MQTAESTGMV

SEQ ID NO: 128981 - protein, 9 aa, Artificial Sequence
  Description of Artificial Sequence: Synthetic peptide
  Seed: ALDGGNKHF (PMEL_HUMAN)
ALDGGNKHY

SEQ ID NO: 128982 - protein, 10 aa, Artificial Sequence
  Description of Artificial Sequence: Synthetic peptide
  Seed: WKTWGQYWQV (PMEL_HUMAN)
WPTWGQYWQV

SEQ ID NO: 128983 - protein, 9 aa, Artificial Sequence
  Description of Artificial Sequence: Synthetic peptide
  Seed: TTPGQAPTA (PMEL_HUMAN)
TMPGQAPTL

SEQ ID NO: 128984 - protein, 9 aa, Artificial Sequence
  Description of Artificial Sequence: Synthetic peptide
  Seed: GPTLIGANA (PMEL_HUMAN)
GPTLIGANL

SEQ ID NO: 128985 - protein, 8 aa, Artificial Sequence
  Description of Artificial Sequence: Synthetic peptide
  Seed: HSSSHWLR (PMEL_HUMAN)
HLSSHWLR

SEQ ID NO: 128986 - protein, 9 aa, Artificial Sequence
  Description of Artificial Sequence: Synthetic peptide
  Seed: SAFTITDQV (PMEL_HUMAN)
STFTITDQI

SEQ ID NO: 128987 - protein, 9 aa, Artificial Sequence
  Description of Artificial Sequence: Synthetic peptide
  Seed: NQDWLGVSR (PMEL_HUMAN)
NTDWLGVSY

SEQ ID NO: 128988 - protein, 11 aa, Artificial Sequence
  Description of Artificial Sequence: Synthetic peptide
  Seed: CVLYRYGSFSV (PMEL_HUMAN)
CYLYRYGSFSI

SEQ ID NO: 128989 - protein, 9 aa, Artificial Sequence
  Description of Artificial Sequence: Synthetic peptide
  Seed: LYRYGSFSV (PMEL_HUMAN)
LLRYGSFSK

SEQ ID NO: 128990 - protein, 8 aa, Artificial Sequence
  Description of Artificial Sequence: Synthetic peptide
  Seed: FGDSSGTL (PMEL_HUMAN)
FLDSSGTL

SEQ ID NO: 128991 - protein, 10 aa, Artificial Sequence
  Description of Artificial Sequence: Synthetic peptide
  Seed: ESITGSLGPL (PMEL_HUMAN)
EIITGSLGPV

SEQ ID NO: 128992 - protein, 9 aa, Artificial Sequence
  Description of Artificial Sequence: Synthetic peptide
  Seed: LAVGATKVP (PMEL_HUMAN)
LTVGATKVF

SEQ ID NO: 128993 - protein, 9 aa, Artificial Sequence
  Description of Artificial Sequence: Synthetic peptide
  Seed: KVLPDGQVI (PMEL_HUMAN)
KSLPDGQVL

SEQ ID NO: 128994 - protein, 8 aa, Artificial Sequence
  Description of Artificial Sequence: Synthetic peptide
  Seed: LADTNSLA (PMEL_HUMAN)
LADTNSLM

SEQ ID NO: 128995 - protein, 9 aa, Artificial Sequence
  Description of Artificial Sequence: Synthetic peptide
  Seed: RALVVTHTY (PMEL_HUMAN)
RILVVTHTR

SEQ ID NO: 128996 - protein, 10 aa, Artificial Sequence
  Description of Artificial Sequence: Synthetic peptide
  Seed: SGTYCLNVSL (PMEL_HUMAN)
SDTYCLNVSW

SEQ ID NO: 128997 - protein, 9 aa, Artificial Sequence
  Description of Artificial Sequence: Synthetic peptide
  Seed: RLMKQDFSV (PMEL_HUMAN)
RFMKQDFSY

SEQ ID NO: 128998 - protein, 9 aa, Artificial Sequence
  Description of Artificial Sequence: Synthetic peptide
  Seed: RLVKRQVPL (PMEL_HUMAN)
RAVKRQVPY

SEQ ID NO: 128999 - protein, 9 aa, Artificial Sequence
  Description of Artificial Sequence: Synthetic peptide
  Seed: VLKRCLLHL (PMEL_HUMAN)
VMKRCLLHV

SEQ ID NO: 129000 - protein, 9 aa, Artificial Sequence
  Description of Artificial Sequence: Synthetic peptide
  Seed: FTITDQVPF (PMEL_HUMAN)
FHITDQVPF

SEQ ID NO: 129001 - protein, 10 aa, Artificial Sequence
  Description of Artificial Sequence: Synthetic peptide
  Seed: YVPLAHSSSA (PMEL_HUMAN)
YRPLAHSSSL

SEQ ID NO: 129002 - protein, 8 aa, Artificial Sequence
  Description of Artificial Sequence: Synthetic peptide
  Seed: AQVVLQAA (PMEL_HUMAN)
AQVVLQAI

SEQ ID NO: 129003 - protein, 9 aa, Artificial Sequence
  Description of Artificial Sequence: Synthetic peptide
  Seed: HLAVIGALL (PMEL_HUMAN)
HMAVIGALM

SEQ ID NO: 129004 - protein, 10 aa, Artificial Sequence
  Description of Artificial Sequence: Synthetic peptide
  Seed: RGSRSYVPLA (PMEL_HUMAN)
RWSRSYVPLM

SEQ ID NO: 129005 - protein, 9 aa, Artificial Sequence
  Description of Artificial Sequence: Synthetic peptide
  Seed: LMAVVLASL (PMEL_HUMAN)
LLAVVLASV

SEQ ID NO: 129006 - protein, 9 aa, Artificial Sequence
  Description of Artificial Sequence: Synthetic peptide
  Seed: DQVPFSVSV (PMEL_HUMAN)
DIVPFSVSV

SEQ ID NO: 129007 - protein, 9 aa, Artificial Sequence
  Description of Artificial Sequence: Synthetic peptide
  Seed: ISRALVVTH (PMEL_HUMAN)
ILRALVVTY

SEQ ID NO: 129008 - protein, 10 aa, Artificial Sequence
  Description of Artificial Sequence: Synthetic peptide
  Seed: EVMGTTLAEM (PMEL_HUMAN)
ELMGTTLAEF

SEQ ID NO: 129009 - protein, 10 aa, Artificial Sequence
  Description of Artificial Sequence: Synthetic peptide
  Seed: RSFVYVWKTW (PMEL_HUMAN)
RMFVYVWKTM

SEQ ID NO: 129010 - protein, 10 aa, Artificial Sequence
  Description of Artificial Sequence: Synthetic peptide
  Seed: LVLMAVVLAS (PMEL_HUMAN)
LKLMAVVLAA

SEQ ID NO: 129011 - protein, 10 aa, Artificial Sequence
  Description of Artificial Sequence: Synthetic peptide
  Seed: MTPAEVSIVV (PMEL_HUMAN)
MVPAEVSIVA

SEQ ID NO: 129012 - protein, 10 aa, Artificial Sequence
  Description of Artificial Sequence: Synthetic peptide
  Seed: RQLYPEWTEA (PMEL_HUMAN)
RPLYPEWTEY

SEQ ID NO: 129013 - protein, 9 aa, Artificial Sequence
  Description of Artificial Sequence: Synthetic peptide
  Seed: IESAEILQA (PMEL_HUMAN)
IESAEILQF

SEQ ID NO: 129014 - protein, 9 aa, Artificial Sequence
  Description of Artificial Sequence: Synthetic peptide
  Seed: TAQVVLQAA (PMEL_HUMAN)
TAQVVLQAL

SEQ ID NO: 129015 - protein, 11 aa, Artificial Sequence
  Description of Artificial Sequence: Synthetic peptide
  Seed: LYRYGSFSVTL (PMEL_HUMAN)
LTRYGSFSVTF

SEQ ID NO: 129016 - protein, 9 aa, Artificial Sequence
  Description of Artificial Sequence: Synthetic peptide
  Seed: APVQMPTAE (PMEL_HUMAN)
APVQMPTAV

SEQ ID NO: 129017 - protein, 9 aa, Artificial Sequence
  Description of Artificial Sequence: Synthetic peptide
  Seed: FGDSSGTLI (PMEL_HUMAN)
FTDSSGTLL

SEQ ID NO: 129018 - protein, 10 aa, Artificial Sequence
  Description of Artificial Sequence: Synthetic peptide
  Seed: RALVVTHTYL (PMEL_HUMAN)
RMLVVTHTYA

SEQ ID NO: 129019 - protein, 9 aa, Artificial Sequence
  Description of Artificial Sequence: Synthetic peptide
  Seed: LNFPGSQKV (PMEL_HUMAN)
LLFPGSQKF

SEQ ID NO: 129020 - protein, 9 aa, Artificial Sequence
  Description of Artificial Sequence: Synthetic peptide
  Seed: KAWNRQLYP (PMEL_HUMAN)
KTWNRQLYY

SEQ ID NO: 129021 - protein, 9 aa, Artificial Sequence
  Description of Artificial Sequence: Synthetic peptide
  Seed: AEADLSYTW (PMEL_HUMAN)
AVADLSYTI

SEQ ID NO: 129022 - protein, 9 aa, Artificial Sequence
  Description of Artificial Sequence: Synthetic peptide
  Seed: ESAEILQAV (PMEL_HUMAN)
EAAEILQAM

SEQ ID NO: 129023 - protein, 10 aa, Artificial Sequence
  Description of Artificial Sequence: Synthetic peptide
  Seed: KTWGQYWQVL (PMEL_HUMAN)
KIWGQYWQVC

SEQ ID NO: 129024 - protein, 10 aa, Artificial Sequence
  Description of Artificial Sequence: Synthetic peptide
  Seed: RQLYPEWTEA (PMEL_HUMAN)
RQLYPEWTEM

SEQ ID NO: 129025 - protein, 10 aa, Artificial Sequence
  Description of Artificial Sequence: Synthetic peptide
  Seed: RALDGGNKHF (PMEL_HUMAN)
RMLDGGNKHM

SEQ ID NO: 129026 - protein, 11 aa, Artificial Sequence
  Description of Artificial Sequence: Synthetic peptide
  Seed: RRRLMKQDFSV (PMEL_HUMAN)
RWRLMKQDFSV

SEQ ID NO: 129027 - protein, 10 aa, Artificial Sequence
  Description of Artificial Sequence: Synthetic peptide
  Seed: MTPAEVSIVV (PMEL_HUMAN)
MTPAEVSIVS

SEQ ID NO: 129028 - protein, 10 aa, Artificial Sequence
  Description of Artificial Sequence: Synthetic peptide
  Seed: AEILQAVPSG (PMEL_HUMAN)
AEILQAVPSA

SEQ ID NO: 129029 - protein, 11 aa, Artificial Sequence
  Description of Artificial Sequence: Synthetic peptide
  Seed: VWKTWGQYWQV (PMEL_HUMAN)
VMKTWGQYWQL

SEQ ID NO: 129030 - protein, 9 aa, Artificial Sequence
  Description of Artificial Sequence: Synthetic peptide
  Seed: AVIGALLAV (PMEL_HUMAN)
APIGALLAM

SEQ ID NO: 129031 - protein, 9 aa, Artificial Sequence
  Description of Artificial Sequence: Synthetic peptide
  Seed: DAFELTVSC (PMEL_HUMAN)
DVFELTVSV

SEQ ID NO: 129032 - protein, 11 aa, Artificial Sequence
  Description of Artificial Sequence: Synthetic peptide
  Seed: KHFLRNQPLTF (PMEL_HUMAN)
KRFLRNQPLTF

SEQ ID NO: 129033 - protein, 9 aa, Artificial Sequence
  Description of Artificial Sequence: Synthetic peptide
  Seed: VSRQLRTKA (PMEL_HUMAN)
VTRQLRTKA

SEQ ID NO: 129034 - protein, 9 aa, Artificial Sequence
  Description of Artificial Sequence: Synthetic peptide
  Seed: MTPEKVPVS (PMEL_HUMAN)
MSPEKVPVF

SEQ ID NO: 129035 - protein, 9 aa, Artificial Sequence
  Description of Artificial Sequence: Synthetic peptide
  Seed: TLISRALVV (PMEL_HUMAN)
TQISRALVI

SEQ ID NO: 129036 - protein, 9 aa, Artificial Sequence
  Description of Artificial Sequence: Synthetic peptide
  Seed: HTYLEPGPV (PMEL_HUMAN)
HVYLEPGPW

SEQ ID NO: 129037 - protein, 9 aa, Artificial Sequence
  Description of Artificial Sequence: Synthetic peptide
  Seed: AVIGALLAV (PMEL_HUMAN)
AIIGALLAY

SEQ ID NO: 129038 - protein, 11 aa, Artificial Sequence
  Description of Artificial Sequence: Synthetic peptide
  Seed: RALDGGNKHFL (PMEL_HUMAN)
RLLDGGNKHFF

SEQ ID NO: 129039 - protein, 9 aa, Artificial Sequence
  Description of Artificial Sequence: Synthetic peptide
  Seed: YLEPGPVTA (PMEL_HUMAN)
YFEPGPVTM

SEQ ID NO: 129040 - protein, 11 aa, Artificial Sequence
  Description of Artificial Sequence: Synthetic peptide
  Seed: VLASLIYRRRL (PMEL_HUMAN)
VMASLIYRRRV

SEQ ID NO: 129041 - protein, 9 aa, Artificial Sequence
  Description of Artificial Sequence: Synthetic peptide
  Seed: RALVVTHTY (PMEL_HUMAN)
RKLVVTHTM

SEQ ID NO: 129042 - protein, 9 aa, Artificial Sequence
  Description of Artificial Sequence: Synthetic peptide
  Seed: ALVVTHTYL (PMEL_HUMAN)
ASVVTHTYF

SEQ ID NO: 129043 - protein, 10 aa, Artificial Sequence
  Description of Artificial Sequence: Synthetic peptide
  Seed: LDGGNKHFLR (PMEL_HUMAN)
LMGGNKHFLR

SEQ ID NO: 129044 - protein, 9 aa, Artificial Sequence
  Description of Artificial Sequence: Synthetic peptide
  Seed: AQVTTTEWV (PMEL_HUMAN)
AIVTTTEWI

SEQ ID NO: 129045 - protein, 9 aa, Artificial Sequence
  Description of Artificial Sequence: Synthetic peptide
  Seed: TTPGQAPTA (PMEL_HUMAN)
TVPGQAPTI

SEQ ID NO: 129046 - protein, 10 aa, Artificial Sequence
  Description of Artificial Sequence: Synthetic peptide
  Seed: SRALVVTHTY (PMEL_HUMAN)
SLALVVTHTW

SEQ ID NO: 129047 - protein, 10 aa, Artificial Sequence
  Description of Artificial Sequence: Synthetic peptide
  Seed: RLMKQDFSVP (PMEL_HUMAN)
RMMKQDFSVA

SEQ ID NO: 129048 - protein, 9 aa, Artificial Sequence
  Description of Artificial Sequence: Synthetic peptide
  Seed: KQDFSVPQL (PMEL_HUMAN)
KMDFSVPQF

SEQ ID NO: 129049 - protein, 10 aa, Artificial Sequence
  Description of Artificial Sequence: Synthetic peptide
  Seed: AEADLSYTWD (PMEL_HUMAN)
AEADLSYTWE

SEQ ID NO: 129050 - protein, 9 aa, Artificial Sequence
  Description of Artificial Sequence: Synthetic peptide
  Seed: MLGTHTMEV (PMEL_HUMAN)
MGGTHTMEY

SEQ ID NO: 129051 - protein, 11 aa, Artificial Sequence
  Description of Artificial Sequence: Synthetic peptide
  Seed: QEAGLGQVPLI (PMEL_HUMAN)
QEAGLGQVPLA

SEQ ID NO: 129052 - protein, 9 aa, Artificial Sequence
  Description of Artificial Sequence: Synthetic peptide
  Seed: TLIGANASF (PMEL_HUMAN)
TPIGANASF

SEQ ID NO: 129053 - protein, 9 aa, Artificial Sequence
  Description of Artificial Sequence: Synthetic peptide
  Seed: VSVSQLRAL (PMEL_HUMAN)
VSVSQLRAF

SEQ ID NO: 129054 - protein, 9 aa, Artificial Sequence
  Description of Artificial Sequence: Synthetic peptide
  Seed: RTKAWNRQL (PMEL_HUMAN)
RMKAWNRQY

SEQ ID NO: 129055 - protein, 9 aa, Artificial Sequence
  Description of Artificial Sequence: Synthetic peptide
  Seed: TLIGANASF (PMEL_HUMAN)
TMIGANASF

SEQ ID NO: 129056 - protein, 9 aa, Artificial Sequence
  Description of Artificial Sequence: Synthetic peptide
  Seed: GMTPAEVSI (PMEL_HUMAN)
GMTPAEVSY

SEQ ID NO: 129057 - protein, 11 aa, Artificial Sequence
  Description of Artificial Sequence: Synthetic peptide
  Seed: RYGSFSVTLDI (PMEL_HUMAN)
RFGSFSVTLDW

SEQ ID NO: 129058 - protein, 8 aa, Artificial Sequence
  Description of Artificial Sequence: Synthetic peptide
  Seed: FGDSSGTL (PMEL_HUMAN)
FYDSSGTL

SEQ ID NO: 129059 - protein, 9 aa, Artificial Sequence
  Description of Artificial Sequence: Synthetic peptide
  Seed: ILKGGSGTY (PMEL_HUMAN)
IAKGGSGTM

SEQ ID NO: 129060 - protein, 10 aa, Artificial Sequence
  Description of Artificial Sequence: Synthetic peptide
  Seed: KRQVPLDCVL (PMEL_HUMAN)
KAQVPLDCVF

SEQ ID NO: 129061 - protein, 10 aa, Artificial Sequence
  Description of Artificial Sequence: Synthetic peptide
  Seed: SVTLDIVQGI (PMEL_HUMAN)
SGTLDIVQGV

SEQ ID NO: 129062 - protein, 9 aa, Artificial Sequence
  Description of Artificial Sequence: Synthetic peptide
  Seed: SQVWGGQPV (PMEL_HUMAN)
STVWGGQPY

SEQ ID NO: 129063 - protein, 9 aa, Artificial Sequence
  Description of Artificial Sequence: Synthetic peptide
  Seed: KQDFSVPQL (PMEL_HUMAN)
KSDFSVPQM

SEQ ID NO: 129064 - protein, 9 aa, Artificial Sequence
  Description of Artificial Sequence: Synthetic peptide
  Seed: VLQAAIPLT (PMEL_HUMAN)
VLQAAIPLM

SEQ ID NO: 129065 - protein, 9 aa, Artificial Sequence
  Description of Artificial Sequence: Synthetic peptide
  Seed: EGDAFELTV (PMEL_HUMAN)
EADAFELTI

SEQ ID NO: 129066 - protein, 9 aa, Artificial Sequence
  Description of Artificial Sequence: Synthetic peptide
  Seed: SAFTITDQV (PMEL_HUMAN)
SIFTITDQM

SEQ ID NO: 129067 - protein, 9 aa, Artificial Sequence
  Description of Artificial Sequence: Synthetic peptide
  Seed: RLMKQDFSV (PMEL_HUMAN)
RIMKQDFSF

SEQ ID NO: 129068 - protein, 10 aa, Artificial Sequence
  Description of Artificial Sequence: Synthetic peptide
  Seed: YVPLAHSSSA (PMEL_HUMAN)
YCPLAHSSSM

SEQ ID NO: 129069 - protein, 9 aa, Artificial Sequence
  Description of Artificial Sequence: Synthetic peptide
  Seed: DSSGTLISR (PMEL_HUMAN)
DNSGTLISR

SEQ ID NO: 129070 - protein, 9 aa, Artificial Sequence
  Description of Artificial Sequence: Synthetic peptide
  Seed: KHFLRNQPL (PMEL_HUMAN)
KEFLRNQPF

SEQ ID NO: 129071 - protein, 11 aa, Artificial Sequence
  Description of Artificial Sequence: Synthetic peptide
  Seed: RYGSFSVTLDI (PMEL_HUMAN)
RFGSFSVTLDF

SEQ ID NO: 129072 - protein, 10 aa, Artificial Sequence
  Description of Artificial Sequence: Synthetic peptide
  Seed: VLPSPACQLV (PMEL_HUMAN)
VVPSPACQLL

SEQ ID NO: 129073 - protein, 9 aa, Artificial Sequence
  Description of Artificial Sequence: Synthetic peptide
  Seed: MLGTHTMEV (PMEL_HUMAN)
MYGTHTMEL

SEQ ID NO: 129074 - protein, 9 aa, Artificial Sequence
  Description of Artificial Sequence: Synthetic peptide
  Seed: AGLGQVPLI (PMEL_HUMAN)
AVLGQVPLV

SEQ ID NO: 129075 - protein, 10 aa, Artificial Sequence
  Description of Artificial Sequence: Synthetic peptide
  Seed: MSTESITGSL (PMEL_HUMAN)
MSTESITGSW

SEQ ID NO: 129076 - protein, 11 aa, Artificial Sequence
  Description of Artificial Sequence: Synthetic peptide
  Seed: RTKAWNRQLYP (PMEL_HUMAN)
RTKAWNRQLYK

SEQ ID NO: 129077 - protein, 9 aa, Artificial Sequence
  Description of Artificial Sequence: Synthetic peptide
  Seed: RALVVTHTY (PMEL_HUMAN)
RGLVVTHTW

SEQ ID NO: 129078 - protein, 9 aa, Artificial Sequence
  Description of Artificial Sequence: Synthetic peptide
  Seed: VQVPTTEVI (PMEL_HUMAN)
VSVPTTEVY

SEQ ID NO: 129079 - protein, 11 aa, Artificial Sequence
  Description of Artificial Sequence: Synthetic peptide
  Seed: YVPLAHSSSAF (PMEL_HUMAN)
YDPLAHSSSAF

SEQ ID NO: 129080 - protein, 9 aa, Artificial Sequence
  Description of Artificial Sequence: Synthetic peptide
  Seed: RAMLGTHTM (PMEL_HUMAN)
RHMLGTHTV

SEQ ID NO: 129081 - protein, 9 aa, Artificial Sequence
  Description of Artificial Sequence: Synthetic peptide
  Seed: VSLADTNSL (PMEL_HUMAN)
VTLADTNSF

SEQ ID NO: 129082 - protein, 10 aa, Artificial Sequence
  Description of Artificial Sequence: Synthetic peptide
  Seed: ALDGGNKHFL (PMEL_HUMAN)
AFDGGNKHFL

SEQ ID NO: 129083 - protein, 9 aa, Artificial Sequence
  Description of Artificial Sequence: Synthetic peptide
  Seed: TLIGANASF (PMEL_HUMAN)
TTIGANASL

SEQ ID NO: 129084 - protein, 9 aa, Artificial Sequence
  Description of Artificial Sequence: Synthetic peptide
  Seed: FGDSSGTLI (PMEL_HUMAN)
FCDSSGTLM

SEQ ID NO: 129085 - protein, 10 aa, Artificial Sequence
  Description of Artificial Sequence: Synthetic peptide
  Seed: MTPAEVSIVV (PMEL_HUMAN)
MNPAEVSIVY

SEQ ID NO: 129086 - protein, 11 aa, Artificial Sequence
  Description of Artificial Sequence: Synthetic peptide
  Seed: RYGSFSVTLDI (PMEL_HUMAN)
RWGSFSVTLDF

SEQ ID NO: 129087 - protein, 10 aa, Artificial Sequence
  Description of Artificial Sequence: Synthetic peptide
  Seed: RALDGGNKHF (PMEL_HUMAN)
RTLDGGNKHY

SEQ ID NO: 129088 - protein, 9 aa, Artificial Sequence
  Description of Artificial Sequence: Synthetic peptide
  Seed: RELPIPEPE (PMEL_HUMAN)
RELPIPEPI

SEQ ID NO: 129089 - protein, 10 aa, Artificial Sequence
  Description of Artificial Sequence: Synthetic peptide
  Seed: VLMAVVLASL (PMEL_HUMAN)
VYMAVVLASY

SEQ ID NO: 129090 - protein, 10 aa, Artificial Sequence
  Description of Artificial Sequence: Synthetic peptide
  Seed: KTWGQYWQVL (PMEL_HUMAN)
KIWGQYWQVS

SEQ ID NO: 129091 - protein, 9 aa, Artificial Sequence
  Description of Artificial Sequence: Synthetic peptide
  Seed: RLMKQDFSV (PMEL_HUMAN)
RKMKQDFSL

SEQ ID NO: 129092 - protein, 11 aa, Artificial Sequence
  Description of Artificial Sequence: Synthetic peptide
  Seed: RELPIPEPEGP (PMEL_HUMAN)
RELPIPEPEGC

SEQ ID NO: 129093 - protein, 9 aa, Artificial Sequence
  Description of Artificial Sequence: Synthetic peptide
  Seed: FGDSSGTLI (PMEL_HUMAN)
FGDSSGTLM

SEQ ID NO: 129094 - protein, 9 aa, Artificial Sequence
  Description of Artificial Sequence: Synthetic peptide
  Seed: WSQKRSFVY (PMEL_HUMAN)
WKQKRSFVY

SEQ ID NO: 129095 - protein, 9 aa, Artificial Sequence
  Description of Artificial Sequence: Synthetic peptide
  Seed: LPDGQVIWV (PMEL_HUMAN)
LTDGQVIWL

SEQ ID NO: 129096 - protein, 9 aa, Artificial Sequence
  Description of Artificial Sequence: Synthetic peptide
  Seed: LSIGTGRAM (PMEL_HUMAN)
LAIGTGRAH

SEQ ID NO: 129097 - protein, 9 aa, Artificial Sequence
  Description of Artificial Sequence: Synthetic peptide
  Seed: RAMLGTHTM (PMEL_HUMAN)
RGMLGTHTW

SEQ ID NO: 129098 - protein, 10 aa, Artificial Sequence
  Description of Artificial Sequence: Synthetic peptide
  Seed: ESITGSLGPL (PMEL_HUMAN)
ETITGSLGPM

SEQ ID NO: 129099 - protein, 10 aa, Artificial Sequence
  Description of Artificial Sequence: Synthetic peptide
  Seed: YVPLAHSSSA (PMEL_HUMAN)
YCPLAHSSSA

SEQ ID NO: 129100 - protein, 9 aa, Artificial Sequence
  Description of Artificial Sequence: Synthetic peptide
  Seed: LQAAIPLTS (PMEL_HUMAN)
LVAAIPLTY

SEQ ID NO: 129101 - protein, 9 aa, Artificial Sequence
  Description of Artificial Sequence: Synthetic peptide
  Seed: AESTGMTPE (PMEL_HUMAN)
AESTGMTPT

SEQ ID NO: 129102 - protein, 9 aa, Artificial Sequence
  Description of Artificial Sequence: Synthetic peptide
  Seed: TTPGQAPTA (PMEL_HUMAN)
TRPGQAPTM

SEQ ID NO: 129103 - protein, 9 aa, Artificial Sequence
  Description of Artificial Sequence: Synthetic peptide
  Seed: GMTPAEVSI (PMEL_HUMAN)
GQTPAEVSI

SEQ ID NO: 129104 - protein, 9 aa, Artificial Sequence
  Description of Artificial Sequence: Synthetic peptide
  Seed: VSEVMGTTL (PMEL_HUMAN)
VEEVMGTTM

SEQ ID NO: 129105 - protein, 9 aa, Artificial Sequence
  Description of Artificial Sequence: Synthetic peptide
  Seed: MAVVLASLI (PMEL_HUMAN)
MKVVLASLL

SEQ ID NO: 129106 - protein, 9 aa, Artificial Sequence
  Description of Artificial Sequence: Synthetic peptide
  Seed: VLASLIYRR (PMEL_HUMAN)
VPASLIYRR

SEQ ID NO: 129107 - protein, 10 aa, Artificial Sequence
  Description of Artificial Sequence: Synthetic peptide
  Seed: SGTYCLNVSL (PMEL_HUMAN)
SATYCLNVSY

SEQ ID NO: 129108 - protein, 10 aa, Artificial Sequence
  Description of Artificial Sequence: Synthetic peptide
  Seed: SVPQLPHSSS (PMEL_HUMAN)
SLPQLPHSSA

SEQ ID NO: 129109 - protein, 10 aa, Artificial Sequence
  Description of Artificial Sequence: Synthetic peptide
  Seed: TPAEVSIVVL (PMEL_HUMAN)
TAAEVSIVVY

SEQ ID NO: 129110 - protein, 9 aa, Artificial Sequence
  Description of Artificial Sequence: Synthetic peptide
  Seed: KTWGQYWQV (PMEL_HUMAN)
KMWGQYWQM

SEQ ID NO: 129111 - protein, 10 aa, Artificial Sequence
  Description of Artificial Sequence: Synthetic peptide
  Seed: IALNFPGSQK (PMEL_HUMAN)
IILNFPGSQR

SEQ ID NO: 129112 - protein, 9 aa, Artificial Sequence
  Description of Artificial Sequence: Synthetic peptide
  Seed: VSEVMGTTL (PMEL_HUMAN)
VYEVMGTTF

SEQ ID NO: 129113 - protein, 10 aa, Artificial Sequence
  Description of Artificial Sequence: Synthetic peptide
  Seed: LMAVVLASLI (PMEL_HUMAN)
LLAVVLASLA

SEQ ID NO: 129114 - protein, 10 aa, Artificial Sequence
  Description of Artificial Sequence: Synthetic peptide
  Seed: SVPQLPHSSS (PMEL_HUMAN)
SRPQLPHSSA

SEQ ID NO: 129115 - protein, 10 aa, Artificial Sequence
  Description of Artificial Sequence: Synthetic peptide
  Seed: SRALVVTHTY (PMEL_HUMAN)
SMALVVTHTM

SEQ ID NO: 129116 - protein, 9 aa, Artificial Sequence
  Description of Artificial Sequence: Synthetic peptide
  Seed: AEADLSYTW (PMEL_HUMAN)
APADLSYTF

SEQ ID NO: 129117 - protein, 9 aa, Artificial Sequence
  Description of Artificial Sequence: Synthetic peptide
  Seed: QKRSFVYVW (PMEL_HUMAN)
QERSFVYVF

SEQ ID NO: 129118 - protein, 9 aa, Artificial Sequence
  Description of Artificial Sequence: Synthetic peptide
  Seed: FLRNQPLTF (PMEL_HUMAN)
FVRNQPLTM

SEQ ID NO: 129119 - protein, 9 aa, Artificial Sequence
  Description of Artificial Sequence: Synthetic peptide
  Seed: LSIGTGRAM (PMEL_HUMAN)
LPIGTGRAM

SEQ ID NO: 129120 - protein, 10 aa, Artificial Sequence
  Description of Artificial Sequence: Synthetic peptide
  Seed: SGTYCLNVSL (PMEL_HUMAN)
SITYCLNVSV

SEQ ID NO: 129121 - protein, 11 aa, Artificial Sequence
  Description of Artificial Sequence: Synthetic peptide
  Seed: ISRALVVTHTY (PMEL_HUMAN)
IPRALVVTHTW

SEQ ID NO: 129122 - protein, 9 aa, Artificial Sequence
  Description of Artificial Sequence: Synthetic peptide
  Seed: LADTNSLAV (PMEL_HUMAN)
LMDTNSLAF

SEQ ID NO: 129123 - protein, 9 aa, Artificial Sequence
  Description of Artificial Sequence: Synthetic peptide
  Seed: LQAAIPLTS (PMEL_HUMAN)
LSAAIPLTY

SEQ ID NO: 129124 - protein, 9 aa, Artificial Sequence
  Description of Artificial Sequence: Synthetic peptide
  Seed: VQMPTAEST (PMEL_HUMAN)
VVMPTAESM

SEQ ID NO: 129125 - protein, 9 aa, Artificial Sequence
  Description of Artificial Sequence: Synthetic peptide
  Seed: QVIWVNNTI (PMEL_HUMAN)
QTIWVNNTL

SEQ ID NO: 129126 - protein, 10 aa, Artificial Sequence
  Description of Artificial Sequence: Synthetic peptide
  Seed: MSTESITGSL (PMEL_HUMAN)
MVTESITGSW

SEQ ID NO: 129127 - protein, 9 aa, Artificial Sequence
  Description of Artificial Sequence: Synthetic peptide
  Seed: FTITDQVPF (PMEL_HUMAN)
FFITDQVPI

SEQ ID NO: 129128 - protein, 9 aa, Artificial Sequence
  Description of Artificial Sequence: Synthetic peptide
  Seed: LYRYGSFSV (PMEL_HUMAN)
LSRYGSFSA

SEQ ID NO: 129129 - protein, 9 aa, Artificial Sequence
  Description of Artificial Sequence: Synthetic peptide
  Seed: MSTPEATGM (PMEL_HUMAN)
MMTPEATGY

SEQ ID NO: 129130 - protein, 10 aa, Artificial Sequence
  Description of Artificial Sequence: Synthetic peptide
  Seed: RGSRSYVPLA (PMEL_HUMAN)
RNSRSYVPLY

SEQ ID NO: 129131 - protein, 9 aa, Artificial Sequence
  Description of Artificial Sequence: Synthetic peptide
  Seed: FGDSSGTLI (PMEL_HUMAN)
FYDSSGTLC

SEQ ID NO: 129132 - protein, 8 aa, Artificial Sequence
  Description of Artificial Sequence: Synthetic peptide
  Seed: LLDGTATL (PMEL_HUMAN)
LSDGTATF

SEQ ID NO: 129133 - protein, 9 aa, Artificial Sequence
  Description of Artificial Sequence: Synthetic peptide
  Seed: TKAWNRQLY (PMEL_HUMAN)
TLAWNRQLY

SEQ ID NO: 129134 - protein, 9 aa, Artificial Sequence
  Description of Artificial Sequence: Synthetic peptide
  Seed: VLGGPVSGL (PMEL_HUMAN)
VSGGPVSGF

SEQ ID NO: 129135 - protein, 11 aa, Artificial Sequence
  Description of Artificial Sequence: Synthetic peptide
  Seed: FGDSSGTLISR (PMEL_HUMAN)
FTDSSGTLISH

SEQ ID NO: 129136 - protein, 9 aa, Artificial Sequence
  Description of Artificial Sequence: Synthetic peptide
  Seed: YRYGSFSVT (PMEL_HUMAN)
YHYGSFSVF

SEQ ID NO: 129137 - protein, 9 aa, Artificial Sequence
  Description of Artificial Sequence: Synthetic peptide
  Seed: YPQETDDAC (PMEL_HUMAN)
YAQETDDAY

SEQ ID NO: 129138 - protein, 10 aa, Artificial Sequence
  Description of Artificial Sequence: Synthetic peptide
  Seed: ASSIMSTESI (PMEL_HUMAN)
AWSIMSTESW

SEQ ID NO: 129139 - protein, 9 aa, Artificial Sequence
  Description of Artificial Sequence: Synthetic peptide
  Seed: LSIGTGRAM (PMEL_HUMAN)
LQIGTGRAV

SEQ ID NO: 129140 - protein, 9 aa, Artificial Sequence
  Description of Artificial Sequence: Synthetic peptide
  Seed: SFVYVWKTW (PMEL_HUMAN)
SYVYVWKTV

SEQ ID NO: 129141 - protein, 10 aa, Artificial Sequence
  Description of Artificial Sequence: Synthetic peptide
  Seed: TGMTPAEVSI (PMEL_HUMAN)
TLMTPAEVSL

SEQ ID NO: 129142 - protein, 8 aa, Artificial Sequence
  Description of Artificial Sequence: Synthetic peptide
  Seed: SHWLRLPR (PMEL_HUMAN)
SMWLRLPR

SEQ ID NO: 129143 - protein, 9 aa, Artificial Sequence
  Description of Artificial Sequence: Synthetic peptide
  Seed: FLRNQPLTF (PMEL_HUMAN)
FSRNQPLTF

SEQ ID NO: 129144 - protein, 9 aa, Artificial Sequence
  Description of Artificial Sequence: Synthetic peptide
  Seed: SGTLISRAL (PMEL_HUMAN)
SSTLISRAV

SEQ ID NO: 129145 - protein, 9 aa, Artificial Sequence
  Description of Artificial Sequence: Synthetic peptide
  Seed: VLQAAIPLT (PMEL_HUMAN)
VMQAAIPLV

SEQ ID NO: 129146 - protein, 10 aa, Artificial Sequence
  Description of Artificial Sequence: Synthetic peptide
  Seed: FLRNQPLTFA (PMEL_HUMAN)
FVRNQPLTFV

SEQ ID NO: 129147 - protein, 10 aa, Artificial Sequence
  Description of Artificial Sequence: Synthetic peptide
  Seed: VSLADTNSLA (PMEL_HUMAN)
VALADTNSLL

SEQ ID NO: 129148 - protein, 10 aa, Artificial Sequence
  Description of Artificial Sequence: Synthetic peptide
  Seed: KVLPDGQVIW (PMEL_HUMAN)
KSLPDGQVIF

SEQ ID NO: 129149 - protein, 9 aa, Artificial Sequence
  Description of Artificial Sequence: Synthetic peptide
  Seed: RALVVTHTY (PMEL_HUMAN)
RLLVVTHTV

SEQ ID NO: 129150 - protein, 9 aa, Artificial Sequence
  Description of Artificial Sequence: Synthetic peptide
  Seed: VLKRCLLHL (PMEL_HUMAN)
VLKRCLLHA

SEQ ID NO: 129151 - protein, 9 aa, Artificial Sequence
  Description of Artificial Sequence: Synthetic peptide
  Seed: TLISRALVV (PMEL_HUMAN)
TQISRALVM

SEQ ID NO: 129152 - protein, 9 aa, Artificial Sequence
  Description of Artificial Sequence: Synthetic peptide
  Seed: GQVPLIVGI (PMEL_HUMAN)
GLVPLIVGI

SEQ ID NO: 129153 - protein, 10 aa, Artificial Sequence
  Description of Artificial Sequence: Synthetic peptide
  Seed: LHLAVIGALL (PMEL_HUMAN)
LELAVIGALL

SEQ ID NO: 129154 - protein, 9 aa, Artificial Sequence
  Description of Artificial Sequence: Synthetic peptide
  Seed: LQAAIPLTS (PMEL_HUMAN)
LLAAIPLTM

SEQ ID NO: 129155 - protein, 9 aa, Artificial Sequence
  Description of Artificial Sequence: Synthetic peptide
  Seed: RTKAWNRQL (PMEL_HUMAN)
RQKAWNRQK

SEQ ID NO: 129156 - protein, 10 aa, Artificial Sequence
  Description of Artificial Sequence: Synthetic peptide
  Seed: RGSRSYVPLA (PMEL_HUMAN)
RQSRSYVPLA

SEQ ID NO: 129157 - protein, 9 aa, Artificial Sequence
  Description of Artificial Sequence: Synthetic peptide
  Seed: HWLRLPRIF (PMEL_HUMAN)
HFLRLPRIM

SEQ ID NO: 129158 - protein, 10 aa, Artificial Sequence
  Description of Artificial Sequence: Synthetic peptide
  Seed: YVPLAHSSSA (PMEL_HUMAN)
YSPLAHSSSI

SEQ ID NO: 129159 - protein, 10 aa, Artificial Sequence
  Description of Artificial Sequence: Synthetic peptide
  Seed: QVLGGPVSGL (PMEL_HUMAN)
QLLGGPVSGM

SEQ ID NO: 129160 - protein, 10 aa, Artificial Sequence
  Description of Artificial Sequence: Synthetic peptide
  Seed: MPTAESTGMT (PMEL_HUMAN)
MITAESTGMA

SEQ ID NO: 129161 - protein, 10 aa, Artificial Sequence
  Description of Artificial Sequence: Synthetic peptide
  Seed: AVIGALLAVG (PMEL_HUMAN)
ALIGALLAVY

SEQ ID NO: 129162 - protein, 9 aa, Artificial Sequence
  Description of Artificial Sequence: Synthetic peptide
  Seed: AEADLSYTW (PMEL_HUMAN)
ALADLSYTF

SEQ ID NO: 129163 - protein, 8 aa, Artificial Sequence
  Description of Artificial Sequence: Synthetic peptide
  Seed: LHDPSGYL (PMEL_HUMAN)
LMDPSGYL

SEQ ID NO: 129164 - protein, 10 aa, Artificial Sequence
  Description of Artificial Sequence: Synthetic peptide
  Seed: MSTESITGSL (PMEL_HUMAN)
METESITGSV

SEQ ID NO: 129165 - protein, 9 aa, Artificial Sequence
  Description of Artificial Sequence: Synthetic peptide
  Seed: YLEPGPVTA (PMEL_HUMAN)
YGEPGPVTF

SEQ ID NO: 129166 - protein, 9 aa, Artificial Sequence
  Description of Artificial Sequence: Synthetic peptide
  Seed: VVLASLIYR (PMEL_HUMAN)
VALASLIYK

SEQ ID NO: 129167 - protein, 10 aa, Artificial Sequence
  Description of Artificial Sequence: Synthetic peptide
  Seed: MTPAEVSIVV (PMEL_HUMAN)
MCPAEVSIVT

SEQ ID NO: 129168 - protein, 9 aa, Artificial Sequence
  Description of Artificial Sequence: Synthetic peptide
  Seed: SSIMSTESI (PMEL_HUMAN)
SKIMSTESY

SEQ ID NO: 129169 - protein, 9 aa, Artificial Sequence
  Description of Artificial Sequence: Synthetic peptide
  Seed: LADTNSLAV (PMEL_HUMAN)
LTDTNSLAV

SEQ ID NO: 129170 - protein, 11 aa, Artificial Sequence
  Description of Artificial Sequence: Synthetic peptide
  Seed: RRRLMKQDFSV (PMEL_HUMAN)
RKRLMKQDFSV

SEQ ID NO: 129171 - protein, 9 aa, Artificial Sequence
  Description of Artificial Sequence: Synthetic peptide
  Seed: RALVVTHTY (PMEL_HUMAN)
RQLVVTHTK

SEQ ID NO: 129172 - protein, 9 aa, Artificial Sequence
  Description of Artificial Sequence: Synthetic peptide
  Seed: MTPAEVSIV (PMEL_HUMAN)
MRPAEVSIL

SEQ ID NO: 129173 - protein, 9 aa, Artificial Sequence
  Description of Artificial Sequence: Synthetic peptide
  Seed: TIINGSQVW (PMEL_HUMAN)
TMINGSQVF

SEQ ID NO: 129174 - protein, 9 aa, Artificial Sequence
  Description of Artificial Sequence: Synthetic peptide
  Seed: LTVSCQGGL (PMEL_HUMAN)
LLVSCQGGL

SEQ ID NO: 129175 - protein, 10 aa, Artificial Sequence
  Description of Artificial Sequence: Synthetic peptide
  Seed: NASFSIALNF (PMEL_HUMAN)
NPSFSIALNY

SEQ ID NO: 129176 - protein, 10 aa, Artificial Sequence
  Description of Artificial Sequence: Synthetic peptide
  Seed: SQVWGGQPVY (PMEL_HUMAN)
STVWGGQPVF

SEQ ID NO: 129177 - protein, 9 aa, Artificial Sequence
  Description of Artificial Sequence: Synthetic peptide
  Seed: ALDGGNKHF (PMEL_HUMAN)
AMDGGNKHW

SEQ ID NO: 129178 - protein, 9 aa, Artificial Sequence
  Description of Artificial Sequence: Synthetic peptide
  Seed: VSNDGPTLI (PMEL_HUMAN)
VWNDGPTLL

SEQ ID NO: 129179 - protein, 10 aa, Artificial Sequence
  Description of Artificial Sequence: Synthetic peptide
  Seed: LQLHDPSGYL (PMEL_HUMAN)
LKLHDPSGYV

SEQ ID NO: 129180 - protein, 9 aa, Artificial Sequence
  Description of Artificial Sequence: Synthetic peptide
  Seed: RAMLGTHTM (PMEL_HUMAN)
RFMLGTHTM

SEQ ID NO: 129181 - protein, 9 aa, Artificial Sequence
  Description of Artificial Sequence: Synthetic peptide
  Seed: VLMAVVLAS (PMEL_HUMAN)
VLMAVVLAT

SEQ ID NO: 129182 - protein, 9 aa, Artificial Sequence
  Description of Artificial Sequence: Synthetic peptide
  Seed: QPVLPSPAC (PMEL_HUMAN)
QPVLPSPAP

SEQ ID NO: 129183 - protein, 9 aa, Artificial Sequence
  Description of Artificial Sequence: Synthetic peptide
  Seed: AEMSTPEAT (PMEL_HUMAN)
AEMSTPEAG

SEQ ID NO: 129184 - protein, 9 aa, Artificial Sequence
  Description of Artificial Sequence: Synthetic peptide
  Seed: LHLAVIGAL (PMEL_HUMAN)
LNLAVIGAY

SEQ ID NO: 129185 - protein, 10 aa, Artificial Sequence
  Description of Artificial Sequence: Synthetic peptide
  Seed: YVWKTWGQYW (PMEL_HUMAN)
YYWKTWGQYF

SEQ ID NO: 129186 - protein, 9 aa, Artificial Sequence
  Description of Artificial Sequence: Synthetic peptide
  Seed: VLPSPACQL (PMEL_HUMAN)
VYPSPACQI

SEQ ID NO: 129187 - protein, 9 aa, Artificial Sequence
  Description of Artificial Sequence: Synthetic peptide
  Seed: YVWKTWGQY (PMEL_HUMAN)
YQWKTWGQY

SEQ ID NO: 129188 - protein, 10 aa, Artificial Sequence
  Description of Artificial Sequence: Synthetic peptide
  Seed: YVPLAHSSSA (PMEL_HUMAN)
YWPLAHSSSI

SEQ ID NO: 129189 - protein, 10 aa, Artificial Sequence
  Description of Artificial Sequence: Synthetic peptide
  Seed: LVLKRCLLHL (PMEL_HUMAN)
LRLKRCLLHV

SEQ ID NO: 129190 - protein, 10 aa, Artificial Sequence
  Description of Artificial Sequence: Synthetic peptide
  Seed: SSHWLRLPRI (PMEL_HUMAN)
STHWLRLPRW

SEQ ID NO: 129191 - protein, 10 aa, Artificial Sequence
  Description of Artificial Sequence: Synthetic peptide
  Seed: RGSRSYVPLA (PMEL_HUMAN)
RHSRSYVPLS

SEQ ID NO: 129192 - protein, 10 aa, Artificial Sequence
  Description of Artificial Sequence: Synthetic peptide
  Seed: RSYVPLAHSS (PMEL_HUMAN)
RYYVPLAHSK

SEQ ID NO: 129193 - protein, 9 aa, Artificial Sequence
  Description of Artificial Sequence: Synthetic peptide
  Seed: THTMEVTVY (PMEL_HUMAN)
TQTMEVTVL

SEQ ID NO: 129194 - protein, 11 aa, Artificial Sequence
  Description of Artificial Sequence: Synthetic peptide
  Seed: RLPRIFCSCPI (PMEL_HUMAN)
RMPRIFCSCPV

SEQ ID NO: 129195 - protein, 10 aa, Artificial Sequence
  Description of Artificial Sequence: Synthetic peptide
  Seed: RPTAEAPNTT (PMEL_HUMAN)
RPTAEAPNTF

SEQ ID NO: 129196 - protein, 10 aa, Artificial Sequence
  Description of Artificial Sequence: Synthetic peptide
  Seed: MAVVLASLIY (PMEL_HUMAN)
MMVVLASLIR

SEQ ID NO: 129197 - protein, 9 aa, Artificial Sequence
  Description of Artificial Sequence: Synthetic peptide
  Seed: AEADLSYTW (PMEL_HUMAN)
AVADLSYTV

SEQ ID NO: 129198 - protein, 10 aa, Artificial Sequence
  Description of Artificial Sequence: Synthetic peptide
  Seed: KVSNDGPTLI (PMEL_HUMAN)
KLSNDGPTLI

SEQ ID NO: 129199 - protein, 9 aa, Artificial Sequence
  Description of Artificial Sequence: Synthetic peptide
  Seed: RNQPLTFAL (PMEL_HUMAN)
RIQPLTFAM

SEQ ID NO: 129200 - protein, 11 aa, Artificial Sequence
  Description of Artificial Sequence: Synthetic peptide
  Seed: ITDQVPFSVSV (PMEL_HUMAN)
IADQVPFSVSI

SEQ ID NO: 129201 - protein, 11 aa, Artificial Sequence
  Description of Artificial Sequence: Synthetic peptide
  Seed: SAFTITDQVPF (PMEL_HUMAN)
SPFTITDQVPY

SEQ ID NO: 129202 - protein, 10 aa, Artificial Sequence
  Description of Artificial Sequence: Synthetic peptide
  Seed: LAVIGALLAV (PMEL_HUMAN)
LNVIGALLAI

SEQ ID NO: 129203 - protein, 11 aa, Artificial Sequence
  Description of Artificial Sequence: Synthetic peptide
  Seed: RALDGGNKHFL (PMEL_HUMAN)
RVLDGGNKHFR

SEQ ID NO: 129204 - protein, 11 aa, Artificial Sequence
  Description of Artificial Sequence: Synthetic peptide
  Seed: VPVSEVMGTTL (PMEL_HUMAN)
VPVSEVMGTTA

SEQ ID NO: 129205 - protein, 10 aa, Artificial Sequence
  Description of Artificial Sequence: Synthetic peptide
  Seed: RGSRSYVPLA (PMEL_HUMAN)
RLSRSYVPLM

SEQ ID NO: 129206 - protein, 9 aa, Artificial Sequence
  Description of Artificial Sequence: Synthetic peptide
  Seed: QVWGGQPVY (PMEL_HUMAN)
QHWGGQPVF

SEQ ID NO: 129207 - protein, 9 aa, Artificial Sequence
  Description of Artificial Sequence: Synthetic peptide
  Seed: VVLQAAIPL (PMEL_HUMAN)
VRLQAAIPY

SEQ ID NO: 129208 - protein, 9 aa, Artificial Sequence
  Description of Artificial Sequence: Synthetic peptide
  Seed: VTLDIVQGI (PMEL_HUMAN)
VQLDIVQGM

SEQ ID NO: 129209 - protein, 9 aa, Artificial Sequence
  Description of Artificial Sequence: Synthetic peptide
  Seed: VSVSQLRAL (PMEL_HUMAN)
VTVSQLRAW

SEQ ID NO: 129210 - protein, 9 aa, Artificial Sequence
  Description of Artificial Sequence: Synthetic peptide
  Seed: SPVPGTTDG (PMEL_HUMAN)
SPVPGTTDI

SEQ ID NO: 129211 - protein, 9 aa, Artificial Sequence
  Description of Artificial Sequence: Synthetic peptide
  Seed: VQMPTAEST (PMEL_HUMAN)
VTMPTAESV

SEQ ID NO: 129212 - protein, 9 aa, Artificial Sequence
  Description of Artificial Sequence: Synthetic peptide
  Seed: FLRNQPLTF (PMEL_HUMAN)
FVRNQPLTW

SEQ ID NO: 129213 - protein, 10 aa, Artificial Sequence
  Description of Artificial Sequence: Synthetic peptide
  Seed: KVLPDGQVIW (PMEL_HUMAN)
KALPDGQVIW

SEQ ID NO: 129214 - protein, 9 aa, Artificial Sequence
  Description of Artificial Sequence: Synthetic peptide
  Seed: DAFELTVSC (PMEL_HUMAN)
DPFELTVSM

SEQ ID NO: 129215 - protein, 10 aa, Artificial Sequence
  Description of Artificial Sequence: Synthetic peptide
  Seed: NSLAVVSTQL (PMEL_HUMAN)
NWLAVVSTQV

SEQ ID NO: 129216 - protein, 9 aa, Artificial Sequence
  Description of Artificial Sequence: Synthetic peptide
  Seed: TTPGQAPTA (PMEL_HUMAN)
TTPGQAPTI

SEQ ID NO: 129217 - protein, 11 aa, Artificial Sequence
  Description of Artificial Sequence: Synthetic peptide
  Seed: SYVPLAHSSSA (PMEL_HUMAN)
SKVPLAHSSSM

SEQ ID NO: 129218 - protein, 9 aa, Artificial Sequence
  Description of Artificial Sequence: Synthetic peptide
  Seed: TPAEVSIVV (PMEL_HUMAN)
TSAEVSIVY

SEQ ID NO: 129219 - protein, 9 aa, Artificial Sequence
  Description of Artificial Sequence: Synthetic peptide
  Seed: SSIMSTESI (PMEL_HUMAN)
SLIMSTESV

SEQ ID NO: 129220 - protein, 9 aa, Artificial Sequence
  Description of Artificial Sequence: Synthetic peptide
  Seed: TEWVETTAR (PMEL_HUMAN)
TEWVETTAC

SEQ ID NO: 129221 - protein, 11 aa, Artificial Sequence
  Description of Artificial Sequence: Synthetic peptide
  Seed: TLIGANASFSI (PMEL_HUMAN)
TQIGANASFSL

SEQ ID NO: 129222 - protein, 9 aa, Artificial Sequence
  Description of Artificial Sequence: Synthetic peptide
  Seed: YLEPGPVTA (PMEL_HUMAN)
YYEPGPVTI

SEQ ID NO: 129223 - protein, 10 aa, Artificial Sequence
  Description of Artificial Sequence: Synthetic peptide
  Seed: MTPAEVSIVV (PMEL_HUMAN)
MCPAEVSIVL

SEQ ID NO: 129224 - protein, 9 aa, Artificial Sequence
  Description of Artificial Sequence: Synthetic peptide
  Seed: QPVLPSPAC (PMEL_HUMAN)
QPVLPSPAI

SEQ ID NO: 129225 - protein, 9 aa, Artificial Sequence
  Description of Artificial Sequence: Synthetic peptide
  Seed: RTKAWNRQL (PMEL_HUMAN)
RFKAWNRQI

SEQ ID NO: 129226 - protein, 9 aa, Artificial Sequence
  Description of Artificial Sequence: Synthetic peptide
  Seed: RALVVTHTY (PMEL_HUMAN)
RFLVVTHTY

SEQ ID NO: 129227 - protein, 10 aa, Artificial Sequence
  Description of Artificial Sequence: Synthetic peptide
  Seed: LGQVPLIVGI (PMEL_HUMAN)
LLQVPLIVGV

SEQ ID NO: 129228 - protein, 9 aa, Artificial Sequence
  Description of Artificial Sequence: Synthetic peptide
  Seed: SSPGCQPPA (PMEL_HUMAN)
SIPGCQPPI

SEQ ID NO: 129229 - protein, 10 aa, Artificial Sequence
  Description of Artificial Sequence: Synthetic peptide
  Seed: YRYGSFSVTL (PMEL_HUMAN)
YFYGSFSVTW

SEQ ID NO: 129230 - protein, 8 aa, Artificial Sequence
  Description of Artificial Sequence: Synthetic peptide
  Seed: SNDGPTLI (PMEL_HUMAN)
SFDGPTLM

SEQ ID NO: 129231 - protein, 10 aa, Artificial Sequence
  Description of Artificial Sequence: Synthetic peptide
  Seed: LAHSSSAFTI (PMEL_HUMAN)
LWHSSSAFTL

SEQ ID NO: 129232 - protein, 11 aa, Artificial Sequence
  Description of Artificial Sequence: Synthetic peptide
  Seed: YVPLAHSSSAF (PMEL_HUMAN)
YQPLAHSSSAF

SEQ ID NO: 129233 - protein, 9 aa, Artificial Sequence
  Description of Artificial Sequence: Synthetic peptide
  Seed: TAEAPNTTA (PMEL_HUMAN)
TAEAPNTTV

SEQ ID NO: 129234 - protein, 9 aa, Artificial Sequence
  Description of Artificial Sequence: Synthetic peptide
  Seed: SSHWLRLPR (PMEL_HUMAN)
SQHWLRLPR

SEQ ID NO: 129235 - protein, 10 aa, Artificial Sequence
  Description of Artificial Sequence: Synthetic peptide
  Seed: RNQDWLGVSR (PMEL_HUMAN)
RQQDWLGVSR

SEQ ID NO: 129236 - protein, 9 aa, Artificial Sequence
  Description of Artificial Sequence: Synthetic peptide
  Seed: VSNDGPTLI (PMEL_HUMAN)
VANDGPTLW

SEQ ID NO: 129237 - protein, 9 aa, Artificial Sequence
  Description of Artificial Sequence: Synthetic peptide
  Seed: RLVKRQVPL (PMEL_HUMAN)
RPVKRQVPC

SEQ ID NO: 129238 - protein, 10 aa, Artificial Sequence
  Description of Artificial Sequence: Synthetic peptide
  Seed: GLSIGTGRAM (PMEL_HUMAN)
GQSIGTGRAY

SEQ ID NO: 129239 - protein, 9 aa, Artificial Sequence
  Description of Artificial Sequence: Synthetic peptide
  Seed: LQAAIPLTS (PMEL_HUMAN)
LSAAIPLTM

SEQ ID NO: 129240 - protein, 9 aa, Artificial Sequence
  Description of Artificial Sequence: Synthetic peptide
  Seed: TPAEVSIVV (PMEL_HUMAN)
TPAEVSIVH

SEQ ID NO: 129241 - protein, 10 aa, Artificial Sequence
  Description of Artificial Sequence: Synthetic peptide
  Seed: VPQLPHSSSH (PMEL_HUMAN)
VIQLPHSSSM

SEQ ID NO: 129242 - protein, 9 aa, Artificial Sequence
  Description of Artificial Sequence: Synthetic peptide
  Seed: ALDGGNKHF (PMEL_HUMAN)
AYDGGNKHL

SEQ ID NO: 129243 - protein, 10 aa, Artificial Sequence
  Description of Artificial Sequence: Synthetic peptide
  Seed: LAVIGALLAV (PMEL_HUMAN)
LMVIGALLAI

SEQ ID NO: 129244 - protein, 9 aa, Artificial Sequence
  Description of Artificial Sequence: Synthetic peptide
  Seed: YLAEADLSY (PMEL_HUMAN)
YMAEADLSA

SEQ ID NO: 129245 - protein, 9 aa, Artificial Sequence
  Description of Artificial Sequence: Synthetic peptide
  Seed: RLMKQDFSV (PMEL_HUMAN)
RMMKQDFSC

SEQ ID NO: 129246 - protein, 9 aa, Artificial Sequence
  Description of Artificial Sequence: Synthetic peptide
  Seed: KEACMEISS (PMEL_HUMAN)
KEACMEISV

SEQ ID NO: 129247 - protein, 9 aa, Artificial Sequence
  Description of Artificial Sequence: Synthetic peptide
  Seed: ALNFPGSQK (PMEL_HUMAN)
ASNFPGSQL

SEQ ID NO: 129248 - protein, 9 aa, Artificial Sequence
  Description of Artificial Sequence: Synthetic peptide
  Seed: FTITDQVPF (PMEL_HUMAN)
FQITDQVPF

SEQ ID NO: 129249 - protein, 10 aa, Artificial Sequence
  Description of Artificial Sequence: Synthetic peptide
  Seed: MKQDFSVPQL (PMEL_HUMAN)
MQQDFSVPQY

SEQ ID NO: 129250 - protein, 11 aa, Artificial Sequence
  Description of Artificial Sequence: Synthetic peptide
  Seed: TWDFGDSSGTL (PMEL_HUMAN)
TTDFGDSSGTL

SEQ ID NO: 129251 - protein, 9 aa, Artificial Sequence
  Description of Artificial Sequence: Synthetic peptide
  Seed: SLAVVSTQL (PMEL_HUMAN)
SQAVVSTQI

SEQ ID NO: 129252 - protein, 11 aa, Artificial Sequence
  Description of Artificial Sequence: Synthetic peptide
  Seed: ITDQVPFSVSV (PMEL_HUMAN)
IADQVPFSVSF

SEQ ID NO: 129253 - protein, 9 aa, Artificial Sequence
  Description of Artificial Sequence: Synthetic peptide
  Seed: LIVGILLVL (PMEL_HUMAN)
LTVGILLVW

SEQ ID NO: 129254 - protein, 11 aa, Artificial Sequence
  Description of Artificial Sequence: Synthetic peptide
  Seed: SYVPLAHSSSA (PMEL_HUMAN)
SNVPLAHSSSM

SEQ ID NO: 129255 - protein, 9 aa, Artificial Sequence
  Description of Artificial Sequence: Synthetic peptide
  Seed: YLEPGPVTA (PMEL_HUMAN)
YYEPGPVTL

SEQ ID NO: 129256 - protein, 9 aa, Artificial Sequence
  Description of Artificial Sequence: Synthetic peptide
  Seed: VPFSVSVSQ (PMEL_HUMAN)
VPFSVSVSM

SEQ ID NO: 129257 - protein, 9 aa, Artificial Sequence
  Description of Artificial Sequence: Synthetic peptide
  Seed: SQKRSFVYV (PMEL_HUMAN)
SSKRSFVYG

SEQ ID NO: 129258 - protein, 9 aa, Artificial Sequence
  Description of Artificial Sequence: Synthetic peptide
  Seed: TAPVQMPTA (PMEL_HUMAN)
TCPVQMPTL

SEQ ID NO: 129259 - protein, 9 aa, Artificial Sequence
  Description of Artificial Sequence: Synthetic peptide
  Seed: VLASLIYRR (PMEL_HUMAN)
VFASLIYRR

SEQ ID NO: 129260 - protein, 10 aa, Artificial Sequence
  Description of Artificial Sequence: Synthetic peptide
  Seed: MTPAEVSIVV (PMEL_HUMAN)
MEPAEVSIVA

SEQ ID NO: 129261 - protein, 9 aa, Artificial Sequence
  Description of Artificial Sequence: Synthetic peptide
  Seed: TLIGANASF (PMEL_HUMAN)
TRIGANASL

SEQ ID NO: 129262 - protein, 11 aa, Artificial Sequence
  Description of Artificial Sequence: Synthetic peptide
  Seed: AEPSGTTSVQV (PMEL_HUMAN)
AEPSGTTSVQL

SEQ ID NO: 129263 - protein, 9 aa, Artificial Sequence
  Description of Artificial Sequence: Synthetic peptide
  Seed: ASFSIALNF (PMEL_HUMAN)
AIFSIALNF

SEQ ID NO: 129264 - protein, 9 aa, Artificial Sequence
  Description of Artificial Sequence: Synthetic peptide
  Seed: FTITDQVPF (PMEL_HUMAN)
FPITDQVPG

SEQ ID NO: 129265 - protein, 9 aa, Artificial Sequence
  Description of Artificial Sequence: Synthetic peptide
  Seed: SVQVPTTEV (PMEL_HUMAN)
SSQVPTTEV

SEQ ID NO: 129266 - protein, 9 aa, Artificial Sequence
  Description of Artificial Sequence: Synthetic peptide
  Seed: MTPEKVPVS (PMEL_HUMAN)
MIPEKVPVI

SEQ ID NO: 129267 - protein, 10 aa, Artificial Sequence
  Description of Artificial Sequence: Synthetic peptide
  Seed: RSFVYVWKTW (PMEL_HUMAN)
RDFVYVWKTF

SEQ ID NO: 129268 - protein, 8 aa, Artificial Sequence
  Description of Artificial Sequence: Synthetic peptide
  Seed: FGDSSGTL (PMEL_HUMAN)
FVDSSGTV

SEQ ID NO: 129269 - protein, 9 aa, Artificial Sequence
  Description of Artificial Sequence: Synthetic peptide
  Seed: VLMAVVLAS (PMEL_HUMAN)
VLMAVVLAV

SEQ ID NO: 129270 - protein, 9 aa, Artificial Sequence
  Description of Artificial Sequence: Synthetic peptide
  Seed: WSQKRSFVY (PMEL_HUMAN)
WAQKRSFVI

SEQ ID NO: 129271 - protein, 9 aa, Artificial Sequence
  Description of Artificial Sequence: Synthetic peptide
  Seed: AEADLSYTW (PMEL_HUMAN)
AIADLSYTL

SEQ ID NO: 129272 - protein, 9 aa, Artificial Sequence
  Description of Artificial Sequence: Synthetic peptide
  Seed: RTKAWNRQL (PMEL_HUMAN)
RSKAWNRQW

SEQ ID NO: 129273 - protein, 9 aa, Artificial Sequence
  Description of Artificial Sequence: Synthetic peptide
  Seed: TLIGANASF (PMEL_HUMAN)
TVIGANASM

SEQ ID NO: 129274 - protein, 10 aa, Artificial Sequence
  Description of Artificial Sequence: Synthetic peptide
  Seed: RQLYPEWTEA (PMEL_HUMAN)
RDLYPEWTEF

SEQ ID NO: 129275 - protein, 10 aa, Artificial Sequence
  Description of Artificial Sequence: Synthetic peptide
  Seed: VLMAVVLASL (PMEL_HUMAN)
VKMAVVLASA

SEQ ID NO: 129276 - protein, 9 aa, Artificial Sequence
  Description of Artificial Sequence: Synthetic peptide
  Seed: ASFSIALNF (PMEL_HUMAN)
ARFSIALNI

SEQ ID NO: 129277 - protein, 11 aa, Artificial Sequence
  Description of Artificial Sequence: Synthetic peptide
  Seed: RRGSRSYVPLA (PMEL_HUMAN)
RCGSRSYVPLV

SEQ ID NO: 129278 - protein, 10 aa, Artificial Sequence
  Description of Artificial Sequence: Synthetic peptide
  Seed: TAAQVTTTEW (PMEL_HUMAN)
TMAQVTTTEW

SEQ ID NO: 129279 - protein, 10 aa, Artificial Sequence
  Description of Artificial Sequence: Synthetic peptide
  Seed: LVLMAVVLAS (PMEL_HUMAN)
LTLMAVVLAV

SEQ ID NO: 129280 - protein, 9 aa, Artificial Sequence
  Description of Artificial Sequence: Synthetic peptide
  Seed: RYGSFSVTL (PMEL_HUMAN)
RYGSFSVTM

SEQ ID NO: 129281 - protein, 9 aa, Artificial Sequence
  Description of Artificial Sequence: Synthetic peptide
  Seed: QPVLPSPAC (PMEL_HUMAN)
QHVLPSPAV

SEQ ID NO: 129282 - protein, 9 aa, Artificial Sequence
  Description of Artificial Sequence: Synthetic peptide
  Seed: VMGTTLAEM (PMEL_HUMAN)
VPGTTLAEY

SEQ ID NO: 129283 - protein, 9 aa, Artificial Sequence
  Description of Artificial Sequence: Synthetic peptide
  Seed: SLAVVSTQL (PMEL_HUMAN)
SMAVVSTQY

SEQ ID NO: 129284 - protein, 9 aa, Artificial Sequence
  Description of Artificial Sequence: Synthetic peptide
  Seed: SPLLSGQQV (PMEL_HUMAN)
SPLLSGQQF

SEQ ID NO: 129285 - protein, 9 aa, Artificial Sequence
  Description of Artificial Sequence: Synthetic peptide
  Seed: HTMEVTVYH (PMEL_HUMAN)
HSMEVTVYY

SEQ ID NO: 129286 - protein, 10 aa, Artificial Sequence
  Description of Artificial Sequence: Synthetic peptide
  Seed: YVPLAHSSSA (PMEL_HUMAN)
YEPLAHSSSI

SEQ ID NO: 129287 - protein, 9 aa, Artificial Sequence
  Description of Artificial Sequence: Synthetic peptide
  Seed: LADTNSLAV (PMEL_HUMAN)
LYDTNSLAV

SEQ ID NO: 129288 - protein, 10 aa, Artificial Sequence
  Description of Artificial Sequence: Synthetic peptide
  Seed: ESITGSLGPL (PMEL_HUMAN)
EVITGSLGPK

SEQ ID NO: 129289 - protein, 10 aa, Artificial Sequence
  Description of Artificial Sequence: Synthetic peptide
  Seed: THTMEVTVYH (PMEL_HUMAN)
TQTMEVTVYR

SEQ ID NO: 129290 - protein, 10 aa, Artificial Sequence
  Description of Artificial Sequence: Synthetic peptide
  Seed: GPLLDGTATL (PMEL_HUMAN)
GGLLDGTATI

SEQ ID NO: 129291 - protein, 9 aa, Artificial Sequence
  Description of Artificial Sequence: Synthetic peptide
  Seed: LSIGTGRAM (PMEL_HUMAN)
LSIGTGRAL

SEQ ID NO: 129292 - protein, 10 aa, Artificial Sequence
  Description of Artificial Sequence: Synthetic peptide
  Seed: ALDGGNKHFL (PMEL_HUMAN)
AADGGNKHFI

SEQ ID NO: 129293 - protein, 9 aa, Artificial Sequence
  Description of Artificial Sequence: Synthetic peptide
  Seed: AEADLSYTW (PMEL_HUMAN)
ADADLSYTI

SEQ ID NO: 129294 - protein, 9 aa, Artificial Sequence
  Description of Artificial Sequence: Synthetic peptide
  Seed: VVLQAAIPL (PMEL_HUMAN)
VLLQAAIPV

SEQ ID NO: 129295 - protein, 10 aa, Artificial Sequence
  Description of Artificial Sequence: Synthetic peptide
  Seed: LVLMAVVLAS (PMEL_HUMAN)
LSLMAVVLAL

SEQ ID NO: 129296 - protein, 10 aa, Artificial Sequence
  Description of Artificial Sequence: Synthetic peptide
  Seed: IALNFPGSQK (PMEL_HUMAN)
IALNFPGSQM

SEQ ID NO: 129297 - protein, 11 aa, Artificial Sequence
  Description of Artificial Sequence: Synthetic peptide
  Seed: LYRYGSFSVTL (PMEL_HUMAN)
LRRYGSFSVTL

SEQ ID NO: 129298 - protein, 8 aa, Artificial Sequence
  Description of Artificial Sequence: Synthetic peptide
  Seed: VIWVNNTI (PMEL_HUMAN)
VQWVNNTL

SEQ ID NO: 129299 - protein, 9 aa, Artificial Sequence
  Description of Artificial Sequence: Synthetic peptide
  Seed: HTMEVTVYH (PMEL_HUMAN)
HGMEVTVYF

SEQ ID NO: 129300 - protein, 9 aa, Artificial Sequence
  Description of Artificial Sequence: Synthetic peptide
  Seed: SQVWGGQPV (PMEL_HUMAN)
SHVWGGQPI

SEQ ID NO: 129301 - protein, 9 aa, Artificial Sequence
  Description of Artificial Sequence: Synthetic peptide
  Seed: LNFPGSQKV (PMEL_HUMAN)
LVFPGSQKL

SEQ ID NO: 129302 - protein, 9 aa, Artificial Sequence
  Description of Artificial Sequence: Synthetic peptide
  Seed: VTAQVVLQA (PMEL_HUMAN)
VAAQVVLQI

SEQ ID NO: 129303 - protein, 9 aa, Artificial Sequence
  Description of Artificial Sequence: Synthetic peptide
  Seed: GMTPEKVPV (PMEL_HUMAN)
GLTPEKVPV

SEQ ID NO: 129304 - protein, 9 aa, Artificial Sequence
  Description of Artificial Sequence: Synthetic peptide
  Seed: AQVVLQAAI (PMEL_HUMAN)
AQVVLQAAL

SEQ ID NO: 129305 - protein, 9 aa, Artificial Sequence
  Description of Artificial Sequence: Synthetic peptide
  Seed: AVIGALLAV (PMEL_HUMAN)
AQIGALLAC

SEQ ID NO: 129306 - protein, 10 aa, Artificial Sequence
  Description of Artificial Sequence: Synthetic peptide
  Seed: LIYRRRLMKQ (PMEL_HUMAN)
LLYRRRLMKY

SEQ ID NO: 129307 - protein, 9 aa, Artificial Sequence
  Description of Artificial Sequence: Synthetic peptide
  Seed: VMGTTLAEM (PMEL_HUMAN)
VVGTTLAEY

SEQ ID NO: 129308 - protein, 9 aa, Artificial Sequence
  Description of Artificial Sequence: Synthetic peptide
  Seed: VPLDCVLYR (PMEL_HUMAN)
VFLDCVLYR

SEQ ID NO: 129309 - protein, 9 aa, Artificial Sequence
  Description of Artificial Sequence: Synthetic peptide
  Seed: RAMLGTHTM (PMEL_HUMAN)
RQMLGTHTK

SEQ ID NO: 129310 - protein, 10 aa, Artificial Sequence
  Description of Artificial Sequence: Synthetic peptide
  Seed: MAVVLASLIY (PMEL_HUMAN)
MFVVLASLIY

SEQ ID NO: 129311 - protein, 9 aa, Artificial Sequence
  Description of Artificial Sequence: Synthetic peptide
  Seed: RALDGGNKH (PMEL_HUMAN)
RLLDGGNKF

SEQ ID NO: 129312 - protein, 11 aa, Artificial Sequence
  Description of Artificial Sequence: Synthetic peptide
  Seed: RALDGGNKHFL (PMEL_HUMAN)
RTLDGGNKHFL

SEQ ID NO: 129313 - protein, 10 aa, Artificial Sequence
  Description of Artificial Sequence: Synthetic peptide
  Seed: LHLAVIGALL (PMEL_HUMAN)
LSLAVIGALV

SEQ ID NO: 129314 - protein, 9 aa, Artificial Sequence
  Description of Artificial Sequence: Synthetic peptide
  Seed: QPVLPSPAC (PMEL_HUMAN)
QPVLPSPAL

SEQ ID NO: 129315 - protein, 9 aa, Artificial Sequence
  Description of Artificial Sequence: Synthetic peptide
  Seed: WQVLGGPVS (PMEL_HUMAN)
WTVLGGPVY

SEQ ID NO: 129316 - protein, 9 aa, Artificial Sequence
  Description of Artificial Sequence: Synthetic peptide
  Seed: CVLYRYGSF (PMEL_HUMAN)
CQLYRYGSY

SEQ ID NO: 129317 - protein, 9 aa, Artificial Sequence
  Description of Artificial Sequence: Synthetic peptide
  Seed: EKVPVSEVM (PMEL_HUMAN)
ERVPVSEVF

SEQ ID NO: 129318 - protein, 10 aa, Artificial Sequence
  Description of Artificial Sequence: Synthetic peptide
  Seed: ESITGSLGPL (PMEL_HUMAN)
ETITGSLGPL

SEQ ID NO: 129319 - protein, 10 aa, Artificial Sequence
  Description of Artificial Sequence: Synthetic peptide
  Seed: GDSSGTLISR (PMEL_HUMAN)
GASSGTLISM

SEQ ID NO: 129320 - protein, 10 aa, Artificial Sequence
  Description of Artificial Sequence: Synthetic peptide
  Seed: TAEPSGTTSV (PMEL_HUMAN)
TIEPSGTTSL

SEQ ID NO: 129321 - protein, 9 aa, Artificial Sequence
  Description of Artificial Sequence: Synthetic peptide
  Seed: LPDGQVIWV (PMEL_HUMAN)
LTDGQVIWF

SEQ ID NO: 129322 - protein, 9 aa, Artificial Sequence
  Description of Artificial Sequence: Synthetic peptide
  Seed: VLGGPVSGL (PMEL_HUMAN)
VSGGPVSGY

SEQ ID NO: 129323 - protein, 9 aa, Artificial Sequence
  Description of Artificial Sequence: Synthetic peptide
  Seed: ISRALVVTH (PMEL_HUMAN)
ITRALVVTK

SEQ ID NO: 129324 - protein, 9 aa, Artificial Sequence
  Description of Artificial Sequence: Synthetic peptide
  Seed: RAMLGTHTM (PMEL_HUMAN)
RVMLGTHTV

SEQ ID NO: 129325 - protein, 9 aa, Artificial Sequence
  Description of Artificial Sequence: Synthetic peptide
  Seed: ITGSLGPLL (PMEL_HUMAN)
ITGSLGPLW

SEQ ID NO: 129326 - protein, 10 aa, Artificial Sequence
  Description of Artificial Sequence: Synthetic peptide
  Seed: EVMGTTLAEM (PMEL_HUMAN)
EGMGTTLAER

SEQ ID NO: 129327 - protein, 10 aa, Artificial Sequence
  Description of Artificial Sequence: Synthetic peptide
  Seed: KTWGQYWQVL (PMEL_HUMAN)
KMWGQYWQVM

SEQ ID NO: 129328 - protein, 9 aa, Artificial Sequence
  Description of Artificial Sequence: Synthetic peptide
  Seed: TLIGANASF (PMEL_HUMAN)
TMIGANASI

SEQ ID NO: 129329 - protein, 9 aa, Artificial Sequence
  Description of Artificial Sequence: Synthetic peptide
  Seed: AEADLSYTW (PMEL_HUMAN)
ASADLSYTF

SEQ ID NO: 129330 - protein, 10 aa, Artificial Sequence
  Description of Artificial Sequence: Synthetic peptide
  Seed: SQVWGGQPVY (PMEL_HUMAN)
SAVWGGQPVY

SEQ ID NO: 129331 - protein, 11 aa, Artificial Sequence
  Description of Artificial Sequence: Synthetic peptide
  Seed: YLAEADLSYTW (PMEL_HUMAN)
YAAEADLSYTW

SEQ ID NO: 129332 - protein, 9 aa, Artificial Sequence
  Description of Artificial Sequence: Synthetic peptide
  Seed: HLAVIGALL (PMEL_HUMAN)
HLAVIGALI

SEQ ID NO: 129333 - protein, 9 aa, Artificial Sequence
  Description of Artificial Sequence: Synthetic peptide
  Seed: RALDGGNKH (PMEL_HUMAN)
RFLDGGNKY

SEQ ID NO: 129334 - protein, 9 aa, Artificial Sequence
  Description of Artificial Sequence: Synthetic peptide
  Seed: LLAVGATKV (PMEL_HUMAN)
LQAVGATKW

SEQ ID NO: 129335 - protein, 11 aa, Artificial Sequence
  Description of Artificial Sequence: Synthetic peptide
  Seed: RQVPLDCVLYR (PMEL_HUMAN)
RYVPLDCVLYK

SEQ ID NO: 129336 - protein, 10 aa, Artificial Sequence
  Description of Artificial Sequence: Synthetic peptide
  Seed: SVPQLPHSSS (PMEL_HUMAN)
SRPQLPHSSI

SEQ ID NO: 129337 - protein, 9 aa, Artificial Sequence
  Description of Artificial Sequence: Synthetic peptide
  Seed: FLRNQPLTF (PMEL_HUMAN)
FLRNQPLTM

SEQ ID NO: 129338 - protein, 9 aa, Artificial Sequence
  Description of Artificial Sequence: Synthetic peptide
  Seed: AEILQAVPS (PMEL_HUMAN)
AEILQAVPV

SEQ ID NO: 129339 - protein, 9 aa, Artificial Sequence
  Description of Artificial Sequence: Synthetic peptide
  Seed: VLGGPVSGL (PMEL_HUMAN)
VVGGPVSGL

SEQ ID NO: 129340 - protein, 9 aa, Artificial Sequence
  Description of Artificial Sequence: Synthetic peptide
  Seed: VWKTWGQYW (PMEL_HUMAN)
VYKTWGQYI

SEQ ID NO: 129341 - protein, 9 aa, Artificial Sequence
  Description of Artificial Sequence: Synthetic peptide
  Seed: GGPVSGLSI (PMEL_HUMAN)
GTPVSGLSL

SEQ ID NO: 129342 - protein, 9 aa, Artificial Sequence
  Description of Artificial Sequence: Synthetic peptide
  Seed: AAQVTTTEW (PMEL_HUMAN)
ATQVTTTEL

SEQ ID NO: 129343 - protein, 9 aa, Artificial Sequence
  Description of Artificial Sequence: Synthetic peptide
  Seed: VQVPTTEVI (PMEL_HUMAN)
VFVPTTEVF

SEQ ID NO: 129344 - protein, 9 aa, Artificial Sequence
  Description of Artificial Sequence: Synthetic peptide
  Seed: VQVPTTEVI (PMEL_HUMAN)
VAVPTTEVY

SEQ ID NO: 129345 - protein, 9 aa, Artificial Sequence
  Description of Artificial Sequence: Synthetic peptide
  Seed: VSLADTNSL (PMEL_HUMAN)
VILADTNSF

SEQ ID NO: 129346 - protein, 10 aa, Artificial Sequence
  Description of Artificial Sequence: Synthetic peptide
  Seed: AVPSGEGDAF (PMEL_HUMAN)
AMPSGEGDAL

SEQ ID NO: 129347 - protein, 9 aa, Artificial Sequence
  Description of Artificial Sequence: Synthetic peptide
  Seed: VSNDGPTLI (PMEL_HUMAN)
VRNDGPTLI

SEQ ID NO: 129348 - protein, 10 aa, Artificial Sequence
  Description of Artificial Sequence: Synthetic peptide
  Seed: KTWGQYWQVL (PMEL_HUMAN)
KQWGQYWQVI

SEQ ID NO: 129349 - protein, 9 aa, Artificial Sequence
  Description of Artificial Sequence: Synthetic peptide
  Seed: KVLPDGQVI (PMEL_HUMAN)
KQLPDGQVL

SEQ ID NO: 129350 - protein, 8 aa, Artificial Sequence
  Description of Artificial Sequence: Synthetic peptide
  Seed: LLDGTATL (PMEL_HUMAN)
LYDGTATI

SEQ ID NO: 129351 - protein, 9 aa, Artificial Sequence
  Description of Artificial Sequence: Synthetic peptide
  Seed: STAPVQMPT (PMEL_HUMAN)
SVAPVQMPI

SEQ ID NO: 129352 - protein, 10 aa, Artificial Sequence
  Description of Artificial Sequence: Synthetic peptide
  Seed: ASSIMSTESI (PMEL_HUMAN)
AKSIMSTESF

SEQ ID NO: 129353 - protein, 9 aa, Artificial Sequence
  Description of Artificial Sequence: Synthetic peptide
  Seed: ALLAVGATK (PMEL_HUMAN)
AYLAVGATR

SEQ ID NO: 129354 - protein, 9 aa, Artificial Sequence
  Description of Artificial Sequence: Synthetic peptide
  Seed: MSTPEATGM (PMEL_HUMAN)
MMTPEATGF

SEQ ID NO: 129355 - protein, 9 aa, Artificial Sequence
  Description of Artificial Sequence: Synthetic peptide
  Seed: AEPSGTTSV (PMEL_HUMAN)
ARPSGTTSI

SEQ ID NO: 129356 - protein, 10 aa, Artificial Sequence
  Description of Artificial Sequence: Synthetic peptide
  Seed: VPLDCVLYRY (PMEL_HUMAN)
VQLDCVLYRY

SEQ ID NO: 129357 - protein, 9 aa, Artificial Sequence
  Description of Artificial Sequence: Synthetic peptide
  Seed: TWGQYWQVL (PMEL_HUMAN)
TFGQYWQVY

SEQ ID NO: 129358 - protein, 11 aa, Artificial Sequence
  Description of Artificial Sequence: Synthetic peptide
  Seed: QAVPSGEGDAF (PMEL_HUMAN)
QPVPSGEGDAY

SEQ ID NO: 129359 - protein, 11 aa, Artificial Sequence
  Description of Artificial Sequence: Synthetic peptide
  Seed: VQMPTAESTGM (PMEL_HUMAN)
VAMPTAESTGM

SEQ ID NO: 129360 - protein, 9 aa, Artificial Sequence
  Description of Artificial Sequence: Synthetic peptide
  Seed: AAQVTTTEW (PMEL_HUMAN)
ALQVTTTEF

SEQ ID NO: 129361 - protein, 9 aa, Artificial Sequence
  Description of Artificial Sequence: Synthetic peptide
  Seed: ESAEILQAV (PMEL_HUMAN)
EMAEILQAR

SEQ ID NO: 129362 - protein, 10 aa, Artificial Sequence
  Description of Artificial Sequence: Synthetic peptide
  Seed: NASFSIALNF (PMEL_HUMAN)
NESFSIALNW

SEQ ID NO: 129363 - protein, 9 aa, Artificial Sequence
  Description of Artificial Sequence: Synthetic peptide
  Seed: VVLSGTTAA (PMEL_HUMAN)
VSLSGTTAI

SEQ ID NO: 129364 - protein, 9 aa, Artificial Sequence
  Description of Artificial Sequence: Synthetic peptide
  Seed: SLGPLLDGT (PMEL_HUMAN)
SLGPLLDGV

SEQ ID NO: 129365 - protein, 11 aa, Artificial Sequence
  Description of Artificial Sequence: Synthetic peptide
  Seed: NQDWLGVSRQL (PMEL_HUMAN)
NHDWLGVSRQF

SEQ ID NO: 129366 - protein, 9 aa, Artificial Sequence
  Description of Artificial Sequence: Synthetic peptide
  Seed: FTITDQVPF (PMEL_HUMAN)
FYITDQVPM

SEQ ID NO: 129367 - protein, 10 aa, Artificial Sequence
  Description of Artificial Sequence: Synthetic peptide
  Seed: RGSRSYVPLA (PMEL_HUMAN)
RDSRSYVPLI

SEQ ID NO: 129368 - protein, 9 aa, Artificial Sequence
  Description of Artificial Sequence: Synthetic peptide
  Seed: EVMGTTLAE (PMEL_HUMAN)
EVMGTTLAL

SEQ ID NO: 129369 - protein, 9 aa, Artificial Sequence
  Description of Artificial Sequence: Synthetic peptide
  Seed: KAWNRQLYP (PMEL_HUMAN)
KTWNRQLYG

SEQ ID NO: 129370 - protein, 9 aa, Artificial Sequence
  Description of Artificial Sequence: Synthetic peptide
  Seed: AVVSTQLIM (PMEL_HUMAN)
AIVSTQLIF

SEQ ID NO: 129371 - protein, 9 aa, Artificial Sequence
  Description of Artificial Sequence: Synthetic peptide
  Seed: ESTGMTPEK (PMEL_HUMAN)
EITGMTPER

SEQ ID NO: 129372 - protein, 11 aa, Artificial Sequence
  Description of Artificial Sequence: Synthetic peptide
  Seed: VSLADTNSLAV (PMEL_HUMAN)
VFLADTNSLAV

SEQ ID NO: 129373 - protein, 10 aa, Artificial Sequence
  Description of Artificial Sequence: Synthetic peptide
  Seed: VPQLPHSSSH (PMEL_HUMAN)
VTQLPHSSSF

SEQ ID NO: 129374 - protein, 8 aa, Artificial Sequence
  Description of Artificial Sequence: Synthetic peptide
  Seed: YGSFSVTL (PMEL_HUMAN)
YASFSVTI

SEQ ID NO: 129375 - protein, 11 aa, Artificial Sequence
  Description of Artificial Sequence: Synthetic peptide
  Seed: YLAEADLSYTW (PMEL_HUMAN)
YSAEADLSYTW

SEQ ID NO: 129376 - protein, 9 aa, Artificial Sequence
  Description of Artificial Sequence: Synthetic peptide
  Seed: VSNDGPTLI (PMEL_HUMAN)
VTNDGPTLW

SEQ ID NO: 129377 - protein, 10 aa, Artificial Sequence
  Description of Artificial Sequence: Synthetic peptide
  Seed: RTKAWNRQLY (PMEL_HUMAN)
RTKAWNRQLK

SEQ ID NO: 129378 - protein, 11 aa, Artificial Sequence
  Description of Artificial Sequence: Synthetic peptide
  Seed: FSVTLDIVQGI (PMEL_HUMAN)
FLVTLDIVQGA

SEQ ID NO: 129379 - protein, 9 aa, Artificial Sequence
  Description of Artificial Sequence: Synthetic peptide
  Seed: KAWNRQLYP (PMEL_HUMAN)
KTWNRQLYA

SEQ ID NO: 129380 - protein, 9 aa, Artificial Sequence
  Description of Artificial Sequence: Synthetic peptide
  Seed: LTSCGSSPV (PMEL_HUMAN)
LMSCGSSPM

SEQ ID NO: 129381 - protein, 9 aa, Artificial Sequence
  Description of Artificial Sequence: Synthetic peptide
  Seed: VPLIVGILL (PMEL_HUMAN)
VPLIVGILM

SEQ ID NO: 129382 - protein, 9 aa, Artificial Sequence
  Description of Artificial Sequence: Synthetic peptide
  Seed: RYGSFSVTL (PMEL_HUMAN)
RRGSFSVTL

SEQ ID NO: 129383 - protein, 10 aa, Artificial Sequence
  Description of Artificial Sequence: Synthetic peptide
  Seed: LMAVVLASLI (PMEL_HUMAN)
LMAVVLASLR

SEQ ID NO: 129384 - protein, 10 aa, Artificial Sequence
  Description of Artificial Sequence: Synthetic peptide
  Seed: GPLLDGTATL (PMEL_HUMAN)
GELLDGTATL

SEQ ID NO: 129385 - protein, 10 aa, Artificial Sequence
  Description of Artificial Sequence: Synthetic peptide
  Seed: RRLMKQDFSV (PMEL_HUMAN)
RELMKQDFSV

SEQ ID NO: 129386 - protein, 10 aa, Artificial Sequence
  Description of Artificial Sequence: Synthetic peptide
  Seed: SVPQLPHSSS (PMEL_HUMAN)
SIPQLPHSSV

SEQ ID NO: 129387 - protein, 9 aa, Artificial Sequence
  Description of Artificial Sequence: Synthetic peptide
  Seed: VQVPTTEVI (PMEL_HUMAN)
VNVPTTEVY

SEQ ID NO: 129388 - protein, 9 aa, Artificial Sequence
  Description of Artificial Sequence: Synthetic peptide
  Seed: MAVVLASLI (PMEL_HUMAN)
MTVVLASLA

SEQ ID NO: 129389 - protein, 10 aa, Artificial Sequence
  Description of Artificial Sequence: Synthetic peptide
  Seed: YRYGSFSVTL (PMEL_HUMAN)
YEYGSFSVTI

SEQ ID NO: 129390 - protein, 9 aa, Artificial Sequence
  Description of Artificial Sequence: Synthetic peptide
  Seed: DIVQGIESA (PMEL_HUMAN)
DVVQGIESL

SEQ ID NO: 129391 - protein, 9 aa, Artificial Sequence
  Description of Artificial Sequence: Synthetic peptide
  Seed: VTLDIVQGI (PMEL_HUMAN)
VMLDIVQGT

SEQ ID NO: 129392 - protein, 9 aa, Artificial Sequence
  Description of Artificial Sequence: Synthetic peptide
  Seed: KTWGQYWQV (PMEL_HUMAN)
KTWGQYWQL

SEQ ID NO: 129393 - protein, 10 aa, Artificial Sequence
  Description of Artificial Sequence: Synthetic peptide
  Seed: THTMEVTVYH (PMEL_HUMAN)
TNTMEVTVYR

SEQ ID NO: 129394 - protein, 9 aa, Artificial Sequence
  Description of Artificial Sequence: Synthetic peptide
  Seed: YVWKTWGQY (PMEL_HUMAN)
YTWKTWGQL

SEQ ID NO: 129395 - protein, 10 aa, Artificial Sequence
  Description of Artificial Sequence: Synthetic peptide
  Seed: VPLAHSSSAF (PMEL_HUMAN)
VQLAHSSSAF

SEQ ID NO: 129396 - protein, 9 aa, Artificial Sequence
  Description of Artificial Sequence: Synthetic peptide
  Seed: SLADTNSLA (PMEL_HUMAN)
STADTNSLI

SEQ ID NO: 129397 - protein, 9 aa, Artificial Sequence
  Description of Artificial Sequence: Synthetic peptide
  Seed: VVLQAAIPL (PMEL_HUMAN)
VALQAAIPI

SEQ ID NO: 129398 - protein, 10 aa, Artificial Sequence
  Description of Artificial Sequence: Synthetic peptide
  Seed: VSLADTNSLA (PMEL_HUMAN)
VGLADTNSLI

SEQ ID NO: 129399 - protein, 9 aa, Artificial Sequence
  Description of Artificial Sequence: Synthetic peptide
  Seed: STAPVQMPT (PMEL_HUMAN)
SSAPVQMPV

SEQ ID NO: 129400 - protein, 9 aa, Artificial Sequence
  Description of Artificial Sequence: Synthetic peptide
  Seed: VSLADTNSL (PMEL_HUMAN)
VALADTNSM

SEQ ID NO: 129401 - protein, 9 aa, Artificial Sequence
  Description of Artificial Sequence: Synthetic peptide
  Seed: AQRLCQPVL (PMEL_HUMAN)
AARLCQPVK

SEQ ID NO: 129402 - protein, 10 aa, Artificial Sequence
  Description of Artificial Sequence: Synthetic peptide
  Seed: VVLASLIYRR (PMEL_HUMAN)
VSLASLIYRR

SEQ ID NO: 129403 - protein, 8 aa, Artificial Sequence
  Description of Artificial Sequence: Synthetic peptide
  Seed: TLDIVQGI (PMEL_HUMAN)
TADIVQGM

SEQ ID NO: 129404 - protein, 9 aa, Artificial Sequence
  Description of Artificial Sequence: Synthetic peptide
  Seed: YLEPGPVTA (PMEL_HUMAN)
YWEPGPVTL

SEQ ID NO: 129405 - protein, 10 aa, Artificial Sequence
  Description of Artificial Sequence: Synthetic peptide
  Seed: DWLGVSRQLR (PMEL_HUMAN)
DMLGVSRQLR

SEQ ID NO: 129406 - protein, 10 aa, Artificial Sequence
  Description of Artificial Sequence: Synthetic peptide
  Seed: SQKRSFVYVW (PMEL_HUMAN)
SSKRSFVYVY

SEQ ID NO: 129407 - protein, 9 aa, Artificial Sequence
  Description of Artificial Sequence: Synthetic peptide
  Seed: LIYRRRLMK (PMEL_HUMAN)
LTYRRRLMR

SEQ ID NO: 129408 - protein, 9 aa, Artificial Sequence
  Description of Artificial Sequence: Synthetic peptide
  Seed: RALVVTHTY (PMEL_HUMAN)
RVLVVTHTK

SEQ ID NO: 129409 - protein, 9 aa, Artificial Sequence
  Description of Artificial Sequence: Synthetic peptide
  Seed: KTWGQYWQV (PMEL_HUMAN)
KTWGQYWQY

SEQ ID NO: 129410 - protein, 10 aa, Artificial Sequence
  Description of Artificial Sequence: Synthetic peptide
  Seed: VLMAVVLASL (PMEL_HUMAN)
VGMAVVLASY

SEQ ID NO: 129411 - protein, 9 aa, Artificial Sequence
  Description of Artificial Sequence: Synthetic peptide
  Seed: KQDFSVPQL (PMEL_HUMAN)
KGDFSVPQM

SEQ ID NO: 129412 - protein, 10 aa, Artificial Sequence
  Description of Artificial Sequence: Synthetic peptide
  Seed: RRLMKQDFSV (PMEL_HUMAN)
RSLMKQDFSL

SEQ ID NO: 129413 - protein, 9 aa, Artificial Sequence
  Description of Artificial Sequence: Synthetic peptide
  Seed: SQKRSFVYV (PMEL_HUMAN)
SFKRSFVYK

SEQ ID NO: 129414 - protein, 10 aa, Artificial Sequence
  Description of Artificial Sequence: Synthetic peptide
  Seed: RGSRSYVPLA (PMEL_HUMAN)
RSSRSYVPLV

SEQ ID NO: 129415 - protein, 10 aa, Artificial Sequence
  Description of Artificial Sequence: Synthetic peptide
  Seed: MTPAEVSIVV (PMEL_HUMAN)
MWPAEVSIVH

SEQ ID NO: 129416 - protein, 9 aa, Artificial Sequence
  Description of Artificial Sequence: Synthetic peptide
  Seed: LADTNSLAV (PMEL_HUMAN)
LQDTNSLAW

SEQ ID NO: 129417 - protein, 11 aa, Artificial Sequence
  Description of Artificial Sequence: Synthetic peptide
  Seed: LGPLLDGTATL (PMEL_HUMAN)
LTPLLDGTATL

SEQ ID NO: 129418 - protein, 10 aa, Artificial Sequence
  Description of Artificial Sequence: Synthetic peptide
  Seed: VPLDCVLYRY (PMEL_HUMAN)
VVLDCVLYRY

SEQ ID NO: 129419 - protein, 9 aa, Artificial Sequence
  Description of Artificial Sequence: Synthetic peptide
  Seed: EAQRLDCWR (PMEL_HUMAN)
EFQRLDCWR

SEQ ID NO: 129420 - protein, 11 aa, Artificial Sequence
  Description of Artificial Sequence: Synthetic peptide
  Seed: LYRYGSFSVTL (PMEL_HUMAN)
LHRYGSFSVTF

SEQ ID NO: 129421 - protein, 9 aa, Artificial Sequence
  Description of Artificial Sequence: Synthetic peptide
  Seed: SLAVVSTQL (PMEL_HUMAN)
SAAVVSTQF

SEQ ID NO: 129422 - protein, 11 aa, Artificial Sequence
  Description of Artificial Sequence: Synthetic peptide
  Seed: YVPLAHSSSAF (PMEL_HUMAN)
YYPLAHSSSAY

SEQ ID NO: 129423 - protein, 10 aa, Artificial Sequence
  Description of Artificial Sequence: Synthetic peptide
  Seed: GSRSYVPLAH (PMEL_HUMAN)
GSRSYVPLAK

SEQ ID NO: 129424 - protein, 9 aa, Artificial Sequence
  Description of Artificial Sequence: Synthetic peptide
  Seed: KHFLRNQPL (PMEL_HUMAN)
KMFLRNQPL

SEQ ID NO: 129425 - protein, 9 aa, Artificial Sequence
  Description of Artificial Sequence: Synthetic peptide
  Seed: LSIGTGRAM (PMEL_HUMAN)
LHIGTGRAM

SEQ ID NO: 129426 - protein, 9 aa, Artificial Sequence
  Description of Artificial Sequence: Synthetic peptide
  Seed: TWGQYWQVL (PMEL_HUMAN)
TYGQYWQVF

SEQ ID NO: 129427 - protein, 9 aa, Artificial Sequence
  Description of Artificial Sequence: Synthetic peptide
  Seed: YHRRGSRSY (PMEL_HUMAN)
YFRRGSRSV

SEQ ID NO: 129428 - protein, 9 aa, Artificial Sequence
  Description of Artificial Sequence: Synthetic peptide
  Seed: MLGTHTMEV (PMEL_HUMAN)
MMGTHTMEF

SEQ ID NO: 129429 - protein, 9 aa, Artificial Sequence
  Description of Artificial Sequence: Synthetic peptide
  Seed: VPSGEGDAF (PMEL_HUMAN)
VMSGEGDAY

SEQ ID NO: 129430 - protein, 9 aa, Artificial Sequence
  Description of Artificial Sequence: Synthetic peptide
  Seed: TVYHRRGSR (PMEL_HUMAN)
TIYHRRGSR

SEQ ID NO: 129431 - protein, 9 aa, Artificial Sequence
  Description of Artificial Sequence: Synthetic peptide
  Seed: LRNQPLTFA (PMEL_HUMAN)
LRNQPLTFM

SEQ ID NO: 129432 - protein, 10 aa, Artificial Sequence
  Description of Artificial Sequence: Synthetic peptide
  Seed: SVTLDIVQGI (PMEL_HUMAN)
SDTLDIVQGV

SEQ ID NO: 129433 - protein, 9 aa, Artificial Sequence
  Description of Artificial Sequence: Synthetic peptide
  Seed: RQVPLDCVL (PMEL_HUMAN)
RQVPLDCVH

SEQ ID NO: 129434 - protein, 10 aa, Artificial Sequence
  Description of Artificial Sequence: Synthetic peptide
  Seed: SVPQLPHSSS (PMEL_HUMAN)
SQPQLPHSSL

SEQ ID NO: 129435 - protein, 9 aa, Artificial Sequence
  Description of Artificial Sequence: Synthetic peptide
  Seed: VTLDIVQGI (PMEL_HUMAN)
VSLDIVQGR

SEQ ID NO: 129436 - protein, 10 aa, Artificial Sequence
  Description of Artificial Sequence: Synthetic peptide
  Seed: RSYVPLAHSS (PMEL_HUMAN)
RTYVPLAHSK

SEQ ID NO: 129437 - protein, 10 aa, Artificial Sequence
  Description of Artificial Sequence: Synthetic peptide
  Seed: LHLAVIGALL (PMEL_HUMAN)
LKLAVIGALV

SEQ ID NO: 129438 - protein, 10 aa, Artificial Sequence
  Description of Artificial Sequence: Synthetic peptide
  Seed: LPHSSSHWLR (PMEL_HUMAN)
LYHSSSHWLR

SEQ ID NO: 129439 - protein, 10 aa, Artificial Sequence
  Description of Artificial Sequence: Synthetic peptide
  Seed: LNFPGSQKVL (PMEL_HUMAN)
LAFPGSQKVF

SEQ ID NO: 129440 - protein, 9 aa, Artificial Sequence
  Description of Artificial Sequence: Synthetic peptide
  Seed: ITDQVPFSV (PMEL_HUMAN)
IADQVPFSL

SEQ ID NO: 129441 - protein, 9 aa, Artificial Sequence
  Description of Artificial Sequence: Synthetic peptide
  Seed: LSIGTGRAM (PMEL_HUMAN)
LIIGTGRAW

SEQ ID NO: 129442 - protein, 9 aa, Artificial Sequence
  Description of Artificial Sequence: Synthetic peptide
  Seed: FGDSSGTLI (PMEL_HUMAN)
FWDSSGTLC

SEQ ID NO: 129443 - protein, 10 aa, Artificial Sequence
  Description of Artificial Sequence: Synthetic peptide
  Seed: YRYGSFSVTL (PMEL_HUMAN)
YSYGSFSVTF

SEQ ID NO: 129444 - protein, 10 aa, Artificial Sequence
  Description of Artificial Sequence: Synthetic peptide
  Seed: DGTATLRLVK (PMEL_HUMAN)
DETATLRLVR

SEQ ID NO: 129445 - protein, 9 aa, Artificial Sequence
  Description of Artificial Sequence: Synthetic peptide
  Seed: LQLHDPSGY (PMEL_HUMAN)
LQLHDPSGM

SEQ ID NO: 129446 - protein, 9 aa, Artificial Sequence
  Description of Artificial Sequence: Synthetic peptide
  Seed: THTMEVTVY (PMEL_HUMAN)
TMTMEVTVM

SEQ ID NO: 129447 - protein, 9 aa, Artificial Sequence
  Description of Artificial Sequence: Synthetic peptide
  Seed: VQVPTTEVI (PMEL_HUMAN)
VMVPTTEVY

SEQ ID NO: 129448 - protein, 9 aa, Artificial Sequence
  Description of Artificial Sequence: Synthetic peptide
  Seed: GTYCLNVSL (PMEL_HUMAN)
GIYCLNVSY

SEQ ID NO: 129449 - protein, 11 aa, Artificial Sequence
  Description of Artificial Sequence: Synthetic peptide
  Seed: AVIGALLAVGA (PMEL_HUMAN)
AQIGALLAVGV

SEQ ID NO: 129450 - protein, 10 aa, Artificial Sequence
  Description of Artificial Sequence: Synthetic peptide
  Seed: KVLPDGQVIW (PMEL_HUMAN)
KQLPDGQVIL

SEQ ID NO: 129451 - protein, 9 aa, Artificial Sequence
  Description of Artificial Sequence: Synthetic peptide
  Seed: LPKEACMEI (PMEL_HUMAN)
LPKEACMEA

SEQ ID NO: 129452 - protein, 9 aa, Artificial Sequence
  Description of Artificial Sequence: Synthetic peptide
  Seed: LNFPGSQKV (PMEL_HUMAN)
LVFPGSQKI

SEQ ID NO: 129453 - protein, 9 aa, Artificial Sequence
  Description of Artificial Sequence: Synthetic peptide
  Seed: QDFSVPQLP (PMEL_HUMAN)
QEFSVPQLF

SEQ ID NO: 129454 - protein, 9 aa, Artificial Sequence
  Description of Artificial Sequence: Synthetic peptide
  Seed: QVWGGQPVY (PMEL_HUMAN)
QQWGGQPVF

SEQ ID NO: 129455 - protein, 11 aa, Artificial Sequence
  Description of Artificial Sequence: Synthetic peptide
  Seed: ASLIYRRRLMK (PMEL_HUMAN)
AFLIYRRRLMR

SEQ ID NO: 129456 - protein, 11 aa, Artificial Sequence
  Description of Artificial Sequence: Synthetic peptide
  Seed: TWDFGDSSGTL (PMEL_HUMAN)
TADFGDSSGTI

SEQ ID NO: 129457 - protein, 9 aa, Artificial Sequence
  Description of Artificial Sequence: Synthetic peptide
  Seed: AGQVPTTEV (PMEL_HUMAN)
AIQVPTTEM

SEQ ID NO: 129458 - protein, 11 aa, Artificial Sequence
  Description of Artificial Sequence: Synthetic peptide
  Seed: VPSGEGDAFEL (PMEL_HUMAN)
VPSGEGDAFEM

SEQ ID NO: 129459 - protein, 9 aa, Artificial Sequence
  Description of Artificial Sequence: Synthetic peptide
  Seed: VSNDGPTLI (PMEL_HUMAN)
VFNDGPTLM

SEQ ID NO: 129460 - protein, 9 aa, Artificial Sequence
  Description of Artificial Sequence: Synthetic peptide
  Seed: VLMAVVLAS (PMEL_HUMAN)
VSMAVVLAL

SEQ ID NO: 129461 - protein, 10 aa, Artificial Sequence
  Description of Artificial Sequence: Synthetic peptide
  Seed: KRQVPLDCVL (PMEL_HUMAN)
KRQVPLDCVM

SEQ ID NO: 129462 - protein, 10 aa, Artificial Sequence
  Description of Artificial Sequence: Synthetic peptide
  Seed: SVTLDIVQGI (PMEL_HUMAN)
SLTLDIVQGV

SEQ ID NO: 129463 - protein, 10 aa, Artificial Sequence
  Description of Artificial Sequence: Synthetic peptide
  Seed: NASFSIALNF (PMEL_HUMAN)
NYSFSIALNF

SEQ ID NO: 129464 - protein, 10 aa, Artificial Sequence
  Description of Artificial Sequence: Synthetic peptide
  Seed: RALVVTHTYL (PMEL_HUMAN)
RILVVTHTYY

SEQ ID NO: 129465 - protein, 9 aa, Artificial Sequence
  Description of Artificial Sequence: Synthetic peptide
  Seed: YPQETDDAC (PMEL_HUMAN)
YLQETDDAY

SEQ ID NO: 129466 - protein, 10 aa, Artificial Sequence
  Description of Artificial Sequence: Synthetic peptide
  Seed: YVPLAHSSSA (PMEL_HUMAN)
YNPLAHSSSL

SEQ ID NO: 129467 - protein, 9 aa, Artificial Sequence
  Description of Artificial Sequence: Synthetic peptide
  Seed: SSPGCQPPA (PMEL_HUMAN)
SIPGCQPPV

SEQ ID NO: 129468 - protein, 10 aa, Artificial Sequence
  Description of Artificial Sequence: Synthetic peptide
  Seed: ESITGSLGPL (PMEL_HUMAN)
ELITGSLGPV

SEQ ID NO: 129469 - protein, 9 aa, Artificial Sequence
  Description of Artificial Sequence: Synthetic peptide
  Seed: EVMGTTLAE (PMEL_HUMAN)
ELMGTTLAR

SEQ ID NO: 129470 - protein, 9 aa, Artificial Sequence
  Description of Artificial Sequence: Synthetic peptide
  Seed: GQVPLIVGI (PMEL_HUMAN)
GIVPLIVGA

SEQ ID NO: 129471 - protein, 9 aa, Artificial Sequence
  Description of Artificial Sequence: Synthetic peptide
  Seed: TAEAPNTTA (PMEL_HUMAN)
TPEAPNTTM

SEQ ID NO: 129472 - protein, 9 aa, Artificial Sequence
  Description of Artificial Sequence: Synthetic peptide
  Seed: FLRNQPLTF (PMEL_HUMAN)
FPRNQPLTV

SEQ ID NO: 129473 - protein, 9 aa, Artificial Sequence
  Description of Artificial Sequence: Synthetic peptide
  Seed: RNQPLTFAL (PMEL_HUMAN)
RKQPLTFAL

SEQ ID NO: 129474 - protein, 9 aa, Artificial Sequence
  Description of Artificial Sequence: Synthetic peptide
  Seed: SSIMSTESI (PMEL_HUMAN)
SQIMSTESL

SEQ ID NO: 129475 - protein, 9 aa, Artificial Sequence
  Description of Artificial Sequence: Synthetic peptide
  Seed: LTSCGSSPV (PMEL_HUMAN)
LMSCGSSPY

SEQ ID NO: 129476 - protein, 9 aa, Artificial Sequence
  Description of Artificial Sequence: Synthetic peptide
  Seed: DQVPFSVSV (PMEL_HUMAN)
DAVPFSVSL

SEQ ID NO: 129477 - protein, 9 aa, Artificial Sequence
  Description of Artificial Sequence: Synthetic peptide
  Seed: LMAVVLASL (PMEL_HUMAN)
LTAVVLASI

SEQ ID NO: 129478 - protein, 9 aa, Artificial Sequence
  Description of Artificial Sequence: Synthetic peptide
  Seed: RIFCSCPIG (PMEL_HUMAN)
RQFCSCPIK

SEQ ID NO: 129479 - protein, 9 aa, Artificial Sequence
  Description of Artificial Sequence: Synthetic peptide
  Seed: RTKAWNRQL (PMEL_HUMAN)
RMKAWNRQM

SEQ ID NO: 129480 - protein, 11 aa, Artificial Sequence
  Description of Artificial Sequence: Synthetic peptide
  Seed: CSCPIGENSPL (PMEL_HUMAN)
CACPIGENSPL

SEQ ID NO: 129481 - protein, 11 aa, Artificial Sequence
  Description of Artificial Sequence: Synthetic peptide
  Seed: GYLAEADLSYT (PMEL_HUMAN)
GFLAEADLSYL

SEQ ID NO: 129482 - protein, 10 aa, Artificial Sequence
  Description of Artificial Sequence: Synthetic peptide
  Seed: SVPQLPHSSS (PMEL_HUMAN)
SDPQLPHSSA

SEQ ID NO: 129483 - protein, 10 aa, Artificial Sequence
  Description of Artificial Sequence: Synthetic peptide
  Seed: VLMAVVLASL (PMEL_HUMAN)
VCMAVVLASL

SEQ ID NO: 129484 - protein, 9 aa, Artificial Sequence
  Description of Artificial Sequence: Synthetic peptide
  Seed: SAFTITDQV (PMEL_HUMAN)
SQFTITDQW

SEQ ID NO: 129485 - protein, 10 aa, Artificial Sequence
  Description of Artificial Sequence: Synthetic peptide
  Seed: SLADTNSLAV (PMEL_HUMAN)
SVADTNSLAV

SEQ ID NO: 129486 - protein, 10 aa, Artificial Sequence
  Description of Artificial Sequence: Synthetic peptide
  Seed: GYLAEADLSY (PMEL_HUMAN)
GILAEADLSY

SEQ ID NO: 129487 - protein, 10 aa, Artificial Sequence
  Description of Artificial Sequence: Synthetic peptide
  Seed: SSSHWLRLPR (PMEL_HUMAN)
SGSHWLRLPK

SEQ ID NO: 129488 - protein, 10 aa, Artificial Sequence
  Description of Artificial Sequence: Synthetic peptide
  Seed: SAEILQAVPS (PMEL_HUMAN)
SWEILQAVPA

SEQ ID NO: 129489 - protein, 9 aa, Artificial Sequence
  Description of Artificial Sequence: Synthetic peptide
  Seed: WVETTAREL (PMEL_HUMAN)
WAETTAREL

SEQ ID NO: 129490 - protein, 9 aa, Artificial Sequence
  Description of Artificial Sequence: Synthetic peptide
  Seed: GQVPLIVGI (PMEL_HUMAN)
GMVPLIVGA

SEQ ID NO: 129491 - protein, 9 aa, Artificial Sequence
  Description of Artificial Sequence: Synthetic peptide
  Seed: ITDQVPFSV (PMEL_HUMAN)
IYDQVPFSL

SEQ ID NO: 129492 - protein, 9 aa, Artificial Sequence
  Description of Artificial Sequence: Synthetic peptide
  Seed: RAMLGTHTM (PMEL_HUMAN)
RDMLGTHTY

SEQ ID NO: 129493 - protein, 9 aa, Artificial Sequence
  Description of Artificial Sequence: Synthetic peptide
  Seed: LPKEACMEI (PMEL_HUMAN)
LPKEACMEM

SEQ ID NO: 129494 - protein, 9 aa, Artificial Sequence
  Description of Artificial Sequence: Synthetic peptide
  Seed: SLGPLLDGT (PMEL_HUMAN)
SMGPLLDGM

SEQ ID NO: 129495 - protein, 9 aa, Artificial Sequence
  Description of Artificial Sequence: Synthetic peptide
  Seed: VSNDGPTLI (PMEL_HUMAN)
VSNDGPTLY

SEQ ID NO: 129496 - protein, 11 aa, Artificial Sequence
  Description of Artificial Sequence: Synthetic peptide
  Seed: CVLYRYGSFSV (PMEL_HUMAN)
CFLYRYGSFSL

SEQ ID NO: 129497 - protein, 9 aa, Artificial Sequence
  Description of Artificial Sequence: Synthetic peptide
  Seed: LSIGTGRAM (PMEL_HUMAN)
LVIGTGRAF

SEQ ID NO: 129498 - protein, 9 aa, Artificial Sequence
  Description of Artificial Sequence: Synthetic peptide
  Seed: EGDAFELTV (PMEL_HUMAN)
EIDAFELTM

SEQ ID NO: 129499 - protein, 9 aa, Artificial Sequence
  Description of Artificial Sequence: Synthetic peptide
  Seed: LIVGILLVL (PMEL_HUMAN)
LSVGILLVF

SEQ ID NO: 129500 - protein, 10 aa, Artificial Sequence
  Description of Artificial Sequence: Synthetic peptide
  Seed: YGSFSVTLDI (PMEL_HUMAN)
YPSFSVTLDF

SEQ ID NO: 129501 - protein, 9 aa, Artificial Sequence
  Description of Artificial Sequence: Synthetic peptide
  Seed: SYVPLAHSS (PMEL_HUMAN)
SFVPLAHSV

SEQ ID NO: 129502 - protein, 9 aa, Artificial Sequence
  Description of Artificial Sequence: Synthetic peptide
  Seed: TAEAPNTTA (PMEL_HUMAN)
TAEAPNTTM

SEQ ID NO: 129503 - protein, 9 aa, Artificial Sequence
  Description of Artificial Sequence: Synthetic peptide
  Seed: TTDGHRPTA (PMEL_HUMAN)
TMDGHRPTF

SEQ ID NO: 129504 - protein, 10 aa, Artificial Sequence
  Description of Artificial Sequence: Synthetic peptide
  Seed: QILKGGSGTY (PMEL_HUMAN)
QMLKGGSGTF

SEQ ID NO: 129505 - protein, 10 aa, Artificial Sequence
  Description of Artificial Sequence: Synthetic peptide
  Seed: LDGGNKHFLR (PMEL_HUMAN)
LMGGNKHFLK

SEQ ID NO: 129506 - protein, 9 aa, Artificial Sequence
  Description of Artificial Sequence: Synthetic peptide
  Seed: RLVKRQVPL (PMEL_HUMAN)
RQVKRQVPK

SEQ ID NO: 129507 - protein, 9 aa, Artificial Sequence
  Description of Artificial Sequence: Synthetic peptide
  Seed: LADTNSLAV (PMEL_HUMAN)
LVDTNSLAF

SEQ ID NO: 129508 - protein, 9 aa, Artificial Sequence
  Description of Artificial Sequence: Synthetic peptide
  Seed: TDQVPFSVS (PMEL_HUMAN)
TEQVPFSVL

SEQ ID NO: 129509 - protein, 9 aa, Artificial Sequence
  Description of Artificial Sequence: Synthetic peptide
  Seed: TAEAPNTTA (PMEL_HUMAN)
TLEAPNTTI

SEQ ID NO: 129510 - protein, 10 aa, Artificial Sequence
  Description of Artificial Sequence: Synthetic peptide
  Seed: IESAEILQAV (PMEL_HUMAN)
IVSAEILQAL

SEQ ID NO: 129511 - protein, 10 aa, Artificial Sequence
  Description of Artificial Sequence: Synthetic peptide
  Seed: SLADTNSLAV (PMEL_HUMAN)
SWADTNSLAL

SEQ ID NO: 129512 - protein, 10 aa, Artificial Sequence
  Description of Artificial Sequence: Synthetic peptide
  Seed: IALNFPGSQK (PMEL_HUMAN)
ILLNFPGSQR

SEQ ID NO: 129513 - protein, 9 aa, Artificial Sequence
  Description of Artificial Sequence: Synthetic peptide
  Seed: MEVTVYHRR (PMEL_HUMAN)
MTVTVYHRY

SEQ ID NO: 129514 - protein, 10 aa, Artificial Sequence
  Description of Artificial Sequence: Synthetic peptide
  Seed: ALDGGNKHFL (PMEL_HUMAN)
AFDGGNKHFY

SEQ ID NO: 129515 - protein, 9 aa, Artificial Sequence
  Description of Artificial Sequence: Synthetic peptide
  Seed: CQLVLHQIL (PMEL_HUMAN)
CELVLHQIL

SEQ ID NO: 129516 - protein, 10 aa, Artificial Sequence
  Description of Artificial Sequence: Synthetic peptide
  Seed: IFPDGGPCPS (PMEL_HUMAN)
IFPDGGPCPL

SEQ ID NO: 129517 - protein, 9 aa, Artificial Sequence
  Description of Artificial Sequence: Synthetic peptide
  Seed: RLMKQDFSV (PMEL_HUMAN)
RIMKQDFSK

SEQ ID NO: 129518 - protein, 9 aa, Artificial Sequence
  Description of Artificial Sequence: Synthetic peptide
  Seed: VSLADTNSL (PMEL_HUMAN)
VVLADTNSV

SEQ ID NO: 129519 - protein, 10 aa, Artificial Sequence
  Description of Artificial Sequence: Synthetic peptide
  Seed: LVLMAVVLAS (PMEL_HUMAN)
LHLMAVVLAI

SEQ ID NO: 129520 - protein, 9 aa, Artificial Sequence
  Description of Artificial Sequence: Synthetic peptide
  Seed: AQVVLQAAI (PMEL_HUMAN)
ARVVLQAAY

SEQ ID NO: 129521 - protein, 9 aa, Artificial Sequence
  Description of Artificial Sequence: Synthetic peptide
  Seed: LADTNSLAV (PMEL_HUMAN)
LIDTNSLAV

SEQ ID NO: 129522 - protein, 9 aa, Artificial Sequence
  Description of Artificial Sequence: Synthetic peptide
  Seed: RLPRIFCSC (PMEL_HUMAN)
RLPRIFCSA

SEQ ID NO: 129523 - protein, 9 aa, Artificial Sequence
  Description of Artificial Sequence: Synthetic peptide
  Seed: YPQETDDAC (PMEL_HUMAN)
YSQETDDAY

SEQ ID NO: 129524 - protein, 10 aa, Artificial Sequence
  Description of Artificial Sequence: Synthetic peptide
  Seed: AEMSTPEATG (PMEL_HUMAN)
AEMSTPEATM

SEQ ID NO: 129525 - protein, 9 aa, Artificial Sequence
  Description of Artificial Sequence: Synthetic peptide
  Seed: STAPVQMPT (PMEL_HUMAN)
SMAPVQMPA

SEQ ID NO: 129526 - protein, 10 aa, Artificial Sequence
  Description of Artificial Sequence: Synthetic peptide
  Seed: MAVVLASLIY (PMEL_HUMAN)
MAVVLASLIW

SEQ ID NO: 129527 - protein, 9 aa, Artificial Sequence
  Description of Artificial Sequence: Synthetic peptide
  Seed: VLQAAIPLT (PMEL_HUMAN)
VIQAAIPLL

SEQ ID NO: 129528 - protein, 11 aa, Artificial Sequence
  Description of Artificial Sequence: Synthetic peptide
  Seed: FGDSSGTLISR (PMEL_HUMAN)
FTDSSGTLISI

SEQ ID NO: 129529 - protein, 10 aa, Artificial Sequence
  Description of Artificial Sequence: Synthetic peptide
  Seed: THTMEVTVYH (PMEL_HUMAN)
TKTMEVTVYY

SEQ ID NO: 129530 - protein, 9 aa, Artificial Sequence
  Description of Artificial Sequence: Synthetic peptide
  Seed: VSCQGGLPK (PMEL_HUMAN)
VACQGGLPL

SEQ ID NO: 129531 - protein, 9 aa, Artificial Sequence
  Description of Artificial Sequence: Synthetic peptide
  Seed: YLAEADLSY (PMEL_HUMAN)
YPAEADLSM

SEQ ID NO: 129532 - protein, 10 aa, Artificial Sequence
  Description of Artificial Sequence: Synthetic peptide
  Seed: YRYGSFSVTL (PMEL_HUMAN)
YTYGSFSVTY

SEQ ID NO: 129533 - protein, 8 aa, Artificial Sequence
  Description of Artificial Sequence: Synthetic peptide
  Seed: FGDSSGTL (PMEL_HUMAN)
FFDSSGTL

SEQ ID NO: 129534 - protein, 9 aa, Artificial Sequence
  Description of Artificial Sequence: Synthetic peptide
  Seed: LQAAIPLTS (PMEL_HUMAN)
LKAAIPLTF

SEQ ID NO: 129535 - protein, 11 aa, Artificial Sequence
  Description of Artificial Sequence: Synthetic peptide
  Seed: RYGSFSVTLDI (PMEL_HUMAN)
RAGSFSVTLDF

SEQ ID NO: 129536 - protein, 10 aa, Artificial Sequence
  Description of Artificial Sequence: Synthetic peptide
  Seed: GPLLDGTATL (PMEL_HUMAN)
GELLDGTATA

SEQ ID NO: 129537 - protein, 11 aa, Artificial Sequence
  Description of Artificial Sequence: Synthetic peptide
  Seed: HTMEVTVYHRR (PMEL_HUMAN)
HTMEVTVYHRS

SEQ ID NO: 129538 - protein, 9 aa, Artificial Sequence
  Description of Artificial Sequence: Synthetic peptide
  Seed: RYGSFSVTL (PMEL_HUMAN)
RMGSFSVTI

SEQ ID NO: 129539 - protein, 9 aa, Artificial Sequence
  Description of Artificial Sequence: Synthetic peptide
  Seed: FGDSSGTLI (PMEL_HUMAN)
FLDSSGTLA

SEQ ID NO: 129540 - protein, 10 aa, Artificial Sequence
  Description of Artificial Sequence: Synthetic peptide
  Seed: LVLKRCLLHL (PMEL_HUMAN)
LDLKRCLLHV

SEQ ID NO: 129541 - protein, 9 aa, Artificial Sequence
  Description of Artificial Sequence: Synthetic peptide
  Seed: RQVPLDCVL (PMEL_HUMAN)
REVPLDCVM

SEQ ID NO: 129542 - protein, 9 aa, Artificial Sequence
  Description of Artificial Sequence: Synthetic peptide
  Seed: VLKRCLLHL (PMEL_HUMAN)
VLKRCLLHW

SEQ ID NO: 129543 - protein, 9 aa, Artificial Sequence
  Description of Artificial Sequence: Synthetic peptide
  Seed: LADTNSLAV (PMEL_HUMAN)
LVDTNSLAL

SEQ ID NO: 129544 - protein, 10 aa, Artificial Sequence
  Description of Artificial Sequence: Synthetic peptide
  Seed: FLRNQPLTFA (PMEL_HUMAN)
FLRNQPLTFT

SEQ ID NO: 129545 - protein, 9 aa, Artificial Sequence
  Description of Artificial Sequence: Synthetic peptide
  Seed: RAMLGTHTM (PMEL_HUMAN)
RMMLGTHTT

SEQ ID NO: 129546 - protein, 9 aa, Artificial Sequence
  Description of Artificial Sequence: Synthetic peptide
  Seed: IMPGQEAGL (PMEL_HUMAN)
IYPGQEAGL

SEQ ID NO: 129547 - protein, 9 aa, Artificial Sequence
  Description of Artificial Sequence: Synthetic peptide
  Seed: GENSPLLSG (PMEL_HUMAN)
GENSPLLSV

SEQ ID NO: 129548 - protein, 10 aa, Artificial Sequence
  Description of Artificial Sequence: Synthetic peptide
  Seed: MSTESITGSL (PMEL_HUMAN)
MATESITGSI

SEQ ID NO: 129549 - protein, 11 aa, Artificial Sequence
  Description of Artificial Sequence: Synthetic peptide
  Seed: SLADTNSLAVV (PMEL_HUMAN)
SMADTNSLAVI

SEQ ID NO: 129550 - protein, 9 aa, Artificial Sequence
  Description of Artificial Sequence: Synthetic peptide
  Seed: TTDGHRPTA (PMEL_HUMAN)
TIDGHRPTA

SEQ ID NO: 129551 - protein, 10 aa, Artificial Sequence
  Description of Artificial Sequence: Synthetic peptide
  Seed: MAVVLASLIY (PMEL_HUMAN)
MSVVLASLIL

SEQ ID NO: 129552 - protein, 9 aa, Artificial Sequence
  Description of Artificial Sequence: Synthetic peptide
  Seed: FTITDQVPF (PMEL_HUMAN)
FFITDQVPM

SEQ ID NO: 129553 - protein, 9 aa, Artificial Sequence
  Description of Artificial Sequence: Synthetic peptide
  Seed: KAWNRQLYP (PMEL_HUMAN)
KVWNRQLYV

SEQ ID NO: 129554 - protein, 9 aa, Artificial Sequence
  Description of Artificial Sequence: Synthetic peptide
  Seed: VSCQGGLPK (PMEL_HUMAN)
VACQGGLPY

SEQ ID NO: 129555 - protein, 9 aa, Artificial Sequence
  Description of Artificial Sequence: Synthetic peptide
  Seed: TEWVETTAR (PMEL_HUMAN)
TEWVETTAV

SEQ ID NO: 129556 - protein, 9 aa, Artificial Sequence
  Description of Artificial Sequence: Synthetic peptide
  Seed: ASFSIALNF (PMEL_HUMAN)
AAFSIALNM

SEQ ID NO: 129557 - protein, 10 aa, Artificial Sequence
  Description of Artificial Sequence: Synthetic peptide
  Seed: QVPLDCVLYR (PMEL_HUMAN)
QQPLDCVLYK

SEQ ID NO: 129558 - protein, 8 aa, Artificial Sequence
  Description of Artificial Sequence: Synthetic peptide
  Seed: FGDSSGTL (PMEL_HUMAN)
FSDSSGTL

SEQ ID NO: 129559 - protein, 10 aa, Artificial Sequence
  Description of Artificial Sequence: Synthetic peptide
  Seed: LAEADLSYTW (PMEL_HUMAN)
LHEADLSYTW

SEQ ID NO: 129560 - protein, 9 aa, Artificial Sequence
  Description of Artificial Sequence: Synthetic peptide
  Seed: GSFSVTLDI (PMEL_HUMAN)
GQFSVTLDV

SEQ ID NO: 129561 - protein, 9 aa, Artificial Sequence
  Description of Artificial Sequence: Synthetic peptide
  Seed: FGDSSGTLI (PMEL_HUMAN)
FYDSSGTLV

SEQ ID NO: 129562 - protein, 9 aa, Artificial Sequence
  Description of Artificial Sequence: Synthetic peptide
  Seed: DGGNKHFLR (PMEL_HUMAN)
DIGNKHFLK

SEQ ID NO: 129563 - protein, 10 aa, Artificial Sequence
  Description of Artificial Sequence: Synthetic peptide
  Seed: HFLRNQPLTF (PMEL_HUMAN)
HYLRNQPLTI

SEQ ID NO: 129564 - protein, 8 aa, Artificial Sequence
  Description of Artificial Sequence: Synthetic peptide
  Seed: QDFSVPQL (PMEL_HUMAN)
QQFSVPQV

SEQ ID NO: 129565 - protein, 10 aa, Artificial Sequence
  Description of Artificial Sequence: Synthetic peptide
  Seed: TDQVPFSVSV (PMEL_HUMAN)
TMQVPFSVSL

SEQ ID NO: 129566 - protein, 9 aa, Artificial Sequence
  Description of Artificial Sequence: Synthetic peptide
  Seed: SLAVVSTQL (PMEL_HUMAN)
SRAVVSTQM

SEQ ID NO: 129567 - protein, 9 aa, Artificial Sequence
  Description of Artificial Sequence: Synthetic peptide
  Seed: WSQKRSFVY (PMEL_HUMAN)
WAQKRSFVW

SEQ ID NO: 129568 - protein, 9 aa, Artificial Sequence
  Description of Artificial Sequence: Synthetic peptide
  Seed: CPIGENSPL (PMEL_HUMAN)
CMIGENSPY

SEQ ID NO: 129569 - protein, 9 aa, Artificial Sequence
  Description of Artificial Sequence: Synthetic peptide
  Seed: QVIWVNNTI (PMEL_HUMAN)
QLIWVNNTL

SEQ ID NO: 129570 - protein, 9 aa, Artificial Sequence
  Description of Artificial Sequence: Synthetic peptide
  Seed: LPDGQVIWV (PMEL_HUMAN)
LFDGQVIWL

SEQ ID NO: 129571 - protein, 10 aa, Artificial Sequence
  Description of Artificial Sequence: Synthetic peptide
  Seed: NKHFLRNQPL (PMEL_HUMAN)
NLHFLRNQPL

SEQ ID NO: 129572 - protein, 9 aa, Artificial Sequence
  Description of Artificial Sequence: Synthetic peptide
  Seed: VLGGPVSGL (PMEL_HUMAN)
VMGGPVSGF

SEQ ID NO: 129573 - protein, 11 aa, Artificial Sequence
  Description of Artificial Sequence: Synthetic peptide
  Seed: RQVPLDCVLYR (PMEL_HUMAN)
RLVPLDCVLYK

SEQ ID NO: 129574 - protein, 9 aa, Artificial Sequence
  Description of Artificial Sequence: Synthetic peptide
  Seed: KVSNDGPTL (PMEL_HUMAN)
KASNDGPTV

SEQ ID NO: 129575 - protein, 10 aa, Artificial Sequence
  Description of Artificial Sequence: Synthetic peptide
  Seed: SGTYCLNVSL (PMEL_HUMAN)
SWTYCLNVSV

SEQ ID NO: 129576 - protein, 9 aa, Artificial Sequence
  Description of Artificial Sequence: Synthetic peptide
  Seed: VISTAPVQM (PMEL_HUMAN)
VASTAPVQV

SEQ ID NO: 129577 - protein, 10 aa, Artificial Sequence
  Description of Artificial Sequence: Synthetic peptide
  Seed: RNQDWLGVSR (PMEL_HUMAN)
RFQDWLGVSK

SEQ ID NO: 129578 - protein, 8 aa, Artificial Sequence
  Description of Artificial Sequence: Synthetic peptide
  Seed: TEVISTAP (PMEL_HUMAN)
TEVISTAA

SEQ ID NO: 129579 - protein, 8 aa, Artificial Sequence
  Description of Artificial Sequence: Synthetic peptide
  Seed: TPGQAPTA (PMEL_HUMAN)
TPGQAPTL

SEQ ID NO: 129580 - protein, 9 aa, Artificial Sequence
  Description of Artificial Sequence: Synthetic peptide
  Seed: VSEVMGTTL (PMEL_HUMAN)
VVEVMGTTL

SEQ ID NO: 129581 - protein, 9 aa, Artificial Sequence
  Description of Artificial Sequence: Synthetic peptide
  Seed: KHFLRNQPL (PMEL_HUMAN)
KAFLRNQPY

SEQ ID NO: 129582 - protein, 9 aa, Artificial Sequence
  Description of Artificial Sequence: Synthetic peptide
  Seed: VLPSPACQL (PMEL_HUMAN)
VVPSPACQF

SEQ ID NO: 129583 - protein, 11 aa, Artificial Sequence
  Description of Artificial Sequence: Synthetic peptide
  Seed: FSVSVSQLRAL (PMEL_HUMAN)
FAVSVSQLRAF

SEQ ID NO: 129584 - protein, 10 aa, Artificial Sequence
  Description of Artificial Sequence: Synthetic peptide
  Seed: SLADTNSLAV (PMEL_HUMAN)
SVADTNSLAL

SEQ ID NO: 129585 - protein, 10 aa, Artificial Sequence
  Description of Artificial Sequence: Synthetic peptide
  Seed: VLASLIYRRR (PMEL_HUMAN)
VFASLIYRRR

SEQ ID NO: 129586 - protein, 9 aa, Artificial Sequence
  Description of Artificial Sequence: Synthetic peptide
  Seed: AVIGALLAV (PMEL_HUMAN)
AAIGALLAH

SEQ ID NO: 129587 - protein, 11 aa, Artificial Sequence
  Description of Artificial Sequence: Synthetic peptide
  Seed: SQKRSFVYVWK (PMEL_HUMAN)
SMKRSFVYVWK

SEQ ID NO: 129588 - protein, 10 aa, Artificial Sequence
  Description of Artificial Sequence: Synthetic peptide
  Seed: RGSRSYVPLA (PMEL_HUMAN)
RESRSYVPLI

SEQ ID NO: 129589 - protein, 11 aa, Artificial Sequence
  Description of Artificial Sequence: Synthetic peptide
  Seed: GYLAEADLSYT (PMEL_HUMAN)
GYLAEADLSYL

SEQ ID NO: 129590 - protein, 10 aa, Artificial Sequence
  Description of Artificial Sequence: Synthetic peptide
  Seed: TYLEPGPVTA (PMEL_HUMAN)
TYLEPGPVTF

SEQ ID NO: 129591 - protein, 10 aa, Artificial Sequence
  Description of Artificial Sequence: Synthetic peptide
  Seed: LIGANASFSI (PMEL_HUMAN)
LMGANASFSV

SEQ ID NO: 129592 - protein, 9 aa, Artificial Sequence
  Description of Artificial Sequence: Synthetic peptide
  Seed: AQRLCQPVL (PMEL_HUMAN)
AERLCQPVF

SEQ ID NO: 129593 - protein, 9 aa, Artificial Sequence
  Description of Artificial Sequence: Synthetic peptide
  Seed: AQRLCQPVL (PMEL_HUMAN)
AMRLCQPVY

SEQ ID NO: 129594 - protein, 10 aa, Artificial Sequence
  Description of Artificial Sequence: Synthetic peptide
  Seed: YRYGSFSVTL (PMEL_HUMAN)
YCYGSFSVTF

SEQ ID NO: 129595 - protein, 9 aa, Artificial Sequence
  Description of Artificial Sequence: Synthetic peptide
  Seed: KVSNDGPTL (PMEL_HUMAN)
KSSNDGPTL

SEQ ID NO: 129596 - protein, 10 aa, Artificial Sequence
  Description of Artificial Sequence: Synthetic peptide
  Seed: YGSFSVTLDI (PMEL_HUMAN)
YDSFSVTLDW

SEQ ID NO: 129597 - protein, 9 aa, Artificial Sequence
  Description of Artificial Sequence: Synthetic peptide
  Seed: RAMLGTHTM (PMEL_HUMAN)
RSMLGTHTR

SEQ ID NO: 129598 - protein, 9 aa, Artificial Sequence
  Description of Artificial Sequence: Synthetic peptide
  Seed: QKRSFVYVW (PMEL_HUMAN)
QLRSFVYVY

SEQ ID NO: 129599 - protein, 9 aa, Artificial Sequence
  Description of Artificial Sequence: Synthetic peptide
  Seed: ITDQVPFSV (PMEL_HUMAN)
IGDQVPFSY

SEQ ID NO: 129600 - protein, 9 aa, Artificial Sequence
  Description of Artificial Sequence: Synthetic peptide
  Seed: TLISRALVV (PMEL_HUMAN)
TTISRALVF

SEQ ID NO: 129601 - protein, 9 aa, Artificial Sequence
  Description of Artificial Sequence: Synthetic peptide
  Seed: HLAVIGALL (PMEL_HUMAN)
HAAVIGALV

SEQ ID NO: 129602 - protein, 10 aa, Artificial Sequence
  Description of Artificial Sequence: Synthetic peptide
  Seed: LDGGNKHFLR (PMEL_HUMAN)
LLGGNKHFLR

SEQ ID NO: 129603 - protein, 9 aa, Artificial Sequence
  Description of Artificial Sequence: Synthetic peptide
  Seed: RALVVTHTY (PMEL_HUMAN)
RWLVVTHTY

SEQ ID NO: 129604 - protein, 9 aa, Artificial Sequence
  Description of Artificial Sequence: Synthetic peptide
  Seed: ILLVLMAVV (PMEL_HUMAN)
IQLVLMAVV

SEQ ID NO: 129605 - protein, 9 aa, Artificial Sequence
  Description of Artificial Sequence: Synthetic peptide
  Seed: KQDFSVPQL (PMEL_HUMAN)
KSDFSVPQW

SEQ ID NO: 129606 - protein, 9 aa, Artificial Sequence
  Description of Artificial Sequence: Synthetic peptide
  Seed: KTWGQYWQV (PMEL_HUMAN)
KMWGQYWQH

SEQ ID NO: 129607 - protein, 9 aa, Artificial Sequence
  Description of Artificial Sequence: Synthetic peptide
  Seed: QVIWVNNTI (PMEL_HUMAN)
QVIWVNNTL

SEQ ID NO: 129608 - protein, 9 aa, Artificial Sequence
  Description of Artificial Sequence: Synthetic peptide
  Seed: MSTPEATGM (PMEL_HUMAN)
MSTPEATGL

SEQ ID NO: 129609 - protein, 10 aa, Artificial Sequence
  Description of Artificial Sequence: Synthetic peptide
  Seed: ESITGSLGPL (PMEL_HUMAN)
ETITGSLGPY

SEQ ID NO: 129610 - protein, 9 aa, Artificial Sequence
  Description of Artificial Sequence: Synthetic peptide
  Seed: AHSSSAFTI (PMEL_HUMAN)
ASSSSAFTF

SEQ ID NO: 129611 - protein, 10 aa, Artificial Sequence
  Description of Artificial Sequence: Synthetic peptide
  Seed: GYLAEADLSY (PMEL_HUMAN)
GQLAEADLSY

SEQ ID NO: 129612 - protein, 11 aa, Artificial Sequence
  Description of Artificial Sequence: Synthetic peptide
  Seed: VPQLPHSSSHW (PMEL_HUMAN)
VTQLPHSSSHW

SEQ ID NO: 129613 - protein, 9 aa, Artificial Sequence
  Description of Artificial Sequence: Synthetic peptide
  Seed: TLIGANASF (PMEL_HUMAN)
TSIGANASY

SEQ ID NO: 129614 - protein, 10 aa, Artificial Sequence
  Description of Artificial Sequence: Synthetic peptide
  Seed: LIGANASFSI (PMEL_HUMAN)
LLGANASFSV

SEQ ID NO: 129615 - protein, 11 aa, Artificial Sequence
  Description of Artificial Sequence: Synthetic peptide
  Seed: TEVISTAPVQM (PMEL_HUMAN)
TEVISTAPVQL

SEQ ID NO: 129616 - protein, 9 aa, Artificial Sequence
  Description of Artificial Sequence: Synthetic peptide
  Seed: AEADLSYTW (PMEL_HUMAN)
ANADLSYTW

SEQ ID NO: 129617 - protein, 11 aa, Artificial Sequence
  Description of Artificial Sequence: Synthetic peptide
  Seed: QLYPEWTEAQR (PMEL_HUMAN)
QTYPEWTEAQR

SEQ ID NO: 129618 - protein, 9 aa, Artificial Sequence
  Description of Artificial Sequence: Synthetic peptide
  Seed: KTWGQYWQV (PMEL_HUMAN)
KEWGQYWQY

SEQ ID NO: 129619 - protein, 9 aa, Artificial Sequence
  Description of Artificial Sequence: Synthetic peptide
  Seed: YRYGSFSVT (PMEL_HUMAN)
YHYGSFSVL

SEQ ID NO: 129620 - protein, 9 aa, Artificial Sequence
  Description of Artificial Sequence: Synthetic peptide
  Seed: AEADLSYTW (PMEL_HUMAN)
ACADLSYTW

SEQ ID NO: 129621 - protein, 9 aa, Artificial Sequence
  Description of Artificial Sequence: Synthetic peptide
  Seed: LSIGTGRAM (PMEL_HUMAN)
LWIGTGRAM

SEQ ID NO: 129622 - protein, 9 aa, Artificial Sequence
  Description of Artificial Sequence: Synthetic peptide
  Seed: AEADLSYTW (PMEL_HUMAN)
AMADLSYTI

SEQ ID NO: 129623 - protein, 9 aa, Artificial Sequence
  Description of Artificial Sequence: Synthetic peptide
  Seed: ITDQVPFSV (PMEL_HUMAN)
IHDQVPFSL

SEQ ID NO: 129624 - protein, 8 aa, Artificial Sequence
  Description of Artificial Sequence: Synthetic peptide
  Seed: FGDSSGTL (PMEL_HUMAN)
FYDSSGTI

SEQ ID NO: 129625 - protein, 10 aa, Artificial Sequence
  Description of Artificial Sequence: Synthetic peptide
  Seed: MPTAESTGMT (PMEL_HUMAN)
MSTAESTGML

SEQ ID NO: 129626 - protein, 10 aa, Artificial Sequence
  Description of Artificial Sequence: Synthetic peptide
  Seed: GPLLDGTATL (PMEL_HUMAN)
GWLLDGTATV

SEQ ID NO: 129627 - protein, 9 aa, Artificial Sequence
  Description of Artificial Sequence: Synthetic peptide
  Seed: YWQVLGGPV (PMEL_HUMAN)
YYQVLGGPI

SEQ ID NO: 129628 - protein, 9 aa, Artificial Sequence
  Description of Artificial Sequence: Synthetic peptide
  Seed: RNQPLTFAL (PMEL_HUMAN)
RIQPLTFAV

SEQ ID NO: 129629 - protein, 9 aa, Artificial Sequence
  Description of Artificial Sequence: Synthetic peptide
  Seed: LAVIGALLA (PMEL_HUMAN)
LAVIGALLM

SEQ ID NO: 129630 - protein, 9 aa, Artificial Sequence
  Description of Artificial Sequence: Synthetic peptide
  Seed: LIVGILLVL (PMEL_HUMAN)
LTVGILLVL

SEQ ID NO: 129631 - protein, 9 aa, Artificial Sequence
  Description of Artificial Sequence: Synthetic peptide
  Seed: SFVYVWKTW (PMEL_HUMAN)
SAVYVWKTW

SEQ ID NO: 129632 - protein, 10 aa, Artificial Sequence
  Description of Artificial Sequence: Synthetic peptide
  Seed: SVTLDIVQGI (PMEL_HUMAN)
SITLDIVQGV

SEQ ID NO: 129633 - protein, 10 aa, Artificial Sequence
  Description of Artificial Sequence: Synthetic peptide
  Seed: MTPAEVSIVV (PMEL_HUMAN)
MMPAEVSIVT

SEQ ID NO: 129634 - protein, 9 aa, Artificial Sequence
  Description of Artificial Sequence: Synthetic peptide
  Seed: GQVPLIVGI (PMEL_HUMAN)
GEVPLIVGP

SEQ ID NO: 129635 - protein, 9 aa, Artificial Sequence
  Description of Artificial Sequence: Synthetic peptide
  Seed: RAMLGTHTM (PMEL_HUMAN)
RPMLGTHTV

SEQ ID NO: 129636 - protein, 9 aa, Artificial Sequence
  Description of Artificial Sequence: Synthetic peptide
  Seed: LTSCGSSPV (PMEL_HUMAN)
LASCGSSPF

SEQ ID NO: 129637 - protein, 9 aa, Artificial Sequence
  Description of Artificial Sequence: Synthetic peptide
  Seed: RSYVPLAHS (PMEL_HUMAN)
RTYVPLAHI

SEQ ID NO: 129638 - protein, 10 aa, Artificial Sequence
  Description of Artificial Sequence: Synthetic peptide
  Seed: KVLPDGQVIW (PMEL_HUMAN)
KQLPDGQVIV

SEQ ID NO: 129639 - protein, 10 aa, Artificial Sequence
  Description of Artificial Sequence: Synthetic peptide
  Seed: RALDGGNKHF (PMEL_HUMAN)
RTLDGGNKHL

SEQ ID NO: 129640 - protein, 10 aa, Artificial Sequence
  Description of Artificial Sequence: Synthetic peptide
  Seed: DGTATLRLVK (PMEL_HUMAN)
DFTATLRLVR

SEQ ID NO: 129641 - protein, 9 aa, Artificial Sequence
  Description of Artificial Sequence: Synthetic peptide
  Seed: AGLGQVPLI (PMEL_HUMAN)
AALGQVPLF

SEQ ID NO: 129642 - protein, 9 aa, Artificial Sequence
  Description of Artificial Sequence: Synthetic peptide
  Seed: PLLDGTATL (PMEL_HUMAN)
PQLDGTATY

SEQ ID NO: 129643 - protein, 10 aa, Artificial Sequence
  Description of Artificial Sequence: Synthetic peptide
  Seed: MDLVLKRCLL (PMEL_HUMAN)
MMLVLKRCLL

SEQ ID NO: 129644 - protein, 10 aa, Artificial Sequence
  Description of Artificial Sequence: Synthetic peptide
  Seed: MTPAEVSIVV (PMEL_HUMAN)
MHPAEVSIVA

SEQ ID NO: 129645 - protein, 10 aa, Artificial Sequence
  Description of Artificial Sequence: Synthetic peptide
  Seed: SVTLDIVQGI (PMEL_HUMAN)
SMTLDIVQGL

SEQ ID NO: 129646 - protein, 9 aa, Artificial Sequence
  Description of Artificial Sequence: Synthetic peptide
  Seed: QLHDPSGYL (PMEL_HUMAN)
QAHDPSGYF

SEQ ID NO: 129647 - protein, 9 aa, Artificial Sequence
  Description of Artificial Sequence: Synthetic peptide
  Seed: YHRRGSRSY (PMEL_HUMAN)
YHRRGSRSF

SEQ ID NO: 129648 - protein, 9 aa, Artificial Sequence
  Description of Artificial Sequence: Synthetic peptide
  Seed: LVLKRCLLH (PMEL_HUMAN)
LTLKRCLLK

SEQ ID NO: 129649 - protein, 9 aa, Artificial Sequence
  Description of Artificial Sequence: Synthetic peptide
  Seed: FTITDQVPF (PMEL_HUMAN)
FKITDQVPM

SEQ ID NO: 129650 - protein, 10 aa, Artificial Sequence
  Description of Artificial Sequence: Synthetic peptide
  Seed: SVPQLPHSSS (PMEL_HUMAN)
SGPQLPHSSV

SEQ ID NO: 129651 - protein, 10 aa, Artificial Sequence
  Description of Artificial Sequence: Synthetic peptide
  Seed: TDQVPFSVSV (PMEL_HUMAN)
TWQVPFSVSV

SEQ ID NO: 129652 - protein, 9 aa, Artificial Sequence
  Description of Artificial Sequence: Synthetic peptide
  Seed: FTITDQVPF (PMEL_HUMAN)
FNITDQVPF

SEQ ID NO: 129653 - protein, 10 aa, Artificial Sequence
  Description of Artificial Sequence: Synthetic peptide
  Seed: RGSRSYVPLA (PMEL_HUMAN)
RYSRSYVPLM

SEQ ID NO: 129654 - protein, 9 aa, Artificial Sequence
  Description of Artificial Sequence: Synthetic peptide
  Seed: KHFLRNQPL (PMEL_HUMAN)
KHFLRNQPY

SEQ ID NO: 129655 - protein, 9 aa, Artificial Sequence
  Description of Artificial Sequence: Synthetic peptide
  Seed: HSSSHWLRL (PMEL_HUMAN)
HTSSHWLRL

SEQ ID NO: 129656 - protein, 10 aa, Artificial Sequence
  Description of Artificial Sequence: Synthetic peptide
  Seed: RQLYPEWTEA (PMEL_HUMAN)
RPLYPEWTEI

SEQ ID NO: 129657 - protein, 9 aa, Artificial Sequence
  Description of Artificial Sequence: Synthetic peptide
  Seed: LQAAIPLTS (PMEL_HUMAN)
LFAAIPLTF

SEQ ID NO: 129658 - protein, 11 aa, Artificial Sequence
  Description of Artificial Sequence: Synthetic peptide
  Seed: RYGSFSVTLDI (PMEL_HUMAN)
RYGSFSVTLDF

SEQ ID NO: 129659 - protein, 10 aa, Artificial Sequence
  Description of Artificial Sequence: Synthetic peptide
  Seed: YGSFSVTLDI (PMEL_HUMAN)
YWSFSVTLDW

SEQ ID NO: 129660 - protein, 10 aa, Artificial Sequence
  Description of Artificial Sequence: Synthetic peptide
  Seed: RQLRTKAWNR (PMEL_HUMAN)
RHLRTKAWNR

SEQ ID NO: 129661 - protein, 11 aa, Artificial Sequence
  Description of Artificial Sequence: Synthetic peptide
  Seed: SYVPLAHSSSA (PMEL_HUMAN)
SCVPLAHSSSF

SEQ ID NO: 129662 - protein, 9 aa, Artificial Sequence
  Description of Artificial Sequence: Synthetic peptide
  Seed: VTAQVVLQA (PMEL_HUMAN)
VLAQVVLQT

SEQ ID NO: 129663 - protein, 9 aa, Artificial Sequence
  Description of Artificial Sequence: Synthetic peptide
  Seed: DSSGTLISR (PMEL_HUMAN)
DTSGTLISK

SEQ ID NO: 129664 - protein, 9 aa, Artificial Sequence
  Description of Artificial Sequence: Synthetic peptide
  Seed: LTSCGSSPV (PMEL_HUMAN)
LSSCGSSPL

SEQ ID NO: 129665 - protein, 11 aa, Artificial Sequence
  Description of Artificial Sequence: Synthetic peptide
  Seed: RRGSRSYVPLA (PMEL_HUMAN)
RRGSRSYVPLL

SEQ ID NO: 129666 - protein, 10 aa, Artificial Sequence
  Description of Artificial Sequence: Synthetic peptide
  Seed: RRLMKQDFSV (PMEL_HUMAN)
RRLMKQDFSM

SEQ ID NO: 129667 - protein, 10 aa, Artificial Sequence
  Description of Artificial Sequence: Synthetic peptide
  Seed: YRYGSFSVTL (PMEL_HUMAN)
YDYGSFSVTW

SEQ ID NO: 129668 - protein, 9 aa, Artificial Sequence
  Description of Artificial Sequence: Synthetic peptide
  Seed: RALVVTHTY (PMEL_HUMAN)
RCLVVTHTW

SEQ ID NO: 129669 - protein, 10 aa, Artificial Sequence
  Description of Artificial Sequence: Synthetic peptide
  Seed: VYHRRGSRSY (PMEL_HUMAN)
VKHRRGSRSF

SEQ ID NO: 129670 - protein, 9 aa, Artificial Sequence
  Description of Artificial Sequence: Synthetic peptide
  Seed: MSTPEATGM (PMEL_HUMAN)
MITPEATGY

SEQ ID NO: 129671 - protein, 9 aa, Artificial Sequence
  Description of Artificial Sequence: Synthetic peptide
  Seed: MAVVLASLI (PMEL_HUMAN)
MKVVLASLM

SEQ ID NO: 129672 - protein, 9 aa, Artificial Sequence
  Description of Artificial Sequence: Synthetic peptide
  Seed: SQVWGGQPV (PMEL_HUMAN)
SKVWGGQPM

SEQ ID NO: 129673 - protein, 9 aa, Artificial Sequence
  Description of Artificial Sequence: Synthetic peptide
  Seed: FTITDQVPF (PMEL_HUMAN)
FPITDQVPS

SEQ ID NO: 129674 - protein, 9 aa, Artificial Sequence
  Description of Artificial Sequence: Synthetic peptide
  Seed: AGLGQVPLI (PMEL_HUMAN)
AALGQVPLI

SEQ ID NO: 129675 - protein, 10 aa, Artificial Sequence
  Description of Artificial Sequence: Synthetic peptide
  Seed: MTPAEVSIVV (PMEL_HUMAN)
MGPAEVSIVT

SEQ ID NO: 129676 - protein, 9 aa, Artificial Sequence
  Description of Artificial Sequence: Synthetic peptide
  Seed: VTAQVVLQA (PMEL_HUMAN)
VAAQVVLQV

SEQ ID NO: 129677 - protein, 9 aa, Artificial Sequence
  Description of Artificial Sequence: Synthetic peptide
  Seed: VMGTTLAEM (PMEL_HUMAN)
VSGTTLAEL

SEQ ID NO: 129678 - protein, 10 aa, Artificial Sequence
  Description of Artificial Sequence: Synthetic peptide
  Seed: YVPLAHSSSA (PMEL_HUMAN)
YEPLAHSSSL

SEQ ID NO: 129679 - protein, 10 aa, Artificial Sequence
  Description of Artificial Sequence: Synthetic peptide
  Seed: YLAEADLSYT (PMEL_HUMAN)
YTAEADLSYV

SEQ ID NO: 129680 - protein, 9 aa, Artificial Sequence
  Description of Artificial Sequence: Synthetic peptide
  Seed: HLAVIGALL (PMEL_HUMAN)
HAAVIGALI

SEQ ID NO: 129681 - protein, 10 aa, Artificial Sequence
  Description of Artificial Sequence: Synthetic peptide
  Seed: LRNQPLTFAL (PMEL_HUMAN)
LRNQPLTFAM

SEQ ID NO: 129682 - protein, 10 aa, Artificial Sequence
  Description of Artificial Sequence: Synthetic peptide
  Seed: QVLGGPVSGL (PMEL_HUMAN)
QMLGGPVSGK

SEQ ID NO: 129683 - protein, 9 aa, Artificial Sequence
  Description of Artificial Sequence: Synthetic peptide
  Seed: RLVKRQVPL (PMEL_HUMAN)
RTVKRQVPY

SEQ ID NO: 129684 - protein, 9 aa, Artificial Sequence
  Description of Artificial Sequence: Synthetic peptide
  Seed: GSRSYVPLA (PMEL_HUMAN)
GQRSYVPLK

SEQ ID NO: 129685 - protein, 11 aa, Artificial Sequence
  Description of Artificial Sequence: Synthetic peptide
  Seed: TWDFGDSSGTL (PMEL_HUMAN)
TADFGDSSGTF

SEQ ID NO: 129686 - protein, 9 aa, Artificial Sequence
  Description of Artificial Sequence: Synthetic peptide
  Seed: AGLGQVPLI (PMEL_HUMAN)
ASLGQVPLV

SEQ ID NO: 129687 - protein, 11 aa, Artificial Sequence
  Description of Artificial Sequence: Synthetic peptide
  Seed: MTPEKVPVSEV (PMEL_HUMAN)
MMPEKVPVSEV

SEQ ID NO: 129688 - protein, 9 aa, Artificial Sequence
  Description of Artificial Sequence: Synthetic peptide
  Seed: VSNDGPTLI (PMEL_HUMAN)
VYNDGPTLV

SEQ ID NO: 129689 - protein, 9 aa, Artificial Sequence
  Description of Artificial Sequence: Synthetic peptide
  Seed: RQVPLDCVL (PMEL_HUMAN)
RRVPLDCVF

SEQ ID NO: 129690 - protein, 8 aa, Artificial Sequence
  Description of Artificial Sequence: Synthetic peptide
  Seed: LHDPSGYL (PMEL_HUMAN)
LADPSGYL

SEQ ID NO: 129691 - protein, 9 aa, Artificial Sequence
  Description of Artificial Sequence: Synthetic peptide
  Seed: LPKEACMEI (PMEL_HUMAN)
LPKEACMEF

SEQ ID NO: 129692 - protein, 9 aa, Artificial Sequence
  Description of Artificial Sequence: Synthetic peptide
  Seed: CVLYRYGSF (PMEL_HUMAN)
CTLYRYGSW

SEQ ID NO: 129693 - protein, 11 aa, Artificial Sequence
  Description of Artificial Sequence: Synthetic peptide
  Seed: LGPLLDGTATL (PMEL_HUMAN)
LLPLLDGTATV

SEQ ID NO: 129694 - protein, 10 aa, Artificial Sequence
  Description of Artificial Sequence: Synthetic peptide
  Seed: YGSFSVTLDI (PMEL_HUMAN)
YESFSVTLDY

SEQ ID NO: 129695 - protein, 9 aa, Artificial Sequence
  Description of Artificial Sequence: Synthetic peptide
  Seed: HTMEVTVYH (PMEL_HUMAN)
HVMEVTVYH

SEQ ID NO: 129696 - protein, 9 aa, Artificial Sequence
  Description of Artificial Sequence: Synthetic peptide
  Seed: GQVPLIVGI (PMEL_HUMAN)
GMVPLIVGY

SEQ ID NO: 129697 - protein, 9 aa, Artificial Sequence
  Description of Artificial Sequence: Synthetic peptide
  Seed: ESAEILQAV (PMEL_HUMAN)
EVAEILQAH

SEQ ID NO: 129698 - protein, 10 aa, Artificial Sequence
  Description of Artificial Sequence: Synthetic peptide
  Seed: RQLYPEWTEA (PMEL_HUMAN)
RFLYPEWTEA

SEQ ID NO: 129699 - protein, 10 aa, Artificial Sequence
  Description of Artificial Sequence: Synthetic peptide
  Seed: ELTVSCQGGL (PMEL_HUMAN)
EATVSCQGGV

SEQ ID NO: 129700 - protein, 9 aa, Artificial Sequence
  Description of Artificial Sequence: Synthetic peptide
  Seed: SQKRSFVYV (PMEL_HUMAN)
SQKRSFVYA

SEQ ID NO: 129701 - protein, 11 aa, Artificial Sequence
  Description of Artificial Sequence: Synthetic peptide
  Seed: IPEPEGPDASS (PMEL_HUMAN)
IPEPEGPDASF

SEQ ID NO: 129702 - protein, 9 aa, Artificial Sequence
  Description of Artificial Sequence: Synthetic peptide
  Seed: LIVGILLVL (PMEL_HUMAN)
LVVGILLVY

SEQ ID NO: 129703 - protein, 9 aa, Artificial Sequence
  Description of Artificial Sequence: Synthetic peptide
  Seed: HTMEVTVYH (PMEL_HUMAN)
HLMEVTVYL

SEQ ID NO: 129704 - protein, 9 aa, Artificial Sequence
  Description of Artificial Sequence: Synthetic peptide
  Seed: RPTAEAPNT (PMEL_HUMAN)
RPTAEAPNA

SEQ ID NO: 129705 - protein, 9 aa, Artificial Sequence
  Description of Artificial Sequence: Synthetic peptide
  Seed: RTKAWNRQL (PMEL_HUMAN)
RTKAWNRQR

SEQ ID NO: 129706 - protein, 10 aa, Artificial Sequence
  Description of Artificial Sequence: Synthetic peptide
  Seed: ILKGGSGTYC (PMEL_HUMAN)
IMKGGSGTYY

SEQ ID NO: 129707 - protein, 11 aa, Artificial Sequence
  Description of Artificial Sequence: Synthetic peptide
  Seed: SAFTITDQVPF (PMEL_HUMAN)
SQFTITDQVPF

SEQ ID NO: 129708 - protein, 9 aa, Artificial Sequence
  Description of Artificial Sequence: Synthetic peptide
  Seed: RNQPLTFAL (PMEL_HUMAN)
RLQPLTFAF

SEQ ID NO: 129709 - protein, 10 aa, Artificial Sequence
  Description of Artificial Sequence: Synthetic peptide
  Seed: YRYGSFSVTL (PMEL_HUMAN)
YGYGSFSVTL

SEQ ID NO: 129710 - protein, 9 aa, Artificial Sequence
  Description of Artificial Sequence: Synthetic peptide
  Seed: AVVLASLIY (PMEL_HUMAN)
ATVLASLIY

SEQ ID NO: 129711 - protein, 9 aa, Artificial Sequence
  Description of Artificial Sequence: Synthetic peptide
  Seed: IMPGQEAGL (PMEL_HUMAN)
ISPGQEAGL

SEQ ID NO: 129712 - protein, 10 aa, Artificial Sequence
  Description of Artificial Sequence: Synthetic peptide
  Seed: SLIYRRRLMK (PMEL_HUMAN)
SMIYRRRLMK

SEQ ID NO: 129713 - protein, 9 aa, Artificial Sequence
  Description of Artificial Sequence: Synthetic peptide
  Seed: TIINGSQVW (PMEL_HUMAN)
TQINGSQVY

SEQ ID NO: 129714 - protein, 9 aa, Artificial Sequence
  Description of Artificial Sequence: Synthetic peptide
  Seed: VLASLIYRR (PMEL_HUMAN)
VMASLIYRK

SEQ ID NO: 129715 - protein, 10 aa, Artificial Sequence
  Description of Artificial Sequence: Synthetic peptide
  Seed: SVPQLPHSSS (PMEL_HUMAN)
SFPQLPHSSF

SEQ ID NO: 129716 - protein, 10 aa, Artificial Sequence
  Description of Artificial Sequence: Synthetic peptide
  Seed: QVPLDCVLYR (PMEL_HUMAN)
QTPLDCVLYK

SEQ ID NO: 129717 - protein, 9 aa, Artificial Sequence
  Description of Artificial Sequence: Synthetic peptide
  Seed: HSSSHWLRL (PMEL_HUMAN)
HRSSHWLRM

SEQ ID NO: 129718 - protein, 9 aa, Artificial Sequence
  Description of Artificial Sequence: Synthetic peptide
  Seed: ILKGGSGTY (PMEL_HUMAN)
IFKGGSGTL

SEQ ID NO: 129719 - protein, 9 aa, Artificial Sequence
  Description of Artificial Sequence: Synthetic peptide
  Seed: MLGTHTMEV (PMEL_HUMAN)
MMGTHTMEA

SEQ ID NO: 129720 - protein, 9 aa, Artificial Sequence
  Description of Artificial Sequence: Synthetic peptide
  Seed: STAPVQMPT (PMEL_HUMAN)
SLAPVQMPM

SEQ ID NO: 129721 - protein, 9 aa, Artificial Sequence
  Description of Artificial Sequence: Synthetic peptide
  Seed: SGLSIGTGR (PMEL_HUMAN)
SALSIGTGM

SEQ ID NO: 129722 - protein, 9 aa, Artificial Sequence
  Description of Artificial Sequence: Synthetic peptide
  Seed: AVIGALLAV (PMEL_HUMAN)
ALIGALLAM

SEQ ID NO: 129723 - protein, 10 aa, Artificial Sequence
  Description of Artificial Sequence: Synthetic peptide
  Seed: YGSFSVTLDI (PMEL_HUMAN)
YPSFSVTLDW

SEQ ID NO: 129724 - protein, 9 aa, Artificial Sequence
  Description of Artificial Sequence: Synthetic peptide
  Seed: LLDGTATLR (PMEL_HUMAN)
LADGTATLY

SEQ ID NO: 129725 - protein, 11 aa, Artificial Sequence
  Description of Artificial Sequence: Synthetic peptide
  Seed: TYLEPGPVTAQ (PMEL_HUMAN)
TYLEPGPVTAF

SEQ ID NO: 129726 - protein, 8 aa, Artificial Sequence
  Description of Artificial Sequence: Synthetic peptide
  Seed: FGDSSGTL (PMEL_HUMAN)
FIDSSGTF

SEQ ID NO: 129727 - protein, 9 aa, Artificial Sequence
  Description of Artificial Sequence: Synthetic peptide
  Seed: MAVVLASLI (PMEL_HUMAN)
MSVVLASLY

SEQ ID NO: 129728 - protein, 10 aa, Artificial Sequence
  Description of Artificial Sequence: Synthetic peptide
  Seed: SGTYCLNVSL (PMEL_HUMAN)
SDTYCLNVSV

SEQ ID NO: 129729 - protein, 10 aa, Artificial Sequence
  Description of Artificial Sequence: Synthetic peptide
  Seed: YRYGSFSVTL (PMEL_HUMAN)
YQYGSFSVTH

SEQ ID NO: 129730 - protein, 9 aa, Artificial Sequence
  Description of Artificial Sequence: Synthetic peptide
  Seed: TPAEVSIVV (PMEL_HUMAN)
THAEVSIVA

SEQ ID NO: 129731 - protein, 9 aa, Artificial Sequence
  Description of Artificial Sequence: Synthetic peptide
  Seed: ASFSIALNF (PMEL_HUMAN)
AMFSIALNW

SEQ ID NO: 129732 - protein, 9 aa, Artificial Sequence
  Description of Artificial Sequence: Synthetic peptide
  Seed: FTITDQVPF (PMEL_HUMAN)
FCITDQVPF

SEQ ID NO: 129733 - protein, 9 aa, Artificial Sequence
  Description of Artificial Sequence: Synthetic peptide
  Seed: WQVLGGPVS (PMEL_HUMAN)
WIVLGGPVY

SEQ ID NO: 129734 - protein, 9 aa, Artificial Sequence
  Description of Artificial Sequence: Synthetic peptide
  Seed: CPIGENSPL (PMEL_HUMAN)
CVIGENSPY

SEQ ID NO: 129735 - protein, 9 aa, Artificial Sequence
  Description of Artificial Sequence: Synthetic peptide
  Seed: THTMEVTVY (PMEL_HUMAN)
TQTMEVTVF

SEQ ID NO: 129736 - protein, 10 aa, Artificial Sequence
  Description of Artificial Sequence: Synthetic peptide
  Seed: RALDGGNKHF (PMEL_HUMAN)
RILDGGNKHW

SEQ ID NO: 129737 - protein, 9 aa, Artificial Sequence
  Description of Artificial Sequence: Synthetic peptide
  Seed: ANASFSIAL (PMEL_HUMAN)
AIASFSIAL

SEQ ID NO: 129738 - protein, 9 aa, Artificial Sequence
  Description of Artificial Sequence: Synthetic peptide
  Seed: VSNDGPTLI (PMEL_HUMAN)
VRNDGPTLV

SEQ ID NO: 129739 - protein, 11 aa, Artificial Sequence
  Description of Artificial Sequence: Synthetic peptide
  Seed: MPTAESTGMTP (PMEL_HUMAN)
MPTAESTGMTL

SEQ ID NO: 129740 - protein, 9 aa, Artificial Sequence
  Description of Artificial Sequence: Synthetic peptide
  Seed: TTPGQAPTA (PMEL_HUMAN)
TIPGQAPTL

SEQ ID NO: 129741 - protein, 10 aa, Artificial Sequence
  Description of Artificial Sequence: Synthetic peptide
  Seed: SVPQLPHSSS (PMEL_HUMAN)
SHPQLPHSSF

SEQ ID NO: 129742 - protein, 9 aa, Artificial Sequence
  Description of Artificial Sequence: Synthetic peptide
  Seed: TTDGHRPTA (PMEL_HUMAN)
TNDGHRPTL

SEQ ID NO: 129743 - protein, 9 aa, Artificial Sequence
  Description of Artificial Sequence: Synthetic peptide
  Seed: VVLASLIYR (PMEL_HUMAN)
VWLASLIYR

SEQ ID NO: 129744 - protein, 10 aa, Artificial Sequence
  Description of Artificial Sequence: Synthetic peptide
  Seed: YVPLAHSSSA (PMEL_HUMAN)
YPPLAHSSSF

SEQ ID NO: 129745 - protein, 11 aa, Artificial Sequence
  Description of Artificial Sequence: Synthetic peptide
  Seed: YLAEADLSYTW (PMEL_HUMAN)
YPAEADLSYTF

SEQ ID NO: 129746 - protein, 9 aa, Artificial Sequence
  Description of Artificial Sequence: Synthetic peptide
  Seed: RYGSFSVTL (PMEL_HUMAN)
RSGSFSVTF

SEQ ID NO: 129747 - protein, 10 aa, Artificial Sequence
  Description of Artificial Sequence: Synthetic peptide
  Seed: RSFVYVWKTW (PMEL_HUMAN)
RVFVYVWKTI

SEQ ID NO: 129748 - protein, 9 aa, Artificial Sequence
  Description of Artificial Sequence: Synthetic peptide
  Seed: SQKRSFVYV (PMEL_HUMAN)
SIKRSFVYV

SEQ ID NO: 129749 - protein, 9 aa, Artificial Sequence
  Description of Artificial Sequence: Synthetic peptide
  Seed: VQMPTAEST (PMEL_HUMAN)
VLMPTAESY

SEQ ID NO: 129750 - protein, 11 aa, Artificial Sequence
  Description of Artificial Sequence: Synthetic peptide
  Seed: RRGSRSYVPLA (PMEL_HUMAN)
RHGSRSYVPLK

SEQ ID NO: 129751 - protein, 10 aa, Artificial Sequence
  Description of Artificial Sequence: Synthetic peptide
  Seed: MTPAEVSIVV (PMEL_HUMAN)
MFPAEVSIVH

SEQ ID NO: 129752 - protein, 10 aa, Artificial Sequence
  Description of Artificial Sequence: Synthetic peptide
  Seed: RGSRSYVPLA (PMEL_HUMAN)
RWSRSYVPLS

SEQ ID NO: 129753 - protein, 9 aa, Artificial Sequence
  Description of Artificial Sequence: Synthetic peptide
  Seed: KVSNDGPTL (PMEL_HUMAN)
KVSNDGPTY

SEQ ID NO: 129754 - protein, 10 aa, Artificial Sequence
  Description of Artificial Sequence: Synthetic peptide
  Seed: MKQDFSVPQL (PMEL_HUMAN)
MHQDFSVPQM

SEQ ID NO: 129755 - protein, 9 aa, Artificial Sequence
  Description of Artificial Sequence: Synthetic peptide
  Seed: SGEGDAFEL (PMEL_HUMAN)
SYEGDAFEM

SEQ ID NO: 129756 - protein, 9 aa, Artificial Sequence
  Description of Artificial Sequence: Synthetic peptide
  Seed: DAFELTVSC (PMEL_HUMAN)
DMFELTVSF

SEQ ID NO: 129757 - protein, 9 aa, Artificial Sequence
  Description of Artificial Sequence: Synthetic peptide
  Seed: AEPSGTTSV (PMEL_HUMAN)
AGPSGTTSY

SEQ ID NO: 129758 - protein, 9 aa, Artificial Sequence
  Description of Artificial Sequence: Synthetic peptide
  Seed: VQVPTTEVI (PMEL_HUMAN)
VMVPTTEVF

SEQ ID NO: 129759 - protein, 9 aa, Artificial Sequence
  Description of Artificial Sequence: Synthetic peptide
  Seed: GQVPLIVGI (PMEL_HUMAN)
GSVPLIVGI

SEQ ID NO: 129760 - protein, 11 aa, Artificial Sequence
  Description of Artificial Sequence: Synthetic peptide
  Seed: YVPLAHSSSAF (PMEL_HUMAN)
YAPLAHSSSAF

SEQ ID NO: 129761 - protein, 9 aa, Artificial Sequence
  Description of Artificial Sequence: Synthetic peptide
  Seed: TTDGHRPTA (PMEL_HUMAN)
TTDGHRPTY

SEQ ID NO: 129762 - protein, 9 aa, Artificial Sequence
  Description of Artificial Sequence: Synthetic peptide
  Seed: TIINGSQVW (PMEL_HUMAN)
TLINGSQVL

SEQ ID NO: 129763 - protein, 9 aa, Artificial Sequence
  Description of Artificial Sequence: Synthetic peptide
  Seed: VISTAPVQM (PMEL_HUMAN)
VRSTAPVQY

SEQ ID NO: 129764 - protein, 11 aa, Artificial Sequence
  Description of Artificial Sequence: Synthetic peptide
  Seed: FSVTLDIVQGI (PMEL_HUMAN)
FMVTLDIVQGV

SEQ ID NO: 129765 - protein, 9 aa, Artificial Sequence
  Description of Artificial Sequence: Synthetic peptide
  Seed: TLIGANASF (PMEL_HUMAN)
TTIGANASY

SEQ ID NO: 129766 - protein, 9 aa, Artificial Sequence
  Description of Artificial Sequence: Synthetic peptide
  Seed: LNFPGSQKV (PMEL_HUMAN)
LGFPGSQKM

SEQ ID NO: 129767 - protein, 10 aa, Artificial Sequence
  Description of Artificial Sequence: Synthetic peptide
  Seed: TPEATGMTPA (PMEL_HUMAN)
TPEATGMTPI

SEQ ID NO: 129768 - protein, 9 aa, Artificial Sequence
  Description of Artificial Sequence: Synthetic peptide
  Seed: KQDFSVPQL (PMEL_HUMAN)
KTDFSVPQF

SEQ ID NO: 129769 - protein, 9 aa, Artificial Sequence
  Description of Artificial Sequence: Synthetic peptide
  Seed: CPSGSWSQK (PMEL_HUMAN)
CVSGSWSQK

SEQ ID NO: 129770 - protein, 9 aa, Artificial Sequence
  Description of Artificial Sequence: Synthetic peptide
  Seed: HSSSHWLRL (PMEL_HUMAN)
HTSSHWLRK

SEQ ID NO: 129771 - protein, 9 aa, Artificial Sequence
  Description of Artificial Sequence: Synthetic peptide
  Seed: YLEPGPVTA (PMEL_HUMAN)
YNEPGPVTV

SEQ ID NO: 129772 - protein, 9 aa, Artificial Sequence
  Description of Artificial Sequence: Synthetic peptide
  Seed: ASFSIALNF (PMEL_HUMAN)
AIFSIALNL

SEQ ID NO: 129773 - protein, 9 aa, Artificial Sequence
  Description of Artificial Sequence: Synthetic peptide
  Seed: QAAIPLTSC (PMEL_HUMAN)
QVAIPLTSY

SEQ ID NO: 129774 - protein, 10 aa, Artificial Sequence
  Description of Artificial Sequence: Synthetic peptide
  Seed: EVMGTTLAEM (PMEL_HUMAN)
ESMGTTLAEW

SEQ ID NO: 129775 - protein, 9 aa, Artificial Sequence
  Description of Artificial Sequence: Synthetic peptide
  Seed: SAFTITDQV (PMEL_HUMAN)
SSFTITDQI

SEQ ID NO: 129776 - protein, 9 aa, Artificial Sequence
  Description of Artificial Sequence: Synthetic peptide
  Seed: TTDGHRPTA (PMEL_HUMAN)
TQDGHRPTM

SEQ ID NO: 129777 - protein, 10 aa, Artificial Sequence
  Description of Artificial Sequence: Synthetic peptide
  Seed: TLAEMSTPEA (PMEL_HUMAN)
TMAEMSTPEA

SEQ ID NO: 129778 - protein, 11 aa, Artificial Sequence
  Description of Artificial Sequence: Synthetic peptide
  Seed: KVLPDGQVIWV (PMEL_HUMAN)
KSLPDGQVIWM

SEQ ID NO: 129779 - protein, 10 aa, Artificial Sequence
  Description of Artificial Sequence: Synthetic peptide
  Seed: LVLMAVVLAS (PMEL_HUMAN)
LCLMAVVLAV

SEQ ID NO: 129780 - protein, 10 aa, Artificial Sequence
  Description of Artificial Sequence: Synthetic peptide
  Seed: GMTPAEVSIV (PMEL_HUMAN)
GLTPAEVSIV

SEQ ID NO: 129781 - protein, 9 aa, Artificial Sequence
  Description of Artificial Sequence: Synthetic peptide
  Seed: SVPQLPHSS (PMEL_HUMAN)
SMPQLPHSM

SEQ ID NO: 129782 - protein, 10 aa, Artificial Sequence
  Description of Artificial Sequence: Synthetic peptide
  Seed: KTWGQYWQVL (PMEL_HUMAN)
KMWGQYWQVS

SEQ ID NO: 129783 - protein, 8 aa, Artificial Sequence
  Description of Artificial Sequence: Synthetic peptide
  Seed: HTMEVTVY (PMEL_HUMAN)
HSMEVTVM

SEQ ID NO: 129784 - protein, 9 aa, Artificial Sequence
  Description of Artificial Sequence: Synthetic peptide
  Seed: EVVGTTPGQ (PMEL_HUMAN)
EVVGTTPGK

SEQ ID NO: 129785 - protein, 10 aa, Artificial Sequence
  Description of Artificial Sequence: Synthetic peptide
  Seed: GYLAEADLSY (PMEL_HUMAN)
GVLAEADLSY

SEQ ID NO: 129786 - protein, 10 aa, Artificial Sequence
  Description of Artificial Sequence: Synthetic peptide
  Seed: MPTAESTGMT (PMEL_HUMAN)
MYTAESTGML

SEQ ID NO: 129787 - protein, 10 aa, Artificial Sequence
  Description of Artificial Sequence: Synthetic peptide
  Seed: SSHWLRLPRI (PMEL_HUMAN)
SSHWLRLPRK

SEQ ID NO: 129788 - protein, 10 aa, Artificial Sequence
  Description of Artificial Sequence: Synthetic peptide
  Seed: SWSQKRSFVY (PMEL_HUMAN)
STSQKRSFVW

SEQ ID NO: 129789 - protein, 10 aa, Artificial Sequence
  Description of Artificial Sequence: Synthetic peptide
  Seed: RQLYPEWTEA (PMEL_HUMAN)
RHLYPEWTEL

SEQ ID NO: 129790 - protein, 11 aa, Artificial Sequence
  Description of Artificial Sequence: Synthetic peptide
  Seed: YLAEADLSYTW (PMEL_HUMAN)
YMAEADLSYTT

SEQ ID NO: 129791 - protein, 10 aa, Artificial Sequence
  Description of Artificial Sequence: Synthetic peptide
  Seed: ESITGSLGPL (PMEL_HUMAN)
ETITGSLGPK

SEQ ID NO: 129792 - protein, 9 aa, Artificial Sequence
  Description of Artificial Sequence: Synthetic peptide
  Seed: ITDQVPFSV (PMEL_HUMAN)
ICDQVPFSL

SEQ ID NO: 129793 - protein, 9 aa, Artificial Sequence
  Description of Artificial Sequence: Synthetic peptide
  Seed: MAVVLASLI (PMEL_HUMAN)
MEVVLASLY

SEQ ID NO: 129794 - protein, 10 aa, Artificial Sequence
  Description of Artificial Sequence: Synthetic peptide
  Seed: MTPAEVSIVV (PMEL_HUMAN)
MQPAEVSIVT

SEQ ID NO: 129795 - protein, 10 aa, Artificial Sequence
  Description of Artificial Sequence: Synthetic peptide
  Seed: QVIWVNNTII (PMEL_HUMAN)
QTIWVNNTIV

SEQ ID NO: 129796 - protein, 9 aa, Artificial Sequence
  Description of Artificial Sequence: Synthetic peptide
  Seed: RTKAWNRQL (PMEL_HUMAN)
RTKAWNRQG

SEQ ID NO: 129797 - protein, 9 aa, Artificial Sequence
  Description of Artificial Sequence: Synthetic peptide
  Seed: EKVPVSEVM (PMEL_HUMAN)
EMVPVSEVF

SEQ ID NO: 129798 - protein, 9 aa, Artificial Sequence
  Description of Artificial Sequence: Synthetic peptide
  Seed: MLGTHTMEV (PMEL_HUMAN)
MAGTHTMEI

SEQ ID NO: 129799 - protein, 9 aa, Artificial Sequence
  Description of Artificial Sequence: Synthetic peptide
  Seed: KHFLRNQPL (PMEL_HUMAN)
KFFLRNQPF

SEQ ID NO: 129800 - protein, 10 aa, Artificial Sequence
  Description of Artificial Sequence: Synthetic peptide
  Seed: MAVVLASLIY (PMEL_HUMAN)
MMVVLASLIY

SEQ ID NO: 129801 - protein, 9 aa, Artificial Sequence
  Description of Artificial Sequence: Synthetic peptide
  Seed: YLEPGPVTA (PMEL_HUMAN)
YREPGPVTL

SEQ ID NO: 129802 - protein, 11 aa, Artificial Sequence
  Description of Artificial Sequence: Synthetic peptide
  Seed: VQMPTAESTGM (PMEL_HUMAN)
VQMPTAESTGF

SEQ ID NO: 129803 - protein, 8 aa, Artificial Sequence
  Description of Artificial Sequence: Synthetic peptide
  Seed: SNDGPTLI (PMEL_HUMAN)
SYDGPTLF

SEQ ID NO: 129804 - protein, 9 aa, Artificial Sequence
  Description of Artificial Sequence: Synthetic peptide
  Seed: IYRRRLMKQ (PMEL_HUMAN)
ITRRRLMKK

SEQ ID NO: 129805 - protein, 10 aa, Artificial Sequence
  Description of Artificial Sequence: Synthetic peptide
  Seed: VPFSVSVSQL (PMEL_HUMAN)
VPFSVSVSQW

SEQ ID NO: 129806 - protein, 9 aa, Artificial Sequence
  Description of Artificial Sequence: Synthetic peptide
  Seed: LADTNSLAV (PMEL_HUMAN)
LPDTNSLAF

SEQ ID NO: 129807 - protein, 8 aa, Artificial Sequence
  Description of Artificial Sequence: Synthetic peptide
  Seed: HTMEVTVY (PMEL_HUMAN)
HPMEVTVF

SEQ ID NO: 129808 - protein, 10 aa, Artificial Sequence
  Description of Artificial Sequence: Synthetic peptide
  Seed: AVIGALLAVG (PMEL_HUMAN)
AMIGALLAVH

SEQ ID NO: 129809 - protein, 10 aa, Artificial Sequence
  Description of Artificial Sequence: Synthetic peptide
  Seed: RALVVTHTYL (PMEL_HUMAN)
RNLVVTHTYY

SEQ ID NO: 129810 - protein, 10 aa, Artificial Sequence
  Description of Artificial Sequence: Synthetic peptide
  Seed: YLAEADLSYT (PMEL_HUMAN)
YIAEADLSYI

SEQ ID NO: 129811 - protein, 9 aa, Artificial Sequence
  Description of Artificial Sequence: Synthetic peptide
  Seed: VWKTWGQYW (PMEL_HUMAN)
VYKTWGQYM

SEQ ID NO: 129812 - protein, 9 aa, Artificial Sequence
  Description of Artificial Sequence: Synthetic peptide
  Seed: LPDGQVIWV (PMEL_HUMAN)
LLDGQVIWL

SEQ ID NO: 129813 - protein, 8 aa, Artificial Sequence
  Description of Artificial Sequence: Synthetic peptide
  Seed: RELPIPEP (PMEL_HUMAN)
RELPIPET

SEQ ID NO: 129814 - protein, 10 aa, Artificial Sequence
  Description of Artificial Sequence: Synthetic peptide
  Seed: IALNFPGSQK (PMEL_HUMAN)
IVLNFPGSQK

SEQ ID NO: 129815 - protein, 9 aa, Artificial Sequence
  Description of Artificial Sequence: Synthetic peptide
  Seed: SPLLSGQQV (PMEL_HUMAN)
SALLSGQQF

SEQ ID NO: 129816 - protein, 10 aa, Artificial Sequence
  Description of Artificial Sequence: Synthetic peptide
  Seed: AMLGTHTMEV (PMEL_HUMAN)
AYLGTHTMEI

SEQ ID NO: 129817 - protein, 10 aa, Artificial Sequence
  Description of Artificial Sequence: Synthetic peptide
  Seed: SLIYRRRLMK (PMEL_HUMAN)
SQIYRRRLMR

SEQ ID NO: 129818 - protein, 11 aa, Artificial Sequence
  Description of Artificial Sequence: Synthetic peptide
  Seed: VSLADTNSLAV (PMEL_HUMAN)
VTLADTNSLAW

SEQ ID NO: 129819 - protein, 9 aa, Artificial Sequence
  Description of Artificial Sequence: Synthetic peptide
  Seed: ILKGGSGTY (PMEL_HUMAN)
IAKGGSGTH

SEQ ID NO: 129820 - protein, 9 aa, Artificial Sequence
  Description of Artificial Sequence: Synthetic peptide
  Seed: FLRNQPLTF (PMEL_HUMAN)
FTRNQPLTI

SEQ ID NO: 129821 - protein, 9 aa, Artificial Sequence
  Description of Artificial Sequence: Synthetic peptide
  Seed: RLMKQDFSV (PMEL_HUMAN)
RKMKQDFSV

SEQ ID NO: 129822 - protein, 10 aa, Artificial Sequence
  Description of Artificial Sequence: Synthetic peptide
  Seed: LGQVPLIVGI (PMEL_HUMAN)
LGQVPLIVGV

SEQ ID NO: 129823 - protein, 9 aa, Artificial Sequence
  Description of Artificial Sequence: Synthetic peptide
  Seed: VSVSQLRAL (PMEL_HUMAN)
VQVSQLRAI

SEQ ID NO: 129824 - protein, 9 aa, Artificial Sequence
  Description of Artificial Sequence: Synthetic peptide
  Seed: LHLAVIGAL (PMEL_HUMAN)
LRLAVIGAF

SEQ ID NO: 129825 - protein, 10 aa, Artificial Sequence
  Description of Artificial Sequence: Synthetic peptide
  Seed: MPTAESTGMT (PMEL_HUMAN)
MFTAESTGML

SEQ ID NO: 129826 - protein, 10 aa, Artificial Sequence
  Description of Artificial Sequence: Synthetic peptide
  Seed: MTPAEVSIVV (PMEL_HUMAN)
MMPAEVSIVV

SEQ ID NO: 129827 - protein, 9 aa, Artificial Sequence
  Description of Artificial Sequence: Synthetic peptide
  Seed: LADTNSLAV (PMEL_HUMAN)
LPDTNSLAY

SEQ ID NO: 129828 - protein, 9 aa, Artificial Sequence
  Description of Artificial Sequence: Synthetic peptide
  Seed: LTSCGSSPV (PMEL_HUMAN)
LMSCGSSPV

SEQ ID NO: 129829 - protein, 9 aa, Artificial Sequence
  Description of Artificial Sequence: Synthetic peptide
  Seed: EVVGTTPGQ (PMEL_HUMAN)
EVVGTTPGY

SEQ ID NO: 129830 - protein, 10 aa, Artificial Sequence
  Description of Artificial Sequence: Synthetic peptide
  Seed: MTPAEVSIVV (PMEL_HUMAN)
MWPAEVSIVT

SEQ ID NO: 129831 - protein, 9 aa, Artificial Sequence
  Description of Artificial Sequence: Synthetic peptide
  Seed: AAIPLTSCG (PMEL_HUMAN)
AAIPLTSCM

SEQ ID NO: 129832 - protein, 9 aa, Artificial Sequence
  Description of Artificial Sequence: Synthetic peptide
  Seed: KQDFSVPQL (PMEL_HUMAN)
KRDFSVPQF

SEQ ID NO: 129833 - protein, 10 aa, Artificial Sequence
  Description of Artificial Sequence: Synthetic peptide
  Seed: SQKRSFVYVW (PMEL_HUMAN)
SFKRSFVYVF

SEQ ID NO: 129834 - protein, 9 aa, Artificial Sequence
  Description of Artificial Sequence: Synthetic peptide
  Seed: VVLSGTTAA (PMEL_HUMAN)
VMLSGTTAM

SEQ ID NO: 129835 - protein, 9 aa, Artificial Sequence
  Description of Artificial Sequence: Synthetic peptide
  Seed: SVPQLPHSS (PMEL_HUMAN)
SMPQLPHSI

SEQ ID NO: 129836 - protein, 9 aa, Artificial Sequence
  Description of Artificial Sequence: Synthetic peptide
  Seed: ALLAVGATK (PMEL_HUMAN)
AVLAVGATR

SEQ ID NO: 129837 - protein, 10 aa, Artificial Sequence
  Description of Artificial Sequence: Synthetic peptide
  Seed: EVMGTTLAEM (PMEL_HUMAN)
ESMGTTLAEA

SEQ ID NO: 129838 - protein, 10 aa, Artificial Sequence
  Description of Artificial Sequence: Synthetic peptide
  Seed: VLMAVVLASL (PMEL_HUMAN)
VHMAVVLASA

SEQ ID NO: 129839 - protein, 9 aa, Artificial Sequence
  Description of Artificial Sequence: Synthetic peptide
  Seed: LASLIYRRR (PMEL_HUMAN)
LMSLIYRRR

SEQ ID NO: 129840 - protein, 9 aa, Artificial Sequence
  Description of Artificial Sequence: Synthetic peptide
  Seed: VPFSVSVSQ (PMEL_HUMAN)
VPFSVSVSI

SEQ ID NO: 129841 - protein, 10 aa, Artificial Sequence
  Description of Artificial Sequence: Synthetic peptide
  Seed: AEADLSYTWD (PMEL_HUMAN)
AEADLSYTWS

SEQ ID NO: 129842 - protein, 8 aa, Artificial Sequence
  Description of Artificial Sequence: Synthetic peptide
  Seed: LADTNSLA (PMEL_HUMAN)
LTDTNSLM

SEQ ID NO: 129843 - protein, 10 aa, Artificial Sequence
  Description of Artificial Sequence: Synthetic peptide
  Seed: KRQVPLDCVL (PMEL_HUMAN)
KKQVPLDCVY

SEQ ID NO: 129844 - protein, 9 aa, Artificial Sequence
  Description of Artificial Sequence: Synthetic peptide
  Seed: LLDGTATLR (PMEL_HUMAN)
LADGTATLL

SEQ ID NO: 129845 - protein, 10 aa, Artificial Sequence
  Description of Artificial Sequence: Synthetic peptide
  Seed: VLMAVVLASL (PMEL_HUMAN)
VTMAVVLASY

SEQ ID NO: 129846 - protein, 10 aa, Artificial Sequence
  Description of Artificial Sequence: Synthetic peptide
  Seed: SLIYRRRLMK (PMEL_HUMAN)
SHIYRRRLMK

SEQ ID NO: 129847 - protein, 9 aa, Artificial Sequence
  Description of Artificial Sequence: Synthetic peptide
  Seed: SSHWLRLPR (PMEL_HUMAN)
STHWLRLPY

SEQ ID NO: 129848 - protein, 10 aa, Artificial Sequence
  Description of Artificial Sequence: Synthetic peptide
  Seed: LQLHDPSGYL (PMEL_HUMAN)
LLLHDPSGYL

SEQ ID NO: 129849 - protein, 10 aa, Artificial Sequence
  Description of Artificial Sequence: Synthetic peptide
  Seed: LIGANASFSI (PMEL_HUMAN)
LTGANASFSV

SEQ ID NO: 129850 - protein, 9 aa, Artificial Sequence
  Description of Artificial Sequence: Synthetic peptide
  Seed: MAVVLASLI (PMEL_HUMAN)
MHVVLASLF

SEQ ID NO: 129851 - protein, 9 aa, Artificial Sequence
  Description of Artificial Sequence: Synthetic peptide
  Seed: LNFPGSQKV (PMEL_HUMAN)
LIFPGSQKV

SEQ ID NO: 129852 - protein, 11 aa, Artificial Sequence
  Description of Artificial Sequence: Synthetic peptide
  Seed: RRLMKQDFSVP (PMEL_HUMAN)
RRLMKQDFSVM

SEQ ID NO: 129853 - protein, 10 aa, Artificial Sequence
  Description of Artificial Sequence: Synthetic peptide
  Seed: MTPAEVSIVV (PMEL_HUMAN)
MPPAEVSIVL

SEQ ID NO: 129854 - protein, 9 aa, Artificial Sequence
  Description of Artificial Sequence: Synthetic peptide
  Seed: GQVPTTEVV (PMEL_HUMAN)
GHVPTTEVY

SEQ ID NO: 129855 - protein, 10 aa, Artificial Sequence
  Description of Artificial Sequence: Synthetic peptide
  Seed: MTPAEVSIVV (PMEL_HUMAN)
MMPAEVSIVH

SEQ ID NO: 129856 - protein, 9 aa, Artificial Sequence
  Description of Artificial Sequence: Synthetic peptide
  Seed: DQVPFSVSV (PMEL_HUMAN)
DEVPFSVSL

SEQ ID NO: 129857 - protein, 9 aa, Artificial Sequence
  Description of Artificial Sequence: Synthetic peptide
  Seed: GTATLRLVK (PMEL_HUMAN)
GIATLRLVR

SEQ ID NO: 129858 - protein, 9 aa, Artificial Sequence
  Description of Artificial Sequence: Synthetic peptide
  Seed: AVIGALLAV (PMEL_HUMAN)
AMIGALLAR

SEQ ID NO: 129859 - protein, 9 aa, Artificial Sequence
  Description of Artificial Sequence: Synthetic peptide
  Seed: KVSNDGPTL (PMEL_HUMAN)
KISNDGPTW

SEQ ID NO: 129860 - protein, 9 aa, Artificial Sequence
  Description of Artificial Sequence: Synthetic peptide
  Seed: AEPSGTTSV (PMEL_HUMAN)
AMPSGTTSA

SEQ ID NO: 129861 - protein, 10 aa, Artificial Sequence
  Description of Artificial Sequence: Synthetic peptide
  Seed: SCPIGENSPL (PMEL_HUMAN)
SEPIGENSPM

SEQ ID NO: 129862 - protein, 8 aa, Artificial Sequence
  Description of Artificial Sequence: Synthetic peptide
  Seed: LNFPGSQK (PMEL_HUMAN)
LAFPGSQV

SEQ ID NO: 129863 - protein, 9 aa, Artificial Sequence
  Description of Artificial Sequence: Synthetic peptide
  Seed: VLMAVVLAS (PMEL_HUMAN)
VVMAVVLAA

SEQ ID NO: 129864 - protein, 10 aa, Artificial Sequence
  Description of Artificial Sequence: Synthetic peptide
  Seed: MAVVLASLIY (PMEL_HUMAN)
MSVVLASLIK

SEQ ID NO: 129865 - protein, 10 aa, Artificial Sequence
  Description of Artificial Sequence: Synthetic peptide
  Seed: MSTESITGSL (PMEL_HUMAN)
MTTESITGSW

SEQ ID NO: 129866 - protein, 10 aa, Artificial Sequence
  Description of Artificial Sequence: Synthetic peptide
  Seed: GQVPLIVGIL (PMEL_HUMAN)
GLVPLIVGIV

SEQ ID NO: 129867 - protein, 9 aa, Artificial Sequence
  Description of Artificial Sequence: Synthetic peptide
  Seed: YLAEADLSY (PMEL_HUMAN)
YEAEADLSY

SEQ ID NO: 129868 - protein, 11 aa, Artificial Sequence
  Description of Artificial Sequence: Synthetic peptide
  Seed: AEMSTPEATGM (PMEL_HUMAN)
AEMSTPEATGY

SEQ ID NO: 129869 - protein, 9 aa, Artificial Sequence
  Description of Artificial Sequence: Synthetic peptide
  Seed: LTSCGSSPV (PMEL_HUMAN)
LISCGSSPV

SEQ ID NO: 129870 - protein, 11 aa, Artificial Sequence
  Description of Artificial Sequence: Synthetic peptide
  Seed: RYGSFSVTLDI (PMEL_HUMAN)
RGGSFSVTLDF

SEQ ID NO: 129871 - protein, 9 aa, Artificial Sequence
  Description of Artificial Sequence: Synthetic peptide
  Seed: GSWSQKRSF (PMEL_HUMAN)
GQWSQKRSM

SEQ ID NO: 129872 - protein, 10 aa, Artificial Sequence
  Description of Artificial Sequence: Synthetic peptide
  Seed: YGSFSVTLDI (PMEL_HUMAN)
YRSFSVTLDF

SEQ ID NO: 129873 - protein, 8 aa, Artificial Sequence
  Description of Artificial Sequence: Synthetic peptide
  Seed: VLPDGQVI (PMEL_HUMAN)
VVPDGQVL

SEQ ID NO: 129874 - protein, 9 aa, Artificial Sequence
  Description of Artificial Sequence: Synthetic peptide
  Seed: VVLSGTTAA (PMEL_HUMAN)
VMLSGTTAY

SEQ ID NO: 129875 - protein, 10 aa, Artificial Sequence
  Description of Artificial Sequence: Synthetic peptide
  Seed: VVLASLIYRR (PMEL_HUMAN)
VRLASLIYRK

SEQ ID NO: 129876 - protein, 9 aa, Artificial Sequence
  Description of Artificial Sequence: Synthetic peptide
  Seed: VVLSGTTAA (PMEL_HUMAN)
VSLSGTTAH

SEQ ID NO: 129877 - protein, 10 aa, Artificial Sequence
  Description of Artificial Sequence: Synthetic peptide
  Seed: APNTTAGQVP (PMEL_HUMAN)
APNTTAGQVL

SEQ ID NO: 129878 - protein, 9 aa, Artificial Sequence
  Description of Artificial Sequence: Synthetic peptide
  Seed: ESAEILQAV (PMEL_HUMAN)
ETAEILQAM

SEQ ID NO: 129879 - protein, 10 aa, Artificial Sequence
  Description of Artificial Sequence: Synthetic peptide
  Seed: SLIYRRRLMK (PMEL_HUMAN)
SSIYRRRLMR

SEQ ID NO: 129880 - protein, 9 aa, Artificial Sequence
  Description of Artificial Sequence: Synthetic peptide
  Seed: YHRRGSRSY (PMEL_HUMAN)
YYRRGSRSM

SEQ ID NO: 129881 - protein, 9 aa, Artificial Sequence
  Description of Artificial Sequence: Synthetic peptide
  Seed: YLAEADLSY (PMEL_HUMAN)
YSAEADLSV

SEQ ID NO: 129882 - protein, 9 aa, Artificial Sequence
  Description of Artificial Sequence: Synthetic peptide
  Seed: VVLSGTTAA (PMEL_HUMAN)
VMLSGTTAT

SEQ ID NO: 129883 - protein, 9 aa, Artificial Sequence
  Description of Artificial Sequence: Synthetic peptide
  Seed: ITDQVPFSV (PMEL_HUMAN)
IADQVPFSA

SEQ ID NO: 129884 - protein, 10 aa, Artificial Sequence
  Description of Artificial Sequence: Synthetic peptide
  Seed: MKQDFSVPQL (PMEL_HUMAN)
MTQDFSVPQV

SEQ ID NO: 129885 - protein, 10 aa, Artificial Sequence
  Description of Artificial Sequence: Synthetic peptide
  Seed: LVLMAVVLAS (PMEL_HUMAN)
LDLMAVVLAI

SEQ ID NO: 129886 - protein, 10 aa, Artificial Sequence
  Description of Artificial Sequence: Synthetic peptide
  Seed: LGQVPLIVGI (PMEL_HUMAN)
LNQVPLIVGV

SEQ ID NO: 129887 - protein, 10 aa, Artificial Sequence
  Description of Artificial Sequence: Synthetic peptide
  Seed: VLMAVVLASL (PMEL_HUMAN)
VNMAVVLASL

SEQ ID NO: 129888 - protein, 10 aa, Artificial Sequence
  Description of Artificial Sequence: Synthetic peptide
  Seed: TAAQVTTTEW (PMEL_HUMAN)
TTAQVTTTEF

SEQ ID NO: 129889 - protein, 9 aa, Artificial Sequence
  Description of Artificial Sequence: Synthetic peptide
  Seed: ALDGGNKHF (PMEL_HUMAN)
ALDGGNKHI

SEQ ID NO: 129890 - protein, 10 aa, Artificial Sequence
  Description of Artificial Sequence: Synthetic peptide
  Seed: LAVVSTQLIM (PMEL_HUMAN)
LVVVSTQLIW

SEQ ID NO: 129891 - protein, 10 aa, Artificial Sequence
  Description of Artificial Sequence: Synthetic peptide
  Seed: RRLMKQDFSV (PMEL_HUMAN)
RRLMKQDFSF

SEQ ID NO: 129892 - protein, 9 aa, Artificial Sequence
  Description of Artificial Sequence: Synthetic peptide
  Seed: AAQVTTTEW (PMEL_HUMAN)
AVQVTTTEW

SEQ ID NO: 129893 - protein, 9 aa, Artificial Sequence
  Description of Artificial Sequence: Synthetic peptide
  Seed: ILKGGSGTY (PMEL_HUMAN)
IRKGGSGTY

SEQ ID NO: 129894 - protein, 9 aa, Artificial Sequence
  Description of Artificial Sequence: Synthetic peptide
  Seed: ESAEILQAV (PMEL_HUMAN)
EGAEILQAV

SEQ ID NO: 129895 - protein, 10 aa, Artificial Sequence
  Description of Artificial Sequence: Synthetic peptide
  Seed: RQLRTKAWNR (PMEL_HUMAN)
RMLRTKAWNR

SEQ ID NO: 129896 - protein, 10 aa, Artificial Sequence
  Description of Artificial Sequence: Synthetic peptide
  Seed: RNQDWLGVSR (PMEL_HUMAN)
RSQDWLGVSR

SEQ ID NO: 129897 - protein, 9 aa, Artificial Sequence
  Description of Artificial Sequence: Synthetic peptide
  Seed: MAVVLASLI (PMEL_HUMAN)
MTVVLASLM

SEQ ID NO: 129898 - protein, 10 aa, Artificial Sequence
  Description of Artificial Sequence: Synthetic peptide
  Seed: RQLRTKAWNR (PMEL_HUMAN)
RKLRTKAWNR

SEQ ID NO: 129899 - protein, 10 aa, Artificial Sequence
  Description of Artificial Sequence: Synthetic peptide
  Seed: LVLMAVVLAS (PMEL_HUMAN)
LPLMAVVLAV

SEQ ID NO: 129900 - protein, 9 aa, Artificial Sequence
  Description of Artificial Sequence: Synthetic peptide
  Seed: GSSPVPGTT (PMEL_HUMAN)
GVSPVPGTY

SEQ ID NO: 129901 - protein, 9 aa, Artificial Sequence
  Description of Artificial Sequence: Synthetic peptide
  Seed: MSTPEATGM (PMEL_HUMAN)
MQTPEATGY

SEQ ID NO: 129902 - protein, 9 aa, Artificial Sequence
  Description of Artificial Sequence: Synthetic peptide
  Seed: VSVSQLRAL (PMEL_HUMAN)
VPVSQLRAY

SEQ ID NO: 129903 - protein, 10 aa, Artificial Sequence
  Description of Artificial Sequence: Synthetic peptide
  Seed: VPLAHSSSAF (PMEL_HUMAN)
VQLAHSSSAM

SEQ ID NO: 129904 - protein, 9 aa, Artificial Sequence
  Description of Artificial Sequence: Synthetic peptide
  Seed: ESAEILQAV (PMEL_HUMAN)
EIAEILQAM

SEQ ID NO: 129905 - protein, 9 aa, Artificial Sequence
  Description of Artificial Sequence: Synthetic peptide
  Seed: RAMLGTHTM (PMEL_HUMAN)
RKMLGTHTF

SEQ ID NO: 129906 - protein, 9 aa, Artificial Sequence
  Description of Artificial Sequence: Synthetic peptide
  Seed: ALDGGNKHF (PMEL_HUMAN)
AVDGGNKHV

SEQ ID NO: 129907 - protein, 9 aa, Artificial Sequence
  Description of Artificial Sequence: Synthetic peptide
  Seed: GQVPTTEVV (PMEL_HUMAN)
GMVPTTEVA

SEQ ID NO: 129908 - protein, 11 aa, Artificial Sequence
  Description of Artificial Sequence: Synthetic peptide
  Seed: APVQMPTAEST (PMEL_HUMAN)
APVQMPTAESL

SEQ ID NO: 129909 - protein, 8 aa, Artificial Sequence
  Description of Artificial Sequence: Synthetic peptide
  Seed: LADTNSLA (PMEL_HUMAN)
LSDTNSLI

SEQ ID NO: 129910 - protein, 10 aa, Artificial Sequence
  Description of Artificial Sequence: Synthetic peptide
  Seed: GLSIGTGRAM (PMEL_HUMAN)
GLSIGTGRAY

SEQ ID NO: 129911 - protein, 9 aa, Artificial Sequence
  Description of Artificial Sequence: Synthetic peptide
  Seed: KVSNDGPTL (PMEL_HUMAN)
KMSNDGPTV

SEQ ID NO: 129912 - protein, 9 aa, Artificial Sequence
  Description of Artificial Sequence: Synthetic peptide
  Seed: RYGSFSVTL (PMEL_HUMAN)
RIGSFSVTI

SEQ ID NO: 129913 - protein, 9 aa, Artificial Sequence
  Description of Artificial Sequence: Synthetic peptide
  Seed: RLVKRQVPL (PMEL_HUMAN)
RVVKRQVPR

SEQ ID NO: 129914 - protein, 11 aa, Artificial Sequence
  Description of Artificial Sequence: Synthetic peptide
  Seed: YLAEADLSYTW (PMEL_HUMAN)
YQAEADLSYTV

SEQ ID NO: 129915 - protein, 10 aa, Artificial Sequence
  Description of Artificial Sequence: Synthetic peptide
  Seed: LMAVVLASLI (PMEL_HUMAN)
LLAVVLASLC

SEQ ID NO: 129916 - protein, 8 aa, Artificial Sequence
  Description of Artificial Sequence: Synthetic peptide
  Seed: LHDPSGYL (PMEL_HUMAN)
LLDPSGYI

SEQ ID NO: 129917 - protein, 9 aa, Artificial Sequence
  Description of Artificial Sequence: Synthetic peptide
  Seed: VSCQGGLPK (PMEL_HUMAN)
VVCQGGLPM

SEQ ID NO: 129918 - protein, 9 aa, Artificial Sequence
  Description of Artificial Sequence: Synthetic peptide
  Seed: SITGSLGPL (PMEL_HUMAN)
SVTGSLGPY

SEQ ID NO: 129919 - protein, 10 aa, Artificial Sequence
  Description of Artificial Sequence: Synthetic peptide
  Seed: VLYRYGSFSV (PMEL_HUMAN)
VKYRYGSFSK

SEQ ID NO: 129920 - protein, 10 aa, Artificial Sequence
  Description of Artificial Sequence: Synthetic peptide
  Seed: EVSIVVLSGT (PMEL_HUMAN)
ELSIVVLSGI

SEQ ID NO: 129921 - protein, 9 aa, Artificial Sequence
  Description of Artificial Sequence: Synthetic peptide
  Seed: GSFSVTLDI (PMEL_HUMAN)
GSFSVTLDF

SEQ ID NO: 129922 - protein, 10 aa, Artificial Sequence
  Description of Artificial Sequence: Synthetic peptide
  Seed: LHLAVIGALL (PMEL_HUMAN)
LMLAVIGALA

SEQ ID NO: 129923 - protein, 9 aa, Artificial Sequence
  Description of Artificial Sequence: Synthetic peptide
  Seed: ATGMTPAEV (PMEL_HUMAN)
AAGMTPAEL

SEQ ID NO: 129924 - protein, 9 aa, Artificial Sequence
  Description of Artificial Sequence: Synthetic peptide
  Seed: VQVPTTEVI (PMEL_HUMAN)
VQVPTTEVW

SEQ ID NO: 129925 - protein, 8 aa, Artificial Sequence
  Description of Artificial Sequence: Synthetic peptide
  Seed: VLPDGQVI (PMEL_HUMAN)
VIPDGQVL

SEQ ID NO: 129926 - protein, 10 aa, Artificial Sequence
  Description of Artificial Sequence: Synthetic peptide
  Seed: AVIGALLAVG (PMEL_HUMAN)
AIIGALLAVI

SEQ ID NO: 129927 - protein, 9 aa, Artificial Sequence
  Description of Artificial Sequence: Synthetic peptide
  Seed: ESAEILQAV (PMEL_HUMAN)
EVAEILQAK

SEQ ID NO: 129928 - protein, 8 aa, Artificial Sequence
  Description of Artificial Sequence: Synthetic peptide
  Seed: SEVMGTTL (PMEL_HUMAN)
SDVMGTTF

SEQ ID NO: 129929 - protein, 9 aa, Artificial Sequence
  Description of Artificial Sequence: Synthetic peptide
  Seed: NQDWLGVSR (PMEL_HUMAN)
NIDWLGVSY

SEQ ID NO: 129930 - protein, 10 aa, Artificial Sequence
  Description of Artificial Sequence: Synthetic peptide
  Seed: EVVGTTPGQA (PMEL_HUMAN)
EMVGTTPGQR

SEQ ID NO: 129931 - protein, 10 aa, Artificial Sequence
  Description of Artificial Sequence: Synthetic peptide
  Seed: YRYGSFSVTL (PMEL_HUMAN)
YPYGSFSVTY

SEQ ID NO: 129932 - protein, 9 aa, Artificial Sequence
  Description of Artificial Sequence: Synthetic peptide
  Seed: SLAVVSTQL (PMEL_HUMAN)
SSAVVSTQY

SEQ ID NO: 129933 - protein, 11 aa, Artificial Sequence
  Description of Artificial Sequence: Synthetic peptide
  Seed: RALDGGNKHFL (PMEL_HUMAN)
RILDGGNKHFR

SEQ ID NO: 129934 - protein, 10 aa, Artificial Sequence
  Description of Artificial Sequence: Synthetic peptide
  Seed: RTKAWNRQLY (PMEL_HUMAN)
RIKAWNRQLV

SEQ ID NO: 129935 - protein, 9 aa, Artificial Sequence
  Description of Artificial Sequence: Synthetic peptide
  Seed: HTMEVTVYH (PMEL_HUMAN)
HPMEVTVYA

SEQ ID NO: 129936 - protein, 10 aa, Artificial Sequence
  Description of Artificial Sequence: Synthetic peptide
  Seed: MKQDFSVPQL (PMEL_HUMAN)
MVQDFSVPQY

SEQ ID NO: 129937 - protein, 9 aa, Artificial Sequence
  Description of Artificial Sequence: Synthetic peptide
  Seed: SLAVVSTQL (PMEL_HUMAN)
SLAVVSTQW

SEQ ID NO: 129938 - protein, 11 aa, Artificial Sequence
  Description of Artificial Sequence: Synthetic peptide
  Seed: VLYRYGSFSVT (PMEL_HUMAN)
VLYRYGSFSVV

SEQ ID NO: 129939 - protein, 9 aa, Artificial Sequence
  Description of Artificial Sequence: Synthetic peptide
  Seed: VLASLIYRR (PMEL_HUMAN)
VYASLIYRK

SEQ ID NO: 129940 - protein, 10 aa, Artificial Sequence
  Description of Artificial Sequence: Synthetic peptide
  Seed: SQVWGGQPVY (PMEL_HUMAN)
SEVWGGQPVY

SEQ ID NO: 129941 - protein, 9 aa, Artificial Sequence
  Description of Artificial Sequence: Synthetic peptide
  Seed: GGPVSGLSI (PMEL_HUMAN)
GIPVSGLSM

SEQ ID NO: 129942 - protein, 9 aa, Artificial Sequence
  Description of Artificial Sequence: Synthetic peptide
  Seed: LADTNSLAV (PMEL_HUMAN)
LADTNSLAM

SEQ ID NO: 129943 - protein, 10 aa, Artificial Sequence
  Description of Artificial Sequence: Synthetic peptide
  Seed: ALDGGNKHFL (PMEL_HUMAN)
AYDGGNKHFI

SEQ ID NO: 129944 - protein, 11 aa, Artificial Sequence
  Description of Artificial Sequence: Synthetic peptide
  Seed: LGPLLDGTATL (PMEL_HUMAN)
LSPLLDGTATL

SEQ ID NO: 129945 - protein, 11 aa, Artificial Sequence
  Description of Artificial Sequence: Synthetic peptide
  Seed: YLAEADLSYTW (PMEL_HUMAN)
YTAEADLSYTY

SEQ ID NO: 129946 - protein, 10 aa, Artificial Sequence
  Description of Artificial Sequence: Synthetic peptide
  Seed: YGSFSVTLDI (PMEL_HUMAN)
YQSFSVTLDY

SEQ ID NO: 129947 - protein, 9 aa, Artificial Sequence
  Description of Artificial Sequence: Synthetic peptide
  Seed: RYGSFSVTL (PMEL_HUMAN)
RRGSFSVTM

SEQ ID NO: 129948 - protein, 9 aa, Artificial Sequence
  Description of Artificial Sequence: Synthetic peptide
  Seed: GSRSYVPLA (PMEL_HUMAN)
GTRSYVPLV

SEQ ID NO: 129949 - protein, 9 aa, Artificial Sequence
  Description of Artificial Sequence: Synthetic peptide
  Seed: KHFLRNQPL (PMEL_HUMAN)
KNFLRNQPM

SEQ ID NO: 129950 - protein, 9 aa, Artificial Sequence
  Description of Artificial Sequence: Synthetic peptide
  Seed: HTYLEPGPV (PMEL_HUMAN)
HAYLEPGPH

SEQ ID NO: 129951 - protein, 10 aa, Artificial Sequence
  Description of Artificial Sequence: Synthetic peptide
  Seed: STAPVQMPTA (PMEL_HUMAN)
SMAPVQMPTL

SEQ ID NO: 129952 - protein, 9 aa, Artificial Sequence
  Description of Artificial Sequence: Synthetic peptide
  Seed: AQVVLQAAI (PMEL_HUMAN)
AEVVLQAAL

SEQ ID NO: 129953 - protein, 10 aa, Artificial Sequence
  Description of Artificial Sequence: Synthetic peptide
  Seed: SQVWGGQPVY (PMEL_HUMAN)
SQVWGGQPVM

SEQ ID NO: 129954 - protein, 9 aa, Artificial Sequence
  Description of Artificial Sequence: Synthetic peptide
  Seed: THTMEVTVY (PMEL_HUMAN)
TQTMEVTVM

SEQ ID NO: 129955 - protein, 9 aa, Artificial Sequence
  Description of Artificial Sequence: Synthetic peptide
  Seed: AAQVTTTEW (PMEL_HUMAN)
AFQVTTTEY

SEQ ID NO: 129956 - protein, 10 aa, Artificial Sequence
  Description of Artificial Sequence: Synthetic peptide
  Seed: EVSIVVLSGT (PMEL_HUMAN)
ERSIVVLSGI

SEQ ID NO: 129957 - protein, 9 aa, Artificial Sequence
  Description of Artificial Sequence: Synthetic peptide
  Seed: LLDGTATLR (PMEL_HUMAN)
LSDGTATLY

SEQ ID NO: 129958 - protein, 9 aa, Artificial Sequence
  Description of Artificial Sequence: Synthetic peptide
  Seed: EVVGTTPGQ (PMEL_HUMAN)
EVVGTTPGF

SEQ ID NO: 129959 - protein, 9 aa, Artificial Sequence
  Description of Artificial Sequence: Synthetic peptide
  Seed: AQVVLQAAI (PMEL_HUMAN)
ATVVLQAAV

SEQ ID NO: 129960 - protein, 11 aa, Artificial Sequence
  Description of Artificial Sequence: Synthetic peptide
  Seed: RRGSRSYVPLA (PMEL_HUMAN)
RWGSRSYVPLV

SEQ ID NO: 129961 - protein, 9 aa, Artificial Sequence
  Description of Artificial Sequence: Synthetic peptide
  Seed: KTWGQYWQV (PMEL_HUMAN)
KFWGQYWQV

SEQ ID NO: 129962 - protein, 10 aa, Artificial Sequence
  Description of Artificial Sequence: Synthetic peptide
  Seed: THTMEVTVYH (PMEL_HUMAN)
TSTMEVTVYY

SEQ ID NO: 129963 - protein, 10 aa, Artificial Sequence
  Description of Artificial Sequence: Synthetic peptide
  Seed: APVQMPTAES (PMEL_HUMAN)
APVQMPTAEA

SEQ ID NO: 129964 - protein, 9 aa, Artificial Sequence
  Description of Artificial Sequence: Synthetic peptide
  Seed: FPDGGPCPS (PMEL_HUMAN)
FPDGGPCPI

SEQ ID NO: 129965 - protein, 9 aa, Artificial Sequence
  Description of Artificial Sequence: Synthetic peptide
  Seed: AEADLSYTW (PMEL_HUMAN)
AVADLSYTL

SEQ ID NO: 129966 - protein, 8 aa, Artificial Sequence
  Description of Artificial Sequence: Synthetic peptide
  Seed: SNDGPTLI (PMEL_HUMAN)
SGDGPTLI

SEQ ID NO: 129967 - protein, 9 aa, Artificial Sequence
  Description of Artificial Sequence: Synthetic peptide
  Seed: SQVWGGQPV (PMEL_HUMAN)
SQVWGGQPI

SEQ ID NO: 129968 - protein, 9 aa, Artificial Sequence
  Description of Artificial Sequence: Synthetic peptide
  Seed: VLPDGQVIW (PMEL_HUMAN)
VGPDGQVIV

SEQ ID NO: 129969 - protein, 10 aa, Artificial Sequence
  Description of Artificial Sequence: Synthetic peptide
  Seed: ASSIMSTESI (PMEL_HUMAN)
AMSIMSTESF

SEQ ID NO: 129970 - protein, 10 aa, Artificial Sequence
  Description of Artificial Sequence: Synthetic peptide
  Seed: RLMKQDFSVP (PMEL_HUMAN)
RMMKQDFSVM

SEQ ID NO: 129971 - protein, 9 aa, Artificial Sequence
  Description of Artificial Sequence: Synthetic peptide
  Seed: TLIGANASF (PMEL_HUMAN)
TQIGANASF

SEQ ID NO: 129972 - protein, 10 aa, Artificial Sequence
  Description of Artificial Sequence: Synthetic peptide
  Seed: WKTWGQYWQV (PMEL_HUMAN)
WQTWGQYWQV

SEQ ID NO: 129973 - protein, 9 aa, Artificial Sequence
  Description of Artificial Sequence: Synthetic peptide
  Seed: VSLADTNSL (PMEL_HUMAN)
VVLADTNSY

SEQ ID NO: 129974 - protein, 9 aa, Artificial Sequence
  Description of Artificial Sequence: Synthetic peptide
  Seed: APVQMPTAE (PMEL_HUMAN)
APVQMPTAP

SEQ ID NO: 129975 - protein, 9 aa, Artificial Sequence
  Description of Artificial Sequence: Synthetic peptide
  Seed: VVLSGTTAA (PMEL_HUMAN)
VMLSGTTAL

SEQ ID NO: 129976 - protein, 10 aa, Artificial Sequence
  Description of Artificial Sequence: Synthetic peptide
  Seed: VLMAVVLASL (PMEL_HUMAN)
VYMAVVLASF

SEQ ID NO: 129977 - protein, 10 aa, Artificial Sequence
  Description of Artificial Sequence: Synthetic peptide
  Seed: TDQVPFSVSV (PMEL_HUMAN)
TNQVPFSVSV

SEQ ID NO: 129978 - protein, 10 aa, Artificial Sequence
  Description of Artificial Sequence: Synthetic peptide
  Seed: LAVIGALLAV (PMEL_HUMAN)
LFVIGALLAL

SEQ ID NO: 129979 - protein, 9 aa, Artificial Sequence
  Description of Artificial Sequence: Synthetic peptide
  Seed: TLIGANASF (PMEL_HUMAN)
TQIGANASW

SEQ ID NO: 129980 - protein, 11 aa, Artificial Sequence
  Description of Artificial Sequence: Synthetic peptide
  Seed: RYGSFSVTLDI (PMEL_HUMAN)
RRGSFSVTLDF

SEQ ID NO: 129981 - protein, 11 aa, Artificial Sequence
  Description of Artificial Sequence: Synthetic peptide
  Seed: MAVVLASLIYR (PMEL_HUMAN)
MMVVLASLIYR

SEQ ID NO: 129982 - protein, 9 aa, Artificial Sequence
  Description of Artificial Sequence: Synthetic peptide
  Seed: TATLRLVKR (PMEL_HUMAN)
TVTLRLVKR

SEQ ID NO: 129983 - protein, 9 aa, Artificial Sequence
  Description of Artificial Sequence: Synthetic peptide
  Seed: AEAPNTTAG (PMEL_HUMAN)
ADAPNTTAL

SEQ ID NO: 129984 - protein, 11 aa, Artificial Sequence
  Description of Artificial Sequence: Synthetic peptide
  Seed: AEMSTPEATGM (PMEL_HUMAN)
AQMSTPEATGV

SEQ ID NO: 129985 - protein, 9 aa, Artificial Sequence
  Description of Artificial Sequence: Synthetic peptide
  Seed: YLEPGPVTA (PMEL_HUMAN)
YIEPGPVTY

SEQ ID NO: 129986 - protein, 10 aa, Artificial Sequence
  Description of Artificial Sequence: Synthetic peptide
  Seed: YRYGSFSVTL (PMEL_HUMAN)
YYYGSFSVTY

SEQ ID NO: 129987 - protein, 9 aa, Artificial Sequence
  Description of Artificial Sequence: Synthetic peptide
  Seed: YLEPGPVTA (PMEL_HUMAN)
YAEPGPVTA

SEQ ID NO: 129988 - protein, 11 aa, Artificial Sequence
  Description of Artificial Sequence: Synthetic peptide
  Seed: FGDSSGTLISR (PMEL_HUMAN)
FYDSSGTLISM

SEQ ID NO: 129989 - protein, 10 aa, Artificial Sequence
  Description of Artificial Sequence: Synthetic peptide
  Seed: KRCLLHLAVI (PMEL_HUMAN)
KRCLLHLAVK

SEQ ID NO: 129990 - protein, 9 aa, Artificial Sequence
  Description of Artificial Sequence: Synthetic peptide
  Seed: RNQPLTFAL (PMEL_HUMAN)
RTQPLTFAM

SEQ ID NO: 129991 - protein, 10 aa, Artificial Sequence
  Description of Artificial Sequence: Synthetic peptide
  Seed: ELTVSCQGGL (PMEL_HUMAN)
EPTVSCQGGV

SEQ ID NO: 129992 - protein, 9 aa, Artificial Sequence
  Description of Artificial Sequence: Synthetic peptide
  Seed: WSQKRSFVY (PMEL_HUMAN)
WVQKRSFVW

SEQ ID NO: 129993 - protein, 10 aa, Artificial Sequence
  Description of Artificial Sequence: Synthetic peptide
  Seed: TMEVTVYHRR (PMEL_HUMAN)
TVEVTVYHRK

SEQ ID NO: 129994 - protein, 9 aa, Artificial Sequence
  Description of Artificial Sequence: Synthetic peptide
  Seed: KQDFSVPQL (PMEL_HUMAN)
KQDFSVPQI

SEQ ID NO: 129995 - protein, 10 aa, Artificial Sequence
  Description of Artificial Sequence: Synthetic peptide
  Seed: RQLYPEWTEA (PMEL_HUMAN)
RRLYPEWTEV

SEQ ID NO: 129996 - protein, 9 aa, Artificial Sequence
  Description of Artificial Sequence: Synthetic peptide
  Seed: TPAEVSIVV (PMEL_HUMAN)
TIAEVSIVM

SEQ ID NO: 129997 - protein, 10 aa, Artificial Sequence
  Description of Artificial Sequence: Synthetic peptide
  Seed: VLMAVVLASL (PMEL_HUMAN)
VRMAVVLASF

SEQ ID NO: 129998 - protein, 8 aa, Artificial Sequence
  Description of Artificial Sequence: Synthetic peptide
  Seed: VSNDGPTL (PMEL_HUMAN)
VANDGPTI

SEQ ID NO: 129999 - protein, 10 aa, Artificial Sequence
  Description of Artificial Sequence: Synthetic peptide
  Seed: TDQVPFSVSV (PMEL_HUMAN)
TRQVPFSVSV

SEQ ID NO: 130000 - protein, 10 aa, Artificial Sequence
  Description of Artificial Sequence: Synthetic peptide
  Seed: AESTGMTPEK (PMEL_HUMAN)
AISTGMTPEK

SEQ ID NO: 130001 - protein, 10 aa, Artificial Sequence
  Description of Artificial Sequence: Synthetic peptide
  Seed: SLADTNSLAV (PMEL_HUMAN)
SQADTNSLAF

SEQ ID NO: 130002 - protein, 9 aa, Artificial Sequence
  Description of Artificial Sequence: Synthetic peptide
  Seed: VQVPTTEVI (PMEL_HUMAN)
VEVPTTEVF

SEQ ID NO: 130003 - protein, 9 aa, Artificial Sequence
  Description of Artificial Sequence: Synthetic peptide
  Seed: TTPGQAPTA (PMEL_HUMAN)
TMPGQAPTI

SEQ ID NO: 130004 - protein, 9 aa, Artificial Sequence
  Description of Artificial Sequence: Synthetic peptide
  Seed: SVQVPTTEV (PMEL_HUMAN)
SMQVPTTEI

SEQ ID NO: 130005 - protein, 9 aa, Artificial Sequence
  Description of Artificial Sequence: Synthetic peptide
  Seed: ITDQVPFSV (PMEL_HUMAN)
ITDQVPFSM

SEQ ID NO: 130006 - protein, 9 aa, Artificial Sequence
  Description of Artificial Sequence: Synthetic peptide
  Seed: VMGTTLAEM (PMEL_HUMAN)
VMGTTLAEI

SEQ ID NO: 130007 - protein, 9 aa, Artificial Sequence
  Description of Artificial Sequence: Synthetic peptide
  Seed: QLVLHQILK (PMEL_HUMAN)
QIVLHQILR

SEQ ID NO: 130008 - protein, 11 aa, Artificial Sequence
  Description of Artificial Sequence: Synthetic peptide
  Seed: YVPLAHSSSAF (PMEL_HUMAN)
YWPLAHSSSAF

SEQ ID NO: 130009 - protein, 9 aa, Artificial Sequence
  Description of Artificial Sequence: Synthetic peptide
  Seed: SSIMSTESI (PMEL_HUMAN)
SSIMSTESL

SEQ ID NO: 130010 - protein, 9 aa, Artificial Sequence
  Description of Artificial Sequence: Synthetic peptide
  Seed: HLAVIGALL (PMEL_HUMAN)
HMAVIGALW

SEQ ID NO: 130011 - protein, 8 aa, Artificial Sequence
  Description of Artificial Sequence: Synthetic peptide
  Seed: FGDSSGTL (PMEL_HUMAN)
FWDSSGTL

SEQ ID NO: 130012 - protein, 9 aa, Artificial Sequence
  Description of Artificial Sequence: Synthetic peptide
  Seed: TTPGQAPTA (PMEL_HUMAN)
TLPGQAPTV

SEQ ID NO: 130013 - protein, 9 aa, Artificial Sequence
  Description of Artificial Sequence: Synthetic peptide
  Seed: RAMLGTHTM (PMEL_HUMAN)
RQMLGTHTH

SEQ ID NO: 130014 - protein, 9 aa, Artificial Sequence
  Description of Artificial Sequence: Synthetic peptide
  Seed: ISRALVVTH (PMEL_HUMAN)
IARALVVTM

SEQ ID NO: 130015 - protein, 9 aa, Artificial Sequence
  Description of Artificial Sequence: Synthetic peptide
  Seed: TPAEVSIVV (PMEL_HUMAN)
TAAEVSIVY

SEQ ID NO: 130016 - protein, 10 aa, Artificial Sequence
  Description of Artificial Sequence: Synthetic peptide
  Seed: IALNFPGSQK (PMEL_HUMAN)
ITLNFPGSQR

SEQ ID NO: 130017 - protein, 10 aa, Artificial Sequence
  Description of Artificial Sequence: Synthetic peptide
  Seed: YVPLAHSSSA (PMEL_HUMAN)
YDPLAHSSSL

SEQ ID NO: 130018 - protein, 10 aa, Artificial Sequence
  Description of Artificial Sequence: Synthetic peptide
  Seed: CQLVLHQILK (PMEL_HUMAN)
CFLVLHQILR

SEQ ID NO: 130019 - protein, 9 aa, Artificial Sequence
  Description of Artificial Sequence: Synthetic peptide
  Seed: YRYGSFSVT (PMEL_HUMAN)
YQYGSFSVI

SEQ ID NO: 130020 - protein, 10 aa, Artificial Sequence
  Description of Artificial Sequence: Synthetic peptide
  Seed: EVISTAPVQM (PMEL_HUMAN)
EIISTAPVQK

SEQ ID NO: 130021 - protein, 9 aa, Artificial Sequence
  Description of Artificial Sequence: Synthetic peptide
  Seed: FGDSSGTLI (PMEL_HUMAN)
FMDSSGTLC

SEQ ID NO: 130022 - protein, 10 aa, Artificial Sequence
  Description of Artificial Sequence: Synthetic peptide
  Seed: RALVVTHTYL (PMEL_HUMAN)
RVLVVTHTYY

SEQ ID NO: 130023 - protein, 9 aa, Artificial Sequence
  Description of Artificial Sequence: Synthetic peptide
  Seed: LPKEACMEI (PMEL_HUMAN)
LAKEACMEF

SEQ ID NO: 130024 - protein, 9 aa, Artificial Sequence
  Description of Artificial Sequence: Synthetic peptide
  Seed: FGDSSGTLI (PMEL_HUMAN)
FSDSSGTLY

SEQ ID NO: 130025 - protein, 10 aa, Artificial Sequence
  Description of Artificial Sequence: Synthetic peptide
  Seed: GPLLDGTATL (PMEL_HUMAN)
GMLLDGTATA

SEQ ID NO: 130026 - protein, 9 aa, Artificial Sequence
  Description of Artificial Sequence: Synthetic peptide
  Seed: YLEPGPVTA (PMEL_HUMAN)
YWEPGPVTV

SEQ ID NO: 130027 - protein, 9 aa, Artificial Sequence
  Description of Artificial Sequence: Synthetic peptide
  Seed: GQVPLIVGI (PMEL_HUMAN)
GAVPLIVGY

SEQ ID NO: 130028 - protein, 10 aa, Artificial Sequence
  Description of Artificial Sequence: Synthetic peptide
  Seed: FSVSVSQLRA (PMEL_HUMAN)
FHVSVSQLRR

SEQ ID NO: 130029 - protein, 9 aa, Artificial Sequence
  Description of Artificial Sequence: Synthetic peptide
  Seed: SQKRSFVYV (PMEL_HUMAN)
SVKRSFVYP

SEQ ID NO: 130030 - protein, 9 aa, Artificial Sequence
  Description of Artificial Sequence: Synthetic peptide
  Seed: GTYCLNVSL (PMEL_HUMAN)
GIYCLNVSV

SEQ ID NO: 130031 - protein, 10 aa, Artificial Sequence
  Description of Artificial Sequence: Synthetic peptide
  Seed: GPLLDGTATL (PMEL_HUMAN)
GNLLDGTATV

SEQ ID NO: 130032 - protein, 10 aa, Artificial Sequence
  Description of Artificial Sequence: Synthetic peptide
  Seed: RALDGGNKHF (PMEL_HUMAN)
RMLDGGNKHI

SEQ ID NO: 130033 - protein, 11 aa, Artificial Sequence
  Description of Artificial Sequence: Synthetic peptide
  Seed: FGDSSGTLISR (PMEL_HUMAN)
FMDSSGTLISM

SEQ ID NO: 130034 - protein, 10 aa, Artificial Sequence
  Description of Artificial Sequence: Synthetic peptide
  Seed: SQKRSFVYVW (PMEL_HUMAN)
SEKRSFVYVW

SEQ ID NO: 130035 - protein, 9 aa, Artificial Sequence
  Description of Artificial Sequence: Synthetic peptide
  Seed: VLKRCLLHL (PMEL_HUMAN)
VTKRCLLHY

SEQ ID NO: 130036 - protein, 9 aa, Artificial Sequence
  Description of Artificial Sequence: Synthetic peptide
  Seed: LPDGQVIWV (PMEL_HUMAN)
LVDGQVIWF

SEQ ID NO: 130037 - protein, 10 aa, Artificial Sequence
  Description of Artificial Sequence: Synthetic peptide
  Seed: KTWGQYWQVL (PMEL_HUMAN)
KQWGQYWQVW

SEQ ID NO: 130038 - protein, 9 aa, Artificial Sequence
  Description of Artificial Sequence: Synthetic peptide
  Seed: GILLVLMAV (PMEL_HUMAN)
GLLLVLMAA

SEQ ID NO: 130039 - protein, 10 aa, Artificial Sequence
  Description of Artificial Sequence: Synthetic peptide
  Seed: ALDGGNKHFL (PMEL_HUMAN)
AIDGGNKHFM

SEQ ID NO: 130040 - protein, 9 aa, Artificial Sequence
  Description of Artificial Sequence: Synthetic peptide
  Seed: KQDFSVPQL (PMEL_HUMAN)
KLDFSVPQI

SEQ ID NO: 130041 - protein, 9 aa, Artificial Sequence
  Description of Artificial Sequence: Synthetic peptide
  Seed: FGDSSGTLI (PMEL_HUMAN)
FVDSSGTLL

SEQ ID NO: 130042 - protein, 9 aa, Artificial Sequence
  Description of Artificial Sequence: Synthetic peptide
  Seed: MAVVLASLI (PMEL_HUMAN)
MLVVLASLW

SEQ ID NO: 130043 - protein, 9 aa, Artificial Sequence
  Description of Artificial Sequence: Synthetic peptide
  Seed: FGDSSGTLI (PMEL_HUMAN)
FYDSSGTLI

SEQ ID NO: 130044 - protein, 9 aa, Artificial Sequence
  Description of Artificial Sequence: Synthetic peptide
  Seed: VSLADTNSL (PMEL_HUMAN)
VTLADTNSY

SEQ ID NO: 130045 - protein, 11 aa, Artificial Sequence
  Description of Artificial Sequence: Synthetic peptide
  Seed: FGDSSGTLISR (PMEL_HUMAN)
FVDSSGTLISL

SEQ ID NO: 130046 - protein, 9 aa, Artificial Sequence
  Description of Artificial Sequence: Synthetic peptide
  Seed: ITDQVPFSV (PMEL_HUMAN)
IVDQVPFSY

SEQ ID NO: 130047 - protein, 11 aa, Artificial Sequence
  Description of Artificial Sequence: Synthetic peptide
  Seed: GYLAEADLSYT (PMEL_HUMAN)
GTLAEADLSYV

SEQ ID NO: 130048 - protein, 10 aa, Artificial Sequence
  Description of Artificial Sequence: Synthetic peptide
  Seed: MTPAEVSIVV (PMEL_HUMAN)
MMPAEVSIVA

SEQ ID NO: 130049 - protein, 9 aa, Artificial Sequence
  Description of Artificial Sequence: Synthetic peptide
  Seed: FTITDQVPF (PMEL_HUMAN)
FGITDQVPM

SEQ ID NO: 130050 - protein, 9 aa, Artificial Sequence
  Description of Artificial Sequence: Synthetic peptide
  Seed: AVIGALLAV (PMEL_HUMAN)
APIGALLAF

SEQ ID NO: 130051 - protein, 9 aa, Artificial Sequence
  Description of Artificial Sequence: Synthetic peptide
  Seed: VPSGEGDAF (PMEL_HUMAN)
VMSGEGDAF

SEQ ID NO: 130052 - protein, 9 aa, Artificial Sequence
  Description of Artificial Sequence: Synthetic peptide
  Seed: TIINGSQVW (PMEL_HUMAN)
TPINGSQVY

SEQ ID NO: 130053 - protein, 10 aa, Artificial Sequence
  Description of Artificial Sequence: Synthetic peptide
  Seed: RGSRSYVPLA (PMEL_HUMAN)
RCSRSYVPLS

SEQ ID NO: 130054 - protein, 10 aa, Artificial Sequence
  Description of Artificial Sequence: Synthetic peptide
  Seed: SGTYCLNVSL (PMEL_HUMAN)
SSTYCLNVSY

SEQ ID NO: 130055 - protein, 10 aa, Artificial Sequence
  Description of Artificial Sequence: Synthetic peptide
  Seed: VLYRYGSFSV (PMEL_HUMAN)
VQYRYGSFSK

SEQ ID NO: 130056 - protein, 9 aa, Artificial Sequence
  Description of Artificial Sequence: Synthetic peptide
  Seed: VQMPTAEST (PMEL_HUMAN)
VKMPTAESL

SEQ ID NO: 130057 - protein, 9 aa, Artificial Sequence
  Description of Artificial Sequence: Synthetic peptide
  Seed: SRSYVPLAH (PMEL_HUMAN)
SYSYVPLAF

SEQ ID NO: 130058 - protein, 10 aa, Artificial Sequence
  Description of Artificial Sequence: Synthetic peptide
  Seed: RALDGGNKHF (PMEL_HUMAN)
RVLDGGNKHL

SEQ ID NO: 130059 - protein, 9 aa, Artificial Sequence
  Description of Artificial Sequence: Synthetic peptide
  Seed: EVVGTTPGQ (PMEL_HUMAN)
EVVGTTPGR

SEQ ID NO: 130060 - protein, 10 aa, Artificial Sequence
  Description of Artificial Sequence: Synthetic peptide
  Seed: ALDGGNKHFL (PMEL_HUMAN)
AADGGNKHFF

SEQ ID NO: 130061 - protein, 9 aa, Artificial Sequence
  Description of Artificial Sequence: Synthetic peptide
  Seed: LPKEACMEI (PMEL_HUMAN)
LPKEACMEV

SEQ ID NO: 130062 - protein, 9 aa, Artificial Sequence
  Description of Artificial Sequence: Synthetic peptide
  Seed: AQRLCQPVL (PMEL_HUMAN)
ASRLCQPVS

SEQ ID NO: 130063 - protein, 9 aa, Artificial Sequence
  Description of Artificial Sequence: Synthetic peptide
  Seed: VQVPTTEVI (PMEL_HUMAN)
VYVPTTEVY

SEQ ID NO: 130064 - protein, 9 aa, Artificial Sequence
  Description of Artificial Sequence: Synthetic peptide
  Seed: RAMLGTHTM (PMEL_HUMAN)
RLMLGTHTI

SEQ ID NO: 130065 - protein, 9 aa, Artificial Sequence
  Description of Artificial Sequence: Synthetic peptide
  Seed: KTWGQYWQV (PMEL_HUMAN)
KMWGQYWQA

SEQ ID NO: 130066 - protein, 10 aa, Artificial Sequence
  Description of Artificial Sequence: Synthetic peptide
  Seed: AVPSGEGDAF (PMEL_HUMAN)
AYPSGEGDAL

SEQ ID NO: 130067 - protein, 10 aa, Artificial Sequence
  Description of Artificial Sequence: Synthetic peptide
  Seed: YGSFSVTLDI (PMEL_HUMAN)
YCSFSVTLDF

SEQ ID NO: 130068 - protein, 9 aa, Artificial Sequence
  Description of Artificial Sequence: Synthetic peptide
  Seed: TAEAPNTTA (PMEL_HUMAN)
TSEAPNTTM

SEQ ID NO: 130069 - protein, 9 aa, Artificial Sequence
  Description of Artificial Sequence: Synthetic peptide
  Seed: VVLSGTTAA (PMEL_HUMAN)
VLLSGTTAL

SEQ ID NO: 130070 - protein, 9 aa, Artificial Sequence
  Description of Artificial Sequence: Synthetic peptide
  Seed: VPFSVSVSQ (PMEL_HUMAN)
VMFSVSVSY

SEQ ID NO: 130071 - protein, 9 aa, Artificial Sequence
  Description of Artificial Sequence: Synthetic peptide
  Seed: AEMSTPEAT (PMEL_HUMAN)
AEMSTPEAV

SEQ ID NO: 130072 - protein, 11 aa, Artificial Sequence
  Description of Artificial Sequence: Synthetic peptide
  Seed: YVPLAHSSSAF (PMEL_HUMAN)
YHPLAHSSSAY

SEQ ID NO: 130073 - protein, 9 aa, Artificial Sequence
  Description of Artificial Sequence: Synthetic peptide
  Seed: VLPDGQVIW (PMEL_HUMAN)
VCPDGQVIM

SEQ ID NO: 130074 - protein, 9 aa, Artificial Sequence
  Description of Artificial Sequence: Synthetic peptide
  Seed: FLRNQPLTF (PMEL_HUMAN)
FFRNQPLTL

SEQ ID NO: 130075 - protein, 9 aa, Artificial Sequence
  Description of Artificial Sequence: Synthetic peptide
  Seed: VTLDIVQGI (PMEL_HUMAN)
VLLDIVQGR

SEQ ID NO: 130076 - protein, 9 aa, Artificial Sequence
  Description of Artificial Sequence: Synthetic peptide
  Seed: YHRRGSRSY (PMEL_HUMAN)
YRRRGSRSY

SEQ ID NO: 130077 - protein, 10 aa, Artificial Sequence
  Description of Artificial Sequence: Synthetic peptide
  Seed: EVMGTTLAEM (PMEL_HUMAN)
EMMGTTLAEW

SEQ ID NO: 130078 - protein, 9 aa, Artificial Sequence
  Description of Artificial Sequence: Synthetic peptide
  Seed: ALLAVGATK (PMEL_HUMAN)
AILAVGATK

SEQ ID NO: 130079 - protein, 9 aa, Artificial Sequence
  Description of Artificial Sequence: Synthetic peptide
  Seed: TPAEVSIVV (PMEL_HUMAN)
TSAEVSIVL

SEQ ID NO: 130080 - protein, 9 aa, Artificial Sequence
  Description of Artificial Sequence: Synthetic peptide
  Seed: LADTNSLAV (PMEL_HUMAN)
LMDTNSLAI

SEQ ID NO: 130081 - protein, 9 aa, Artificial Sequence
  Description of Artificial Sequence: Synthetic peptide
  Seed: IVVLSGTTA (PMEL_HUMAN)
IAVLSGTTM

SEQ ID NO: 130082 - protein, 9 aa, Artificial Sequence
  Description of Artificial Sequence: Synthetic peptide
  Seed: RGSRSYVPL (PMEL_HUMAN)
RSSRSYVPA

SEQ ID NO: 130083 - protein, 10 aa, Artificial Sequence
  Description of Artificial Sequence: Synthetic peptide
  Seed: RRLMKQDFSV (PMEL_HUMAN)
RWLMKQDFSV

SEQ ID NO: 130084 - protein, 10 aa, Artificial Sequence
  Description of Artificial Sequence: Synthetic peptide
  Seed: GDSSGTLISR (PMEL_HUMAN)
GLSSGTLISK

SEQ ID NO: 130085 - protein, 9 aa, Artificial Sequence
  Description of Artificial Sequence: Synthetic peptide
  Seed: FLRNQPLTF (PMEL_HUMAN)
FKRNQPLTL

SEQ ID NO: 130086 - protein, 10 aa, Artificial Sequence
  Description of Artificial Sequence: Synthetic peptide
  Seed: LAVIGALLAV (PMEL_HUMAN)
LDVIGALLAV

SEQ ID NO: 130087 - protein, 9 aa, Artificial Sequence
  Description of Artificial Sequence: Synthetic peptide
  Seed: VLPDGQVIW (PMEL_HUMAN)
VAPDGQVIW

SEQ ID NO: 130088 - protein, 9 aa, Artificial Sequence
  Description of Artificial Sequence: Synthetic peptide
  Seed: QLYPEWTEA (PMEL_HUMAN)
QQYPEWTEV

SEQ ID NO: 130089 - protein, 9 aa, Artificial Sequence
  Description of Artificial Sequence: Synthetic peptide
  Seed: QLYPEWTEA (PMEL_HUMAN)
QIYPEWTEV

SEQ ID NO: 130090 - protein, 10 aa, Artificial Sequence
  Description of Artificial Sequence: Synthetic peptide
  Seed: VPLAHSSSAF (PMEL_HUMAN)
VPLAHSSSAI

SEQ ID NO: 130091 - protein, 10 aa, Artificial Sequence
  Description of Artificial Sequence: Synthetic peptide
  Seed: QILKGGSGTY (PMEL_HUMAN)
QTLKGGSGTK

SEQ ID NO: 130092 - protein, 9 aa, Artificial Sequence
  Description of Artificial Sequence: Synthetic peptide
  Seed: RQVPLDCVL (PMEL_HUMAN)
RSVPLDCVY

SEQ ID NO: 130093 - protein, 11 aa, Artificial Sequence
  Description of Artificial Sequence: Synthetic peptide
  Seed: RTKAWNRQLYP (PMEL_HUMAN)
RTKAWNRQLYV

SEQ ID NO: 130094 - protein, 9 aa, Artificial Sequence
  Description of Artificial Sequence: Synthetic peptide
  Seed: SLAVVSTQL (PMEL_HUMAN)
SQAVVSTQY

SEQ ID NO: 130095 - protein, 9 aa, Artificial Sequence
  Description of Artificial Sequence: Synthetic peptide
  Seed: KVSNDGPTL (PMEL_HUMAN)
KASNDGPTW

SEQ ID NO: 130096 - protein, 9 aa, Artificial Sequence
  Description of Artificial Sequence: Synthetic peptide
  Seed: RIFCSCPIG (PMEL_HUMAN)
RSFCSCPII

SEQ ID NO: 130097 - protein, 11 aa, Artificial Sequence
  Description of Artificial Sequence: Synthetic peptide
  Seed: SYVPLAHSSSA (PMEL_HUMAN)
SHVPLAHSSSF

SEQ ID NO: 130098 - protein, 9 aa, Artificial Sequence
  Description of Artificial Sequence: Synthetic peptide
  Seed: VPSGEGDAF (PMEL_HUMAN)
VQSGEGDAY

SEQ ID NO: 130099 - protein, 9 aa, Artificial Sequence
  Description of Artificial Sequence: Synthetic peptide
  Seed: TTDGHRPTA (PMEL_HUMAN)
TVDGHRPTF

SEQ ID NO: 130100 - protein, 10 aa, Artificial Sequence
  Description of Artificial Sequence: Synthetic peptide
  Seed: RGSRSYVPLA (PMEL_HUMAN)
RHSRSYVPLY

SEQ ID NO: 130101 - protein, 10 aa, Artificial Sequence
  Description of Artificial Sequence: Synthetic peptide
  Seed: AVIGALLAVG (PMEL_HUMAN)
AVIGALLAVH

SEQ ID NO: 130102 - protein, 9 aa, Artificial Sequence
  Description of Artificial Sequence: Synthetic peptide
  Seed: LSIGTGRAM (PMEL_HUMAN)
LRIGTGRAY

SEQ ID NO: 130103 - protein, 8 aa, Artificial Sequence
  Description of Artificial Sequence: Synthetic peptide
  Seed: MGTTLAEM (PMEL_HUMAN)
MATTLAEL

SEQ ID NO: 130104 - protein, 11 aa, Artificial Sequence
  Description of Artificial Sequence: Synthetic peptide
  Seed: ISRALVVTHTY (PMEL_HUMAN)
IMRALVVTHTY

SEQ ID NO: 130105 - protein, 9 aa, Artificial Sequence
  Description of Artificial Sequence: Synthetic peptide
  Seed: YLAEADLSY (PMEL_HUMAN)
YNAEADLSF

SEQ ID NO: 130106 - protein, 10 aa, Artificial Sequence
  Description of Artificial Sequence: Synthetic peptide
  Seed: VTAQVVLQAA (PMEL_HUMAN)
VMAQVVLQAI

SEQ ID NO: 130107 - protein, 10 aa, Artificial Sequence
  Description of Artificial Sequence: Synthetic peptide
  Seed: RALDGGNKHF (PMEL_HUMAN)
RRLDGGNKHM

SEQ ID NO: 130108 - protein, 10 aa, Artificial Sequence
  Description of Artificial Sequence: Synthetic peptide
  Seed: SQKRSFVYVW (PMEL_HUMAN)
SMKRSFVYVY

SEQ ID NO: 130109 - protein, 9 aa, Artificial Sequence
  Description of Artificial Sequence: Synthetic peptide
  Seed: HLAVIGALL (PMEL_HUMAN)
HSAVIGALY

SEQ ID NO: 130110 - protein, 9 aa, Artificial Sequence
  Description of Artificial Sequence: Synthetic peptide
  Seed: WQVLGGPVS (PMEL_HUMAN)
WKVLGGPVI

SEQ ID NO: 130111 - protein, 10 aa, Artificial Sequence
  Description of Artificial Sequence: Synthetic peptide
  Seed: EVSIVVLSGT (PMEL_HUMAN)
ESSIVVLSGI

SEQ ID NO: 130112 - protein, 9 aa, Artificial Sequence
  Description of Artificial Sequence: Synthetic peptide
  Seed: FGDSSGTLI (PMEL_HUMAN)
FVDSSGTLM

SEQ ID NO: 130113 - protein, 10 aa, Artificial Sequence
  Description of Artificial Sequence: Synthetic peptide
  Seed: TYLEPGPVTA (PMEL_HUMAN)
TWLEPGPVTM

SEQ ID NO: 130114 - protein, 9 aa, Artificial Sequence
  Description of Artificial Sequence: Synthetic peptide
  Seed: ASFSIALNF (PMEL_HUMAN)
ARFSIALNM

SEQ ID NO: 130115 - protein, 9 aa, Artificial Sequence
  Description of Artificial Sequence: Synthetic peptide
  Seed: VPLDCVLYR (PMEL_HUMAN)
VGLDCVLYR

SEQ ID NO: 130116 - protein, 11 aa, Artificial Sequence
  Description of Artificial Sequence: Synthetic peptide
  Seed: HTMEVTVYHRR (PMEL_HUMAN)
HTMEVTVYHRP

SEQ ID NO: 130117 - protein, 10 aa, Artificial Sequence
  Description of Artificial Sequence: Synthetic peptide
  Seed: MAVVLASLIY (PMEL_HUMAN)
MSVVLASLIW

SEQ ID NO: 130118 - protein, 10 aa, Artificial Sequence
  Description of Artificial Sequence: Synthetic peptide
  Seed: NSLAVVSTQL (PMEL_HUMAN)
NKLAVVSTQV

SEQ ID NO: 130119 - protein, 9 aa, Artificial Sequence
  Description of Artificial Sequence: Synthetic peptide
  Seed: SHWLRLPRI (PMEL_HUMAN)
SQWLRLPRI

SEQ ID NO: 130120 - protein, 9 aa, Artificial Sequence
  Description of Artificial Sequence: Synthetic peptide
  Seed: LMAVVLASL (PMEL_HUMAN)
LSAVVLASF

SEQ ID NO: 130121 - protein, 11 aa, Artificial Sequence
  Description of Artificial Sequence: Synthetic peptide
  Seed: KVLPDGQVIWV (PMEL_HUMAN)
KMLPDGQVIWV

SEQ ID NO: 130122 - protein, 10 aa, Artificial Sequence
  Description of Artificial Sequence: Synthetic peptide
  Seed: RALVVTHTYL (PMEL_HUMAN)
RDLVVTHTYY

SEQ ID NO: 130123 - protein, 11 aa, Artificial Sequence
  Description of Artificial Sequence: Synthetic peptide
  Seed: RYGSFSVTLDI (PMEL_HUMAN)
RNGSFSVTLDW

SEQ ID NO: 130124 - protein, 10 aa, Artificial Sequence
  Description of Artificial Sequence: Synthetic peptide
  Seed: RALDGGNKHF (PMEL_HUMAN)
RVLDGGNKHI

SEQ ID NO: 130125 - protein, 9 aa, Artificial Sequence
  Description of Artificial Sequence: Synthetic peptide
  Seed: EGDAFELTV (PMEL_HUMAN)
EFDAFELTM

SEQ ID NO: 130126 - protein, 10 aa, Artificial Sequence
  Description of Artificial Sequence: Synthetic peptide
  Seed: AESTGMTPEK (PMEL_HUMAN)
AASTGMTPEK

SEQ ID NO: 130127 - protein, 9 aa, Artificial Sequence
  Description of Artificial Sequence: Synthetic peptide
  Seed: ADTNSLAVV (PMEL_HUMAN)
AETNSLAVF

SEQ ID NO: 130128 - protein, 9 aa, Artificial Sequence
  Description of Artificial Sequence: Synthetic peptide
  Seed: FGDSSGTLI (PMEL_HUMAN)
FLDSSGTLC

SEQ ID NO: 130129 - protein, 9 aa, Artificial Sequence
  Description of Artificial Sequence: Synthetic peptide
  Seed: SLAVVSTQL (PMEL_HUMAN)
SSAVVSTQL

SEQ ID NO: 130130 - protein, 10 aa, Artificial Sequence
  Description of Artificial Sequence: Synthetic peptide
  Seed: RQLYPEWTEA (PMEL_HUMAN)
RMLYPEWTEL

SEQ ID NO: 130131 - protein, 11 aa, Artificial Sequence
  Description of Artificial Sequence: Synthetic peptide
  Seed: RALDGGNKHFL (PMEL_HUMAN)
RSLDGGNKHFF

SEQ ID NO: 130132 - protein, 9 aa, Artificial Sequence
  Description of Artificial Sequence: Synthetic peptide
  Seed: VSVSQLRAL (PMEL_HUMAN)
VAVSQLRAF

SEQ ID NO: 130133 - protein, 11 aa, Artificial Sequence
  Description of Artificial Sequence: Synthetic peptide
  Seed: MTPEKVPVSEV (PMEL_HUMAN)
MLPEKVPVSEV

SEQ ID NO: 130134 - protein, 9 aa, Artificial Sequence
  Description of Artificial Sequence: Synthetic peptide
  Seed: YHRRGSRSY (PMEL_HUMAN)
YERRGSRSF

SEQ ID NO: 130135 - protein, 9 aa, Artificial Sequence
  Description of Artificial Sequence: Synthetic peptide
  Seed: LLDGTATLR (PMEL_HUMAN)
LSDGTATLM

SEQ ID NO: 130136 - protein, 9 aa, Artificial Sequence
  Description of Artificial Sequence: Synthetic peptide
  Seed: TEWVETTAR (PMEL_HUMAN)
TIWVETTAR

SEQ ID NO: 130137 - protein, 9 aa, Artificial Sequence
  Description of Artificial Sequence: Synthetic peptide
  Seed: RIFCSCPIG (PMEL_HUMAN)
RSFCSCPIK

SEQ ID NO: 130138 - protein, 9 aa, Artificial Sequence
  Description of Artificial Sequence: Synthetic peptide
  Seed: MEVTVYHRR (PMEL_HUMAN)
MYVTVYHRK

SEQ ID NO: 130139 - protein, 11 aa, Artificial Sequence
  Description of Artificial Sequence: Synthetic peptide
  Seed: RYGSFSVTLDI (PMEL_HUMAN)
RYGSFSVTLDW

SEQ ID NO: 130140 - protein, 9 aa, Artificial Sequence
  Description of Artificial Sequence: Synthetic peptide
  Seed: SSIMSTESI (PMEL_HUMAN)
SSIMSTESW

SEQ ID NO: 130141 - protein, 10 aa, Artificial Sequence
  Description of Artificial Sequence: Synthetic peptide
  Seed: GILLVLMAVV (PMEL_HUMAN)
GQLLVLMAVV

SEQ ID NO: 130142 - protein, 11 aa, Artificial Sequence
  Description of Artificial Sequence: Synthetic peptide
  Seed: LYRYGSFSVTL (PMEL_HUMAN)
LFRYGSFSVTF

SEQ ID NO: 130143 - protein, 9 aa, Artificial Sequence
  Description of Artificial Sequence: Synthetic peptide
  Seed: YWQVLGGPV (PMEL_HUMAN)
YWQVLGGPY

SEQ ID NO: 130144 - protein, 8 aa, Artificial Sequence
  Description of Artificial Sequence: Synthetic peptide
  Seed: SNDGPTLI (PMEL_HUMAN)
SADGPTLM

SEQ ID NO: 130145 - protein, 9 aa, Artificial Sequence
  Description of Artificial Sequence: Synthetic peptide
  Seed: TEWVETTAR (PMEL_HUMAN)
TAWVETTAR

SEQ ID NO: 130146 - protein, 9 aa, Artificial Sequence
  Description of Artificial Sequence: Synthetic peptide
  Seed: VPTTEVIST (PMEL_HUMAN)
VPTTEVISF

SEQ ID NO: 130147 - protein, 10 aa, Artificial Sequence
  Description of Artificial Sequence: Synthetic peptide
  Seed: VQGIESAEIL (PMEL_HUMAN)
VMGIESAEIF

SEQ ID NO: 130148 - protein, 10 aa, Artificial Sequence
  Description of Artificial Sequence: Synthetic peptide
  Seed: AVIGALLAVG (PMEL_HUMAN)
AMIGALLAVQ

SEQ ID NO: 130149 - protein, 9 aa, Artificial Sequence
  Description of Artificial Sequence: Synthetic peptide
  Seed: KHFLRNQPL (PMEL_HUMAN)
KVFLRNQPF

SEQ ID NO: 130150 - protein, 9 aa, Artificial Sequence
  Description of Artificial Sequence: Synthetic peptide
  Seed: RNQPLTFAL (PMEL_HUMAN)
RMQPLTFAL

SEQ ID NO: 130151 - protein, 11 aa, Artificial Sequence
  Description of Artificial Sequence: Synthetic peptide
  Seed: YLAEADLSYTW (PMEL_HUMAN)
YTAEADLSYTW

SEQ ID NO: 130152 - protein, 10 aa, Artificial Sequence
  Description of Artificial Sequence: Synthetic peptide
  Seed: RQVPLDCVLY (PMEL_HUMAN)
RLVPLDCVLF

SEQ ID NO: 130153 - protein, 10 aa, Artificial Sequence
  Description of Artificial Sequence: Synthetic peptide
  Seed: ALDGGNKHFL (PMEL_HUMAN)
AWDGGNKHFM

SEQ ID NO: 130154 - protein, 9 aa, Artificial Sequence
  Description of Artificial Sequence: Synthetic peptide
  Seed: TYLEPGPVT (PMEL_HUMAN)
TWLEPGPVM

SEQ ID NO: 130155 - protein, 11 aa, Artificial Sequence
  Description of Artificial Sequence: Synthetic peptide
  Seed: AEAPNTTAGQV (PMEL_HUMAN)
AEAPNTTAGQL

SEQ ID NO: 130156 - protein, 9 aa, Artificial Sequence
  Description of Artificial Sequence: Synthetic peptide
  Seed: AAIPLTSCG (PMEL_HUMAN)
ASIPLTSCY

SEQ ID NO: 130157 - protein, 10 aa, Artificial Sequence
  Description of Artificial Sequence: Synthetic peptide
  Seed: EVSIVVLSGT (PMEL_HUMAN)
EGSIVVLSGI

SEQ ID NO: 130158 - protein, 10 aa, Artificial Sequence
  Description of Artificial Sequence: Synthetic peptide
  Seed: GSFSVTLDIV (PMEL_HUMAN)
GTFSVTLDIV

SEQ ID NO: 130159 - protein, 9 aa, Artificial Sequence
  Description of Artificial Sequence: Synthetic peptide
  Seed: MSTPEATGM (PMEL_HUMAN)
MPTPEATGM

SEQ ID NO: 130160 - protein, 9 aa, Artificial Sequence
  Description of Artificial Sequence: Synthetic peptide
  Seed: TLIGANASF (PMEL_HUMAN)
TLIGANASA

SEQ ID NO: 130161 - protein, 9 aa, Artificial Sequence
  Description of Artificial Sequence: Synthetic peptide
  Seed: VSNDGPTLI (PMEL_HUMAN)
VYNDGPTLI

SEQ ID NO: 130162 - protein, 9 aa, Artificial Sequence
  Description of Artificial Sequence: Synthetic peptide
  Seed: TEWVETTAR (PMEL_HUMAN)
TSWVETTAR

SEQ ID NO: 130163 - protein, 9 aa, Artificial Sequence
  Description of Artificial Sequence: Synthetic peptide
  Seed: FSIALNFPG (PMEL_HUMAN)
FQIALNFPW

SEQ ID NO: 130164 - protein, 9 aa, Artificial Sequence
  Description of Artificial Sequence: Synthetic peptide
  Seed: GTYCLNVSL (PMEL_HUMAN)
GVYCLNVSF

SEQ ID NO: 130165 - protein, 9 aa, Artificial Sequence
  Description of Artificial Sequence: Synthetic peptide
  Seed: MAVVLASLI (PMEL_HUMAN)
MTVVLASLF

SEQ ID NO: 130166 - protein, 9 aa, Artificial Sequence
  Description of Artificial Sequence: Synthetic peptide
  Seed: TTPGQAPTA (PMEL_HUMAN)
TIPGQAPTM

SEQ ID NO: 130167 - protein, 9 aa, Artificial Sequence
  Description of Artificial Sequence: Synthetic peptide
  Seed: HLAVIGALL (PMEL_HUMAN)
HLAVIGALM

SEQ ID NO: 130168 - protein, 10 aa, Artificial Sequence
  Description of Artificial Sequence: Synthetic peptide
  Seed: AEVSIVVLSG (PMEL_HUMAN)
AEVSIVVLSC

SEQ ID NO: 130169 - protein, 10 aa, Artificial Sequence
  Description of Artificial Sequence: Synthetic peptide
  Seed: YGSFSVTLDI (PMEL_HUMAN)
YHSFSVTLDF

SEQ ID NO: 130170 - protein, 10 aa, Artificial Sequence
  Description of Artificial Sequence: Synthetic peptide
  Seed: RQVPLDCVLY (PMEL_HUMAN)
RTVPLDCVLW

SEQ ID NO: 130171 - protein, 11 aa, Artificial Sequence
  Description of Artificial Sequence: Synthetic peptide
  Seed: YVPLAHSSSAF (PMEL_HUMAN)
YEPLAHSSSAF

SEQ ID NO: 130172 - protein, 10 aa, Artificial Sequence
  Description of Artificial Sequence: Synthetic peptide
  Seed: VPQLPHSSSH (PMEL_HUMAN)
VVQLPHSSSF

SEQ ID NO: 130173 - protein, 9 aa, Artificial Sequence
  Description of Artificial Sequence: Synthetic peptide
  Seed: ITDQVPFSV (PMEL_HUMAN)
IMDQVPFSY

SEQ ID NO: 130174 - protein, 9 aa, Artificial Sequence
  Description of Artificial Sequence: Synthetic peptide
  Seed: MTPAEVSIV (PMEL_HUMAN)
MLPAEVSIL

SEQ ID NO: 130175 - protein, 9 aa, Artificial Sequence
  Description of Artificial Sequence: Synthetic peptide
  Seed: AESTGMTPE (PMEL_HUMAN)
AESTGMTPL

SEQ ID NO: 130176 - protein, 9 aa, Artificial Sequence
  Description of Artificial Sequence: Synthetic peptide
  Seed: ALDGGNKHF (PMEL_HUMAN)
ATDGGNKHW

SEQ ID NO: 130177 - protein, 9 aa, Artificial Sequence
  Description of Artificial Sequence: Synthetic peptide
  Seed: VVLSGTTAA (PMEL_HUMAN)
VILSGTTAY

SEQ ID NO: 130178 - protein, 9 aa, Artificial Sequence
  Description of Artificial Sequence: Synthetic peptide
  Seed: CQLVLHQIL (PMEL_HUMAN)
CKLVLHQIY

SEQ ID NO: 130179 - protein, 10 aa, Artificial Sequence
  Description of Artificial Sequence: Synthetic peptide
  Seed: VSLADTNSLA (PMEL_HUMAN)
VALADTNSLI

SEQ ID NO: 130180 - protein, 9 aa, Artificial Sequence
  Description of Artificial Sequence: Synthetic peptide
  Seed: FTITDQVPF (PMEL_HUMAN)
FYITDQVPI

SEQ ID NO: 130181 - protein, 10 aa, Artificial Sequence
  Description of Artificial Sequence: Synthetic peptide
  Seed: VPQLPHSSSH (PMEL_HUMAN)
VDQLPHSSSF

SEQ ID NO: 130182 - protein, 11 aa, Artificial Sequence
  Description of Artificial Sequence: Synthetic peptide
  Seed: YRYGSFSVTLD (PMEL_HUMAN)
YRYGSFSVTLI

SEQ ID NO: 130183 - protein, 9 aa, Artificial Sequence
  Description of Artificial Sequence: Synthetic peptide
  Seed: RAMLGTHTM (PMEL_HUMAN)
RPMLGTHTP

SEQ ID NO: 130184 - protein, 9 aa, Artificial Sequence
  Description of Artificial Sequence: Synthetic peptide
  Seed: VQVPTTEVI (PMEL_HUMAN)
VFVPTTEVY

SEQ ID NO: 130185 - protein, 8 aa, Artificial Sequence
  Description of Artificial Sequence: Synthetic peptide
  Seed: LRNQPLTF (PMEL_HUMAN)
LQNQPLTY

SEQ ID NO: 130186 - protein, 9 aa, Artificial Sequence
  Description of Artificial Sequence: Synthetic peptide
  Seed: ASFSIALNF (PMEL_HUMAN)
AYFSIALNF

SEQ ID NO: 130187 - protein, 10 aa, Artificial Sequence
  Description of Artificial Sequence: Synthetic peptide
  Seed: KTWGQYWQVL (PMEL_HUMAN)
KLWGQYWQVL

SEQ ID NO: 130188 - protein, 10 aa, Artificial Sequence
  Description of Artificial Sequence: Synthetic peptide
  Seed: RGSRSYVPLA (PMEL_HUMAN)
RISRSYVPLG

SEQ ID NO: 130189 - protein, 11 aa, Artificial Sequence
  Description of Artificial Sequence: Synthetic peptide
  Seed: SQKRSFVYVWK (PMEL_HUMAN)
SLKRSFVYVWR

SEQ ID NO: 130190 - protein, 10 aa, Artificial Sequence
  Description of Artificial Sequence: Synthetic peptide
  Seed: VTAQVVLQAA (PMEL_HUMAN)
VIAQVVLQAL

SEQ ID NO: 130191 - protein, 9 aa, Artificial Sequence
  Description of Artificial Sequence: Synthetic peptide
  Seed: VPLDCVLYR (PMEL_HUMAN)
VVLDCVLYK

SEQ ID NO: 130192 - protein, 8 aa, Artificial Sequence
  Description of Artificial Sequence: Synthetic peptide
  Seed: QDFSVPQL (PMEL_HUMAN)
QEFSVPQL

SEQ ID NO: 130193 - protein, 9 aa, Artificial Sequence
  Description of Artificial Sequence: Synthetic peptide
  Seed: SAFTITDQV (PMEL_HUMAN)
SIFTITDQA

SEQ ID NO: 130194 - protein, 9 aa, Artificial Sequence
  Description of Artificial Sequence: Synthetic peptide
  Seed: AVIGALLAV (PMEL_HUMAN)
AIIGALLAM

SEQ ID NO: 130195 - protein, 9 aa, Artificial Sequence
  Description of Artificial Sequence: Synthetic peptide
  Seed: IGANASFSI (PMEL_HUMAN)
ITANASFSL

SEQ ID NO: 130196 - protein, 9 aa, Artificial Sequence
  Description of Artificial Sequence: Synthetic peptide
  Seed: RLVKRQVPL (PMEL_HUMAN)
RVVKRQVPW

SEQ ID NO: 130197 - protein, 11 aa, Artificial Sequence
  Description of Artificial Sequence: Synthetic peptide
  Seed: SYVPLAHSSSA (PMEL_HUMAN)
SLVPLAHSSSM

SEQ ID NO: 130198 - protein, 9 aa, Artificial Sequence
  Description of Artificial Sequence: Synthetic peptide
  Seed: VPLAHSSSA (PMEL_HUMAN)
VPLAHSSSF

SEQ ID NO: 130199 - protein, 9 aa, Artificial Sequence
  Description of Artificial Sequence: Synthetic peptide
  Seed: LVLMAVVLA (PMEL_HUMAN)
LMLMAVVLV

SEQ ID NO: 130200 - protein, 10 aa, Artificial Sequence
  Description of Artificial Sequence: Synthetic peptide
  Seed: LIVGILLVLM (PMEL_HUMAN)
LLVGILLVLI

SEQ ID NO: 130201 - protein, 10 aa, Artificial Sequence
  Description of Artificial Sequence: Synthetic peptide
  Seed: GTYCLNVSLA (PMEL_HUMAN)
GLYCLNVSLI

SEQ ID NO: 130202 - protein, 9 aa, Artificial Sequence
  Description of Artificial Sequence: Synthetic peptide
  Seed: ITGSLGPLL (PMEL_HUMAN)
IQGSLGPLL

SEQ ID NO: 130203 - protein, 11 aa, Artificial Sequence
  Description of Artificial Sequence: Synthetic peptide
  Seed: QLYPEWTEAQR (PMEL_HUMAN)
QSYPEWTEAQR

SEQ ID NO: 130204 - protein, 10 aa, Artificial Sequence
  Description of Artificial Sequence: Synthetic peptide
  Seed: QVLGGPVSGL (PMEL_HUMAN)
QLLGGPVSGL

SEQ ID NO: 130205 - protein, 9 aa, Artificial Sequence
  Description of Artificial Sequence: Synthetic peptide
  Seed: FGDSSGTLI (PMEL_HUMAN)
FWDSSGTLA

SEQ ID NO: 130206 - protein, 10 aa, Artificial Sequence
  Description of Artificial Sequence: Synthetic peptide
  Seed: VPQLPHSSSH (PMEL_HUMAN)
VLQLPHSSSF

SEQ ID NO: 130207 - protein, 9 aa, Artificial Sequence
  Description of Artificial Sequence: Synthetic peptide
  Seed: ANASFSIAL (PMEL_HUMAN)
AAASFSIAL

SEQ ID NO: 130208 - protein, 9 aa, Artificial Sequence
  Description of Artificial Sequence: Synthetic peptide
  Seed: LADTNSLAV (PMEL_HUMAN)
LWDTNSLAM

SEQ ID NO: 130209 - protein, 9 aa, Artificial Sequence
  Description of Artificial Sequence: Synthetic peptide
  Seed: TEVISTAPV (PMEL_HUMAN)
TEVISTAPY

SEQ ID NO: 130210 - protein, 10 aa, Artificial Sequence
  Description of Artificial Sequence: Synthetic peptide
  Seed: RGSRSYVPLA (PMEL_HUMAN)
RVSRSYVPLF

SEQ ID NO: 130211 - protein, 9 aa, Artificial Sequence
  Description of Artificial Sequence: Synthetic peptide
  Seed: TTPGQAPTA (PMEL_HUMAN)
TGPGQAPTL

SEQ ID NO: 130212 - protein, 9 aa, Artificial Sequence
  Description of Artificial Sequence: Synthetic peptide
  Seed: WSQKRSFVY (PMEL_HUMAN)
WQQKRSFVL

SEQ ID NO: 130213 - protein, 10 aa, Artificial Sequence
  Description of Artificial Sequence: Synthetic peptide
  Seed: VPLDCVLYRY (PMEL_HUMAN)
VMLDCVLYRY

SEQ ID NO: 130214 - protein, 9 aa, Artificial Sequence
  Description of Artificial Sequence: Synthetic peptide
  Seed: AQVTTTEWV (PMEL_HUMAN)
AVVTTTEWL

SEQ ID NO: 130215 - protein, 9 aa, Artificial Sequence
  Description of Artificial Sequence: Synthetic peptide
  Seed: FGDSSGTLI (PMEL_HUMAN)
FVDSSGTLI

SEQ ID NO: 130216 - protein, 9 aa, Artificial Sequence
  Description of Artificial Sequence: Synthetic peptide
  Seed: VSLADTNSL (PMEL_HUMAN)
VILADTNSV

SEQ ID NO: 130217 - protein, 10 aa, Artificial Sequence
  Description of Artificial Sequence: Synthetic peptide
  Seed: LVLMAVVLAS (PMEL_HUMAN)
LYLMAVVLAT

SEQ ID NO: 130218 - protein, 10 aa, Artificial Sequence
  Description of Artificial Sequence: Synthetic peptide
  Seed: HTMEVTVYHR (PMEL_HUMAN)
HWMEVTVYHR

SEQ ID NO: 130219 - protein, 10 aa, Artificial Sequence
  Description of Artificial Sequence: Synthetic peptide
  Seed: SGTYCLNVSL (PMEL_HUMAN)
SFTYCLNVSY

SEQ ID NO: 130220 - protein, 10 aa, Artificial Sequence
  Description of Artificial Sequence: Synthetic peptide
  Seed: SQVWGGQPVY (PMEL_HUMAN)
SSVWGGQPVW

SEQ ID NO: 130221 - protein, 9 aa, Artificial Sequence
  Description of Artificial Sequence: Synthetic peptide
  Seed: AEPSGTTSV (PMEL_HUMAN)
AQPSGTTSL

SEQ ID NO: 130222 - protein, 9 aa, Artificial Sequence
  Description of Artificial Sequence: Synthetic peptide
  Seed: VLGGPVSGL (PMEL_HUMAN)
VAGGPVSGY

SEQ ID NO: 130223 - protein, 9 aa, Artificial Sequence
  Description of Artificial Sequence: Synthetic peptide
  Seed: GTYCLNVSL (PMEL_HUMAN)
GSYCLNVSY

SEQ ID NO: 130224 - protein, 10 aa, Artificial Sequence
  Description of Artificial Sequence: Synthetic peptide
  Seed: KTWGQYWQVL (PMEL_HUMAN)
KIWGQYWQVN

SEQ ID NO: 130225 - protein, 9 aa, Artificial Sequence
  Description of Artificial Sequence: Synthetic peptide
  Seed: RGGQVSLKV (PMEL_HUMAN)
RAGQVSLKI

SEQ ID NO: 130226 - protein, 10 aa, Artificial Sequence
  Description of Artificial Sequence: Synthetic peptide
  Seed: TPEATGMTPA (PMEL_HUMAN)
TPEATGMTPV

SEQ ID NO: 130227 - protein, 9 aa, Artificial Sequence
  Description of Artificial Sequence: Synthetic peptide
  Seed: WSQKRSFVY (PMEL_HUMAN)
WHQKRSFVF

SEQ ID NO: 130228 - protein, 9 aa, Artificial Sequence
  Description of Artificial Sequence: Synthetic peptide
  Seed: GSRSYVPLA (PMEL_HUMAN)
GLRSYVPLK

SEQ ID NO: 130229 - protein, 9 aa, Artificial Sequence
  Description of Artificial Sequence: Synthetic peptide
  Seed: VTLDIVQGI (PMEL_HUMAN)
VQLDIVQGV

SEQ ID NO: 130230 - protein, 9 aa, Artificial Sequence
  Description of Artificial Sequence: Synthetic peptide
  Seed: TIINGSQVW (PMEL_HUMAN)
TQINGSQVW

SEQ ID NO: 130231 - protein, 10 aa, Artificial Sequence
  Description of Artificial Sequence: Synthetic peptide
  Seed: QVPLDCVLYR (PMEL_HUMAN)
QAPLDCVLYK

SEQ ID NO: 130232 - protein, 9 aa, Artificial Sequence
  Description of Artificial Sequence: Synthetic peptide
  Seed: LLDGTATLR (PMEL_HUMAN)
LQDGTATLY

SEQ ID NO: 130233 - protein, 10 aa, Artificial Sequence
  Description of Artificial Sequence: Synthetic peptide
  Seed: YRYGSFSVTL (PMEL_HUMAN)
YWYGSFSVTI

SEQ ID NO: 130234 - protein, 10 aa, Artificial Sequence
  Description of Artificial Sequence: Synthetic peptide
  Seed: LAVVSTQLIM (PMEL_HUMAN)
LPVVSTQLIM

SEQ ID NO: 130235 - protein, 11 aa, Artificial Sequence
  Description of Artificial Sequence: Synthetic peptide
  Seed: RLPRIFCSCPI (PMEL_HUMAN)
RMPRIFCSCPL

SEQ ID NO: 130236 - protein, 9 aa, Artificial Sequence
  Description of Artificial Sequence: Synthetic peptide
  Seed: SQVWGGQPV (PMEL_HUMAN)
SMVWGGQPA

SEQ ID NO: 130237 - protein, 9 aa, Artificial Sequence
  Description of Artificial Sequence: Synthetic peptide
  Seed: SGLSIGTGR (PMEL_HUMAN)
SALSIGTGH

SEQ ID NO: 130238 - protein, 10 aa, Artificial Sequence
  Description of Artificial Sequence: Synthetic peptide
  Seed: RALVVTHTYL (PMEL_HUMAN)
RMLVVTHTYM

SEQ ID NO: 130239 - protein, 9 aa, Artificial Sequence
  Description of Artificial Sequence: Synthetic peptide
  Seed: CPIGENSPL (PMEL_HUMAN)
CPIGENSPY

SEQ ID NO: 130240 - protein, 11 aa, Artificial Sequence
  Description of Artificial Sequence: Synthetic peptide
  Seed: LYRYGSFSVTL (PMEL_HUMAN)
LARYGSFSVTF

SEQ ID NO: 130241 - protein, 9 aa, Artificial Sequence
  Description of Artificial Sequence: Synthetic peptide
  Seed: LQAAIPLTS (PMEL_HUMAN)
LMAAIPLTH

SEQ ID NO: 130242 - protein, 9 aa, Artificial Sequence
  Description of Artificial Sequence: Synthetic peptide
  Seed: VTLDIVQGI (PMEL_HUMAN)
VTLDIVQGY

SEQ ID NO: 130243 - protein, 10 aa, Artificial Sequence
  Description of Artificial Sequence: Synthetic peptide
  Seed: GPLLDGTATL (PMEL_HUMAN)
GTLLDGTATI

SEQ ID NO: 130244 - protein, 10 aa, Artificial Sequence
  Description of Artificial Sequence: Synthetic peptide
  Seed: EAPNTTAGQV (PMEL_HUMAN)
ETPNTTAGQV

SEQ ID NO: 130245 - protein, 9 aa, Artificial Sequence
  Description of Artificial Sequence: Synthetic peptide
  Seed: LSIGTGRAM (PMEL_HUMAN)
LIIGTGRAY

SEQ ID NO: 130246 - protein, 9 aa, Artificial Sequence
  Description of Artificial Sequence: Synthetic peptide
  Seed: KRCLLHLAV (PMEL_HUMAN)
KRCLLHLAK

SEQ ID NO: 130247 - protein, 9 aa, Artificial Sequence
  Description of Artificial Sequence: Synthetic peptide
  Seed: YLAEADLSY (PMEL_HUMAN)
YVAEADLSV

SEQ ID NO: 130248 - protein, 10 aa, Artificial Sequence
  Description of Artificial Sequence: Synthetic peptide
  Seed: VQGIESAEIL (PMEL_HUMAN)
VQGIESAEIF

SEQ ID NO: 130249 - protein, 9 aa, Artificial Sequence
  Description of Artificial Sequence: Synthetic peptide
  Seed: LADTNSLAV (PMEL_HUMAN)
LQDTNSLAL

SEQ ID NO: 130250 - protein, 9 aa, Artificial Sequence
  Description of Artificial Sequence: Synthetic peptide
  Seed: GSWSQKRSF (PMEL_HUMAN)
GVWSQKRSY

SEQ ID NO: 130251 - protein, 9 aa, Artificial Sequence
  Description of Artificial Sequence: Synthetic peptide
  Seed: DAFELTVSC (PMEL_HUMAN)
DPFELTVSL

SEQ ID NO: 130252 - protein, 9 aa, Artificial Sequence
  Description of Artificial Sequence: Synthetic peptide
  Seed: GSRSYVPLA (PMEL_HUMAN)
GTRSYVPLG

SEQ ID NO: 130253 - protein, 9 aa, Artificial Sequence
  Description of Artificial Sequence: Synthetic peptide
  Seed: MTPEKVPVS (PMEL_HUMAN)
MVPEKVPVV

SEQ ID NO: 130254 - protein, 9 aa, Artificial Sequence
  Description of Artificial Sequence: Synthetic peptide
  Seed: HTMEVTVYH (PMEL_HUMAN)
HVMEVTVYV

SEQ ID NO: 130255 - protein, 9 aa, Artificial Sequence
  Description of Artificial Sequence: Synthetic peptide
  Seed: ILKGGSGTY (PMEL_HUMAN)
IMKGGSGTM

SEQ ID NO: 130256 - protein, 9 aa, Artificial Sequence
  Description of Artificial Sequence: Synthetic peptide
  Seed: LADTNSLAV (PMEL_HUMAN)
LVDTNSLAV

SEQ ID NO: 130257 - protein, 9 aa, Artificial Sequence
  Description of Artificial Sequence: Synthetic peptide
  Seed: HTMEVTVYH (PMEL_HUMAN)
HSMEVTVYK

SEQ ID NO: 130258 - protein, 10 aa, Artificial Sequence
  Description of Artificial Sequence: Synthetic peptide
  Seed: NKHFLRNQPL (PMEL_HUMAN)
NMHFLRNQPL

SEQ ID NO: 130259 - protein, 9 aa, Artificial Sequence
  Description of Artificial Sequence: Synthetic peptide
  Seed: KQDFSVPQL (PMEL_HUMAN)
KLDFSVPQC

SEQ ID NO: 130260 - protein, 9 aa, Artificial Sequence
  Description of Artificial Sequence: Synthetic peptide
  Seed: MAVVLASLI (PMEL_HUMAN)
MMVVLASLF

SEQ ID NO: 130261 - protein, 9 aa, Artificial Sequence
  Description of Artificial Sequence: Synthetic peptide
  Seed: LMAVVLASL (PMEL_HUMAN)
LLAVVLASL

SEQ ID NO: 130262 - protein, 9 aa, Artificial Sequence
  Description of Artificial Sequence: Synthetic peptide
  Seed: QVIWVNNTI (PMEL_HUMAN)
QSIWVNNTA

SEQ ID NO: 130263 - protein, 10 aa, Artificial Sequence
  Description of Artificial Sequence: Synthetic peptide
  Seed: VPQLPHSSSH (PMEL_HUMAN)
VSQLPHSSSL

SEQ ID NO: 130264 - protein, 10 aa, Artificial Sequence
  Description of Artificial Sequence: Synthetic peptide
  Seed: MPTAESTGMT (PMEL_HUMAN)
MCTAESTGMA

SEQ ID NO: 130265 - protein, 9 aa, Artificial Sequence
  Description of Artificial Sequence: Synthetic peptide
  Seed: VSVSQLRAL (PMEL_HUMAN)
VTVSQLRAM

SEQ ID NO: 130266 - protein, 9 aa, Artificial Sequence
  Description of Artificial Sequence: Synthetic peptide
  Seed: GQVPTTEVV (PMEL_HUMAN)
GTVPTTEVV

SEQ ID NO: 130267 - protein, 9 aa, Artificial Sequence
  Description of Artificial Sequence: Synthetic peptide
  Seed: VPLAHSSSA (PMEL_HUMAN)
VPLAHSSST

SEQ ID NO: 130268 - protein, 9 aa, Artificial Sequence
  Description of Artificial Sequence: Synthetic peptide
  Seed: MEVTVYHRR (PMEL_HUMAN)
MWVTVYHRR

SEQ ID NO: 130269 - protein, 8 aa, Artificial Sequence
  Description of Artificial Sequence: Synthetic peptide
  Seed: LVKRQVPL (PMEL_HUMAN)
LMKRQVPM

SEQ ID NO: 130270 - protein, 9 aa, Artificial Sequence
  Description of Artificial Sequence: Synthetic peptide
  Seed: WSQKRSFVY (PMEL_HUMAN)
WYQKRSFVI

SEQ ID NO: 130271 - protein, 9 aa, Artificial Sequence
  Description of Artificial Sequence: Synthetic peptide
  Seed: YPQETDDAC (PMEL_HUMAN)
YPQETDDAW

SEQ ID NO: 130272 - protein, 10 aa, Artificial Sequence
  Description of Artificial Sequence: Synthetic peptide
  Seed: LVLMAVVLAS (PMEL_HUMAN)
LMLMAVVLAM

SEQ ID NO: 130273 - protein, 11 aa, Artificial Sequence
  Description of Artificial Sequence: Synthetic peptide
  Seed: SGYLAEADLSY (PMEL_HUMAN)
SQYLAEADLSM

SEQ ID NO: 130274 - protein, 10 aa, Artificial Sequence
  Description of Artificial Sequence: Synthetic peptide
  Seed: VGILLVLMAV (PMEL_HUMAN)
VMILLVLMAV

SEQ ID NO: 130275 - protein, 9 aa, Artificial Sequence
  Description of Artificial Sequence: Synthetic peptide
  Seed: LAVGATKVP (PMEL_HUMAN)
LGVGATKVY

SEQ ID NO: 130276 - protein, 9 aa, Artificial Sequence
  Description of Artificial Sequence: Synthetic peptide
  Seed: VSLADTNSL (PMEL_HUMAN)
VALADTNSW

SEQ ID NO: 130277 - protein, 9 aa, Artificial Sequence
  Description of Artificial Sequence: Synthetic peptide
  Seed: MPTAESTGM (PMEL_HUMAN)
MPTAESTGY

SEQ ID NO: 130278 - protein, 9 aa, Artificial Sequence
  Description of Artificial Sequence: Synthetic peptide
  Seed: QAAIPLTSC (PMEL_HUMAN)
QSAIPLTSF

SEQ ID NO: 130279 - protein, 10 aa, Artificial Sequence
  Description of Artificial Sequence: Synthetic peptide
  Seed: ALDGGNKHFL (PMEL_HUMAN)
AFDGGNKHFF

SEQ ID NO: 130280 - protein, 10 aa, Artificial Sequence
  Description of Artificial Sequence: Synthetic peptide
  Seed: STAPVQMPTA (PMEL_HUMAN)
SVAPVQMPTA

SEQ ID NO: 130281 - protein, 9 aa, Artificial Sequence
  Description of Artificial Sequence: Synthetic peptide
  Seed: ITDQVPFSV (PMEL_HUMAN)
ILDQVPFSR

SEQ ID NO: 130282 - protein, 10 aa, Artificial Sequence
  Description of Artificial Sequence: Synthetic peptide
  Seed: VLMAVVLASL (PMEL_HUMAN)
VSMAVVLASV

SEQ ID NO: 130283 - protein, 10 aa, Artificial Sequence
  Description of Artificial Sequence: Synthetic peptide
  Seed: SQKRSFVYVW (PMEL_HUMAN)
STKRSFVYVY

SEQ ID NO: 130284 - protein, 9 aa, Artificial Sequence
  Description of Artificial Sequence: Synthetic peptide
  Seed: TTDGHRPTA (PMEL_HUMAN)
TNDGHRPTV

SEQ ID NO: 130285 - protein, 11 aa, Artificial Sequence
  Description of Artificial Sequence: Synthetic peptide
  Seed: VVLASLIYRRR (PMEL_HUMAN)
VTLASLIYRRK

SEQ ID NO: 130286 - protein, 9 aa, Artificial Sequence
  Description of Artificial Sequence: Synthetic peptide
  Seed: AVVLASLIY (PMEL_HUMAN)
AMVLASLIY

SEQ ID NO: 130287 - protein, 10 aa, Artificial Sequence
  Description of Artificial Sequence: Synthetic peptide
  Seed: THTMEVTVYH (PMEL_HUMAN)
TDTMEVTVYY

SEQ ID NO: 130288 - protein, 9 aa, Artificial Sequence
  Description of Artificial Sequence: Synthetic peptide
  Seed: VSLADTNSL (PMEL_HUMAN)
VALADTNSV

SEQ ID NO: 130289 - protein, 9 aa, Artificial Sequence
  Description of Artificial Sequence: Synthetic peptide
  Seed: KQDFSVPQL (PMEL_HUMAN)
KADFSVPQL

SEQ ID NO: 130290 - protein, 10 aa, Artificial Sequence
  Description of Artificial Sequence: Synthetic peptide
  Seed: SCPIGENSPL (PMEL_HUMAN)
SKPIGENSPM

SEQ ID NO: 130291 - protein, 10 aa, Artificial Sequence
  Description of Artificial Sequence: Synthetic peptide
  Seed: YVWKTWGQYW (PMEL_HUMAN)
YPWKTWGQYF

SEQ ID NO: 130292 - protein, 9 aa, Artificial Sequence
  Description of Artificial Sequence: Synthetic peptide
  Seed: KVSNDGPTL (PMEL_HUMAN)
KTSNDGPTW

SEQ ID NO: 130293 - protein, 9 aa, Artificial Sequence
  Description of Artificial Sequence: Synthetic peptide
  Seed: AVIGALLAV (PMEL_HUMAN)
ATIGALLAK

SEQ ID NO: 130294 - protein, 11 aa, Artificial Sequence
  Description of Artificial Sequence: Synthetic peptide
  Seed: HSSSHWLRLPR (PMEL_HUMAN)
HTSSHWLRLPR

SEQ ID NO: 130295 - protein, 9 aa, Artificial Sequence
  Description of Artificial Sequence: Synthetic peptide
  Seed: TTTEWVETT (PMEL_HUMAN)
TVTEWVETV

SEQ ID NO: 130296 - protein, 10 aa, Artificial Sequence
  Description of Artificial Sequence: Synthetic peptide
  Seed: EVMGTTLAEM (PMEL_HUMAN)
EPMGTTLAEY

SEQ ID NO: 130297 - protein, 9 aa, Artificial Sequence
  Description of Artificial Sequence: Synthetic peptide
  Seed: TPAEVSIVV (PMEL_HUMAN)
TVAEVSIVV

SEQ ID NO: 130298 - protein, 9 aa, Artificial Sequence
  Description of Artificial Sequence: Synthetic peptide
  Seed: ALVVTHTYL (PMEL_HUMAN)
AIVVTHTYF

SEQ ID NO: 130299 - protein, 9 aa, Artificial Sequence
  Description of Artificial Sequence: Synthetic peptide
  Seed: EVMGTTLAE (PMEL_HUMAN)
EMMGTTLAR

SEQ ID NO: 130300 - protein, 9 aa, Artificial Sequence
  Description of Artificial Sequence: Synthetic peptide
  Seed: ESTGMTPEK (PMEL_HUMAN)
EMTGMTPEK

SEQ ID NO: 130301 - protein, 9 aa, Artificial Sequence
  Description of Artificial Sequence: Synthetic peptide
  Seed: RAMLGTHTM (PMEL_HUMAN)
RWMLGTHTF

SEQ ID NO: 130302 - protein, 10 aa, Artificial Sequence
  Description of Artificial Sequence: Synthetic peptide
  Seed: RTKAWNRQLY (PMEL_HUMAN)
RIKAWNRQLW

SEQ ID NO: 130303 - protein, 9 aa, Artificial Sequence
  Description of Artificial Sequence: Synthetic peptide
  Seed: QKRSFVYVW (PMEL_HUMAN)
QQRSFVYVF

SEQ ID NO: 130304 - protein, 10 aa, Artificial Sequence
  Description of Artificial Sequence: Synthetic peptide
  Seed: YGSFSVTLDI (PMEL_HUMAN)
YISFSVTLDW

SEQ ID NO: 130305 - protein, 10 aa, Artificial Sequence
  Description of Artificial Sequence: Synthetic peptide
  Seed: AEMSTPEATG (PMEL_HUMAN)
AEMSTPEATV

SEQ ID NO: 130306 - protein, 9 aa, Artificial Sequence
  Description of Artificial Sequence: Synthetic peptide
  Seed: ITGSLGPLL (PMEL_HUMAN)
ITGSLGPLM

SEQ ID NO: 130307 - protein, 10 aa, Artificial Sequence
  Description of Artificial Sequence: Synthetic peptide
  Seed: LVLMAVVLAS (PMEL_HUMAN)
LWLMAVVLAV

SEQ ID NO: 130308 - protein, 10 aa, Artificial Sequence
  Description of Artificial Sequence: Synthetic peptide
  Seed: RQLYPEWTEA (PMEL_HUMAN)
RQLYPEWTEY

SEQ ID NO: 130309 - protein, 8 aa, Artificial Sequence
  Description of Artificial Sequence: Synthetic peptide
  Seed: LHDPSGYL (PMEL_HUMAN)
LGDPSGYI

SEQ ID NO: 130310 - protein, 9 aa, Artificial Sequence
  Description of Artificial Sequence: Synthetic peptide
  Seed: HLAVIGALL (PMEL_HUMAN)
HIAVIGALF

SEQ ID NO: 130311 - protein, 10 aa, Artificial Sequence
  Description of Artificial Sequence: Synthetic peptide
  Seed: RALDGGNKHF (PMEL_HUMAN)
RGLDGGNKHW

SEQ ID NO: 130312 - protein, 9 aa, Artificial Sequence
  Description of Artificial Sequence: Synthetic peptide
  Seed: RALVVTHTY (PMEL_HUMAN)
RTLVVTHTR

SEQ ID NO: 130313 - protein, 11 aa, Artificial Sequence
  Description of Artificial Sequence: Synthetic peptide
  Seed: ISRALVVTHTY (PMEL_HUMAN)
IQRALVVTHTW

SEQ ID NO: 130314 - protein, 11 aa, Artificial Sequence
  Description of Artificial Sequence: Synthetic peptide
  Seed: RAMLGTHTMEV (PMEL_HUMAN)
RLMLGTHTMEL

SEQ ID NO: 130315 - protein, 11 aa, Artificial Sequence
  Description of Artificial Sequence: Synthetic peptide
  Seed: SYVPLAHSSSA (PMEL_HUMAN)
SRVPLAHSSSF

SEQ ID NO: 130316 - protein, 10 aa, Artificial Sequence
  Description of Artificial Sequence: Synthetic peptide
  Seed: THTMEVTVYH (PMEL_HUMAN)
TLTMEVTVYK

SEQ ID NO: 130317 - protein, 9 aa, Artificial Sequence
  Description of Artificial Sequence: Synthetic peptide
  Seed: IVVLSGTTA (PMEL_HUMAN)
IPVLSGTTL

SEQ ID NO: 130318 - protein, 10 aa, Artificial Sequence
  Description of Artificial Sequence: Synthetic peptide
  Seed: RGSRSYVPLA (PMEL_HUMAN)
RISRSYVPLR

SEQ ID NO: 130319 - protein, 9 aa, Artificial Sequence
  Description of Artificial Sequence: Synthetic peptide
  Seed: IVVLSGTTA (PMEL_HUMAN)
IPVLSGTTA

SEQ ID NO: 130320 - protein, 9 aa, Artificial Sequence
  Description of Artificial Sequence: Synthetic peptide
  Seed: GEGDAFELT (PMEL_HUMAN)
GEGDAFELV

SEQ ID NO: 130321 - protein, 10 aa, Artificial Sequence
  Description of Artificial Sequence: Synthetic peptide
  Seed: TAAQVTTTEW (PMEL_HUMAN)
TSAQVTTTEF

SEQ ID NO: 130322 - protein, 9 aa, Artificial Sequence
  Description of Artificial Sequence: Synthetic peptide
  Seed: RALVVTHTY (PMEL_HUMAN)
RLLVVTHTL

SEQ ID NO: 130323 - protein, 8 aa, Artificial Sequence
  Description of Artificial Sequence: Synthetic peptide
  Seed: TEVISTAP (PMEL_HUMAN)
TEVISTAV

SEQ ID NO: 130324 - protein, 9 aa, Artificial Sequence
  Description of Artificial Sequence: Synthetic peptide
  Seed: KHFLRNQPL (PMEL_HUMAN)
KNFLRNQPY

SEQ ID NO: 130325 - protein, 9 aa, Artificial Sequence
  Description of Artificial Sequence: Synthetic peptide
  Seed: SVQVPTTEV (PMEL_HUMAN)
SAQVPTTEI

SEQ ID NO: 130326 - protein, 9 aa, Artificial Sequence
  Description of Artificial Sequence: Synthetic peptide
  Seed: SSHWLRLPR (PMEL_HUMAN)
SIHWLRLPR

SEQ ID NO: 130327 - protein, 10 aa, Artificial Sequence
  Description of Artificial Sequence: Synthetic peptide
  Seed: YVPLAHSSSA (PMEL_HUMAN)
YRPLAHSSSI

SEQ ID NO: 130328 - protein, 10 aa, Artificial Sequence
  Description of Artificial Sequence: Synthetic peptide
  Seed: VSLADTNSLA (PMEL_HUMAN)
VGLADTNSLV

SEQ ID NO: 130329 - protein, 10 aa, Artificial Sequence
  Description of Artificial Sequence: Synthetic peptide
  Seed: HFLRNQPLTF (PMEL_HUMAN)
HKLRNQPLTF

SEQ ID NO: 130330 - protein, 9 aa, Artificial Sequence
  Description of Artificial Sequence: Synthetic peptide
  Seed: HTYLEPGPV (PMEL_HUMAN)
HVYLEPGPY

SEQ ID NO: 130331 - protein, 9 aa, Artificial Sequence
  Description of Artificial Sequence: Synthetic peptide
  Seed: FGDSSGTLI (PMEL_HUMAN)
FQDSSGTLI

SEQ ID NO: 130332 - protein, 9 aa, Artificial Sequence
  Description of Artificial Sequence: Synthetic peptide
  Seed: AQVTTTEWV (PMEL_HUMAN)
ATVTTTEWV

SEQ ID NO: 130333 - protein, 9 aa, Artificial Sequence
  Description of Artificial Sequence: Synthetic peptide
  Seed: EKVPVSEVM (PMEL_HUMAN)
ELVPVSEVY

SEQ ID NO: 130334 - protein, 9 aa, Artificial Sequence
  Description of Artificial Sequence: Synthetic peptide
  Seed: KQDFSVPQL (PMEL_HUMAN)
KYDFSVPQM

SEQ ID NO: 130335 - protein, 10 aa, Artificial Sequence
  Description of Artificial Sequence: Synthetic peptide
  Seed: KVLPDGQVIW (PMEL_HUMAN)
KGLPDGQVIW

SEQ ID NO: 130336 - protein, 9 aa, Artificial Sequence
  Description of Artificial Sequence: Synthetic peptide
  Seed: RIFCSCPIG (PMEL_HUMAN)
RIFCSCPIK

SEQ ID NO: 130337 - protein, 11 aa, Artificial Sequence
  Description of Artificial Sequence: Synthetic peptide
  Seed: TVYHRRGSRSY (PMEL_HUMAN)
TSYHRRGSRSW

SEQ ID NO: 130338 - protein, 9 aa, Artificial Sequence
  Description of Artificial Sequence: Synthetic peptide
  Seed: VWKTWGQYW (PMEL_HUMAN)
VVKTWGQYW

SEQ ID NO: 130339 - protein, 10 aa, Artificial Sequence
  Description of Artificial Sequence: Synthetic peptide
  Seed: MPTAESTGMT (PMEL_HUMAN)
MLTAESTGMA

SEQ ID NO: 130340 - protein, 10 aa, Artificial Sequence
  Description of Artificial Sequence: Synthetic peptide
  Seed: IALNFPGSQK (PMEL_HUMAN)
IQLNFPGSQK

SEQ ID NO: 130341 - protein, 9 aa, Artificial Sequence
  Description of Artificial Sequence: Synthetic peptide
  Seed: GSWSQKRSF (PMEL_HUMAN)
GLWSQKRSW

SEQ ID NO: 130342 - protein, 9 aa, Artificial Sequence
  Description of Artificial Sequence: Synthetic peptide
  Seed: DQVPFSVSV (PMEL_HUMAN)
DAVPFSVSI

SEQ ID NO: 130343 - protein, 9 aa, Artificial Sequence
  Description of Artificial Sequence: Synthetic peptide
  Seed: QVIWVNNTI (PMEL_HUMAN)
QQIWVNNTM

SEQ ID NO: 130344 - protein, 11 aa, Artificial Sequence
  Description of Artificial Sequence: Synthetic peptide
  Seed: FLRNQPLTFAL (PMEL_HUMAN)
FMRNQPLTFAV

SEQ ID NO: 130345 - protein, 9 aa, Artificial Sequence
  Description of Artificial Sequence: Synthetic peptide
  Seed: WSQKRSFVY (PMEL_HUMAN)
WMQKRSFVF

SEQ ID NO: 130346 - protein, 10 aa, Artificial Sequence
  Description of Artificial Sequence: Synthetic peptide
  Seed: KTWGQYWQVL (PMEL_HUMAN)
KFWGQYWQVL

SEQ ID NO: 130347 - protein, 9 aa, Artificial Sequence
  Description of Artificial Sequence: Synthetic peptide
  Seed: CQLVLHQIL (PMEL_HUMAN)
CQLVLHQIY

SEQ ID NO: 130348 - protein, 10 aa, Artificial Sequence
  Description of Artificial Sequence: Synthetic peptide
  Seed: YLAEADLSYT (PMEL_HUMAN)
YVAEADLSYY

SEQ ID NO: 130349 - protein, 10 aa, Artificial Sequence
  Description of Artificial Sequence: Synthetic peptide
  Seed: ALDGGNKHFL (PMEL_HUMAN)
ATDGGNKHFV

SEQ ID NO: 130350 - protein, 9 aa, Artificial Sequence
  Description of Artificial Sequence: Synthetic peptide
  Seed: SVPQLPHSS (PMEL_HUMAN)
SAPQLPHSL

SEQ ID NO: 130351 - protein, 9 aa, Artificial Sequence
  Description of Artificial Sequence: Synthetic peptide
  Seed: TPAEVSIVV (PMEL_HUMAN)
THAEVSIVL

SEQ ID NO: 130352 - protein, 9 aa, Artificial Sequence
  Description of Artificial Sequence: Synthetic peptide
  Seed: VVLQAAIPL (PMEL_HUMAN)
VALQAAIPW

SEQ ID NO: 130353 - protein, 9 aa, Artificial Sequence
  Description of Artificial Sequence: Synthetic peptide
  Seed: TPAEVSIVV (PMEL_HUMAN)
TVAEVSIVW

SEQ ID NO: 130354 - protein, 9 aa, Artificial Sequence
  Description of Artificial Sequence: Synthetic peptide
  Seed: KTWGQYWQV (PMEL_HUMAN)
KVWGQYWQT

SEQ ID NO: 130355 - protein, 9 aa, Artificial Sequence
  Description of Artificial Sequence: Synthetic peptide
  Seed: LPDGQVIWV (PMEL_HUMAN)
LIDGQVIWL

SEQ ID NO: 130356 - protein, 11 aa, Artificial Sequence
  Description of Artificial Sequence: Synthetic peptide
  Seed: LGPLLDGTATL (PMEL_HUMAN)
LKPLLDGTATL

SEQ ID NO: 130357 - protein, 9 aa, Artificial Sequence
  Description of Artificial Sequence: Synthetic peptide
  Seed: HLAVIGALL (PMEL_HUMAN)
HTAVIGALY

SEQ ID NO: 130358 - protein, 10 aa, Artificial Sequence
  Description of Artificial Sequence: Synthetic peptide
  Seed: LAVIGALLAV (PMEL_HUMAN)
LGVIGALLAI

SEQ ID NO: 130359 - protein, 9 aa, Artificial Sequence
  Description of Artificial Sequence: Synthetic peptide
  Seed: LNFPGSQKV (PMEL_HUMAN)
LRFPGSQKI

SEQ ID NO: 130360 - protein, 9 aa, Artificial Sequence
  Description of Artificial Sequence: Synthetic peptide
  Seed: TIINGSQVW (PMEL_HUMAN)
TVINGSQVY

SEQ ID NO: 130361 - protein, 10 aa, Artificial Sequence
  Description of Artificial Sequence: Synthetic peptide
  Seed: RQLYPEWTEA (PMEL_HUMAN)
RALYPEWTEL

SEQ ID NO: 130362 - protein, 10 aa, Artificial Sequence
  Description of Artificial Sequence: Synthetic peptide
  Seed: RQLYPEWTEA (PMEL_HUMAN)
RFLYPEWTEI

SEQ ID NO: 130363 - protein, 9 aa, Artificial Sequence
  Description of Artificial Sequence: Synthetic peptide
  Seed: LIVGILLVL (PMEL_HUMAN)
LQVGILLVF

SEQ ID NO: 130364 - protein, 8 aa, Artificial Sequence
  Description of Artificial Sequence: Synthetic peptide
  Seed: LADTNSLA (PMEL_HUMAN)
LTDTNSLI

SEQ ID NO: 130365 - protein, 9 aa, Artificial Sequence
  Description of Artificial Sequence: Synthetic peptide
  Seed: ESAEILQAV (PMEL_HUMAN)
EMAEILQAW

SEQ ID NO: 130366 - protein, 9 aa, Artificial Sequence
  Description of Artificial Sequence: Synthetic peptide
  Seed: CVLYRYGSF (PMEL_HUMAN)
CPLYRYGSL

SEQ ID NO: 130367 - protein, 9 aa, Artificial Sequence
  Description of Artificial Sequence: Synthetic peptide
  Seed: AQRLCQPVL (PMEL_HUMAN)
AQRLCQPVM

SEQ ID NO: 130368 - protein, 10 aa, Artificial Sequence
  Description of Artificial Sequence: Synthetic peptide
  Seed: QVLGGPVSGL (PMEL_HUMAN)
QQLGGPVSGV

SEQ ID NO: 130369 - protein, 9 aa, Artificial Sequence
  Description of Artificial Sequence: Synthetic peptide
  Seed: TAPVQMPTA (PMEL_HUMAN)
TIPVQMPTL

SEQ ID NO: 130370 - protein, 9 aa, Artificial Sequence
  Description of Artificial Sequence: Synthetic peptide
  Seed: VISTAPVQM (PMEL_HUMAN)
VSSTAPVQI

SEQ ID NO: 130371 - protein, 10 aa, Artificial Sequence
  Description of Artificial Sequence: Synthetic peptide
  Seed: RGSRSYVPLA (PMEL_HUMAN)
RRSRSYVPLV

SEQ ID NO: 130372 - protein, 10 aa, Artificial Sequence
  Description of Artificial Sequence: Synthetic peptide
  Seed: THTMEVTVYH (PMEL_HUMAN)
TQTMEVTVYK

SEQ ID NO: 130373 - protein, 8 aa, Artificial Sequence
  Description of Artificial Sequence: Synthetic peptide
  Seed: AQVVLQAA (PMEL_HUMAN)
AEVVLQAA

SEQ ID NO: 130374 - protein, 9 aa, Artificial Sequence
  Description of Artificial Sequence: Synthetic peptide
  Seed: LNFPGSQKV (PMEL_HUMAN)
LTFPGSQKL

SEQ ID NO: 130375 - protein, 9 aa, Artificial Sequence
  Description of Artificial Sequence: Synthetic peptide
  Seed: FGDSSGTLI (PMEL_HUMAN)
FYDSSGTLY

SEQ ID NO: 130376 - protein, 9 aa, Artificial Sequence
  Description of Artificial Sequence: Synthetic peptide
  Seed: TAEAPNTTA (PMEL_HUMAN)
TVEAPNTTV

SEQ ID NO: 130377 - protein, 9 aa, Artificial Sequence
  Description of Artificial Sequence: Synthetic peptide
  Seed: STAPVQMPT (PMEL_HUMAN)
STAPVQMPI

SEQ ID NO: 130378 - protein, 9 aa, Artificial Sequence
  Description of Artificial Sequence: Synthetic peptide
  Seed: VMGTTLAEM (PMEL_HUMAN)
VQGTTLAEV

SEQ ID NO: 130379 - protein, 9 aa, Artificial Sequence
  Description of Artificial Sequence: Synthetic peptide
  Seed: VLPSPACQL (PMEL_HUMAN)
VVPSPACQI

SEQ ID NO: 130380 - protein, 11 aa, Artificial Sequence
  Description of Artificial Sequence: Synthetic peptide
  Seed: RALDGGNKHFL (PMEL_HUMAN)
RQLDGGNKHFF

SEQ ID NO: 130381 - protein, 9 aa, Artificial Sequence
  Description of Artificial Sequence: Synthetic peptide
  Seed: KVSNDGPTL (PMEL_HUMAN)
KMSNDGPTL

SEQ ID NO: 130382 - protein, 9 aa, Artificial Sequence
  Description of Artificial Sequence: Synthetic peptide
  Seed: GQVPTTEVV (PMEL_HUMAN)
GEVPTTEVM

SEQ ID NO: 130383 - protein, 9 aa, Artificial Sequence
  Description of Artificial Sequence: Synthetic peptide
  Seed: LSIGTGRAM (PMEL_HUMAN)
LGIGTGRAM

SEQ ID NO: 130384 - protein, 11 aa, Artificial Sequence
  Description of Artificial Sequence: Synthetic peptide
  Seed: RRRLMKQDFSV (PMEL_HUMAN)
RFRLMKQDFSL

SEQ ID NO: 130385 - protein, 9 aa, Artificial Sequence
  Description of Artificial Sequence: Synthetic peptide
  Seed: GGPVSGLSI (PMEL_HUMAN)
GAPVSGLSV

SEQ ID NO: 130386 - protein, 8 aa, Artificial Sequence
  Description of Artificial Sequence: Synthetic peptide
  Seed: AQVVLQAA (PMEL_HUMAN)
AEVVLQAL

SEQ ID NO: 130387 - protein, 11 aa, Artificial Sequence
  Description of Artificial Sequence: Synthetic peptide
  Seed: HQILKGGSGTY (PMEL_HUMAN)
HMILKGGSGTF

SEQ ID NO: 130388 - protein, 10 aa, Artificial Sequence
  Description of Artificial Sequence: Synthetic peptide
  Seed: AEVSIVVLSG (PMEL_HUMAN)
AEVSIVVLSA

SEQ ID NO: 130389 - protein, 9 aa, Artificial Sequence
  Description of Artificial Sequence: Synthetic peptide
  Seed: LPIPEPEGP (PMEL_HUMAN)
LPIPEPEGF

SEQ ID NO: 130390 - protein, 10 aa, Artificial Sequence
  Description of Artificial Sequence: Synthetic peptide
  Seed: MSTESITGSL (PMEL_HUMAN)
MLTESITGSV

SEQ ID NO: 130391 - protein, 10 aa, Artificial Sequence
  Description of Artificial Sequence: Synthetic peptide
  Seed: MTPAEVSIVV (PMEL_HUMAN)
MQPAEVSIVY

SEQ ID NO: 130392 - protein, 9 aa, Artificial Sequence
  Description of Artificial Sequence: Synthetic peptide
  Seed: YVWKTWGQY (PMEL_HUMAN)
YLWKTWGQY

SEQ ID NO: 130393 - protein, 9 aa, Artificial Sequence
  Description of Artificial Sequence: Synthetic peptide
  Seed: AEMSTPEAT (PMEL_HUMAN)
AEMSTPEAW

SEQ ID NO: 130394 - protein, 10 aa, Artificial Sequence
  Description of Artificial Sequence: Synthetic peptide
  Seed: SLIYRRRLMK (PMEL_HUMAN)
SLIYRRRLMY

SEQ ID NO: 130395 - protein, 10 aa, Artificial Sequence
  Description of Artificial Sequence: Synthetic peptide
  Seed: RGSRSYVPLA (PMEL_HUMAN)
RSSRSYVPLM

SEQ ID NO: 130396 - protein, 9 aa, Artificial Sequence
  Description of Artificial Sequence: Synthetic peptide
  Seed: ANASFSIAL (PMEL_HUMAN)
AQASFSIAL

SEQ ID NO: 130397 - protein, 10 aa, Artificial Sequence
  Description of Artificial Sequence: Synthetic peptide
  Seed: GPLLDGTATL (PMEL_HUMAN)
GTLLDGTATV

SEQ ID NO: 130398 - protein, 9 aa, Artificial Sequence
  Description of Artificial Sequence: Synthetic peptide
  Seed: LSGTTAAQV (PMEL_HUMAN)
LSGTTAAQW

SEQ ID NO: 130399 - protein, 9 aa, Artificial Sequence
  Description of Artificial Sequence: Synthetic peptide
  Seed: SQVWGGQPV (PMEL_HUMAN)
SEVWGGQPC

SEQ ID NO: 130400 - protein, 10 aa, Artificial Sequence
  Description of Artificial Sequence: Synthetic peptide
  Seed: MSTESITGSL (PMEL_HUMAN)
MWTESITGSV

SEQ ID NO: 130401 - protein, 9 aa, Artificial Sequence
  Description of Artificial Sequence: Synthetic peptide
  Seed: SSIMSTESI (PMEL_HUMAN)
SLIMSTESL

SEQ ID NO: 130402 - protein, 10 aa, Artificial Sequence
  Description of Artificial Sequence: Synthetic peptide
  Seed: SQVWGGQPVY (PMEL_HUMAN)
SQVWGGQPVW

SEQ ID NO: 130403 - protein, 9 aa, Artificial Sequence
  Description of Artificial Sequence: Synthetic peptide
  Seed: TPAEVSIVV (PMEL_HUMAN)
TVAEVSIVY

SEQ ID NO: 130404 - protein, 10 aa, Artificial Sequence
  Description of Artificial Sequence: Synthetic peptide
  Seed: LAVIGALLAV (PMEL_HUMAN)
LNVIGALLAA

SEQ ID NO: 130405 - protein, 10 aa, Artificial Sequence
  Description of Artificial Sequence: Synthetic peptide
  Seed: LAVVSTQLIM (PMEL_HUMAN)
LSVVSTQLIW

SEQ ID NO: 130406 - protein, 11 aa, Artificial Sequence
  Description of Artificial Sequence: Synthetic peptide
  Seed: TYLEPGPVTAQ (PMEL_HUMAN)
TFLEPGPVTAF

SEQ ID NO: 130407 - protein, 9 aa, Artificial Sequence
  Description of Artificial Sequence: Synthetic peptide
  Seed: SSPGCQPPA (PMEL_HUMAN)
SLPGCQPPM

SEQ ID NO: 130408 - protein, 9 aa, Artificial Sequence
  Description of Artificial Sequence: Synthetic peptide
  Seed: ANASFSIAL (PMEL_HUMAN)
AMASFSIAV

SEQ ID NO: 130409 - protein, 9 aa, Artificial Sequence
  Description of Artificial Sequence: Synthetic peptide
  Seed: TLIGANASF (PMEL_HUMAN)
TSIGANASF

SEQ ID NO: 130410 - protein, 10 aa, Artificial Sequence
  Description of Artificial Sequence: Synthetic peptide
  Seed: LPHSSSHWLR (PMEL_HUMAN)
LVHSSSHWLK

SEQ ID NO: 130411 - protein, 9 aa, Artificial Sequence
  Description of Artificial Sequence: Synthetic peptide
  Seed: RAMLGTHTM (PMEL_HUMAN)
RHMLGTHTF

SEQ ID NO: 130412 - protein, 10 aa, Artificial Sequence
  Description of Artificial Sequence: Synthetic peptide
  Seed: RSFVYVWKTW (PMEL_HUMAN)
RVFVYVWKTW

SEQ ID NO: 130413 - protein, 9 aa, Artificial Sequence
  Description of Artificial Sequence: Synthetic peptide
  Seed: QLYPEWTEA (PMEL_HUMAN)
QIYPEWTEI

SEQ ID NO: 130414 - protein, 11 aa, Artificial Sequence
  Description of Artificial Sequence: Synthetic peptide
  Seed: SPVPGTTDGHR (PMEL_HUMAN)
SVVPGTTDGHR

SEQ ID NO: 130415 - protein, 10 aa, Artificial Sequence
  Description of Artificial Sequence: Synthetic peptide
  Seed: SSSHWLRLPR (PMEL_HUMAN)
SWSHWLRLPR

SEQ ID NO: 130416 - protein, 8 aa, Artificial Sequence
  Description of Artificial Sequence: Synthetic peptide
  Seed: FGDSSGTL (PMEL_HUMAN)
FYDSSGTV

SEQ ID NO: 130417 - protein, 10 aa, Artificial Sequence
  Description of Artificial Sequence: Synthetic peptide
  Seed: KTWGQYWQVL (PMEL_HUMAN)
KMWGQYWQVW

SEQ ID NO: 130418 - protein, 9 aa, Artificial Sequence
  Description of Artificial Sequence: Synthetic peptide
  Seed: ITGSLGPLL (PMEL_HUMAN)
IAGSLGPLY

SEQ ID NO: 130419 - protein, 9 aa, Artificial Sequence
  Description of Artificial Sequence: Synthetic peptide
  Seed: KTWGQYWQV (PMEL_HUMAN)
KFWGQYWQK

SEQ ID NO: 130420 - protein, 11 aa, Artificial Sequence
  Description of Artificial Sequence: Synthetic peptide
  Seed: LVLMAVVLASL (PMEL_HUMAN)
LGLMAVVLASV

SEQ ID NO: 130421 - protein, 10 aa, Artificial Sequence
  Description of Artificial Sequence: Synthetic peptide
  Seed: SSSHWLRLPR (PMEL_HUMAN)
SGSHWLRLPR

SEQ ID NO: 130422 - protein, 9 aa, Artificial Sequence
  Description of Artificial Sequence: Synthetic peptide
  Seed: TLIGANASF (PMEL_HUMAN)
TFIGANASY

SEQ ID NO: 130423 - protein, 9 aa, Artificial Sequence
  Description of Artificial Sequence: Synthetic peptide
  Seed: SSHWLRLPR (PMEL_HUMAN)
SLHWLRLPR

SEQ ID NO: 130424 - protein, 9 aa, Artificial Sequence
  Description of Artificial Sequence: Synthetic peptide
  Seed: CQLVLHQIL (PMEL_HUMAN)
CMLVLHQIY

SEQ ID NO: 130425 - protein, 10 aa, Artificial Sequence
  Description of Artificial Sequence: Synthetic peptide
  Seed: VPRNQDWLGV (PMEL_HUMAN)
VPRNQDWLGL

SEQ ID NO: 130426 - protein, 9 aa, Artificial Sequence
  Description of Artificial Sequence: Synthetic peptide
  Seed: AGQVPTTEV (PMEL_HUMAN)
AGQVPTTEL

SEQ ID NO: 130427 - protein, 10 aa, Artificial Sequence
  Description of Artificial Sequence: Synthetic peptide
  Seed: ESITGSLGPL (PMEL_HUMAN)
EAITGSLGPR

SEQ ID NO: 130428 - protein, 9 aa, Artificial Sequence
  Description of Artificial Sequence: Synthetic peptide
  Seed: TEAQRLDCW (PMEL_HUMAN)
TTAQRLDCW

SEQ ID NO: 130429 - protein, 9 aa, Artificial Sequence
  Description of Artificial Sequence: Synthetic peptide
  Seed: VTAQVVLQA (PMEL_HUMAN)
VVAQVVLQV

SEQ ID NO: 130430 - protein, 10 aa, Artificial Sequence
  Description of Artificial Sequence: Synthetic peptide
  Seed: EVMGTTLAEM (PMEL_HUMAN)
EMMGTTLAEV

SEQ ID NO: 130431 - protein, 10 aa, Artificial Sequence
  Description of Artificial Sequence: Synthetic peptide
  Seed: TTEWVETTAR (PMEL_HUMAN)
TSEWVETTAY

SEQ ID NO: 130432 - protein, 9 aa, Artificial Sequence
  Description of Artificial Sequence: Synthetic peptide
  Seed: GQVPLIVGI (PMEL_HUMAN)
GIVPLIVGV

SEQ ID NO: 130433 - protein, 10 aa, Artificial Sequence
  Description of Artificial Sequence: Synthetic peptide
  Seed: RGSRSYVPLA (PMEL_HUMAN)
RKSRSYVPLT

SEQ ID NO: 130434 - protein, 9 aa, Artificial Sequence
  Description of Artificial Sequence: Synthetic peptide
  Seed: SFVYVWKTW (PMEL_HUMAN)
SSVYVWKTW

SEQ ID NO: 130435 - protein, 9 aa, Artificial Sequence
  Description of Artificial Sequence: Synthetic peptide
  Seed: MPTAESTGM (PMEL_HUMAN)
MVTAESTGF

SEQ ID NO: 130436 - protein, 9 aa, Artificial Sequence
  Description of Artificial Sequence: Synthetic peptide
  Seed: EGDAFELTV (PMEL_HUMAN)
ELDAFELTM

SEQ ID NO: 130437 - protein, 8 aa, Artificial Sequence
  Description of Artificial Sequence: Synthetic peptide
  Seed: FGDSSGTL (PMEL_HUMAN)
FADSSGTM

SEQ ID NO: 130438 - protein, 9 aa, Artificial Sequence
  Description of Artificial Sequence: Synthetic peptide
  Seed: QLRTKAWNR (PMEL_HUMAN)
QFRTKAWNR

SEQ ID NO: 130439 - protein, 9 aa, Artificial Sequence
  Description of Artificial Sequence: Synthetic peptide
  Seed: LSIGTGRAM (PMEL_HUMAN)
LAIGTGRAY

SEQ ID NO: 130440 - protein, 9 aa, Artificial Sequence
  Description of Artificial Sequence: Synthetic peptide
  Seed: SAFTITDQV (PMEL_HUMAN)
SAFTITDQW

SEQ ID NO: 130441 - protein, 11 aa, Artificial Sequence
  Description of Artificial Sequence: Synthetic peptide
  Seed: KVLPDGQVIWV (PMEL_HUMAN)
KMLPDGQVIWY

SEQ ID NO: 130442 - protein, 10 aa, Artificial Sequence
  Description of Artificial Sequence: Synthetic peptide
  Seed: VPLIVGILLV (PMEL_HUMAN)
VMLIVGILLV

SEQ ID NO: 130443 - protein, 9 aa, Artificial Sequence
  Description of Artificial Sequence: Synthetic peptide
  Seed: GQVPLIVGI (PMEL_HUMAN)
GEVPLIVGL

SEQ ID NO: 130444 - protein, 10 aa, Artificial Sequence
  Description of Artificial Sequence: Synthetic peptide
  Seed: YRYGSFSVTL (PMEL_HUMAN)
YRYGSFSVTW

SEQ ID NO: 130445 - protein, 9 aa, Artificial Sequence
  Description of Artificial Sequence: Synthetic peptide
  Seed: MEVTVYHRR (PMEL_HUMAN)
MQVTVYHRR

SEQ ID NO: 130446 - protein, 9 aa, Artificial Sequence
  Description of Artificial Sequence: Synthetic peptide
  Seed: SLGPLLDGT (PMEL_HUMAN)
SLGPLLDGL

SEQ ID NO: 130447 - protein, 9 aa, Artificial Sequence
  Description of Artificial Sequence: Synthetic peptide
  Seed: KTWGQYWQV (PMEL_HUMAN)
KYWGQYWQR

SEQ ID NO: 130448 - protein, 9 aa, Artificial Sequence
  Description of Artificial Sequence: Synthetic peptide
  Seed: TTAGQVPTT (PMEL_HUMAN)
TTAGQVPTL

SEQ ID NO: 130449 - protein, 9 aa, Artificial Sequence
  Description of Artificial Sequence: Synthetic peptide
  Seed: VPVSEVMGT (PMEL_HUMAN)
VPVSEVMGA

SEQ ID NO: 130450 - protein, 9 aa, Artificial Sequence
  Description of Artificial Sequence: Synthetic peptide
  Seed: MPTAESTGM (PMEL_HUMAN)
MSTAESTGY

SEQ ID NO: 130451 - protein, 11 aa, Artificial Sequence
  Description of Artificial Sequence: Synthetic peptide
  Seed: RYGSFSVTLDI (PMEL_HUMAN)
RPGSFSVTLDY

SEQ ID NO: 130452 - protein, 9 aa, Artificial Sequence
  Description of Artificial Sequence: Synthetic peptide
  Seed: SQVWGGQPV (PMEL_HUMAN)
SEVWGGQPY

SEQ ID NO: 130453 - protein, 9 aa, Artificial Sequence
  Description of Artificial Sequence: Synthetic peptide
  Seed: SVQVPTTEV (PMEL_HUMAN)
SGQVPTTEF

SEQ ID NO: 130454 - protein, 10 aa, Artificial Sequence
  Description of Artificial Sequence: Synthetic peptide
  Seed: DWLGVSRQLR (PMEL_HUMAN)
DLLGVSRQLR

SEQ ID NO: 130455 - protein, 9 aa, Artificial Sequence
  Description of Artificial Sequence: Synthetic peptide
  Seed: RTKAWNRQL (PMEL_HUMAN)
RNKAWNRQY

SEQ ID NO: 130456 - protein, 9 aa, Artificial Sequence
  Description of Artificial Sequence: Synthetic peptide
  Seed: DAFELTVSC (PMEL_HUMAN)
DSFELTVSV

SEQ ID NO: 130457 - protein, 9 aa, Artificial Sequence
  Description of Artificial Sequence: Synthetic peptide
  Seed: RALVVTHTY (PMEL_HUMAN)
RSLVVTHTF

SEQ ID NO: 130458 - protein, 11 aa, Artificial Sequence
  Description of Artificial Sequence: Synthetic peptide
  Seed: ITDQVPFSVSV (PMEL_HUMAN)
IVDQVPFSVSL

SEQ ID NO: 130459 - protein, 11 aa, Artificial Sequence
  Description of Artificial Sequence: Synthetic peptide
  Seed: VSLADTNSLAV (PMEL_HUMAN)
VTLADTNSLAF

SEQ ID NO: 130460 - protein, 9 aa, Artificial Sequence
  Description of Artificial Sequence: Synthetic peptide
  Seed: AAQVTTTEW (PMEL_HUMAN)
AAQVTTTEY

SEQ ID NO: 130461 - protein, 9 aa, Artificial Sequence
  Description of Artificial Sequence: Synthetic peptide
  Seed: LHLAVIGAL (PMEL_HUMAN)
LNLAVIGAF

SEQ ID NO: 130462 - protein, 10 aa, Artificial Sequence
  Description of Artificial Sequence: Synthetic peptide
  Seed: LAVIGALLAV (PMEL_HUMAN)
LCVIGALLAV

SEQ ID NO: 130463 - protein, 9 aa, Artificial Sequence
  Description of Artificial Sequence: Synthetic peptide
  Seed: HTYLEPGPV (PMEL_HUMAN)
HAYLEPGPW

SEQ ID NO: 130464 - protein, 10 aa, Artificial Sequence
  Description of Artificial Sequence: Synthetic peptide
  Seed: WKTWGQYWQV (PMEL_HUMAN)
WQTWGQYWQI

SEQ ID NO: 130465 - protein, 9 aa, Artificial Sequence
  Description of Artificial Sequence: Synthetic peptide
  Seed: TTPGQAPTA (PMEL_HUMAN)
TNPGQAPTL

SEQ ID NO: 130466 - protein, 9 aa, Artificial Sequence
  Description of Artificial Sequence: Synthetic peptide
  Seed: SAFTITDQV (PMEL_HUMAN)
SIFTITDQI

SEQ ID NO: 130467 - protein, 9 aa, Artificial Sequence
  Description of Artificial Sequence: Synthetic peptide
  Seed: MEVTVYHRR (PMEL_HUMAN)
MSVTVYHRK

SEQ ID NO: 130468 - protein, 10 aa, Artificial Sequence
  Description of Artificial Sequence: Synthetic peptide
  Seed: YVPLAHSSSA (PMEL_HUMAN)
YAPLAHSSSI

SEQ ID NO: 130469 - protein, 10 aa, Artificial Sequence
  Description of Artificial Sequence: Synthetic peptide
  Seed: MTPAEVSIVV (PMEL_HUMAN)
MAPAEVSIVY

SEQ ID NO: 130470 - protein, 11 aa, Artificial Sequence
  Description of Artificial Sequence: Synthetic peptide
  Seed: YVPLAHSSSAF (PMEL_HUMAN)
YKPLAHSSSAY

SEQ ID NO: 130471 - protein, 10 aa, Artificial Sequence
  Description of Artificial Sequence: Synthetic peptide
  Seed: EVISTAPVQM (PMEL_HUMAN)
ELISTAPVQK

SEQ ID NO: 130472 - protein, 10 aa, Artificial Sequence
  Description of Artificial Sequence: Synthetic peptide
  Seed: MPTAESTGMT (PMEL_HUMAN)
MRTAESTGMA

SEQ ID NO: 130473 - protein, 9 aa, Artificial Sequence
  Description of Artificial Sequence: Synthetic peptide
  Seed: SSIMSTESI (PMEL_HUMAN)
SGIMSTESF

SEQ ID NO: 130474 - protein, 9 aa, Artificial Sequence
  Description of Artificial Sequence: Synthetic peptide
  Seed: SSHWLRLPR (PMEL_HUMAN)
SMHWLRLPK

SEQ ID NO: 130475 - protein, 10 aa, Artificial Sequence
  Description of Artificial Sequence: Synthetic peptide
  Seed: LAVIGALLAV (PMEL_HUMAN)
LMVIGALLAA

SEQ ID NO: 130476 - protein, 10 aa, Artificial Sequence
  Description of Artificial Sequence: Synthetic peptide
  Seed: RALVVTHTYL (PMEL_HUMAN)
RLLVVTHTYY

SEQ ID NO: 130477 - protein, 10 aa, Artificial Sequence
  Description of Artificial Sequence: Synthetic peptide
  Seed: TLISRALVVT (PMEL_HUMAN)
TMISRALVVI

SEQ ID NO: 130478 - protein, 10 aa, Artificial Sequence
  Description of Artificial Sequence: Synthetic peptide
  Seed: YVWKTWGQYW (PMEL_HUMAN)
YFWKTWGQYF

SEQ ID NO: 130479 - protein, 9 aa, Artificial Sequence
  Description of Artificial Sequence: Synthetic peptide
  Seed: SLGPLLDGT (PMEL_HUMAN)
SQGPLLDGI

SEQ ID NO: 130480 - protein, 9 aa, Artificial Sequence
  Description of Artificial Sequence: Synthetic peptide
  Seed: HTMEVTVYH (PMEL_HUMAN)
HVMEVTVYQ

SEQ ID NO: 130481 - protein, 9 aa, Artificial Sequence
  Description of Artificial Sequence: Synthetic peptide
  Seed: KVLPDGQVI (PMEL_HUMAN)
KILPDGQVY

SEQ ID NO: 130482 - protein, 10 aa, Artificial Sequence
  Description of Artificial Sequence: Synthetic peptide
  Seed: RSFVYVWKTW (PMEL_HUMAN)
RIFVYVWKTF

SEQ ID NO: 130483 - protein, 8 aa, Artificial Sequence
  Description of Artificial Sequence: Synthetic peptide
  Seed: TLDIVQGI (PMEL_HUMAN)
TSDIVQGF

SEQ ID NO: 130484 - protein, 9 aa, Artificial Sequence
  Description of Artificial Sequence: Synthetic peptide
  Seed: HTMEVTVYH (PMEL_HUMAN)
HGMEVTVYK

SEQ ID NO: 130485 - protein, 9 aa, Artificial Sequence
  Description of Artificial Sequence: Synthetic peptide
  Seed: SSIMSTESI (PMEL_HUMAN)
SVIMSTESY

SEQ ID NO: 130486 - protein, 11 aa, Artificial Sequence
  Description of Artificial Sequence: Synthetic peptide
  Seed: IALNFPGSQKV (PMEL_HUMAN)
IYLNFPGSQKV

SEQ ID NO: 130487 - protein, 9 aa, Artificial Sequence
  Description of Artificial Sequence: Synthetic peptide
  Seed: LTVSCQGGL (PMEL_HUMAN)
LMVSCQGGL

SEQ ID NO: 130488 - protein, 10 aa, Artificial Sequence
  Description of Artificial Sequence: Synthetic peptide
  Seed: RGSRSYVPLA (PMEL_HUMAN)
RRSRSYVPLK

SEQ ID NO: 130489 - protein, 10 aa, Artificial Sequence
  Description of Artificial Sequence: Synthetic peptide
  Seed: KTWGQYWQVL (PMEL_HUMAN)
KQWGQYWQVL

SEQ ID NO: 130490 - protein, 10 aa, Artificial Sequence
  Description of Artificial Sequence: Synthetic peptide
  Seed: MTPAEVSIVV (PMEL_HUMAN)
MRPAEVSIVV

SEQ ID NO: 130491 - protein, 10 aa, Artificial Sequence
  Description of Artificial Sequence: Synthetic peptide
  Seed: YRYGSFSVTL (PMEL_HUMAN)
YQYGSFSVTM

SEQ ID NO: 130492 - protein, 8 aa, Artificial Sequence
  Description of Artificial Sequence: Synthetic peptide
  Seed: TGMTPEKV (PMEL_HUMAN)
TQMTPEKV

SEQ ID NO: 130493 - protein, 9 aa, Artificial Sequence
  Description of Artificial Sequence: Synthetic peptide
  Seed: FGDSSGTLI (PMEL_HUMAN)
FMDSSGTLM

SEQ ID NO: 130494 - protein, 9 aa, Artificial Sequence
  Description of Artificial Sequence: Synthetic peptide
  Seed: SLAVVSTQL (PMEL_HUMAN)
SVAVVSTQA

SEQ ID NO: 130495 - protein, 9 aa, Artificial Sequence
  Description of Artificial Sequence: Synthetic peptide
  Seed: VSVSQLRAL (PMEL_HUMAN)
VVVSQLRAL

SEQ ID NO: 130496 - protein, 9 aa, Artificial Sequence
  Description of Artificial Sequence: Synthetic peptide
  Seed: TLIGANASF (PMEL_HUMAN)
TAIGANASM

SEQ ID NO: 130497 - protein, 10 aa, Artificial Sequence
  Description of Artificial Sequence: Synthetic peptide
  Seed: LMAVVLASLI (PMEL_HUMAN)
LLAVVLASLQ

SEQ ID NO: 130498 - protein, 9 aa, Artificial Sequence
  Description of Artificial Sequence: Synthetic peptide
  Seed: FTITDQVPF (PMEL_HUMAN)
FYITDQVPY

SEQ ID NO: 130499 - protein, 9 aa, Artificial Sequence
  Description of Artificial Sequence: Synthetic peptide
  Seed: YPQETDDAC (PMEL_HUMAN)
YSQETDDAM

SEQ ID NO: 130500 - protein, 9 aa, Artificial Sequence
  Description of Artificial Sequence: Synthetic peptide
  Seed: KQDFSVPQL (PMEL_HUMAN)
KHDFSVPQI

SEQ ID NO: 130501 - protein, 9 aa, Artificial Sequence
  Description of Artificial Sequence: Synthetic peptide
  Seed: LPDGQVIWV (PMEL_HUMAN)
LLDGQVIWM

SEQ ID NO: 130502 - protein, 9 aa, Artificial Sequence
  Description of Artificial Sequence: Synthetic peptide
  Seed: VTLDIVQGI (PMEL_HUMAN)
VTLDIVQGV

SEQ ID NO: 130503 - protein, 11 aa, Artificial Sequence
  Description of Artificial Sequence: Synthetic peptide
  Seed: QAVPSGEGDAF (PMEL_HUMAN)
QQVPSGEGDAI

SEQ ID NO: 130504 - protein, 9 aa, Artificial Sequence
  Description of Artificial Sequence: Synthetic peptide
  Seed: TTTEWVETT (PMEL_HUMAN)
TATEWVETV

SEQ ID NO: 130505 - protein, 10 aa, Artificial Sequence
  Description of Artificial Sequence: Synthetic peptide
  Seed: YVWKTWGQYW (PMEL_HUMAN)
YFWKTWGQYW

SEQ ID NO: 130506 - protein, 9 aa, Artificial Sequence
  Description of Artificial Sequence: Synthetic peptide
  Seed: SYVPLAHSS (PMEL_HUMAN)
SYVPLAHSV

SEQ ID NO: 130507 - protein, 9 aa, Artificial Sequence
  Description of Artificial Sequence: Synthetic peptide
  Seed: ADLSYTWDF (PMEL_HUMAN)
AELSYTWDW

SEQ ID NO: 130508 - protein, 9 aa, Artificial Sequence
  Description of Artificial Sequence: Synthetic peptide
  Seed: VISTAPVQM (PMEL_HUMAN)
VASTAPVQM

SEQ ID NO: 130509 - protein, 10 aa, Artificial Sequence
  Description of Artificial Sequence: Synthetic peptide
  Seed: KTWGQYWQVL (PMEL_HUMAN)
KEWGQYWQVF

SEQ ID NO: 130510 - protein, 9 aa, Artificial Sequence
  Description of Artificial Sequence: Synthetic peptide
  Seed: RNQPLTFAL (PMEL_HUMAN)
REQPLTFAY

SEQ ID NO: 130511 - protein, 9 aa, Artificial Sequence
  Description of Artificial Sequence: Synthetic peptide
  Seed: AGLGQVPLI (PMEL_HUMAN)
AMLGQVPLL

SEQ ID NO: 130512 - protein, 9 aa, Artificial Sequence
  Description of Artificial Sequence: Synthetic peptide
  Seed: GTYCLNVSL (PMEL_HUMAN)
GAYCLNVSL

SEQ ID NO: 130513 - protein, 11 aa, Artificial Sequence
  Description of Artificial Sequence: Synthetic peptide
  Seed: FGDSSGTLISR (PMEL_HUMAN)
FCDSSGTLISL

SEQ ID NO: 130514 - protein, 11 aa, Artificial Sequence
  Description of Artificial Sequence: Synthetic peptide
  Seed: SPVPGTTDGHR (PMEL_HUMAN)
SSVPGTTDGHK

SEQ ID NO: 130515 - protein, 10 aa, Artificial Sequence
  Description of Artificial Sequence: Synthetic peptide
  Seed: LAEADLSYTW (PMEL_HUMAN)
LTEADLSYTW

SEQ ID NO: 130516 - protein, 9 aa, Artificial Sequence
  Description of Artificial Sequence: Synthetic peptide
  Seed: KAWNRQLYP (PMEL_HUMAN)
KNWNRQLYK

SEQ ID NO: 130517 - protein, 9 aa, Artificial Sequence
  Description of Artificial Sequence: Synthetic peptide
  Seed: TAQVVLQAA (PMEL_HUMAN)
TAQVVLQAI

SEQ ID NO: 130518 - protein, 9 aa, Artificial Sequence
  Description of Artificial Sequence: Synthetic peptide
  Seed: LTVSCQGGL (PMEL_HUMAN)
LTVSCQGGY

SEQ ID NO: 130519 - protein, 9 aa, Artificial Sequence
  Description of Artificial Sequence: Synthetic peptide
  Seed: TLIGANASF (PMEL_HUMAN)
TMIGANASR

SEQ ID NO: 130520 - protein, 9 aa, Artificial Sequence
  Description of Artificial Sequence: Synthetic peptide
  Seed: YRYGSFSVT (PMEL_HUMAN)
YRYGSFSVK

SEQ ID NO: 130521 - protein, 10 aa, Artificial Sequence
  Description of Artificial Sequence: Synthetic peptide
  Seed: YRYGSFSVTL (PMEL_HUMAN)
YKYGSFSVTI

SEQ ID NO: 130522 - protein, 9 aa, Artificial Sequence
  Description of Artificial Sequence: Synthetic peptide
  Seed: TTDGHRPTA (PMEL_HUMAN)
TWDGHRPTI

SEQ ID NO: 130523 - protein, 9 aa, Artificial Sequence
  Description of Artificial Sequence: Synthetic peptide
  Seed: RIFCSCPIG (PMEL_HUMAN)
RAFCSCPIK

SEQ ID NO: 130524 - protein, 9 aa, Artificial Sequence
  Description of Artificial Sequence: Synthetic peptide
  Seed: WSQKRSFVY (PMEL_HUMAN)
WLQKRSFVF

SEQ ID NO: 130525 - protein, 10 aa, Artificial Sequence
  Description of Artificial Sequence: Synthetic peptide
  Seed: RGSRSYVPLA (PMEL_HUMAN)
RLSRSYVPLR

SEQ ID NO: 130526 - protein, 9 aa, Artificial Sequence
  Description of Artificial Sequence: Synthetic peptide
  Seed: LLAVGATKV (PMEL_HUMAN)
LMAVGATKA

SEQ ID NO: 130527 - protein, 9 aa, Artificial Sequence
  Description of Artificial Sequence: Synthetic peptide
  Seed: TTDGHRPTA (PMEL_HUMAN)
TYDGHRPTF

SEQ ID NO: 130528 - protein, 9 aa, Artificial Sequence
  Description of Artificial Sequence: Synthetic peptide
  Seed: ITDQVPFSV (PMEL_HUMAN)
IVDQVPFSV

SEQ ID NO: 130529 - protein, 10 aa, Artificial Sequence
  Description of Artificial Sequence: Synthetic peptide
  Seed: VTAQVVLQAA (PMEL_HUMAN)
VVAQVVLQAV

SEQ ID NO: 130530 - protein, 9 aa, Artificial Sequence
  Description of Artificial Sequence: Synthetic peptide
  Seed: MSTPEATGM (PMEL_HUMAN)
MKTPEATGF

SEQ ID NO: 130531 - protein, 10 aa, Artificial Sequence
  Description of Artificial Sequence: Synthetic peptide
  Seed: IESAEILQAV (PMEL_HUMAN)
IFSAEILQAV

SEQ ID NO: 130532 - protein, 10 aa, Artificial Sequence
  Description of Artificial Sequence: Synthetic peptide
  Seed: KRQVPLDCVL (PMEL_HUMAN)
KTQVPLDCVF

SEQ ID NO: 130533 - protein, 9 aa, Artificial Sequence
  Description of Artificial Sequence: Synthetic peptide
  Seed: VSNDGPTLI (PMEL_HUMAN)
VTNDGPTLM

SEQ ID NO: 130534 - protein, 9 aa, Artificial Sequence
  Description of Artificial Sequence: Synthetic peptide
  Seed: LADTNSLAV (PMEL_HUMAN)
LLDTNSLAY

SEQ ID NO: 130535 - protein, 9 aa, Artificial Sequence
  Description of Artificial Sequence: Synthetic peptide
  Seed: QVWGGQPVY (PMEL_HUMAN)
QQWGGQPVI

SEQ ID NO: 130536 - protein, 11 aa, Artificial Sequence
  Description of Artificial Sequence: Synthetic peptide
  Seed: RAMLGTHTMEV (PMEL_HUMAN)
RYMLGTHTMEL

SEQ ID NO: 130537 - protein, 11 aa, Artificial Sequence
  Description of Artificial Sequence: Synthetic peptide
  Seed: KVLPDGQVIWV (PMEL_HUMAN)
KMLPDGQVIWW

SEQ ID NO: 130538 - protein, 11 aa, Artificial Sequence
  Description of Artificial Sequence: Synthetic peptide
  Seed: HSSSHWLRLPR (PMEL_HUMAN)
HISSHWLRLPR

SEQ ID NO: 130539 - protein, 10 aa, Artificial Sequence
  Description of Artificial Sequence: Synthetic peptide
  Seed: SRALVVTHTY (PMEL_HUMAN)
SKALVVTHTW

SEQ ID NO: 130540 - protein, 9 aa, Artificial Sequence
  Description of Artificial Sequence: Synthetic peptide
  Seed: YRYGSFSVT (PMEL_HUMAN)
YQYGSFSVA

SEQ ID NO: 130541 - protein, 10 aa, Artificial Sequence
  Description of Artificial Sequence: Synthetic peptide
  Seed: KVSNDGPTLI (PMEL_HUMAN)
KMSNDGPTLF

SEQ ID NO: 130542 - protein, 10 aa, Artificial Sequence
  Description of Artificial Sequence: Synthetic peptide
  Seed: RALDGGNKHF (PMEL_HUMAN)
RYLDGGNKHF

SEQ ID NO: 130543 - protein, 9 aa, Artificial Sequence
  Description of Artificial Sequence: Synthetic peptide
  Seed: STESITGSL (PMEL_HUMAN)
SSESITGSY

SEQ ID NO: 130544 - protein, 9 aa, Artificial Sequence
  Description of Artificial Sequence: Synthetic peptide
  Seed: VETTARELP (PMEL_HUMAN)
VETTARELM

SEQ ID NO: 130545 - protein, 9 aa, Artificial Sequence
  Description of Artificial Sequence: Synthetic peptide
  Seed: LSIGTGRAM (PMEL_HUMAN)
LMIGTGRAI

SEQ ID NO: 130546 - protein, 9 aa, Artificial Sequence
  Description of Artificial Sequence: Synthetic peptide
  Seed: RLVKRQVPL (PMEL_HUMAN)
RTVKRQVPI

SEQ ID NO: 130547 - protein, 9 aa, Artificial Sequence
  Description of Artificial Sequence: Synthetic peptide
  Seed: RTKAWNRQL (PMEL_HUMAN)
RMKAWNRQW

SEQ ID NO: 130548 - protein, 11 aa, Artificial Sequence
  Description of Artificial Sequence: Synthetic peptide
  Seed: KHFLRNQPLTF (PMEL_HUMAN)
KRFLRNQPLTL

SEQ ID NO: 130549 - protein, 9 aa, Artificial Sequence
  Description of Artificial Sequence: Synthetic peptide
  Seed: TTAAQVTTT (PMEL_HUMAN)
TVAAQVTTV

SEQ ID NO: 130550 - protein, 9 aa, Artificial Sequence
  Description of Artificial Sequence: Synthetic peptide
  Seed: SQVWGGQPV (PMEL_HUMAN)
SNVWGGQPY

SEQ ID NO: 130551 - protein, 9 aa, Artificial Sequence
  Description of Artificial Sequence: Synthetic peptide
  Seed: FELTVSCQG (PMEL_HUMAN)
FELTVSCQV

SEQ ID NO: 130552 - protein, 11 aa, Artificial Sequence
  Description of Artificial Sequence: Synthetic peptide
  Seed: TYLEPGPVTAQ (PMEL_HUMAN)
TWLEPGPVTAY

SEQ ID NO: 130553 - protein, 9 aa, Artificial Sequence
  Description of Artificial Sequence: Synthetic peptide
  Seed: FLRNQPLTF (PMEL_HUMAN)
FSRNQPLTW

SEQ ID NO: 130554 - protein, 9 aa, Artificial Sequence
  Description of Artificial Sequence: Synthetic peptide
  Seed: VSVSQLRAL (PMEL_HUMAN)
VIVSQLRAF

SEQ ID NO: 130555 - protein, 9 aa, Artificial Sequence
  Description of Artificial Sequence: Synthetic peptide
  Seed: RYGSFSVTL (PMEL_HUMAN)
RQGSFSVTI

SEQ ID NO: 130556 - protein, 9 aa, Artificial Sequence
  Description of Artificial Sequence: Synthetic peptide
  Seed: VISTAPVQM (PMEL_HUMAN)
VMSTAPVQR

SEQ ID NO: 130557 - protein, 9 aa, Artificial Sequence
  Description of Artificial Sequence: Synthetic peptide
  Seed: FTITDQVPF (PMEL_HUMAN)
FAITDQVPV

SEQ ID NO: 130558 - protein, 9 aa, Artificial Sequence
  Description of Artificial Sequence: Synthetic peptide
  Seed: PLDCVLYRY (PMEL_HUMAN)
PSDCVLYRY

SEQ ID NO: 130559 - protein, 9 aa, Artificial Sequence
  Description of Artificial Sequence: Synthetic peptide
  Seed: ESAEILQAV (PMEL_HUMAN)
EGAEILQAF

SEQ ID NO: 130560 - protein, 10 aa, Artificial Sequence
  Description of Artificial Sequence: Synthetic peptide
  Seed: VLPDGQVIWV (PMEL_HUMAN)
VMPDGQVIWI

SEQ ID NO: 130561 - protein, 9 aa, Artificial Sequence
  Description of Artificial Sequence: Synthetic peptide
  Seed: VSNDGPTLI (PMEL_HUMAN)
VQNDGPTLY

SEQ ID NO: 130562 - protein, 9 aa, Artificial Sequence
  Description of Artificial Sequence: Synthetic peptide
  Seed: TAEAPNTTA (PMEL_HUMAN)
TVEAPNTTF

SEQ ID NO: 130563 - protein, 9 aa, Artificial Sequence
  Description of Artificial Sequence: Synthetic peptide
  Seed: GGPVSGLSI (PMEL_HUMAN)
GIPVSGLSI

SEQ ID NO: 130564 - protein, 9 aa, Artificial Sequence
  Description of Artificial Sequence: Synthetic peptide
  Seed: SVQVPTTEV (PMEL_HUMAN)
SGQVPTTEL

SEQ ID NO: 130565 - protein, 9 aa, Artificial Sequence
  Description of Artificial Sequence: Synthetic peptide
  Seed: LNFPGSQKV (PMEL_HUMAN)
LSFPGSQKF

SEQ ID NO: 130566 - protein, 11 aa, Artificial Sequence
  Description of Artificial Sequence: Synthetic peptide
  Seed: QAVPSGEGDAF (PMEL_HUMAN)
QTVPSGEGDAF

SEQ ID NO: 130567 - protein, 10 aa, Artificial Sequence
  Description of Artificial Sequence: Synthetic peptide
  Seed: RQLRTKAWNR (PMEL_HUMAN)
RMLRTKAWNK

SEQ ID NO: 130568 - protein, 8 aa, Artificial Sequence
  Description of Artificial Sequence: Synthetic peptide
  Seed: HLAVIGAL (PMEL_HUMAN)
HQAVIGAI

SEQ ID NO: 130569 - protein, 9 aa, Artificial Sequence
  Description of Artificial Sequence: Synthetic peptide
  Seed: GQVPLIVGI (PMEL_HUMAN)
GKVPLIVGY

SEQ ID NO: 130570 - protein, 9 aa, Artificial Sequence
  Description of Artificial Sequence: Synthetic peptide
  Seed: SSPGCQPPA (PMEL_HUMAN)
SVPGCQPPI

SEQ ID NO: 130571 - protein, 9 aa, Artificial Sequence
  Description of Artificial Sequence: Synthetic peptide
  Seed: VSRQLRTKA (PMEL_HUMAN)
VARQLRTKK

SEQ ID NO: 130572 - protein, 9 aa, Artificial Sequence
  Description of Artificial Sequence: Synthetic peptide
  Seed: VQMPTAEST (PMEL_HUMAN)
VRMPTAESY

SEQ ID NO: 130573 - protein, 9 aa, Artificial Sequence
  Description of Artificial Sequence: Synthetic peptide
  Seed: AVIGALLAV (PMEL_HUMAN)
AAIGALLAW

SEQ ID NO: 130574 - protein, 11 aa, Artificial Sequence
  Description of Artificial Sequence: Synthetic peptide
  Seed: RRGSRSYVPLA (PMEL_HUMAN)
RSGSRSYVPLK

SEQ ID NO: 130575 - protein, 10 aa, Artificial Sequence
  Description of Artificial Sequence: Synthetic peptide
  Seed: LAVIGALLAV (PMEL_HUMAN)
LQVIGALLAI

SEQ ID NO: 130576 - protein, 10 aa, Artificial Sequence
  Description of Artificial Sequence: Synthetic peptide
  Seed: NASFSIALNF (PMEL_HUMAN)
NQSFSIALNF

SEQ ID NO: 130577 - protein, 9 aa, Artificial Sequence
  Description of Artificial Sequence: Synthetic peptide
  Seed: AQVVLQAAI (PMEL_HUMAN)
AEVVLQAAF

SEQ ID NO: 130578 - protein, 9 aa, Artificial Sequence
  Description of Artificial Sequence: Synthetic peptide
  Seed: IVVLSGTTA (PMEL_HUMAN)
IPVLSGTTV

SEQ ID NO: 130579 - protein, 9 aa, Artificial Sequence
  Description of Artificial Sequence: Synthetic peptide
  Seed: QLYPEWTEA (PMEL_HUMAN)
QLYPEWTEL

SEQ ID NO: 130580 - protein, 9 aa, Artificial Sequence
  Description of Artificial Sequence: Synthetic peptide
  Seed: VSCQGGLPK (PMEL_HUMAN)
VACQGGLPF

SEQ ID NO: 130581 - protein, 9 aa, Artificial Sequence
  Description of Artificial Sequence: Synthetic peptide
  Seed: VSNDGPTLI (PMEL_HUMAN)
VLNDGPTLA

SEQ ID NO: 130582 - protein, 8 aa, Artificial Sequence
  Description of Artificial Sequence: Synthetic peptide
  Seed: VPQLPHSS (PMEL_HUMAN)
VPQLPHSA

SEQ ID NO: 130583 - protein, 9 aa, Artificial Sequence
  Description of Artificial Sequence: Synthetic peptide
  Seed: SSIMSTESI (PMEL_HUMAN)
SQIMSTESW

SEQ ID NO: 130584 - protein, 10 aa, Artificial Sequence
  Description of Artificial Sequence: Synthetic peptide
  Seed: YRYGSFSVTL (PMEL_HUMAN)
YQYGSFSVTV

SEQ ID NO: 130585 - protein, 9 aa, Artificial Sequence
  Description of Artificial Sequence: Synthetic peptide
  Seed: STAPVQMPT (PMEL_HUMAN)
STAPVQMPV

SEQ ID NO: 130586 - protein, 10 aa, Artificial Sequence
  Description of Artificial Sequence: Synthetic peptide
  Seed: LQLHDPSGYL (PMEL_HUMAN)
LFLHDPSGYI

SEQ ID NO: 130587 - protein, 10 aa, Artificial Sequence
  Description of Artificial Sequence: Synthetic peptide
  Seed: RQLYPEWTEA (PMEL_HUMAN)
RKLYPEWTEL

SEQ ID NO: 130588 - protein, 10 aa, Artificial Sequence
  Description of Artificial Sequence: Synthetic peptide
  Seed: AVIGALLAVG (PMEL_HUMAN)
AQIGALLAVE

SEQ ID NO: 130589 - protein, 9 aa, Artificial Sequence
  Description of Artificial Sequence: Synthetic peptide
  Seed: WQVLGGPVS (PMEL_HUMAN)
WQVLGGPVI

SEQ ID NO: 130590 - protein, 11 aa, Artificial Sequence
  Description of Artificial Sequence: Synthetic peptide
  Seed: LVLMAVVLASL (PMEL_HUMAN)
LSLMAVVLASL

SEQ ID NO: 130591 - protein, 9 aa, Artificial Sequence
  Description of Artificial Sequence: Synthetic peptide
  Seed: GTYCLNVSL (PMEL_HUMAN)
GAYCLNVSV

SEQ ID NO: 130592 - protein, 11 aa, Artificial Sequence
  Description of Artificial Sequence: Synthetic peptide
  Seed: HTMEVTVYHRR (PMEL_HUMAN)
HTMEVTVYHRN

SEQ ID NO: 130593 - protein, 11 aa, Artificial Sequence
  Description of Artificial Sequence: Synthetic peptide
  Seed: LYPEWTEAQRL (PMEL_HUMAN)
LWPEWTEAQRF

SEQ ID NO: 130594 - protein, 10 aa, Artificial Sequence
  Description of Artificial Sequence: Synthetic peptide
  Seed: RALVVTHTYL (PMEL_HUMAN)
RQLVVTHTYW

SEQ ID NO: 130595 - protein, 10 aa, Artificial Sequence
  Description of Artificial Sequence: Synthetic peptide
  Seed: RGSRSYVPLA (PMEL_HUMAN)
RVSRSYVPLI

SEQ ID NO: 130596 - protein, 9 aa, Artificial Sequence
  Description of Artificial Sequence: Synthetic peptide
  Seed: ISRALVVTH (PMEL_HUMAN)
IARALVVTI

SEQ ID NO: 130597 - protein, 10 aa, Artificial Sequence
  Description of Artificial Sequence: Synthetic peptide
  Seed: RGSRSYVPLA (PMEL_HUMAN)
RMSRSYVPLK

SEQ ID NO: 130598 - protein, 9 aa, Artificial Sequence
  Description of Artificial Sequence: Synthetic peptide
  Seed: NFPGSQKVL (PMEL_HUMAN)
NMPGSQKVL

SEQ ID NO: 130599 - protein, 10 aa, Artificial Sequence
  Description of Artificial Sequence: Synthetic peptide
  Seed: QVLGGPVSGL (PMEL_HUMAN)
QMLGGPVSGM

SEQ ID NO: 130600 - protein, 10 aa, Artificial Sequence
  Description of Artificial Sequence: Synthetic peptide
  Seed: RQVPLDCVLY (PMEL_HUMAN)
RTVPLDCVLR

SEQ ID NO: 130601 - protein, 9 aa, Artificial Sequence
  Description of Artificial Sequence: Synthetic peptide
  Seed: WQVLGGPVS (PMEL_HUMAN)
WQVLGGPVL

SEQ ID NO: 130602 - protein, 10 aa, Artificial Sequence
  Description of Artificial Sequence: Synthetic peptide
  Seed: SCPIGENSPL (PMEL_HUMAN)
SKPIGENSPL

SEQ ID NO: 130603 - protein, 10 aa, Artificial Sequence
  Description of Artificial Sequence: Synthetic peptide
  Seed: SVPQLPHSSS (PMEL_HUMAN)
SWPQLPHSSV

SEQ ID NO: 130604 - protein, 9 aa, Artificial Sequence
  Description of Artificial Sequence: Synthetic peptide
  Seed: RLVKRQVPL (PMEL_HUMAN)
RQVKRQVPV

SEQ ID NO: 130605 - protein, 9 aa, Artificial Sequence
  Description of Artificial Sequence: Synthetic peptide
  Seed: RAMLGTHTM (PMEL_HUMAN)
RMMLGTHTV

SEQ ID NO: 130606 - protein, 9 aa, Artificial Sequence
  Description of Artificial Sequence: Synthetic peptide
  Seed: MTPEKVPVS (PMEL_HUMAN)
MLPEKVPVM

SEQ ID NO: 130607 - protein, 9 aa, Artificial Sequence
  Description of Artificial Sequence: Synthetic peptide
  Seed: SAFTITDQV (PMEL_HUMAN)
SVFTITDQA

SEQ ID NO: 130608 - protein, 11 aa, Artificial Sequence
  Description of Artificial Sequence: Synthetic peptide
  Seed: MAVVLASLIYR (PMEL_HUMAN)
MDVVLASLIYK

SEQ ID NO: 130609 - protein, 10 aa, Artificial Sequence
  Description of Artificial Sequence: Synthetic peptide
  Seed: SGTYCLNVSL (PMEL_HUMAN)
SITYCLNVSF

SEQ ID NO: 130610 - protein, 10 aa, Artificial Sequence
  Description of Artificial Sequence: Synthetic peptide
  Seed: GTLISRALVV (PMEL_HUMAN)
GFLISRALVV

SEQ ID NO: 130611 - protein, 9 aa, Artificial Sequence
  Description of Artificial Sequence: Synthetic peptide
  Seed: HTMEVTVYH (PMEL_HUMAN)
HIMEVTVYV

SEQ ID NO: 130612 - protein, 9 aa, Artificial Sequence
  Description of Artificial Sequence: Synthetic peptide
  Seed: LQAAIPLTS (PMEL_HUMAN)
LIAAIPLTY

SEQ ID NO: 130613 - protein, 9 aa, Artificial Sequence
  Description of Artificial Sequence: Synthetic peptide
  Seed: RAMLGTHTM (PMEL_HUMAN)
RPMLGTHTM

SEQ ID NO: 130614 - protein, 9 aa, Artificial Sequence
  Description of Artificial Sequence: Synthetic peptide
  Seed: TIINGSQVW (PMEL_HUMAN)
TIINGSQVF

SEQ ID NO: 130615 - protein, 9 aa, Artificial Sequence
  Description of Artificial Sequence: Synthetic peptide
  Seed: FSVSVSQLR (PMEL_HUMAN)
FSVSVSQLL

SEQ ID NO: 130616 - protein, 10 aa, Artificial Sequence
  Description of Artificial Sequence: Synthetic peptide
  Seed: HLAVIGALLA (PMEL_HUMAN)
HLAVIGALLV

SEQ ID NO: 130617 - protein, 10 aa, Artificial Sequence
  Description of Artificial Sequence: Synthetic peptide
  Seed: RGSRSYVPLA (PMEL_HUMAN)
RESRSYVPLS

SEQ ID NO: 130618 - protein, 11 aa, Artificial Sequence
  Description of Artificial Sequence: Synthetic peptide
  Seed: LYRYGSFSVTL (PMEL_HUMAN)
LNRYGSFSVTF

SEQ ID NO: 130619 - protein, 9 aa, Artificial Sequence
  Description of Artificial Sequence: Synthetic peptide
  Seed: VMGTTLAEM (PMEL_HUMAN)
VLGTTLAEL

SEQ ID NO: 130620 - protein, 9 aa, Artificial Sequence
  Description of Artificial Sequence: Synthetic peptide
  Seed: GQVPTTEVV (PMEL_HUMAN)
GRVPTTEVF

SEQ ID NO: 130621 - protein, 10 aa, Artificial Sequence
  Description of Artificial Sequence: Synthetic peptide
  Seed: FLRNQPLTFA (PMEL_HUMAN)
FIRNQPLTFV

SEQ ID NO: 130622 - protein, 9 aa, Artificial Sequence
  Description of Artificial Sequence: Synthetic peptide
  Seed: TYLEPGPVT (PMEL_HUMAN)
TYLEPGPVI

SEQ ID NO: 130623 - protein, 9 aa, Artificial Sequence
  Description of Artificial Sequence: Synthetic peptide
  Seed: YHRRGSRSY (PMEL_HUMAN)
YKRRGSRSM

SEQ ID NO: 130624 - protein, 9 aa, Artificial Sequence
  Description of Artificial Sequence: Synthetic peptide
  Seed: LMAVVLASL (PMEL_HUMAN)
LAAVVLASY

SEQ ID NO: 130625 - protein, 10 aa, Artificial Sequence
  Description of Artificial Sequence: Synthetic peptide
  Seed: RTKAWNRQLY (PMEL_HUMAN)
RAKAWNRQLF

SEQ ID NO: 130626 - protein, 9 aa, Artificial Sequence
  Description of Artificial Sequence: Synthetic peptide
  Seed: FLRNQPLTF (PMEL_HUMAN)
FSRNQPLTV

SEQ ID NO: 130627 - protein, 10 aa, Artificial Sequence
  Description of Artificial Sequence: Synthetic peptide
  Seed: SCPIGENSPL (PMEL_HUMAN)
SNPIGENSPL

SEQ ID NO: 130628 - protein, 8 aa, Artificial Sequence
  Description of Artificial Sequence: Synthetic peptide
  Seed: FGDSSGTL (PMEL_HUMAN)
FFDSSGTF

SEQ ID NO: 130629 - protein, 8 aa, Artificial Sequence
  Description of Artificial Sequence: Synthetic peptide
  Seed: TEWVETTA (PMEL_HUMAN)
TEWVETTM

SEQ ID NO: 130630 - protein, 9 aa, Artificial Sequence
  Description of Artificial Sequence: Synthetic peptide
  Seed: VISTAPVQM (PMEL_HUMAN)
VMSTAPVQA

SEQ ID NO: 130631 - protein, 9 aa, Artificial Sequence
  Description of Artificial Sequence: Synthetic peptide
  Seed: KVLPDGQVI (PMEL_HUMAN)
KALPDGQVF

SEQ ID NO: 130632 - protein, 10 aa, Artificial Sequence
  Description of Artificial Sequence: Synthetic peptide
  Seed: GPLLDGTATL (PMEL_HUMAN)
GGLLDGTATL

SEQ ID NO: 130633 - protein, 10 aa, Artificial Sequence
  Description of Artificial Sequence: Synthetic peptide
  Seed: KRQVPLDCVL (PMEL_HUMAN)
KTQVPLDCVM

SEQ ID NO: 130634 - protein, 9 aa, Artificial Sequence
  Description of Artificial Sequence: Synthetic peptide
  Seed: MSTPEATGM (PMEL_HUMAN)
MRTPEATGY

SEQ ID NO: 130635 - protein, 10 aa, Artificial Sequence
  Description of Artificial Sequence: Synthetic peptide
  Seed: TDQVPFSVSV (PMEL_HUMAN)
TVQVPFSVSV

SEQ ID NO: 130636 - protein, 9 aa, Artificial Sequence
  Description of Artificial Sequence: Synthetic peptide
  Seed: IVVLSGTTA (PMEL_HUMAN)
IAVLSGTTL

SEQ ID NO: 130637 - protein, 9 aa, Artificial Sequence
  Description of Artificial Sequence: Synthetic peptide
  Seed: LIVGILLVL (PMEL_HUMAN)
LMVGILLVM

SEQ ID NO: 130638 - protein, 10 aa, Artificial Sequence
  Description of Artificial Sequence: Synthetic peptide
  Seed: AVIGALLAVG (PMEL_HUMAN)
AVIGALLAVW

SEQ ID NO: 130639 - protein, 10 aa, Artificial Sequence
  Description of Artificial Sequence: Synthetic peptide
  Seed: VSLADTNSLA (PMEL_HUMAN)
VSLADTNSLI

SEQ ID NO: 130640 - protein, 9 aa, Artificial Sequence
  Description of Artificial Sequence: Synthetic peptide
  Seed: FSVSVSQLR (PMEL_HUMAN)
FGVSVSQLL

SEQ ID NO: 130641 - protein, 9 aa, Artificial Sequence
  Description of Artificial Sequence: Synthetic peptide
  Seed: GTYCLNVSL (PMEL_HUMAN)
GVYCLNVSW

SEQ ID NO: 130642 - protein, 11 aa, Artificial Sequence
  Description of Artificial Sequence: Synthetic peptide
  Seed: LVLMAVVLASL (PMEL_HUMAN)
LMLMAVVLASV

SEQ ID NO: 130643 - protein, 9 aa, Artificial Sequence
  Description of Artificial Sequence: Synthetic peptide
  Seed: RALDGGNKH (PMEL_HUMAN)
RSLDGGNKY

SEQ ID NO: 130644 - protein, 9 aa, Artificial Sequence
  Description of Artificial Sequence: Synthetic peptide
  Seed: SLAVVSTQL (PMEL_HUMAN)
SRAVVSTQF

SEQ ID NO: 130645 - protein, 9 aa, Artificial Sequence
  Description of Artificial Sequence: Synthetic peptide
  Seed: FLRNQPLTF (PMEL_HUMAN)
FIRNQPLTW

SEQ ID NO: 130646 - protein, 10 aa, Artificial Sequence
  Description of Artificial Sequence: Synthetic peptide
  Seed: RGSRSYVPLA (PMEL_HUMAN)
RFSRSYVPLL

SEQ ID NO: 130647 - protein, 11 aa, Artificial Sequence
  Description of Artificial Sequence: Synthetic peptide
  Seed: FGDSSGTLISR (PMEL_HUMAN)
FLDSSGTLISM

SEQ ID NO: 130648 - protein, 8 aa, Artificial Sequence
  Description of Artificial Sequence: Synthetic peptide
  Seed: VSNDGPTL (PMEL_HUMAN)
VTNDGPTL

SEQ ID NO: 130649 - protein, 10 aa, Artificial Sequence
  Description of Artificial Sequence: Synthetic peptide
  Seed: RRLMKQDFSV (PMEL_HUMAN)
RDLMKQDFSI

SEQ ID NO: 130650 - protein, 8 aa, Artificial Sequence
  Description of Artificial Sequence: Synthetic peptide
  Seed: QDFSVPQL (PMEL_HUMAN)
QQFSVPQI

SEQ ID NO: 130651 - protein, 9 aa, Artificial Sequence
  Description of Artificial Sequence: Synthetic peptide
  Seed: VLASLIYRR (PMEL_HUMAN)
VSASLIYRR

SEQ ID NO: 130652 - protein, 9 aa, Artificial Sequence
  Description of Artificial Sequence: Synthetic peptide
  Seed: RYGSFSVTL (PMEL_HUMAN)
RTGSFSVTI

SEQ ID NO: 130653 - protein, 10 aa, Artificial Sequence
  Description of Artificial Sequence: Synthetic peptide
  Seed: RQLYPEWTEA (PMEL_HUMAN)
RILYPEWTEV

SEQ ID NO: 130654 - protein, 9 aa, Artificial Sequence
  Description of Artificial Sequence: Synthetic peptide
  Seed: TLIGANASF (PMEL_HUMAN)
THIGANASF

SEQ ID NO: 130655 - protein, 9 aa, Artificial Sequence
  Description of Artificial Sequence: Synthetic peptide
  Seed: YLAEADLSY (PMEL_HUMAN)
YPAEADLSW

SEQ ID NO: 130656 - protein, 11 aa, Artificial Sequence
  Description of Artificial Sequence: Synthetic peptide
  Seed: SGYLAEADLSY (PMEL_HUMAN)
SIYLAEADLSY

SEQ ID NO: 130657 - protein, 10 aa, Artificial Sequence
  Description of Artificial Sequence: Synthetic peptide
  Seed: THTMEVTVYH (PMEL_HUMAN)
TTTMEVTVYY

SEQ ID NO: 130658 - protein, 10 aa, Artificial Sequence
  Description of Artificial Sequence: Synthetic peptide
  Seed: SSSHWLRLPR (PMEL_HUMAN)
SCSHWLRLPR

SEQ ID NO: 130659 - protein, 9 aa, Artificial Sequence
  Description of Artificial Sequence: Synthetic peptide
  Seed: NFPGSQKVL (PMEL_HUMAN)
NYPGSQKVL

SEQ ID NO: 130660 - protein, 10 aa, Artificial Sequence
  Description of Artificial Sequence: Synthetic peptide
  Seed: KRSFVYVWKT (PMEL_HUMAN)
KRSFVYVWKK

SEQ ID NO: 130661 - protein, 9 aa, Artificial Sequence
  Description of Artificial Sequence: Synthetic peptide
  Seed: FPGSQKVLP (PMEL_HUMAN)
FPGSQKVLV

SEQ ID NO: 130662 - protein, 11 aa, Artificial Sequence
  Description of Artificial Sequence: Synthetic peptide
  Seed: SGLSIGTGRAM (PMEL_HUMAN)
SALSIGTGRAL

SEQ ID NO: 130663 - protein, 9 aa, Artificial Sequence
  Description of Artificial Sequence: Synthetic peptide
  Seed: LPIPEPEGP (PMEL_HUMAN)
LPIPEPEGL

SEQ ID NO: 130664 - protein, 9 aa, Artificial Sequence
  Description of Artificial Sequence: Synthetic peptide
  Seed: MEVTVYHRR (PMEL_HUMAN)
MIVTVYHRK

SEQ ID NO: 130665 - protein, 9 aa, Artificial Sequence
  Description of Artificial Sequence: Synthetic peptide
  Seed: AQVTTTEWV (PMEL_HUMAN)
AQVTTTEWF

SEQ ID NO: 130666 - protein, 11 aa, Artificial Sequence
  Description of Artificial Sequence: Synthetic peptide
  Seed: ALDGGNKHFLR (PMEL_HUMAN)
AVDGGNKHFLY

SEQ ID NO: 130667 - protein, 9 aa, Artificial Sequence
  Description of Artificial Sequence: Synthetic peptide
  Seed: TLISRALVV (PMEL_HUMAN)
TSISRALVV

SEQ ID NO: 130668 - protein, 9 aa, Artificial Sequence
  Description of Artificial Sequence: Synthetic peptide
  Seed: HTYLEPGPV (PMEL_HUMAN)
HAYLEPGPF

SEQ ID NO: 130669 - protein, 10 aa, Artificial Sequence
  Description of Artificial Sequence: Synthetic peptide
  Seed: SVPQLPHSSS (PMEL_HUMAN)
SSPQLPHSSL

SEQ ID NO: 130670 - protein, 10 aa, Artificial Sequence
  Description of Artificial Sequence: Synthetic peptide
  Seed: ASSIMSTESI (PMEL_HUMAN)
AESIMSTESF

SEQ ID NO: 130671 - protein, 11 aa, Artificial Sequence
  Description of Artificial Sequence: Synthetic peptide
  Seed: TYLEPGPVTAQ (PMEL_HUMAN)
TWLEPGPVTAM

SEQ ID NO: 130672 - protein, 9 aa, Artificial Sequence
  Description of Artificial Sequence: Synthetic peptide
  Seed: AEADLSYTW (PMEL_HUMAN)
AQADLSYTF

SEQ ID NO: 130673 - protein, 9 aa, Artificial Sequence
  Description of Artificial Sequence: Synthetic peptide
  Seed: AVVLASLIY (PMEL_HUMAN)
ASVLASLIL

SEQ ID NO: 130674 - protein, 9 aa, Artificial Sequence
  Description of Artificial Sequence: Synthetic peptide
  Seed: QLYPEWTEA (PMEL_HUMAN)
QMYPEWTEV

SEQ ID NO: 130675 - protein, 10 aa, Artificial Sequence
  Description of Artificial Sequence: Synthetic peptide
  Seed: FSVSVSQLRA (PMEL_HUMAN)
FTVSVSQLRE

SEQ ID NO: 130676 - protein, 10 aa, Artificial Sequence
  Description of Artificial Sequence: Synthetic peptide
  Seed: WSQKRSFVYV (PMEL_HUMAN)
WSQKRSFVYK

SEQ ID NO: 130677 - protein, 10 aa, Artificial Sequence
  Description of Artificial Sequence: Synthetic peptide
  Seed: RRLMKQDFSV (PMEL_HUMAN)
RFLMKQDFSV

SEQ ID NO: 130678 - protein, 11 aa, Artificial Sequence
  Description of Artificial Sequence: Synthetic peptide
  Seed: TYLEPGPVTAQ (PMEL_HUMAN)
TWLEPGPVTAL

SEQ ID NO: 130679 - protein, 9 aa, Artificial Sequence
  Description of Artificial Sequence: Synthetic peptide
  Seed: RAMLGTHTM (PMEL_HUMAN)
RNMLGTHTK

SEQ ID NO: 130680 - protein, 9 aa, Artificial Sequence
  Description of Artificial Sequence: Synthetic peptide
  Seed: VSLADTNSL (PMEL_HUMAN)
VLLADTNSA

SEQ ID NO: 130681 - protein, 10 aa, Artificial Sequence
  Description of Artificial Sequence: Synthetic peptide
  Seed: KTWGQYWQVL (PMEL_HUMAN)
KLWGQYWQVK

SEQ ID NO: 130682 - protein, 9 aa, Artificial Sequence
  Description of Artificial Sequence: Synthetic peptide
  Seed: WQVLGGPVS (PMEL_HUMAN)
WRVLGGPVM

SEQ ID NO: 130683 - protein, 10 aa, Artificial Sequence
  Description of Artificial Sequence: Synthetic peptide
  Seed: SCPIGENSPL (PMEL_HUMAN)
SRPIGENSPL

SEQ ID NO: 130684 - protein, 10 aa, Artificial Sequence
  Description of Artificial Sequence: Synthetic peptide
  Seed: MAVVLASLIY (PMEL_HUMAN)
MEVVLASLIY

SEQ ID NO: 130685 - protein, 10 aa, Artificial Sequence
  Description of Artificial Sequence: Synthetic peptide
  Seed: MSTESITGSL (PMEL_HUMAN)
MQTESITGSV

SEQ ID NO: 130686 - protein, 10 aa, Artificial Sequence
  Description of Artificial Sequence: Synthetic peptide
  Seed: LVLMAVVLAS (PMEL_HUMAN)
LILMAVVLAV

SEQ ID NO: 130687 - protein, 10 aa, Artificial Sequence
  Description of Artificial Sequence: Synthetic peptide
  Seed: SVPQLPHSSS (PMEL_HUMAN)
SQPQLPHSSF

SEQ ID NO: 130688 - protein, 10 aa, Artificial Sequence
  Description of Artificial Sequence: Synthetic peptide
  Seed: YLAEADLSYT (PMEL_HUMAN)
YAAEADLSYM

SEQ ID NO: 130689 - protein, 9 aa, Artificial Sequence
  Description of Artificial Sequence: Synthetic peptide
  Seed: NDGPTLIGA (PMEL_HUMAN)
NEGPTLIGI

SEQ ID NO: 130690 - protein, 9 aa, Artificial Sequence
  Description of Artificial Sequence: Synthetic peptide
  Seed: VMGTTLAEM (PMEL_HUMAN)
VQGTTLAEY

SEQ ID NO: 130691 - protein, 9 aa, Artificial Sequence
  Description of Artificial Sequence: Synthetic peptide
  Seed: RQVPLDCVL (PMEL_HUMAN)
REVPLDCVT

SEQ ID NO: 130692 - protein, 9 aa, Artificial Sequence
  Description of Artificial Sequence: Synthetic peptide
  Seed: RAMLGTHTM (PMEL_HUMAN)
RYMLGTHTK

SEQ ID NO: 130693 - protein, 10 aa, Artificial Sequence
  Description of Artificial Sequence: Synthetic peptide
  Seed: SGTYCLNVSL (PMEL_HUMAN)
SQTYCLNVSF

SEQ ID NO: 130694 - protein, 9 aa, Artificial Sequence
  Description of Artificial Sequence: Synthetic peptide
  Seed: RTKAWNRQL (PMEL_HUMAN)
RIKAWNRQA

SEQ ID NO: 130695 - protein, 9 aa, Artificial Sequence
  Description of Artificial Sequence: Synthetic peptide
  Seed: ILKGGSGTY (PMEL_HUMAN)
ISKGGSGTM

SEQ ID NO: 130696 - protein, 9 aa, Artificial Sequence
  Description of Artificial Sequence: Synthetic peptide
  Seed: LSIGTGRAM (PMEL_HUMAN)
LSIGTGRAV

SEQ ID NO: 130697 - protein, 10 aa, Artificial Sequence
  Description of Artificial Sequence: Synthetic peptide
  Seed: GTYCLNVSLA (PMEL_HUMAN)
GLYCLNVSLL

SEQ ID NO: 130698 - protein, 10 aa, Artificial Sequence
  Description of Artificial Sequence: Synthetic peptide
  Seed: LMAVVLASLI (PMEL_HUMAN)
LLAVVLASLV

SEQ ID NO: 130699 - protein, 11 aa, Artificial Sequence
  Description of Artificial Sequence: Synthetic peptide
  Seed: AEMSTPEATGM (PMEL_HUMAN)
AQMSTPEATGI

SEQ ID NO: 130700 - protein, 10 aa, Artificial Sequence
  Description of Artificial Sequence: Synthetic peptide
  Seed: RQVPLDCVLY (PMEL_HUMAN)
RQVPLDCVLV

SEQ ID NO: 130701 - protein, 9 aa, Artificial Sequence
  Description of Artificial Sequence: Synthetic peptide
  Seed: SSHWLRLPR (PMEL_HUMAN)
SWHWLRLPR

SEQ ID NO: 130702 - protein, 9 aa, Artificial Sequence
  Description of Artificial Sequence: Synthetic peptide
  Seed: GEGDAFELT (PMEL_HUMAN)
GEGDAFELP

SEQ ID NO: 130703 - protein, 9 aa, Artificial Sequence
  Description of Artificial Sequence: Synthetic peptide
  Seed: RALVVTHTY (PMEL_HUMAN)
RHLVVTHTY

SEQ ID NO: 130704 - protein, 11 aa, Artificial Sequence
  Description of Artificial Sequence: Synthetic peptide
  Seed: RYGSFSVTLDI (PMEL_HUMAN)
RFGSFSVTLDY

SEQ ID NO: 130705 - protein, 10 aa, Artificial Sequence
  Description of Artificial Sequence: Synthetic peptide
  Seed: AVVLASLIYR (PMEL_HUMAN)
AHVLASLIYR

SEQ ID NO: 130706 - protein, 11 aa, Artificial Sequence
  Description of Artificial Sequence: Synthetic peptide
  Seed: RYGSFSVTLDI (PMEL_HUMAN)
RNGSFSVTLDY

SEQ ID NO: 130707 - protein, 9 aa, Artificial Sequence
  Description of Artificial Sequence: Synthetic peptide
  Seed: FLRNQPLTF (PMEL_HUMAN)
FFRNQPLTY

SEQ ID NO: 130708 - protein, 9 aa, Artificial Sequence
  Description of Artificial Sequence: Synthetic peptide
  Seed: RNQPLTFAL (PMEL_HUMAN)
RVQPLTFAY

SEQ ID NO: 130709 - protein, 10 aa, Artificial Sequence
  Description of Artificial Sequence: Synthetic peptide
  Seed: WKTWGQYWQV (PMEL_HUMAN)
WRTWGQYWQV

SEQ ID NO: 130710 - protein, 8 aa, Artificial Sequence
  Description of Artificial Sequence: Synthetic peptide
  Seed: MAVVLASL (PMEL_HUMAN)
MQVVLASI

SEQ ID NO: 130711 - protein, 9 aa, Artificial Sequence
  Description of Artificial Sequence: Synthetic peptide
  Seed: SSPGCQPPA (PMEL_HUMAN)
SMPGCQPPL

SEQ ID NO: 130712 - protein, 9 aa, Artificial Sequence
  Description of Artificial Sequence: Synthetic peptide
  Seed: SSPGCQPPA (PMEL_HUMAN)
SLPGCQPPA

SEQ ID NO: 130713 - protein, 10 aa, Artificial Sequence
  Description of Artificial Sequence: Synthetic peptide
  Seed: VPFSVSVSQL (PMEL_HUMAN)
VPFSVSVSQF

SEQ ID NO: 130714 - protein, 9 aa, Artificial Sequence
  Description of Artificial Sequence: Synthetic peptide
  Seed: YLAEADLSY (PMEL_HUMAN)
YTAEADLSI

SEQ ID NO: 130715 - protein, 9 aa, Artificial Sequence
  Description of Artificial Sequence: Synthetic peptide
  Seed: GSRSYVPLA (PMEL_HUMAN)
GVRSYVPLA

SEQ ID NO: 130716 - protein, 9 aa, Artificial Sequence
  Description of Artificial Sequence: Synthetic peptide
  Seed: YRYGSFSVT (PMEL_HUMAN)
YHYGSFSVA

SEQ ID NO: 130717 - protein, 11 aa, Artificial Sequence
  Description of Artificial Sequence: Synthetic peptide
  Seed: DCWRGGQVSLK (PMEL_HUMAN)
DIWRGGQVSLK

SEQ ID NO: 130718 - protein, 10 aa, Artificial Sequence
  Description of Artificial Sequence: Synthetic peptide
  Seed: AEADLSYTWD (PMEL_HUMAN)
AEADLSYTWM

SEQ ID NO: 130719 - protein, 10 aa, Artificial Sequence
  Description of Artificial Sequence: Synthetic peptide
  Seed: MAVVLASLIY (PMEL_HUMAN)
MQVVLASLIR

SEQ ID NO: 130720 - protein, 8 aa, Artificial Sequence
  Description of Artificial Sequence: Synthetic peptide
  Seed: SEVMGTTL (PMEL_HUMAN)
SEVMGTTM

SEQ ID NO: 130721 - protein, 9 aa, Artificial Sequence
  Description of Artificial Sequence: Synthetic peptide
  Seed: AVVLASLIY (PMEL_HUMAN)
AHVLASLIF

SEQ ID NO: 130722 - protein, 10 aa, Artificial Sequence
  Description of Artificial Sequence: Synthetic peptide
  Seed: SSSHWLRLPR (PMEL_HUMAN)
SVSHWLRLPK

SEQ ID NO: 130723 - protein, 10 aa, Artificial Sequence
  Description of Artificial Sequence: Synthetic peptide
  Seed: SRALVVTHTY (PMEL_HUMAN)
STALVVTHTW

SEQ ID NO: 130724 - protein, 9 aa, Artificial Sequence
  Description of Artificial Sequence: Synthetic peptide
  Seed: LYPEWTEAQ (PMEL_HUMAN)
LYPEWTEAF

SEQ ID NO: 130725 - protein, 10 aa, Artificial Sequence
  Description of Artificial Sequence: Synthetic peptide
  Seed: VSLADTNSLA (PMEL_HUMAN)
VDLADTNSLL

SEQ ID NO: 130726 - protein, 9 aa, Artificial Sequence
  Description of Artificial Sequence: Synthetic peptide
  Seed: AVIGALLAV (PMEL_HUMAN)
AGIGALLAM

SEQ ID NO: 130727 - protein, 9 aa, Artificial Sequence
  Description of Artificial Sequence: Synthetic peptide
  Seed: RTKAWNRQL (PMEL_HUMAN)
RIKAWNRQR

SEQ ID NO: 130728 - protein, 9 aa, Artificial Sequence
  Description of Artificial Sequence: Synthetic peptide
  Seed: SVPQLPHSS (PMEL_HUMAN)
SLPQLPHSV

SEQ ID NO: 130729 - protein, 9 aa, Artificial Sequence
  Description of Artificial Sequence: Synthetic peptide
  Seed: VVLSGTTAA (PMEL_HUMAN)
VQLSGTTAL

SEQ ID NO: 130730 - protein, 9 aa, Artificial Sequence
  Description of Artificial Sequence: Synthetic peptide
  Seed: GGPVSGLSI (PMEL_HUMAN)
GSPVSGLSM

SEQ ID NO: 130731 - protein, 9 aa, Artificial Sequence
  Description of Artificial Sequence: Synthetic peptide
  Seed: GQVPLIVGI (PMEL_HUMAN)
GEVPLIVGS

SEQ ID NO: 130732 - protein, 9 aa, Artificial Sequence
  Description of Artificial Sequence: Synthetic peptide
  Seed: ITDQVPFSV (PMEL_HUMAN)
IQDQVPFSI

SEQ ID NO: 130733 - protein, 9 aa, Artificial Sequence
  Description of Artificial Sequence: Synthetic peptide
  Seed: VSEVMGTTL (PMEL_HUMAN)
VYEVMGTTY

SEQ ID NO: 130734 - protein, 11 aa, Artificial Sequence
  Description of Artificial Sequence: Synthetic peptide
  Seed: LMKQDFSVPQL (PMEL_HUMAN)
LLKQDFSVPQV

SEQ ID NO: 130735 - protein, 9 aa, Artificial Sequence
  Description of Artificial Sequence: Synthetic peptide
  Seed: VSNDGPTLI (PMEL_HUMAN)
VQNDGPTLL

SEQ ID NO: 130736 - protein, 9 aa, Artificial Sequence
  Description of Artificial Sequence: Synthetic peptide
  Seed: QEAGLGQVP (PMEL_HUMAN)
QEAGLGQVS

SEQ ID NO: 130737 - protein, 9 aa, Artificial Sequence
  Description of Artificial Sequence: Synthetic peptide
  Seed: ESTGMTPEK (PMEL_HUMAN)
EATGMTPEK

SEQ ID NO: 130738 - protein, 9 aa, Artificial Sequence
  Description of Artificial Sequence: Synthetic peptide
  Seed: STAPVQMPT (PMEL_HUMAN)
SMAPVQMPV

SEQ ID NO: 130739 - protein, 11 aa, Artificial Sequence
  Description of Artificial Sequence: Synthetic peptide
  Seed: LGPLLDGTATL (PMEL_HUMAN)
LAPLLDGTATV

SEQ ID NO: 130740 - protein, 9 aa, Artificial Sequence
  Description of Artificial Sequence: Synthetic peptide
  Seed: FGDSSGTLI (PMEL_HUMAN)
FSDSSGTLA

SEQ ID NO: 130741 - protein, 8 aa, Artificial Sequence
  Description of Artificial Sequence: Synthetic peptide
  Seed: LIYRRRLM (PMEL_HUMAN)
LIYRRRLL

SEQ ID NO: 130742 - protein, 9 aa, Artificial Sequence
  Description of Artificial Sequence: Synthetic peptide
  Seed: WSQKRSFVY (PMEL_HUMAN)
WAQKRSFVY

SEQ ID NO: 130743 - protein, 9 aa, Artificial Sequence
  Description of Artificial Sequence: Synthetic peptide
  Seed: QVIWVNNTI (PMEL_HUMAN)
QSIWVNNTV

SEQ ID NO: 130744 - protein, 9 aa, Artificial Sequence
  Description of Artificial Sequence: Synthetic peptide
  Seed: VVLSGTTAA (PMEL_HUMAN)
VQLSGTTAV

SEQ ID NO: 130745 - protein, 8 aa, Artificial Sequence
  Description of Artificial Sequence: Synthetic peptide
  Seed: LADTNSLA (PMEL_HUMAN)
LVDTNSLM

SEQ ID NO: 130746 - protein, 10 aa, Artificial Sequence
  Description of Artificial Sequence: Synthetic peptide
  Seed: AMLGTHTMEV (PMEL_HUMAN)
APLGTHTMEV

SEQ ID NO: 130747 - protein, 9 aa, Artificial Sequence
  Description of Artificial Sequence: Synthetic peptide
  Seed: CPSGSWSQK (PMEL_HUMAN)
CTSGSWSQK

SEQ ID NO: 130748 - protein, 11 aa, Artificial Sequence
  Description of Artificial Sequence: Synthetic peptide
  Seed: LGPLLDGTATL (PMEL_HUMAN)
LAPLLDGTATL

SEQ ID NO: 130749 - protein, 9 aa, Artificial Sequence
  Description of Artificial Sequence: Synthetic peptide
  Seed: YLEPGPVTA (PMEL_HUMAN)
YAEPGPVTC

SEQ ID NO: 130750 - protein, 9 aa, Artificial Sequence
  Description of Artificial Sequence: Synthetic peptide
  Seed: LSIGTGRAM (PMEL_HUMAN)
LAIGTGRAV

SEQ ID NO: 130751 - protein, 9 aa, Artificial Sequence
  Description of Artificial Sequence: Synthetic peptide
  Seed: LIYRRRLMK (PMEL_HUMAN)
LAYRRRLMR

SEQ ID NO: 130752 - protein, 8 aa, Artificial Sequence
  Description of Artificial Sequence: Synthetic peptide
  Seed: SNDGPTLI (PMEL_HUMAN)
SMDGPTLL

SEQ ID NO: 130753 - protein, 9 aa, Artificial Sequence
  Description of Artificial Sequence: Synthetic peptide
  Seed: KQDFSVPQL (PMEL_HUMAN)
KQDFSVPQF

SEQ ID NO: 130754 - protein, 9 aa, Artificial Sequence
  Description of Artificial Sequence: Synthetic peptide
  Seed: AVIGALLAV (PMEL_HUMAN)
AMIGALLAW

SEQ ID NO: 130755 - protein, 10 aa, Artificial Sequence
  Description of Artificial Sequence: Synthetic peptide
  Seed: GDSSGTLISR (PMEL_HUMAN)
GSSSGTLISY

SEQ ID NO: 130756 - protein, 9 aa, Artificial Sequence
  Description of Artificial Sequence: Synthetic peptide
  Seed: RLMKQDFSV (PMEL_HUMAN)
RWMKQDFSY

SEQ ID NO: 130757 - protein, 9 aa, Artificial Sequence
  Description of Artificial Sequence: Synthetic peptide
  Seed: HSSSHWLRL (PMEL_HUMAN)
HWSSHWLRY

SEQ ID NO: 130758 - protein, 10 aa, Artificial Sequence
  Description of Artificial Sequence: Synthetic peptide
  Seed: LVLMAVVLAS (PMEL_HUMAN)
LQLMAVVLAL

SEQ ID NO: 130759 - protein, 9 aa, Artificial Sequence
  Description of Artificial Sequence: Synthetic peptide
  Seed: RTKAWNRQL (PMEL_HUMAN)
RMKAWNRQR

SEQ ID NO: 130760 - protein, 9 aa, Artificial Sequence
  Description of Artificial Sequence: Synthetic peptide
  Seed: TAEAPNTTA (PMEL_HUMAN)
TAEAPNTTY

SEQ ID NO: 130761 - protein, 10 aa, Artificial Sequence
  Description of Artificial Sequence: Synthetic peptide
  Seed: TAAQVTTTEW (PMEL_HUMAN)
TVAQVTTTEW

SEQ ID NO: 130762 - protein, 9 aa, Artificial Sequence
  Description of Artificial Sequence: Synthetic peptide
  Seed: AAIPLTSCG (PMEL_HUMAN)
ATIPLTSCF

SEQ ID NO: 130763 - protein, 9 aa, Artificial Sequence
  Description of Artificial Sequence: Synthetic peptide
  Seed: FSIALNFPG (PMEL_HUMAN)
FSIALNFPI

SEQ ID NO: 130764 - protein, 9 aa, Artificial Sequence
  Description of Artificial Sequence: Synthetic peptide
  Seed: LMAVVLASL (PMEL_HUMAN)
LAAVVLASV

SEQ ID NO: 130765 - protein, 9 aa, Artificial Sequence
  Description of Artificial Sequence: Synthetic peptide
  Seed: SQKRSFVYV (PMEL_HUMAN)
SYKRSFVYI

SEQ ID NO: 130766 - protein, 9 aa, Artificial Sequence
  Description of Artificial Sequence: Synthetic peptide
  Seed: YHRRGSRSY (PMEL_HUMAN)
YQRRGSRSW

SEQ ID NO: 130767 - protein, 9 aa, Artificial Sequence
  Description of Artificial Sequence: Synthetic peptide
  Seed: TAEAPNTTA (PMEL_HUMAN)
TVEAPNTTI

SEQ ID NO: 130768 - protein, 10 aa, Artificial Sequence
  Description of Artificial Sequence: Synthetic peptide
  Seed: RQLYPEWTEA (PMEL_HUMAN)
RKLYPEWTEI

SEQ ID NO: 130769 - protein, 9 aa, Artificial Sequence
  Description of Artificial Sequence: Synthetic peptide
  Seed: VQVPTTEVI (PMEL_HUMAN)
VHVPTTEVA

SEQ ID NO: 130770 - protein, 9 aa, Artificial Sequence
  Description of Artificial Sequence: Synthetic peptide
  Seed: IMPGQEAGL (PMEL_HUMAN)
IAPGQEAGL

SEQ ID NO: 130771 - protein, 9 aa, Artificial Sequence
  Description of Artificial Sequence: Synthetic peptide
  Seed: SQVWGGQPV (PMEL_HUMAN)
SVVWGGQPL

SEQ ID NO: 130772 - protein, 9 aa, Artificial Sequence
  Description of Artificial Sequence: Synthetic peptide
  Seed: LPDGQVIWV (PMEL_HUMAN)
LWDGQVIWL

SEQ ID NO: 130773 - protein, 9 aa, Artificial Sequence
  Description of Artificial Sequence: Synthetic peptide
  Seed: FLRNQPLTF (PMEL_HUMAN)
FARNQPLTI

SEQ ID NO: 130774 - protein, 11 aa, Artificial Sequence
  Description of Artificial Sequence: Synthetic peptide
  Seed: ITDQVPFSVSV (PMEL_HUMAN)
IADQVPFSVSV

SEQ ID NO: 130775 - protein, 9 aa, Artificial Sequence
  Description of Artificial Sequence: Synthetic peptide
  Seed: RLPRIFCSC (PMEL_HUMAN)
RLPRIFCSL

SEQ ID NO: 130776 - protein, 9 aa, Artificial Sequence
  Description of Artificial Sequence: Synthetic peptide
  Seed: SQVWGGQPV (PMEL_HUMAN)
SHVWGGQPY

SEQ ID NO: 130777 - protein, 9 aa, Artificial Sequence
  Description of Artificial Sequence: Synthetic peptide
  Seed: VPFSVSVSQ (PMEL_HUMAN)
VPFSVSVSH

SEQ ID NO: 130778 - protein, 9 aa, Artificial Sequence
  Description of Artificial Sequence: Synthetic peptide
  Seed: SGTLISRAL (PMEL_HUMAN)
SSTLISRAL

SEQ ID NO: 130779 - protein, 10 aa, Artificial Sequence
  Description of Artificial Sequence: Synthetic peptide
  Seed: KVLPDGQVIW (PMEL_HUMAN)
KTLPDGQVIL

SEQ ID NO: 130780 - protein, 9 aa, Artificial Sequence
  Description of Artificial Sequence: Synthetic peptide
  Seed: SRALVVTHT (PMEL_HUMAN)
SHALVVTHL

SEQ ID NO: 130781 - protein, 11 aa, Artificial Sequence
  Description of Artificial Sequence: Synthetic peptide
  Seed: RAMLGTHTMEV (PMEL_HUMAN)
RYMLGTHTMEV

SEQ ID NO: 130782 - protein, 10 aa, Artificial Sequence
  Description of Artificial Sequence: Synthetic peptide
  Seed: SRALVVTHTY (PMEL_HUMAN)
STALVVTHTY

SEQ ID NO: 130783 - protein, 9 aa, Artificial Sequence
  Description of Artificial Sequence: Synthetic peptide
  Seed: ITDQVPFSV (PMEL_HUMAN)
IMDQVPFSV

SEQ ID NO: 130784 - protein, 9 aa, Artificial Sequence
  Description of Artificial Sequence: Synthetic peptide
  Seed: VTAQVVLQA (PMEL_HUMAN)
VQAQVVLQM

SEQ ID NO: 130785 - protein, 9 aa, Artificial Sequence
  Description of Artificial Sequence: Synthetic peptide
  Seed: VVLASLIYR (PMEL_HUMAN)
VNLASLIYR

SEQ ID NO: 130786 - protein, 9 aa, Artificial Sequence
  Description of Artificial Sequence: Synthetic peptide
  Seed: QVIWVNNTI (PMEL_HUMAN)
QVIWVNNTA

SEQ ID NO: 130787 - protein, 9 aa, Artificial Sequence
  Description of Artificial Sequence: Synthetic peptide
  Seed: WSQKRSFVY (PMEL_HUMAN)
WWQKRSFVY

SEQ ID NO: 130788 - protein, 9 aa, Artificial Sequence
  Description of Artificial Sequence: Synthetic peptide
  Seed: VQMPTAEST (PMEL_HUMAN)
VTMPTAESM

SEQ ID NO: 130789 - protein, 10 aa, Artificial Sequence
  Description of Artificial Sequence: Synthetic peptide
  Seed: VLMAVVLASL (PMEL_HUMAN)
VMMAVVLASA

SEQ ID NO: 130790 - protein, 9 aa, Artificial Sequence
  Description of Artificial Sequence: Synthetic peptide
  Seed: AVIGALLAV (PMEL_HUMAN)
ALIGALLAF

SEQ ID NO: 130791 - protein, 10 aa, Artificial Sequence
  Description of Artificial Sequence: Synthetic peptide
  Seed: LQLHDPSGYL (PMEL_HUMAN)
LALHDPSGYY

SEQ ID NO: 130792 - protein, 10 aa, Artificial Sequence
  Description of Artificial Sequence: Synthetic peptide
  Seed: YRYGSFSVTL (PMEL_HUMAN)
YQYGSFSVTI

SEQ ID NO: 130793 - protein, 10 aa, Artificial Sequence
  Description of Artificial Sequence: Synthetic peptide
  Seed: LAVIGALLAV (PMEL_HUMAN)
LSVIGALLAI

SEQ ID NO: 130794 - protein, 10 aa, Artificial Sequence
  Description of Artificial Sequence: Synthetic peptide
  Seed: AVIGALLAVG (PMEL_HUMAN)
ALIGALLAVW

SEQ ID NO: 130795 - protein, 10 aa, Artificial Sequence
  Description of Artificial Sequence: Synthetic peptide
  Seed: ESITGSLGPL (PMEL_HUMAN)
EVITGSLGPI

SEQ ID NO: 130796 - protein, 10 aa, Artificial Sequence
  Description of Artificial Sequence: Synthetic peptide
  Seed: RTKAWNRQLY (PMEL_HUMAN)
RFKAWNRQLA

SEQ ID NO: 130797 - protein, 9 aa, Artificial Sequence
  Description of Artificial Sequence: Synthetic peptide
  Seed: GQVPTTEVV (PMEL_HUMAN)
GHVPTTEVL

SEQ ID NO: 130798 - protein, 9 aa, Artificial Sequence
  Description of Artificial Sequence: Synthetic peptide
  Seed: LNFPGSQKV (PMEL_HUMAN)
LQFPGSQKL

SEQ ID NO: 130799 - protein, 10 aa, Artificial Sequence
  Description of Artificial Sequence: Synthetic peptide
  Seed: AVPSGEGDAF (PMEL_HUMAN)
AYPSGEGDAY

SEQ ID NO: 130800 - protein, 10 aa, Artificial Sequence
  Description of Artificial Sequence: Synthetic peptide
  Seed: GSFSVTLDIV (PMEL_HUMAN)
GVFSVTLDIV

SEQ ID NO: 130801 - protein, 9 aa, Artificial Sequence
  Description of Artificial Sequence: Synthetic peptide
  Seed: GSRSYVPLA (PMEL_HUMAN)
GSRSYVPLT

SEQ ID NO: 130802 - protein, 10 aa, Artificial Sequence
  Description of Artificial Sequence: Synthetic peptide
  Seed: QLHDPSGYLA (PMEL_HUMAN)
QLHDPSGYLV

SEQ ID NO: 130803 - protein, 9 aa, Artificial Sequence
  Description of Artificial Sequence: Synthetic peptide
  Seed: GQVPTTEVV (PMEL_HUMAN)
GAVPTTEVY

SEQ ID NO: 130804 - protein, 9 aa, Artificial Sequence
  Description of Artificial Sequence: Synthetic peptide
  Seed: SLGPLLDGT (PMEL_HUMAN)
SQGPLLDGL

SEQ ID NO: 130805 - protein, 11 aa, Artificial Sequence
  Description of Artificial Sequence: Synthetic peptide
  Seed: QEAGLGQVPLI (PMEL_HUMAN)
QEAGLGQVPLY

SEQ ID NO: 130806 - protein, 9 aa, Artificial Sequence
  Description of Artificial Sequence: Synthetic peptide
  Seed: AVIGALLAV (PMEL_HUMAN)
AMIGALLAV

SEQ ID NO: 130807 - protein, 10 aa, Artificial Sequence
  Description of Artificial Sequence: Synthetic peptide
  Seed: MKQDFSVPQL (PMEL_HUMAN)
MQQDFSVPQF

SEQ ID NO: 130808 - protein, 9 aa, Artificial Sequence
  Description of Artificial Sequence: Synthetic peptide
  Seed: KQDFSVPQL (PMEL_HUMAN)
KLDFSVPQT

SEQ ID NO: 130809 - protein, 9 aa, Artificial Sequence
  Description of Artificial Sequence: Synthetic peptide
  Seed: SAFTITDQV (PMEL_HUMAN)
STFTITDQV

SEQ ID NO: 130810 - protein, 8 aa, Artificial Sequence
  Description of Artificial Sequence: Synthetic peptide
  Seed: SEVMGTTL (PMEL_HUMAN)
SEVMGTTV

SEQ ID NO: 130811 - protein, 10 aa, Artificial Sequence
  Description of Artificial Sequence: Synthetic peptide
  Seed: VVLASLIYRR (PMEL_HUMAN)
VRLASLIYRR

SEQ ID NO: 130812 - protein, 9 aa, Artificial Sequence
  Description of Artificial Sequence: Synthetic peptide
  Seed: YLEPGPVTA (PMEL_HUMAN)
YVEPGPVTY

SEQ ID NO: 130813 - protein, 9 aa, Artificial Sequence
  Description of Artificial Sequence: Synthetic peptide
  Seed: GTYCLNVSL (PMEL_HUMAN)
GAYCLNVSW

SEQ ID NO: 130814 - protein, 10 aa, Artificial Sequence
  Description of Artificial Sequence: Synthetic peptide
  Seed: RSFVYVWKTW (PMEL_HUMAN)
RYFVYVWKTI

SEQ ID NO: 130815 - protein, 9 aa, Artificial Sequence
  Description of Artificial Sequence: Synthetic peptide
  Seed: HLAVIGALL (PMEL_HUMAN)
HMAVIGALI

SEQ ID NO: 130816 - protein, 9 aa, Artificial Sequence
  Description of Artificial Sequence: Synthetic peptide
  Seed: RAMLGTHTM (PMEL_HUMAN)
RWMLGTHTL

SEQ ID NO: 130817 - protein, 10 aa, Artificial Sequence
  Description of Artificial Sequence: Synthetic peptide
  Seed: VLMAVVLASL (PMEL_HUMAN)
VCMAVVLASV

SEQ ID NO: 130818 - protein, 11 aa, Artificial Sequence
  Description of Artificial Sequence: Synthetic peptide
  Seed: LGPLLDGTATL (PMEL_HUMAN)
LYPLLDGTATL

SEQ ID NO: 130819 - protein, 10 aa, Artificial Sequence
  Description of Artificial Sequence: Synthetic peptide
  Seed: VPLAHSSSAF (PMEL_HUMAN)
VNLAHSSSAF

SEQ ID NO: 130820 - protein, 9 aa, Artificial Sequence
  Description of Artificial Sequence: Synthetic peptide
  Seed: QVWGGQPVY (PMEL_HUMAN)
QTWGGQPVK

SEQ ID NO: 130821 - protein, 9 aa, Artificial Sequence
  Description of Artificial Sequence: Synthetic peptide
  Seed: AGQVPTTEV (PMEL_HUMAN)
AVQVPTTEY

SEQ ID NO: 130822 - protein, 10 aa, Artificial Sequence
  Description of Artificial Sequence: Synthetic peptide
  Seed: RALVVTHTYL (PMEL_HUMAN)
RALVVTHTYW

SEQ ID NO: 130823 - protein, 8 aa, Artificial Sequence
  Description of Artificial Sequence: Synthetic peptide
  Seed: VSNDGPTL (PMEL_HUMAN)
VANDGPTF

SEQ ID NO: 130824 - protein, 11 aa, Artificial Sequence
  Description of Artificial Sequence: Synthetic peptide
  Seed: TVYHRRGSRSY (PMEL_HUMAN)
TTYHRRGSRSF

SEQ ID NO: 130825 - protein, 10 aa, Artificial Sequence
  Description of Artificial Sequence: Synthetic peptide
  Seed: GLSIGTGRAM (PMEL_HUMAN)
GMSIGTGRAF

SEQ ID NO: 130826 - protein, 9 aa, Artificial Sequence
  Description of Artificial Sequence: Synthetic peptide
  Seed: AHSSSAFTI (PMEL_HUMAN)
AHSSSAFTL

SEQ ID NO: 130827 - protein, 11 aa, Artificial Sequence
  Description of Artificial Sequence: Synthetic peptide
  Seed: HTMEVTVYHRR (PMEL_HUMAN)
HTMEVTVYHRA

SEQ ID NO: 130828 - protein, 9 aa, Artificial Sequence
  Description of Artificial Sequence: Synthetic peptide
  Seed: RAMLGTHTM (PMEL_HUMAN)
RNMLGTHTF

SEQ ID NO: 130829 - protein, 8 aa, Artificial Sequence
  Description of Artificial Sequence: Synthetic peptide
  Seed: SEVMGTTL (PMEL_HUMAN)
SEVMGTTF

SEQ ID NO: 130830 - protein, 9 aa, Artificial Sequence
  Description of Artificial Sequence: Synthetic peptide
  Seed: STESITGSL (PMEL_HUMAN)
SWESITGSL

SEQ ID NO: 130831 - protein, 11 aa, Artificial Sequence
  Description of Artificial Sequence: Synthetic peptide
  Seed: ITDQVPFSVSV (PMEL_HUMAN)
IMDQVPFSVSV

SEQ ID NO: 130832 - protein, 10 aa, Artificial Sequence
  Description of Artificial Sequence: Synthetic peptide
  Seed: SLIYRRRLMK (PMEL_HUMAN)
SVIYRRRLMR

SEQ ID NO: 130833 - protein, 11 aa, Artificial Sequence
  Description of Artificial Sequence: Synthetic peptide
  Seed: FGDSSGTLISR (PMEL_HUMAN)
FADSSGTLISM

SEQ ID NO: 130834 - protein, 9 aa, Artificial Sequence
  Description of Artificial Sequence: Synthetic peptide
  Seed: SITGSLGPL (PMEL_HUMAN)
SMTGSLGPY

SEQ ID NO: 130835 - protein, 10 aa, Artificial Sequence
  Description of Artificial Sequence: Synthetic peptide
  Seed: QVLGGPVSGL (PMEL_HUMAN)
QTLGGPVSGL

SEQ ID NO: 130836 - protein, 10 aa, Artificial Sequence
  Description of Artificial Sequence: Synthetic peptide
  Seed: MTPAEVSIVV (PMEL_HUMAN)
MSPAEVSIVL

SEQ ID NO: 130837 - protein, 9 aa, Artificial Sequence
  Description of Artificial Sequence: Synthetic peptide
  Seed: GQVPLIVGI (PMEL_HUMAN)
GIVPLIVGF

SEQ ID NO: 130838 - protein, 9 aa, Artificial Sequence
  Description of Artificial Sequence: Synthetic peptide
  Seed: EVMGTTLAE (PMEL_HUMAN)
EAMGTTLAY

SEQ ID NO: 130839 - protein, 9 aa, Artificial Sequence
  Description of Artificial Sequence: Synthetic peptide
  Seed: LQAAIPLTS (PMEL_HUMAN)
LQAAIPLTW

SEQ ID NO: 130840 - protein, 10 aa, Artificial Sequence
  Description of Artificial Sequence: Synthetic peptide
  Seed: RGSRSYVPLA (PMEL_HUMAN)
RCSRSYVPLR

SEQ ID NO: 130841 - protein, 9 aa, Artificial Sequence
  Description of Artificial Sequence: Synthetic peptide
  Seed: NQDWLGVSR (PMEL_HUMAN)
NADWLGVSL

SEQ ID NO: 130842 - protein, 10 aa, Artificial Sequence
  Description of Artificial Sequence: Synthetic peptide
  Seed: RALVVTHTYL (PMEL_HUMAN)
RPLVVTHTYY

SEQ ID NO: 130843 - protein, 10 aa, Artificial Sequence
  Description of Artificial Sequence: Synthetic peptide
  Seed: LVLMAVVLAS (PMEL_HUMAN)
LRLMAVVLAI

SEQ ID NO: 130844 - protein, 9 aa, Artificial Sequence
  Description of Artificial Sequence: Synthetic peptide
  Seed: RAMLGTHTM (PMEL_HUMAN)
RSMLGTHTM

SEQ ID NO: 130845 - protein, 10 aa, Artificial Sequence
  Description of Artificial Sequence: Synthetic peptide
  Seed: AEMSTPEATG (PMEL_HUMAN)
AEMSTPEATC

SEQ ID NO: 130846 - protein, 9 aa, Artificial Sequence
  Description of Artificial Sequence: Synthetic peptide
  Seed: MSTPEATGM (PMEL_HUMAN)
MITPEATGW

SEQ ID NO: 130847 - protein, 9 aa, Artificial Sequence
  Description of Artificial Sequence: Synthetic peptide
  Seed: SVQVPTTEV (PMEL_HUMAN)
SLQVPTTEM

SEQ ID NO: 130848 - protein, 9 aa, Artificial Sequence
  Description of Artificial Sequence: Synthetic peptide
  Seed: VTLDIVQGI (PMEL_HUMAN)
VSLDIVQGW

SEQ ID NO: 130849 - protein, 10 aa, Artificial Sequence
  Description of Artificial Sequence: Synthetic peptide
  Seed: ESITGSLGPL (PMEL_HUMAN)
ETITGSLGPV

SEQ ID NO: 130850 - protein, 9 aa, Artificial Sequence
  Description of Artificial Sequence: Synthetic peptide
  Seed: TLIGANASF (PMEL_HUMAN)
TKIGANASF

SEQ ID NO: 130851 - protein, 9 aa, Artificial Sequence
  Description of Artificial Sequence: Synthetic peptide
  Seed: GTHTMEVTV (PMEL_HUMAN)
GLHTMEVTV

SEQ ID NO: 130852 - protein, 9 aa, Artificial Sequence
  Description of Artificial Sequence: Synthetic peptide
  Seed: RALVVTHTY (PMEL_HUMAN)
RVLVVTHTF

SEQ ID NO: 130853 - protein, 9 aa, Artificial Sequence
  Description of Artificial Sequence: Synthetic peptide
  Seed: RLVKRQVPL (PMEL_HUMAN)
RKVKRQVPL

SEQ ID NO: 130854 - protein, 10 aa, Artificial Sequence
  Description of Artificial Sequence: Synthetic peptide
  Seed: EVSIVVLSGT (PMEL_HUMAN)
ETSIVVLSGV

SEQ ID NO: 130855 - protein, 10 aa, Artificial Sequence
  Description of Artificial Sequence: Synthetic peptide
  Seed: RYGSFSVTLD (PMEL_HUMAN)
RWGSFSVTLF

SEQ ID NO: 130856 - protein, 10 aa, Artificial Sequence
  Description of Artificial Sequence: Synthetic peptide
  Seed: LQLHDPSGYL (PMEL_HUMAN)
LFLHDPSGYL

SEQ ID NO: 130857 - protein, 9 aa, Artificial Sequence
  Description of Artificial Sequence: Synthetic peptide
  Seed: QVIWVNNTI (PMEL_HUMAN)
QTIWVNNTV

SEQ ID NO: 130858 - protein, 9 aa, Artificial Sequence
  Description of Artificial Sequence: Synthetic peptide
  Seed: VSLADTNSL (PMEL_HUMAN)
VALADTNSF

SEQ ID NO: 130859 - protein, 9 aa, Artificial Sequence
  Description of Artificial Sequence: Synthetic peptide
  Seed: ESAEILQAV (PMEL_HUMAN)
EEAEILQAI

SEQ ID NO: 130860 - protein, 10 aa, Artificial Sequence
  Description of Artificial Sequence: Synthetic peptide
  Seed: MTPAEVSIVV (PMEL_HUMAN)
MCPAEVSIVY

SEQ ID NO: 130861 - protein, 9 aa, Artificial Sequence
  Description of Artificial Sequence: Synthetic peptide
  Seed: LNFPGSQKV (PMEL_HUMAN)
LMFPGSQKI

SEQ ID NO: 130862 - protein, 9 aa, Artificial Sequence
  Description of Artificial Sequence: Synthetic peptide
  Seed: AVIGALLAV (PMEL_HUMAN)
ATIGALLAR

SEQ ID NO: 130863 - protein, 9 aa, Artificial Sequence
  Description of Artificial Sequence: Synthetic peptide
  Seed: VQVPTTEVI (PMEL_HUMAN)
VAVPTTEVH

SEQ ID NO: 130864 - protein, 9 aa, Artificial Sequence
  Description of Artificial Sequence: Synthetic peptide
  Seed: SQKRSFVYV (PMEL_HUMAN)
SSKRSFVYH

SEQ ID NO: 130865 - protein, 10 aa, Artificial Sequence
  Description of Artificial Sequence: Synthetic peptide
  Seed: VLMAVVLASL (PMEL_HUMAN)
VFMAVVLASM

SEQ ID NO: 130866 - protein, 10 aa, Artificial Sequence
  Description of Artificial Sequence: Synthetic peptide
  Seed: RQLYPEWTEA (PMEL_HUMAN)
RWLYPEWTEV

SEQ ID NO: 130867 - protein, 9 aa, Artificial Sequence
  Description of Artificial Sequence: Synthetic peptide
  Seed: VISTAPVQM (PMEL_HUMAN)
VWSTAPVQL

SEQ ID NO: 130868 - protein, 11 aa, Artificial Sequence
  Description of Artificial Sequence: Synthetic peptide
  Seed: HQILKGGSGTY (PMEL_HUMAN)
HEILKGGSGTF

SEQ ID NO: 130869 - protein, 9 aa, Artificial Sequence
  Description of Artificial Sequence: Synthetic peptide
  Seed: TTPGQAPTA (PMEL_HUMAN)
TAPGQAPTF

SEQ ID NO: 130870 - protein, 9 aa, Artificial Sequence
  Description of Artificial Sequence: Synthetic peptide
  Seed: VQVPTTEVI (PMEL_HUMAN)
VGVPTTEVY

SEQ ID NO: 130871 - protein, 10 aa, Artificial Sequence
  Description of Artificial Sequence: Synthetic peptide
  Seed: RQVPLDCVLY (PMEL_HUMAN)
RMVPLDCVLM

SEQ ID NO: 130872 - protein, 9 aa, Artificial Sequence
  Description of Artificial Sequence: Synthetic peptide
  Seed: SQKRSFVYV (PMEL_HUMAN)
SHKRSFVYY

SEQ ID NO: 130873 - protein, 11 aa, Artificial Sequence
  Description of Artificial Sequence: Synthetic peptide
  Seed: HTMEVTVYHRR (PMEL_HUMAN)
HTMEVTVYHRC

SEQ ID NO: 130874 - protein, 9 aa, Artificial Sequence
  Description of Artificial Sequence: Synthetic peptide
  Seed: VQVPTTEVI (PMEL_HUMAN)
VGVPTTEVL

SEQ ID NO: 130875 - protein, 9 aa, Artificial Sequence
  Description of Artificial Sequence: Synthetic peptide
  Seed: RGSRSYVPL (PMEL_HUMAN)
RVSRSYVPI

SEQ ID NO: 130876 - protein, 10 aa, Artificial Sequence
  Description of Artificial Sequence: Synthetic peptide
  Seed: SLADTNSLAV (PMEL_HUMAN)
SQADTNSLAV

SEQ ID NO: 130877 - protein, 9 aa, Artificial Sequence
  Description of Artificial Sequence: Synthetic peptide
  Seed: LIVGILLVL (PMEL_HUMAN)
LIVGILLVF

SEQ ID NO: 130878 - protein, 9 aa, Artificial Sequence
  Description of Artificial Sequence: Synthetic peptide
  Seed: TTPGQAPTA (PMEL_HUMAN)
TSPGQAPTI

SEQ ID NO: 130879 - protein, 9 aa, Artificial Sequence
  Description of Artificial Sequence: Synthetic peptide
  Seed: VISTAPVQM (PMEL_HUMAN)
VFSTAPVQY

SEQ ID NO: 130880 - protein, 10 aa, Artificial Sequence
  Description of Artificial Sequence: Synthetic peptide
  Seed: RGSRSYVPLA (PMEL_HUMAN)
RTSRSYVPLQ

SEQ ID NO: 130881 - protein, 9 aa, Artificial Sequence
  Description of Artificial Sequence: Synthetic peptide
  Seed: GTYCLNVSL (PMEL_HUMAN)
GMYCLNVSA

SEQ ID NO: 130882 - protein, 10 aa, Artificial Sequence
  Description of Artificial Sequence: Synthetic peptide
  Seed: LQLHDPSGYL (PMEL_HUMAN)
LQLHDPSGYY

SEQ ID NO: 130883 - protein, 10 aa, Artificial Sequence
  Description of Artificial Sequence: Synthetic peptide
  Seed: LAVVSTQLIM (PMEL_HUMAN)
LPVVSTQLIF

SEQ ID NO: 130884 - protein, 10 aa, Artificial Sequence
  Description of Artificial Sequence: Synthetic peptide
  Seed: LVLMAVVLAS (PMEL_HUMAN)
LALMAVVLAA

SEQ ID NO: 130885 - protein, 10 aa, Artificial Sequence
  Description of Artificial Sequence: Synthetic peptide
  Seed: EVISTAPVQM (PMEL_HUMAN)
ESISTAPVQK

SEQ ID NO: 130886 - protein, 9 aa, Artificial Sequence
  Description of Artificial Sequence: Synthetic peptide
  Seed: RLVKRQVPL (PMEL_HUMAN)
RFVKRQVPY

SEQ ID NO: 130887 - protein, 9 aa, Artificial Sequence
  Description of Artificial Sequence: Synthetic peptide
  Seed: ALDGGNKHF (PMEL_HUMAN)
AQDGGNKHF

SEQ ID NO: 130888 - protein, 9 aa, Artificial Sequence
  Description of Artificial Sequence: Synthetic peptide
  Seed: FGDSSGTLI (PMEL_HUMAN)
FIDSSGTLL

SEQ ID NO: 130889 - protein, 10 aa, Artificial Sequence
  Description of Artificial Sequence: Synthetic peptide
  Seed: LAVVSTQLIM (PMEL_HUMAN)
LMVVSTQLIW

SEQ ID NO: 130890 - protein, 10 aa, Artificial Sequence
  Description of Artificial Sequence: Synthetic peptide
  Seed: LNFPGSQKVL (PMEL_HUMAN)
LVFPGSQKVY

SEQ ID NO: 130891 - protein, 10 aa, Artificial Sequence
  Description of Artificial Sequence: Synthetic peptide
  Seed: NSLAVVSTQL (PMEL_HUMAN)
NILAVVSTQV

SEQ ID NO: 130892 - protein, 9 aa, Artificial Sequence
  Description of Artificial Sequence: Synthetic peptide
  Seed: ITDQVPFSV (PMEL_HUMAN)
ITDQVPFSW

SEQ ID NO: 130893 - protein, 10 aa, Artificial Sequence
  Description of Artificial Sequence: Synthetic peptide
  Seed: SCPIGENSPL (PMEL_HUMAN)
SSPIGENSPL

SEQ ID NO: 130894 - protein, 9 aa, Artificial Sequence
  Description of Artificial Sequence: Synthetic peptide
  Seed: VISTAPVQM (PMEL_HUMAN)
VLSTAPVQV

SEQ ID NO: 130895 - protein, 8 aa, Artificial Sequence
  Description of Artificial Sequence: Synthetic peptide
  Seed: LLDGTATL (PMEL_HUMAN)
LADGTATF

SEQ ID NO: 130896 - protein, 10 aa, Artificial Sequence
  Description of Artificial Sequence: Synthetic peptide
  Seed: TAAQVTTTEW (PMEL_HUMAN)
TAAQVTTTEF

SEQ ID NO: 130897 - protein, 10 aa, Artificial Sequence
  Description of Artificial Sequence: Synthetic peptide
  Seed: SVPQLPHSSS (PMEL_HUMAN)
SDPQLPHSSV

SEQ ID NO: 130898 - protein, 11 aa, Artificial Sequence
  Description of Artificial Sequence: Synthetic peptide
  Seed: SYVPLAHSSSA (PMEL_HUMAN)
SMVPLAHSSSF

SEQ ID NO: 130899 - protein, 9 aa, Artificial Sequence
  Description of Artificial Sequence: Synthetic peptide
  Seed: VLMAVVLAS (PMEL_HUMAN)
VVMAVVLAL

SEQ ID NO: 130900 - protein, 9 aa, Artificial Sequence
  Description of Artificial Sequence: Synthetic peptide
  Seed: AEADLSYTW (PMEL_HUMAN)
ALADLSYTM

SEQ ID NO: 130901 - protein, 10 aa, Artificial Sequence
  Description of Artificial Sequence: Synthetic peptide
  Seed: RGSRSYVPLA (PMEL_HUMAN)
RESRSYVPLK

SEQ ID NO: 130902 - protein, 11 aa, Artificial Sequence
  Description of Artificial Sequence: Synthetic peptide
  Seed: YLAEADLSYTW (PMEL_HUMAN)
YYAEADLSYTL

SEQ ID NO: 130903 - protein, 9 aa, Artificial Sequence
  Description of Artificial Sequence: Synthetic peptide
  Seed: SVPQLPHSS (PMEL_HUMAN)
STPQLPHSM

SEQ ID NO: 130904 - protein, 10 aa, Artificial Sequence
  Description of Artificial Sequence: Synthetic peptide
  Seed: GSFSVTLDIV (PMEL_HUMAN)
GIFSVTLDIV

SEQ ID NO: 130905 - protein, 10 aa, Artificial Sequence
  Description of Artificial Sequence: Synthetic peptide
  Seed: RGSRSYVPLA (PMEL_HUMAN)
RESRSYVPLM

SEQ ID NO: 130906 - protein, 9 aa, Artificial Sequence
  Description of Artificial Sequence: Synthetic peptide
  Seed: QPLTFALQL (PMEL_HUMAN)
QPLTFALQA

SEQ ID NO: 130907 - protein, 11 aa, Artificial Sequence
  Description of Artificial Sequence: Synthetic peptide
  Seed: SGYLAEADLSY (PMEL_HUMAN)
SMYLAEADLSY

SEQ ID NO: 130908 - protein, 11 aa, Artificial Sequence
  Description of Artificial Sequence: Synthetic peptide
  Seed: RTKAWNRQLYP (PMEL_HUMAN)
RTKAWNRQLYM

SEQ ID NO: 130909 - protein, 10 aa, Artificial Sequence
  Description of Artificial Sequence: Synthetic peptide
  Seed: LHLAVIGALL (PMEL_HUMAN)
LFLAVIGALA

SEQ ID NO: 130910 - protein, 9 aa, Artificial Sequence
  Description of Artificial Sequence: Synthetic peptide
  Seed: KQDFSVPQL (PMEL_HUMAN)
KEDFSVPQF

SEQ ID NO: 130911 - protein, 9 aa, Artificial Sequence
  Description of Artificial Sequence: Synthetic peptide
  Seed: WSQKRSFVY (PMEL_HUMAN)
WAQKRSFVL

SEQ ID NO: 130912 - protein, 11 aa, Artificial Sequence
  Description of Artificial Sequence: Synthetic peptide
  Seed: AEMSTPEATGM (PMEL_HUMAN)
AAMSTPEATGY

SEQ ID NO: 130913 - protein, 10 aa, Artificial Sequence
  Description of Artificial Sequence: Synthetic peptide
  Seed: YGSFSVTLDI (PMEL_HUMAN)
YYSFSVTLDY

SEQ ID NO: 130914 - protein, 10 aa, Artificial Sequence
  Description of Artificial Sequence: Synthetic peptide
  Seed: SQVWGGQPVY (PMEL_HUMAN)
SPVWGGQPVY

SEQ ID NO: 130915 - protein, 11 aa, Artificial Sequence
  Description of Artificial Sequence: Synthetic peptide
  Seed: FLRNQPLTFAL (PMEL_HUMAN)
FMRNQPLTFAA

SEQ ID NO: 130916 - protein, 11 aa, Artificial Sequence
  Description of Artificial Sequence: Synthetic peptide
  Seed: RALDGGNKHFL (PMEL_HUMAN)
RLLDGGNKHFM

SEQ ID NO: 130917 - protein, 10 aa, Artificial Sequence
  Description of Artificial Sequence: Synthetic peptide
  Seed: LHLAVIGALL (PMEL_HUMAN)
LWLAVIGALL

SEQ ID NO: 130918 - protein, 9 aa, Artificial Sequence
  Description of Artificial Sequence: Synthetic peptide
  Seed: KTWGQYWQV (PMEL_HUMAN)
KFWGQYWQY

SEQ ID NO: 130919 - protein, 9 aa, Artificial Sequence
  Description of Artificial Sequence: Synthetic peptide
  Seed: SLAVVSTQL (PMEL_HUMAN)
SIAVVSTQF

SEQ ID NO: 130920 - protein, 9 aa, Artificial Sequence
  Description of Artificial Sequence: Synthetic peptide
  Seed: LSIGTGRAM (PMEL_HUMAN)
LMIGTGRAW

SEQ ID NO: 130921 - protein, 11 aa, Artificial Sequence
  Description of Artificial Sequence: Synthetic peptide
  Seed: RALDGGNKHFL (PMEL_HUMAN)
RTLDGGNKHFF

SEQ ID NO: 130922 - protein, 10 aa, Artificial Sequence
  Description of Artificial Sequence: Synthetic peptide
  Seed: SQVWGGQPVY (PMEL_HUMAN)
SHVWGGQPVY

SEQ ID NO: 130923 - protein, 9 aa, Artificial Sequence
  Description of Artificial Sequence: Synthetic peptide
  Seed: LSIGTGRAM (PMEL_HUMAN)
LEIGTGRAF

SEQ ID NO: 130924 - protein, 10 aa, Artificial Sequence
  Description of Artificial Sequence: Synthetic peptide
  Seed: MPTAESTGMT (PMEL_HUMAN)
MTTAESTGMA

SEQ ID NO: 130925 - protein, 11 aa, Artificial Sequence
  Description of Artificial Sequence: Synthetic peptide
  Seed: GYLAEADLSYT (PMEL_HUMAN)
GSLAEADLSYL

SEQ ID NO: 130926 - protein, 9 aa, Artificial Sequence
  Description of Artificial Sequence: Synthetic peptide
  Seed: VPLAHSSSA (PMEL_HUMAN)
VALAHSSSF

SEQ ID NO: 130927 - protein, 10 aa, Artificial Sequence
  Description of Artificial Sequence: Synthetic peptide
  Seed: SAEILQAVPS (PMEL_HUMAN)
SGEILQAVPA

SEQ ID NO: 130928 - protein, 9 aa, Artificial Sequence
  Description of Artificial Sequence: Synthetic peptide
  Seed: FGDSSGTLI (PMEL_HUMAN)
FTDSSGTLA

SEQ ID NO: 130929 - protein, 9 aa, Artificial Sequence
  Description of Artificial Sequence: Synthetic peptide
  Seed: AEADLSYTW (PMEL_HUMAN)
AVADLSYTF

SEQ ID NO: 130930 - protein, 9 aa, Artificial Sequence
  Description of Artificial Sequence: Synthetic peptide
  Seed: ALNFPGSQK (PMEL_HUMAN)
ATNFPGSQR

SEQ ID NO: 130931 - protein, 9 aa, Artificial Sequence
  Description of Artificial Sequence: Synthetic peptide
  Seed: ILKGGSGTY (PMEL_HUMAN)
IFKGGSGTY

SEQ ID NO: 130932 - protein, 9 aa, Artificial Sequence
  Description of Artificial Sequence: Synthetic peptide
  Seed: KTWGQYWQV (PMEL_HUMAN)
KWWGQYWQR

SEQ ID NO: 130933 - protein, 10 aa, Artificial Sequence
  Description of Artificial Sequence: Synthetic peptide
  Seed: AMLGTHTMEV (PMEL_HUMAN)
ALLGTHTMEI

SEQ ID NO: 130934 - protein, 9 aa, Artificial Sequence
  Description of Artificial Sequence: Synthetic peptide
  Seed: MLGTHTMEV (PMEL_HUMAN)
MMGTHTMEY

SEQ ID NO: 130935 - protein, 9 aa, Artificial Sequence
  Description of Artificial Sequence: Synthetic peptide
  Seed: GGPVSGLSI (PMEL_HUMAN)
GRPVSGLSL

SEQ ID NO: 130936 - protein, 9 aa, Artificial Sequence
  Description of Artificial Sequence: Synthetic peptide
  Seed: VMGTTLAEM (PMEL_HUMAN)
VAGTTLAEY

SEQ ID NO: 130937 - protein, 9 aa, Artificial Sequence
  Description of Artificial Sequence: Synthetic peptide
  Seed: VQMPTAEST (PMEL_HUMAN)
VIMPTAESM

SEQ ID NO: 130938 - protein, 9 aa, Artificial Sequence
  Description of Artificial Sequence: Synthetic peptide
  Seed: ITDQVPFSV (PMEL_HUMAN)
ITDQVPFSI

SEQ ID NO: 130939 - protein, 10 aa, Artificial Sequence
  Description of Artificial Sequence: Synthetic peptide
  Seed: YVPLAHSSSA (PMEL_HUMAN)
YIPLAHSSSV

SEQ ID NO: 130940 - protein, 9 aa, Artificial Sequence
  Description of Artificial Sequence: Synthetic peptide
  Seed: SSIMSTESI (PMEL_HUMAN)
STIMSTESV

SEQ ID NO: 130941 - protein, 9 aa, Artificial Sequence
  Description of Artificial Sequence: Synthetic peptide
  Seed: DQVPFSVSV (PMEL_HUMAN)
DAVPFSVSV

SEQ ID NO: 130942 - protein, 10 aa, Artificial Sequence
  Description of Artificial Sequence: Synthetic peptide
  Seed: KVLPDGQVIW (PMEL_HUMAN)
KQLPDGQVIY

SEQ ID NO: 130943 - protein, 9 aa, Artificial Sequence
  Description of Artificial Sequence: Synthetic peptide
  Seed: GQVPLIVGI (PMEL_HUMAN)
GMVPLIVGV

SEQ ID NO: 130944 - protein, 9 aa, Artificial Sequence
  Description of Artificial Sequence: Synthetic peptide
  Seed: VVLQAAIPL (PMEL_HUMAN)
VKLQAAIPI

SEQ ID NO: 130945 - protein, 9 aa, Artificial Sequence
  Description of Artificial Sequence: Synthetic peptide
  Seed: VISTAPVQM (PMEL_HUMAN)
VMSTAPVQY

SEQ ID NO: 130946 - protein, 9 aa, Artificial Sequence
  Description of Artificial Sequence: Synthetic peptide
  Seed: RAMLGTHTM (PMEL_HUMAN)
RHMLGTHTW

SEQ ID NO: 130947 - protein, 9 aa, Artificial Sequence
  Description of Artificial Sequence: Synthetic peptide
  Seed: WSQKRSFVY (PMEL_HUMAN)
WTQKRSFVF

SEQ ID NO: 130948 - protein, 9 aa, Artificial Sequence
  Description of Artificial Sequence: Synthetic peptide
  Seed: SQVWGGQPV (PMEL_HUMAN)
SLVWGGQPI

SEQ ID NO: 130949 - protein, 10 aa, Artificial Sequence
  Description of Artificial Sequence: Synthetic peptide
  Seed: SAEILQAVPS (PMEL_HUMAN)
STEILQAVPA

SEQ ID NO: 130950 - protein, 9 aa, Artificial Sequence
  Description of Artificial Sequence: Synthetic peptide
  Seed: YLEPGPVTA (PMEL_HUMAN)
YQEPGPVTF

SEQ ID NO: 130951 - protein, 9 aa, Artificial Sequence
  Description of Artificial Sequence: Synthetic peptide
  Seed: FTITDQVPF (PMEL_HUMAN)
FYITDQVPF

SEQ ID NO: 130952 - protein, 9 aa, Artificial Sequence
  Description of Artificial Sequence: Synthetic peptide
  Seed: AVVSTQLIM (PMEL_HUMAN)
AQVSTQLIM

SEQ ID NO: 130953 - protein, 9 aa, Artificial Sequence
  Description of Artificial Sequence: Synthetic peptide
  Seed: SVQVPTTEV (PMEL_HUMAN)
SGQVPTTEY

SEQ ID NO: 130954 - protein, 9 aa, Artificial Sequence
  Description of Artificial Sequence: Synthetic peptide
  Seed: SYVPLAHSS (PMEL_HUMAN)
SYVPLAHSM

SEQ ID NO: 130955 - protein, 10 aa, Artificial Sequence
  Description of Artificial Sequence: Synthetic peptide
  Seed: WSQKRSFVYV (PMEL_HUMAN)
WMQKRSFVYV

SEQ ID NO: 130956 - protein, 9 aa, Artificial Sequence
  Description of Artificial Sequence: Synthetic peptide
  Seed: WSQKRSFVY (PMEL_HUMAN)
WWQKRSFVM

SEQ ID NO: 130957 - protein, 10 aa, Artificial Sequence
  Description of Artificial Sequence: Synthetic peptide
  Seed: AMLGTHTMEV (PMEL_HUMAN)
ARLGTHTMEV

SEQ ID NO: 130958 - protein, 9 aa, Artificial Sequence
  Description of Artificial Sequence: Synthetic peptide
  Seed: RLVKRQVPL (PMEL_HUMAN)
RSVKRQVPY

SEQ ID NO: 130959 - protein, 10 aa, Artificial Sequence
  Description of Artificial Sequence: Synthetic peptide
  Seed: SSAFTITDQV (PMEL_HUMAN)
SMAFTITDQL

SEQ ID NO: 130960 - protein, 9 aa, Artificial Sequence
  Description of Artificial Sequence: Synthetic peptide
  Seed: VSLADTNSL (PMEL_HUMAN)
VLLADTNSF

SEQ ID NO: 130961 - protein, 9 aa, Artificial Sequence
  Description of Artificial Sequence: Synthetic peptide
  Seed: RQVPLDCVL (PMEL_HUMAN)
RLVPLDCVW

SEQ ID NO: 130962 - protein, 9 aa, Artificial Sequence
  Description of Artificial Sequence: Synthetic peptide
  Seed: IGANASFSI (PMEL_HUMAN)
ISANASFSL

SEQ ID NO: 130963 - protein, 10 aa, Artificial Sequence
  Description of Artificial Sequence: Synthetic peptide
  Seed: VLYRYGSFSV (PMEL_HUMAN)
VMYRYGSFSV

SEQ ID NO: 130964 - protein, 9 aa, Artificial Sequence
  Description of Artificial Sequence: Synthetic peptide
  Seed: FLRNQPLTF (PMEL_HUMAN)
FWRNQPLTF

SEQ ID NO: 130965 - protein, 8 aa, Artificial Sequence
  Description of Artificial Sequence: Synthetic peptide
  Seed: LADTNSLA (PMEL_HUMAN)
LSDTNSLM

SEQ ID NO: 130966 - protein, 9 aa, Artificial Sequence
  Description of Artificial Sequence: Synthetic peptide
  Seed: VSLADTNSL (PMEL_HUMAN)
VTLADTNSV

SEQ ID NO: 130967 - protein, 9 aa, Artificial Sequence
  Description of Artificial Sequence: Synthetic peptide
  Seed: SSHWLRLPR (PMEL_HUMAN)
SGHWLRLPK

SEQ ID NO: 130968 - protein, 9 aa, Artificial Sequence
  Description of Artificial Sequence: Synthetic peptide
  Seed: LSIGTGRAM (PMEL_HUMAN)
LIIGTGRAL

SEQ ID NO: 130969 - protein, 10 aa, Artificial Sequence
  Description of Artificial Sequence: Synthetic peptide
  Seed: MKQDFSVPQL (PMEL_HUMAN)
MHQDFSVPQL

SEQ ID NO: 130970 - protein, 11 aa, Artificial Sequence
  Description of Artificial Sequence: Synthetic peptide
  Seed: YVPLAHSSSAF (PMEL_HUMAN)
YDPLAHSSSAY

SEQ ID NO: 130971 - protein, 9 aa, Artificial Sequence
  Description of Artificial Sequence: Synthetic peptide
  Seed: KAWNRQLYP (PMEL_HUMAN)
KMWNRQLYV

SEQ ID NO: 130972 - protein, 11 aa, Artificial Sequence
  Description of Artificial Sequence: Synthetic peptide
  Seed: RQVPLDCVLYR (PMEL_HUMAN)
RQVPLDCVLYF

SEQ ID NO: 130973 - protein, 9 aa, Artificial Sequence
  Description of Artificial Sequence: Synthetic peptide
  Seed: TTDGHRPTA (PMEL_HUMAN)
TMDGHRPTY

SEQ ID NO: 130974 - protein, 9 aa, Artificial Sequence
  Description of Artificial Sequence: Synthetic peptide
  Seed: SITGSLGPL (PMEL_HUMAN)
SQTGSLGPY

SEQ ID NO: 130975 - protein, 10 aa, Artificial Sequence
  Description of Artificial Sequence: Synthetic peptide
  Seed: GSFSVTLDIV (PMEL_HUMAN)
GAFSVTLDIV

SEQ ID NO: 130976 - protein, 10 aa, Artificial Sequence
  Description of Artificial Sequence: Synthetic peptide
  Seed: RQLYPEWTEA (PMEL_HUMAN)
RGLYPEWTEL

SEQ ID NO: 130977 - protein, 9 aa, Artificial Sequence
  Description of Artificial Sequence: Synthetic peptide
  Seed: KTWGQYWQV (PMEL_HUMAN)
KIWGQYWQI

SEQ ID NO: 130978 - protein, 9 aa, Artificial Sequence
  Description of Artificial Sequence: Synthetic peptide
  Seed: VLPSPACQL (PMEL_HUMAN)
VQPSPACQY

SEQ ID NO: 130979 - protein, 10 aa, Artificial Sequence
  Description of Artificial Sequence: Synthetic peptide
  Seed: SSAFTITDQV (PMEL_HUMAN)
STAFTITDQV

SEQ ID NO: 130980 - protein, 9 aa, Artificial Sequence
  Description of Artificial Sequence: Synthetic peptide
  Seed: VISTAPVQM (PMEL_HUMAN)
VTSTAPVQV

SEQ ID NO: 130981 - protein, 10 aa, Artificial Sequence
  Description of Artificial Sequence: Synthetic peptide
  Seed: LVLKRCLLHL (PMEL_HUMAN)
LCLKRCLLHV

SEQ ID NO: 130982 - protein, 10 aa, Artificial Sequence
  Description of Artificial Sequence: Synthetic peptide
  Seed: YGSFSVTLDI (PMEL_HUMAN)
YFSFSVTLDY

SEQ ID NO: 130983 - protein, 9 aa, Artificial Sequence
  Description of Artificial Sequence: Synthetic peptide
  Seed: IMPGQEAGL (PMEL_HUMAN)
IAPGQEAGI

SEQ ID NO: 130984 - protein, 9 aa, Artificial Sequence
  Description of Artificial Sequence: Synthetic peptide
  Seed: WQVLGGPVS (PMEL_HUMAN)
WQVLGGPVH

SEQ ID NO: 130985 - protein, 9 aa, Artificial Sequence
  Description of Artificial Sequence: Synthetic peptide
  Seed: LLHLAVIGA (PMEL_HUMAN)
LLHLAVIGV

SEQ ID NO: 130986 - protein, 9 aa, Artificial Sequence
  Description of Artificial Sequence: Synthetic peptide
  Seed: RTKAWNRQL (PMEL_HUMAN)
RAKAWNRQK

SEQ ID NO: 130987 - protein, 10 aa, Artificial Sequence
  Description of Artificial Sequence: Synthetic peptide
  Seed: VPQLPHSSSH (PMEL_HUMAN)
VPQLPHSSSL

SEQ ID NO: 130988 - protein, 9 aa, Artificial Sequence
  Description of Artificial Sequence: Synthetic peptide
  Seed: TAQVVLQAA (PMEL_HUMAN)
TAQVVLQAF

SEQ ID NO: 130989 - protein, 9 aa, Artificial Sequence
  Description of Artificial Sequence: Synthetic peptide
  Seed: MLGTHTMEV (PMEL_HUMAN)
MSGTHTMEI

SEQ ID NO: 130990 - protein, 9 aa, Artificial Sequence
  Description of Artificial Sequence: Synthetic peptide
  Seed: AHSSSAFTI (PMEL_HUMAN)
AMSSSAFTL

SEQ ID NO: 130991 - protein, 10 aa, Artificial Sequence
  Description of Artificial Sequence: Synthetic peptide
  Seed: RGSRSYVPLA (PMEL_HUMAN)
RMSRSYVPLG

SEQ ID NO: 130992 - protein, 9 aa, Artificial Sequence
  Description of Artificial Sequence: Synthetic peptide
  Seed: MTPEKVPVS (PMEL_HUMAN)
MIPEKVPVF

SEQ ID NO: 130993 - protein, 9 aa, Artificial Sequence
  Description of Artificial Sequence: Synthetic peptide
  Seed: VLPDGQVIW (PMEL_HUMAN)
VYPDGQVII

SEQ ID NO: 130994 - protein, 8 aa, Artificial Sequence
  Description of Artificial Sequence: Synthetic peptide
  Seed: TEVVGTTP (PMEL_HUMAN)
TEVVGTTL

SEQ ID NO: 130995 - protein, 9 aa, Artificial Sequence
  Description of Artificial Sequence: Synthetic peptide
  Seed: SLAVVSTQL (PMEL_HUMAN)
SRAVVSTQY

SEQ ID NO: 130996 - protein, 8 aa, Artificial Sequence
  Description of Artificial Sequence: Synthetic peptide
  Seed: SNDGPTLI (PMEL_HUMAN)
SVDGPTLM

SEQ ID NO: 130997 - protein, 10 aa, Artificial Sequence
  Description of Artificial Sequence: Synthetic peptide
  Seed: LPSPACQLVL (PMEL_HUMAN)
LASPACQLVY

SEQ ID NO: 130998 - protein, 9 aa, Artificial Sequence
  Description of Artificial Sequence: Synthetic peptide
  Seed: YHRRGSRSY (PMEL_HUMAN)
YTRRGSRSY

SEQ ID NO: 130999 - protein, 9 aa, Artificial Sequence
  Description of Artificial Sequence: Synthetic peptide
  Seed: RQVPLDCVL (PMEL_HUMAN)
RHVPLDCVF

SEQ ID NO: 131000 - protein, 9 aa, Artificial Sequence
  Description of Artificial Sequence: Synthetic peptide
  Seed: GEGDAFELT (PMEL_HUMAN)
GEGDAFELA

SEQ ID NO: 131001 - protein, 11 aa, Artificial Sequence
  Description of Artificial Sequence: Synthetic peptide
  Seed: MTPEKVPVSEV (PMEL_HUMAN)
MIPEKVPVSEL

SEQ ID NO: 131002 - protein, 9 aa, Artificial Sequence
  Description of Artificial Sequence: Synthetic peptide
  Seed: DGGNKHFLR (PMEL_HUMAN)
DSGNKHFLR

SEQ ID NO: 131003 - protein, 10 aa, Artificial Sequence
  Description of Artificial Sequence: Synthetic peptide
  Seed: RGSRSYVPLA (PMEL_HUMAN)
RHSRSYVPLT

SEQ ID NO: 131004 - protein, 9 aa, Artificial Sequence
  Description of Artificial Sequence: Synthetic peptide
  Seed: MTPEKVPVS (PMEL_HUMAN)
MGPEKVPVM

SEQ ID NO: 131005 - protein, 9 aa, Artificial Sequence
  Description of Artificial Sequence: Synthetic peptide
  Seed: VPFSVSVSQ (PMEL_HUMAN)
VPFSVSVSY

SEQ ID NO: 131006 - protein, 10 aa, Artificial Sequence
  Description of Artificial Sequence: Synthetic peptide
  Seed: SVPQLPHSSS (PMEL_HUMAN)
SIPQLPHSSA

SEQ ID NO: 131007 - protein, 9 aa, Artificial Sequence
  Description of Artificial Sequence: Synthetic peptide
  Seed: KTWGQYWQV (PMEL_HUMAN)
KVWGQYWQI

SEQ ID NO: 131008 - protein, 9 aa, Artificial Sequence
  Description of Artificial Sequence: Synthetic peptide
  Seed: MTPAEVSIV (PMEL_HUMAN)
MLPAEVSIA

SEQ ID NO: 131009 - protein, 9 aa, Artificial Sequence
  Description of Artificial Sequence: Synthetic peptide
  Seed: RGSRSYVPL (PMEL_HUMAN)
RLSRSYVPK

SEQ ID NO: 131010 - protein, 8 aa, Artificial Sequence
  Description of Artificial Sequence: Synthetic peptide
  Seed: LHDPSGYL (PMEL_HUMAN)
LWDPSGYL

SEQ ID NO: 131011 - protein, 10 aa, Artificial Sequence
  Description of Artificial Sequence: Synthetic peptide
  Seed: KTWGQYWQVL (PMEL_HUMAN)
KIWGQYWQVW

SEQ ID NO: 131012 - protein, 9 aa, Artificial Sequence
  Description of Artificial Sequence: Synthetic peptide
  Seed: KTWGQYWQV (PMEL_HUMAN)
KAWGQYWQW

SEQ ID NO: 131013 - protein, 9 aa, Artificial Sequence
  Description of Artificial Sequence: Synthetic peptide
  Seed: TLISRALVV (PMEL_HUMAN)
TLISRALVL

SEQ ID NO: 131014 - protein, 11 aa, Artificial Sequence
  Description of Artificial Sequence: Synthetic peptide
  Seed: YLAEADLSYTW (PMEL_HUMAN)
YIAEADLSYTW

SEQ ID NO: 131015 - protein, 9 aa, Artificial Sequence
  Description of Artificial Sequence: Synthetic peptide
  Seed: QLHDPSGYL (PMEL_HUMAN)
QLHDPSGYY

SEQ ID NO: 131016 - protein, 9 aa, Artificial Sequence
  Description of Artificial Sequence: Synthetic peptide
  Seed: RLVKRQVPL (PMEL_HUMAN)
RGVKRQVPK

SEQ ID NO: 131017 - protein, 10 aa, Artificial Sequence
  Description of Artificial Sequence: Synthetic peptide
  Seed: RGSRSYVPLA (PMEL_HUMAN)
RCSRSYVPLA

SEQ ID NO: 131018 - protein, 9 aa, Artificial Sequence
  Description of Artificial Sequence: Synthetic peptide
  Seed: AHSSSAFTI (PMEL_HUMAN)
AMSSSAFTF

SEQ ID NO: 131019 - protein, 10 aa, Artificial Sequence
  Description of Artificial Sequence: Synthetic peptide
  Seed: LAHSSSAFTI (PMEL_HUMAN)
LCHSSSAFTW

SEQ ID NO: 131020 - protein, 10 aa, Artificial Sequence
  Description of Artificial Sequence: Synthetic peptide
  Seed: MTPAEVSIVV (PMEL_HUMAN)
MVPAEVSIVF

SEQ ID NO: 131021 - protein, 11 aa, Artificial Sequence
  Description of Artificial Sequence: Synthetic peptide
  Seed: HTMEVTVYHRR (PMEL_HUMAN)
HTMEVTVYHRY

SEQ ID NO: 131022 - protein, 10 aa, Artificial Sequence
  Description of Artificial Sequence: Synthetic peptide
  Seed: FLRNQPLTFA (PMEL_HUMAN)
FMRNQPLTFM

SEQ ID NO: 131023 - protein, 11 aa, Artificial Sequence
  Description of Artificial Sequence: Synthetic peptide
  Seed: TVYHRRGSRSY (PMEL_HUMAN)
TQYHRRGSRSM

SEQ ID NO: 131024 - protein, 11 aa, Artificial Sequence
  Description of Artificial Sequence: Synthetic peptide
  Seed: LGPLLDGTATL (PMEL_HUMAN)
LCPLLDGTATL

SEQ ID NO: 131025 - protein, 9 aa, Artificial Sequence
  Description of Artificial Sequence: Synthetic peptide
  Seed: AEVSIVVLS (PMEL_HUMAN)
AEVSIVVLY

SEQ ID NO: 131026 - protein, 9 aa, Artificial Sequence
  Description of Artificial Sequence: Synthetic peptide
  Seed: QLHDPSGYL (PMEL_HUMAN)
QMHDPSGYY

SEQ ID NO: 131027 - protein, 10 aa, Artificial Sequence
  Description of Artificial Sequence: Synthetic peptide
  Seed: LMAVVLASLI (PMEL_HUMAN)
LMAVVLASLT

SEQ ID NO: 131028 - protein, 10 aa, Artificial Sequence
  Description of Artificial Sequence: Synthetic peptide
  Seed: MAVVLASLIY (PMEL_HUMAN)
MPVVLASLII

SEQ ID NO: 131029 - protein, 10 aa, Artificial Sequence
  Description of Artificial Sequence: Synthetic peptide
  Seed: YVPLAHSSSA (PMEL_HUMAN)
YHPLAHSSSL

SEQ ID NO: 131030 - protein, 9 aa, Artificial Sequence
  Description of Artificial Sequence: Synthetic peptide
  Seed: YHRRGSRSY (PMEL_HUMAN)
YYRRGSRSF

SEQ ID NO: 131031 - protein, 10 aa, Artificial Sequence
  Description of Artificial Sequence: Synthetic peptide
  Seed: SCPIGENSPL (PMEL_HUMAN)
SWPIGENSPL

SEQ ID NO: 131032 - protein, 11 aa, Artificial Sequence
  Description of Artificial Sequence: Synthetic peptide
  Seed: FGDSSGTLISR (PMEL_HUMAN)
FCDSSGTLISF

SEQ ID NO: 131033 - protein, 10 aa, Artificial Sequence
  Description of Artificial Sequence: Synthetic peptide
  Seed: RSFVYVWKTW (PMEL_HUMAN)
RSFVYVWKTL

SEQ ID NO: 131034 - protein, 10 aa, Artificial Sequence
  Description of Artificial Sequence: Synthetic peptide
  Seed: WKTWGQYWQV (PMEL_HUMAN)
WFTWGQYWQV

SEQ ID NO: 131035 - protein, 11 aa, Artificial Sequence
  Description of Artificial Sequence: Synthetic peptide
  Seed: RQVPLDCVLYR (PMEL_HUMAN)
RWVPLDCVLYR

SEQ ID NO: 131036 - protein, 10 aa, Artificial Sequence
  Description of Artificial Sequence: Synthetic peptide
  Seed: YGSFSVTLDI (PMEL_HUMAN)
YTSFSVTLDW

SEQ ID NO: 131037 - protein, 10 aa, Artificial Sequence
  Description of Artificial Sequence: Synthetic peptide
  Seed: VLSGTTAAQV (PMEL_HUMAN)
VISGTTAAQV

SEQ ID NO: 131038 - protein, 9 aa, Artificial Sequence
  Description of Artificial Sequence: Synthetic peptide
  Seed: GSFSVTLDI (PMEL_HUMAN)
GSFSVTLDM

SEQ ID NO: 131039 - protein, 10 aa, Artificial Sequence
  Description of Artificial Sequence: Synthetic peptide
  Seed: SQKRSFVYVW (PMEL_HUMAN)
SQKRSFVYVF

SEQ ID NO: 131040 - protein, 9 aa, Artificial Sequence
  Description of Artificial Sequence: Synthetic peptide
  Seed: ITDQVPFSV (PMEL_HUMAN)
ISDQVPFSV

SEQ ID NO: 131041 - protein, 9 aa, Artificial Sequence
  Description of Artificial Sequence: Synthetic peptide
  Seed: LHLAVIGAL (PMEL_HUMAN)
LELAVIGAY

SEQ ID NO: 131042 - protein, 9 aa, Artificial Sequence
  Description of Artificial Sequence: Synthetic peptide
  Seed: AQRLCQPVL (PMEL_HUMAN)
AFRLCQPVK

SEQ ID NO: 131043 - protein, 9 aa, Artificial Sequence
  Description of Artificial Sequence: Synthetic peptide
  Seed: KVSNDGPTL (PMEL_HUMAN)
KTSNDGPTL

SEQ ID NO: 131044 - protein, 9 aa, Artificial Sequence
  Description of Artificial Sequence: Synthetic peptide
  Seed: VVLQAAIPL (PMEL_HUMAN)
VSLQAAIPW

SEQ ID NO: 131045 - protein, 9 aa, Artificial Sequence
  Description of Artificial Sequence: Synthetic peptide
  Seed: VSLADTNSL (PMEL_HUMAN)
VRLADTNSF

SEQ ID NO: 131046 - protein, 9 aa, Artificial Sequence
  Description of Artificial Sequence: Synthetic peptide
  Seed: QVWGGQPVY (PMEL_HUMAN)
QKWGGQPVM

SEQ ID NO: 131047 - protein, 9 aa, Artificial Sequence
  Description of Artificial Sequence: Synthetic peptide
  Seed: EVVGTTPGQ (PMEL_HUMAN)
ELVGTTPGR

SEQ ID NO: 131048 - protein, 9 aa, Artificial Sequence
  Description of Artificial Sequence: Synthetic peptide
  Seed: MAVVLASLI (PMEL_HUMAN)
MSVVLASLA

SEQ ID NO: 131049 - protein, 10 aa, Artificial Sequence
  Description of Artificial Sequence: Synthetic peptide
  Seed: KRQVPLDCVL (PMEL_HUMAN)
KQQVPLDCVM

SEQ ID NO: 131050 - protein, 10 aa, Artificial Sequence
  Description of Artificial Sequence: Synthetic peptide
  Seed: RGSRSYVPLA (PMEL_HUMAN)
RPSRSYVPLT

SEQ ID NO: 131051 - protein, 9 aa, Artificial Sequence
  Description of Artificial Sequence: Synthetic peptide
  Seed: APNTTAGQV (PMEL_HUMAN)
APNTTAGQM

SEQ ID NO: 131052 - protein, 9 aa, Artificial Sequence
  Description of Artificial Sequence: Synthetic peptide
  Seed: QKRSFVYVW (PMEL_HUMAN)
QMRSFVYVL

SEQ ID NO: 131053 - protein, 10 aa, Artificial Sequence
  Description of Artificial Sequence: Synthetic peptide
  Seed: YRYGSFSVTL (PMEL_HUMAN)
YDYGSFSVTL

SEQ ID NO: 131054 - protein, 9 aa, Artificial Sequence
  Description of Artificial Sequence: Synthetic peptide
  Seed: ASFSIALNF (PMEL_HUMAN)
AHFSIALNF

SEQ ID NO: 131055 - protein, 9 aa, Artificial Sequence
  Description of Artificial Sequence: Synthetic peptide
  Seed: YLAEADLSY (PMEL_HUMAN)
YFAEADLSV

SEQ ID NO: 131056 - protein, 9 aa, Artificial Sequence
  Description of Artificial Sequence: Synthetic peptide
  Seed: DSSGTLISR (PMEL_HUMAN)
DSSGTLISK

SEQ ID NO: 131057 - protein, 10 aa, Artificial Sequence
  Description of Artificial Sequence: Synthetic peptide
  Seed: AVIGALLAVG (PMEL_HUMAN)
AIIGALLAVA

SEQ ID NO: 131058 - protein, 11 aa, Artificial Sequence
  Description of Artificial Sequence: Synthetic peptide
  Seed: YLAEADLSYTW (PMEL_HUMAN)
YMAEADLSYTV

SEQ ID NO: 131059 - protein, 9 aa, Artificial Sequence
  Description of Artificial Sequence: Synthetic peptide
  Seed: LQAAIPLTS (PMEL_HUMAN)
LRAAIPLTY

SEQ ID NO: 131060 - protein, 9 aa, Artificial Sequence
  Description of Artificial Sequence: Synthetic peptide
  Seed: RLVKRQVPL (PMEL_HUMAN)
RLVKRQVPF

SEQ ID NO: 131061 - protein, 9 aa, Artificial Sequence
  Description of Artificial Sequence: Synthetic peptide
  Seed: VSNDGPTLI (PMEL_HUMAN)
VVNDGPTLL

SEQ ID NO: 131062 - protein, 9 aa, Artificial Sequence
  Description of Artificial Sequence: Synthetic peptide
  Seed: AEPSGTTSV (PMEL_HUMAN)
AGPSGTTSL

SEQ ID NO: 131063 - protein, 9 aa, Artificial Sequence
  Description of Artificial Sequence: Synthetic peptide
  Seed: ASFSIALNF (PMEL_HUMAN)
AIFSIALNR

SEQ ID NO: 131064 - protein, 10 aa, Artificial Sequence
  Description of Artificial Sequence: Synthetic peptide
  Seed: GDSSGTLISR (PMEL_HUMAN)
GYSSGTLISR

SEQ ID NO: 131065 - protein, 10 aa, Artificial Sequence
  Description of Artificial Sequence: Synthetic peptide
  Seed: EVSIVVLSGT (PMEL_HUMAN)
ENSIVVLSGV

SEQ ID NO: 131066 - protein, 9 aa, Artificial Sequence
  Description of Artificial Sequence: Synthetic peptide
  Seed: RLMKQDFSV (PMEL_HUMAN)
RIMKQDFSV

SEQ ID NO: 131067 - protein, 10 aa, Artificial Sequence
  Description of Artificial Sequence: Synthetic peptide
  Seed: RRLMKQDFSV (PMEL_HUMAN)
RMLMKQDFSL

SEQ ID NO: 131068 - protein, 9 aa, Artificial Sequence
  Description of Artificial Sequence: Synthetic peptide
  Seed: SQKRSFVYV (PMEL_HUMAN)
SYKRSFVYS

SEQ ID NO: 131069 - protein, 11 aa, Artificial Sequence
  Description of Artificial Sequence: Synthetic peptide
  Seed: IPLTSCGSSPV (PMEL_HUMAN)
IPLTSCGSSPL

SEQ ID NO: 131070 - protein, 9 aa, Artificial Sequence
  Description of Artificial Sequence: Synthetic peptide
  Seed: KVSNDGPTL (PMEL_HUMAN)
KLSNDGPTW

SEQ ID NO: 131071 - protein, 9 aa, Artificial Sequence
  Description of Artificial Sequence: Synthetic peptide
  Seed: MLGTHTMEV (PMEL_HUMAN)
MQGTHTMEF

SEQ ID NO: 131072 - protein, 9 aa, Artificial Sequence
  Description of Artificial Sequence: Synthetic peptide
  Seed: RLMKQDFSV (PMEL_HUMAN)
RMMKQDFSM

SEQ ID NO: 131073 - protein, 10 aa, Artificial Sequence
  Description of Artificial Sequence: Synthetic peptide
  Seed: EVSIVVLSGT (PMEL_HUMAN)
ETSIVVLSGL

SEQ ID NO: 131074 - protein, 11 aa, Artificial Sequence
  Description of Artificial Sequence: Synthetic peptide
  Seed: TLIGANASFSI (PMEL_HUMAN)
TQIGANASFSV

SEQ ID NO: 131075 - protein, 9 aa, Artificial Sequence
  Description of Artificial Sequence: Synthetic peptide
  Seed: LTVSCQGGL (PMEL_HUMAN)
LTVSCQGGV

SEQ ID NO: 131076 - protein, 9 aa, Artificial Sequence
  Description of Artificial Sequence: Synthetic peptide
  Seed: VVLQAAIPL (PMEL_HUMAN)
VMLQAAIPF

SEQ ID NO: 131077 - protein, 9 aa, Artificial Sequence
  Description of Artificial Sequence: Synthetic peptide
  Seed: RGGQVSLKV (PMEL_HUMAN)
RLGQVSLKV

SEQ ID NO: 131078 - protein, 9 aa, Artificial Sequence
  Description of Artificial Sequence: Synthetic peptide
  Seed: EKVPVSEVM (PMEL_HUMAN)
EHVPVSEVW

SEQ ID NO: 131079 - protein, 9 aa, Artificial Sequence
  Description of Artificial Sequence: Synthetic peptide
  Seed: VSLADTNSL (PMEL_HUMAN)
VVLADTNSL

SEQ ID NO: 131080 - protein, 10 aa, Artificial Sequence
  Description of Artificial Sequence: Synthetic peptide
  Seed: AEAPNTTAGQ (PMEL_HUMAN)
AEAPNTTAGC

SEQ ID NO: 131081 - protein, 9 aa, Artificial Sequence
  Description of Artificial Sequence: Synthetic peptide
  Seed: LYRYGSFSV (PMEL_HUMAN)
LSRYGSFSL

SEQ ID NO: 131082 - protein, 11 aa, Artificial Sequence
  Description of Artificial Sequence: Synthetic peptide
  Seed: FSVTLDIVQGI (PMEL_HUMAN)
FLVTLDIVQGV

SEQ ID NO: 131083 - protein, 10 aa, Artificial Sequence
  Description of Artificial Sequence: Synthetic peptide
  Seed: NSLAVVSTQL (PMEL_HUMAN)
NYLAVVSTQI

SEQ ID NO: 131084 - protein, 10 aa, Artificial Sequence
  Description of Artificial Sequence: Synthetic peptide
  Seed: MSTESITGSL (PMEL_HUMAN)
MQTESITGSL

SEQ ID NO: 131085 - protein, 9 aa, Artificial Sequence
  Description of Artificial Sequence: Synthetic peptide
  Seed: YLAEADLSY (PMEL_HUMAN)
YGAEADLSY

SEQ ID NO: 131086 - protein, 10 aa, Artificial Sequence
  Description of Artificial Sequence: Synthetic peptide
  Seed: MAVVLASLIY (PMEL_HUMAN)
MSVVLASLIR

SEQ ID NO: 131087 - protein, 10 aa, Artificial Sequence
  Description of Artificial Sequence: Synthetic peptide
  Seed: RALVVTHTYL (PMEL_HUMAN)
RSLVVTHTYW

SEQ ID NO: 131088 - protein, 9 aa, Artificial Sequence
  Description of Artificial Sequence: Synthetic peptide
  Seed: QETDDACIF (PMEL_HUMAN)
QETDDACIW

SEQ ID NO: 131089 - protein, 9 aa, Artificial Sequence
  Description of Artificial Sequence: Synthetic peptide
  Seed: VSNDGPTLI (PMEL_HUMAN)
VMNDGPTLV

SEQ ID NO: 131090 - protein, 10 aa, Artificial Sequence
  Description of Artificial Sequence: Synthetic peptide
  Seed: GDSSGTLISR (PMEL_HUMAN)
GTSSGTLISK

SEQ ID NO: 131091 - protein, 9 aa, Artificial Sequence
  Description of Artificial Sequence: Synthetic peptide
  Seed: VSLADTNSL (PMEL_HUMAN)
VVLADTNSF

SEQ ID NO: 131092 - protein, 10 aa, Artificial Sequence
  Description of Artificial Sequence: Synthetic peptide
  Seed: MSTESITGSL (PMEL_HUMAN)
MPTESITGSV

SEQ ID NO: 131093 - protein, 10 aa, Artificial Sequence
  Description of Artificial Sequence: Synthetic peptide
  Seed: RQVPLDCVLY (PMEL_HUMAN)
RSVPLDCVLY

SEQ ID NO: 131094 - protein, 9 aa, Artificial Sequence
  Description of Artificial Sequence: Synthetic peptide
  Seed: IVVLSGTTA (PMEL_HUMAN)
ISVLSGTTY

SEQ ID NO: 131095 - protein, 9 aa, Artificial Sequence
  Description of Artificial Sequence: Synthetic peptide
  Seed: RRGSRSYVP (PMEL_HUMAN)
RRGSRSYVL

SEQ ID NO: 131096 - protein, 10 aa, Artificial Sequence
  Description of Artificial Sequence: Synthetic peptide
  Seed: CLLHLAVIGA (PMEL_HUMAN)
CYLHLAVIGV

SEQ ID NO: 131097 - protein, 10 aa, Artificial Sequence
  Description of Artificial Sequence: Synthetic peptide
  Seed: MTPAEVSIVV (PMEL_HUMAN)
MGPAEVSIVF

SEQ ID NO: 131098 - protein, 9 aa, Artificial Sequence
  Description of Artificial Sequence: Synthetic peptide
  Seed: LLAVGATKV (PMEL_HUMAN)
LLAVGATKI

SEQ ID NO: 131099 - protein, 9 aa, Artificial Sequence
  Description of Artificial Sequence: Synthetic peptide
  Seed: KQDFSVPQL (PMEL_HUMAN)
KIDFSVPQV

SEQ ID NO: 131100 - protein, 8 aa, Artificial Sequence
  Description of Artificial Sequence: Synthetic peptide
  Seed: VIWVNNTI (PMEL_HUMAN)
VQWVNNTI

SEQ ID NO: 131101 - protein, 9 aa, Artificial Sequence
  Description of Artificial Sequence: Synthetic peptide
  Seed: ISRALVVTH (PMEL_HUMAN)
IARALVVTL

SEQ ID NO: 131102 - protein, 10 aa, Artificial Sequence
  Description of Artificial Sequence: Synthetic peptide
  Seed: MPTAESTGMT (PMEL_HUMAN)
MQTAESTGML

SEQ ID NO: 131103 - protein, 9 aa, Artificial Sequence
  Description of Artificial Sequence: Synthetic peptide
  Seed: LQAAIPLTS (PMEL_HUMAN)
LHAAIPLTY

SEQ ID NO: 131104 - protein, 9 aa, Artificial Sequence
  Description of Artificial Sequence: Synthetic peptide
  Seed: SQVWGGQPV (PMEL_HUMAN)
SAVWGGQPM

SEQ ID NO: 131105 - protein, 9 aa, Artificial Sequence
  Description of Artificial Sequence: Synthetic peptide
  Seed: SRALVVTHT (PMEL_HUMAN)
SRALVVTHL

SEQ ID NO: 131106 - protein, 9 aa, Artificial Sequence
  Description of Artificial Sequence: Synthetic peptide
  Seed: VVLQAAIPL (PMEL_HUMAN)
VHLQAAIPF

SEQ ID NO: 131107 - protein, 10 aa, Artificial Sequence
  Description of Artificial Sequence: Synthetic peptide
  Seed: YVPLAHSSSA (PMEL_HUMAN)
YKPLAHSSSA

SEQ ID NO: 131108 - protein, 10 aa, Artificial Sequence
  Description of Artificial Sequence: Synthetic peptide
  Seed: RQLRTKAWNR (PMEL_HUMAN)
RRLRTKAWNF

SEQ ID NO: 131109 - protein, 9 aa, Artificial Sequence
  Description of Artificial Sequence: Synthetic peptide
  Seed: GILLVLMAV (PMEL_HUMAN)
GVLLVLMAV

SEQ ID NO: 131110 - protein, 10 aa, Artificial Sequence
  Description of Artificial Sequence: Synthetic peptide
  Seed: AVPSGEGDAF (PMEL_HUMAN)
ALPSGEGDAY

SEQ ID NO: 131111 - protein, 9 aa, Artificial Sequence
  Description of Artificial Sequence: Synthetic peptide
  Seed: ILKGGSGTY (PMEL_HUMAN)
IAKGGSGTV

SEQ ID NO: 131112 - protein, 9 aa, Artificial Sequence
  Description of Artificial Sequence: Synthetic peptide
  Seed: RTKAWNRQL (PMEL_HUMAN)
RIKAWNRQY

SEQ ID NO: 131113 - protein, 9 aa, Artificial Sequence
  Description of Artificial Sequence: Synthetic peptide
  Seed: SVQVPTTEV (PMEL_HUMAN)
SPQVPTTEP

SEQ ID NO: 131114 - protein, 9 aa, Artificial Sequence
  Description of Artificial Sequence: Synthetic peptide
  Seed: YLEPGPVTA (PMEL_HUMAN)
YAEPGPVTF

SEQ ID NO: 131115 - protein, 11 aa, Artificial Sequence
  Description of Artificial Sequence: Synthetic peptide
  Seed: MAVVLASLIYR (PMEL_HUMAN)
MAVVLASLIYK

SEQ ID NO: 131116 - protein, 10 aa, Artificial Sequence
  Description of Artificial Sequence: Synthetic peptide
  Seed: RGSRSYVPLA (PMEL_HUMAN)
RCSRSYVPLT

SEQ ID NO: 131117 - protein, 9 aa, Artificial Sequence
  Description of Artificial Sequence: Synthetic peptide
  Seed: FLRNQPLTF (PMEL_HUMAN)
FARNQPLTY

SEQ ID NO: 131118 - protein, 9 aa, Artificial Sequence
  Description of Artificial Sequence: Synthetic peptide
  Seed: GQVPLIVGI (PMEL_HUMAN)
GVVPLIVGV

SEQ ID NO: 131119 - protein, 11 aa, Artificial Sequence
  Description of Artificial Sequence: Synthetic peptide
  Seed: TVYHRRGSRSY (PMEL_HUMAN)
TTYHRRGSRSW

SEQ ID NO: 131120 - protein, 11 aa, Artificial Sequence
  Description of Artificial Sequence: Synthetic peptide
  Seed: RYGSFSVTLDI (PMEL_HUMAN)
RLGSFSVTLDY

SEQ ID NO: 131121 - protein, 10 aa, Artificial Sequence
  Description of Artificial Sequence: Synthetic peptide
  Seed: AMLGTHTMEV (PMEL_HUMAN)
AFLGTHTMEV

SEQ ID NO: 131122 - protein, 10 aa, Artificial Sequence
  Description of Artificial Sequence: Synthetic peptide
  Seed: VSLADTNSLA (PMEL_HUMAN)
VCLADTNSLL

SEQ ID NO: 131123 - protein, 9 aa, Artificial Sequence
  Description of Artificial Sequence: Synthetic peptide
  Seed: AVVSTQLIM (PMEL_HUMAN)
AMVSTQLIL

SEQ ID NO: 131124 - protein, 9 aa, Artificial Sequence
  Description of Artificial Sequence: Synthetic peptide
  Seed: RTKAWNRQL (PMEL_HUMAN)
RIKAWNRQL

SEQ ID NO: 131125 - protein, 9 aa, Artificial Sequence
  Description of Artificial Sequence: Synthetic peptide
  Seed: CWRGGQVSL (PMEL_HUMAN)
CYRGGQVSY

SEQ ID NO: 131126 - protein, 9 aa, Artificial Sequence
  Description of Artificial Sequence: Synthetic peptide
  Seed: YHRRGSRSY (PMEL_HUMAN)
YLRRGSRSM

SEQ ID NO: 131127 - protein, 10 aa, Artificial Sequence
  Description of Artificial Sequence: Synthetic peptide
  Seed: ALDGGNKHFL (PMEL_HUMAN)
AMDGGNKHFW

SEQ ID NO: 131128 - protein, 9 aa, Artificial Sequence
  Description of Artificial Sequence: Synthetic peptide
  Seed: YHRRGSRSY (PMEL_HUMAN)
YMRRGSRSM

SEQ ID NO: 131129 - protein, 9 aa, Artificial Sequence
  Description of Artificial Sequence: Synthetic peptide
  Seed: ITDQVPFSV (PMEL_HUMAN)
IWDQVPFSF

SEQ ID NO: 131130 - protein, 9 aa, Artificial Sequence
  Description of Artificial Sequence: Synthetic peptide
  Seed: DAFELTVSC (PMEL_HUMAN)
DHFELTVST

SEQ ID NO: 131131 - protein, 9 aa, Artificial Sequence
  Description of Artificial Sequence: Synthetic peptide
  Seed: LLDGTATLR (PMEL_HUMAN)
LVDGTATLM

SEQ ID NO: 131132 - protein, 9 aa, Artificial Sequence
  Description of Artificial Sequence: Synthetic peptide
  Seed: MTPEKVPVS (PMEL_HUMAN)
MIPEKVPVL

SEQ ID NO: 131133 - protein, 9 aa, Artificial Sequence
  Description of Artificial Sequence: Synthetic peptide
  Seed: YLEPGPVTA (PMEL_HUMAN)
YIEPGPVTF

SEQ ID NO: 131134 - protein, 10 aa, Artificial Sequence
  Description of Artificial Sequence: Synthetic peptide
  Seed: RRLMKQDFSV (PMEL_HUMAN)
RRLMKQDFSY

SEQ ID NO: 131135 - protein, 10 aa, Artificial Sequence
  Description of Artificial Sequence: Synthetic peptide
  Seed: KTWGQYWQVL (PMEL_HUMAN)
KMWGQYWQVD

SEQ ID NO: 131136 - protein, 10 aa, Artificial Sequence
  Description of Artificial Sequence: Synthetic peptide
  Seed: QEAGLGQVPL (PMEL_HUMAN)
QEAGLGQVPA

SEQ ID NO: 131137 - protein, 8 aa, Artificial Sequence
  Description of Artificial Sequence: Synthetic peptide
  Seed: LHDPSGYL (PMEL_HUMAN)
LSDPSGYM

SEQ ID NO: 131138 - protein, 9 aa, Artificial Sequence
  Description of Artificial Sequence: Synthetic peptide
  Seed: SSPGCQPPA (PMEL_HUMAN)
SAPGCQPPY

SEQ ID NO: 131139 - protein, 10 aa, Artificial Sequence
  Description of Artificial Sequence: Synthetic peptide
  Seed: ESAEILQAVP (PMEL_HUMAN)
ESAEILQAVM

SEQ ID NO: 131140 - protein, 9 aa, Artificial Sequence
  Description of Artificial Sequence: Synthetic peptide
  Seed: LIVGILLVL (PMEL_HUMAN)
LSVGILLVY

SEQ ID NO: 131141 - protein, 10 aa, Artificial Sequence
  Description of Artificial Sequence: Synthetic peptide
  Seed: GPLLDGTATL (PMEL_HUMAN)
GYLLDGTATV

SEQ ID NO: 131142 - protein, 9 aa, Artificial Sequence
  Description of Artificial Sequence: Synthetic peptide
  Seed: SSPGCQPPA (PMEL_HUMAN)
SMPGCQPPM

SEQ ID NO: 131143 - protein, 11 aa, Artificial Sequence
  Description of Artificial Sequence: Synthetic peptide
  Seed: LYRYGSFSVTL (PMEL_HUMAN)
LPRYGSFSVTF

SEQ ID NO: 131144 - protein, 8 aa, Artificial Sequence
  Description of Artificial Sequence: Synthetic peptide
  Seed: LHDPSGYL (PMEL_HUMAN)
LSDPSGYL

SEQ ID NO: 131145 - protein, 9 aa, Artificial Sequence
  Description of Artificial Sequence: Synthetic peptide
  Seed: SLADTNSLA (PMEL_HUMAN)
SIADTNSLI

SEQ ID NO: 131146 - protein, 10 aa, Artificial Sequence
  Description of Artificial Sequence: Synthetic peptide
  Seed: GQVIWVNNTI (PMEL_HUMAN)
GMVIWVNNTV

SEQ ID NO: 131147 - protein, 11 aa, Artificial Sequence
  Description of Artificial Sequence: Synthetic peptide
  Seed: QAVPSGEGDAF (PMEL_HUMAN)
QQVPSGEGDAW

SEQ ID NO: 131148 - protein, 9 aa, Artificial Sequence
  Description of Artificial Sequence: Synthetic peptide
  Seed: SLIYRRRLM (PMEL_HUMAN)
SFIYRRRLM

SEQ ID NO: 131149 - protein, 10 aa, Artificial Sequence
  Description of Artificial Sequence: Synthetic peptide
  Seed: DWLGVSRQLR (PMEL_HUMAN)
DSLGVSRQLR

SEQ ID NO: 131150 - protein, 10 aa, Artificial Sequence
  Description of Artificial Sequence: Synthetic peptide
  Seed: MTPAEVSIVV (PMEL_HUMAN)
MPPAEVSIVH

SEQ ID NO: 131151 - protein, 9 aa, Artificial Sequence
  Description of Artificial Sequence: Synthetic peptide
  Seed: GSFSVTLDI (PMEL_HUMAN)
GTFSVTLDV

SEQ ID NO: 131152 - protein, 9 aa, Artificial Sequence
  Description of Artificial Sequence: Synthetic peptide
  Seed: LYPEWTEAQ (PMEL_HUMAN)
LWPEWTEAL

SEQ ID NO: 131153 - protein, 9 aa, Artificial Sequence
  Description of Artificial Sequence: Synthetic peptide
  Seed: QLYPEWTEA (PMEL_HUMAN)
QMYPEWTEA

SEQ ID NO: 131154 - protein, 10 aa, Artificial Sequence
  Description of Artificial Sequence: Synthetic peptide
  Seed: SQKRSFVYVW (PMEL_HUMAN)
SNKRSFVYVF

SEQ ID NO: 131155 - protein, 9 aa, Artificial Sequence
  Description of Artificial Sequence: Synthetic peptide
  Seed: RLVKRQVPL (PMEL_HUMAN)
RSVKRQVPM

SEQ ID NO: 131156 - protein, 10 aa, Artificial Sequence
  Description of Artificial Sequence: Synthetic peptide
  Seed: SQKRSFVYVW (PMEL_HUMAN)
SPKRSFVYVY

SEQ ID NO: 131157 - protein, 9 aa, Artificial Sequence
  Description of Artificial Sequence: Synthetic peptide
  Seed: KHFLRNQPL (PMEL_HUMAN)
KMFLRNQPH

SEQ ID NO: 131158 - protein, 10 aa, Artificial Sequence
  Description of Artificial Sequence: Synthetic peptide
  Seed: LAVIGALLAV (PMEL_HUMAN)
LNVIGALLAV

SEQ ID NO: 131159 - protein, 10 aa, Artificial Sequence
  Description of Artificial Sequence: Synthetic peptide
  Seed: VLSGTTAAQV (PMEL_HUMAN)
VMSGTTAAQV

SEQ ID NO: 131160 - protein, 10 aa, Artificial Sequence
  Description of Artificial Sequence: Synthetic peptide
  Seed: TPGQAPTAEP (PMEL_HUMAN)
TPGQAPTAEA

SEQ ID NO: 131161 - protein, 11 aa, Artificial Sequence
  Description of Artificial Sequence: Synthetic peptide
  Seed: ISRALVVTHTY (PMEL_HUMAN)
IDRALVVTHTW

SEQ ID NO: 131162 - protein, 9 aa, Artificial Sequence
  Description of Artificial Sequence: Synthetic peptide
  Seed: FGDSSGTLI (PMEL_HUMAN)
FPDSSGTLM

SEQ ID NO: 131163 - protein, 11 aa, Artificial Sequence
  Description of Artificial Sequence: Synthetic peptide
  Seed: TWDFGDSSGTL (PMEL_HUMAN)
TADFGDSSGTM

SEQ ID NO: 131164 - protein, 9 aa, Artificial Sequence
  Description of Artificial Sequence: Synthetic peptide
  Seed: SGLSIGTGR (PMEL_HUMAN)
SSLSIGTGK

SEQ ID NO: 131165 - protein, 10 aa, Artificial Sequence
  Description of Artificial Sequence: Synthetic peptide
  Seed: YGSFSVTLDI (PMEL_HUMAN)
YCSFSVTLDY

SEQ ID NO: 131166 - protein, 9 aa, Artificial Sequence
  Description of Artificial Sequence: Synthetic peptide
  Seed: KHFLRNQPL (PMEL_HUMAN)
KHFLRNQPA

SEQ ID NO: 131167 - protein, 10 aa, Artificial Sequence
  Description of Artificial Sequence: Synthetic peptide
  Seed: LKVSNDGPTL (PMEL_HUMAN)
LKVSNDGPTM

SEQ ID NO: 131168 - protein, 9 aa, Artificial Sequence
  Description of Artificial Sequence: Synthetic peptide
  Seed: AEPSGTTSV (PMEL_HUMAN)
ALPSGTTSV

SEQ ID NO: 131169 - protein, 9 aa, Artificial Sequence
  Description of Artificial Sequence: Synthetic peptide
  Seed: AEAPNTTAG (PMEL_HUMAN)
AEAPNTTAF

SEQ ID NO: 131170 - protein, 9 aa, Artificial Sequence
  Description of Artificial Sequence: Synthetic peptide
  Seed: LYRYGSFSV (PMEL_HUMAN)
LSRYGSFSK

SEQ ID NO: 131171 - protein, 10 aa, Artificial Sequence
  Description of Artificial Sequence: Synthetic peptide
  Seed: QEAGLGQVPL (PMEL_HUMAN)
QEAGLGQVPY

SEQ ID NO: 131172 - protein, 10 aa, Artificial Sequence
  Description of Artificial Sequence: Synthetic peptide
  Seed: YRYGSFSVTL (PMEL_HUMAN)
YMYGSFSVTF

SEQ ID NO: 131173 - protein, 9 aa, Artificial Sequence
  Description of Artificial Sequence: Synthetic peptide
  Seed: YLEPGPVTA (PMEL_HUMAN)
YSEPGPVTC

SEQ ID NO: 131174 - protein, 9 aa, Artificial Sequence
  Description of Artificial Sequence: Synthetic peptide
  Seed: VMGTTLAEM (PMEL_HUMAN)
VVGTTLAEL

SEQ ID NO: 131175 - protein, 9 aa, Artificial Sequence
  Description of Artificial Sequence: Synthetic peptide
  Seed: VSRQLRTKA (PMEL_HUMAN)
VVRQLRTKK

SEQ ID NO: 131176 - protein, 9 aa, Artificial Sequence
  Description of Artificial Sequence: Synthetic peptide
  Seed: DAFELTVSC (PMEL_HUMAN)
DGFELTVSY

SEQ ID NO: 131177 - protein, 9 aa, Artificial Sequence
  Description of Artificial Sequence: Synthetic peptide
  Seed: GTYCLNVSL (PMEL_HUMAN)
GMYCLNVSW

SEQ ID NO: 131178 - protein, 9 aa, Artificial Sequence
  Description of Artificial Sequence: Synthetic peptide
  Seed: SLGPLLDGT (PMEL_HUMAN)
SAGPLLDGV

SEQ ID NO: 131179 - protein, 9 aa, Artificial Sequence
  Description of Artificial Sequence: Synthetic peptide
  Seed: SSIMSTESI (PMEL_HUMAN)
SKIMSTESI

SEQ ID NO: 131180 - protein, 9 aa, Artificial Sequence
  Description of Artificial Sequence: Synthetic peptide
  Seed: SITGSLGPL (PMEL_HUMAN)
SITGSLGPY

SEQ ID NO: 131181 - protein, 11 aa, Artificial Sequence
  Description of Artificial Sequence: Synthetic peptide
  Seed: RQVPLDCVLYR (PMEL_HUMAN)
RVVPLDCVLYR

SEQ ID NO: 131182 - protein, 11 aa, Artificial Sequence
  Description of Artificial Sequence: Synthetic peptide
  Seed: GYLAEADLSYT (PMEL_HUMAN)
GFLAEADLSYI

SEQ ID NO: 131183 - protein, 11 aa, Artificial Sequence
  Description of Artificial Sequence: Synthetic peptide
  Seed: FSVTLDIVQGI (PMEL_HUMAN)
FHVTLDIVQGV

SEQ ID NO: 131184 - protein, 10 aa, Artificial Sequence
  Description of Artificial Sequence: Synthetic peptide
  Seed: YLAEADLSYT (PMEL_HUMAN)
YIAEADLSYY

SEQ ID NO: 131185 - protein, 10 aa, Artificial Sequence
  Description of Artificial Sequence: Synthetic peptide
  Seed: RALVVTHTYL (PMEL_HUMAN)
RYLVVTHTYV

SEQ ID NO: 131186 - protein, 9 aa, Artificial Sequence
  Description of Artificial Sequence: Synthetic peptide
  Seed: VQMPTAEST (PMEL_HUMAN)
VKMPTAESM

SEQ ID NO: 131187 - protein, 11 aa, Artificial Sequence
  Description of Artificial Sequence: Synthetic peptide
  Seed: AVVLASLIYRR (PMEL_HUMAN)
AKVLASLIYRR

SEQ ID NO: 131188 - protein, 9 aa, Artificial Sequence
  Description of Artificial Sequence: Synthetic peptide
  Seed: KHFLRNQPL (PMEL_HUMAN)
KHFLRNQPF

SEQ ID NO: 131189 - protein, 10 aa, Artificial Sequence
  Description of Artificial Sequence: Synthetic peptide
  Seed: LMAVVLASLI (PMEL_HUMAN)
LLAVVLASLM

SEQ ID NO: 131190 - protein, 10 aa, Artificial Sequence
  Description of Artificial Sequence: Synthetic peptide
  Seed: ALDGGNKHFL (PMEL_HUMAN)
AIDGGNKHFF

SEQ ID NO: 131191 - protein, 8 aa, Artificial Sequence
  Description of Artificial Sequence: Synthetic peptide
  Seed: FGDSSGTL (PMEL_HUMAN)
FIDSSGTV

SEQ ID NO: 131192 - protein, 9 aa, Artificial Sequence
  Description of Artificial Sequence: Synthetic peptide
  Seed: TAPVQMPTA (PMEL_HUMAN)
TAPVQMPTV

SEQ ID NO: 131193 - protein, 9 aa, Artificial Sequence
  Description of Artificial Sequence: Synthetic peptide
  Seed: TLISRALVV (PMEL_HUMAN)
TQISRALVL

SEQ ID NO: 131194 - protein, 9 aa, Artificial Sequence
  Description of Artificial Sequence: Synthetic peptide
  Seed: AEADLSYTW (PMEL_HUMAN)
AEADLSYTC

SEQ ID NO: 131195 - protein, 9 aa, Artificial Sequence
  Description of Artificial Sequence: Synthetic peptide
  Seed: MTPEKVPVS (PMEL_HUMAN)
MAPEKVPVI

SEQ ID NO: 131196 - protein, 10 aa, Artificial Sequence
  Description of Artificial Sequence: Synthetic peptide
  Seed: LIGANASFSI (PMEL_HUMAN)
LLGANASFSA

SEQ ID NO: 131197 - protein, 10 aa, Artificial Sequence
  Description of Artificial Sequence: Synthetic peptide
  Seed: RQLYPEWTEA (PMEL_HUMAN)
RLLYPEWTEV

SEQ ID NO: 131198 - protein, 10 aa, Artificial Sequence
  Description of Artificial Sequence: Synthetic peptide
  Seed: YGSFSVTLDI (PMEL_HUMAN)
YTSFSVTLDY

SEQ ID NO: 131199 - protein, 9 aa, Artificial Sequence
  Description of Artificial Sequence: Synthetic peptide
  Seed: RALVVTHTY (PMEL_HUMAN)
RRLVVTHTI

SEQ ID NO: 131200 - protein, 9 aa, Artificial Sequence
  Description of Artificial Sequence: Synthetic peptide
  Seed: VLGGPVSGL (PMEL_HUMAN)
VMGGPVSGA

SEQ ID NO: 131201 - protein, 9 aa, Artificial Sequence
  Description of Artificial Sequence: Synthetic peptide
  Seed: TWGQYWQVL (PMEL_HUMAN)
TYGQYWQVM

SEQ ID NO: 131202 - protein, 9 aa, Artificial Sequence
  Description of Artificial Sequence: Synthetic peptide
  Seed: AEPSGTTSV (PMEL_HUMAN)
AFPSGTTSF

SEQ ID NO: 131203 - protein, 8 aa, Artificial Sequence
  Description of Artificial Sequence: Synthetic peptide
  Seed: FGDSSGTL (PMEL_HUMAN)
FSDSSGTI

SEQ ID NO: 131204 - protein, 9 aa, Artificial Sequence
  Description of Artificial Sequence: Synthetic peptide
  Seed: GLGQVPLIV (PMEL_HUMAN)
GQGQVPLIF

SEQ ID NO: 131205 - protein, 11 aa, Artificial Sequence
  Description of Artificial Sequence: Synthetic peptide
  Seed: RSYVPLAHSSS (PMEL_HUMAN)
RAYVPLAHSSK

SEQ ID NO: 131206 - protein, 10 aa, Artificial Sequence
  Description of Artificial Sequence: Synthetic peptide
  Seed: ALDGGNKHFL (PMEL_HUMAN)
AYDGGNKHFL

SEQ ID NO: 131207 - protein, 9 aa, Artificial Sequence
  Description of Artificial Sequence: Synthetic peptide
  Seed: RYGSFSVTL (PMEL_HUMAN)
RVGSFSVTV

SEQ ID NO: 131208 - protein, 9 aa, Artificial Sequence
  Description of Artificial Sequence: Synthetic peptide
  Seed: ILKGGSGTY (PMEL_HUMAN)
IYKGGSGTI

SEQ ID NO: 131209 - protein, 10 aa, Artificial Sequence
  Description of Artificial Sequence: Synthetic peptide
  Seed: KEACMEISSP (PMEL_HUMAN)
KEACMEISSL

SEQ ID NO: 131210 - protein, 9 aa, Artificial Sequence
  Description of Artificial Sequence: Synthetic peptide
  Seed: LLDGTATLR (PMEL_HUMAN)
LTDGTATLL

SEQ ID NO: 131211 - protein, 9 aa, Artificial Sequence
  Description of Artificial Sequence: Synthetic peptide
  Seed: IMPGQEAGL (PMEL_HUMAN)
ILPGQEAGV

SEQ ID NO: 131212 - protein, 9 aa, Artificial Sequence
  Description of Artificial Sequence: Synthetic peptide
  Seed: ESAEILQAV (PMEL_HUMAN)
ETAEILQAT

SEQ ID NO: 131213 - protein, 9 aa, Artificial Sequence
  Description of Artificial Sequence: Synthetic peptide
  Seed: RQVPLDCVL (PMEL_HUMAN)
RRVPLDCVI

SEQ ID NO: 131214 - protein, 9 aa, Artificial Sequence
  Description of Artificial Sequence: Synthetic peptide
  Seed: RTKAWNRQL (PMEL_HUMAN)
RLKAWNRQA

SEQ ID NO: 131215 - protein, 9 aa, Artificial Sequence
  Description of Artificial Sequence: Synthetic peptide
  Seed: YPQETDDAC (PMEL_HUMAN)
YMQETDDAM

SEQ ID NO: 131216 - protein, 9 aa, Artificial Sequence
  Description of Artificial Sequence: Synthetic peptide
  Seed: VISTAPVQM (PMEL_HUMAN)
VISTAPVQY

SEQ ID NO: 131217 - protein, 9 aa, Artificial Sequence
  Description of Artificial Sequence: Synthetic peptide
  Seed: RAMLGTHTM (PMEL_HUMAN)
RSMLGTHTK

SEQ ID NO: 131218 - protein, 9 aa, Artificial Sequence
  Description of Artificial Sequence: Synthetic peptide
  Seed: LLAVGATKV (PMEL_HUMAN)
LQAVGATKF

SEQ ID NO: 131219 - protein, 9 aa, Artificial Sequence
  Description of Artificial Sequence: Synthetic peptide
  Seed: MTPEKVPVS (PMEL_HUMAN)
MAPEKVPVL

SEQ ID NO: 131220 - protein, 10 aa, Artificial Sequence
  Description of Artificial Sequence: Synthetic peptide
  Seed: RRLMKQDFSV (PMEL_HUMAN)
RRLMKQDFSI

SEQ ID NO: 131221 - protein, 9 aa, Artificial Sequence
  Description of Artificial Sequence: Synthetic peptide
  Seed: TAPVQMPTA (PMEL_HUMAN)
TMPVQMPTL

SEQ ID NO: 131222 - protein, 9 aa, Artificial Sequence
  Description of Artificial Sequence: Synthetic peptide
  Seed: AQVVLQAAI (PMEL_HUMAN)
AEVVLQAAV

SEQ ID NO: 131223 - protein, 9 aa, Artificial Sequence
  Description of Artificial Sequence: Synthetic peptide
  Seed: VLPDGQVIW (PMEL_HUMAN)
VTPDGQVIV

SEQ ID NO: 131224 - protein, 9 aa, Artificial Sequence
  Description of Artificial Sequence: Synthetic peptide
  Seed: LMAVVLASL (PMEL_HUMAN)
LAAVVLASF

SEQ ID NO: 131225 - protein, 9 aa, Artificial Sequence
  Description of Artificial Sequence: Synthetic peptide
  Seed: QLHDPSGYL (PMEL_HUMAN)
QMHDPSGYV

SEQ ID NO: 131226 - protein, 10 aa, Artificial Sequence
  Description of Artificial Sequence: Synthetic peptide
  Seed: LADTNSLAVV (PMEL_HUMAN)
LTDTNSLAVL

SEQ ID NO: 131227 - protein, 11 aa, Artificial Sequence
  Description of Artificial Sequence: Synthetic peptide
  Seed: SYVPLAHSSSA (PMEL_HUMAN)
SPVPLAHSSSL

SEQ ID NO: 131228 - protein, 10 aa, Artificial Sequence
  Description of Artificial Sequence: Synthetic peptide
  Seed: MKQDFSVPQL (PMEL_HUMAN)
MRQDFSVPQL

SEQ ID NO: 131229 - protein, 9 aa, Artificial Sequence
  Description of Artificial Sequence: Synthetic peptide
  Seed: ALNFPGSQK (PMEL_HUMAN)
ATNFPGSQM

SEQ ID NO: 131230 - protein, 9 aa, Artificial Sequence
  Description of Artificial Sequence: Synthetic peptide
  Seed: VLPSPACQL (PMEL_HUMAN)
VAPSPACQF

SEQ ID NO: 131231 - protein, 11 aa, Artificial Sequence
  Description of Artificial Sequence: Synthetic peptide
  Seed: RAMLGTHTMEV (PMEL_HUMAN)
RFMLGTHTMEI

SEQ ID NO: 131232 - protein, 9 aa, Artificial Sequence
  Description of Artificial Sequence: Synthetic peptide
  Seed: AEPSGTTSV (PMEL_HUMAN)
ARPSGTTSL

SEQ ID NO: 131233 - protein, 10 aa, Artificial Sequence
  Description of Artificial Sequence: Synthetic peptide
  Seed: VPLAHSSSAF (PMEL_HUMAN)
VWLAHSSSAY

SEQ ID NO: 131234 - protein, 11 aa, Artificial Sequence
  Description of Artificial Sequence: Synthetic peptide
  Seed: LMAVVLASLIY (PMEL_HUMAN)
LQAVVLASLIF

SEQ ID NO: 131235 - protein, 10 aa, Artificial Sequence
  Description of Artificial Sequence: Synthetic peptide
  Seed: RQLRTKAWNR (PMEL_HUMAN)
RPLRTKAWNR

SEQ ID NO: 131236 - protein, 10 aa, Artificial Sequence
  Description of Artificial Sequence: Synthetic peptide
  Seed: MTPAEVSIVV (PMEL_HUMAN)
MVPAEVSIVH

SEQ ID NO: 131237 - protein, 9 aa, Artificial Sequence
  Description of Artificial Sequence: Synthetic peptide
  Seed: SQKRSFVYV (PMEL_HUMAN)
SVKRSFVYR

SEQ ID NO: 131238 - protein, 9 aa, Artificial Sequence
  Description of Artificial Sequence: Synthetic peptide
  Seed: LAVVSTQLI (PMEL_HUMAN)
LPVVSTQLI

SEQ ID NO: 131239 - protein, 11 aa, Artificial Sequence
  Description of Artificial Sequence: Synthetic peptide
  Seed: MAVVLASLIYR (PMEL_HUMAN)
MNVVLASLIYK

SEQ ID NO: 131240 - protein, 9 aa, Artificial Sequence
  Description of Artificial Sequence: Synthetic peptide
  Seed: GSRSYVPLA (PMEL_HUMAN)
GVRSYVPLL

SEQ ID NO: 131241 - protein, 9 aa, Artificial Sequence
  Description of Artificial Sequence: Synthetic peptide
  Seed: AVVSTQLIM (PMEL_HUMAN)
AQVSTQLIW

SEQ ID NO: 131242 - protein, 9 aa, Artificial Sequence
  Description of Artificial Sequence: Synthetic peptide
  Seed: LADTNSLAV (PMEL_HUMAN)
LADTNSLAY

SEQ ID NO: 131243 - protein, 10 aa, Artificial Sequence
  Description of Artificial Sequence: Synthetic peptide
  Seed: GSQVWGGQPV (PMEL_HUMAN)
GLQVWGGQPV

SEQ ID NO: 131244 - protein, 10 aa, Artificial Sequence
  Description of Artificial Sequence: Synthetic peptide
  Seed: MPTAESTGMT (PMEL_HUMAN)
MSTAESTGMV

SEQ ID NO: 131245 - protein, 9 aa, Artificial Sequence
  Description of Artificial Sequence: Synthetic peptide
  Seed: ALNFPGSQK (PMEL_HUMAN)
AVNFPGSQK

SEQ ID NO: 131246 - protein, 10 aa, Artificial Sequence
  Description of Artificial Sequence: Synthetic peptide
  Seed: YRYGSFSVTL (PMEL_HUMAN)
YHYGSFSVTM

SEQ ID NO: 131247 - protein, 10 aa, Artificial Sequence
  Description of Artificial Sequence: Synthetic peptide
  Seed: LMAVVLASLI (PMEL_HUMAN)
LLAVVLASLH

SEQ ID NO: 131248 - protein, 10 aa, Artificial Sequence
  Description of Artificial Sequence: Synthetic peptide
  Seed: ESITGSLGPL (PMEL_HUMAN)
EIITGSLGPY

SEQ ID NO: 131249 - protein, 9 aa, Artificial Sequence
  Description of Artificial Sequence: Synthetic peptide
  Seed: AGLGQVPLI (PMEL_HUMAN)
AVLGQVPLI

SEQ ID NO: 131250 - protein, 9 aa, Artificial Sequence
  Description of Artificial Sequence: Synthetic peptide
  Seed: ILKGGSGTY (PMEL_HUMAN)
IPKGGSGTY

SEQ ID NO: 131251 - protein, 9 aa, Artificial Sequence
  Description of Artificial Sequence: Synthetic peptide
  Seed: QPVLPSPAC (PMEL_HUMAN)
QPVLPSPAT

SEQ ID NO: 131252 - protein, 9 aa, Artificial Sequence
  Description of Artificial Sequence: Synthetic peptide
  Seed: HLAVIGALL (PMEL_HUMAN)
HTAVIGALF

SEQ ID NO: 131253 - protein, 9 aa, Artificial Sequence
  Description of Artificial Sequence: Synthetic peptide
  Seed: RAMLGTHTM (PMEL_HUMAN)
RQMLGTHTV

SEQ ID NO: 131254 - protein, 9 aa, Artificial Sequence
  Description of Artificial Sequence: Synthetic peptide
  Seed: GSRSYVPLA (PMEL_HUMAN)
GYRSYVPLK

SEQ ID NO: 131255 - protein, 10 aa, Artificial Sequence
  Description of Artificial Sequence: Synthetic peptide
  Seed: YLAEADLSYT (PMEL_HUMAN)
YMAEADLSYK

SEQ ID NO: 131256 - protein, 10 aa, Artificial Sequence
  Description of Artificial Sequence: Synthetic peptide
  Seed: QVLGGPVSGL (PMEL_HUMAN)
QVLGGPVSGF

SEQ ID NO: 131257 - protein, 10 aa, Artificial Sequence
  Description of Artificial Sequence: Synthetic peptide
  Seed: AESTGMTPEK (PMEL_HUMAN)
AVSTGMTPEK

SEQ ID NO: 131258 - protein, 10 aa, Artificial Sequence
  Description of Artificial Sequence: Synthetic peptide
  Seed: RNQDWLGVSR (PMEL_HUMAN)
RYQDWLGVSK

SEQ ID NO: 131259 - protein, 10 aa, Artificial Sequence
  Description of Artificial Sequence: Synthetic peptide
  Seed: NASFSIALNF (PMEL_HUMAN)
NQSFSIALNY

SEQ ID NO: 131260 - protein, 11 aa, Artificial Sequence
  Description of Artificial Sequence: Synthetic peptide
  Seed: TYLEPGPVTAQ (PMEL_HUMAN)
TFLEPGPVTAY

SEQ ID NO: 131261 - protein, 9 aa, Artificial Sequence
  Description of Artificial Sequence: Synthetic peptide
  Seed: YLEPGPVTA (PMEL_HUMAN)
YMEPGPVTI

SEQ ID NO: 131262 - protein, 11 aa, Artificial Sequence
  Description of Artificial Sequence: Synthetic peptide
  Seed: SSPGCQPPAQR (PMEL_HUMAN)
STPGCQPPAQR

SEQ ID NO: 131263 - protein, 9 aa, Artificial Sequence
  Description of Artificial Sequence: Synthetic peptide
  Seed: LNFPGSQKV (PMEL_HUMAN)
LIFPGSQKF

SEQ ID NO: 131264 - protein, 9 aa, Artificial Sequence
  Description of Artificial Sequence: Synthetic peptide
  Seed: ALLAVGATK (PMEL_HUMAN)
AMLAVGATR

SEQ ID NO: 131265 - protein, 9 aa, Artificial Sequence
  Description of Artificial Sequence: Synthetic peptide
  Seed: KQDFSVPQL (PMEL_HUMAN)
KIDFSVPQL

SEQ ID NO: 131266 - protein, 9 aa, Artificial Sequence
  Description of Artificial Sequence: Synthetic peptide
  Seed: VPQLPHSSS (PMEL_HUMAN)
VPQLPHSSP

SEQ ID NO: 131267 - protein, 10 aa, Artificial Sequence
  Description of Artificial Sequence: Synthetic peptide
  Seed: ALDGGNKHFL (PMEL_HUMAN)
ALDGGNKHFI

SEQ ID NO: 131268 - protein, 10 aa, Artificial Sequence
  Description of Artificial Sequence: Synthetic peptide
  Seed: IALNFPGSQK (PMEL_HUMAN)
IVLNFPGSQR

SEQ ID NO: 131269 - protein, 10 aa, Artificial Sequence
  Description of Artificial Sequence: Synthetic peptide
  Seed: AVVLASLIYR (PMEL_HUMAN)
AKVLASLIYK

SEQ ID NO: 131270 - protein, 9 aa, Artificial Sequence
  Description of Artificial Sequence: Synthetic peptide
  Seed: SVPQLPHSS (PMEL_HUMAN)
SGPQLPHSL

SEQ ID NO: 131271 - protein, 9 aa, Artificial Sequence
  Description of Artificial Sequence: Synthetic peptide
  Seed: MTPEKVPVS (PMEL_HUMAN)
MIPEKVPVV

SEQ ID NO: 131272 - protein, 9 aa, Artificial Sequence
  Description of Artificial Sequence: Synthetic peptide
  Seed: KVLPDGQVI (PMEL_HUMAN)
KTLPDGQVV

SEQ ID NO: 131273 - protein, 10 aa, Artificial Sequence
  Description of Artificial Sequence: Synthetic peptide
  Seed: EVMGTTLAEM (PMEL_HUMAN)
EPMGTTLAEF

SEQ ID NO: 131274 - protein, 10 aa, Artificial Sequence
  Description of Artificial Sequence: Synthetic peptide
  Seed: RSFVYVWKTW (PMEL_HUMAN)
RCFVYVWKTF

SEQ ID NO: 131275 - protein, 9 aa, Artificial Sequence
  Description of Artificial Sequence: Synthetic peptide
  Seed: AEPSGTTSV (PMEL_HUMAN)
ACPSGTTSL

SEQ ID NO: 131276 - protein, 9 aa, Artificial Sequence
  Description of Artificial Sequence: Synthetic peptide
  Seed: AGQVPTTEV (PMEL_HUMAN)
AVQVPTTEL

SEQ ID NO: 131277 - protein, 10 aa, Artificial Sequence
  Description of Artificial Sequence: Synthetic peptide
  Seed: QVLGGPVSGL (PMEL_HUMAN)
QTLGGPVSGI

SEQ ID NO: 131278 - protein, 10 aa, Artificial Sequence
  Description of Artificial Sequence: Synthetic peptide
  Seed: VPLDCVLYRY (PMEL_HUMAN)
VILDCVLYRY

SEQ ID NO: 131279 - protein, 9 aa, Artificial Sequence
  Description of Artificial Sequence: Synthetic peptide
  Seed: AEADLSYTW (PMEL_HUMAN)
ASADLSYTY

SEQ ID NO: 131280 - protein, 10 aa, Artificial Sequence
  Description of Artificial Sequence: Synthetic peptide
  Seed: LHLAVIGALL (PMEL_HUMAN)
LNLAVIGALV

SEQ ID NO: 131281 - protein, 10 aa, Artificial Sequence
  Description of Artificial Sequence: Synthetic peptide
  Seed: VLMAVVLASL (PMEL_HUMAN)
VQMAVVLASY

SEQ ID NO: 131282 - protein, 9 aa, Artificial Sequence
  Description of Artificial Sequence: Synthetic peptide
  Seed: QLHDPSGYL (PMEL_HUMAN)
QSHDPSGYY

SEQ ID NO: 131283 - protein, 9 aa, Artificial Sequence
  Description of Artificial Sequence: Synthetic peptide
  Seed: KAWNRQLYP (PMEL_HUMAN)
KTWNRQLYS

SEQ ID NO: 131284 - protein, 9 aa, Artificial Sequence
  Description of Artificial Sequence: Synthetic peptide
  Seed: RNQPLTFAL (PMEL_HUMAN)
RFQPLTFAY

SEQ ID NO: 131285 - protein, 9 aa, Artificial Sequence
  Description of Artificial Sequence: Synthetic peptide
  Seed: SQKRSFVYV (PMEL_HUMAN)
SIKRSFVYA

SEQ ID NO: 131286 - protein, 9 aa, Artificial Sequence
  Description of Artificial Sequence: Synthetic peptide
  Seed: SAFTITDQV (PMEL_HUMAN)
SQFTITDQF

SEQ ID NO: 131287 - protein, 10 aa, Artificial Sequence
  Description of Artificial Sequence: Synthetic peptide
  Seed: QVPLDCVLYR (PMEL_HUMAN)
QSPLDCVLYK

SEQ ID NO: 131288 - protein, 9 aa, Artificial Sequence
  Description of Artificial Sequence: Synthetic peptide
  Seed: FPDGGPCPS (PMEL_HUMAN)
FVDGGPCPY

SEQ ID NO: 131289 - protein, 9 aa, Artificial Sequence
  Description of Artificial Sequence: Synthetic peptide
  Seed: RAMLGTHTM (PMEL_HUMAN)
RTMLGTHTM

SEQ ID NO: 131290 - protein, 10 aa, Artificial Sequence
  Description of Artificial Sequence: Synthetic peptide
  Seed: YLAEADLSYT (PMEL_HUMAN)
YFAEADLSYV

SEQ ID NO: 131291 - protein, 9 aa, Artificial Sequence
  Description of Artificial Sequence: Synthetic peptide
  Seed: YLEPGPVTA (PMEL_HUMAN)
YAEPGPVTL

SEQ ID NO: 131292 - protein, 9 aa, Artificial Sequence
  Description of Artificial Sequence: Synthetic peptide
  Seed: YLEPGPVTA (PMEL_HUMAN)
YSEPGPVTI

SEQ ID NO: 131293 - protein, 9 aa, Artificial Sequence
  Description of Artificial Sequence: Synthetic peptide
  Seed: WSQKRSFVY (PMEL_HUMAN)
WQQKRSFVY

SEQ ID NO: 131294 - protein, 10 aa, Artificial Sequence
  Description of Artificial Sequence: Synthetic peptide
  Seed: RQLYPEWTEA (PMEL_HUMAN)
RELYPEWTEY

SEQ ID NO: 131295 - protein, 11 aa, Artificial Sequence
  Description of Artificial Sequence: Synthetic peptide
  Seed: HTMEVTVYHRR (PMEL_HUMAN)
HTMEVTVYHRL

SEQ ID NO: 131296 - protein, 10 aa, Artificial Sequence
  Description of Artificial Sequence: Synthetic peptide
  Seed: EVMGTTLAEM (PMEL_HUMAN)
EAMGTTLAER

SEQ ID NO: 131297 - protein, 11 aa, Artificial Sequence
  Description of Artificial Sequence: Synthetic peptide
  Seed: LVLMAVVLASL (PMEL_HUMAN)
LFLMAVVLASV

SEQ ID NO: 131298 - protein, 9 aa, Artificial Sequence
  Description of Artificial Sequence: Synthetic peptide
  Seed: RLVKRQVPL (PMEL_HUMAN)
RMVKRQVPK

SEQ ID NO: 131299 - protein, 8 aa, Artificial Sequence
  Description of Artificial Sequence: Synthetic peptide
  Seed: SNDGPTLI (PMEL_HUMAN)
STDGPTLV

SEQ ID NO: 131300 - protein, 10 aa, Artificial Sequence
  Description of Artificial Sequence: Synthetic peptide
  Seed: IALNFPGSQK (PMEL_HUMAN)
IWLNFPGSQK

SEQ ID NO: 131301 - protein, 9 aa, Artificial Sequence
  Description of Artificial Sequence: Synthetic peptide
  Seed: APVQMPTAE (PMEL_HUMAN)
APVQMPTAM

SEQ ID NO: 131302 - protein, 10 aa, Artificial Sequence
  Description of Artificial Sequence: Synthetic peptide
  Seed: RRLMKQDFSV (PMEL_HUMAN)
RKLMKQDFSI

SEQ ID NO: 131303 - protein, 10 aa, Artificial Sequence
  Description of Artificial Sequence: Synthetic peptide
  Seed: MPTAESTGMT (PMEL_HUMAN)
MYTAESTGMI

SEQ ID NO: 131304 - protein, 9 aa, Artificial Sequence
  Description of Artificial Sequence: Synthetic peptide
  Seed: ANASFSIAL (PMEL_HUMAN)
AVASFSIAF

SEQ ID NO: 131305 - protein, 9 aa, Artificial Sequence
  Description of Artificial Sequence: Synthetic peptide
  Seed: YLAEADLSY (PMEL_HUMAN)
YFAEADLSY

SEQ ID NO: 131306 - protein, 9 aa, Artificial Sequence
  Description of Artificial Sequence: Synthetic peptide
  Seed: YLAEADLSY (PMEL_HUMAN)
YAAEADLSW

SEQ ID NO: 131307 - protein, 10 aa, Artificial Sequence
  Description of Artificial Sequence: Synthetic peptide
  Seed: KVLPDGQVIW (PMEL_HUMAN)
KALPDGQVIF

SEQ ID NO: 131308 - protein, 10 aa, Artificial Sequence
  Description of Artificial Sequence: Synthetic peptide
  Seed: MTPAEVSIVV (PMEL_HUMAN)
MEPAEVSIVF

SEQ ID NO: 131309 - protein, 10 aa, Artificial Sequence
  Description of Artificial Sequence: Synthetic peptide
  Seed: RALDGGNKHF (PMEL_HUMAN)
RMLDGGNKHY

SEQ ID NO: 131310 - protein, 9 aa, Artificial Sequence
  Description of Artificial Sequence: Synthetic peptide
  Seed: SITGSLGPL (PMEL_HUMAN)
STTGSLGPI

SEQ ID NO: 131311 - protein, 9 aa, Artificial Sequence
  Description of Artificial Sequence: Synthetic peptide
  Seed: TAEAPNTTA (PMEL_HUMAN)
TAEAPNTTF

SEQ ID NO: 131312 - protein, 9 aa, Artificial Sequence
  Description of Artificial Sequence: Synthetic peptide
  Seed: VSVSQLRAL (PMEL_HUMAN)
VSVSQLRAI

SEQ ID NO: 131313 - protein, 10 aa, Artificial Sequence
  Description of Artificial Sequence: Synthetic peptide
  Seed: LVLMAVVLAS (PMEL_HUMAN)
LVLMAVVLAM

SEQ ID NO: 131314 - protein, 10 aa, Artificial Sequence
  Description of Artificial Sequence: Synthetic peptide
  Seed: LHLAVIGALL (PMEL_HUMAN)
LELAVIGALV

SEQ ID NO: 131315 - protein, 9 aa, Artificial Sequence
  Description of Artificial Sequence: Synthetic peptide
  Seed: DIVQGIESA (PMEL_HUMAN)
DVVQGIESV

SEQ ID NO: 131316 - protein, 9 aa, Artificial Sequence
  Description of Artificial Sequence: Synthetic peptide
  Seed: VSNDGPTLI (PMEL_HUMAN)
VMNDGPTLW

SEQ ID NO: 131317 - protein, 9 aa, Artificial Sequence
  Description of Artificial Sequence: Synthetic peptide
  Seed: HLAVIGALL (PMEL_HUMAN)
HVAVIGALV

SEQ ID NO: 131318 - protein, 9 aa, Artificial Sequence
  Description of Artificial Sequence: Synthetic peptide
  Seed: QLYPEWTEA (PMEL_HUMAN)
QLYPEWTEV

SEQ ID NO: 131319 - protein, 10 aa, Artificial Sequence
  Description of Artificial Sequence: Synthetic peptide
  Seed: SVPQLPHSSS (PMEL_HUMAN)
STPQLPHSSF

SEQ ID NO: 131320 - protein, 10 aa, Artificial Sequence
  Description of Artificial Sequence: Synthetic peptide
  Seed: SAEILQAVPS (PMEL_HUMAN)
SREILQAVPA

SEQ ID NO: 131321 - protein, 10 aa, Artificial Sequence
  Description of Artificial Sequence: Synthetic peptide
  Seed: ALDGGNKHFL (PMEL_HUMAN)
AYDGGNKHFY

SEQ ID NO: 131322 - protein, 9 aa, Artificial Sequence
  Description of Artificial Sequence: Synthetic peptide
  Seed: SEVMGTTLA (PMEL_HUMAN)
SEVMGTTLW

SEQ ID NO: 131323 - protein, 9 aa, Artificial Sequence
  Description of Artificial Sequence: Synthetic peptide
  Seed: GENSPLLSG (PMEL_HUMAN)
GENSPLLSM

SEQ ID NO: 131324 - protein, 9 aa, Artificial Sequence
  Description of Artificial Sequence: Synthetic peptide
  Seed: KQDFSVPQL (PMEL_HUMAN)
KMDFSVPQI

SEQ ID NO: 131325 - protein, 10 aa, Artificial Sequence
  Description of Artificial Sequence: Synthetic peptide
  Seed: SSAFTITDQV (PMEL_HUMAN)
SLAFTITDQV

SEQ ID NO: 131326 - protein, 10 aa, Artificial Sequence
  Description of Artificial Sequence: Synthetic peptide
  Seed: VPQLPHSSSH (PMEL_HUMAN)
VDQLPHSSSL

SEQ ID NO: 131327 - protein, 10 aa, Artificial Sequence
  Description of Artificial Sequence: Synthetic peptide
  Seed: ESAEILQAVP (PMEL_HUMAN)
ESAEILQAVL

SEQ ID NO: 131328 - protein, 9 aa, Artificial Sequence
  Description of Artificial Sequence: Synthetic peptide
  Seed: LADTNSLAV (PMEL_HUMAN)
LTDTNSLAY

SEQ ID NO: 131329 - protein, 9 aa, Artificial Sequence
  Description of Artificial Sequence: Synthetic peptide
  Seed: SITGSLGPL (PMEL_HUMAN)
SMTGSLGPV

SEQ ID NO: 131330 - protein, 10 aa, Artificial Sequence
  Description of Artificial Sequence: Synthetic peptide
  Seed: LGGPVSGLSI (PMEL_HUMAN)
LAGPVSGLSL

SEQ ID NO: 131331 - protein, 9 aa, Artificial Sequence
  Description of Artificial Sequence: Synthetic peptide
  Seed: VIWVNNTII (PMEL_HUMAN)
VQWVNNTIV

SEQ ID NO: 131332 - protein, 10 aa, Artificial Sequence
  Description of Artificial Sequence: Synthetic peptide
  Seed: MTPAEVSIVV (PMEL_HUMAN)
MVPAEVSIVW

SEQ ID NO: 131333 - protein, 9 aa, Artificial Sequence
  Description of Artificial Sequence: Synthetic peptide
  Seed: ESAEILQAV (PMEL_HUMAN)
EAAEILQAV

SEQ ID NO: 131334 - protein, 10 aa, Artificial Sequence
  Description of Artificial Sequence: Synthetic peptide
  Seed: VPQLPHSSSH (PMEL_HUMAN)
VIQLPHSSSF

SEQ ID NO: 131335 - protein, 9 aa, Artificial Sequence
  Description of Artificial Sequence: Synthetic peptide
  Seed: ESAEILQAV (PMEL_HUMAN)
ESAEILQAA

SEQ ID NO: 131336 - protein, 10 aa, Artificial Sequence
  Description of Artificial Sequence: Synthetic peptide
  Seed: VPLAHSSSAF (PMEL_HUMAN)
VKLAHSSSAF

SEQ ID NO: 131337 - protein, 9 aa, Artificial Sequence
  Description of Artificial Sequence: Synthetic peptide
  Seed: WSQKRSFVY (PMEL_HUMAN)
WYQKRSFVL

SEQ ID NO: 131338 - protein, 10 aa, Artificial Sequence
  Description of Artificial Sequence: Synthetic peptide
  Seed: RGSRSYVPLA (PMEL_HUMAN)
RYSRSYVPLI

SEQ ID NO: 131339 - protein, 9 aa, Artificial Sequence
  Description of Artificial Sequence: Synthetic peptide
  Seed: WQVLGGPVS (PMEL_HUMAN)
WNVLGGPVY

SEQ ID NO: 131340 - protein, 10 aa, Artificial Sequence
  Description of Artificial Sequence: Synthetic peptide
  Seed: TYLEPGPVTA (PMEL_HUMAN)
THLEPGPVTI

SEQ ID NO: 131341 - protein, 9 aa, Artificial Sequence
  Description of Artificial Sequence: Synthetic peptide
  Seed: THTMEVTVY (PMEL_HUMAN)
THTMEVTVL

SEQ ID NO: 131342 - protein, 9 aa, Artificial Sequence
  Description of Artificial Sequence: Synthetic peptide
  Seed: AVVSTQLIM (PMEL_HUMAN)
AHVSTQLIF

SEQ ID NO: 131343 - protein, 11 aa, Artificial Sequence
  Description of Artificial Sequence: Synthetic peptide
  Seed: QAVPSGEGDAF (PMEL_HUMAN)
QHVPSGEGDAW

SEQ ID NO: 131344 - protein, 10 aa, Artificial Sequence
  Description of Artificial Sequence: Synthetic peptide
  Seed: CLLHLAVIGA (PMEL_HUMAN)
CFLHLAVIGV

SEQ ID NO: 131345 - protein, 9 aa, Artificial Sequence
  Description of Artificial Sequence: Synthetic peptide
  Seed: ALDGGNKHF (PMEL_HUMAN)
AGDGGNKHV

SEQ ID NO: 131346 - protein, 9 aa, Artificial Sequence
  Description of Artificial Sequence: Synthetic peptide
  Seed: AEMSTPEAT (PMEL_HUMAN)
AQMSTPEAW

SEQ ID NO: 131347 - protein, 9 aa, Artificial Sequence
  Description of Artificial Sequence: Synthetic peptide
  Seed: KQDFSVPQL (PMEL_HUMAN)
KADFSVPQI

SEQ ID NO: 131348 - protein, 10 aa, Artificial Sequence
  Description of Artificial Sequence: Synthetic peptide
  Seed: KRQVPLDCVL (PMEL_HUMAN)
KCQVPLDCVY

SEQ ID NO: 131349 - protein, 10 aa, Artificial Sequence
  Description of Artificial Sequence: Synthetic peptide
  Seed: SLADTNSLAV (PMEL_HUMAN)
SLADTNSLAM

SEQ ID NO: 131350 - protein, 10 aa, Artificial Sequence
  Description of Artificial Sequence: Synthetic peptide
  Seed: YVPLAHSSSA (PMEL_HUMAN)
YAPLAHSSSL

SEQ ID NO: 131351 - protein, 9 aa, Artificial Sequence
  Description of Artificial Sequence: Synthetic peptide
  Seed: AEPSGTTSV (PMEL_HUMAN)
AEPSGTTSW

SEQ ID NO: 131352 - protein, 9 aa, Artificial Sequence
  Description of Artificial Sequence: Synthetic peptide
  Seed: TEVVGTTPG (PMEL_HUMAN)
TEVVGTTPM

SEQ ID NO: 131353 - protein, 9 aa, Artificial Sequence
  Description of Artificial Sequence: Synthetic peptide
  Seed: LADTNSLAV (PMEL_HUMAN)
LYDTNSLAF

SEQ ID NO: 131354 - protein, 10 aa, Artificial Sequence
  Description of Artificial Sequence: Synthetic peptide
  Seed: VPLAHSSSAF (PMEL_HUMAN)
VPLAHSSSAV

SEQ ID NO: 131355 - protein, 9 aa, Artificial Sequence
  Description of Artificial Sequence: Synthetic peptide
  Seed: AEAPNTTAG (PMEL_HUMAN)
AEAPNTTAA

SEQ ID NO: 131356 - protein, 10 aa, Artificial Sequence
  Description of Artificial Sequence: Synthetic peptide
  Seed: LMAVVLASLI (PMEL_HUMAN)
LLAVVLASLI

SEQ ID NO: 131357 - protein, 10 aa, Artificial Sequence
  Description of Artificial Sequence: Synthetic peptide
  Seed: RSFVYVWKTW (PMEL_HUMAN)
RTFVYVWKTM

SEQ ID NO: 131358 - protein, 9 aa, Artificial Sequence
  Description of Artificial Sequence: Synthetic peptide
  Seed: YLAEADLSY (PMEL_HUMAN)
YLAEADLSV

SEQ ID NO: 131359 - protein, 10 aa, Artificial Sequence
  Description of Artificial Sequence: Synthetic peptide
  Seed: VPVSEVMGTT (PMEL_HUMAN)
VPVSEVMGTA

SEQ ID NO: 131360 - protein, 9 aa, Artificial Sequence
  Description of Artificial Sequence: Synthetic peptide
  Seed: QKRSFVYVW (PMEL_HUMAN)
QLRSFVYVF

SEQ ID NO: 131361 - protein, 9 aa, Artificial Sequence
  Description of Artificial Sequence: Synthetic peptide
  Seed: ALNFPGSQK (PMEL_HUMAN)
AVNFPGSQF

SEQ ID NO: 131362 - protein, 9 aa, Artificial Sequence
  Description of Artificial Sequence: Synthetic peptide
  Seed: DAFELTVSC (PMEL_HUMAN)
DQFELTVSL

SEQ ID NO: 131363 - protein, 10 aa, Artificial Sequence
  Description of Artificial Sequence: Synthetic peptide
  Seed: VLSGTTAAQV (PMEL_HUMAN)
VVSGTTAAQV

SEQ ID NO: 131364 - protein, 9 aa, Artificial Sequence
  Description of Artificial Sequence: Synthetic peptide
  Seed: ITDQVPFSV (PMEL_HUMAN)
IYDQVPFSF

SEQ ID NO: 131365 - protein, 10 aa, Artificial Sequence
  Description of Artificial Sequence: Synthetic peptide
  Seed: EVSIVVLSGT (PMEL_HUMAN)
EMSIVVLSGI

SEQ ID NO: 131366 - protein, 9 aa, Artificial Sequence
  Description of Artificial Sequence: Synthetic peptide
  Seed: ASFSIALNF (PMEL_HUMAN)
AAFSIALNY

SEQ ID NO: 131367 - protein, 9 aa, Artificial Sequence
  Description of Artificial Sequence: Synthetic peptide
  Seed: AQVVLQAAI (PMEL_HUMAN)
AEVVLQAAS

SEQ ID NO: 131368 - protein, 11 aa, Artificial Sequence
  Description of Artificial Sequence: Synthetic peptide
  Seed: HTMEVTVYHRR (PMEL_HUMAN)
HMMEVTVYHRK

SEQ ID NO: 131369 - protein, 11 aa, Artificial Sequence
  Description of Artificial Sequence: Synthetic peptide
  Seed: RALDGGNKHFL (PMEL_HUMAN)
RILDGGNKHFL

SEQ ID NO: 131370 - protein, 8 aa, Artificial Sequence
  Description of Artificial Sequence: Synthetic peptide
  Seed: AQVVLQAA (PMEL_HUMAN)
AQVVLQAL

SEQ ID NO: 131371 - protein, 10 aa, Artificial Sequence
  Description of Artificial Sequence: Synthetic peptide
  Seed: QVPLDCVLYR (PMEL_HUMAN)
QFPLDCVLYR

SEQ ID NO: 131372 - protein, 8 aa, Artificial Sequence
  Description of Artificial Sequence: Synthetic peptide
  Seed: TLDIVQGI (PMEL_HUMAN)
TMDIVQGL

SEQ ID NO: 131373 - protein, 10 aa, Artificial Sequence
  Description of Artificial Sequence: Synthetic peptide
  Seed: RALVVTHTYL (PMEL_HUMAN)
RRLVVTHTYY

SEQ ID NO: 131374 - protein, 9 aa, Artificial Sequence
  Description of Artificial Sequence: Synthetic peptide
  Seed: KTWGQYWQV (PMEL_HUMAN)
KNWGQYWQY

SEQ ID NO: 131375 - protein, 9 aa, Artificial Sequence
  Description of Artificial Sequence: Synthetic peptide
  Seed: KAWNRQLYP (PMEL_HUMAN)
KAWNRQLYK

SEQ ID NO: 131376 - protein, 11 aa, Artificial Sequence
  Description of Artificial Sequence: Synthetic peptide
  Seed: RRLMKQDFSVP (PMEL_HUMAN)
RFLMKQDFSVV

SEQ ID NO: 131377 - protein, 10 aa, Artificial Sequence
  Description of Artificial Sequence: Synthetic peptide
  Seed: TITDQVPFSV (PMEL_HUMAN)
TMTDQVPFSV

SEQ ID NO: 131378 - protein, 10 aa, Artificial Sequence
  Description of Artificial Sequence: Synthetic peptide
  Seed: THTMEVTVYH (PMEL_HUMAN)
TYTMEVTVYR

SEQ ID NO: 131379 - protein, 9 aa, Artificial Sequence
  Description of Artificial Sequence: Synthetic peptide
  Seed: THTMEVTVY (PMEL_HUMAN)
TKTMEVTVM

SEQ ID NO: 131380 - protein, 10 aa, Artificial Sequence
  Description of Artificial Sequence: Synthetic peptide
  Seed: RQLRTKAWNR (PMEL_HUMAN)
RELRTKAWNR

SEQ ID NO: 131381 - protein, 10 aa, Artificial Sequence
  Description of Artificial Sequence: Synthetic peptide
  Seed: VPQLPHSSSH (PMEL_HUMAN)
VVQLPHSSSY

SEQ ID NO: 131382 - protein, 10 aa, Artificial Sequence
  Description of Artificial Sequence: Synthetic peptide
  Seed: LADTNSLAVV (PMEL_HUMAN)
LTDTNSLAVF

SEQ ID NO: 131383 - protein, 9 aa, Artificial Sequence
  Description of Artificial Sequence: Synthetic peptide
  Seed: MTPEKVPVS (PMEL_HUMAN)
MSPEKVPVI

SEQ ID NO: 131384 - protein, 9 aa, Artificial Sequence
  Description of Artificial Sequence: Synthetic peptide
  Seed: HSSSHWLRL (PMEL_HUMAN)
HQSSHWLRY

SEQ ID NO: 131385 - protein, 9 aa, Artificial Sequence
  Description of Artificial Sequence: Synthetic peptide
  Seed: SSIMSTESI (PMEL_HUMAN)
SAIMSTESL

SEQ ID NO: 131386 - protein, 9 aa, Artificial Sequence
  Description of Artificial Sequence: Synthetic peptide
  Seed: SAFTITDQV (PMEL_HUMAN)
SMFTITDQV

SEQ ID NO: 131387 - protein, 11 aa, Artificial Sequence
  Description of Artificial Sequence: Synthetic peptide
  Seed: FGDSSGTLISR (PMEL_HUMAN)
FGDSSGTLISI

SEQ ID NO: 131388 - protein, 9 aa, Artificial Sequence
  Description of Artificial Sequence: Synthetic peptide
  Seed: RALVVTHTY (PMEL_HUMAN)
RRLVVTHTV

SEQ ID NO: 131389 - protein, 9 aa, Artificial Sequence
  Description of Artificial Sequence: Synthetic peptide
  Seed: THTMEVTVY (PMEL_HUMAN)
TVTMEVTVY

SEQ ID NO: 131390 - protein, 11 aa, Artificial Sequence
  Description of Artificial Sequence: Synthetic peptide
  Seed: SYVPLAHSSSA (PMEL_HUMAN)
SAVPLAHSSSM

SEQ ID NO: 131391 - protein, 9 aa, Artificial Sequence
  Description of Artificial Sequence: Synthetic peptide
  Seed: AHSSSAFTI (PMEL_HUMAN)
AHSSSAFTF

SEQ ID NO: 131392 - protein, 8 aa, Artificial Sequence
  Description of Artificial Sequence: Synthetic peptide
  Seed: LHDPSGYL (PMEL_HUMAN)
LADPSGYI

SEQ ID NO: 131393 - protein, 10 aa, Artificial Sequence
  Description of Artificial Sequence: Synthetic peptide
  Seed: YVWKTWGQYW (PMEL_HUMAN)
YAWKTWGQYF

SEQ ID NO: 131394 - protein, 9 aa, Artificial Sequence
  Description of Artificial Sequence: Synthetic peptide
  Seed: LIVGILLVL (PMEL_HUMAN)
LTVGILLVY

SEQ ID NO: 131395 - protein, 9 aa, Artificial Sequence
  Description of Artificial Sequence: Synthetic peptide
  Seed: GTYCLNVSL (PMEL_HUMAN)
GMYCLNVST

SEQ ID NO: 131396 - protein, 9 aa, Artificial Sequence
  Description of Artificial Sequence: Synthetic peptide
  Seed: AQRLCQPVL (PMEL_HUMAN)
AERLCQPVL

SEQ ID NO: 131397 - protein, 11 aa, Artificial Sequence
  Description of Artificial Sequence: Synthetic peptide
  Seed: VYVWKTWGQYW (PMEL_HUMAN)
VYVWKTWGQYL

SEQ ID NO: 131398 - protein, 9 aa, Artificial Sequence
  Description of Artificial Sequence: Synthetic peptide
  Seed: RAMLGTHTM (PMEL_HUMAN)
RAMLGTHTR

SEQ ID NO: 131399 - protein, 10 aa, Artificial Sequence
  Description of Artificial Sequence: Synthetic peptide
  Seed: GPLLDGTATL (PMEL_HUMAN)
GVLLDGTATM

SEQ ID NO: 131400 - protein, 10 aa, Artificial Sequence
  Description of Artificial Sequence: Synthetic peptide
  Seed: LMAVVLASLI (PMEL_HUMAN)
LLAVVLASLP

SEQ ID NO: 131401 - protein, 10 aa, Artificial Sequence
  Description of Artificial Sequence: Synthetic peptide
  Seed: RQLYPEWTEA (PMEL_HUMAN)
RELYPEWTEF

SEQ ID NO: 131402 - protein, 9 aa, Artificial Sequence
  Description of Artificial Sequence: Synthetic peptide
  Seed: VLPSPACQL (PMEL_HUMAN)
VTPSPACQL

SEQ ID NO: 131403 - protein, 9 aa, Artificial Sequence
  Description of Artificial Sequence: Synthetic peptide
  Seed: AVVSTQLIM (PMEL_HUMAN)
ATVSTQLIY

SEQ ID NO: 131404 - protein, 9 aa, Artificial Sequence
  Description of Artificial Sequence: Synthetic peptide
  Seed: LMAVVLASL (PMEL_HUMAN)
LEAVVLASF

SEQ ID NO: 131405 - protein, 10 aa, Artificial Sequence
  Description of Artificial Sequence: Synthetic peptide
  Seed: SVPQLPHSSS (PMEL_HUMAN)
SFPQLPHSSI

SEQ ID NO: 131406 - protein, 10 aa, Artificial Sequence
  Description of Artificial Sequence: Synthetic peptide
  Seed: AVIGALLAVG (PMEL_HUMAN)
AQIGALLAVN

SEQ ID NO: 131407 - protein, 9 aa, Artificial Sequence
  Description of Artificial Sequence: Synthetic peptide
  Seed: YVWKTWGQY (PMEL_HUMAN)
YKWKTWGQF

SEQ ID NO: 131408 - protein, 9 aa, Artificial Sequence
  Description of Artificial Sequence: Synthetic peptide
  Seed: GTYCLNVSL (PMEL_HUMAN)
GIYCLNVSW

SEQ ID NO: 131409 - protein, 10 aa, Artificial Sequence
  Description of Artificial Sequence: Synthetic peptide
  Seed: GRAMLGTHTM (PMEL_HUMAN)
GQAMLGTHTM

SEQ ID NO: 131410 - protein, 9 aa, Artificial Sequence
  Description of Artificial Sequence: Synthetic peptide
  Seed: YLAEADLSY (PMEL_HUMAN)
YLAEADLSI

SEQ ID NO: 131411 - protein, 9 aa, Artificial Sequence
  Description of Artificial Sequence: Synthetic peptide
  Seed: VSLADTNSL (PMEL_HUMAN)
VALADTNSY

SEQ ID NO: 131412 - protein, 9 aa, Artificial Sequence
  Description of Artificial Sequence: Synthetic peptide
  Seed: SSPGCQPPA (PMEL_HUMAN)
SMPGCQPPA

SEQ ID NO: 131413 - protein, 10 aa, Artificial Sequence
  Description of Artificial Sequence: Synthetic peptide
  Seed: MAVVLASLIY (PMEL_HUMAN)
MDVVLASLIR

SEQ ID NO: 131414 - protein, 9 aa, Artificial Sequence
  Description of Artificial Sequence: Synthetic peptide
  Seed: YVWKTWGQY (PMEL_HUMAN)
YAWKTWGQY

SEQ ID NO: 131415 - protein, 10 aa, Artificial Sequence
  Description of Artificial Sequence: Synthetic peptide
  Seed: LAVGATKVPR (PMEL_HUMAN)
LTVGATKVPR

SEQ ID NO: 131416 - protein, 10 aa, Artificial Sequence
  Description of Artificial Sequence: Synthetic peptide
  Seed: KRQVPLDCVL (PMEL_HUMAN)
KRQVPLDCVY

SEQ ID NO: 131417 - protein, 10 aa, Artificial Sequence
  Description of Artificial Sequence: Synthetic peptide
  Seed: VSLADTNSLA (PMEL_HUMAN)
VRLADTNSLI

SEQ ID NO: 131418 - protein, 9 aa, Artificial Sequence
  Description of Artificial Sequence: Synthetic peptide
  Seed: AVVLASLIY (PMEL_HUMAN)
ATVLASLIL

SEQ ID NO: 131419 - protein, 8 aa, Artificial Sequence
  Description of Artificial Sequence: Synthetic peptide
  Seed: LAHSSSAF (PMEL_HUMAN)
LQHSSSAM

SEQ ID NO: 131420 - protein, 10 aa, Artificial Sequence
  Description of Artificial Sequence: Synthetic peptide
  Seed: ESAEILQAVP (PMEL_HUMAN)
EVAEILQAVT

SEQ ID NO: 131421 - protein, 9 aa, Artificial Sequence
  Description of Artificial Sequence: Synthetic peptide
  Seed: HTMEVTVYH (PMEL_HUMAN)
HGMEVTVYW

SEQ ID NO: 131422 - protein, 9 aa, Artificial Sequence
  Description of Artificial Sequence: Synthetic peptide
  Seed: MSTPEATGM (PMEL_HUMAN)
MTTPEATGL

SEQ ID NO: 131423 - protein, 10 aa, Artificial Sequence
  Description of Artificial Sequence: Synthetic peptide
  Seed: LMAVVLASLI (PMEL_HUMAN)
LMAVVLASLQ

SEQ ID NO: 131424 - protein, 11 aa, Artificial Sequence
  Description of Artificial Sequence: Synthetic peptide
  Seed: SYVPLAHSSSA (PMEL_HUMAN)
SVVPLAHSSSF

SEQ ID NO: 131425 - protein, 9 aa, Artificial Sequence
  Description of Artificial Sequence: Synthetic peptide
  Seed: HTMEVTVYH (PMEL_HUMAN)
HLMEVTVYR

SEQ ID NO: 131426 - protein, 9 aa, Artificial Sequence
  Description of Artificial Sequence: Synthetic peptide
  Seed: RNQPLTFAL (PMEL_HUMAN)
RIQPLTFAY

SEQ ID NO: 131427 - protein, 8 aa, Artificial Sequence
  Description of Artificial Sequence: Synthetic peptide
  Seed: SNDGPTLI (PMEL_HUMAN)
SADGPTLF

SEQ ID NO: 131428 - protein, 10 aa, Artificial Sequence
  Description of Artificial Sequence: Synthetic peptide
  Seed: KTWGQYWQVL (PMEL_HUMAN)
KWWGQYWQVF

SEQ ID NO: 131429 - protein, 10 aa, Artificial Sequence
  Description of Artificial Sequence: Synthetic peptide
  Seed: YVPLAHSSSA (PMEL_HUMAN)
YCPLAHSSSV

SEQ ID NO: 131430 - protein, 9 aa, Artificial Sequence
  Description of Artificial Sequence: Synthetic peptide
  Seed: YLEPGPVTA (PMEL_HUMAN)
YSEPGPVTM

SEQ ID NO: 131431 - protein, 10 aa, Artificial Sequence
  Description of Artificial Sequence: Synthetic peptide
  Seed: ESAEILQAVP (PMEL_HUMAN)
EVAEILQAVE

SEQ ID NO: 131432 - protein, 11 aa, Artificial Sequence
  Description of Artificial Sequence: Synthetic peptide
  Seed: SEVMGTTLAEM (PMEL_HUMAN)
SEVMGTTLAEA

SEQ ID NO: 131433 - protein, 10 aa, Artificial Sequence
  Description of Artificial Sequence: Synthetic peptide
  Seed: MTPAEVSIVV (PMEL_HUMAN)
MHPAEVSIVS

SEQ ID NO: 131434 - protein, 9 aa, Artificial Sequence
  Description of Artificial Sequence: Synthetic peptide
  Seed: AEVSIVVLS (PMEL_HUMAN)
AEVSIVVLA

SEQ ID NO: 131435 - protein, 10 aa, Artificial Sequence
  Description of Artificial Sequence: Synthetic peptide
  Seed: KTWGQYWQVL (PMEL_HUMAN)
KIWGQYWQVI

SEQ ID NO: 131436 - protein, 9 aa, Artificial Sequence
  Description of Artificial Sequence: Synthetic peptide
  Seed: TLISRALVV (PMEL_HUMAN)
TIISRALVF

SEQ ID NO: 131437 - protein, 8 aa, Artificial Sequence
  Description of Artificial Sequence: Synthetic peptide
  Seed: SIGTGRAM (PMEL_HUMAN)
STGTGRAL

SEQ ID NO: 131438 - protein, 9 aa, Artificial Sequence
  Description of Artificial Sequence: Synthetic peptide
  Seed: AGQVPTTEV (PMEL_HUMAN)
AVQVPTTEM

SEQ ID NO: 131439 - protein, 10 aa, Artificial Sequence
  Description of Artificial Sequence: Synthetic peptide
  Seed: SVPQLPHSSS (PMEL_HUMAN)
SHPQLPHSSI

SEQ ID NO: 131440 - protein, 9 aa, Artificial Sequence
  Description of Artificial Sequence: Synthetic peptide
  Seed: LIYRRRLMK (PMEL_HUMAN)
LSYRRRLMA

SEQ ID NO: 131441 - protein, 9 aa, Artificial Sequence
  Description of Artificial Sequence: Synthetic peptide
  Seed: TYLEPGPVT (PMEL_HUMAN)
TYLEPGPVM

SEQ ID NO: 131442 - protein, 10 aa, Artificial Sequence
  Description of Artificial Sequence: Synthetic peptide
  Seed: RRLMKQDFSV (PMEL_HUMAN)
RSLMKQDFSI

SEQ ID NO: 131443 - protein, 9 aa, Artificial Sequence
  Description of Artificial Sequence: Synthetic peptide
  Seed: FTITDQVPF (PMEL_HUMAN)
FFITDQVPF

SEQ ID NO: 131444 - protein, 10 aa, Artificial Sequence
  Description of Artificial Sequence: Synthetic peptide
  Seed: RGSRSYVPLA (PMEL_HUMAN)
RSSRSYVPLK

SEQ ID NO: 131445 - protein, 9 aa, Artificial Sequence
  Description of Artificial Sequence: Synthetic peptide
  Seed: FLRNQPLTF (PMEL_HUMAN)
FMRNQPLTR

SEQ ID NO: 131446 - protein, 10 aa, Artificial Sequence
  Description of Artificial Sequence: Synthetic peptide
  Seed: IFPDGGPCPS (PMEL_HUMAN)
IMPDGGPCPF

SEQ ID NO: 131447 - protein, 10 aa, Artificial Sequence
  Description of Artificial Sequence: Synthetic peptide
  Seed: MPTAESTGMT (PMEL_HUMAN)
MGTAESTGMI

SEQ ID NO: 131448 - protein, 10 aa, Artificial Sequence
  Description of Artificial Sequence: Synthetic peptide
  Seed: SITGSLGPLL (PMEL_HUMAN)
SLTGSLGPLA

SEQ ID NO: 131449 - protein, 9 aa, Artificial Sequence
  Description of Artificial Sequence: Synthetic peptide
  Seed: LPDGQVIWV (PMEL_HUMAN)
LPDGQVIWY

SEQ ID NO: 131450 - protein, 8 aa, Artificial Sequence
  Description of Artificial Sequence: Synthetic peptide
  Seed: FSVSVSQL (PMEL_HUMAN)
FAVSVSQL

SEQ ID NO: 131451 - protein, 10 aa, Artificial Sequence
  Description of Artificial Sequence: Synthetic peptide
  Seed: RALVVTHTYL (PMEL_HUMAN)
RELVVTHTYY

SEQ ID NO: 131452 - protein, 9 aa, Artificial Sequence
  Description of Artificial Sequence: Synthetic peptide
  Seed: SSPGCQPPA (PMEL_HUMAN)
SMPGCQPPV

SEQ ID NO: 131453 - protein, 10 aa, Artificial Sequence
  Description of Artificial Sequence: Synthetic peptide
  Seed: YVPLAHSSSA (PMEL_HUMAN)
YQPLAHSSSF

SEQ ID NO: 131454 - protein, 8 aa, Artificial Sequence
  Description of Artificial Sequence: Synthetic peptide
  Seed: LAHSSSAF (PMEL_HUMAN)
LQHSSSAY

SEQ ID NO: 131455 - protein, 9 aa, Artificial Sequence
  Description of Artificial Sequence: Synthetic peptide
  Seed: WQVLGGPVS (PMEL_HUMAN)
WMVLGGPVY

SEQ ID NO: 131456 - protein, 9 aa, Artificial Sequence
  Description of Artificial Sequence: Synthetic peptide
  Seed: LQLHDPSGY (PMEL_HUMAN)
LTLHDPSGY

SEQ ID NO: 131457 - protein, 10 aa, Artificial Sequence
  Description of Artificial Sequence: Synthetic peptide
  Seed: SRALVVTHTY (PMEL_HUMAN)
SMALVVTHTW

SEQ ID NO: 131458 - protein, 9 aa, Artificial Sequence
  Description of Artificial Sequence: Synthetic peptide
  Seed: HTMEVTVYH (PMEL_HUMAN)
HAMEVTVYW

SEQ ID NO: 131459 - protein, 11 aa, Artificial Sequence
  Description of Artificial Sequence: Synthetic peptide
  Seed: RQVPLDCVLYR (PMEL_HUMAN)
RAVPLDCVLYR

SEQ ID NO: 131460 - protein, 9 aa, Artificial Sequence
  Description of Artificial Sequence: Synthetic peptide
  Seed: LHLAVIGAL (PMEL_HUMAN)
LLLAVIGAY

SEQ ID NO: 131461 - protein, 10 aa, Artificial Sequence
  Description of Artificial Sequence: Synthetic peptide
  Seed: SVPQLPHSSS (PMEL_HUMAN)
SSPQLPHSSA

SEQ ID NO: 131462 - protein, 9 aa, Artificial Sequence
  Description of Artificial Sequence: Synthetic peptide
  Seed: AGLGQVPLI (PMEL_HUMAN)
AMLGQVPLI

SEQ ID NO: 131463 - protein, 9 aa, Artificial Sequence
  Description of Artificial Sequence: Synthetic peptide
  Seed: LSGTTAAQV (PMEL_HUMAN)
LVGTTAAQV

SEQ ID NO: 131464 - protein, 9 aa, Artificial Sequence
  Description of Artificial Sequence: Synthetic peptide
  Seed: HSSSHWLRL (PMEL_HUMAN)
HASSHWLRF

SEQ ID NO: 131465 - protein, 10 aa, Artificial Sequence
  Description of Artificial Sequence: Synthetic peptide
  Seed: RTKAWNRQLY (PMEL_HUMAN)
RTKAWNRQLW

SEQ ID NO: 131466 - protein, 10 aa, Artificial Sequence
  Description of Artificial Sequence: Synthetic peptide
  Seed: VVLASLIYRR (PMEL_HUMAN)
VMLASLIYRT

SEQ ID NO: 131467 - protein, 9 aa, Artificial Sequence
  Description of Artificial Sequence: Synthetic peptide
  Seed: FTITDQVPF (PMEL_HUMAN)
FTITDQVPL

SEQ ID NO: 131468 - protein, 9 aa, Artificial Sequence
  Description of Artificial Sequence: Synthetic peptide
  Seed: VSNDGPTLI (PMEL_HUMAN)
VINDGPTLI

SEQ ID NO: 131469 - protein, 9 aa, Artificial Sequence
  Description of Artificial Sequence: Synthetic peptide
  Seed: VPLDCVLYR (PMEL_HUMAN)
VMLDCVLYM

SEQ ID NO: 131470 - protein, 10 aa, Artificial Sequence
  Description of Artificial Sequence: Synthetic peptide
  Seed: HFLRNQPLTF (PMEL_HUMAN)
HQLRNQPLTF

SEQ ID NO: 131471 - protein, 10 aa, Artificial Sequence
  Description of Artificial Sequence: Synthetic peptide
  Seed: QVLGGPVSGL (PMEL_HUMAN)
QLLGGPVSGI

SEQ ID NO: 131472 - protein, 10 aa, Artificial Sequence
  Description of Artificial Sequence: Synthetic peptide
  Seed: MTPAEVSIVV (PMEL_HUMAN)
MDPAEVSIVY

SEQ ID NO: 131473 - protein, 10 aa, Artificial Sequence
  Description of Artificial Sequence: Synthetic peptide
  Seed: WKTWGQYWQV (PMEL_HUMAN)
WMTWGQYWQA

SEQ ID NO: 131474 - protein, 10 aa, Artificial Sequence
  Description of Artificial Sequence: Synthetic peptide
  Seed: GRAMLGTHTM (PMEL_HUMAN)
GKAMLGTHTF

SEQ ID NO: 131475 - protein, 9 aa, Artificial Sequence
  Description of Artificial Sequence: Synthetic peptide
  Seed: VSEVMGTTL (PMEL_HUMAN)
VEEVMGTTL

SEQ ID NO: 131476 - protein, 10 aa, Artificial Sequence
  Description of Artificial Sequence: Synthetic peptide
  Seed: VLMAVVLASL (PMEL_HUMAN)
VMMAVVLASF

SEQ ID NO: 131477 - protein, 9 aa, Artificial Sequence
  Description of Artificial Sequence: Synthetic peptide
  Seed: SEVMGTTLA (PMEL_HUMAN)
SEVMGTTLI

SEQ ID NO: 131478 - protein, 10 aa, Artificial Sequence
  Description of Artificial Sequence: Synthetic peptide
  Seed: YVPLAHSSSA (PMEL_HUMAN)
YSPLAHSSSF

SEQ ID NO: 131479 - protein, 9 aa, Artificial Sequence
  Description of Artificial Sequence: Synthetic peptide
  Seed: DSSGTLISR (PMEL_HUMAN)
DGSGTLISR

SEQ ID NO: 131480 - protein, 9 aa, Artificial Sequence
  Description of Artificial Sequence: Synthetic peptide
  Seed: LIVGILLVL (PMEL_HUMAN)
LLVGILLVM

SEQ ID NO: 131481 - protein, 9 aa, Artificial Sequence
  Description of Artificial Sequence: Synthetic peptide
  Seed: VSNDGPTLI (PMEL_HUMAN)
VINDGPTLY

SEQ ID NO: 131482 - protein, 9 aa, Artificial Sequence
  Description of Artificial Sequence: Synthetic peptide
  Seed: TTDGHRPTA (PMEL_HUMAN)
TSDGHRPTI

SEQ ID NO: 131483 - protein, 10 aa, Artificial Sequence
  Description of Artificial Sequence: Synthetic peptide
  Seed: FSVSVSQLRA (PMEL_HUMAN)
FTVSVSQLRH

SEQ ID NO: 131484 - protein, 9 aa, Artificial Sequence
  Description of Artificial Sequence: Synthetic peptide
  Seed: AESTGMTPE (PMEL_HUMAN)
AESTGMTPI

SEQ ID NO: 131485 - protein, 8 aa, Artificial Sequence
  Description of Artificial Sequence: Synthetic peptide
  Seed: SHWLRLPR (PMEL_HUMAN)
SYWLRLPR

SEQ ID NO: 131486 - protein, 9 aa, Artificial Sequence
  Description of Artificial Sequence: Synthetic peptide
  Seed: RAMLGTHTM (PMEL_HUMAN)
RMMLGTHTF

SEQ ID NO: 131487 - protein, 11 aa, Artificial Sequence
  Description of Artificial Sequence: Synthetic peptide
  Seed: HQILKGGSGTY (PMEL_HUMAN)
HQILKGGSGTL

SEQ ID NO: 131488 - protein, 10 aa, Artificial Sequence
  Description of Artificial Sequence: Synthetic peptide
  Seed: SVPQLPHSSS (PMEL_HUMAN)
SKPQLPHSSA

SEQ ID NO: 131489 - protein, 10 aa, Artificial Sequence
  Description of Artificial Sequence: Synthetic peptide
  Seed: EVMGTTLAEM (PMEL_HUMAN)
ELMGTTLAEK

SEQ ID NO: 131490 - protein, 9 aa, Artificial Sequence
  Description of Artificial Sequence: Synthetic peptide
  Seed: LSIGTGRAM (PMEL_HUMAN)
LSIGTGRAI

SEQ ID NO: 131491 - protein, 9 aa, Artificial Sequence
  Description of Artificial Sequence: Synthetic peptide
  Seed: YVWKTWGQY (PMEL_HUMAN)
YVWKTWGQF

SEQ ID NO: 131492 - protein, 9 aa, Artificial Sequence
  Description of Artificial Sequence: Synthetic peptide
  Seed: TLIGANASF (PMEL_HUMAN)
TNIGANASY

SEQ ID NO: 131493 - protein, 9 aa, Artificial Sequence
  Description of Artificial Sequence: Synthetic peptide
  Seed: IYRRRLMKQ (PMEL_HUMAN)
ISRRRLMKV

SEQ ID NO: 131494 - protein, 9 aa, Artificial Sequence
  Description of Artificial Sequence: Synthetic peptide
  Seed: KTWGQYWQV (PMEL_HUMAN)
KSWGQYWQK

SEQ ID NO: 131495 - protein, 10 aa, Artificial Sequence
  Description of Artificial Sequence: Synthetic peptide
  Seed: LMAVVLASLI (PMEL_HUMAN)
LMAVVLASLE

SEQ ID NO: 131496 - protein, 9 aa, Artificial Sequence
  Description of Artificial Sequence: Synthetic peptide
  Seed: RNQPLTFAL (PMEL_HUMAN)
RAQPLTFAF

SEQ ID NO: 131497 - protein, 10 aa, Artificial Sequence
  Description of Artificial Sequence: Synthetic peptide
  Seed: VLYRYGSFSV (PMEL_HUMAN)
VMYRYGSFSI

SEQ ID NO: 131498 - protein, 10 aa, Artificial Sequence
  Description of Artificial Sequence: Synthetic peptide
  Seed: RGSRSYVPLA (PMEL_HUMAN)
RISRSYVPLK

SEQ ID NO: 131499 - protein, 9 aa, Artificial Sequence
  Description of Artificial Sequence: Synthetic peptide
  Seed: SVQVPTTEV (PMEL_HUMAN)
SAQVPTTEF

SEQ ID NO: 131500 - protein, 9 aa, Artificial Sequence
  Description of Artificial Sequence: Synthetic peptide
  Seed: SITGSLGPL (PMEL_HUMAN)
SSTGSLGPV

SEQ ID NO: 131501 - protein, 9 aa, Artificial Sequence
  Description of Artificial Sequence: Synthetic peptide
  Seed: ESAEILQAV (PMEL_HUMAN)
EIAEILQAY

SEQ ID NO: 131502 - protein, 9 aa, Artificial Sequence
  Description of Artificial Sequence: Synthetic peptide
  Seed: TEWVETTAR (PMEL_HUMAN)
TVWVETTAR

SEQ ID NO: 131503 - protein, 10 aa, Artificial Sequence
  Description of Artificial Sequence: Synthetic peptide
  Seed: VPLAHSSSAF (PMEL_HUMAN)
VELAHSSSAF

SEQ ID NO: 131504 - protein, 10 aa, Artificial Sequence
  Description of Artificial Sequence: Synthetic peptide
  Seed: MSTESITGSL (PMEL_HUMAN)
MTTESITGSY

SEQ ID NO: 131505 - protein, 9 aa, Artificial Sequence
  Description of Artificial Sequence: Synthetic peptide
  Seed: RTKAWNRQL (PMEL_HUMAN)
RSKAWNRQF

SEQ ID NO: 131506 - protein, 10 aa, Artificial Sequence
  Description of Artificial Sequence: Synthetic peptide
  Seed: SLIYRRRLMK (PMEL_HUMAN)
SIIYRRRLMK

SEQ ID NO: 131507 - protein, 11 aa, Artificial Sequence
  Description of Artificial Sequence: Synthetic peptide
  Seed: FGDSSGTLISR (PMEL_HUMAN)
FIDSSGTLISF

SEQ ID NO: 131508 - protein, 9 aa, Artificial Sequence
  Description of Artificial Sequence: Synthetic peptide
  Seed: QLYPEWTEA (PMEL_HUMAN)
QMYPEWTEI

SEQ ID NO: 131509 - protein, 10 aa, Artificial Sequence
  Description of Artificial Sequence: Synthetic peptide
  Seed: VPLAHSSSAF (PMEL_HUMAN)
VTLAHSSSAY

SEQ ID NO: 131510 - protein, 11 aa, Artificial Sequence
  Description of Artificial Sequence: Synthetic peptide
  Seed: SYVPLAHSSSA (PMEL_HUMAN)
SLVPLAHSSSL

SEQ ID NO: 131511 - protein, 9 aa, Artificial Sequence
  Description of Artificial Sequence: Synthetic peptide
  Seed: STESITGSL (PMEL_HUMAN)
SIESITGSY

SEQ ID NO: 131512 - protein, 10 aa, Artificial Sequence
  Description of Artificial Sequence: Synthetic peptide
  Seed: SLADTNSLAV (PMEL_HUMAN)
SIADTNSLAV

SEQ ID NO: 131513 - protein, 11 aa, Artificial Sequence
  Description of Artificial Sequence: Synthetic peptide
  Seed: VQMPTAESTGM (PMEL_HUMAN)
VKMPTAESTGY

SEQ ID NO: 131514 - protein, 9 aa, Artificial Sequence
  Description of Artificial Sequence: Synthetic peptide
  Seed: TGRAMLGTH (PMEL_HUMAN)
TSRAMLGTY

SEQ ID NO: 131515 - protein, 10 aa, Artificial Sequence
  Description of Artificial Sequence: Synthetic peptide
  Seed: KVSNDGPTLI (PMEL_HUMAN)
KISNDGPTLV

SEQ ID NO: 131516 - protein, 10 aa, Artificial Sequence
  Description of Artificial Sequence: Synthetic peptide
  Seed: YLAEADLSYT (PMEL_HUMAN)
YLAEADLSYY

SEQ ID NO: 131517 - protein, 11 aa, Artificial Sequence
  Description of Artificial Sequence: Synthetic peptide
  Seed: RALDGGNKHFL (PMEL_HUMAN)
RLLDGGNKHFV

SEQ ID NO: 131518 - protein, 9 aa, Artificial Sequence
  Description of Artificial Sequence: Synthetic peptide
  Seed: VSNDGPTLI (PMEL_HUMAN)
VTNDGPTLI

SEQ ID NO: 131519 - protein, 9 aa, Artificial Sequence
  Description of Artificial Sequence: Synthetic peptide
  Seed: SAFTITDQV (PMEL_HUMAN)
STFTITDQM

SEQ ID NO: 131520 - protein, 9 aa, Artificial Sequence
  Description of Artificial Sequence: Synthetic peptide
  Seed: RTKAWNRQL (PMEL_HUMAN)
RSKAWNRQI

SEQ ID NO: 131521 - protein, 10 aa, Artificial Sequence
  Description of Artificial Sequence: Synthetic peptide
  Seed: LIGANASFSI (PMEL_HUMAN)
LVGANASFSV

SEQ ID NO: 131522 - protein, 9 aa, Artificial Sequence
  Description of Artificial Sequence: Synthetic peptide
  Seed: LNFPGSQKV (PMEL_HUMAN)
LEFPGSQKV

SEQ ID NO: 131523 - protein, 10 aa, Artificial Sequence
  Description of Artificial Sequence: Synthetic peptide
  Seed: LPHSSSHWLR (PMEL_HUMAN)
LSHSSSHWLR

SEQ ID NO: 131524 - protein, 10 aa, Artificial Sequence
  Description of Artificial Sequence: Synthetic peptide
  Seed: AVIGALLAVG (PMEL_HUMAN)
AMIGALLAVT

SEQ ID NO: 131525 - protein, 9 aa, Artificial Sequence
  Description of Artificial Sequence: Synthetic peptide
  Seed: TLIGANASF (PMEL_HUMAN)
TQIGANASM

SEQ ID NO: 131526 - protein, 9 aa, Artificial Sequence
  Description of Artificial Sequence: Synthetic peptide
  Seed: SSIMSTESI (PMEL_HUMAN)
SAIMSTESI

SEQ ID NO: 131527 - protein, 9 aa, Artificial Sequence
  Description of Artificial Sequence: Synthetic peptide
  Seed: WSQKRSFVY (PMEL_HUMAN)
WTQKRSFVL

SEQ ID NO: 131528 - protein, 10 aa, Artificial Sequence
  Description of Artificial Sequence: Synthetic peptide
  Seed: EVMGTTLAEM (PMEL_HUMAN)
ELMGTTLAEV

SEQ ID NO: 131529 - protein, 9 aa, Artificial Sequence
  Description of Artificial Sequence: Synthetic peptide
  Seed: RAMLGTHTM (PMEL_HUMAN)
RVMLGTHTF

SEQ ID NO: 131530 - protein, 10 aa, Artificial Sequence
  Description of Artificial Sequence: Synthetic peptide
  Seed: VPLIVGILLV (PMEL_HUMAN)
VLLIVGILLV

SEQ ID NO: 131531 - protein, 9 aa, Artificial Sequence
  Description of Artificial Sequence: Synthetic peptide
  Seed: AVGATKVPR (PMEL_HUMAN)
ALGATKVPK

SEQ ID NO: 131532 - protein, 9 aa, Artificial Sequence
  Description of Artificial Sequence: Synthetic peptide
  Seed: GQVPLIVGI (PMEL_HUMAN)
GRVPLIVGY

SEQ ID NO: 131533 - protein, 8 aa, Artificial Sequence
  Description of Artificial Sequence: Synthetic peptide
  Seed: LHDPSGYL (PMEL_HUMAN)
LTDPSGYF

SEQ ID NO: 131534 - protein, 10 aa, Artificial Sequence
  Description of Artificial Sequence: Synthetic peptide
  Seed: KTWGQYWQVL (PMEL_HUMAN)
KLWGQYWQVI

SEQ ID NO: 131535 - protein, 10 aa, Artificial Sequence
  Description of Artificial Sequence: Synthetic peptide
  Seed: RALVVTHTYL (PMEL_HUMAN)
RCLVVTHTYY

SEQ ID NO: 131536 - protein, 9 aa, Artificial Sequence
  Description of Artificial Sequence: Synthetic peptide
  Seed: KEACMEISS (PMEL_HUMAN)
KEACMEISI

SEQ ID NO: 131537 - protein, 11 aa, Artificial Sequence
  Description of Artificial Sequence: Synthetic peptide
  Seed: RRGSRSYVPLA (PMEL_HUMAN)
RMGSRSYVPLK

SEQ ID NO: 131538 - protein, 10 aa, Artificial Sequence
  Description of Artificial Sequence: Synthetic peptide
  Seed: YRYGSFSVTL (PMEL_HUMAN)
YMYGSFSVTW

SEQ ID NO: 131539 - protein, 9 aa, Artificial Sequence
  Description of Artificial Sequence: Synthetic peptide
  Seed: AEADLSYTW (PMEL_HUMAN)
AMADLSYTL

SEQ ID NO: 131540 - protein, 9 aa, Artificial Sequence
  Description of Artificial Sequence: Synthetic peptide
  Seed: VMGTTLAEM (PMEL_HUMAN)
VVGTTLAEI

SEQ ID NO: 131541 - protein, 9 aa, Artificial Sequence
  Description of Artificial Sequence: Synthetic peptide
  Seed: YLEPGPVTA (PMEL_HUMAN)
YTEPGPVTF

SEQ ID NO: 131542 - protein, 9 aa, Artificial Sequence
  Description of Artificial Sequence: Synthetic peptide
  Seed: EKVPVSEVM (PMEL_HUMAN)
EQVPVSEVF

SEQ ID NO: 131543 - protein, 9 aa, Artificial Sequence
  Description of Artificial Sequence: Synthetic peptide
  Seed: SYVPLAHSS (PMEL_HUMAN)
SWVPLAHSM

SEQ ID NO: 131544 - protein, 9 aa, Artificial Sequence
  Description of Artificial Sequence: Synthetic peptide
  Seed: LSIGTGRAM (PMEL_HUMAN)
LGIGTGRAL

SEQ ID NO: 131545 - protein, 10 aa, Artificial Sequence
  Description of Artificial Sequence: Synthetic peptide
  Seed: AVIGALLAVG (PMEL_HUMAN)
AAIGALLAVV

SEQ ID NO: 131546 - protein, 10 aa, Artificial Sequence
  Description of Artificial Sequence: Synthetic peptide
  Seed: RALVVTHTYL (PMEL_HUMAN)
RQLVVTHTYY

SEQ ID NO: 131547 - protein, 8 aa, Artificial Sequence
  Description of Artificial Sequence: Synthetic peptide
  Seed: LLDGTATL (PMEL_HUMAN)
LVDGTATM

SEQ ID NO: 131548 - protein, 9 aa, Artificial Sequence
  Description of Artificial Sequence: Synthetic peptide
  Seed: SVQVPTTEV (PMEL_HUMAN)
SMQVPTTEF

SEQ ID NO: 131549 - protein, 10 aa, Artificial Sequence
  Description of Artificial Sequence: Synthetic peptide
  Seed: FLRNQPLTFA (PMEL_HUMAN)
FIRNQPLTFL

SEQ ID NO: 131550 - protein, 10 aa, Artificial Sequence
  Description of Artificial Sequence: Synthetic peptide
  Seed: MAVVLASLIY (PMEL_HUMAN)
MPVVLASLIW

SEQ ID NO: 131551 - protein, 9 aa, Artificial Sequence
  Description of Artificial Sequence: Synthetic peptide
  Seed: KHFLRNQPL (PMEL_HUMAN)
KQFLRNQPY

SEQ ID NO: 131552 - protein, 10 aa, Artificial Sequence
  Description of Artificial Sequence: Synthetic peptide
  Seed: YVPLAHSSSA (PMEL_HUMAN)
YPPLAHSSSL

SEQ ID NO: 131553 - protein, 9 aa, Artificial Sequence
  Description of Artificial Sequence: Synthetic peptide
  Seed: VSVSQLRAL (PMEL_HUMAN)
VTVSQLRAY

SEQ ID NO: 131554 - protein, 9 aa, Artificial Sequence
  Description of Artificial Sequence: Synthetic peptide
  Seed: AQRLCQPVL (PMEL_HUMAN)
AERLCQPVV

SEQ ID NO: 131555 - protein, 9 aa, Artificial Sequence
  Description of Artificial Sequence: Synthetic peptide
  Seed: AVIGALLAV (PMEL_HUMAN)
ALIGALLAI

SEQ ID NO: 131556 - protein, 10 aa, Artificial Sequence
  Description of Artificial Sequence: Synthetic peptide
  Seed: RTKAWNRQLY (PMEL_HUMAN)
RFKAWNRQLK

SEQ ID NO: 131557 - protein, 10 aa, Artificial Sequence
  Description of Artificial Sequence: Synthetic peptide
  Seed: VLMAVVLASL (PMEL_HUMAN)
VVMAVVLASI

SEQ ID NO: 131558 - protein, 9 aa, Artificial Sequence
  Description of Artificial Sequence: Synthetic peptide
  Seed: VLASLIYRR (PMEL_HUMAN)
VGASLIYRR

SEQ ID NO: 131559 - protein, 9 aa, Artificial Sequence
  Description of Artificial Sequence: Synthetic peptide
  Seed: MLGTHTMEV (PMEL_HUMAN)
MLGTHTMEI

SEQ ID NO: 131560 - protein, 11 aa, Artificial Sequence
  Description of Artificial Sequence: Synthetic peptide
  Seed: RAMLGTHTMEV (PMEL_HUMAN)
RMMLGTHTMEL

SEQ ID NO: 131561 - protein, 10 aa, Artificial Sequence
  Description of Artificial Sequence: Synthetic peptide
  Seed: SCPIGENSPL (PMEL_HUMAN)
SYPIGENSPM

SEQ ID NO: 131562 - protein, 9 aa, Artificial Sequence
  Description of Artificial Sequence: Synthetic peptide
  Seed: VVLSGTTAA (PMEL_HUMAN)
VVLSGTTAI

SEQ ID NO: 131563 - protein, 9 aa, Artificial Sequence
  Description of Artificial Sequence: Synthetic peptide
  Seed: VTAQVVLQA (PMEL_HUMAN)
VIAQVVLQA

SEQ ID NO: 131564 - protein, 10 aa, Artificial Sequence
  Description of Artificial Sequence: Synthetic peptide
  Seed: VLMAVVLASL (PMEL_HUMAN)
VDMAVVLASL

SEQ ID NO: 131565 - protein, 10 aa, Artificial Sequence
  Description of Artificial Sequence: Synthetic peptide
  Seed: ILKGGSGTYC (PMEL_HUMAN)
IMKGGSGTYM

SEQ ID NO: 131566 - protein, 10 aa, Artificial Sequence
  Description of Artificial Sequence: Synthetic peptide
  Seed: YLAEADLSYT (PMEL_HUMAN)
YGAEADLSYV

SEQ ID NO: 131567 - protein, 10 aa, Artificial Sequence
  Description of Artificial Sequence: Synthetic peptide
  Seed: ESAEILQAVP (PMEL_HUMAN)
EIAEILQAVI

SEQ ID NO: 131568 - protein, 9 aa, Artificial Sequence
  Description of Artificial Sequence: Synthetic peptide
  Seed: RYGSFSVTL (PMEL_HUMAN)
RFGSFSVTW

SEQ ID NO: 131569 - protein, 9 aa, Artificial Sequence
  Description of Artificial Sequence: Synthetic peptide
  Seed: VVLQAAIPL (PMEL_HUMAN)
VKLQAAIPY

SEQ ID NO: 131570 - protein, 9 aa, Artificial Sequence
  Description of Artificial Sequence: Synthetic peptide
  Seed: FTITDQVPF (PMEL_HUMAN)
FAITDQVPW

SEQ ID NO: 131571 - protein, 10 aa, Artificial Sequence
  Description of Artificial Sequence: Synthetic peptide
  Seed: IESAEILQAV (PMEL_HUMAN)
ITSAEILQAV

SEQ ID NO: 131572 - protein, 10 aa, Artificial Sequence
  Description of Artificial Sequence: Synthetic peptide
  Seed: MAVVLASLIY (PMEL_HUMAN)
MNVVLASLIW

SEQ ID NO: 131573 - protein, 10 aa, Artificial Sequence
  Description of Artificial Sequence: Synthetic peptide
  Seed: YVPLAHSSSA (PMEL_HUMAN)
YPPLAHSSSM

SEQ ID NO: 131574 - protein, 10 aa, Artificial Sequence
  Description of Artificial Sequence: Synthetic peptide
  Seed: KRSFVYVWKT (PMEL_HUMAN)
KRSFVYVWKI

SEQ ID NO: 131575 - protein, 9 aa, Artificial Sequence
  Description of Artificial Sequence: Synthetic peptide
  Seed: AQRLCQPVL (PMEL_HUMAN)
AVRLCQPVA

SEQ ID NO: 131576 - protein, 9 aa, Artificial Sequence
  Description of Artificial Sequence: Synthetic peptide
  Seed: ESAEILQAV (PMEL_HUMAN)
ESAEILQAY

SEQ ID NO: 131577 - protein, 11 aa, Artificial Sequence
  Description of Artificial Sequence: Synthetic peptide
  Seed: RLPRIFCSCPI (PMEL_HUMAN)
RWPRIFCSCPL

SEQ ID NO: 131578 - protein, 9 aa, Artificial Sequence
  Description of Artificial Sequence: Synthetic peptide
  Seed: LQLHDPSGY (PMEL_HUMAN)
LKLHDPSGY

SEQ ID NO: 131579 - protein, 11 aa, Artificial Sequence
  Description of Artificial Sequence: Synthetic peptide
  Seed: FSVTLDIVQGI (PMEL_HUMAN)
FMVTLDIVQGA

SEQ ID NO: 131580 - protein, 9 aa, Artificial Sequence
  Description of Artificial Sequence: Synthetic peptide
  Seed: LSIGTGRAM (PMEL_HUMAN)
LMIGTGRAV

SEQ ID NO: 131581 - protein, 9 aa, Artificial Sequence
  Description of Artificial Sequence: Synthetic peptide
  Seed: LRNQPLTFA (PMEL_HUMAN)
LRNQPLTFF

SEQ ID NO: 131582 - protein, 9 aa, Artificial Sequence
  Description of Artificial Sequence: Synthetic peptide
  Seed: GQVPTTEVV (PMEL_HUMAN)
GAVPTTEVL

SEQ ID NO: 131583 - protein, 9 aa, Artificial Sequence
  Description of Artificial Sequence: Synthetic peptide
  Seed: RAMLGTHTM (PMEL_HUMAN)
RYMLGTHTH

SEQ ID NO: 131584 - protein, 10 aa, Artificial Sequence
  Description of Artificial Sequence: Synthetic peptide
  Seed: ESITGSLGPL (PMEL_HUMAN)
EVITGSLGPA

SEQ ID NO: 131585 - protein, 9 aa, Artificial Sequence
  Description of Artificial Sequence: Synthetic peptide
  Seed: IYRRRLMKQ (PMEL_HUMAN)
IGRRRLMKK

SEQ ID NO: 131586 - protein, 10 aa, Artificial Sequence
  Description of Artificial Sequence: Synthetic peptide
  Seed: VLPDGQVIWV (PMEL_HUMAN)
VLPDGQVIWL

SEQ ID NO: 131587 - protein, 9 aa, Artificial Sequence
  Description of Artificial Sequence: Synthetic peptide
  Seed: AQRLCQPVL (PMEL_HUMAN)
ALRLCQPVY

SEQ ID NO: 131588 - protein, 9 aa, Artificial Sequence
  Description of Artificial Sequence: Synthetic peptide
  Seed: MSTPEATGM (PMEL_HUMAN)
MSTPEATGF

SEQ ID NO: 131589 - protein, 9 aa, Artificial Sequence
  Description of Artificial Sequence: Synthetic peptide
  Seed: SLADTNSLA (PMEL_HUMAN)
SAADTNSLL

SEQ ID NO: 131590 - protein, 11 aa, Artificial Sequence
  Description of Artificial Sequence: Synthetic peptide
  Seed: MAVVLASLIYR (PMEL_HUMAN)
MTVVLASLIYK

SEQ ID NO: 131591 - protein, 9 aa, Artificial Sequence
  Description of Artificial Sequence: Synthetic peptide
  Seed: MTPAEVSIV (PMEL_HUMAN)
MAPAEVSIY

SEQ ID NO: 131592 - protein, 10 aa, Artificial Sequence
  Description of Artificial Sequence: Synthetic peptide
  Seed: VLMAVVLASL (PMEL_HUMAN)
VQMAVVLASV

SEQ ID NO: 131593 - protein, 9 aa, Artificial Sequence
  Description of Artificial Sequence: Synthetic peptide
  Seed: HLAVIGALL (PMEL_HUMAN)
HVAVIGALY

SEQ ID NO: 131594 - protein, 8 aa, Artificial Sequence
  Description of Artificial Sequence: Synthetic peptide
  Seed: SNDGPTLI (PMEL_HUMAN)
SSDGPTLI

SEQ ID NO: 131595 - protein, 9 aa, Artificial Sequence
  Description of Artificial Sequence: Synthetic peptide
  Seed: VLGGPVSGL (PMEL_HUMAN)
VAGGPVSGF

SEQ ID NO: 131596 - protein, 9 aa, Artificial Sequence
  Description of Artificial Sequence: Synthetic peptide
  Seed: FLRNQPLTF (PMEL_HUMAN)
FKRNQPLTM

SEQ ID NO: 131597 - protein, 9 aa, Artificial Sequence
  Description of Artificial Sequence: Synthetic peptide
  Seed: ITDQVPFSV (PMEL_HUMAN)
IMDQVPFSW

SEQ ID NO: 131598 - protein, 9 aa, Artificial Sequence
  Description of Artificial Sequence: Synthetic peptide
  Seed: GTYCLNVSL (PMEL_HUMAN)
GVYCLNVSI

SEQ ID NO: 131599 - protein, 10 aa, Artificial Sequence
  Description of Artificial Sequence: Synthetic peptide
  Seed: RSFVYVWKTW (PMEL_HUMAN)
RWFVYVWKTL

SEQ ID NO: 131600 - protein, 9 aa, Artificial Sequence
  Description of Artificial Sequence: Synthetic peptide
  Seed: GQVPLIVGI (PMEL_HUMAN)
GHVPLIVGL

SEQ ID NO: 131601 - protein, 9 aa, Artificial Sequence
  Description of Artificial Sequence: Synthetic peptide
  Seed: VQMPTAEST (PMEL_HUMAN)
VIMPTAESY

SEQ ID NO: 131602 - protein, 9 aa, Artificial Sequence
  Description of Artificial Sequence: Synthetic peptide
  Seed: AVIGALLAV (PMEL_HUMAN)
AIIGALLAF

SEQ ID NO: 131603 - protein, 9 aa, Artificial Sequence
  Description of Artificial Sequence: Synthetic peptide
  Seed: KVSNDGPTL (PMEL_HUMAN)
KSSNDGPTY

SEQ ID NO: 131604 - protein, 11 aa, Artificial Sequence
  Description of Artificial Sequence: Synthetic peptide
  Seed: GYLAEADLSYT (PMEL_HUMAN)
GVLAEADLSYL

SEQ ID NO: 131605 - protein, 9 aa, Artificial Sequence
  Description of Artificial Sequence: Synthetic peptide
  Seed: HSSSHWLRL (PMEL_HUMAN)
HRSSHWLRL

SEQ ID NO: 131606 - protein, 9 aa, Artificial Sequence
  Description of Artificial Sequence: Synthetic peptide
  Seed: LRNQPLTFA (PMEL_HUMAN)
LRNQPLTFL

SEQ ID NO: 131607 - protein, 9 aa, Artificial Sequence
  Description of Artificial Sequence: Synthetic peptide
  Seed: RGSRSYVPL (PMEL_HUMAN)
RVSRSYVPV

SEQ ID NO: 131608 - protein, 9 aa, Artificial Sequence
  Description of Artificial Sequence: Synthetic peptide
  Seed: AQVVLQAAI (PMEL_HUMAN)
ADVVLQAAL

SEQ ID NO: 131609 - protein, 9 aa, Artificial Sequence
  Description of Artificial Sequence: Synthetic peptide
  Seed: VPSGEGDAF (PMEL_HUMAN)
VPSGEGDAW

SEQ ID NO: 131610 - protein, 10 aa, Artificial Sequence
  Description of Artificial Sequence: Synthetic peptide
  Seed: VPLAHSSSAF (PMEL_HUMAN)
VTLAHSSSAF

SEQ ID NO: 131611 - protein, 9 aa, Artificial Sequence
  Description of Artificial Sequence: Synthetic peptide
  Seed: MTPEKVPVS (PMEL_HUMAN)
MMPEKVPVI

SEQ ID NO: 131612 - protein, 10 aa, Artificial Sequence
  Description of Artificial Sequence: Synthetic peptide
  Seed: RTKAWNRQLY (PMEL_HUMAN)
RSKAWNRQLW

SEQ ID NO: 131613 - protein, 9 aa, Artificial Sequence
  Description of Artificial Sequence: Synthetic peptide
  Seed: LIVGILLVL (PMEL_HUMAN)
LAVGILLVI

SEQ ID NO: 131614 - protein, 10 aa, Artificial Sequence
  Description of Artificial Sequence: Synthetic peptide
  Seed: VLMAVVLASL (PMEL_HUMAN)
VRMAVVLASI

SEQ ID NO: 131615 - protein, 10 aa, Artificial Sequence
  Description of Artificial Sequence: Synthetic peptide
  Seed: KVSNDGPTLI (PMEL_HUMAN)
KQSNDGPTLI

SEQ ID NO: 131616 - protein, 11 aa, Artificial Sequence
  Description of Artificial Sequence: Synthetic peptide
  Seed: RALDGGNKHFL (PMEL_HUMAN)
RTLDGGNKHFW

SEQ ID NO: 131617 - protein, 9 aa, Artificial Sequence
  Description of Artificial Sequence: Synthetic peptide
  Seed: VTLDIVQGI (PMEL_HUMAN)
VLLDIVQGK

SEQ ID NO: 131618 - protein, 10 aa, Artificial Sequence
  Description of Artificial Sequence: Synthetic peptide
  Seed: SVPQLPHSSS (PMEL_HUMAN)
SCPQLPHSSA

SEQ ID NO: 131619 - protein, 10 aa, Artificial Sequence
  Description of Artificial Sequence: Synthetic peptide
  Seed: AVPSGEGDAF (PMEL_HUMAN)
AMPSGEGDAW

SEQ ID NO: 131620 - protein, 10 aa, Artificial Sequence
  Description of Artificial Sequence: Synthetic peptide
  Seed: LGQVPLIVGI (PMEL_HUMAN)
LYQVPLIVGV

SEQ ID NO: 131621 - protein, 9 aa, Artificial Sequence
  Description of Artificial Sequence: Synthetic peptide
  Seed: SGLSIGTGR (PMEL_HUMAN)
SILSIGTGK

SEQ ID NO: 131622 - protein, 8 aa, Artificial Sequence
  Description of Artificial Sequence: Synthetic peptide
  Seed: LHDPSGYL (PMEL_HUMAN)
LQDPSGYL

SEQ ID NO: 131623 - protein, 10 aa, Artificial Sequence
  Description of Artificial Sequence: Synthetic peptide
  Seed: TPAEVSIVVL (PMEL_HUMAN)
TPAEVSIVVF

SEQ ID NO: 131624 - protein, 9 aa, Artificial Sequence
  Description of Artificial Sequence: Synthetic peptide
  Seed: AEMSTPEAT (PMEL_HUMAN)
AEMSTPEAC

SEQ ID NO: 131625 - protein, 9 aa, Artificial Sequence
  Description of Artificial Sequence: Synthetic peptide
  Seed: SQVWGGQPV (PMEL_HUMAN)
SAVWGGQPV

SEQ ID NO: 131626 - protein, 10 aa, Artificial Sequence
  Description of Artificial Sequence: Synthetic peptide
  Seed: SVPQLPHSSS (PMEL_HUMAN)
SNPQLPHSSF

SEQ ID NO: 131627 - protein, 10 aa, Artificial Sequence
  Description of Artificial Sequence: Synthetic peptide
  Seed: GSQVWGGQPV (PMEL_HUMAN)
GMQVWGGQPV

SEQ ID NO: 131628 - protein, 9 aa, Artificial Sequence
  Description of Artificial Sequence: Synthetic peptide
  Seed: VQMPTAEST (PMEL_HUMAN)
VFMPTAESF

SEQ ID NO: 131629 - protein, 10 aa, Artificial Sequence
  Description of Artificial Sequence: Synthetic peptide
  Seed: ALDGGNKHFL (PMEL_HUMAN)
ALDGGNKHFV

SEQ ID NO: 131630 - protein, 10 aa, Artificial Sequence
  Description of Artificial Sequence: Synthetic peptide
  Seed: VVLASLIYRR (PMEL_HUMAN)
VMLASLIYRL

SEQ ID NO: 131631 - protein, 10 aa, Artificial Sequence
  Description of Artificial Sequence: Synthetic peptide
  Seed: TITDQVPFSV (PMEL_HUMAN)
TTTDQVPFSV

SEQ ID NO: 131632 - protein, 9 aa, Artificial Sequence
  Description of Artificial Sequence: Synthetic peptide
  Seed: VQVPTTEVI (PMEL_HUMAN)
VYVPTTEVF

SEQ ID NO: 131633 - protein, 11 aa, Artificial Sequence
  Description of Artificial Sequence: Synthetic peptide
  Seed: FLRNQPLTFAL (PMEL_HUMAN)
FMRNQPLTFAM

SEQ ID NO: 131634 - protein, 11 aa, Artificial Sequence
  Description of Artificial Sequence: Synthetic peptide
  Seed: LGPLLDGTATL (PMEL_HUMAN)
LKPLLDGTATI

SEQ ID NO: 131635 - protein, 10 aa, Artificial Sequence
  Description of Artificial Sequence: Synthetic peptide
  Seed: LVLMAVVLAS (PMEL_HUMAN)
LGLMAVVLAV

SEQ ID NO: 131636 - protein, 11 aa, Artificial Sequence
  Description of Artificial Sequence: Synthetic peptide
  Seed: SQKRSFVYVWK (PMEL_HUMAN)
SSKRSFVYVWK

SEQ ID NO: 131637 - protein, 10 aa, Artificial Sequence
  Description of Artificial Sequence: Synthetic peptide
  Seed: LAHSSSAFTI (PMEL_HUMAN)
LSHSSSAFTF

SEQ ID NO: 131638 - protein, 9 aa, Artificial Sequence
  Description of Artificial Sequence: Synthetic peptide
  Seed: SGLSIGTGR (PMEL_HUMAN)
SILSIGTGR

SEQ ID NO: 131639 - protein, 9 aa, Artificial Sequence
  Description of Artificial Sequence: Synthetic peptide
  Seed: YVWKTWGQY (PMEL_HUMAN)
YHWKTWGQF

SEQ ID NO: 131640 - protein, 10 aa, Artificial Sequence
  Description of Artificial Sequence: Synthetic peptide
  Seed: KVSNDGPTLI (PMEL_HUMAN)
KQSNDGPTLL

SEQ ID NO: 131641 - protein, 10 aa, Artificial Sequence
  Description of Artificial Sequence: Synthetic peptide
  Seed: NSLAVVSTQL (PMEL_HUMAN)
NCLAVVSTQV

SEQ ID NO: 131642 - protein, 9 aa, Artificial Sequence
  Description of Artificial Sequence: Synthetic peptide
  Seed: SGEGDAFEL (PMEL_HUMAN)
SWEGDAFEL

SEQ ID NO: 131643 - protein, 9 aa, Artificial Sequence
  Description of Artificial Sequence: Synthetic peptide
  Seed: HSSSHWLRL (PMEL_HUMAN)
HTSSHWLRY

SEQ ID NO: 131644 - protein, 10 aa, Artificial Sequence
  Description of Artificial Sequence: Synthetic peptide
  Seed: WKTWGQYWQV (PMEL_HUMAN)
WLTWGQYWQA

SEQ ID NO: 131645 - protein, 9 aa, Artificial Sequence
  Description of Artificial Sequence: Synthetic peptide
  Seed: KTWGQYWQV (PMEL_HUMAN)
KCWGQYWQW

SEQ ID NO: 131646 - protein, 11 aa, Artificial Sequence
  Description of Artificial Sequence: Synthetic peptide
  Seed: CVLYRYGSFSV (PMEL_HUMAN)
CALYRYGSFSV

SEQ ID NO: 131647 - protein, 9 aa, Artificial Sequence
  Description of Artificial Sequence: Synthetic peptide
  Seed: PFSVSVSQL (PMEL_HUMAN)
PYSVSVSQF

SEQ ID NO: 131648 - protein, 9 aa, Artificial Sequence
  Description of Artificial Sequence: Synthetic peptide
  Seed: RNQPLTFAL (PMEL_HUMAN)
RQQPLTFAA

SEQ ID NO: 131649 - protein, 9 aa, Artificial Sequence
  Description of Artificial Sequence: Synthetic peptide
  Seed: ALDGGNKHF (PMEL_HUMAN)
ASDGGNKHY

SEQ ID NO: 131650 - protein, 9 aa, Artificial Sequence
  Description of Artificial Sequence: Synthetic peptide
  Seed: VVLASLIYR (PMEL_HUMAN)
VVLASLIYY

SEQ ID NO: 131651 - protein, 9 aa, Artificial Sequence
  Description of Artificial Sequence: Synthetic peptide
  Seed: CQLVLHQIL (PMEL_HUMAN)
CKLVLHQIF

SEQ ID NO: 131652 - protein, 9 aa, Artificial Sequence
  Description of Artificial Sequence: Synthetic peptide
  Seed: VPFSVSVSQ (PMEL_HUMAN)
VVFSVSVSF

SEQ ID NO: 131653 - protein, 9 aa, Artificial Sequence
  Description of Artificial Sequence: Synthetic peptide
  Seed: RAMLGTHTM (PMEL_HUMAN)
RNMLGTHTL

SEQ ID NO: 131654 - protein, 10 aa, Artificial Sequence
  Description of Artificial Sequence: Synthetic peptide
  Seed: EVSIVVLSGT (PMEL_HUMAN)
EDSIVVLSGV

SEQ ID NO: 131655 - protein, 9 aa, Artificial Sequence
  Description of Artificial Sequence: Synthetic peptide
  Seed: QVWGGQPVY (PMEL_HUMAN)
QLWGGQPVF

SEQ ID NO: 131656 - protein, 11 aa, Artificial Sequence
  Description of Artificial Sequence: Synthetic peptide
  Seed: VLGGPVSGLSI (PMEL_HUMAN)
VQGGPVSGLSF

SEQ ID NO: 131657 - protein, 10 aa, Artificial Sequence
  Description of Artificial Sequence: Synthetic peptide
  Seed: SVPQLPHSSS (PMEL_HUMAN)
SEPQLPHSSV

SEQ ID NO: 131658 - protein, 9 aa, Artificial Sequence
  Description of Artificial Sequence: Synthetic peptide
  Seed: FGDSSGTLI (PMEL_HUMAN)
FWDSSGTLI

SEQ ID NO: 131659 - protein, 9 aa, Artificial Sequence
  Description of Artificial Sequence: Synthetic peptide
  Seed: VLPDGQVIW (PMEL_HUMAN)
VLPDGQVIM

SEQ ID NO: 131660 - protein, 10 aa, Artificial Sequence
  Description of Artificial Sequence: Synthetic peptide
  Seed: SVPQLPHSSS (PMEL_HUMAN)
SFPQLPHSSL

SEQ ID NO: 131661 - protein, 9 aa, Artificial Sequence
  Description of Artificial Sequence: Synthetic peptide
  Seed: QVWGGQPVY (PMEL_HUMAN)
QPWGGQPVY

SEQ ID NO: 131662 - protein, 9 aa, Artificial Sequence
  Description of Artificial Sequence: Synthetic peptide
  Seed: YLAEADLSY (PMEL_HUMAN)
YYAEADLSV

SEQ ID NO: 131663 - protein, 11 aa, Artificial Sequence
  Description of Artificial Sequence: Synthetic peptide
  Seed: SYVPLAHSSSA (PMEL_HUMAN)
SVVPLAHSSSM

SEQ ID NO: 131664 - protein, 10 aa, Artificial Sequence
  Description of Artificial Sequence: Synthetic peptide
  Seed: VLMAVVLASL (PMEL_HUMAN)
VAMAVVLASY

SEQ ID NO: 131665 - protein, 10 aa, Artificial Sequence
  Description of Artificial Sequence: Synthetic peptide
  Seed: MSTESITGSL (PMEL_HUMAN)
MFTESITGSV

SEQ ID NO: 131666 - protein, 10 aa, Artificial Sequence
  Description of Artificial Sequence: Synthetic peptide
  Seed: LHLAVIGALL (PMEL_HUMAN)
LYLAVIGALI

SEQ ID NO: 131667 - protein, 10 aa, Artificial Sequence
  Description of Artificial Sequence: Synthetic peptide
  Seed: YRYGSFSVTL (PMEL_HUMAN)
YVYGSFSVTF

SEQ ID NO: 131668 - protein, 10 aa, Artificial Sequence
  Description of Artificial Sequence: Synthetic peptide
  Seed: YLAEADLSYT (PMEL_HUMAN)
YAAEADLSYI

SEQ ID NO: 131669 - protein, 9 aa, Artificial Sequence
  Description of Artificial Sequence: Synthetic peptide
  Seed: GEGDAFELT (PMEL_HUMAN)
GEGDAFELI

SEQ ID NO: 131670 - protein, 9 aa, Artificial Sequence
  Description of Artificial Sequence: Synthetic peptide
  Seed: AEPSGTTSV (PMEL_HUMAN)
ALPSGTTSL

SEQ ID NO: 131671 - protein, 10 aa, Artificial Sequence
  Description of Artificial Sequence: Synthetic peptide
  Seed: AMLGTHTMEV (PMEL_HUMAN)
ACLGTHTMEV

SEQ ID NO: 131672 - protein, 10 aa, Artificial Sequence
  Description of Artificial Sequence: Synthetic peptide
  Seed: VPQLPHSSSH (PMEL_HUMAN)
VLQLPHSSSM

SEQ ID NO: 131673 - protein, 9 aa, Artificial Sequence
  Description of Artificial Sequence: Synthetic peptide
  Seed: VLPDGQVIW (PMEL_HUMAN)
VSPDGQVIV

SEQ ID NO: 131674 - protein, 9 aa, Artificial Sequence
  Description of Artificial Sequence: Synthetic peptide
  Seed: STAPVQMPT (PMEL_HUMAN)
SVAPVQMPL

SEQ ID NO: 131675 - protein, 9 aa, Artificial Sequence
  Description of Artificial Sequence: Synthetic peptide
  Seed: MLGTHTMEV (PMEL_HUMAN)
MSGTHTMEV

SEQ ID NO: 131676 - protein, 9 aa, Artificial Sequence
  Description of Artificial Sequence: Synthetic peptide
  Seed: RGGQVSLKV (PMEL_HUMAN)
RTGQVSLKI

SEQ ID NO: 131677 - protein, 10 aa, Artificial Sequence
  Description of Artificial Sequence: Synthetic peptide
  Seed: RGSRSYVPLA (PMEL_HUMAN)
RPSRSYVPLK

SEQ ID NO: 131678 - protein, 9 aa, Artificial Sequence
  Description of Artificial Sequence: Synthetic peptide
  Seed: TWGQYWQVL (PMEL_HUMAN)
TFGQYWQVW

SEQ ID NO: 131679 - protein, 9 aa, Artificial Sequence
  Description of Artificial Sequence: Synthetic peptide
  Seed: KTWGQYWQV (PMEL_HUMAN)
KAWGQYWQV

SEQ ID NO: 131680 - protein, 8 aa, Artificial Sequence
  Description of Artificial Sequence: Synthetic peptide
  Seed: FGDSSGTL (PMEL_HUMAN)
FADSSGTL

SEQ ID NO: 131681 - protein, 9 aa, Artificial Sequence
  Description of Artificial Sequence: Synthetic peptide
  Seed: AEPSGTTSV (PMEL_HUMAN)
AAPSGTTSF

SEQ ID NO: 131682 - protein, 8 aa, Artificial Sequence
  Description of Artificial Sequence: Synthetic peptide
  Seed: QDFSVPQL (PMEL_HUMAN)
QQFSVPQL

SEQ ID NO: 131683 - protein, 10 aa, Artificial Sequence
  Description of Artificial Sequence: Synthetic peptide
  Seed: GPLLDGTATL (PMEL_HUMAN)
GVLLDGTATI

SEQ ID NO: 131684 - protein, 10 aa, Artificial Sequence
  Description of Artificial Sequence: Synthetic peptide
  Seed: NKHFLRNQPL (PMEL_HUMAN)
NRHFLRNQPL

SEQ ID NO: 131685 - protein, 9 aa, Artificial Sequence
  Description of Artificial Sequence: Synthetic peptide
  Seed: VVLQAAIPL (PMEL_HUMAN)
VQLQAAIPH

SEQ ID NO: 131686 - protein, 10 aa, Artificial Sequence
  Description of Artificial Sequence: Synthetic peptide
  Seed: ESAEILQAVP (PMEL_HUMAN)
ETAEILQAVK

SEQ ID NO: 131687 - protein, 10 aa, Artificial Sequence
  Description of Artificial Sequence: Synthetic peptide
  Seed: ESITGSLGPL (PMEL_HUMAN)
EAITGSLGPK

SEQ ID NO: 131688 - protein, 9 aa, Artificial Sequence
  Description of Artificial Sequence: Synthetic peptide
  Seed: ILKGGSGTY (PMEL_HUMAN)
IFKGGSGTF

SEQ ID NO: 131689 - protein, 9 aa, Artificial Sequence
  Description of Artificial Sequence: Synthetic peptide
  Seed: SFVYVWKTW (PMEL_HUMAN)
STVYVWKTW

SEQ ID NO: 131690 - protein, 9 aa, Artificial Sequence
  Description of Artificial Sequence: Synthetic peptide
  Seed: VQMPTAEST (PMEL_HUMAN)
VAMPTAESV

SEQ ID NO: 131691 - protein, 9 aa, Artificial Sequence
  Description of Artificial Sequence: Synthetic peptide
  Seed: LAVVSTQLI (PMEL_HUMAN)
LTVVSTQLW

SEQ ID NO: 131692 - protein, 10 aa, Artificial Sequence
  Description of Artificial Sequence: Synthetic peptide
  Seed: SGTYCLNVSL (PMEL_HUMAN)
SGTYCLNVSW

SEQ ID NO: 131693 - protein, 11 aa, Artificial Sequence
  Description of Artificial Sequence: Synthetic peptide
  Seed: KVLPDGQVIWV (PMEL_HUMAN)
KALPDGQVIWL

SEQ ID NO: 131694 - protein, 8 aa, Artificial Sequence
  Description of Artificial Sequence: Synthetic peptide
  Seed: SEVMGTTL (PMEL_HUMAN)
SHVMGTTL

SEQ ID NO: 131695 - protein, 10 aa, Artificial Sequence
  Description of Artificial Sequence: Synthetic peptide
  Seed: RQLYPEWTEA (PMEL_HUMAN)
RELYPEWTEI

SEQ ID NO: 131696 - protein, 8 aa, Artificial Sequence
  Description of Artificial Sequence: Synthetic peptide
  Seed: SIGTGRAM (PMEL_HUMAN)
SSGTGRAL

SEQ ID NO: 131697 - protein, 9 aa, Artificial Sequence
  Description of Artificial Sequence: Synthetic peptide
  Seed: SVQVPTTEV (PMEL_HUMAN)
STQVPTTEM

SEQ ID NO: 131698 - protein, 9 aa, Artificial Sequence
  Description of Artificial Sequence: Synthetic peptide
  Seed: LMAVVLASL (PMEL_HUMAN)
LAAVVLASI

SEQ ID NO: 131699 - protein, 9 aa, Artificial Sequence
  Description of Artificial Sequence: Synthetic peptide
  Seed: SSIMSTESI (PMEL_HUMAN)
SNIMSTESF

SEQ ID NO: 131700 - protein, 10 aa, Artificial Sequence
  Description of Artificial Sequence: Synthetic peptide
  Seed: WKTWGQYWQV (PMEL_HUMAN)
WLTWGQYWQT

SEQ ID NO: 131701 - protein, 10 aa, Artificial Sequence
  Description of Artificial Sequence: Synthetic peptide
  Seed: YLAEADLSYT (PMEL_HUMAN)
YTAEADLSYY

SEQ ID NO: 131702 - protein, 9 aa, Artificial Sequence
  Description of Artificial Sequence: Synthetic peptide
  Seed: TAQVVLQAA (PMEL_HUMAN)
THQVVLQAV

SEQ ID NO: 131703 - protein, 9 aa, Artificial Sequence
  Description of Artificial Sequence: Synthetic peptide
  Seed: SQKRSFVYV (PMEL_HUMAN)
SMKRSFVYS

SEQ ID NO: 131704 - protein, 9 aa, Artificial Sequence
  Description of Artificial Sequence: Synthetic peptide
  Seed: RNQPLTFAL (PMEL_HUMAN)
RRQPLTFAL

SEQ ID NO: 131705 - protein, 9 aa, Artificial Sequence
  Description of Artificial Sequence: Synthetic peptide
  Seed: AQRLCQPVL (PMEL_HUMAN)
AYRLCQPVA

SEQ ID NO: 131706 - protein, 9 aa, Artificial Sequence
  Description of Artificial Sequence: Synthetic peptide
  Seed: RSYVPLAHS (PMEL_HUMAN)
RSYVPLAHK

SEQ ID NO: 131707 - protein, 9 aa, Artificial Sequence
  Description of Artificial Sequence: Synthetic peptide
  Seed: IYRRRLMKQ (PMEL_HUMAN)
IFRRRLMKK

SEQ ID NO: 131708 - protein, 11 aa, Artificial Sequence
  Description of Artificial Sequence: Synthetic peptide
  Seed: SYVPLAHSSSA (PMEL_HUMAN)
SHVPLAHSSSM

SEQ ID NO: 131709 - protein, 9 aa, Artificial Sequence
  Description of Artificial Sequence: Synthetic peptide
  Seed: SGLSIGTGR (PMEL_HUMAN)
SSLSIGTGR

SEQ ID NO: 131710 - protein, 11 aa, Artificial Sequence
  Description of Artificial Sequence: Synthetic peptide
  Seed: FTITDQVPFSV (PMEL_HUMAN)
FLITDQVPFSM

SEQ ID NO: 131711 - protein, 9 aa, Artificial Sequence
  Description of Artificial Sequence: Synthetic peptide
  Seed: ALVVTHTYL (PMEL_HUMAN)
AAVVTHTYF

SEQ ID NO: 131712 - protein, 9 aa, Artificial Sequence
  Description of Artificial Sequence: Synthetic peptide
  Seed: TIINGSQVW (PMEL_HUMAN)
TLINGSQVW

SEQ ID NO: 131713 - protein, 10 aa, Artificial Sequence
  Description of Artificial Sequence: Synthetic peptide
  Seed: SSSHWLRLPR (PMEL_HUMAN)
SKSHWLRLPK

SEQ ID NO: 131714 - protein, 9 aa, Artificial Sequence
  Description of Artificial Sequence: Synthetic peptide
  Seed: EGDAFELTV (PMEL_HUMAN)
ELDAFELTL

SEQ ID NO: 131715 - protein, 9 aa, Artificial Sequence
  Description of Artificial Sequence: Synthetic peptide
  Seed: RYGSFSVTL (PMEL_HUMAN)
RMGSFSVTW

SEQ ID NO: 131716 - protein, 10 aa, Artificial Sequence
  Description of Artificial Sequence: Synthetic peptide
  Seed: MPTAESTGMT (PMEL_HUMAN)
MHTAESTGMA

SEQ ID NO: 131717 - protein, 9 aa, Artificial Sequence
  Description of Artificial Sequence: Synthetic peptide
  Seed: KVSNDGPTL (PMEL_HUMAN)
KMSNDGPTK

SEQ ID NO: 131718 - protein, 9 aa, Artificial Sequence
  Description of Artificial Sequence: Synthetic peptide
  Seed: RLVKRQVPL (PMEL_HUMAN)
RIVKRQVPF

SEQ ID NO: 131719 - protein, 9 aa, Artificial Sequence
  Description of Artificial Sequence: Synthetic peptide
  Seed: KQDFSVPQL (PMEL_HUMAN)
KVDFSVPQL

SEQ ID NO: 131720 - protein, 9 aa, Artificial Sequence
  Description of Artificial Sequence: Synthetic peptide
  Seed: AAQVTTTEW (PMEL_HUMAN)
AMQVTTTEY

SEQ ID NO: 131721 - protein, 9 aa, Artificial Sequence
  Description of Artificial Sequence: Synthetic peptide
  Seed: VLPDGQVIW (PMEL_HUMAN)
VSPDGQVIM

SEQ ID NO: 131722 - protein, 9 aa, Artificial Sequence
  Description of Artificial Sequence: Synthetic peptide
  Seed: GGPVSGLSI (PMEL_HUMAN)
GVPVSGLSI

SEQ ID NO: 131723 - protein, 9 aa, Artificial Sequence
  Description of Artificial Sequence: Synthetic peptide
  Seed: LMAVVLASL (PMEL_HUMAN)
LMAVVLASS

SEQ ID NO: 131724 - protein, 10 aa, Artificial Sequence
  Description of Artificial Sequence: Synthetic peptide
  Seed: CLLHLAVIGA (PMEL_HUMAN)
CMLHLAVIGL

SEQ ID NO: 131725 - protein, 10 aa, Artificial Sequence
  Description of Artificial Sequence: Synthetic peptide
  Seed: YVPLAHSSSA (PMEL_HUMAN)
YDPLAHSSSF

SEQ ID NO: 131726 - protein, 9 aa, Artificial Sequence
  Description of Artificial Sequence: Synthetic peptide
  Seed: SQKRSFVYV (PMEL_HUMAN)
SSKRSFVYL

SEQ ID NO: 131727 - protein, 10 aa, Artificial Sequence
  Description of Artificial Sequence: Synthetic peptide
  Seed: GSRSYVPLAH (PMEL_HUMAN)
GTRSYVPLAA

SEQ ID NO: 131728 - protein, 10 aa, Artificial Sequence
  Description of Artificial Sequence: Synthetic peptide
  Seed: LLDGTATLRL (PMEL_HUMAN)
LADGTATLRM

SEQ ID NO: 131729 - protein, 10 aa, Artificial Sequence
  Description of Artificial Sequence: Synthetic peptide
  Seed: AEMSTPEATG (PMEL_HUMAN)
AEMSTPEATS

SEQ ID NO: 131730 - protein, 10 aa, Artificial Sequence
  Description of Artificial Sequence: Synthetic peptide
  Seed: DGTATLRLVK (PMEL_HUMAN)
DPTATLRLVR

SEQ ID NO: 131731 - protein, 8 aa, Artificial Sequence
  Description of Artificial Sequence: Synthetic peptide
  Seed: TLDIVQGI (PMEL_HUMAN)
TADIVQGV

SEQ ID NO: 131732 - protein, 10 aa, Artificial Sequence
  Description of Artificial Sequence: Synthetic peptide
  Seed: QVPLDCVLYR (PMEL_HUMAN)
QIPLDCVLYR

SEQ ID NO: 131733 - protein, 10 aa, Artificial Sequence
  Description of Artificial Sequence: Synthetic peptide
  Seed: AVIGALLAVG (PMEL_HUMAN)
AQIGALLAVQ

SEQ ID NO: 131734 - protein, 9 aa, Artificial Sequence
  Description of Artificial Sequence: Synthetic peptide
  Seed: STAPVQMPT (PMEL_HUMAN)
SIAPVQMPV

SEQ ID NO: 131735 - protein, 9 aa, Artificial Sequence
  Description of Artificial Sequence: Synthetic peptide
  Seed: AEPSGTTSV (PMEL_HUMAN)
AAPSGTTSY

SEQ ID NO: 131736 - protein, 10 aa, Artificial Sequence
  Description of Artificial Sequence: Synthetic peptide
  Seed: HTMEVTVYHR (PMEL_HUMAN)
HNMEVTVYHK

SEQ ID NO: 131737 - protein, 10 aa, Artificial Sequence
  Description of Artificial Sequence: Synthetic peptide
  Seed: AVIGALLAVG (PMEL_HUMAN)
AQIGALLAVT

SEQ ID NO: 131738 - protein, 10 aa, Artificial Sequence
  Description of Artificial Sequence: Synthetic peptide
  Seed: ALLAVGATKV (PMEL_HUMAN)
AYLAVGATKV

SEQ ID NO: 131739 - protein, 10 aa, Artificial Sequence
  Description of Artificial Sequence: Synthetic peptide
  Seed: GPLLDGTATL (PMEL_HUMAN)
GYLLDGTATI

SEQ ID NO: 131740 - protein, 10 aa, Artificial Sequence
  Description of Artificial Sequence: Synthetic peptide
  Seed: YRYGSFSVTL (PMEL_HUMAN)
YNYGSFSVTI

SEQ ID NO: 131741 - protein, 9 aa, Artificial Sequence
  Description of Artificial Sequence: Synthetic peptide
  Seed: ALDGGNKHF (PMEL_HUMAN)
AADGGNKHW

SEQ ID NO: 131742 - protein, 9 aa, Artificial Sequence
  Description of Artificial Sequence: Synthetic peptide
  Seed: TAPVQMPTA (PMEL_HUMAN)
TPPVQMPTI

SEQ ID NO: 131743 - protein, 9 aa, Artificial Sequence
  Description of Artificial Sequence: Synthetic peptide
  Seed: EVVGTTPGQ (PMEL_HUMAN)
ESVGTTPGK

SEQ ID NO: 131744 - protein, 9 aa, Artificial Sequence
  Description of Artificial Sequence: Synthetic peptide
  Seed: SQKRSFVYV (PMEL_HUMAN)
SSKRSFVYF

SEQ ID NO: 131745 - protein, 11 aa, Artificial Sequence
  Description of Artificial Sequence: Synthetic peptide
  Seed: RQVPLDCVLYR (PMEL_HUMAN)
RMVPLDCVLYK

SEQ ID NO: 131746 - protein, 9 aa, Artificial Sequence
  Description of Artificial Sequence: Synthetic peptide
  Seed: DIVQGIESA (PMEL_HUMAN)
DVVQGIESI

SEQ ID NO: 131747 - protein, 9 aa, Artificial Sequence
  Description of Artificial Sequence: Synthetic peptide
  Seed: EVMGTTLAE (PMEL_HUMAN)
EVMGTTLAR

SEQ ID NO: 131748 - protein, 10 aa, Artificial Sequence
  Description of Artificial Sequence: Synthetic peptide
  Seed: QVPLDCVLYR (PMEL_HUMAN)
QMPLDCVLYK

SEQ ID NO: 131749 - protein, 9 aa, Artificial Sequence
  Description of Artificial Sequence: Synthetic peptide
  Seed: ITDQVPFSV (PMEL_HUMAN)
ICDQVPFSF

SEQ ID NO: 131750 - protein, 9 aa, Artificial Sequence
  Description of Artificial Sequence: Synthetic peptide
  Seed: AAQVTTTEW (PMEL_HUMAN)
AAQVTTTEH

SEQ ID NO: 131751 - protein, 10 aa, Artificial Sequence
  Description of Artificial Sequence: Synthetic peptide
  Seed: MTPAEVSIVV (PMEL_HUMAN)
MHPAEVSIVW

SEQ ID NO: 131752 - protein, 9 aa, Artificial Sequence
  Description of Artificial Sequence: Synthetic peptide
  Seed: ITGSLGPLL (PMEL_HUMAN)
IMGSLGPLV

SEQ ID NO: 131753 - protein, 9 aa, Artificial Sequence
  Description of Artificial Sequence: Synthetic peptide
  Seed: KTWGQYWQV (PMEL_HUMAN)
KMWGQYWQY

SEQ ID NO: 131754 - protein, 10 aa, Artificial Sequence
  Description of Artificial Sequence: Synthetic peptide
  Seed: YRYGSFSVTL (PMEL_HUMAN)
YWYGSFSVTV

SEQ ID NO: 131755 - protein, 10 aa, Artificial Sequence
  Description of Artificial Sequence: Synthetic peptide
  Seed: SGTYCLNVSL (PMEL_HUMAN)
STTYCLNVSW

SEQ ID NO: 131756 - protein, 11 aa, Artificial Sequence
  Description of Artificial Sequence: Synthetic peptide
  Seed: RRRLMKQDFSV (PMEL_HUMAN)
RRRLMKQDFSL

SEQ ID NO: 131757 - protein, 9 aa, Artificial Sequence
  Description of Artificial Sequence: Synthetic peptide
  Seed: VQVPTTEVI (PMEL_HUMAN)
VKVPTTEVL

SEQ ID NO: 131758 - protein, 10 aa, Artificial Sequence
  Description of Artificial Sequence: Synthetic peptide
  Seed: SQKRSFVYVW (PMEL_HUMAN)
SAKRSFVYVW

SEQ ID NO: 131759 - protein, 11 aa, Artificial Sequence
  Description of Artificial Sequence: Synthetic peptide
  Seed: ASLIYRRRLMK (PMEL_HUMAN)
AMLIYRRRLMK

SEQ ID NO: 131760 - protein, 10 aa, Artificial Sequence
  Description of Artificial Sequence: Synthetic peptide
  Seed: LVLMAVVLAS (PMEL_HUMAN)
LRLMAVVLAA

SEQ ID NO: 131761 - protein, 9 aa, Artificial Sequence
  Description of Artificial Sequence: Synthetic peptide
  Seed: SQVWGGQPV (PMEL_HUMAN)
SRVWGGQPM

SEQ ID NO: 131762 - protein, 9 aa, Artificial Sequence
  Description of Artificial Sequence: Synthetic peptide
  Seed: VISTAPVQM (PMEL_HUMAN)
VSSTAPVQF

SEQ ID NO: 131763 - protein, 9 aa, Artificial Sequence
  Description of Artificial Sequence: Synthetic peptide
  Seed: QVIWVNNTI (PMEL_HUMAN)
QIIWVNNTI

SEQ ID NO: 131764 - protein, 9 aa, Artificial Sequence
  Description of Artificial Sequence: Synthetic peptide
  Seed: ALNFPGSQK (PMEL_HUMAN)
AMNFPGSQK

SEQ ID NO: 131765 - protein, 10 aa, Artificial Sequence
  Description of Artificial Sequence: Synthetic peptide
  Seed: YGSFSVTLDI (PMEL_HUMAN)
YNSFSVTLDW

SEQ ID NO: 131766 - protein, 9 aa, Artificial Sequence
  Description of Artificial Sequence: Synthetic peptide
  Seed: AEADLSYTW (PMEL_HUMAN)
ADADLSYTM

SEQ ID NO: 131767 - protein, 9 aa, Artificial Sequence
  Description of Artificial Sequence: Synthetic peptide
  Seed: AAIPLTSCG (PMEL_HUMAN)
AVIPLTSCF

SEQ ID NO: 131768 - protein, 9 aa, Artificial Sequence
  Description of Artificial Sequence: Synthetic peptide
  Seed: QETDDACIF (PMEL_HUMAN)
QETDDACIL

SEQ ID NO: 131769 - protein, 9 aa, Artificial Sequence
  Description of Artificial Sequence: Synthetic peptide
  Seed: QKRSFVYVW (PMEL_HUMAN)
QARSFVYVF

SEQ ID NO: 131770 - protein, 9 aa, Artificial Sequence
  Description of Artificial Sequence: Synthetic peptide
  Seed: AQRLCQPVL (PMEL_HUMAN)
AIRLCQPVA

SEQ ID NO: 131771 - protein, 10 aa, Artificial Sequence
  Description of Artificial Sequence: Synthetic peptide
  Seed: ELTVSCQGGL (PMEL_HUMAN)
EMTVSCQGGV

SEQ ID NO: 131772 - protein, 9 aa, Artificial Sequence
  Description of Artificial Sequence: Synthetic peptide
  Seed: VQVPTTEVI (PMEL_HUMAN)
VKVPTTEVF

SEQ ID NO: 131773 - protein, 9 aa, Artificial Sequence
  Description of Artificial Sequence: Synthetic peptide
  Seed: RTKAWNRQL (PMEL_HUMAN)
RSKAWNRQM

SEQ ID NO: 131774 - protein, 9 aa, Artificial Sequence
  Description of Artificial Sequence: Synthetic peptide
  Seed: ISRALVVTH (PMEL_HUMAN)
ITRALVVTA

SEQ ID NO: 131775 - protein, 9 aa, Artificial Sequence
  Description of Artificial Sequence: Synthetic peptide
  Seed: STAPVQMPT (PMEL_HUMAN)
SQAPVQMPI

SEQ ID NO: 131776 - protein, 11 aa, Artificial Sequence
  Description of Artificial Sequence: Synthetic peptide
  Seed: KVLPDGQVIWV (PMEL_HUMAN)
KVLPDGQVIWY

SEQ ID NO: 131777 - protein, 10 aa, Artificial Sequence
  Description of Artificial Sequence: Synthetic peptide
  Seed: FSVSVSQLRA (PMEL_HUMAN)
FWVSVSQLRR

SEQ ID NO: 131778 - protein, 9 aa, Artificial Sequence
  Description of Artificial Sequence: Synthetic peptide
  Seed: KHFLRNQPL (PMEL_HUMAN)
KSFLRNQPY

SEQ ID NO: 131779 - protein, 9 aa, Artificial Sequence
  Description of Artificial Sequence: Synthetic peptide
  Seed: AHSSSAFTI (PMEL_HUMAN)
ASSSSAFTY

SEQ ID NO: 131780 - protein, 10 aa, Artificial Sequence
  Description of Artificial Sequence: Synthetic peptide
  Seed: GLSIGTGRAM (PMEL_HUMAN)
GLSIGTGRAF

SEQ ID NO: 131781 - protein, 9 aa, Artificial Sequence
  Description of Artificial Sequence: Synthetic peptide
  Seed: LMAVVLASL (PMEL_HUMAN)
LTAVVLASM

SEQ ID NO: 131782 - protein, 9 aa, Artificial Sequence
  Description of Artificial Sequence: Synthetic peptide
  Seed: VSLADTNSL (PMEL_HUMAN)
VMLADTNSW

SEQ ID NO: 131783 - protein, 10 aa, Artificial Sequence
  Description of Artificial Sequence: Synthetic peptide
  Seed: VLPDGQVIWV (PMEL_HUMAN)
VMPDGQVIWL

SEQ ID NO: 131784 - protein, 10 aa, Artificial Sequence
  Description of Artificial Sequence: Synthetic peptide
  Seed: QVLGGPVSGL (PMEL_HUMAN)
QALGGPVSGW

SEQ ID NO: 131785 - protein, 10 aa, Artificial Sequence
  Description of Artificial Sequence: Synthetic peptide
  Seed: TLAEMSTPEA (PMEL_HUMAN)
TLAEMSTPEM

SEQ ID NO: 131786 - protein, 9 aa, Artificial Sequence
  Description of Artificial Sequence: Synthetic peptide
  Seed: VPQLPHSSS (PMEL_HUMAN)
VPQLPHSSM

SEQ ID NO: 131787 - protein, 9 aa, Artificial Sequence
  Description of Artificial Sequence: Synthetic peptide
  Seed: SAFTITDQV (PMEL_HUMAN)
SSFTITDQY

SEQ ID NO: 131788 - protein, 10 aa, Artificial Sequence
  Description of Artificial Sequence: Synthetic peptide
  Seed: ALLAVGATKV (PMEL_HUMAN)
AMLAVGATKL

SEQ ID NO: 131789 - protein, 9 aa, Artificial Sequence
  Description of Artificial Sequence: Synthetic peptide
  Seed: HSSSHWLRL (PMEL_HUMAN)
HVSSHWLRF

SEQ ID NO: 131790 - protein, 9 aa, Artificial Sequence
  Description of Artificial Sequence: Synthetic peptide
  Seed: GMTPAEVSI (PMEL_HUMAN)
GATPAEVSM

SEQ ID NO: 131791 - protein, 9 aa, Artificial Sequence
  Description of Artificial Sequence: Synthetic peptide
  Seed: QVIWVNNTI (PMEL_HUMAN)
QVIWVNNTF

SEQ ID NO: 131792 - protein, 9 aa, Artificial Sequence
  Description of Artificial Sequence: Synthetic peptide
  Seed: HWLRLPRIF (PMEL_HUMAN)
HFLRLPRIL

SEQ ID NO: 131793 - protein, 9 aa, Artificial Sequence
  Description of Artificial Sequence: Synthetic peptide
  Seed: MLGTHTMEV (PMEL_HUMAN)
MMGTHTMER

SEQ ID NO: 131794 - protein, 9 aa, Artificial Sequence
  Description of Artificial Sequence: Synthetic peptide
  Seed: TVYHRRGSR (PMEL_HUMAN)
TFYHRRGSR

SEQ ID NO: 131795 - protein, 9 aa, Artificial Sequence
  Description of Artificial Sequence: Synthetic peptide
  Seed: VLGGPVSGL (PMEL_HUMAN)
VLGGPVSGA

SEQ ID NO: 131796 - protein, 10 aa, Artificial Sequence
  Description of Artificial Sequence: Synthetic peptide
  Seed: ESITGSLGPL (PMEL_HUMAN)
ETITGSLGPW

SEQ ID NO: 131797 - protein, 10 aa, Artificial Sequence
  Description of Artificial Sequence: Synthetic peptide
  Seed: RALDGGNKHF (PMEL_HUMAN)
RVLDGGNKHV

SEQ ID NO: 131798 - protein, 9 aa, Artificial Sequence
  Description of Artificial Sequence: Synthetic peptide
  Seed: HTMEVTVYH (PMEL_HUMAN)
HTMEVTVYW

SEQ ID NO: 131799 - protein, 9 aa, Artificial Sequence
  Description of Artificial Sequence: Synthetic peptide
  Seed: AVIGALLAV (PMEL_HUMAN)
ARIGALLAM

SEQ ID NO: 131800 - protein, 10 aa, Artificial Sequence
  Description of Artificial Sequence: Synthetic peptide
  Seed: ASSIMSTESI (PMEL_HUMAN)
ASSIMSTESF

SEQ ID NO: 131801 - protein, 10 aa, Artificial Sequence
  Description of Artificial Sequence: Synthetic peptide
  Seed: LDGGNKHFLR (PMEL_HUMAN)
LIGGNKHFLR

SEQ ID NO: 131802 - protein, 9 aa, Artificial Sequence
  Description of Artificial Sequence: Synthetic peptide
  Seed: RALVVTHTY (PMEL_HUMAN)
RPLVVTHTM

SEQ ID NO: 131803 - protein, 9 aa, Artificial Sequence
  Description of Artificial Sequence: Synthetic peptide
  Seed: QAAIPLTSC (PMEL_HUMAN)
QAAIPLTSV

SEQ ID NO: 131804 - protein, 9 aa, Artificial Sequence
  Description of Artificial Sequence: Synthetic peptide
  Seed: TDQVPFSVS (PMEL_HUMAN)
TEQVPFSVP

SEQ ID NO: 131805 - protein, 11 aa, Artificial Sequence
  Description of Artificial Sequence: Synthetic peptide
  Seed: DCWRGGQVSLK (PMEL_HUMAN)
DVWRGGQVSLR

SEQ ID NO: 131806 - protein, 9 aa, Artificial Sequence
  Description of Artificial Sequence: Synthetic peptide
  Seed: KHFLRNQPL (PMEL_HUMAN)
KMFLRNQPY

SEQ ID NO: 131807 - protein, 9 aa, Artificial Sequence
  Description of Artificial Sequence: Synthetic peptide
  Seed: DAFELTVSC (PMEL_HUMAN)
DPFELTVSV

SEQ ID NO: 131808 - protein, 9 aa, Artificial Sequence
  Description of Artificial Sequence: Synthetic peptide
  Seed: ILKGGSGTY (PMEL_HUMAN)
IKKGGSGTY

SEQ ID NO: 131809 - protein, 8 aa, Artificial Sequence
  Description of Artificial Sequence: Synthetic peptide
  Seed: LADTNSLA (PMEL_HUMAN)
LADTNSLL

SEQ ID NO: 131810 - protein, 9 aa, Artificial Sequence
  Description of Artificial Sequence: Synthetic peptide
  Seed: VVLSGTTAA (PMEL_HUMAN)
VPLSGTTAL

SEQ ID NO: 131811 - protein, 9 aa, Artificial Sequence
  Description of Artificial Sequence: Synthetic peptide
  Seed: VQVPTTEVI (PMEL_HUMAN)
VYVPTTEVM

SEQ ID NO: 131812 - protein, 10 aa, Artificial Sequence
  Description of Artificial Sequence: Synthetic peptide
  Seed: MTPAEVSIVV (PMEL_HUMAN)
MIPAEVSIVL

SEQ ID NO: 131813 - protein, 9 aa, Artificial Sequence
  Description of Artificial Sequence: Synthetic peptide
  Seed: SAFTITDQV (PMEL_HUMAN)
STFTITDQW

SEQ ID NO: 131814 - protein, 8 aa, Artificial Sequence
  Description of Artificial Sequence: Synthetic peptide
  Seed: SNDGPTLI (PMEL_HUMAN)
STDGPTLM

SEQ ID NO: 131815 - protein, 9 aa, Artificial Sequence
  Description of Artificial Sequence: Synthetic peptide
  Seed: KTWGQYWQV (PMEL_HUMAN)
KAWGQYWQY

SEQ ID NO: 131816 - protein, 10 aa, Artificial Sequence
  Description of Artificial Sequence: Synthetic peptide
  Seed: ESAEILQAVP (PMEL_HUMAN)
ETAEILQAVA

SEQ ID NO: 131817 - protein, 9 aa, Artificial Sequence
  Description of Artificial Sequence: Synthetic peptide
  Seed: ALNFPGSQK (PMEL_HUMAN)
ATNFPGSQF

SEQ ID NO: 131818 - protein, 10 aa, Artificial Sequence
  Description of Artificial Sequence: Synthetic peptide
  Seed: ASSIMSTESI (PMEL_HUMAN)
AVSIMSTESF

SEQ ID NO: 131819 - protein, 9 aa, Artificial Sequence
  Description of Artificial Sequence: Synthetic peptide
  Seed: AQRLCQPVL (PMEL_HUMAN)
AMRLCQPVA

SEQ ID NO: 131820 - protein, 9 aa, Artificial Sequence
  Description of Artificial Sequence: Synthetic peptide
  Seed: DGGNKHFLR (PMEL_HUMAN)
DTGNKHFLR

SEQ ID NO: 131821 - protein, 10 aa, Artificial Sequence
  Description of Artificial Sequence: Synthetic peptide
  Seed: VPQLPHSSSH (PMEL_HUMAN)
VMQLPHSSSY

SEQ ID NO: 131822 - protein, 11 aa, Artificial Sequence
  Description of Artificial Sequence: Synthetic peptide
  Seed: YVPLAHSSSAF (PMEL_HUMAN)
YIPLAHSSSAF

SEQ ID NO: 131823 - protein, 9 aa, Artificial Sequence
  Description of Artificial Sequence: Synthetic peptide
  Seed: ASFSIALNF (PMEL_HUMAN)
ANFSIALNY

SEQ ID NO: 131824 - protein, 11 aa, Artificial Sequence
  Description of Artificial Sequence: Synthetic peptide
  Seed: QAVPSGEGDAF (PMEL_HUMAN)
QVVPSGEGDAY

SEQ ID NO: 131825 - protein, 10 aa, Artificial Sequence
  Description of Artificial Sequence: Synthetic peptide
  Seed: LVLMAVVLAS (PMEL_HUMAN)
LFLMAVVLAI

SEQ ID NO: 131826 - protein, 9 aa, Artificial Sequence
  Description of Artificial Sequence: Synthetic peptide
  Seed: RNQPLTFAL (PMEL_HUMAN)
RAQPLTFAI

SEQ ID NO: 131827 - protein, 11 aa, Artificial Sequence
  Description of Artificial Sequence: Synthetic peptide
  Seed: LGPLLDGTATL (PMEL_HUMAN)
LRPLLDGTATI

SEQ ID NO: 131828 - protein, 9 aa, Artificial Sequence
  Description of Artificial Sequence: Synthetic peptide
  Seed: MAVVLASLI (PMEL_HUMAN)
MTVVLASLI

SEQ ID NO: 131829 - protein, 10 aa, Artificial Sequence
  Description of Artificial Sequence: Synthetic peptide
  Seed: NASFSIALNF (PMEL_HUMAN)
NCSFSIALNW

SEQ ID NO: 131830 - protein, 10 aa, Artificial Sequence
  Description of Artificial Sequence: Synthetic peptide
  Seed: ESAEILQAVP (PMEL_HUMAN)
ETAEILQAVL

SEQ ID NO: 131831 - protein, 9 aa, Artificial Sequence
  Description of Artificial Sequence: Synthetic peptide
  Seed: DAFELTVSC (PMEL_HUMAN)
DHFELTVSA

SEQ ID NO: 131832 - protein, 10 aa, Artificial Sequence
  Description of Artificial Sequence: Synthetic peptide
  Seed: MTPAEVSIVV (PMEL_HUMAN)
MKPAEVSIVF

SEQ ID NO: 131833 - protein, 9 aa, Artificial Sequence
  Description of Artificial Sequence: Synthetic peptide
  Seed: SQKRSFVYV (PMEL_HUMAN)
SIKRSFVYL

SEQ ID NO: 131834 - protein, 9 aa, Artificial Sequence
  Description of Artificial Sequence: Synthetic peptide
  Seed: DAFELTVSC (PMEL_HUMAN)
DHFELTVSV

SEQ ID NO: 131835 - protein, 9 aa, Artificial Sequence
  Description of Artificial Sequence: Synthetic peptide
  Seed: LYPEWTEAQ (PMEL_HUMAN)
LFPEWTEAY

SEQ ID NO: 131836 - protein, 9 aa, Artificial Sequence
  Description of Artificial Sequence: Synthetic peptide
  Seed: SSIMSTESI (PMEL_HUMAN)
SEIMSTESF

SEQ ID NO: 131837 - protein, 9 aa, Artificial Sequence
  Description of Artificial Sequence: Synthetic peptide
  Seed: VLPDGQVIW (PMEL_HUMAN)
VCPDGQVIL

SEQ ID NO: 131838 - protein, 9 aa, Artificial Sequence
  Description of Artificial Sequence: Synthetic peptide
  Seed: LQLHDPSGY (PMEL_HUMAN)
LILHDPSGY

SEQ ID NO: 131839 - protein, 10 aa, Artificial Sequence
  Description of Artificial Sequence: Synthetic peptide
  Seed: VVLASLIYRR (PMEL_HUMAN)
VYLASLIYRR

SEQ ID NO: 131840 - protein, 10 aa, Artificial Sequence
  Description of Artificial Sequence: Synthetic peptide
  Seed: SSAFTITDQV (PMEL_HUMAN)
SMAFTITDQV

SEQ ID NO: 131841 - protein, 11 aa, Artificial Sequence
  Description of Artificial Sequence: Synthetic peptide
  Seed: VVLSGTTAAQV (PMEL_HUMAN)
VLLSGTTAAQV

SEQ ID NO: 131842 - protein, 9 aa, Artificial Sequence
  Description of Artificial Sequence: Synthetic peptide
  Seed: VSNDGPTLI (PMEL_HUMAN)
VLNDGPTLF

SEQ ID NO: 131843 - protein, 10 aa, Artificial Sequence
  Description of Artificial Sequence: Synthetic peptide
  Seed: MAVVLASLIY (PMEL_HUMAN)
MIVVLASLIW

SEQ ID NO: 131844 - protein, 10 aa, Artificial Sequence
  Description of Artificial Sequence: Synthetic peptide
  Seed: TTEWVETTAR (PMEL_HUMAN)
TVEWVETTAR

SEQ ID NO: 131845 - protein, 9 aa, Artificial Sequence
  Description of Artificial Sequence: Synthetic peptide
  Seed: RLVKRQVPL (PMEL_HUMAN)
RQVKRQVPM

SEQ ID NO: 131846 - protein, 9 aa, Artificial Sequence
  Description of Artificial Sequence: Synthetic peptide
  Seed: SSIMSTESI (PMEL_HUMAN)
SQIMSTESY

SEQ ID NO: 131847 - protein, 9 aa, Artificial Sequence
  Description of Artificial Sequence: Synthetic peptide
  Seed: KHFLRNQPL (PMEL_HUMAN)
KYFLRNQPV

SEQ ID NO: 131848 - protein, 10 aa, Artificial Sequence
  Description of Artificial Sequence: Synthetic peptide
  Seed: RGSRSYVPLA (PMEL_HUMAN)
RYSRSYVPLA

SEQ ID NO: 131849 - protein, 10 aa, Artificial Sequence
  Description of Artificial Sequence: Synthetic peptide
  Seed: VGILLVLMAV (PMEL_HUMAN)
VLILLVLMAV

SEQ ID NO: 131850 - protein, 9 aa, Artificial Sequence
  Description of Artificial Sequence: Synthetic peptide
  Seed: AQVTTTEWV (PMEL_HUMAN)
AIVTTTEWV

SEQ ID NO: 131851 - protein, 11 aa, Artificial Sequence
  Description of Artificial Sequence: Synthetic peptide
  Seed: KVLPDGQVIWV (PMEL_HUMAN)
KNLPDGQVIWW

SEQ ID NO: 131852 - protein, 10 aa, Artificial Sequence
  Description of Artificial Sequence: Synthetic peptide
  Seed: STAPVQMPTA (PMEL_HUMAN)
SLAPVQMPTV

SEQ ID NO: 131853 - protein, 10 aa, Artificial Sequence
  Description of Artificial Sequence: Synthetic peptide
  Seed: LAVVSTQLIM (PMEL_HUMAN)
LIVVSTQLIY

SEQ ID NO: 131854 - protein, 9 aa, Artificial Sequence
  Description of Artificial Sequence: Synthetic peptide
  Seed: AEPSGTTSV (PMEL_HUMAN)
AVPSGTTSV

SEQ ID NO: 131855 - protein, 9 aa, Artificial Sequence
  Description of Artificial Sequence: Synthetic peptide
  Seed: LSIGTGRAM (PMEL_HUMAN)
LYIGTGRAY

SEQ ID NO: 131856 - protein, 10 aa, Artificial Sequence
  Description of Artificial Sequence: Synthetic peptide
  Seed: IESAEILQAV (PMEL_HUMAN)
IISAEILQAV

SEQ ID NO: 131857 - protein, 10 aa, Artificial Sequence
  Description of Artificial Sequence: Synthetic peptide
  Seed: ESAEILQAVP (PMEL_HUMAN)
EVAEILQAVM

SEQ ID NO: 131858 - protein, 9 aa, Artificial Sequence
  Description of Artificial Sequence: Synthetic peptide
  Seed: RLPRIFCSC (PMEL_HUMAN)
RIPRIFCSV

SEQ ID NO: 131859 - protein, 11 aa, Artificial Sequence
  Description of Artificial Sequence: Synthetic peptide
  Seed: VWKTWGQYWQV (PMEL_HUMAN)
VLKTWGQYWQV

SEQ ID NO: 131860 - protein, 10 aa, Artificial Sequence
  Description of Artificial Sequence: Synthetic peptide
  Seed: ALLAVGATKV (PMEL_HUMAN)
AVLAVGATKV

SEQ ID NO: 131861 - protein, 9 aa, Artificial Sequence
  Description of Artificial Sequence: Synthetic peptide
  Seed: RGSRSYVPL (PMEL_HUMAN)
RMSRSYVPI

SEQ ID NO: 131862 - protein, 9 aa, Artificial Sequence
  Description of Artificial Sequence: Synthetic peptide
  Seed: VPSGEGDAF (PMEL_HUMAN)
VPSGEGDAM

SEQ ID NO: 131863 - protein, 9 aa, Artificial Sequence
  Description of Artificial Sequence: Synthetic peptide
  Seed: YHRRGSRSY (PMEL_HUMAN)
YWRRGSRSY

SEQ ID NO: 131864 - protein, 11 aa, Artificial Sequence
  Description of Artificial Sequence: Synthetic peptide
  Seed: RRGSRSYVPLA (PMEL_HUMAN)
RFGSRSYVPLA

SEQ ID NO: 131865 - protein, 9 aa, Artificial Sequence
  Description of Artificial Sequence: Synthetic peptide
  Seed: STESITGSL (PMEL_HUMAN)
SYESITGSL

SEQ ID NO: 131866 - protein, 9 aa, Artificial Sequence
  Description of Artificial Sequence: Synthetic peptide
  Seed: CVLYRYGSF (PMEL_HUMAN)
CMLYRYGSY

SEQ ID NO: 131867 - protein, 10 aa, Artificial Sequence
  Description of Artificial Sequence: Synthetic peptide
  Seed: RRLMKQDFSV (PMEL_HUMAN)
RQLMKQDFSI

SEQ ID NO: 131868 - protein, 10 aa, Artificial Sequence
  Description of Artificial Sequence: Synthetic peptide
  Seed: TSVQVPTTEV (PMEL_HUMAN)
TTVQVPTTEV

SEQ ID NO: 131869 - protein, 9 aa, Artificial Sequence
  Description of Artificial Sequence: Synthetic peptide
  Seed: VTLDIVQGI (PMEL_HUMAN)
VGLDIVQGW

SEQ ID NO: 131870 - protein, 9 aa, Artificial Sequence
  Description of Artificial Sequence: Synthetic peptide
  Seed: GQVPLIVGI (PMEL_HUMAN)
GKVPLIVGF

SEQ ID NO: 131871 - protein, 9 aa, Artificial Sequence
  Description of Artificial Sequence: Synthetic peptide
  Seed: TTDGHRPTA (PMEL_HUMAN)
THDGHRPTM

SEQ ID NO: 131872 - protein, 10 aa, Artificial Sequence
  Description of Artificial Sequence: Synthetic peptide
  Seed: LAEADLSYTW (PMEL_HUMAN)
LNEADLSYTW

SEQ ID NO: 131873 - protein, 9 aa, Artificial Sequence
  Description of Artificial Sequence: Synthetic peptide
  Seed: SPLLSGQQV (PMEL_HUMAN)
SALLSGQQW

SEQ ID NO: 131874 - protein, 8 aa, Artificial Sequence
  Description of Artificial Sequence: Synthetic peptide
  Seed: LNFPGSQK (PMEL_HUMAN)
LAFPGSQI

SEQ ID NO: 131875 - protein, 11 aa, Artificial Sequence
  Description of Artificial Sequence: Synthetic peptide
  Seed: YLAEADLSYTW (PMEL_HUMAN)
YYAEADLSYTI

SEQ ID NO: 131876 - protein, 9 aa, Artificial Sequence
  Description of Artificial Sequence: Synthetic peptide
  Seed: MTPAEVSIV (PMEL_HUMAN)
MLPAEVSIV

SEQ ID NO: 131877 - protein, 9 aa, Artificial Sequence
  Description of Artificial Sequence: Synthetic peptide
  Seed: RTKAWNRQL (PMEL_HUMAN)
RVKAWNRQS

SEQ ID NO: 131878 - protein, 9 aa, Artificial Sequence
  Description of Artificial Sequence: Synthetic peptide
  Seed: RLMKQDFSV (PMEL_HUMAN)
RTMKQDFSW

SEQ ID NO: 131879 - protein, 9 aa, Artificial Sequence
  Description of Artificial Sequence: Synthetic peptide
  Seed: KAWNRQLYP (PMEL_HUMAN)
KMWNRQLYK

SEQ ID NO: 131880 - protein, 9 aa, Artificial Sequence
  Description of Artificial Sequence: Synthetic peptide
  Seed: KTWGQYWQV (PMEL_HUMAN)
KVWGQYWQC

SEQ ID NO: 131881 - protein, 10 aa, Artificial Sequence
  Description of Artificial Sequence: Synthetic peptide
  Seed: SVTLDIVQGI (PMEL_HUMAN)
SMTLDIVQGV

SEQ ID NO: 131882 - protein, 10 aa, Artificial Sequence
  Description of Artificial Sequence: Synthetic peptide
  Seed: SLIYRRRLMK (PMEL_HUMAN)
SCIYRRRLMR

SEQ ID NO: 131883 - protein, 9 aa, Artificial Sequence
  Description of Artificial Sequence: Synthetic peptide
  Seed: YLAEADLSY (PMEL_HUMAN)
YMAEADLSI

SEQ ID NO: 131884 - protein, 10 aa, Artificial Sequence
  Description of Artificial Sequence: Synthetic peptide
  Seed: IVQGIESAEI (PMEL_HUMAN)
ILQGIESAEL

SEQ ID NO: 131885 - protein, 9 aa, Artificial Sequence
  Description of Artificial Sequence: Synthetic peptide
  Seed: GPLLDGTAT (PMEL_HUMAN)
GPLLDGTAL

SEQ ID NO: 131886 - protein, 10 aa, Artificial Sequence
  Description of Artificial Sequence: Synthetic peptide
  Seed: AMLGTHTMEV (PMEL_HUMAN)
ANLGTHTMEV

SEQ ID NO: 131887 - protein, 9 aa, Artificial Sequence
  Description of Artificial Sequence: Synthetic peptide
  Seed: VQVPTTEVI (PMEL_HUMAN)
VRVPTTEVF

SEQ ID NO: 131888 - protein, 10 aa, Artificial Sequence
  Description of Artificial Sequence: Synthetic peptide
  Seed: LAHSSSAFTI (PMEL_HUMAN)
LHHSSSAFTL

SEQ ID NO: 131889 - protein, 9 aa, Artificial Sequence
  Description of Artificial Sequence: Synthetic peptide
  Seed: RLMKQDFSV (PMEL_HUMAN)
RMMKQDFSV

SEQ ID NO: 131890 - protein, 9 aa, Artificial Sequence
  Description of Artificial Sequence: Synthetic peptide
  Seed: VVLSGTTAA (PMEL_HUMAN)
VSLSGTTAY

SEQ ID NO: 131891 - protein, 9 aa, Artificial Sequence
  Description of Artificial Sequence: Synthetic peptide
  Seed: LADTNSLAV (PMEL_HUMAN)
LGDTNSLAL

SEQ ID NO: 131892 - protein, 10 aa, Artificial Sequence
  Description of Artificial Sequence: Synthetic peptide
  Seed: RGSRSYVPLA (PMEL_HUMAN)
RSSRSYVPLY

SEQ ID NO: 131893 - protein, 11 aa, Artificial Sequence
  Description of Artificial Sequence: Synthetic peptide
  Seed: MPTAESTGMTP (PMEL_HUMAN)
MPTAESTGMTV

SEQ ID NO: 131894 - protein, 9 aa, Artificial Sequence
  Description of Artificial Sequence: Synthetic peptide
  Seed: TIINGSQVW (PMEL_HUMAN)
TQINGSQVL

SEQ ID NO: 131895 - protein, 9 aa, Artificial Sequence
  Description of Artificial Sequence: Synthetic peptide
  Seed: RYGSFSVTL (PMEL_HUMAN)
RIGSFSVTY

SEQ ID NO: 131896 - protein, 9 aa, Artificial Sequence
  Description of Artificial Sequence: Synthetic peptide
  Seed: RLMKQDFSV (PMEL_HUMAN)
RQMKQDFSM

SEQ ID NO: 131897 - protein, 9 aa, Artificial Sequence
  Description of Artificial Sequence: Synthetic peptide
  Seed: AHSSSAFTI (PMEL_HUMAN)
AQSSSAFTM

SEQ ID NO: 131898 - protein, 11 aa, Artificial Sequence
  Description of Artificial Sequence: Synthetic peptide
  Seed: AEMSTPEATGM (PMEL_HUMAN)
AEMSTPEATGF

SEQ ID NO: 131899 - protein, 9 aa, Artificial Sequence
  Description of Artificial Sequence: Synthetic peptide
  Seed: LAVVSTQLI (PMEL_HUMAN)
LSVVSTQLL

SEQ ID NO: 131900 - protein, 11 aa, Artificial Sequence
  Description of Artificial Sequence: Synthetic peptide
  Seed: RLPRIFCSCPI (PMEL_HUMAN)
RGPRIFCSCPL

SEQ ID NO: 131901 - protein, 9 aa, Artificial Sequence
  Description of Artificial Sequence: Synthetic peptide
  Seed: SQKRSFVYV (PMEL_HUMAN)
STKRSFVYT

SEQ ID NO: 131902 - protein, 9 aa, Artificial Sequence
  Description of Artificial Sequence: Synthetic peptide
  Seed: YLEPGPVTA (PMEL_HUMAN)
YNEPGPVTF

SEQ ID NO: 131903 - protein, 9 aa, Artificial Sequence
  Description of Artificial Sequence: Synthetic peptide
  Seed: FTITDQVPF (PMEL_HUMAN)
FIITDQVPV

SEQ ID NO: 131904 - protein, 10 aa, Artificial Sequence
  Description of Artificial Sequence: Synthetic peptide
  Seed: LIMPGQEAGL (PMEL_HUMAN)
LVMPGQEAGV

SEQ ID NO: 131905 - protein, 9 aa, Artificial Sequence
  Description of Artificial Sequence: Synthetic peptide
  Seed: LAVGATKVP (PMEL_HUMAN)
LTVGATKVY

SEQ ID NO: 131906 - protein, 9 aa, Artificial Sequence
  Description of Artificial Sequence: Synthetic peptide
  Seed: FGDSSGTLI (PMEL_HUMAN)
FIDSSGTLA

SEQ ID NO: 131907 - protein, 10 aa, Artificial Sequence
  Description of Artificial Sequence: Synthetic peptide
  Seed: HTMEVTVYHR (PMEL_HUMAN)
HMMEVTVYHR

SEQ ID NO: 131908 - protein, 9 aa, Artificial Sequence
  Description of Artificial Sequence: Synthetic peptide
  Seed: KQDFSVPQL (PMEL_HUMAN)
KMDFSVPQY

SEQ ID NO: 131909 - protein, 9 aa, Artificial Sequence
  Description of Artificial Sequence: Synthetic peptide
  Seed: AVVLASLIY (PMEL_HUMAN)
AVVLASLIK

SEQ ID NO: 131910 - protein, 11 aa, Artificial Sequence
  Description of Artificial Sequence: Synthetic peptide
  Seed: KVLPDGQVIWV (PMEL_HUMAN)
KSLPDGQVIWL

SEQ ID NO: 131911 - protein, 9 aa, Artificial Sequence
  Description of Artificial Sequence: Synthetic peptide
  Seed: CPIGENSPL (PMEL_HUMAN)
CAIGENSPF

SEQ ID NO: 131912 - protein, 9 aa, Artificial Sequence
  Description of Artificial Sequence: Synthetic peptide
  Seed: SPVPGTTDG (PMEL_HUMAN)
SPVPGTTDT

SEQ ID NO: 131913 - protein, 10 aa, Artificial Sequence
  Description of Artificial Sequence: Synthetic peptide
  Seed: SCPIGENSPL (PMEL_HUMAN)
SVPIGENSPL

SEQ ID NO: 131914 - protein, 10 aa, Artificial Sequence
  Description of Artificial Sequence: Synthetic peptide
  Seed: RGSRSYVPLA (PMEL_HUMAN)
RFSRSYVPLY

SEQ ID NO: 131915 - protein, 11 aa, Artificial Sequence
  Description of Artificial Sequence: Synthetic peptide
  Seed: TWDFGDSSGTL (PMEL_HUMAN)
TVDFGDSSGTF

SEQ ID NO: 131916 - protein, 9 aa, Artificial Sequence
  Description of Artificial Sequence: Synthetic peptide
  Seed: VLMAVVLAS (PMEL_HUMAN)
VQMAVVLAL

SEQ ID NO: 131917 - protein, 9 aa, Artificial Sequence
  Description of Artificial Sequence: Synthetic peptide
  Seed: AEPSGTTSV (PMEL_HUMAN)
AYPSGTTSM

SEQ ID NO: 131918 - protein, 9 aa, Artificial Sequence
  Description of Artificial Sequence: Synthetic peptide
  Seed: FSVSVSQLR (PMEL_HUMAN)
FAVSVSQLH

SEQ ID NO: 131919 - protein, 9 aa, Artificial Sequence
  Description of Artificial Sequence: Synthetic peptide
  Seed: ASFSIALNF (PMEL_HUMAN)
ASFSIALNY

SEQ ID NO: 131920 - protein, 9 aa, Artificial Sequence
  Description of Artificial Sequence: Synthetic peptide
  Seed: LSIGTGRAM (PMEL_HUMAN)
LFIGTGRAV

SEQ ID NO: 131921 - protein, 11 aa, Artificial Sequence
  Description of Artificial Sequence: Synthetic peptide
  Seed: YPQETDDACIF (PMEL_HUMAN)
YPQETDDACIY

SEQ ID NO: 131922 - protein, 9 aa, Artificial Sequence
  Description of Artificial Sequence: Synthetic peptide
  Seed: HTMEVTVYH (PMEL_HUMAN)
HGMEVTVYR

SEQ ID NO: 131923 - protein, 9 aa, Artificial Sequence
  Description of Artificial Sequence: Synthetic peptide
  Seed: AEPSGTTSV (PMEL_HUMAN)
AAPSGTTSM

SEQ ID NO: 131924 - protein, 9 aa, Artificial Sequence
  Description of Artificial Sequence: Synthetic peptide
  Seed: DGGNKHFLR (PMEL_HUMAN)
DQGNKHFLR

SEQ ID NO: 131925 - protein, 9 aa, Artificial Sequence
  Description of Artificial Sequence: Synthetic peptide
  Seed: FGDSSGTLI (PMEL_HUMAN)
FTDSSGTLC

SEQ ID NO: 131926 - protein, 10 aa, Artificial Sequence
  Description of Artificial Sequence: Synthetic peptide
  Seed: GRAMLGTHTM (PMEL_HUMAN)
GFAMLGTHTM

SEQ ID NO: 131927 - protein, 9 aa, Artificial Sequence
  Description of Artificial Sequence: Synthetic peptide
  Seed: VSVSQLRAL (PMEL_HUMAN)
VAVSQLRAL

SEQ ID NO: 131928 - protein, 10 aa, Artificial Sequence
  Description of Artificial Sequence: Synthetic peptide
  Seed: RGSRSYVPLA (PMEL_HUMAN)
RNSRSYVPLL

SEQ ID NO: 131929 - protein, 9 aa, Artificial Sequence
  Description of Artificial Sequence: Synthetic peptide
  Seed: SSIMSTESI (PMEL_HUMAN)
SIIMSTESF

SEQ ID NO: 131930 - protein, 9 aa, Artificial Sequence
  Description of Artificial Sequence: Synthetic peptide
  Seed: VPLDCVLYR (PMEL_HUMAN)
VLLDCVLYV

SEQ ID NO: 131931 - protein, 9 aa, Artificial Sequence
  Description of Artificial Sequence: Synthetic peptide
  Seed: THTMEVTVY (PMEL_HUMAN)
TKTMEVTVF

SEQ ID NO: 131932 - protein, 10 aa, Artificial Sequence
  Description of Artificial Sequence: Synthetic peptide
  Seed: SQKRSFVYVW (PMEL_HUMAN)
SDKRSFVYVY

SEQ ID NO: 131933 - protein, 10 aa, Artificial Sequence
  Description of Artificial Sequence: Synthetic peptide
  Seed: SVPQLPHSSS (PMEL_HUMAN)
SYPQLPHSSI

SEQ ID NO: 131934 - protein, 11 aa, Artificial Sequence
  Description of Artificial Sequence: Synthetic peptide
  Seed: KVLPDGQVIWV (PMEL_HUMAN)
KTLPDGQVIWW

SEQ ID NO: 131935 - protein, 11 aa, Artificial Sequence
  Description of Artificial Sequence: Synthetic peptide
  Seed: CVLYRYGSFSV (PMEL_HUMAN)
CRLYRYGSFSV

SEQ ID NO: 131936 - protein, 9 aa, Artificial Sequence
  Description of Artificial Sequence: Synthetic peptide
  Seed: RGSRSYVPL (PMEL_HUMAN)
RMSRSYVPV

SEQ ID NO: 131937 - protein, 11 aa, Artificial Sequence
  Description of Artificial Sequence: Synthetic peptide
  Seed: YLAEADLSYTW (PMEL_HUMAN)
YLAEADLSYTA

SEQ ID NO: 131938 - protein, 8 aa, Artificial Sequence
  Description of Artificial Sequence: Synthetic peptide
  Seed: LADTNSLA (PMEL_HUMAN)
LVDTNSLF

SEQ ID NO: 131939 - protein, 9 aa, Artificial Sequence
  Description of Artificial Sequence: Synthetic peptide
  Seed: RLVKRQVPL (PMEL_HUMAN)
RPVKRQVPM

SEQ ID NO: 131940 - protein, 9 aa, Artificial Sequence
  Description of Artificial Sequence: Synthetic peptide
  Seed: VSVSQLRAL (PMEL_HUMAN)
VVVSQLRAF

SEQ ID NO: 131941 - protein, 9 aa, Artificial Sequence
  Description of Artificial Sequence: Synthetic peptide
  Seed: VLQAAIPLT (PMEL_HUMAN)
VAQAAIPLV

SEQ ID NO: 131942 - protein, 9 aa, Artificial Sequence
  Description of Artificial Sequence: Synthetic peptide
  Seed: VLPDGQVIW (PMEL_HUMAN)
VMPDGQVIF

SEQ ID NO: 131943 - protein, 10 aa, Artificial Sequence
  Description of Artificial Sequence: Synthetic peptide
  Seed: CQLVLHQILK (PMEL_HUMAN)
CMLVLHQILR

SEQ ID NO: 131944 - protein, 10 aa, Artificial Sequence
  Description of Artificial Sequence: Synthetic peptide
  Seed: KTWGQYWQVL (PMEL_HUMAN)
KIWGQYWQVP

SEQ ID NO: 131945 - protein, 10 aa, Artificial Sequence
  Description of Artificial Sequence: Synthetic peptide
  Seed: MTPAEVSIVV (PMEL_HUMAN)
MIPAEVSIVI

SEQ ID NO: 131946 - protein, 10 aa, Artificial Sequence
  Description of Artificial Sequence: Synthetic peptide
  Seed: RGSRSYVPLA (PMEL_HUMAN)
RVSRSYVPLL

SEQ ID NO: 131947 - protein, 9 aa, Artificial Sequence
  Description of Artificial Sequence: Synthetic peptide
  Seed: SLGPLLDGT (PMEL_HUMAN)
SMGPLLDGL

SEQ ID NO: 131948 - protein, 8 aa, Artificial Sequence
  Description of Artificial Sequence: Synthetic peptide
  Seed: AMLGTHTM (PMEL_HUMAN)
AQLGTHTY

SEQ ID NO: 131949 - protein, 9 aa, Artificial Sequence
  Description of Artificial Sequence: Synthetic peptide
  Seed: LSIGTGRAM (PMEL_HUMAN)
LKIGTGRAF

SEQ ID NO: 131950 - protein, 9 aa, Artificial Sequence
  Description of Artificial Sequence: Synthetic peptide
  Seed: GMTPAEVSI (PMEL_HUMAN)
GLTPAEVSW

SEQ ID NO: 131951 - protein, 10 aa, Artificial Sequence
  Description of Artificial Sequence: Synthetic peptide
  Seed: RALVVTHTYL (PMEL_HUMAN)
RTLVVTHTYI

SEQ ID NO: 131952 - protein, 9 aa, Artificial Sequence
  Description of Artificial Sequence: Synthetic peptide
  Seed: KHFLRNQPL (PMEL_HUMAN)
KAFLRNQPF

SEQ ID NO: 131953 - protein, 9 aa, Artificial Sequence
  Description of Artificial Sequence: Synthetic peptide
  Seed: MLGTHTMEV (PMEL_HUMAN)
MLGTHTMEY

SEQ ID NO: 131954 - protein, 9 aa, Artificial Sequence
  Description of Artificial Sequence: Synthetic peptide
  Seed: VTAQVVLQA (PMEL_HUMAN)
VNAQVVLQV

SEQ ID NO: 131955 - protein, 9 aa, Artificial Sequence
  Description of Artificial Sequence: Synthetic peptide
  Seed: HTYLEPGPV (PMEL_HUMAN)
HTYLEPGPW

SEQ ID NO: 131956 - protein, 9 aa, Artificial Sequence
  Description of Artificial Sequence: Synthetic peptide
  Seed: VPFSVSVSQ (PMEL_HUMAN)
VSFSVSVSY

SEQ ID NO: 131957 - protein, 10 aa, Artificial Sequence
  Description of Artificial Sequence: Synthetic peptide
  Seed: YRYGSFSVTL (PMEL_HUMAN)
YTYGSFSVTI

SEQ ID NO: 131958 - protein, 10 aa, Artificial Sequence
  Description of Artificial Sequence: Synthetic peptide
  Seed: MTPAEVSIVV (PMEL_HUMAN)
MHPAEVSIVT

SEQ ID NO: 131959 - protein, 10 aa, Artificial Sequence
  Description of Artificial Sequence: Synthetic peptide
  Seed: QVIWVNNTII (PMEL_HUMAN)
QTIWVNNTIL

SEQ ID NO: 131960 - protein, 9 aa, Artificial Sequence
  Description of Artificial Sequence: Synthetic peptide
  Seed: VVLQAAIPL (PMEL_HUMAN)
VMLQAAIPY

SEQ ID NO: 131961 - protein, 10 aa, Artificial Sequence
  Description of Artificial Sequence: Synthetic peptide
  Seed: EVVGTTPGQA (PMEL_HUMAN)
EQVGTTPGQR

SEQ ID NO: 131962 - protein, 9 aa, Artificial Sequence
  Description of Artificial Sequence: Synthetic peptide
  Seed: RTKAWNRQL (PMEL_HUMAN)
RVKAWNRQW

SEQ ID NO: 131963 - protein, 9 aa, Artificial Sequence
  Description of Artificial Sequence: Synthetic peptide
  Seed: CPIGENSPL (PMEL_HUMAN)
CAIGENSPW

SEQ ID NO: 131964 - protein, 11 aa, Artificial Sequence
  Description of Artificial Sequence: Synthetic peptide
  Seed: SYVPLAHSSSA (PMEL_HUMAN)
SRVPLAHSSSM

SEQ ID NO: 131965 - protein, 9 aa, Artificial Sequence
  Description of Artificial Sequence: Synthetic peptide
  Seed: KQDFSVPQL (PMEL_HUMAN)
KWDFSVPQI

SEQ ID NO: 131966 - protein, 11 aa, Artificial Sequence
  Description of Artificial Sequence: Synthetic peptide
  Seed: QAVPSGEGDAF (PMEL_HUMAN)
QQVPSGEGDAY

SEQ ID NO: 131967 - protein, 9 aa, Artificial Sequence
  Description of Artificial Sequence: Synthetic peptide
  Seed: LIYRRRLMK (PMEL_HUMAN)
LTYRRRLMA

SEQ ID NO: 131968 - protein, 10 aa, Artificial Sequence
  Description of Artificial Sequence: Synthetic peptide
  Seed: CPIGENSPLL (PMEL_HUMAN)
CAIGENSPLY

SEQ ID NO: 131969 - protein, 10 aa, Artificial Sequence
  Description of Artificial Sequence: Synthetic peptide
  Seed: RQLYPEWTEA (PMEL_HUMAN)
RYLYPEWTEV

SEQ ID NO: 131970 - protein, 9 aa, Artificial Sequence
  Description of Artificial Sequence: Synthetic peptide
  Seed: TAPVQMPTA (PMEL_HUMAN)
TIPVQMPTM

SEQ ID NO: 131971 - protein, 9 aa, Artificial Sequence
  Description of Artificial Sequence: Synthetic peptide
  Seed: RQVPLDCVL (PMEL_HUMAN)
RAVPLDCVL

SEQ ID NO: 131972 - protein, 9 aa, Artificial Sequence
  Description of Artificial Sequence: Synthetic peptide
  Seed: VLQAAIPLT (PMEL_HUMAN)
VMQAAIPLA

SEQ ID NO: 131973 - protein, 9 aa, Artificial Sequence
  Description of Artificial Sequence: Synthetic peptide
  Seed: RNQPLTFAL (PMEL_HUMAN)
REQPLTFAV

SEQ ID NO: 131974 - protein, 9 aa, Artificial Sequence
  Description of Artificial Sequence: Synthetic peptide
  Seed: GPLLDGTAT (PMEL_HUMAN)
GPLLDGTAA

SEQ ID NO: 131975 - protein, 9 aa, Artificial Sequence
  Description of Artificial Sequence: Synthetic peptide
  Seed: SEVMGTTLA (PMEL_HUMAN)
SEVMGTTLV

SEQ ID NO: 131976 - protein, 9 aa, Artificial Sequence
  Description of Artificial Sequence: Synthetic peptide
  Seed: FGDSSGTLI (PMEL_HUMAN)
FDDSSGTLL

SEQ ID NO: 131977 - protein, 9 aa, Artificial Sequence
  Description of Artificial Sequence: Synthetic peptide
  Seed: VMGTTLAEM (PMEL_HUMAN)
VTGTTLAEV

SEQ ID NO: 131978 - protein, 10 aa, Artificial Sequence
  Description of Artificial Sequence: Synthetic peptide
  Seed: RGSRSYVPLA (PMEL_HUMAN)
RVSRSYVPLA

SEQ ID NO: 131979 - protein, 10 aa, Artificial Sequence
  Description of Artificial Sequence: Synthetic peptide
  Seed: SRALVVTHTY (PMEL_HUMAN)
SVALVVTHTW

SEQ ID NO: 131980 - protein, 9 aa, Artificial Sequence
  Description of Artificial Sequence: Synthetic peptide
  Seed: QEAGLGQVP (PMEL_HUMAN)
QEAGLGQVC

SEQ ID NO: 131981 - protein, 8 aa, Artificial Sequence
  Description of Artificial Sequence: Synthetic peptide
  Seed: SNDGPTLI (PMEL_HUMAN)
SIDGPTLI

SEQ ID NO: 131982 - protein, 9 aa, Artificial Sequence
  Description of Artificial Sequence: Synthetic peptide
  Seed: LHLAVIGAL (PMEL_HUMAN)
LHLAVIGAA

SEQ ID NO: 131983 - protein, 9 aa, Artificial Sequence
  Description of Artificial Sequence: Synthetic peptide
  Seed: LMAVVLASL (PMEL_HUMAN)
LLAVVLASM

SEQ ID NO: 131984 - protein, 9 aa, Artificial Sequence
  Description of Artificial Sequence: Synthetic peptide
  Seed: TIINGSQVW (PMEL_HUMAN)
TAINGSQVF

SEQ ID NO: 131985 - protein, 9 aa, Artificial Sequence
  Description of Artificial Sequence: Synthetic peptide
  Seed: LPSPACQLV (PMEL_HUMAN)
LASPACQLF

SEQ ID NO: 131986 - protein, 10 aa, Artificial Sequence
  Description of Artificial Sequence: Synthetic peptide
  Seed: AEADLSYTWD (PMEL_HUMAN)
AEADLSYTWV

SEQ ID NO: 131987 - protein, 8 aa, Artificial Sequence
  Description of Artificial Sequence: Synthetic peptide
  Seed: SNDGPTLI (PMEL_HUMAN)
SSDGPTLV

SEQ ID NO: 131988 - protein, 9 aa, Artificial Sequence
  Description of Artificial Sequence: Synthetic peptide
  Seed: KVLPDGQVI (PMEL_HUMAN)
KSLPDGQVF

SEQ ID NO: 131989 - protein, 9 aa, Artificial Sequence
  Description of Artificial Sequence: Synthetic peptide
  Seed: VSVSQLRAL (PMEL_HUMAN)
VLVSQLRAL

SEQ ID NO: 131990 - protein, 9 aa, Artificial Sequence
  Description of Artificial Sequence: Synthetic peptide
  Seed: SAFTITDQV (PMEL_HUMAN)
STFTITDQF

SEQ ID NO: 131991 - protein, 10 aa, Artificial Sequence
  Description of Artificial Sequence: Synthetic peptide
  Seed: RGSRSYVPLA (PMEL_HUMAN)
RMSRSYVPLT

SEQ ID NO: 131992 - protein, 9 aa, Artificial Sequence
  Description of Artificial Sequence: Synthetic peptide
  Seed: VTLDIVQGI (PMEL_HUMAN)
VQLDIVQGA

SEQ ID NO: 131993 - protein, 10 aa, Artificial Sequence
  Description of Artificial Sequence: Synthetic peptide
  Seed: GYLAEADLSY (PMEL_HUMAN)
GQLAEADLSM

SEQ ID NO: 131994 - protein, 9 aa, Artificial Sequence
  Description of Artificial Sequence: Synthetic peptide
  Seed: LNFPGSQKV (PMEL_HUMAN)
LMFPGSQKL

SEQ ID NO: 131995 - protein, 10 aa, Artificial Sequence
  Description of Artificial Sequence: Synthetic peptide
  Seed: EVMGTTLAEM (PMEL_HUMAN)
EIMGTTLAEM

SEQ ID NO: 131996 - protein, 10 aa, Artificial Sequence
  Description of Artificial Sequence: Synthetic peptide
  Seed: RALDGGNKHF (PMEL_HUMAN)
RMLDGGNKHF

SEQ ID NO: 131997 - protein, 8 aa, Artificial Sequence
  Description of Artificial Sequence: Synthetic peptide
  Seed: FGDSSGTL (PMEL_HUMAN)
FGDSSGTI

SEQ ID NO: 131998 - protein, 10 aa, Artificial Sequence
  Description of Artificial Sequence: Synthetic peptide
  Seed: YVPLAHSSSA (PMEL_HUMAN)
YQPLAHSSSV

SEQ ID NO: 131999 - protein, 9 aa, Artificial Sequence
  Description of Artificial Sequence: Synthetic peptide
  Seed: HTYLEPGPV (PMEL_HUMAN)
HAYLEPGPM

SEQ ID NO: 132000 - protein, 10 aa, Artificial Sequence
  Description of Artificial Sequence: Synthetic peptide
  Seed: LAVVSTQLIM (PMEL_HUMAN)
LMVVSTQLIM

SEQ ID NO: 132001 - protein, 9 aa, Artificial Sequence
  Description of Artificial Sequence: Synthetic peptide
  Seed: RTKAWNRQL (PMEL_HUMAN)
RVKAWNRQT

SEQ ID NO: 132002 - protein, 9 aa, Artificial Sequence
  Description of Artificial Sequence: Synthetic peptide
  Seed: LMAVVLASL (PMEL_HUMAN)
LQAVVLASF

SEQ ID NO: 132003 - protein, 9 aa, Artificial Sequence
  Description of Artificial Sequence: Synthetic peptide
  Seed: HSSSHWLRL (PMEL_HUMAN)
HASSHWLRL

SEQ ID NO: 132004 - protein, 9 aa, Artificial Sequence
  Description of Artificial Sequence: Synthetic peptide
  Seed: SVQVPTTEV (PMEL_HUMAN)
SMQVPTTEM

SEQ ID NO: 132005 - protein, 9 aa, Artificial Sequence
  Description of Artificial Sequence: Synthetic peptide
  Seed: SLADTNSLA (PMEL_HUMAN)
SSADTNSLI

SEQ ID NO: 132006 - protein, 8 aa, Artificial Sequence
  Description of Artificial Sequence: Synthetic peptide
  Seed: SNDGPTLI (PMEL_HUMAN)
SWDGPTLM

SEQ ID NO: 132007 - protein, 9 aa, Artificial Sequence
  Description of Artificial Sequence: Synthetic peptide
  Seed: NQDWLGVSR (PMEL_HUMAN)
NADWLGVSM

SEQ ID NO: 132008 - protein, 10 aa, Artificial Sequence
  Description of Artificial Sequence: Synthetic peptide
  Seed: LVLKRCLLHL (PMEL_HUMAN)
LHLKRCLLHV

SEQ ID NO: 132009 - protein, 9 aa, Artificial Sequence
  Description of Artificial Sequence: Synthetic peptide
  Seed: VQMPTAEST (PMEL_HUMAN)
VRMPTAESF

SEQ ID NO: 132010 - protein, 9 aa, Artificial Sequence
  Description of Artificial Sequence: Synthetic peptide
  Seed: SVPQLPHSS (PMEL_HUMAN)
SQPQLPHSL

SEQ ID NO: 132011 - protein, 10 aa, Artificial Sequence
  Description of Artificial Sequence: Synthetic peptide
  Seed: YRYGSFSVTL (PMEL_HUMAN)
YDYGSFSVTI

SEQ ID NO: 132012 - protein, 9 aa, Artificial Sequence
  Description of Artificial Sequence: Synthetic peptide
  Seed: VTLDIVQGI (PMEL_HUMAN)
VQLDIVQGF

SEQ ID NO: 132013 - protein, 9 aa, Artificial Sequence
  Description of Artificial Sequence: Synthetic peptide
  Seed: VISTAPVQM (PMEL_HUMAN)
VTSTAPVQY

SEQ ID NO: 132014 - protein, 11 aa, Artificial Sequence
  Description of Artificial Sequence: Synthetic peptide
  Seed: RQVPLDCVLYR (PMEL_HUMAN)
RMVPLDCVLYY

SEQ ID NO: 132015 - protein, 9 aa, Artificial Sequence
  Description of Artificial Sequence: Synthetic peptide
  Seed: VLMAVVLAS (PMEL_HUMAN)
VLMAVVLAM

SEQ ID NO: 132016 - protein, 11 aa, Artificial Sequence
  Description of Artificial Sequence: Synthetic peptide
  Seed: GYLAEADLSYT (PMEL_HUMAN)
GGLAEADLSYV

SEQ ID NO: 132017 - protein, 10 aa, Artificial Sequence
  Description of Artificial Sequence: Synthetic peptide
  Seed: LVLMAVVLAS (PMEL_HUMAN)
LCLMAVVLAI

SEQ ID NO: 132018 - protein, 9 aa, Artificial Sequence
  Description of Artificial Sequence: Synthetic peptide
  Seed: LLHLAVIGA (PMEL_HUMAN)
LVHLAVIGV

SEQ ID NO: 132019 - protein, 9 aa, Artificial Sequence
  Description of Artificial Sequence: Synthetic peptide
  Seed: KAWNRQLYP (PMEL_HUMAN)
KTWNRQLYK

SEQ ID NO: 132020 - protein, 9 aa, Artificial Sequence
  Description of Artificial Sequence: Synthetic peptide
  Seed: RLMKQDFSV (PMEL_HUMAN)
RQMKQDFSW

SEQ ID NO: 132021 - protein, 10 aa, Artificial Sequence
  Description of Artificial Sequence: Synthetic peptide
  Seed: TAAQVTTTEW (PMEL_HUMAN)
TTAQVTTTEW

SEQ ID NO: 132022 - protein, 9 aa, Artificial Sequence
  Description of Artificial Sequence: Synthetic peptide
  Seed: RYGSFSVTL (PMEL_HUMAN)
RSGSFSVTW

SEQ ID NO: 132023 - protein, 11 aa, Artificial Sequence
  Description of Artificial Sequence: Synthetic peptide
  Seed: FGDSSGTLISR (PMEL_HUMAN)
FIDSSGTLISY

SEQ ID NO: 132024 - protein, 9 aa, Artificial Sequence
  Description of Artificial Sequence: Synthetic peptide
  Seed: FLRNQPLTF (PMEL_HUMAN)
FMRNQPLTF

SEQ ID NO: 132025 - protein, 10 aa, Artificial Sequence
  Description of Artificial Sequence: Synthetic peptide
  Seed: MPTAESTGMT (PMEL_HUMAN)
MCTAESTGMV

SEQ ID NO: 132026 - protein, 11 aa, Artificial Sequence
  Description of Artificial Sequence: Synthetic peptide
  Seed: AEMSTPEATGM (PMEL_HUMAN)
AEMSTPEATGT

SEQ ID NO: 132027 - protein, 11 aa, Artificial Sequence
  Description of Artificial Sequence: Synthetic peptide
  Seed: SYVPLAHSSSA (PMEL_HUMAN)
SIVPLAHSSSL

SEQ ID NO: 132028 - protein, 10 aa, Artificial Sequence
  Description of Artificial Sequence: Synthetic peptide
  Seed: KVSNDGPTLI (PMEL_HUMAN)
KQSNDGPTLM

SEQ ID NO: 132029 - protein, 9 aa, Artificial Sequence
  Description of Artificial Sequence: Synthetic peptide
  Seed: FGDSSGTLI (PMEL_HUMAN)
FFDSSGTLA

SEQ ID NO: 132030 - protein, 11 aa, Artificial Sequence
  Description of Artificial Sequence: Synthetic peptide
  Seed: ALDGGNKHFLR (PMEL_HUMAN)
ALDGGNKHFLY

SEQ ID NO: 132031 - protein, 9 aa, Artificial Sequence
  Description of Artificial Sequence: Synthetic peptide
  Seed: VISTAPVQM (PMEL_HUMAN)
VYSTAPVQL

SEQ ID NO: 132032 - protein, 9 aa, Artificial Sequence
  Description of Artificial Sequence: Synthetic peptide
  Seed: FLRNQPLTF (PMEL_HUMAN)
FWRNQPLTY

SEQ ID NO: 132033 - protein, 9 aa, Artificial Sequence
  Description of Artificial Sequence: Synthetic peptide
  Seed: KAWNRQLYP (PMEL_HUMAN)
KSWNRQLYK

SEQ ID NO: 132034 - protein, 10 aa, Artificial Sequence
  Description of Artificial Sequence: Synthetic peptide
  Seed: MTPAEVSIVV (PMEL_HUMAN)
MNPAEVSIVA

SEQ ID NO: 132035 - protein, 10 aa, Artificial Sequence
  Description of Artificial Sequence: Synthetic peptide
  Seed: LRLVKRQVPL (PMEL_HUMAN)
LMLVKRQVPL

SEQ ID NO: 132036 - protein, 9 aa, Artificial Sequence
  Description of Artificial Sequence: Synthetic peptide
  Seed: EVMGTTLAE (PMEL_HUMAN)
EVMGTTLAK

SEQ ID NO: 132037 - protein, 9 aa, Artificial Sequence
  Description of Artificial Sequence: Synthetic peptide
  Seed: MPTAESTGM (PMEL_HUMAN)
MLTAESTGY

SEQ ID NO: 132038 - protein, 9 aa, Artificial Sequence
  Description of Artificial Sequence: Synthetic peptide
  Seed: SGEGDAFEL (PMEL_HUMAN)
SAEGDAFEM

SEQ ID NO: 132039 - protein, 10 aa, Artificial Sequence
  Description of Artificial Sequence: Synthetic peptide
  Seed: AVIGALLAVG (PMEL_HUMAN)
ALIGALLAVV

SEQ ID NO: 132040 - protein, 9 aa, Artificial Sequence
  Description of Artificial Sequence: Synthetic peptide
  Seed: YHRRGSRSY (PMEL_HUMAN)
YMRRGSRSF

SEQ ID NO: 132041 - protein, 10 aa, Artificial Sequence
  Description of Artificial Sequence: Synthetic peptide
  Seed: MTPAEVSIVV (PMEL_HUMAN)
MWPAEVSIVI

SEQ ID NO: 132042 - protein, 9 aa, Artificial Sequence
  Description of Artificial Sequence: Synthetic peptide
  Seed: RGGQVSLKV (PMEL_HUMAN)
RMGQVSLKV

SEQ ID NO: 132043 - protein, 9 aa, Artificial Sequence
  Description of Artificial Sequence: Synthetic peptide
  Seed: AVIGALLAV (PMEL_HUMAN)
ATIGALLAI

SEQ ID NO: 132044 - protein, 9 aa, Artificial Sequence
  Description of Artificial Sequence: Synthetic peptide
  Seed: FTITDQVPF (PMEL_HUMAN)
FLITDQVPV

SEQ ID NO: 132045 - protein, 9 aa, Artificial Sequence
  Description of Artificial Sequence: Synthetic peptide
  Seed: QPVLPSPAC (PMEL_HUMAN)
QHVLPSPAL

SEQ ID NO: 132046 - protein, 10 aa, Artificial Sequence
  Description of Artificial Sequence: Synthetic peptide
  Seed: TAAQVTTTEW (PMEL_HUMAN)
TQAQVTTTEL

SEQ ID NO: 132047 - protein, 9 aa, Artificial Sequence
  Description of Artificial Sequence: Synthetic peptide
  Seed: LIVGILLVL (PMEL_HUMAN)
LLVGILLVL

SEQ ID NO: 132048 - protein, 9 aa, Artificial Sequence
  Description of Artificial Sequence: Synthetic peptide
  Seed: LQAAIPLTS (PMEL_HUMAN)
LMAAIPLTI

SEQ ID NO: 132049 - protein, 11 aa, Artificial Sequence
  Description of Artificial Sequence: Synthetic peptide
  Seed: VLMAVVLASLI (PMEL_HUMAN)
VMMAVVLASLI

SEQ ID NO: 132050 - protein, 9 aa, Artificial Sequence
  Description of Artificial Sequence: Synthetic peptide
  Seed: KTWGQYWQV (PMEL_HUMAN)
KMWGQYWQT

SEQ ID NO: 132051 - protein, 9 aa, Artificial Sequence
  Description of Artificial Sequence: Synthetic peptide
  Seed: VSCQGGLPK (PMEL_HUMAN)
VVCQGGLPR

SEQ ID NO: 132052 - protein, 10 aa, Artificial Sequence
  Description of Artificial Sequence: Synthetic peptide
  Seed: HTMEVTVYHR (PMEL_HUMAN)
HSMEVTVYHK

SEQ ID NO: 132053 - protein, 9 aa, Artificial Sequence
  Description of Artificial Sequence: Synthetic peptide
  Seed: YLEPGPVTA (PMEL_HUMAN)
YIEPGPVTI

SEQ ID NO: 132054 - protein, 9 aa, Artificial Sequence
  Description of Artificial Sequence: Synthetic peptide
  Seed: WQVLGGPVS (PMEL_HUMAN)
WSVLGGPVM

SEQ ID NO: 132055 - protein, 11 aa, Artificial Sequence
  Description of Artificial Sequence: Synthetic peptide
  Seed: RSFVYVWKTWG (PMEL_HUMAN)
RSFVYVWKTWW

SEQ ID NO: 132056 - protein, 10 aa, Artificial Sequence
  Description of Artificial Sequence: Synthetic peptide
  Seed: ALDGGNKHFL (PMEL_HUMAN)
AQDGGNKHFY

SEQ ID NO: 132057 - protein, 9 aa, Artificial Sequence
  Description of Artificial Sequence: Synthetic peptide
  Seed: LQAAIPLTS (PMEL_HUMAN)
LSAAIPLTF

SEQ ID NO: 132058 - protein, 11 aa, Artificial Sequence
  Description of Artificial Sequence: Synthetic peptide
  Seed: TWDFGDSSGTL (PMEL_HUMAN)
TTDFGDSSGTW

SEQ ID NO: 132059 - protein, 10 aa, Artificial Sequence
  Description of Artificial Sequence: Synthetic peptide
  Seed: NSLAVVSTQL (PMEL_HUMAN)
NRLAVVSTQV

SEQ ID NO: 132060 - protein, 10 aa, Artificial Sequence
  Description of Artificial Sequence: Synthetic peptide
  Seed: SGTYCLNVSL (PMEL_HUMAN)
SHTYCLNVSV

SEQ ID NO: 132061 - protein, 10 aa, Artificial Sequence
  Description of Artificial Sequence: Synthetic peptide
  Seed: RGSRSYVPLA (PMEL_HUMAN)
RNSRSYVPLV

SEQ ID NO: 132062 - protein, 11 aa, Artificial Sequence
  Description of Artificial Sequence: Synthetic peptide
  Seed: SYVPLAHSSSA (PMEL_HUMAN)
SLVPLAHSSSF

SEQ ID NO: 132063 - protein, 10 aa, Artificial Sequence
  Description of Artificial Sequence: Synthetic peptide
  Seed: RQLYPEWTEA (PMEL_HUMAN)
RVLYPEWTEF

SEQ ID NO: 132064 - protein, 9 aa, Artificial Sequence
  Description of Artificial Sequence: Synthetic peptide
  Seed: KQDFSVPQL (PMEL_HUMAN)
KSDFSVPQI

SEQ ID NO: 132065 - protein, 9 aa, Artificial Sequence
  Description of Artificial Sequence: Synthetic peptide
  Seed: SLADTNSLA (PMEL_HUMAN)
SMADTNSLI

SEQ ID NO: 132066 - protein, 9 aa, Artificial Sequence
  Description of Artificial Sequence: Synthetic peptide
  Seed: SQKRSFVYV (PMEL_HUMAN)
SSKRSFVYK

SEQ ID NO: 132067 - protein, 11 aa, Artificial Sequence
  Description of Artificial Sequence: Synthetic peptide
  Seed: APTAEPSGTTS (PMEL_HUMAN)
APTAEPSGTTV

SEQ ID NO: 132068 - protein, 9 aa, Artificial Sequence
  Description of Artificial Sequence: Synthetic peptide
  Seed: RGSRSYVPL (PMEL_HUMAN)
RTSRSYVPA

SEQ ID NO: 132069 - protein, 9 aa, Artificial Sequence
  Description of Artificial Sequence: Synthetic peptide
  Seed: SVPQLPHSS (PMEL_HUMAN)
SGPQLPHSF

SEQ ID NO: 132070 - protein, 11 aa, Artificial Sequence
  Description of Artificial Sequence: Synthetic peptide
  Seed: LGPLLDGTATL (PMEL_HUMAN)
LKPLLDGTATV

SEQ ID NO: 132071 - protein, 9 aa, Artificial Sequence
  Description of Artificial Sequence: Synthetic peptide
  Seed: SVQVPTTEV (PMEL_HUMAN)
STQVPTTEF

SEQ ID NO: 132072 - protein, 9 aa, Artificial Sequence
  Description of Artificial Sequence: Synthetic peptide
  Seed: WSQKRSFVY (PMEL_HUMAN)
WMQKRSFVY

SEQ ID NO: 132073 - protein, 9 aa, Artificial Sequence
  Description of Artificial Sequence: Synthetic peptide
  Seed: ILKGGSGTY (PMEL_HUMAN)
IMKGGSGTL

SEQ ID NO: 132074 - protein, 10 aa, Artificial Sequence
  Description of Artificial Sequence: Synthetic peptide
  Seed: THTMEVTVYH (PMEL_HUMAN)
TETMEVTVYY

SEQ ID NO: 132075 - protein, 9 aa, Artificial Sequence
  Description of Artificial Sequence: Synthetic peptide
  Seed: AVGATKVPR (PMEL_HUMAN)
AMGATKVPR

SEQ ID NO: 132076 - protein, 10 aa, Artificial Sequence
  Description of Artificial Sequence: Synthetic peptide
  Seed: MSTESITGSL (PMEL_HUMAN)
MITESITGSV

SEQ ID NO: 132077 - protein, 10 aa, Artificial Sequence
  Description of Artificial Sequence: Synthetic peptide
  Seed: VVLASLIYRR (PMEL_HUMAN)
VFLASLIYRR

SEQ ID NO: 132078 - protein, 10 aa, Artificial Sequence
  Description of Artificial Sequence: Synthetic peptide
  Seed: GPLLDGTATL (PMEL_HUMAN)
GALLDGTATA

SEQ ID NO: 132079 - protein, 9 aa, Artificial Sequence
  Description of Artificial Sequence: Synthetic peptide
  Seed: HTMEVTVYH (PMEL_HUMAN)
HTMEVTVYA

SEQ ID NO: 132080 - protein, 9 aa, Artificial Sequence
  Description of Artificial Sequence: Synthetic peptide
  Seed: VVLQAAIPL (PMEL_HUMAN)
VQLQAAIPW

SEQ ID NO: 132081 - protein, 9 aa, Artificial Sequence
  Description of Artificial Sequence: Synthetic peptide
  Seed: HTMEVTVYH (PMEL_HUMAN)
HLMEVTVYV

SEQ ID NO: 132082 - protein, 9 aa, Artificial Sequence
  Description of Artificial Sequence: Synthetic peptide
  Seed: GSFSVTLDI (PMEL_HUMAN)
GQFSVTLDF

SEQ ID NO: 132083 - protein, 10 aa, Artificial Sequence
  Description of Artificial Sequence: Synthetic peptide
  Seed: MTPAEVSIVV (PMEL_HUMAN)
MFPAEVSIVV

SEQ ID NO: 132084 - protein, 10 aa, Artificial Sequence
  Description of Artificial Sequence: Synthetic peptide
  Seed: MTPAEVSIVV (PMEL_HUMAN)
MTPAEVSIVT

SEQ ID NO: 132085 - protein, 9 aa, Artificial Sequence
  Description of Artificial Sequence: Synthetic peptide
  Seed: AQRLCQPVL (PMEL_HUMAN)
ATRLCQPVA

SEQ ID NO: 132086 - protein, 10 aa, Artificial Sequence
  Description of Artificial Sequence: Synthetic peptide
  Seed: MTPAEVSIVV (PMEL_HUMAN)
MYPAEVSIVH

SEQ ID NO: 132087 - protein, 9 aa, Artificial Sequence
  Description of Artificial Sequence: Synthetic peptide
  Seed: TAPVQMPTA (PMEL_HUMAN)
TLPVQMPTM

SEQ ID NO: 132088 - protein, 9 aa, Artificial Sequence
  Description of Artificial Sequence: Synthetic peptide
  Seed: VPLDCVLYR (PMEL_HUMAN)
VMLDCVLYR

SEQ ID NO: 132089 - protein, 9 aa, Artificial Sequence
  Description of Artificial Sequence: Synthetic peptide
  Seed: AGLGQVPLI (PMEL_HUMAN)
ALLGQVPLM

SEQ ID NO: 132090 - protein, 9 aa, Artificial Sequence
  Description of Artificial Sequence: Synthetic peptide
  Seed: ITDQVPFSV (PMEL_HUMAN)
IRDQVPFSM

SEQ ID NO: 132091 - protein, 10 aa, Artificial Sequence
  Description of Artificial Sequence: Synthetic peptide
  Seed: RGSRSYVPLA (PMEL_HUMAN)
RMSRSYVPLF

SEQ ID NO: 132092 - protein, 11 aa, Artificial Sequence
  Description of Artificial Sequence: Synthetic peptide
  Seed: KVLPDGQVIWV (PMEL_HUMAN)
KSLPDGQVIWY

SEQ ID NO: 132093 - protein, 10 aa, Artificial Sequence
  Description of Artificial Sequence: Synthetic peptide
  Seed: MKQDFSVPQL (PMEL_HUMAN)
MVQDFSVPQF

SEQ ID NO: 132094 - protein, 10 aa, Artificial Sequence
  Description of Artificial Sequence: Synthetic peptide
  Seed: VVLASLIYRR (PMEL_HUMAN)
VMLASLIYRR

SEQ ID NO: 132095 - protein, 10 aa, Artificial Sequence
  Description of Artificial Sequence: Synthetic peptide
  Seed: KRQVPLDCVL (PMEL_HUMAN)
KHQVPLDCVY

SEQ ID NO: 132096 - protein, 10 aa, Artificial Sequence
  Description of Artificial Sequence: Synthetic peptide
  Seed: LVLMAVVLAS (PMEL_HUMAN)
LYLMAVVLAM

SEQ ID NO: 132097 - protein, 10 aa, Artificial Sequence
  Description of Artificial Sequence: Synthetic peptide
  Seed: RTKAWNRQLY (PMEL_HUMAN)
RSKAWNRQLM

SEQ ID NO: 132098 - protein, 9 aa, Artificial Sequence
  Description of Artificial Sequence: Synthetic peptide
  Seed: HLAVIGALL (PMEL_HUMAN)
HLAVIGALA

SEQ ID NO: 132099 - protein, 10 aa, Artificial Sequence
  Description of Artificial Sequence: Synthetic peptide
  Seed: GLPKEACMEI (PMEL_HUMAN)
GLPKEACMEV

SEQ ID NO: 132100 - protein, 10 aa, Artificial Sequence
  Description of Artificial Sequence: Synthetic peptide
  Seed: QVPLDCVLYR (PMEL_HUMAN)
QIPLDCVLYK

SEQ ID NO: 132101 - protein, 10 aa, Artificial Sequence
  Description of Artificial Sequence: Synthetic peptide
  Seed: LLHLAVIGAL (PMEL_HUMAN)
LLHLAVIGAA

SEQ ID NO: 132102 - protein, 9 aa, Artificial Sequence
  Description of Artificial Sequence: Synthetic peptide
  Seed: VLKRCLLHL (PMEL_HUMAN)
VMKRCLLHR

SEQ ID NO: 132103 - protein, 8 aa, Artificial Sequence
  Description of Artificial Sequence: Synthetic peptide
  Seed: SNDGPTLI (PMEL_HUMAN)
SIDGPTLL

SEQ ID NO: 132104 - protein, 9 aa, Artificial Sequence
  Description of Artificial Sequence: Synthetic peptide
  Seed: SSIMSTESI (PMEL_HUMAN)
SAIMSTESF

SEQ ID NO: 132105 - protein, 9 aa, Artificial Sequence
  Description of Artificial Sequence: Synthetic peptide
  Seed: YLAEADLSY (PMEL_HUMAN)
YVAEADLSM

SEQ ID NO: 132106 - protein, 10 aa, Artificial Sequence
  Description of Artificial Sequence: Synthetic peptide
  Seed: HTMEVTVYHR (PMEL_HUMAN)
HYMEVTVYHK

SEQ ID NO: 132107 - protein, 10 aa, Artificial Sequence
  Description of Artificial Sequence: Synthetic peptide
  Seed: LHLAVIGALL (PMEL_HUMAN)
LHLAVIGALV

SEQ ID NO: 132108 - protein, 9 aa, Artificial Sequence
  Description of Artificial Sequence: Synthetic peptide
  Seed: IVVLSGTTA (PMEL_HUMAN)
IAVLSGTTH

SEQ ID NO: 132109 - protein, 10 aa, Artificial Sequence
  Description of Artificial Sequence: Synthetic peptide
  Seed: MTPAEVSIVV (PMEL_HUMAN)
MDPAEVSIVF

SEQ ID NO: 132110 - protein, 9 aa, Artificial Sequence
  Description of Artificial Sequence: Synthetic peptide
  Seed: VSNDGPTLI (PMEL_HUMAN)
VANDGPTLA

SEQ ID NO: 132111 - protein, 10 aa, Artificial Sequence
  Description of Artificial Sequence: Synthetic peptide
  Seed: LGQVPLIVGI (PMEL_HUMAN)
LSQVPLIVGV

SEQ ID NO: 132112 - protein, 10 aa, Artificial Sequence
  Description of Artificial Sequence: Synthetic peptide
  Seed: LAVVSTQLIM (PMEL_HUMAN)
LSVVSTQLIF

SEQ ID NO: 132113 - protein, 9 aa, Artificial Sequence
  Description of Artificial Sequence: Synthetic peptide
  Seed: VTAQVVLQA (PMEL_HUMAN)
VAAQVVLQF

SEQ ID NO: 132114 - protein, 9 aa, Artificial Sequence
  Description of Artificial Sequence: Synthetic peptide
  Seed: TAEAPNTTA (PMEL_HUMAN)
TIEAPNTTL

SEQ ID NO: 132115 - protein, 10 aa, Artificial Sequence
  Description of Artificial Sequence: Synthetic peptide
  Seed: TYLEPGPVTA (PMEL_HUMAN)
TYLEPGPVTL

SEQ ID NO: 132116 - protein, 9 aa, Artificial Sequence
  Description of Artificial Sequence: Synthetic peptide
  Seed: WSQKRSFVY (PMEL_HUMAN)
WHQKRSFVY

SEQ ID NO: 132117 - protein, 10 aa, Artificial Sequence
  Description of Artificial Sequence: Synthetic peptide
  Seed: YLAEADLSYT (PMEL_HUMAN)
YMAEADLSYG

SEQ ID NO: 132118 - protein, 9 aa, Artificial Sequence
  Description of Artificial Sequence: Synthetic peptide
  Seed: KTWGQYWQV (PMEL_HUMAN)
KCWGQYWQY

SEQ ID NO: 132119 - protein, 10 aa, Artificial Sequence
  Description of Artificial Sequence: Synthetic peptide
  Seed: TYLEPGPVTA (PMEL_HUMAN)
TRLEPGPVTF

SEQ ID NO: 132120 - protein, 9 aa, Artificial Sequence
  Description of Artificial Sequence: Synthetic peptide
  Seed: CVLYRYGSF (PMEL_HUMAN)
CALYRYGSL

SEQ ID NO: 132121 - protein, 9 aa, Artificial Sequence
  Description of Artificial Sequence: Synthetic peptide
  Seed: FLRNQPLTF (PMEL_HUMAN)
FERNQPLTF

SEQ ID NO: 132122 - protein, 10 aa, Artificial Sequence
  Description of Artificial Sequence: Synthetic peptide
  Seed: KRQVPLDCVL (PMEL_HUMAN)
KYQVPLDCVY

SEQ ID NO: 132123 - protein, 10 aa, Artificial Sequence
  Description of Artificial Sequence: Synthetic peptide
  Seed: EVSIVVLSGT (PMEL_HUMAN)
EMSIVVLSGV

SEQ ID NO: 132124 - protein, 9 aa, Artificial Sequence
  Description of Artificial Sequence: Synthetic peptide
  Seed: QLYPEWTEA (PMEL_HUMAN)
QLYPEWTEI

SEQ ID NO: 132125 - protein, 8 aa, Artificial Sequence
  Description of Artificial Sequence: Synthetic peptide
  Seed: SQKRSFVY (PMEL_HUMAN)
SMKRSFVF

SEQ ID NO: 132126 - protein, 10 aa, Artificial Sequence
  Description of Artificial Sequence: Synthetic peptide
  Seed: SHWLRLPRIF (PMEL_HUMAN)
SYWLRLPRIL

SEQ ID NO: 132127 - protein, 9 aa, Artificial Sequence
  Description of Artificial Sequence: Synthetic peptide
  Seed: ALDGGNKHF (PMEL_HUMAN)
AGDGGNKHL

SEQ ID NO: 132128 - protein, 9 aa, Artificial Sequence
  Description of Artificial Sequence: Synthetic peptide
  Seed: VVLSGTTAA (PMEL_HUMAN)
VALSGTTAA

SEQ ID NO: 132129 - protein, 9 aa, Artificial Sequence
  Description of Artificial Sequence: Synthetic peptide
  Seed: VLGGPVSGL (PMEL_HUMAN)
VIGGPVSGL

SEQ ID NO: 132130 - protein, 9 aa, Artificial Sequence
  Description of Artificial Sequence: Synthetic peptide
  Seed: MAVVLASLI (PMEL_HUMAN)
MLVVLASLA

SEQ ID NO: 132131 - protein, 9 aa, Artificial Sequence
  Description of Artificial Sequence: Synthetic peptide
  Seed: VLPSPACQL (PMEL_HUMAN)
VYPSPACQV

SEQ ID NO: 132132 - protein, 9 aa, Artificial Sequence
  Description of Artificial Sequence: Synthetic peptide
  Seed: TTDGHRPTA (PMEL_HUMAN)
TFDGHRPTY

SEQ ID NO: 132133 - protein, 9 aa, Artificial Sequence
  Description of Artificial Sequence: Synthetic peptide
  Seed: VLPSPACQL (PMEL_HUMAN)
VRPSPACQL

SEQ ID NO: 132134 - protein, 9 aa, Artificial Sequence
  Description of Artificial Sequence: Synthetic peptide
  Seed: LQLHDPSGY (PMEL_HUMAN)
LLLHDPSGY

SEQ ID NO: 132135 - protein, 9 aa, Artificial Sequence
  Description of Artificial Sequence: Synthetic peptide
  Seed: DAFELTVSC (PMEL_HUMAN)
DPFELTVSI

SEQ ID NO: 132136 - protein, 10 aa, Artificial Sequence
  Description of Artificial Sequence: Synthetic peptide
  Seed: MTPAEVSIVV (PMEL_HUMAN)
MNPAEVSIVM

SEQ ID NO: 132137 - protein, 8 aa, Artificial Sequence
  Description of Artificial Sequence: Synthetic peptide
  Seed: AMLGTHTM (PMEL_HUMAN)
AQLGTHTF

SEQ ID NO: 132138 - protein, 10 aa, Artificial Sequence
  Description of Artificial Sequence: Synthetic peptide
  Seed: YVPLAHSSSA (PMEL_HUMAN)
YSPLAHSSSM

SEQ ID NO: 132139 - protein, 8 aa, Artificial Sequence
  Description of Artificial Sequence: Synthetic peptide
  Seed: LHDPSGYL (PMEL_HUMAN)
LTDPSGYV

SEQ ID NO: 132140 - protein, 9 aa, Artificial Sequence
  Description of Artificial Sequence: Synthetic peptide
  Seed: TPAEVSIVV (PMEL_HUMAN)
TMAEVSIVY

SEQ ID NO: 132141 - protein, 10 aa, Artificial Sequence
  Description of Artificial Sequence: Synthetic peptide
  Seed: YRYGSFSVTL (PMEL_HUMAN)
YRYGSFSVTR

SEQ ID NO: 132142 - protein, 9 aa, Artificial Sequence
  Description of Artificial Sequence: Synthetic peptide
  Seed: DQVPFSVSV (PMEL_HUMAN)
DSVPFSVSL

SEQ ID NO: 132143 - protein, 9 aa, Artificial Sequence
  Description of Artificial Sequence: Synthetic peptide
  Seed: FSVSVSQLR (PMEL_HUMAN)
FTVSVSQLF

SEQ ID NO: 132144 - protein, 10 aa, Artificial Sequence
  Description of Artificial Sequence: Synthetic peptide
  Seed: RELPIPEPEG (PMEL_HUMAN)
RELPIPEPEI

SEQ ID NO: 132145 - protein, 10 aa, Artificial Sequence
  Description of Artificial Sequence: Synthetic peptide
  Seed: RRLMKQDFSV (PMEL_HUMAN)
RFLMKQDFSI

SEQ ID NO: 132146 - protein, 9 aa, Artificial Sequence
  Description of Artificial Sequence: Synthetic peptide
  Seed: ALDGGNKHF (PMEL_HUMAN)
AADGGNKHY

SEQ ID NO: 132147 - protein, 9 aa, Artificial Sequence
  Description of Artificial Sequence: Synthetic peptide
  Seed: SSIMSTESI (PMEL_HUMAN)
SIIMSTESL

SEQ ID NO: 132148 - protein, 9 aa, Artificial Sequence
  Description of Artificial Sequence: Synthetic peptide
  Seed: ESAEILQAV (PMEL_HUMAN)
ERAEILQAL

SEQ ID NO: 132149 - protein, 10 aa, Artificial Sequence
  Description of Artificial Sequence: Synthetic peptide
  Seed: LIGANASFSI (PMEL_HUMAN)
LIGANASFSV

SEQ ID NO: 132150 - protein, 10 aa, Artificial Sequence
  Description of Artificial Sequence: Synthetic peptide
  Seed: MKQDFSVPQL (PMEL_HUMAN)
MIQDFSVPQV

SEQ ID NO: 132151 - protein, 9 aa, Artificial Sequence
  Description of Artificial Sequence: Synthetic peptide
  Seed: TIINGSQVW (PMEL_HUMAN)
TSINGSQVY

SEQ ID NO: 132152 - protein, 9 aa, Artificial Sequence
  Description of Artificial Sequence: Synthetic peptide
  Seed: VSVSQLRAL (PMEL_HUMAN)
VMVSQLRAV

SEQ ID NO: 132153 - protein, 10 aa, Artificial Sequence
  Description of Artificial Sequence: Synthetic peptide
  Seed: EVSIVVLSGT (PMEL_HUMAN)
EFSIVVLSGV

SEQ ID NO: 132154 - protein, 10 aa, Artificial Sequence
  Description of Artificial Sequence: Synthetic peptide
  Seed: LADTNSLAVV (PMEL_HUMAN)
LTDTNSLAVM

SEQ ID NO: 132155 - protein, 9 aa, Artificial Sequence
  Description of Artificial Sequence: Synthetic peptide
  Seed: RSYVPLAHS (PMEL_HUMAN)
RSYVPLAHI

SEQ ID NO: 132156 - protein, 9 aa, Artificial Sequence
  Description of Artificial Sequence: Synthetic peptide
  Seed: GQVPLIVGI (PMEL_HUMAN)
GLVPLIVGF

SEQ ID NO: 132157 - protein, 10 aa, Artificial Sequence
  Description of Artificial Sequence: Synthetic peptide
  Seed: EVVGTTPGQA (PMEL_HUMAN)
ESVGTTPGQK

SEQ ID NO: 132158 - protein, 10 aa, Artificial Sequence
  Description of Artificial Sequence: Synthetic peptide
  Seed: QVLGGPVSGL (PMEL_HUMAN)
QMLGGPVSGR

SEQ ID NO: 132159 - protein, 9 aa, Artificial Sequence
  Description of Artificial Sequence: Synthetic peptide
  Seed: RAMLGTHTM (PMEL_HUMAN)
RRMLGTHTY

SEQ ID NO: 132160 - protein, 10 aa, Artificial Sequence
  Description of Artificial Sequence: Synthetic peptide
  Seed: RALVVTHTYL (PMEL_HUMAN)
RMLVVTHTYI

SEQ ID NO: 132161 - protein, 9 aa, Artificial Sequence
  Description of Artificial Sequence: Synthetic peptide
  Seed: RNQPLTFAL (PMEL_HUMAN)
RAQPLTFAV

SEQ ID NO: 132162 - protein, 10 aa, Artificial Sequence
  Description of Artificial Sequence: Synthetic peptide
  Seed: MPTAESTGMT (PMEL_HUMAN)
MNTAESTGMV

SEQ ID NO: 132163 - protein, 10 aa, Artificial Sequence
  Description of Artificial Sequence: Synthetic peptide
  Seed: YRYGSFSVTL (PMEL_HUMAN)
YFYGSFSVTI

SEQ ID NO: 132164 - protein, 9 aa, Artificial Sequence
  Description of Artificial Sequence: Synthetic peptide
  Seed: TLIGANASF (PMEL_HUMAN)
TAIGANASY

SEQ ID NO: 132165 - protein, 9 aa, Artificial Sequence
  Description of Artificial Sequence: Synthetic peptide
  Seed: FLRNQPLTF (PMEL_HUMAN)
FIRNQPLTF

SEQ ID NO: 132166 - protein, 10 aa, Artificial Sequence
  Description of Artificial Sequence: Synthetic peptide
  Seed: VVLASLIYRR (PMEL_HUMAN)
VMLASLIYRM

SEQ ID NO: 132167 - protein, 11 aa, Artificial Sequence
  Description of Artificial Sequence: Synthetic peptide
  Seed: AESTGMTPEKV (PMEL_HUMAN)
AESTGMTPEKL

SEQ ID NO: 132168 - protein, 9 aa, Artificial Sequence
  Description of Artificial Sequence: Synthetic peptide
  Seed: RALVVTHTY (PMEL_HUMAN)
RTLVVTHTI

SEQ ID NO: 132169 - protein, 9 aa, Artificial Sequence
  Description of Artificial Sequence: Synthetic peptide
  Seed: ALNFPGSQK (PMEL_HUMAN)
AINFPGSQY

SEQ ID NO: 132170 - protein, 9 aa, Artificial Sequence
  Description of Artificial Sequence: Synthetic peptide
  Seed: VLASLIYRR (PMEL_HUMAN)
VQASLIYRK

SEQ ID NO: 132171 - protein, 10 aa, Artificial Sequence
  Description of Artificial Sequence: Synthetic peptide
  Seed: MKQDFSVPQL (PMEL_HUMAN)
MSQDFSVPQF

SEQ ID NO: 132172 - protein, 9 aa, Artificial Sequence
  Description of Artificial Sequence: Synthetic peptide
  Seed: MAVVLASLI (PMEL_HUMAN)
MTVVLASLW

SEQ ID NO: 132173 - protein, 9 aa, Artificial Sequence
  Description of Artificial Sequence: Synthetic peptide
  Seed: SVQVPTTEV (PMEL_HUMAN)
SPQVPTTEF

SEQ ID NO: 132174 - protein, 9 aa, Artificial Sequence
  Description of Artificial Sequence: Synthetic peptide
  Seed: VSLADTNSL (PMEL_HUMAN)
VKLADTNSM

SEQ ID NO: 132175 - protein, 10 aa, Artificial Sequence
  Description of Artificial Sequence: Synthetic peptide
  Seed: HTMEVTVYHR (PMEL_HUMAN)
HVMEVTVYHK

SEQ ID NO: 132176 - protein, 10 aa, Artificial Sequence
  Description of Artificial Sequence: Synthetic peptide
  Seed: MTPAEVSIVV (PMEL_HUMAN)
MTPAEVSIVH

SEQ ID NO: 132177 - protein, 9 aa, Artificial Sequence
  Description of Artificial Sequence: Synthetic peptide
  Seed: FPDGGPCPS (PMEL_HUMAN)
FADGGPCPF

SEQ ID NO: 132178 - protein, 9 aa, Artificial Sequence
  Description of Artificial Sequence: Synthetic peptide
  Seed: SQVWGGQPV (PMEL_HUMAN)
SEVWGGQPP

SEQ ID NO: 132179 - protein, 9 aa, Artificial Sequence
  Description of Artificial Sequence: Synthetic peptide
  Seed: TAQVVLQAA (PMEL_HUMAN)
TPQVVLQAT

SEQ ID NO: 132180 - protein, 9 aa, Artificial Sequence
  Description of Artificial Sequence: Synthetic peptide
  Seed: QAAIPLTSC (PMEL_HUMAN)
QPAIPLTSF

SEQ ID NO: 132181 - protein, 9 aa, Artificial Sequence
  Description of Artificial Sequence: Synthetic peptide
  Seed: QVWGGQPVY (PMEL_HUMAN)
QIWGGQPVF

SEQ ID NO: 132182 - protein, 9 aa, Artificial Sequence
  Description of Artificial Sequence: Synthetic peptide
  Seed: SLADTNSLA (PMEL_HUMAN)
SLADTNSLT

SEQ ID NO: 132183 - protein, 10 aa, Artificial Sequence
  Description of Artificial Sequence: Synthetic peptide
  Seed: SITGSLGPLL (PMEL_HUMAN)
SLTGSLGPLV

SEQ ID NO: 132184 - protein, 9 aa, Artificial Sequence
  Description of Artificial Sequence: Synthetic peptide
  Seed: ITGSLGPLL (PMEL_HUMAN)
IMGSLGPLI

SEQ ID NO: 132185 - protein, 10 aa, Artificial Sequence
  Description of Artificial Sequence: Synthetic peptide
  Seed: AVIGALLAVG (PMEL_HUMAN)
AVIGALLAVI

SEQ ID NO: 132186 - protein, 9 aa, Artificial Sequence
  Description of Artificial Sequence: Synthetic peptide
  Seed: AEADLSYTW (PMEL_HUMAN)
AEADLSYTY

SEQ ID NO: 132187 - protein, 9 aa, Artificial Sequence
  Description of Artificial Sequence: Synthetic peptide
  Seed: QDFSVPQLP (PMEL_HUMAN)
QEFSVPQLT

SEQ ID NO: 132188 - protein, 10 aa, Artificial Sequence
  Description of Artificial Sequence: Synthetic peptide
  Seed: GILLVLMAVV (PMEL_HUMAN)
GMLLVLMAVV

SEQ ID NO: 132189 - protein, 11 aa, Artificial Sequence
  Description of Artificial Sequence: Synthetic peptide
  Seed: IPLTSCGSSPV (PMEL_HUMAN)
IPLTSCGSSPM

SEQ ID NO: 132190 - protein, 9 aa, Artificial Sequence
  Description of Artificial Sequence: Synthetic peptide
  Seed: VLGGPVSGL (PMEL_HUMAN)
VMGGPVSGV

SEQ ID NO: 132191 - protein, 10 aa, Artificial Sequence
  Description of Artificial Sequence: Synthetic peptide
  Seed: RQVPLDCVLY (PMEL_HUMAN)
RHVPLDCVLY

SEQ ID NO: 132192 - protein, 8 aa, Artificial Sequence
  Description of Artificial Sequence: Synthetic peptide
  Seed: SNDGPTLI (PMEL_HUMAN)
SSDGPTLM

SEQ ID NO: 132193 - protein, 10 aa, Artificial Sequence
  Description of Artificial Sequence: Synthetic peptide
  Seed: VVLASLIYRR (PMEL_HUMAN)
VMLASLIYRY

SEQ ID NO: 132194 - protein, 9 aa, Artificial Sequence
  Description of Artificial Sequence: Synthetic peptide
  Seed: RLMKQDFSV (PMEL_HUMAN)
RVMKQDFSK

SEQ ID NO: 132195 - protein, 9 aa, Artificial Sequence
  Description of Artificial Sequence: Synthetic peptide
  Seed: VLMAVVLAS (PMEL_HUMAN)
VQMAVVLAM

SEQ ID NO: 132196 - protein, 9 aa, Artificial Sequence
  Description of Artificial Sequence: Synthetic peptide
  Seed: QVIWVNNTI (PMEL_HUMAN)
QTIWVNNTF

SEQ ID NO: 132197 - protein, 9 aa, Artificial Sequence
  Description of Artificial Sequence: Synthetic peptide
  Seed: CPIGENSPL (PMEL_HUMAN)
CVIGENSPM

SEQ ID NO: 132198 - protein, 10 aa, Artificial Sequence
  Description of Artificial Sequence: Synthetic peptide
  Seed: SLAVVSTQLI (PMEL_HUMAN)
SLAVVSTQLL

SEQ ID NO: 132199 - protein, 8 aa, Artificial Sequence
  Description of Artificial Sequence: Synthetic peptide
  Seed: FGDSSGTL (PMEL_HUMAN)
FNDSSGTL

SEQ ID NO: 132200 - protein, 10 aa, Artificial Sequence
  Description of Artificial Sequence: Synthetic peptide
  Seed: GPLLDGTATL (PMEL_HUMAN)
GGLLDGTATV

SEQ ID NO: 132201 - protein, 9 aa, Artificial Sequence
  Description of Artificial Sequence: Synthetic peptide
  Seed: SSHWLRLPR (PMEL_HUMAN)
SYHWLRLPK

SEQ ID NO: 132202 - protein, 9 aa, Artificial Sequence
  Description of Artificial Sequence: Synthetic peptide
  Seed: VLPSPACQL (PMEL_HUMAN)
VAPSPACQI

SEQ ID NO: 132203 - protein, 10 aa, Artificial Sequence
  Description of Artificial Sequence: Synthetic peptide
  Seed: SVPQLPHSSS (PMEL_HUMAN)
SNPQLPHSSV

SEQ ID NO: 132204 - protein, 9 aa, Artificial Sequence
  Description of Artificial Sequence: Synthetic peptide
  Seed: DGGNKHFLR (PMEL_HUMAN)
DMGNKHFLR

SEQ ID NO: 132205 - protein, 9 aa, Artificial Sequence
  Description of Artificial Sequence: Synthetic peptide
  Seed: GSFSVTLDI (PMEL_HUMAN)
GIFSVTLDL

SEQ ID NO: 132206 - protein, 10 aa, Artificial Sequence
  Description of Artificial Sequence: Synthetic peptide
  Seed: MAVVLASLIY (PMEL_HUMAN)
MMVVLASLIW

SEQ ID NO: 132207 - protein, 10 aa, Artificial Sequence
  Description of Artificial Sequence: Synthetic peptide
  Seed: VVLASLIYRR (PMEL_HUMAN)
VMLASLIYRD

SEQ ID NO: 132208 - protein, 10 aa, Artificial Sequence
  Description of Artificial Sequence: Synthetic peptide
  Seed: SVTLDIVQGI (PMEL_HUMAN)
SKTLDIVQGV

SEQ ID NO: 132209 - protein, 10 aa, Artificial Sequence
  Description of Artificial Sequence: Synthetic peptide
  Seed: SSSHWLRLPR (PMEL_HUMAN)
SRSHWLRLPR

SEQ ID NO: 132210 - protein, 9 aa, Artificial Sequence
  Description of Artificial Sequence: Synthetic peptide
  Seed: FGDSSGTLI (PMEL_HUMAN)
FYDSSGTLT

SEQ ID NO: 132211 - protein, 9 aa, Artificial Sequence
  Description of Artificial Sequence: Synthetic peptide
  Seed: CPIGENSPL (PMEL_HUMAN)
CIIGENSPF

SEQ ID NO: 132212 - protein, 9 aa, Artificial Sequence
  Description of Artificial Sequence: Synthetic peptide
  Seed: FTITDQVPF (PMEL_HUMAN)
FHITDQVPY

SEQ ID NO: 132213 - protein, 10 aa, Artificial Sequence
  Description of Artificial Sequence: Synthetic peptide
  Seed: LMAVVLASLI (PMEL_HUMAN)
LLAVVLASLG

SEQ ID NO: 132214 - protein, 10 aa, Artificial Sequence
  Description of Artificial Sequence: Synthetic peptide
  Seed: YRYGSFSVTL (PMEL_HUMAN)
YHYGSFSVTY

SEQ ID NO: 132215 - protein, 9 aa, Artificial Sequence
  Description of Artificial Sequence: Synthetic peptide
  Seed: TAPVQMPTA (PMEL_HUMAN)
TAPVQMPTF

SEQ ID NO: 132216 - protein, 10 aa, Artificial Sequence
  Description of Artificial Sequence: Synthetic peptide
  Seed: SSHWLRLPRI (PMEL_HUMAN)
SLHWLRLPRR

SEQ ID NO: 132217 - protein, 9 aa, Artificial Sequence
  Description of Artificial Sequence: Synthetic peptide
  Seed: VLPDGQVIW (PMEL_HUMAN)
VQPDGQVIM

SEQ ID NO: 132218 - protein, 9 aa, Artificial Sequence
  Description of Artificial Sequence: Synthetic peptide
  Seed: GMTPAEVSI (PMEL_HUMAN)
GITPAEVSV

SEQ ID NO: 132219 - protein, 10 aa, Artificial Sequence
  Description of Artificial Sequence: Synthetic peptide
  Seed: VSLADTNSLA (PMEL_HUMAN)
VSLADTNSLL

SEQ ID NO: 132220 - protein, 9 aa, Artificial Sequence
  Description of Artificial Sequence: Synthetic peptide
  Seed: SSPGCQPPA (PMEL_HUMAN)
SFPGCQPPL

SEQ ID NO: 132221 - protein, 9 aa, Artificial Sequence
  Description of Artificial Sequence: Synthetic peptide
  Seed: YPQETDDAC (PMEL_HUMAN)
YVQETDDAF

SEQ ID NO: 132222 - protein, 9 aa, Artificial Sequence
  Description of Artificial Sequence: Synthetic peptide
  Seed: LMAVVLASL (PMEL_HUMAN)
LVAVVLASV

SEQ ID NO: 132223 - protein, 9 aa, Artificial Sequence
  Description of Artificial Sequence: Synthetic peptide
  Seed: SYVPLAHSS (PMEL_HUMAN)
SWVPLAHSF

SEQ ID NO: 132224 - protein, 9 aa, Artificial Sequence
  Description of Artificial Sequence: Synthetic peptide
  Seed: LHDPSGYLA (PMEL_HUMAN)
LQDPSGYLI

SEQ ID NO: 132225 - protein, 11 aa, Artificial Sequence
  Description of Artificial Sequence: Synthetic peptide
  Seed: LVLMAVVLASL (PMEL_HUMAN)
LKLMAVVLASI

SEQ ID NO: 132226 - protein, 10 aa, Artificial Sequence
  Description of Artificial Sequence: Synthetic peptide
  Seed: VPLAHSSSAF (PMEL_HUMAN)
VVLAHSSSAF

SEQ ID NO: 132227 - protein, 9 aa, Artificial Sequence
  Description of Artificial Sequence: Synthetic peptide
  Seed: LSIGTGRAM (PMEL_HUMAN)
LLIGTGRAY

SEQ ID NO: 132228 - protein, 9 aa, Artificial Sequence
  Description of Artificial Sequence: Synthetic peptide
  Seed: AVVSTQLIM (PMEL_HUMAN)
AVVSTQLIW

SEQ ID NO: 132229 - protein, 11 aa, Artificial Sequence
  Description of Artificial Sequence: Synthetic peptide
  Seed: TYLEPGPVTAQ (PMEL_HUMAN)
TYLEPGPVTAY

SEQ ID NO: 132230 - protein, 9 aa, Artificial Sequence
  Description of Artificial Sequence: Synthetic peptide
  Seed: HSSSHWLRL (PMEL_HUMAN)
HVSSHWLRK

SEQ ID NO: 132231 - protein, 10 aa, Artificial Sequence
  Description of Artificial Sequence: Synthetic peptide
  Seed: GEGDAFELTV (PMEL_HUMAN)
GEGDAFELTA

SEQ ID NO: 132232 - protein, 9 aa, Artificial Sequence
  Description of Artificial Sequence: Synthetic peptide
  Seed: RAMLGTHTM (PMEL_HUMAN)
RLMLGTHTL

SEQ ID NO: 132233 - protein, 9 aa, Artificial Sequence
  Description of Artificial Sequence: Synthetic peptide
  Seed: HTMEVTVYH (PMEL_HUMAN)
HNMEVTVYR

SEQ ID NO: 132234 - protein, 9 aa, Artificial Sequence
  Description of Artificial Sequence: Synthetic peptide
  Seed: LMAVVLASL (PMEL_HUMAN)
LHAVVLASF

SEQ ID NO: 132235 - protein, 9 aa, Artificial Sequence
  Description of Artificial Sequence: Synthetic peptide
  Seed: LNFPGSQKV (PMEL_HUMAN)
LQFPGSQKV

SEQ ID NO: 132236 - protein, 9 aa, Artificial Sequence
  Description of Artificial Sequence: Synthetic peptide
  Seed: AQRLCQPVL (PMEL_HUMAN)
AVRLCQPVV

SEQ ID NO: 132237 - protein, 9 aa, Artificial Sequence
  Description of Artificial Sequence: Synthetic peptide
  Seed: SAFTITDQV (PMEL_HUMAN)
SVFTITDQW

SEQ ID NO: 132238 - protein, 11 aa, Artificial Sequence
  Description of Artificial Sequence: Synthetic peptide
  Seed: TYLEPGPVTAQ (PMEL_HUMAN)
TYLEPGPVTAM

SEQ ID NO: 132239 - protein, 10 aa, Artificial Sequence
  Description of Artificial Sequence: Synthetic peptide
  Seed: HTMEVTVYHR (PMEL_HUMAN)
HNMEVTVYHR

SEQ ID NO: 132240 - protein, 9 aa, Artificial Sequence
  Description of Artificial Sequence: Synthetic peptide
  Seed: AVIGALLAV (PMEL_HUMAN)
AMIGALLAM

SEQ ID NO: 132241 - protein, 10 aa, Artificial Sequence
  Description of Artificial Sequence: Synthetic peptide
  Seed: LIYRRRLMKQ (PMEL_HUMAN)
LSYRRRLMKK

SEQ ID NO: 132242 - protein, 10 aa, Artificial Sequence
  Description of Artificial Sequence: Synthetic peptide
  Seed: SQKRSFVYVW (PMEL_HUMAN)
SMKRSFVYVF

SEQ ID NO: 132243 - protein, 9 aa, Artificial Sequence
  Description of Artificial Sequence: Synthetic peptide
  Seed: AGQVPTTEV (PMEL_HUMAN)
AVQVPTTEF

SEQ ID NO: 132244 - protein, 8 aa, Artificial Sequence
  Description of Artificial Sequence: Synthetic peptide
  Seed: SEVMGTTL (PMEL_HUMAN)
SEVMGTTA

SEQ ID NO: 132245 - protein, 11 aa, Artificial Sequence
  Description of Artificial Sequence: Synthetic peptide
  Seed: RRGSRSYVPLA (PMEL_HUMAN)
RNGSRSYVPLA

SEQ ID NO: 132246 - protein, 9 aa, Artificial Sequence
  Description of Artificial Sequence: Synthetic peptide
  Seed: VVLSGTTAA (PMEL_HUMAN)
VPLSGTTAI

SEQ ID NO: 132247 - protein, 9 aa, Artificial Sequence
  Description of Artificial Sequence: Synthetic peptide
  Seed: VISTAPVQM (PMEL_HUMAN)
VVSTAPVQM

SEQ ID NO: 132248 - protein, 10 aa, Artificial Sequence
  Description of Artificial Sequence: Synthetic peptide
  Seed: GTHTMEVTVY (PMEL_HUMAN)
GMHTMEVTVF

SEQ ID NO: 132249 - protein, 9 aa, Artificial Sequence
  Description of Artificial Sequence: Synthetic peptide
  Seed: VQMPTAEST (PMEL_HUMAN)
VQMPTAESA

SEQ ID NO: 132250 - protein, 10 aa, Artificial Sequence
  Description of Artificial Sequence: Synthetic peptide
  Seed: RGSRSYVPLA (PMEL_HUMAN)
RTSRSYVPLA

SEQ ID NO: 132251 - protein, 11 aa, Artificial Sequence
  Description of Artificial Sequence: Synthetic peptide
  Seed: CSCPIGENSPL (PMEL_HUMAN)
CSCPIGENSPW

SEQ ID NO: 132252 - protein, 9 aa, Artificial Sequence
  Description of Artificial Sequence: Synthetic peptide
  Seed: ALNFPGSQK (PMEL_HUMAN)
ASNFPGSQM

SEQ ID NO: 132253 - protein, 9 aa, Artificial Sequence
  Description of Artificial Sequence: Synthetic peptide
  Seed: GSSPVPGTT (PMEL_HUMAN)
GTSPVPGTF

SEQ ID NO: 132254 - protein, 9 aa, Artificial Sequence
  Description of Artificial Sequence: Synthetic peptide
  Seed: SGTLISRAL (PMEL_HUMAN)
STTLISRAF

SEQ ID NO: 132255 - protein, 9 aa, Artificial Sequence
  Description of Artificial Sequence: Synthetic peptide
  Seed: TEVISTAPV (PMEL_HUMAN)
TEVISTAPA

SEQ ID NO: 132256 - protein, 10 aa, Artificial Sequence
  Description of Artificial Sequence: Synthetic peptide
  Seed: TDQVPFSVSV (PMEL_HUMAN)
TLQVPFSVSL

SEQ ID NO: 132257 - protein, 10 aa, Artificial Sequence
  Description of Artificial Sequence: Synthetic peptide
  Seed: YRYGSFSVTL (PMEL_HUMAN)
YAYGSFSVTM

SEQ ID NO: 132258 - protein, 9 aa, Artificial Sequence
  Description of Artificial Sequence: Synthetic peptide
  Seed: VPLDCVLYR (PMEL_HUMAN)
VILDCVLYR

SEQ ID NO: 132259 - protein, 9 aa, Artificial Sequence
  Description of Artificial Sequence: Synthetic peptide
  Seed: VSVSQLRAL (PMEL_HUMAN)
VMVSQLRAI

SEQ ID NO: 132260 - protein, 9 aa, Artificial Sequence
  Description of Artificial Sequence: Synthetic peptide
  Seed: VQVPTTEVI (PMEL_HUMAN)
VRVPTTEVL

SEQ ID NO: 132261 - protein, 9 aa, Artificial Sequence
  Description of Artificial Sequence: Synthetic peptide
  Seed: RLMKQDFSV (PMEL_HUMAN)
RTMKQDFSY

SEQ ID NO: 132262 - protein, 10 aa, Artificial Sequence
  Description of Artificial Sequence: Synthetic peptide
  Seed: WKTWGQYWQV (PMEL_HUMAN)
WITWGQYWQI

SEQ ID NO: 132263 - protein, 9 aa, Artificial Sequence
  Description of Artificial Sequence: Synthetic peptide
  Seed: GSRSYVPLA (PMEL_HUMAN)
GSRSYVPLV

SEQ ID NO: 132264 - protein, 9 aa, Artificial Sequence
  Description of Artificial Sequence: Synthetic peptide
  Seed: AEPSGTTSV (PMEL_HUMAN)
AIPSGTTSY

SEQ ID NO: 132265 - protein, 11 aa, Artificial Sequence
  Description of Artificial Sequence: Synthetic peptide
  Seed: GPTLIGANASF (PMEL_HUMAN)
GMTLIGANASF

SEQ ID NO: 132266 - protein, 10 aa, Artificial Sequence
  Description of Artificial Sequence: Synthetic peptide
  Seed: LAEADLSYTW (PMEL_HUMAN)
LPEADLSYTF

SEQ ID NO: 132267 - protein, 9 aa, Artificial Sequence
  Description of Artificial Sequence: Synthetic peptide
  Seed: DQVPFSVSV (PMEL_HUMAN)
DHVPFSVST

SEQ ID NO: 132268 - protein, 10 aa, Artificial Sequence
  Description of Artificial Sequence: Synthetic peptide
  Seed: KTWGQYWQVL (PMEL_HUMAN)
KYWGQYWQVM

SEQ ID NO: 132269 - protein, 9 aa, Artificial Sequence
  Description of Artificial Sequence: Synthetic peptide
  Seed: LNFPGSQKV (PMEL_HUMAN)
LMFPGSQKW

SEQ ID NO: 132270 - protein, 9 aa, Artificial Sequence
  Description of Artificial Sequence: Synthetic peptide
  Seed: DQVPFSVSV (PMEL_HUMAN)
DHVPFSVSL

SEQ ID NO: 132271 - protein, 10 aa, Artificial Sequence
  Description of Artificial Sequence: Synthetic peptide
  Seed: YRYGSFSVTL (PMEL_HUMAN)
YKYGSFSVTH

SEQ ID NO: 132272 - protein, 9 aa, Artificial Sequence
  Description of Artificial Sequence: Synthetic peptide
  Seed: RGSRSYVPL (PMEL_HUMAN)
RFSRSYVPK

SEQ ID NO: 132273 - protein, 9 aa, Artificial Sequence
  Description of Artificial Sequence: Synthetic peptide
  Seed: SAFTITDQV (PMEL_HUMAN)
SLFTITDQV

SEQ ID NO: 132274 - protein, 9 aa, Artificial Sequence
  Description of Artificial Sequence: Synthetic peptide
  Seed: SVPQLPHSS (PMEL_HUMAN)
SIPQLPHSI

SEQ ID NO: 132275 - protein, 9 aa, Artificial Sequence
  Description of Artificial Sequence: Synthetic peptide
  Seed: LTVSCQGGL (PMEL_HUMAN)
LTVSCQGGW

SEQ ID NO: 132276 - protein, 8 aa, Artificial Sequence
  Description of Artificial Sequence: Synthetic peptide
  Seed: TLDIVQGI (PMEL_HUMAN)
TADIVQGL

SEQ ID NO: 132277 - protein, 9 aa, Artificial Sequence
  Description of Artificial Sequence: Synthetic peptide
  Seed: AVIGALLAV (PMEL_HUMAN)
AVIGALLAI

SEQ ID NO: 132278 - protein, 9 aa, Artificial Sequence
  Description of Artificial Sequence: Synthetic peptide
  Seed: FSVSVSQLR (PMEL_HUMAN)
FVVSVSQLR

SEQ ID NO: 132279 - protein, 10 aa, Artificial Sequence
  Description of Artificial Sequence: Synthetic peptide
  Seed: EVMGTTLAEM (PMEL_HUMAN)
ENMGTTLAEK

SEQ ID NO: 132280 - protein, 11 aa, Artificial Sequence
  Description of Artificial Sequence: Synthetic peptide
  Seed: YVPLAHSSSAF (PMEL_HUMAN)
YRPLAHSSSAF

SEQ ID NO: 132281 - protein, 9 aa, Artificial Sequence
  Description of Artificial Sequence: Synthetic peptide
  Seed: AEPSGTTSV (PMEL_HUMAN)
AGPSGTTSF

SEQ ID NO: 132282 - protein, 10 aa, Artificial Sequence
  Description of Artificial Sequence: Synthetic peptide
  Seed: DGTATLRLVK (PMEL_HUMAN)
DSTATLRLVR

SEQ ID NO: 132283 - protein, 9 aa, Artificial Sequence
  Description of Artificial Sequence: Synthetic peptide
  Seed: TTPGQAPTA (PMEL_HUMAN)
TGPGQAPTI

SEQ ID NO: 132284 - protein, 9 aa, Artificial Sequence
  Description of Artificial Sequence: Synthetic peptide
  Seed: YLEPGPVTA (PMEL_HUMAN)
YVEPGPVTA

SEQ ID NO: 132285 - protein, 9 aa, Artificial Sequence
  Description of Artificial Sequence: Synthetic peptide
  Seed: AQVVLQAAI (PMEL_HUMAN)
AVVVLQAAV

SEQ ID NO: 132286 - protein, 10 aa, Artificial Sequence
  Description of Artificial Sequence: Synthetic peptide
  Seed: ESAEILQAVP (PMEL_HUMAN)
EVAEILQAVS

SEQ ID NO: 132287 - protein, 10 aa, Artificial Sequence
  Description of Artificial Sequence: Synthetic peptide
  Seed: MTPAEVSIVV (PMEL_HUMAN)
MPPAEVSIVW

SEQ ID NO: 132288 - protein, 9 aa, Artificial Sequence
  Description of Artificial Sequence: Synthetic peptide
  Seed: AQVVLQAAI (PMEL_HUMAN)
AEVVLQAAI

SEQ ID NO: 132289 - protein, 10 aa, Artificial Sequence
  Description of Artificial Sequence: Synthetic peptide
  Seed: SQKRSFVYVW (PMEL_HUMAN)
SSKRSFVYVW

SEQ ID NO: 132290 - protein, 11 aa, Artificial Sequence
  Description of Artificial Sequence: Synthetic peptide
  Seed: ALDGGNKHFLR (PMEL_HUMAN)
AMDGGNKHFLY

SEQ ID NO: 132291 - protein, 11 aa, Artificial Sequence
  Description of Artificial Sequence: Synthetic peptide
  Seed: AVIGALLAVGA (PMEL_HUMAN)
AQIGALLAVGI

SEQ ID NO: 132292 - protein, 11 aa, Artificial Sequence
  Description of Artificial Sequence: Synthetic peptide
  Seed: VWKTWGQYWQV (PMEL_HUMAN)
VMKTWGQYWQI

SEQ ID NO: 132293 - protein, 11 aa, Artificial Sequence
  Description of Artificial Sequence: Synthetic peptide
  Seed: RALDGGNKHFL (PMEL_HUMAN)
RRLDGGNKHFM

SEQ ID NO: 132294 - protein, 10 aa, Artificial Sequence
  Description of Artificial Sequence: Synthetic peptide
  Seed: VVLASLIYRR (PMEL_HUMAN)
VMLASLIYRP

SEQ ID NO: 132295 - protein, 10 aa, Artificial Sequence
  Description of Artificial Sequence: Synthetic peptide
  Seed: MTPAEVSIVV (PMEL_HUMAN)
MNPAEVSIVH

SEQ ID NO: 132296 - protein, 9 aa, Artificial Sequence
  Description of Artificial Sequence: Synthetic peptide
  Seed: ESAEILQAV (PMEL_HUMAN)
ESAEILQAK

SEQ ID NO: 132297 - protein, 9 aa, Artificial Sequence
  Description of Artificial Sequence: Synthetic peptide
  Seed: ILKGGSGTY (PMEL_HUMAN)
ISKGGSGTF

SEQ ID NO: 132298 - protein, 11 aa, Artificial Sequence
  Description of Artificial Sequence: Synthetic peptide
  Seed: RNQPLTFALQL (PMEL_HUMAN)
RPQPLTFALQM

SEQ ID NO: 132299 - protein, 9 aa, Artificial Sequence
  Description of Artificial Sequence: Synthetic peptide
  Seed: VWKTWGQYW (PMEL_HUMAN)
VSKTWGQYW

SEQ ID NO: 132300 - protein, 10 aa, Artificial Sequence
  Description of Artificial Sequence: Synthetic peptide
  Seed: SQKRSFVYVW (PMEL_HUMAN)
SQKRSFVYVY

SEQ ID NO: 132301 - protein, 9 aa, Artificial Sequence
  Description of Artificial Sequence: Synthetic peptide
  Seed: ANASFSIAL (PMEL_HUMAN)
AMASFSIAF

SEQ ID NO: 132302 - protein, 10 aa, Artificial Sequence
  Description of Artificial Sequence: Synthetic peptide
  Seed: HLAVIGALLA (PMEL_HUMAN)
HLAVIGALLL

SEQ ID NO: 132303 - protein, 10 aa, Artificial Sequence
  Description of Artificial Sequence: Synthetic peptide
  Seed: LAEADLSYTW (PMEL_HUMAN)
LPEADLSYTI

SEQ ID NO: 132304 - protein, 9 aa, Artificial Sequence
  Description of Artificial Sequence: Synthetic peptide
  Seed: LTSCGSSPV (PMEL_HUMAN)
LQSCGSSPI

SEQ ID NO: 132305 - protein, 10 aa, Artificial Sequence
  Description of Artificial Sequence: Synthetic peptide
  Seed: SGTYCLNVSL (PMEL_HUMAN)
SNTYCLNVSV

SEQ ID NO: 132306 - protein, 10 aa, Artificial Sequence
  Description of Artificial Sequence: Synthetic peptide
  Seed: THTMEVTVYH (PMEL_HUMAN)
TGTMEVTVYR

SEQ ID NO: 132307 - protein, 9 aa, Artificial Sequence
  Description of Artificial Sequence: Synthetic peptide
  Seed: VPSGEGDAF (PMEL_HUMAN)
VISGEGDAY

SEQ ID NO: 132308 - protein, 9 aa, Artificial Sequence
  Description of Artificial Sequence: Synthetic peptide
  Seed: TTPGQAPTA (PMEL_HUMAN)
TSPGQAPTF

SEQ ID NO: 132309 - protein, 10 aa, Artificial Sequence
  Description of Artificial Sequence: Synthetic peptide
  Seed: GSRSYVPLAH (PMEL_HUMAN)
GSRSYVPLAA

SEQ ID NO: 132310 - protein, 10 aa, Artificial Sequence
  Description of Artificial Sequence: Synthetic peptide
  Seed: LHLAVIGALL (PMEL_HUMAN)
LALAVIGALL

SEQ ID NO: 132311 - protein, 9 aa, Artificial Sequence
  Description of Artificial Sequence: Synthetic peptide
  Seed: TPAEVSIVV (PMEL_HUMAN)
TVAEVSIVF

SEQ ID NO: 132312 - protein, 9 aa, Artificial Sequence
  Description of Artificial Sequence: Synthetic peptide
  Seed: LQLHDPSGY (PMEL_HUMAN)
LMLHDPSGY

SEQ ID NO: 132313 - protein, 9 aa, Artificial Sequence
  Description of Artificial Sequence: Synthetic peptide
  Seed: YRYGSFSVT (PMEL_HUMAN)
YQYGSFSVM

SEQ ID NO: 132314 - protein, 10 aa, Artificial Sequence
  Description of Artificial Sequence: Synthetic peptide
  Seed: ESAEILQAVP (PMEL_HUMAN)
ETAEILQAVC

SEQ ID NO: 132315 - protein, 9 aa, Artificial Sequence
  Description of Artificial Sequence: Synthetic peptide
  Seed: TEAQRLDCW (PMEL_HUMAN)
TEAQRLDCL

SEQ ID NO: 132316 - protein, 9 aa, Artificial Sequence
  Description of Artificial Sequence: Synthetic peptide
  Seed: TAEAPNTTA (PMEL_HUMAN)
TPEAPNTTV

SEQ ID NO: 132317 - protein, 9 aa, Artificial Sequence
  Description of Artificial Sequence: Synthetic peptide
  Seed: FTITDQVPF (PMEL_HUMAN)
FPITDQVPI

SEQ ID NO: 132318 - protein, 9 aa, Artificial Sequence
  Description of Artificial Sequence: Synthetic peptide
  Seed: VVLSGTTAA (PMEL_HUMAN)
VVLSGTTAY

SEQ ID NO: 132319 - protein, 11 aa, Artificial Sequence
  Description of Artificial Sequence: Synthetic peptide
  Seed: RYGSFSVTLDI (PMEL_HUMAN)
RLGSFSVTLDF

SEQ ID NO: 132320 - protein, 8 aa, Artificial Sequence
  Description of Artificial Sequence: Synthetic peptide
  Seed: VQVPTTEV (PMEL_HUMAN)
VMVPTTEY

SEQ ID NO: 132321 - protein, 10 aa, Artificial Sequence
  Description of Artificial Sequence: Synthetic peptide
  Seed: FSVSVSQLRA (PMEL_HUMAN)
FYVSVSQLRR

SEQ ID NO: 132322 - protein, 9 aa, Artificial Sequence
  Description of Artificial Sequence: Synthetic peptide
  Seed: VLPDGQVIW (PMEL_HUMAN)
VTPDGQVIM

SEQ ID NO: 132323 - protein, 9 aa, Artificial Sequence
  Description of Artificial Sequence: Synthetic peptide
  Seed: ITDQVPFSV (PMEL_HUMAN)
IFDQVPFSF

SEQ ID NO: 132324 - protein, 9 aa, Artificial Sequence
  Description of Artificial Sequence: Synthetic peptide
  Seed: ITDQVPFSV (PMEL_HUMAN)
IWDQVPFSI

SEQ ID NO: 132325 - protein, 9 aa, Artificial Sequence
  Description of Artificial Sequence: Synthetic peptide
  Seed: YWQVLGGPV (PMEL_HUMAN)
YMQVLGGPM

SEQ ID NO: 132326 - protein, 10 aa, Artificial Sequence
  Description of Artificial Sequence: Synthetic peptide
  Seed: SSSHWLRLPR (PMEL_HUMAN)
SNSHWLRLPR

SEQ ID NO: 132327 - protein, 10 aa, Artificial Sequence
  Description of Artificial Sequence: Synthetic peptide
  Seed: AEADLSYTWD (PMEL_HUMAN)
AEADLSYTWA

SEQ ID NO: 132328 - protein, 11 aa, Artificial Sequence
  Description of Artificial Sequence: Synthetic peptide
  Seed: IALNFPGSQKV (PMEL_HUMAN)
ILLNFPGSQKV

SEQ ID NO: 132329 - protein, 10 aa, Artificial Sequence
  Description of Artificial Sequence: Synthetic peptide
  Seed: LAHSSSAFTI (PMEL_HUMAN)
LTHSSSAFTW

SEQ ID NO: 132330 - protein, 9 aa, Artificial Sequence
  Description of Artificial Sequence: Synthetic peptide
  Seed: TLISRALVV (PMEL_HUMAN)
TRISRALVV

SEQ ID NO: 132331 - protein, 9 aa, Artificial Sequence
  Description of Artificial Sequence: Synthetic peptide
  Seed: YLAEADLSY (PMEL_HUMAN)
YVAEADLSL

SEQ ID NO: 132332 - protein, 9 aa, Artificial Sequence
  Description of Artificial Sequence: Synthetic peptide
  Seed: SITGSLGPL (PMEL_HUMAN)
SMTGSLGPL

SEQ ID NO: 132333 - protein, 10 aa, Artificial Sequence
  Description of Artificial Sequence: Synthetic peptide
  Seed: SVPQLPHSSS (PMEL_HUMAN)
SNPQLPHSSM

SEQ ID NO: 132334 - protein, 10 aa, Artificial Sequence
  Description of Artificial Sequence: Synthetic peptide
  Seed: RGSRSYVPLA (PMEL_HUMAN)
RHSRSYVPLM

SEQ ID NO: 132335 - protein, 9 aa, Artificial Sequence
  Description of Artificial Sequence: Synthetic peptide
  Seed: RALVVTHTY (PMEL_HUMAN)
RTLVVTHTM

SEQ ID NO: 132336 - protein, 9 aa, Artificial Sequence
  Description of Artificial Sequence: Synthetic peptide
  Seed: HTMEVTVYH (PMEL_HUMAN)
HPMEVTVYT

SEQ ID NO: 132337 - protein, 9 aa, Artificial Sequence
  Description of Artificial Sequence: Synthetic peptide
  Seed: TESITGSLG (PMEL_HUMAN)
TESITGSLI

SEQ ID NO: 132338 - protein, 9 aa, Artificial Sequence
  Description of Artificial Sequence: Synthetic peptide
  Seed: AVVSTQLIM (PMEL_HUMAN)
AVVSTQLIY

SEQ ID NO: 132339 - protein, 11 aa, Artificial Sequence
  Description of Artificial Sequence: Synthetic peptide
  Seed: SLADTNSLAVV (PMEL_HUMAN)
SLADTNSLAVA

SEQ ID NO: 132340 - protein, 10 aa, Artificial Sequence
  Description of Artificial Sequence: Synthetic peptide
  Seed: VLASLIYRRR (PMEL_HUMAN)
VMASLIYRRR

SEQ ID NO: 132341 - protein, 11 aa, Artificial Sequence
  Description of Artificial Sequence: Synthetic peptide
  Seed: AEMSTPEATGM (PMEL_HUMAN)
AMMSTPEATGW

SEQ ID NO: 132342 - protein, 9 aa, Artificial Sequence
  Description of Artificial Sequence: Synthetic peptide
  Seed: SITGSLGPL (PMEL_HUMAN)
SATGSLGPH

SEQ ID NO: 132343 - protein, 10 aa, Artificial Sequence
  Description of Artificial Sequence: Synthetic peptide
  Seed: YRYGSFSVTL (PMEL_HUMAN)
YRYGSFSVTY

SEQ ID NO: 132344 - protein, 9 aa, Artificial Sequence
  Description of Artificial Sequence: Synthetic peptide
  Seed: RYGSFSVTL (PMEL_HUMAN)
RWGSFSVTI

SEQ ID NO: 132345 - protein, 8 aa, Artificial Sequence
  Description of Artificial Sequence: Synthetic peptide
  Seed: AEAPNTTA (PMEL_HUMAN)
AEAPNTTF

SEQ ID NO: 132346 - protein, 9 aa, Artificial Sequence
  Description of Artificial Sequence: Synthetic peptide
  Seed: SSPGCQPPA (PMEL_HUMAN)
SIPGCQPPM

SEQ ID NO: 132347 - protein, 9 aa, Artificial Sequence
  Description of Artificial Sequence: Synthetic peptide
  Seed: KHFLRNQPL (PMEL_HUMAN)
KSFLRNQPF

SEQ ID NO: 132348 - protein, 11 aa, Artificial Sequence
  Description of Artificial Sequence: Synthetic peptide
  Seed: RRRLMKQDFSV (PMEL_HUMAN)
RFRLMKQDFSI

SEQ ID NO: 132349 - protein, 9 aa, Artificial Sequence
  Description of Artificial Sequence: Synthetic peptide
  Seed: YVWKTWGQY (PMEL_HUMAN)
YMWKTWGQY

SEQ ID NO: 132350 - protein, 9 aa, Artificial Sequence
  Description of Artificial Sequence: Synthetic peptide
  Seed: AEVSIVVLS (PMEL_HUMAN)
ADVSIVVLF

SEQ ID NO: 132351 - protein, 9 aa, Artificial Sequence
  Description of Artificial Sequence: Synthetic peptide
  Seed: RLVKRQVPL (PMEL_HUMAN)
RYVKRQVPK

SEQ ID NO: 132352 - protein, 9 aa, Artificial Sequence
  Description of Artificial Sequence: Synthetic peptide
  Seed: SITGSLGPL (PMEL_HUMAN)
SMTGSLGPM

SEQ ID NO: 132353 - protein, 9 aa, Artificial Sequence
  Description of Artificial Sequence: Synthetic peptide
  Seed: TAQVVLQAA (PMEL_HUMAN)
THQVVLQAL

SEQ ID NO: 132354 - protein, 10 aa, Artificial Sequence
  Description of Artificial Sequence: Synthetic peptide
  Seed: RTKAWNRQLY (PMEL_HUMAN)
RVKAWNRQLI

SEQ ID NO: 132355 - protein, 10 aa, Artificial Sequence
  Description of Artificial Sequence: Synthetic peptide
  Seed: DWLGVSRQLR (PMEL_HUMAN)
DTLGVSRQLR

SEQ ID NO: 132356 - protein, 10 aa, Artificial Sequence
  Description of Artificial Sequence: Synthetic peptide
  Seed: VLMAVVLASL (PMEL_HUMAN)
VGMAVVLASF

SEQ ID NO: 132357 - protein, 9 aa, Artificial Sequence
  Description of Artificial Sequence: Synthetic peptide
  Seed: VQMPTAEST (PMEL_HUMAN)
VSMPTAESY

SEQ ID NO: 132358 - protein, 9 aa, Artificial Sequence
  Description of Artificial Sequence: Synthetic peptide
  Seed: GQVPTTEVV (PMEL_HUMAN)
GMVPTTEVF

SEQ ID NO: 132359 - protein, 10 aa, Artificial Sequence
  Description of Artificial Sequence: Synthetic peptide
  Seed: SVPQLPHSSS (PMEL_HUMAN)
SVPQLPHSSL

SEQ ID NO: 132360 - protein, 10 aa, Artificial Sequence
  Description of Artificial Sequence: Synthetic peptide
  Seed: EVSIVVLSGT (PMEL_HUMAN)
EPSIVVLSGV

SEQ ID NO: 132361 - protein, 11 aa, Artificial Sequence
  Description of Artificial Sequence: Synthetic peptide
  Seed: FSVTLDIVQGI (PMEL_HUMAN)
FWVTLDIVQGV

SEQ ID NO: 132362 - protein, 10 aa, Artificial Sequence
  Description of Artificial Sequence: Synthetic peptide
  Seed: KVLPDGQVIW (PMEL_HUMAN)
KYLPDGQVIY

SEQ ID NO: 132363 - protein, 9 aa, Artificial Sequence
  Description of Artificial Sequence: Synthetic peptide
  Seed: GSRSYVPLA (PMEL_HUMAN)
GVRSYVPLY

SEQ ID NO: 132364 - protein, 11 aa, Artificial Sequence
  Description of Artificial Sequence: Synthetic peptide
  Seed: FSVTLDIVQGI (PMEL_HUMAN)
FQVTLDIVQGI

SEQ ID NO: 132365 - protein, 11 aa, Artificial Sequence
  Description of Artificial Sequence: Synthetic peptide
  Seed: FALQLHDPSGY (PMEL_HUMAN)
FPLQLHDPSGF

SEQ ID NO: 132366 - protein, 10 aa, Artificial Sequence
  Description of Artificial Sequence: Synthetic peptide
  Seed: RALVVTHTYL (PMEL_HUMAN)
RSLVVTHTYY

SEQ ID NO: 132367 - protein, 11 aa, Artificial Sequence
  Description of Artificial Sequence: Synthetic peptide
  Seed: FGDSSGTLISR (PMEL_HUMAN)
FWDSSGTLISL

SEQ ID NO: 132368 - protein, 10 aa, Artificial Sequence
  Description of Artificial Sequence: Synthetic peptide
  Seed: THTMEVTVYH (PMEL_HUMAN)
TETMEVTVYK

SEQ ID NO: 132369 - protein, 8 aa, Artificial Sequence
  Description of Artificial Sequence: Synthetic peptide
  Seed: SEVMGTTL (PMEL_HUMAN)
SEVMGTTY

SEQ ID NO: 132370 - protein, 10 aa, Artificial Sequence
  Description of Artificial Sequence: Synthetic peptide
  Seed: ELTVSCQGGL (PMEL_HUMAN)
EYTVSCQGGV

SEQ ID NO: 132371 - protein, 9 aa, Artificial Sequence
  Description of Artificial Sequence: Synthetic peptide
  Seed: SQKRSFVYV (PMEL_HUMAN)
SFKRSFVYA

SEQ ID NO: 132372 - protein, 9 aa, Artificial Sequence
  Description of Artificial Sequence: Synthetic peptide
  Seed: TIINGSQVW (PMEL_HUMAN)
TAINGSQVL

SEQ ID NO: 132373 - protein, 11 aa, Artificial Sequence
  Description of Artificial Sequence: Synthetic peptide
  Seed: SIALNFPGSQK (PMEL_HUMAN)
STALNFPGSQK

SEQ ID NO: 132374 - protein, 9 aa, Artificial Sequence
  Description of Artificial Sequence: Synthetic peptide
  Seed: TIINGSQVW (PMEL_HUMAN)
TSINGSQVM

SEQ ID NO: 132375 - protein, 8 aa, Artificial Sequence
  Description of Artificial Sequence: Synthetic peptide
  Seed: LLDGTATL (PMEL_HUMAN)
LADGTATM

SEQ ID NO: 132376 - protein, 9 aa, Artificial Sequence
  Description of Artificial Sequence: Synthetic peptide
  Seed: AVVLASLIY (PMEL_HUMAN)
ARVLASLIM

SEQ ID NO: 132377 - protein, 10 aa, Artificial Sequence
  Description of Artificial Sequence: Synthetic peptide
  Seed: MTPAEVSIVV (PMEL_HUMAN)
MLPAEVSIVW

SEQ ID NO: 132378 - protein, 10 aa, Artificial Sequence
  Description of Artificial Sequence: Synthetic peptide
  Seed: EVSIVVLSGT (PMEL_HUMAN)
EVSIVVLSGV

SEQ ID NO: 132379 - protein, 9 aa, Artificial Sequence
  Description of Artificial Sequence: Synthetic peptide
  Seed: AQVVLQAAI (PMEL_HUMAN)
AEVVLQAAM

SEQ ID NO: 132380 - protein, 11 aa, Artificial Sequence
  Description of Artificial Sequence: Synthetic peptide
  Seed: AEAPNTTAGQV (PMEL_HUMAN)
AQAPNTTAGQW

SEQ ID NO: 132381 - protein, 10 aa, Artificial Sequence
  Description of Artificial Sequence: Synthetic peptide
  Seed: LAVIGALLAV (PMEL_HUMAN)
LWVIGALLAI

SEQ ID NO: 132382 - protein, 9 aa, Artificial Sequence
  Description of Artificial Sequence: Synthetic peptide
  Seed: GSSPVPGTT (PMEL_HUMAN)
GTSPVPGTM

SEQ ID NO: 132383 - protein, 9 aa, Artificial Sequence
  Description of Artificial Sequence: Synthetic peptide
  Seed: TLIGANASF (PMEL_HUMAN)
TYIGANASI

SEQ ID NO: 132384 - protein, 10 aa, Artificial Sequence
  Description of Artificial Sequence: Synthetic peptide
  Seed: RGSRSYVPLA (PMEL_HUMAN)
RTSRSYVPLS

SEQ ID NO: 132385 - protein, 10 aa, Artificial Sequence
  Description of Artificial Sequence: Synthetic peptide
  Seed: ALDGGNKHFL (PMEL_HUMAN)
AMDGGNKHFL

SEQ ID NO: 132386 - protein, 9 aa, Artificial Sequence
  Description of Artificial Sequence: Synthetic peptide
  Seed: RAMLGTHTM (PMEL_HUMAN)
REMLGTHTY

SEQ ID NO: 132387 - protein, 9 aa, Artificial Sequence
  Description of Artificial Sequence: Synthetic peptide
  Seed: SLADTNSLA (PMEL_HUMAN)
SMADTNSLL

SEQ ID NO: 132388 - protein, 9 aa, Artificial Sequence
  Description of Artificial Sequence: Synthetic peptide
  Seed: KTWGQYWQV (PMEL_HUMAN)
KGWGQYWQV

SEQ ID NO: 132389 - protein, 10 aa, Artificial Sequence
  Description of Artificial Sequence: Synthetic peptide
  Seed: MTPAEVSIVV (PMEL_HUMAN)
MIPAEVSIVA

SEQ ID NO: 132390 - protein, 9 aa, Artificial Sequence
  Description of Artificial Sequence: Synthetic peptide
  Seed: GSRSYVPLA (PMEL_HUMAN)
GTRSYVPLS

SEQ ID NO: 132391 - protein, 11 aa, Artificial Sequence
  Description of Artificial Sequence: Synthetic peptide
  Seed: SQKRSFVYVWK (PMEL_HUMAN)
SMKRSFVYVWR

SEQ ID NO: 132392 - protein, 9 aa, Artificial Sequence
  Description of Artificial Sequence: Synthetic peptide
  Seed: MEVTVYHRR (PMEL_HUMAN)
MMVTVYHRK

SEQ ID NO: 132393 - protein, 10 aa, Artificial Sequence
  Description of Artificial Sequence: Synthetic peptide
  Seed: KVSNDGPTLI (PMEL_HUMAN)
KLSNDGPTLV

SEQ ID NO: 132394 - protein, 10 aa, Artificial Sequence
  Description of Artificial Sequence: Synthetic peptide
  Seed: RQLYPEWTEA (PMEL_HUMAN)
RNLYPEWTEL

SEQ ID NO: 132395 - protein, 9 aa, Artificial Sequence
  Description of Artificial Sequence: Synthetic peptide
  Seed: VQVPTTEVI (PMEL_HUMAN)
VHVPTTEVY

SEQ ID NO: 132396 - protein, 11 aa, Artificial Sequence
  Description of Artificial Sequence: Synthetic peptide
  Seed: RYGSFSVTLDI (PMEL_HUMAN)
RWGSFSVTLDW

SEQ ID NO: 132397 - protein, 9 aa, Artificial Sequence
  Description of Artificial Sequence: Synthetic peptide
  Seed: KVSNDGPTL (PMEL_HUMAN)
KQSNDGPTV

SEQ ID NO: 132398 - protein, 10 aa, Artificial Sequence
  Description of Artificial Sequence: Synthetic peptide
  Seed: RGSRSYVPLA (PMEL_HUMAN)
RLSRSYVPLV

SEQ ID NO: 132399 - protein, 9 aa, Artificial Sequence
  Description of Artificial Sequence: Synthetic peptide
  Seed: DAFELTVSC (PMEL_HUMAN)
DGFELTVSL

SEQ ID NO: 132400 - protein, 9 aa, Artificial Sequence
  Description of Artificial Sequence: Synthetic peptide
  Seed: SLADTNSLA (PMEL_HUMAN)
SLADTNSLV

SEQ ID NO: 132401 - protein, 8 aa, Artificial Sequence
  Description of Artificial Sequence: Synthetic peptide
  Seed: TEWVETTA (PMEL_HUMAN)
TEWVETTI

SEQ ID NO: 132402 - protein, 9 aa, Artificial Sequence
  Description of Artificial Sequence: Synthetic peptide
  Seed: TLISRALVV (PMEL_HUMAN)
TVISRALVF

SEQ ID NO: 132403 - protein, 10 aa, Artificial Sequence
  Description of Artificial Sequence: Synthetic peptide
  Seed: LAVVSTQLIM (PMEL_HUMAN)
LSVVSTQLIM

SEQ ID NO: 132404 - protein, 9 aa, Artificial Sequence
  Description of Artificial Sequence: Synthetic peptide
  Seed: AVVSTQLIM (PMEL_HUMAN)
AQVSTQLIF

SEQ ID NO: 132405 - protein, 10 aa, Artificial Sequence
  Description of Artificial Sequence: Synthetic peptide
  Seed: KRQVPLDCVL (PMEL_HUMAN)
KNQVPLDCVY

SEQ ID NO: 132406 - protein, 10 aa, Artificial Sequence
  Description of Artificial Sequence: Synthetic peptide
  Seed: RTKAWNRQLY (PMEL_HUMAN)
RSKAWNRQLI

SEQ ID NO: 132407 - protein, 9 aa, Artificial Sequence
  Description of Artificial Sequence: Synthetic peptide
  Seed: RGSRSYVPL (PMEL_HUMAN)
RTSRSYVPT

SEQ ID NO: 132408 - protein, 9 aa, Artificial Sequence
  Description of Artificial Sequence: Synthetic peptide
  Seed: SRALVVTHT (PMEL_HUMAN)
SHALVVTHA

SEQ ID NO: 132409 - protein, 9 aa, Artificial Sequence
  Description of Artificial Sequence: Synthetic peptide
  Seed: LLDGTATLR (PMEL_HUMAN)
LTDGTATLF

SEQ ID NO: 132410 - protein, 9 aa, Artificial Sequence
  Description of Artificial Sequence: Synthetic peptide
  Seed: TAPVQMPTA (PMEL_HUMAN)
TLPVQMPTL

SEQ ID NO: 132411 - protein, 9 aa, Artificial Sequence
  Description of Artificial Sequence: Synthetic peptide
  Seed: VSLADTNSL (PMEL_HUMAN)
VLLADTNSL

SEQ ID NO: 132412 - protein, 9 aa, Artificial Sequence
  Description of Artificial Sequence: Synthetic peptide
  Seed: HSSSHWLRL (PMEL_HUMAN)
HSSSHWLRW

SEQ ID NO: 132413 - protein, 8 aa, Artificial Sequence
  Description of Artificial Sequence: Synthetic peptide
  Seed: FSVSVSQL (PMEL_HUMAN)
FSVSVSQY

SEQ ID NO: 132414 - protein, 9 aa, Artificial Sequence
  Description of Artificial Sequence: Synthetic peptide
  Seed: AAQVTTTEW (PMEL_HUMAN)
AVQVTTTEF

SEQ ID NO: 132415 - protein, 9 aa, Artificial Sequence
  Description of Artificial Sequence: Synthetic peptide
  Seed: YWQVLGGPV (PMEL_HUMAN)
YFQVLGGPI

SEQ ID NO: 132416 - protein, 10 aa, Artificial Sequence
  Description of Artificial Sequence: Synthetic peptide
  Seed: SVPQLPHSSS (PMEL_HUMAN)
SRPQLPHSSM

SEQ ID NO: 132417 - protein, 10 aa, Artificial Sequence
  Description of Artificial Sequence: Synthetic peptide
  Seed: AVIGALLAVG (PMEL_HUMAN)
ALIGALLAVD

SEQ ID NO: 132418 - protein, 8 aa, Artificial Sequence
  Description of Artificial Sequence: Synthetic peptide
  Seed: LADTNSLA (PMEL_HUMAN)
LADTNSLV

SEQ ID NO: 132419 - protein, 11 aa, Artificial Sequence
  Description of Artificial Sequence: Synthetic peptide
  Seed: KVLPDGQVIWV (PMEL_HUMAN)
KILPDGQVIWL

SEQ ID NO: 132420 - protein, 10 aa, Artificial Sequence
  Description of Artificial Sequence: Synthetic peptide
  Seed: YPQETDDACI (PMEL_HUMAN)
YPQETDDACY

SEQ ID NO: 132421 - protein, 9 aa, Artificial Sequence
  Description of Artificial Sequence: Synthetic peptide
  Seed: DSSGTLISR (PMEL_HUMAN)
DMSGTLISR

SEQ ID NO: 132422 - protein, 8 aa, Artificial Sequence
  Description of Artificial Sequence: Synthetic peptide
  Seed: SNDGPTLI (PMEL_HUMAN)
SLDGPTLF

SEQ ID NO: 132423 - protein, 9 aa, Artificial Sequence
  Description of Artificial Sequence: Synthetic peptide
  Seed: GQVPLIVGI (PMEL_HUMAN)
GQVPLIVGF

SEQ ID NO: 132424 - protein, 10 aa, Artificial Sequence
  Description of Artificial Sequence: Synthetic peptide
  Seed: RRLMKQDFSV (PMEL_HUMAN)
RYLMKQDFSL

SEQ ID NO: 132425 - protein, 9 aa, Artificial Sequence
  Description of Artificial Sequence: Synthetic peptide
  Seed: TWGQYWQVL (PMEL_HUMAN)
TWGQYWQVI

SEQ ID NO: 132426 - protein, 10 aa, Artificial Sequence
  Description of Artificial Sequence: Synthetic peptide
  Seed: RQLYPEWTEA (PMEL_HUMAN)
RMLYPEWTEA

SEQ ID NO: 132427 - protein, 9 aa, Artificial Sequence
  Description of Artificial Sequence: Synthetic peptide
  Seed: LASLIYRRR (PMEL_HUMAN)
LTSLIYRRR

SEQ ID NO: 132428 - protein, 10 aa, Artificial Sequence
  Description of Artificial Sequence: Synthetic peptide
  Seed: LMAVVLASLI (PMEL_HUMAN)
LMAVVLASLL

SEQ ID NO: 132429 - protein, 11 aa, Artificial Sequence
  Description of Artificial Sequence: Synthetic peptide
  Seed: LGPLLDGTATL (PMEL_HUMAN)
LFPLLDGTATL

SEQ ID NO: 132430 - protein, 10 aa, Artificial Sequence
  Description of Artificial Sequence: Synthetic peptide
  Seed: VSLADTNSLA (PMEL_HUMAN)
VTLADTNSLV

SEQ ID NO: 132431 - protein, 9 aa, Artificial Sequence
  Description of Artificial Sequence: Synthetic peptide
  Seed: STAPVQMPT (PMEL_HUMAN)
SIAPVQMPA

SEQ ID NO: 132432 - protein, 9 aa, Artificial Sequence
  Description of Artificial Sequence: Synthetic peptide
  Seed: QVWGGQPVY (PMEL_HUMAN)
QAWGGQPVF

SEQ ID NO: 132433 - protein, 11 aa, Artificial Sequence
  Description of Artificial Sequence: Synthetic peptide
  Seed: GPTLIGANASF (PMEL_HUMAN)
GQTLIGANASY

SEQ ID NO: 132434 - protein, 9 aa, Artificial Sequence
  Description of Artificial Sequence: Synthetic peptide
  Seed: ILKGGSGTY (PMEL_HUMAN)
IKKGGSGTM

SEQ ID NO: 132435 - protein, 10 aa, Artificial Sequence
  Description of Artificial Sequence: Synthetic peptide
  Seed: LVLMAVVLAS (PMEL_HUMAN)
LCLMAVVLAA

SEQ ID NO: 132436 - protein, 11 aa, Artificial Sequence
  Description of Artificial Sequence: Synthetic peptide
  Seed: FSVSVSQLRAL (PMEL_HUMAN)
FAVSVSQLRAL

SEQ ID NO: 132437 - protein, 9 aa, Artificial Sequence
  Description of Artificial Sequence: Synthetic peptide
  Seed: RYGSFSVTL (PMEL_HUMAN)
RTGSFSVTW

SEQ ID NO: 132438 - protein, 9 aa, Artificial Sequence
  Description of Artificial Sequence: Synthetic peptide
  Seed: LADTNSLAV (PMEL_HUMAN)
LEDTNSLAF

SEQ ID NO: 132439 - protein, 10 aa, Artificial Sequence
  Description of Artificial Sequence: Synthetic peptide
  Seed: AMLGTHTMEV (PMEL_HUMAN)
ALLGTHTMEL

SEQ ID NO: 132440 - protein, 10 aa, Artificial Sequence
  Description of Artificial Sequence: Synthetic peptide
  Seed: RQVPLDCVLY (PMEL_HUMAN)
REVPLDCVLW

SEQ ID NO: 132441 - protein, 9 aa, Artificial Sequence
  Description of Artificial Sequence: Synthetic peptide
  Seed: KTWGQYWQV (PMEL_HUMAN)
KLWGQYWQC

SEQ ID NO: 132442 - protein, 10 aa, Artificial Sequence
  Description of Artificial Sequence: Synthetic peptide
  Seed: VLMAVVLASL (PMEL_HUMAN)
VPMAVVLASF

SEQ ID NO: 132443 - protein, 9 aa, Artificial Sequence
  Description of Artificial Sequence: Synthetic peptide
  Seed: KTWGQYWQV (PMEL_HUMAN)
KLWGQYWQP

SEQ ID NO: 132444 - protein, 9 aa, Artificial Sequence
  Description of Artificial Sequence: Synthetic peptide
  Seed: AQVVLQAAI (PMEL_HUMAN)
AHVVLQAAF

SEQ ID NO: 132445 - protein, 9 aa, Artificial Sequence
  Description of Artificial Sequence: Synthetic peptide
  Seed: YLAEADLSY (PMEL_HUMAN)
YAAEADLSM

SEQ ID NO: 132446 - protein, 9 aa, Artificial Sequence
  Description of Artificial Sequence: Synthetic peptide
  Seed: ILKGGSGTY (PMEL_HUMAN)
IMKGGSGTW

SEQ ID NO: 132447 - protein, 9 aa, Artificial Sequence
  Description of Artificial Sequence: Synthetic peptide
  Seed: RALVVTHTY (PMEL_HUMAN)
RQLVVTHTV

SEQ ID NO: 132448 - protein, 9 aa, Artificial Sequence
  Description of Artificial Sequence: Synthetic peptide
  Seed: HTMEVTVYH (PMEL_HUMAN)
HVMEVTVYY

SEQ ID NO: 132449 - protein, 9 aa, Artificial Sequence
  Description of Artificial Sequence: Synthetic peptide
  Seed: VSNDGPTLI (PMEL_HUMAN)
VGNDGPTLL

SEQ ID NO: 132450 - protein, 9 aa, Artificial Sequence
  Description of Artificial Sequence: Synthetic peptide
  Seed: AEPSGTTSV (PMEL_HUMAN)
AVPSGTTSI

SEQ ID NO: 132451 - protein, 10 aa, Artificial Sequence
  Description of Artificial Sequence: Synthetic peptide
  Seed: ASSIMSTESI (PMEL_HUMAN)
APSIMSTESW

SEQ ID NO: 132452 - protein, 10 aa, Artificial Sequence
  Description of Artificial Sequence: Synthetic peptide
  Seed: SVTLDIVQGI (PMEL_HUMAN)
SQTLDIVQGV

SEQ ID NO: 132453 - protein, 10 aa, Artificial Sequence
  Description of Artificial Sequence: Synthetic peptide
  Seed: VPFSVSVSQL (PMEL_HUMAN)
VAFSVSVSQY

SEQ ID NO: 132454 - protein, 11 aa, Artificial Sequence
  Description of Artificial Sequence: Synthetic peptide
  Seed: LVLMAVVLASL (PMEL_HUMAN)
LWLMAVVLASV

SEQ ID NO: 132455 - protein, 10 aa, Artificial Sequence
  Description of Artificial Sequence: Synthetic peptide
  Seed: LDGGNKHFLR (PMEL_HUMAN)
LTGGNKHFLR

SEQ ID NO: 132456 - protein, 8 aa, Artificial Sequence
  Description of Artificial Sequence: Synthetic peptide
  Seed: LHDPSGYL (PMEL_HUMAN)
LADPSGYM

SEQ ID NO: 132457 - protein, 9 aa, Artificial Sequence
  Description of Artificial Sequence: Synthetic peptide
  Seed: ILKGGSGTY (PMEL_HUMAN)
IAKGGSGTY

SEQ ID NO: 132458 - protein, 10 aa, Artificial Sequence
  Description of Artificial Sequence: Synthetic peptide
  Seed: YRYGSFSVTL (PMEL_HUMAN)
YIYGSFSVTL

SEQ ID NO: 132459 - protein, 10 aa, Artificial Sequence
  Description of Artificial Sequence: Synthetic peptide
  Seed: MSTESITGSL (PMEL_HUMAN)
MMTESITGSV

SEQ ID NO: 132460 - protein, 10 aa, Artificial Sequence
  Description of Artificial Sequence: Synthetic peptide
  Seed: IVQGIESAEI (PMEL_HUMAN)
IMQGIESAEV

SEQ ID NO: 132461 - protein, 9 aa, Artificial Sequence
  Description of Artificial Sequence: Synthetic peptide
  Seed: GTLISRALV (PMEL_HUMAN)
GTLISRALK

SEQ ID NO: 132462 - protein, 10 aa, Artificial Sequence
  Description of Artificial Sequence: Synthetic peptide
  Seed: MPTAESTGMT (PMEL_HUMAN)
MKTAESTGML

SEQ ID NO: 132463 - protein, 9 aa, Artificial Sequence
  Description of Artificial Sequence: Synthetic peptide
  Seed: TLIGANASF (PMEL_HUMAN)
TMIGANASL

SEQ ID NO: 132464 - protein, 10 aa, Artificial Sequence
  Description of Artificial Sequence: Synthetic peptide
  Seed: RQLYPEWTEA (PMEL_HUMAN)
RNLYPEWTEF

SEQ ID NO: 132465 - protein, 10 aa, Artificial Sequence
  Description of Artificial Sequence: Synthetic peptide
  Seed: LIMPGQEAGL (PMEL_HUMAN)
LMMPGQEAGV

SEQ ID NO: 132466 - protein, 11 aa, Artificial Sequence
  Description of Artificial Sequence: Synthetic peptide
  Seed: SYVPLAHSSSA (PMEL_HUMAN)
SYVPLAHSSSL

SEQ ID NO: 132467 - protein, 9 aa, Artificial Sequence
  Description of Artificial Sequence: Synthetic peptide
  Seed: VLQAAIPLT (PMEL_HUMAN)
VQQAAIPLV

SEQ ID NO: 132468 - protein, 9 aa, Artificial Sequence
  Description of Artificial Sequence: Synthetic peptide
  Seed: LIYRRRLMK (PMEL_HUMAN)
LFYRRRLMR

SEQ ID NO: 132469 - protein, 9 aa, Artificial Sequence
  Description of Artificial Sequence: Synthetic peptide
  Seed: DAFELTVSC (PMEL_HUMAN)
DPFELTVSA

SEQ ID NO: 132470 - protein, 9 aa, Artificial Sequence
  Description of Artificial Sequence: Synthetic peptide
  Seed: QVIWVNNTI (PMEL_HUMAN)
QVIWVNNTR

SEQ ID NO: 132471 - protein, 9 aa, Artificial Sequence
  Description of Artificial Sequence: Synthetic peptide
  Seed: GSFSVTLDI (PMEL_HUMAN)
GVFSVTLDW

SEQ ID NO: 132472 - protein, 10 aa, Artificial Sequence
  Description of Artificial Sequence: Synthetic peptide
  Seed: GPLLDGTATL (PMEL_HUMAN)
GFLLDGTATI

SEQ ID NO: 132473 - protein, 9 aa, Artificial Sequence
  Description of Artificial Sequence: Synthetic peptide
  Seed: LSIGTGRAM (PMEL_HUMAN)
LAIGTGRAM

SEQ ID NO: 132474 - protein, 10 aa, Artificial Sequence
  Description of Artificial Sequence: Synthetic peptide
  Seed: RGSRSYVPLA (PMEL_HUMAN)
RASRSYVPLS

SEQ ID NO: 132475 - protein, 9 aa, Artificial Sequence
  Description of Artificial Sequence: Synthetic peptide
  Seed: LAVGATKVP (PMEL_HUMAN)
LSVGATKVY

SEQ ID NO: 132476 - protein, 9 aa, Artificial Sequence
  Description of Artificial Sequence: Synthetic peptide
  Seed: TLISRALVV (PMEL_HUMAN)
TAISRALVM

SEQ ID NO: 132477 - protein, 9 aa, Artificial Sequence
  Description of Artificial Sequence: Synthetic peptide
  Seed: KTWGQYWQV (PMEL_HUMAN)
KMWGQYWQL

SEQ ID NO: 132478 - protein, 9 aa, Artificial Sequence
  Description of Artificial Sequence: Synthetic peptide
  Seed: ALDGGNKHF (PMEL_HUMAN)
AGDGGNKHI

SEQ ID NO: 132479 - protein, 9 aa, Artificial Sequence
  Description of Artificial Sequence: Synthetic peptide
  Seed: HLAVIGALL (PMEL_HUMAN)
HAAVIGALH

SEQ ID NO: 132480 - protein, 10 aa, Artificial Sequence
  Description of Artificial Sequence: Synthetic peptide
  Seed: RTKAWNRQLY (PMEL_HUMAN)
RSKAWNRQLY

SEQ ID NO: 132481 - protein, 8 aa, Artificial Sequence
  Description of Artificial Sequence: Synthetic peptide
  Seed: LLDGTATL (PMEL_HUMAN)
LYDGTATM

SEQ ID NO: 132482 - protein, 8 aa, Artificial Sequence
  Description of Artificial Sequence: Synthetic peptide
  Seed: FGDSSGTL (PMEL_HUMAN)
FADSSGTV

SEQ ID NO: 132483 - protein, 9 aa, Artificial Sequence
  Description of Artificial Sequence: Synthetic peptide
  Seed: FTITDQVPF (PMEL_HUMAN)
FAITDQVPL

SEQ ID NO: 132484 - protein, 11 aa, Artificial Sequence
  Description of Artificial Sequence: Synthetic peptide
  Seed: HTMEVTVYHRR (PMEL_HUMAN)
HVMEVTVYHRK

SEQ ID NO: 132485 - protein, 10 aa, Artificial Sequence
  Description of Artificial Sequence: Synthetic peptide
  Seed: SGTYCLNVSL (PMEL_HUMAN)
SNTYCLNVSY

SEQ ID NO: 132486 - protein, 10 aa, Artificial Sequence
  Description of Artificial Sequence: Synthetic peptide
  Seed: VLMAVVLASL (PMEL_HUMAN)
VRMAVVLASY

SEQ ID NO: 132487 - protein, 9 aa, Artificial Sequence
  Description of Artificial Sequence: Synthetic peptide
  Seed: YPQETDDAC (PMEL_HUMAN)
YPQETDDAH

SEQ ID NO: 132488 - protein, 9 aa, Artificial Sequence
  Description of Artificial Sequence: Synthetic peptide
  Seed: YWQVLGGPV (PMEL_HUMAN)
YYQVLGGPF

SEQ ID NO: 132489 - protein, 9 aa, Artificial Sequence
  Description of Artificial Sequence: Synthetic peptide
  Seed: FPGSQKVLP (PMEL_HUMAN)
FPGSQKVLA

SEQ ID NO: 132490 - protein, 9 aa, Artificial Sequence
  Description of Artificial Sequence: Synthetic peptide
  Seed: LHLAVIGAL (PMEL_HUMAN)
LHLAVIGAY

SEQ ID NO: 132491 - protein, 9 aa, Artificial Sequence
  Description of Artificial Sequence: Synthetic peptide
  Seed: RALVVTHTY (PMEL_HUMAN)
RTLVVTHTF

SEQ ID NO: 132492 - protein, 9 aa, Artificial Sequence
  Description of Artificial Sequence: Synthetic peptide
  Seed: TLIGANASF (PMEL_HUMAN)
TLIGANASV

SEQ ID NO: 132493 - protein, 10 aa, Artificial Sequence
  Description of Artificial Sequence: Synthetic peptide
  Seed: RYGSFSVTLD (PMEL_HUMAN)
RYGSFSVTLW

SEQ ID NO: 132494 - protein, 9 aa, Artificial Sequence
  Description of Artificial Sequence: Synthetic peptide
  Seed: SPVPGTTDG (PMEL_HUMAN)
SPVPGTTDL

SEQ ID NO: 132495 - protein, 9 aa, Artificial Sequence
  Description of Artificial Sequence: Synthetic peptide
  Seed: YLEPGPVTA (PMEL_HUMAN)
YDEPGPVTM

SEQ ID NO: 132496 - protein, 9 aa, Artificial Sequence
  Description of Artificial Sequence: Synthetic peptide
  Seed: RQVPLDCVL (PMEL_HUMAN)
RAVPLDCVF

SEQ ID NO: 132497 - protein, 9 aa, Artificial Sequence
  Description of Artificial Sequence: Synthetic peptide
  Seed: LAVVSTQLI (PMEL_HUMAN)
LMVVSTQLF

SEQ ID NO: 132498 - protein, 9 aa, Artificial Sequence
  Description of Artificial Sequence: Synthetic peptide
  Seed: LVLKRCLLH (PMEL_HUMAN)
LLLKRCLLK

SEQ ID NO: 132499 - protein, 9 aa, Artificial Sequence
  Description of Artificial Sequence: Synthetic peptide
  Seed: TTDGHRPTA (PMEL_HUMAN)
TQDGHRPTF

SEQ ID NO: 132500 - protein, 9 aa, Artificial Sequence
  Description of Artificial Sequence: Synthetic peptide
  Seed: LTSCGSSPV (PMEL_HUMAN)
LASCGSSPM

SEQ ID NO: 132501 - protein, 9 aa, Artificial Sequence
  Description of Artificial Sequence: Synthetic peptide
  Seed: LADTNSLAV (PMEL_HUMAN)
LMDTNSLAY

SEQ ID NO: 132502 - protein, 9 aa, Artificial Sequence
  Description of Artificial Sequence: Synthetic peptide
  Seed: DIVQGIESA (PMEL_HUMAN)
DIVQGIESV

SEQ ID NO: 132503 - protein, 9 aa, Artificial Sequence
  Description of Artificial Sequence: Synthetic peptide
  Seed: VISTAPVQM (PMEL_HUMAN)
VQSTAPVQF

SEQ ID NO: 132504 - protein, 11 aa, Artificial Sequence
  Description of Artificial Sequence: Synthetic peptide
  Seed: HTMEVTVYHRR (PMEL_HUMAN)
HAMEVTVYHRR

SEQ ID NO: 132505 - protein, 9 aa, Artificial Sequence
  Description of Artificial Sequence: Synthetic peptide
  Seed: VVLQAAIPL (PMEL_HUMAN)
VRLQAAIPF

SEQ ID NO: 132506 - protein, 9 aa, Artificial Sequence
  Description of Artificial Sequence: Synthetic peptide
  Seed: AAQVTTTEW (PMEL_HUMAN)
AAQVTTTEL

SEQ ID NO: 132507 - protein, 9 aa, Artificial Sequence
  Description of Artificial Sequence: Synthetic peptide
  Seed: EGDAFELTV (PMEL_HUMAN)
ETDAFELTL

SEQ ID NO: 132508 - protein, 10 aa, Artificial Sequence
  Description of Artificial Sequence: Synthetic peptide
  Seed: YRYGSFSVTL (PMEL_HUMAN)
YWYGSFSVTF

SEQ ID NO: 132509 - protein, 9 aa, Artificial Sequence
  Description of Artificial Sequence: Synthetic peptide
  Seed: VVLQAAIPL (PMEL_HUMAN)
VVLQAAIPM

SEQ ID NO: 132510 - protein, 10 aa, Artificial Sequence
  Description of Artificial Sequence: Synthetic peptide
  Seed: ESITGSLGPL (PMEL_HUMAN)
EAITGSLGPY

SEQ ID NO: 132511 - protein, 10 aa, Artificial Sequence
  Description of Artificial Sequence: Synthetic peptide
  Seed: ALDGGNKHFL (PMEL_HUMAN)
ASDGGNKHFM

SEQ ID NO: 132512 - protein, 9 aa, Artificial Sequence
  Description of Artificial Sequence: Synthetic peptide
  Seed: SSHWLRLPR (PMEL_HUMAN)
SFHWLRLPK

SEQ ID NO: 132513 - protein, 9 aa, Artificial Sequence
  Description of Artificial Sequence: Synthetic peptide
  Seed: SPACQLVLH (PMEL_HUMAN)
SAACQLVLY

SEQ ID NO: 132514 - protein, 9 aa, Artificial Sequence
  Description of Artificial Sequence: Synthetic peptide
  Seed: RQVPLDCVL (PMEL_HUMAN)
RRVPLDCVL

SEQ ID NO: 132515 - protein, 10 aa, Artificial Sequence
  Description of Artificial Sequence: Synthetic peptide
  Seed: VVLASLIYRR (PMEL_HUMAN)
VMLASLIYRV

SEQ ID NO: 132516 - protein, 9 aa, Artificial Sequence
  Description of Artificial Sequence: Synthetic peptide
  Seed: TPAEVSIVV (PMEL_HUMAN)
TSAEVSIVV

SEQ ID NO: 132517 - protein, 10 aa, Artificial Sequence
  Description of Artificial Sequence: Synthetic peptide
  Seed: SGTYCLNVSL (PMEL_HUMAN)
SQTYCLNVSW

SEQ ID NO: 132518 - protein, 10 aa, Artificial Sequence
  Description of Artificial Sequence: Synthetic peptide
  Seed: EVISTAPVQM (PMEL_HUMAN)
EIISTAPVQW

SEQ ID NO: 132519 - protein, 11 aa, Artificial Sequence
  Description of Artificial Sequence: Synthetic peptide
  Seed: THTMEVTVYHR (PMEL_HUMAN)
TETMEVTVYHR

SEQ ID NO: 132520 - protein, 9 aa, Artificial Sequence
  Description of Artificial Sequence: Synthetic peptide
  Seed: GSFSVTLDI (PMEL_HUMAN)
GLFSVTLDV

SEQ ID NO: 132521 - protein, 9 aa, Artificial Sequence
  Description of Artificial Sequence: Synthetic peptide
  Seed: VSCQGGLPK (PMEL_HUMAN)
VACQGGLPV

SEQ ID NO: 132522 - protein, 9 aa, Artificial Sequence
  Description of Artificial Sequence: Synthetic peptide
  Seed: LSIGTGRAM (PMEL_HUMAN)
LFIGTGRAL

SEQ ID NO: 132523 - protein, 11 aa, Artificial Sequence
  Description of Artificial Sequence: Synthetic peptide
  Seed: GIESAEILQAV (PMEL_HUMAN)
GLESAEILQAV

SEQ ID NO: 132524 - protein, 9 aa, Artificial Sequence
  Description of Artificial Sequence: Synthetic peptide
  Seed: LVLKRCLLH (PMEL_HUMAN)
LMLKRCLLR

SEQ ID NO: 132525 - protein, 9 aa, Artificial Sequence
  Description of Artificial Sequence: Synthetic peptide
  Seed: ESAEILQAV (PMEL_HUMAN)
ETAEILQAW

SEQ ID NO: 132526 - protein, 9 aa, Artificial Sequence
  Description of Artificial Sequence: Synthetic peptide
  Seed: FTITDQVPF (PMEL_HUMAN)
FPITDQVPQ

SEQ ID NO: 132527 - protein, 9 aa, Artificial Sequence
  Description of Artificial Sequence: Synthetic peptide
  Seed: RAMLGTHTM (PMEL_HUMAN)
RNMLGTHTY

SEQ ID NO: 132528 - protein, 10 aa, Artificial Sequence
  Description of Artificial Sequence: Synthetic peptide
  Seed: YVPLAHSSSA (PMEL_HUMAN)
YPPLAHSSSV

SEQ ID NO: 132529 - protein, 10 aa, Artificial Sequence
  Description of Artificial Sequence: Synthetic peptide
  Seed: QVLGGPVSGL (PMEL_HUMAN)
QVLGGPVSGW

SEQ ID NO: 132530 - protein, 9 aa, Artificial Sequence
  Description of Artificial Sequence: Synthetic peptide
  Seed: VLPSPACQL (PMEL_HUMAN)
VYPSPACQL

SEQ ID NO: 132531 - protein, 10 aa, Artificial Sequence
  Description of Artificial Sequence: Synthetic peptide
  Seed: MAVVLASLIY (PMEL_HUMAN)
MPVVLASLIL

SEQ ID NO: 132532 - protein, 9 aa, Artificial Sequence
  Description of Artificial Sequence: Synthetic peptide
  Seed: RALVVTHTY (PMEL_HUMAN)
RELVVTHTL

SEQ ID NO: 132533 - protein, 10 aa, Artificial Sequence
  Description of Artificial Sequence: Synthetic peptide
  Seed: ALQLHDPSGY (PMEL_HUMAN)
AMQLHDPSGY

SEQ ID NO: 132534 - protein, 9 aa, Artificial Sequence
  Description of Artificial Sequence: Synthetic peptide
  Seed: LLDGTATLR (PMEL_HUMAN)
LADGTATLF

SEQ ID NO: 132535 - protein, 10 aa, Artificial Sequence
  Description of Artificial Sequence: Synthetic peptide
  Seed: RALVVTHTYL (PMEL_HUMAN)
RLLVVTHTYF

SEQ ID NO: 132536 - protein, 10 aa, Artificial Sequence
  Description of Artificial Sequence: Synthetic peptide
  Seed: YRYGSFSVTL (PMEL_HUMAN)
YTYGSFSVTF

SEQ ID NO: 132537 - protein, 10 aa, Artificial Sequence
  Description of Artificial Sequence: Synthetic peptide
  Seed: MLGTHTMEVT (PMEL_HUMAN)
MMGTHTMEVL

SEQ ID NO: 132538 - protein, 9 aa, Artificial Sequence
  Description of Artificial Sequence: Synthetic peptide
  Seed: MTPEKVPVS (PMEL_HUMAN)
MYPEKVPVM

SEQ ID NO: 132539 - protein, 10 aa, Artificial Sequence
  Description of Artificial Sequence: Synthetic peptide
  Seed: RRLMKQDFSV (PMEL_HUMAN)
RYLMKQDFSV

SEQ ID NO: 132540 - protein, 9 aa, Artificial Sequence
  Description of Artificial Sequence: Synthetic peptide
  Seed: TTDGHRPTA (PMEL_HUMAN)
TVDGHRPTM

SEQ ID NO: 132541 - protein, 9 aa, Artificial Sequence
  Description of Artificial Sequence: Synthetic peptide
  Seed: ANASFSIAL (PMEL_HUMAN)
ARASFSIAM

SEQ ID NO: 132542 - protein, 9 aa, Artificial Sequence
  Description of Artificial Sequence: Synthetic peptide
  Seed: RGSRSYVPL (PMEL_HUMAN)
RVSRSYVPK

SEQ ID NO: 132543 - protein, 9 aa, Artificial Sequence
  Description of Artificial Sequence: Synthetic peptide
  Seed: FLRNQPLTF (PMEL_HUMAN)
FQRNQPLTH

SEQ ID NO: 132544 - protein, 9 aa, Artificial Sequence
  Description of Artificial Sequence: Synthetic peptide
  Seed: GTATLRLVK (PMEL_HUMAN)
GSATLRLVK

SEQ ID NO: 132545 - protein, 11 aa, Artificial Sequence
  Description of Artificial Sequence: Synthetic peptide
  Seed: KVLPDGQVIWV (PMEL_HUMAN)
KILPDGQVIWF

SEQ ID NO: 132546 - protein, 9 aa, Artificial Sequence
  Description of Artificial Sequence: Synthetic peptide
  Seed: RAMLGTHTM (PMEL_HUMAN)
RGMLGTHTR

SEQ ID NO: 132547 - protein, 10 aa, Artificial Sequence
  Description of Artificial Sequence: Synthetic peptide
  Seed: RNQDWLGVSR (PMEL_HUMAN)
RWQDWLGVSR

SEQ ID NO: 132548 - protein, 9 aa, Artificial Sequence
  Description of Artificial Sequence: Synthetic peptide
  Seed: ASFSIALNF (PMEL_HUMAN)
AAFSIALNL

SEQ ID NO: 132549 - protein, 9 aa, Artificial Sequence
  Description of Artificial Sequence: Synthetic peptide
  Seed: AHSSSAFTI (PMEL_HUMAN)
AASSSAFTY

SEQ ID NO: 132550 - protein, 10 aa, Artificial Sequence
  Description of Artificial Sequence: Synthetic peptide
  Seed: LAVGATKVPR (PMEL_HUMAN)
LTVGATKVPK

SEQ ID NO: 132551 - protein, 9 aa, Artificial Sequence
  Description of Artificial Sequence: Synthetic peptide
  Seed: FPDGGPCPS (PMEL_HUMAN)
FPDGGPCPF

SEQ ID NO: 132552 - protein, 9 aa, Artificial Sequence
  Description of Artificial Sequence: Synthetic peptide
  Seed: TTPGQAPTA (PMEL_HUMAN)
TTPGQAPTM

SEQ ID NO: 132553 - protein, 9 aa, Artificial Sequence
  Description of Artificial Sequence: Synthetic peptide
  Seed: RLVKRQVPL (PMEL_HUMAN)
REVKRQVPF

SEQ ID NO: 132554 - protein, 9 aa, Artificial Sequence
  Description of Artificial Sequence: Synthetic peptide
  Seed: LMAVVLASL (PMEL_HUMAN)
LMAVVLASA

SEQ ID NO: 132555 - protein, 9 aa, Artificial Sequence
  Description of Artificial Sequence: Synthetic peptide
  Seed: SVQVPTTEV (PMEL_HUMAN)
SSQVPTTEF

SEQ ID NO: 132556 - protein, 9 aa, Artificial Sequence
  Description of Artificial Sequence: Synthetic peptide
  Seed: RLMKQDFSV (PMEL_HUMAN)
RSMKQDFSV

SEQ ID NO: 132557 - protein, 9 aa, Artificial Sequence
  Description of Artificial Sequence: Synthetic peptide
  Seed: SGTLISRAL (PMEL_HUMAN)
SSTLISRAM

SEQ ID NO: 132558 - protein, 11 aa, Artificial Sequence
  Description of Artificial Sequence: Synthetic peptide
  Seed: YVPLAHSSSAF (PMEL_HUMAN)
YRPLAHSSSAY

SEQ ID NO: 132559 - protein, 9 aa, Artificial Sequence
  Description of Artificial Sequence: Synthetic peptide
  Seed: SLADTNSLA (PMEL_HUMAN)
SIADTNSLM

SEQ ID NO: 132560 - protein, 9 aa, Artificial Sequence
  Description of Artificial Sequence: Synthetic peptide
  Seed: EVVGTTPGQ (PMEL_HUMAN)
EAVGTTPGK

SEQ ID NO: 132561 - protein, 9 aa, Artificial Sequence
  Description of Artificial Sequence: Synthetic peptide
  Seed: KVSNDGPTL (PMEL_HUMAN)
KQSNDGPTM

SEQ ID NO: 132562 - protein, 9 aa, Artificial Sequence
  Description of Artificial Sequence: Synthetic peptide
  Seed: MAVVLASLI (PMEL_HUMAN)
MVVVLASLV

SEQ ID NO: 132563 - protein, 10 aa, Artificial Sequence
  Description of Artificial Sequence: Synthetic peptide
  Seed: GSRSYVPLAH (PMEL_HUMAN)
GVRSYVPLAK

SEQ ID NO: 132564 - protein, 9 aa, Artificial Sequence
  Description of Artificial Sequence: Synthetic peptide
  Seed: SITGSLGPL (PMEL_HUMAN)
SATGSLGPR

SEQ ID NO: 132565 - protein, 9 aa, Artificial Sequence
  Description of Artificial Sequence: Synthetic peptide
  Seed: LPSPACQLV (PMEL_HUMAN)
LPSPACQLA

SEQ ID NO: 132566 - protein, 9 aa, Artificial Sequence
  Description of Artificial Sequence: Synthetic peptide
  Seed: LYRYGSFSV (PMEL_HUMAN)
LWRYGSFSM

SEQ ID NO: 132567 - protein, 10 aa, Artificial Sequence
  Description of Artificial Sequence: Synthetic peptide
  Seed: QILKGGSGTY (PMEL_HUMAN)
QQLKGGSGTY

SEQ ID NO: 132568 - protein, 9 aa, Artificial Sequence
  Description of Artificial Sequence: Synthetic peptide
  Seed: GQVPLIVGI (PMEL_HUMAN)
GMVPLIVGT

SEQ ID NO: 132569 - protein, 10 aa, Artificial Sequence
  Description of Artificial Sequence: Synthetic peptide
  Seed: VLMAVVLASL (PMEL_HUMAN)
VGMAVVLASL

SEQ ID NO: 132570 - protein, 10 aa, Artificial Sequence
  Description of Artificial Sequence: Synthetic peptide
  Seed: VLMAVVLASL (PMEL_HUMAN)
VCMAVVLASI

SEQ ID NO: 132571 - protein, 9 aa, Artificial Sequence
  Description of Artificial Sequence: Synthetic peptide
  Seed: GGPVSGLSI (PMEL_HUMAN)
GMPVSGLSM

SEQ ID NO: 132572 - protein, 11 aa, Artificial Sequence
  Description of Artificial Sequence: Synthetic peptide
  Seed: YVPLAHSSSAF (PMEL_HUMAN)
YGPLAHSSSAY

SEQ ID NO: 132573 - protein, 10 aa, Artificial Sequence
  Description of Artificial Sequence: Synthetic peptide
  Seed: SITGSLGPLL (PMEL_HUMAN)
SMTGSLGPLI

SEQ ID NO: 132574 - protein, 9 aa, Artificial Sequence
  Description of Artificial Sequence: Synthetic peptide
  Seed: YLEPGPVTA (PMEL_HUMAN)
YCEPGPVTM

SEQ ID NO: 132575 - protein, 9 aa, Artificial Sequence
  Description of Artificial Sequence: Synthetic peptide
  Seed: YLEPGPVTA (PMEL_HUMAN)
YAEPGPVTY

SEQ ID NO: 132576 - protein, 9 aa, Artificial Sequence
  Description of Artificial Sequence: Synthetic peptide
  Seed: ANASFSIAL (PMEL_HUMAN)
AEASFSIAM

SEQ ID NO: 132577 - protein, 10 aa, Artificial Sequence
  Description of Artificial Sequence: Synthetic peptide
  Seed: VPQLPHSSSH (PMEL_HUMAN)
VMQLPHSSSF

SEQ ID NO: 132578 - protein, 11 aa, Artificial Sequence
  Description of Artificial Sequence: Synthetic peptide
  Seed: RRGSRSYVPLA (PMEL_HUMAN)
RMGSRSYVPLV

SEQ ID NO: 132579 - protein, 9 aa, Artificial Sequence
  Description of Artificial Sequence: Synthetic peptide
  Seed: VVLSGTTAA (PMEL_HUMAN)
VALSGTTAL

SEQ ID NO: 132580 - protein, 10 aa, Artificial Sequence
  Description of Artificial Sequence: Synthetic peptide
  Seed: RRLMKQDFSV (PMEL_HUMAN)
RTLMKQDFSL

SEQ ID NO: 132581 - protein, 10 aa, Artificial Sequence
  Description of Artificial Sequence: Synthetic peptide
  Seed: LAEADLSYTW (PMEL_HUMAN)
LREADLSYTW

SEQ ID NO: 132582 - protein, 10 aa, Artificial Sequence
  Description of Artificial Sequence: Synthetic peptide
  Seed: MTPAEVSIVV (PMEL_HUMAN)
MFPAEVSIVT

SEQ ID NO: 132583 - protein, 9 aa, Artificial Sequence
  Description of Artificial Sequence: Synthetic peptide
  Seed: YLAEADLSY (PMEL_HUMAN)
YPAEADLSI

SEQ ID NO: 132584 - protein, 9 aa, Artificial Sequence
  Description of Artificial Sequence: Synthetic peptide
  Seed: VTAQVVLQA (PMEL_HUMAN)
VIAQVVLQM

SEQ ID NO: 132585 - protein, 10 aa, Artificial Sequence
  Description of Artificial Sequence: Synthetic peptide
  Seed: RGSRSYVPLA (PMEL_HUMAN)
RASRSYVPLR

SEQ ID NO: 132586 - protein, 9 aa, Artificial Sequence
  Description of Artificial Sequence: Synthetic peptide
  Seed: RLVKRQVPL (PMEL_HUMAN)
RPVKRQVPI

SEQ ID NO: 132587 - protein, 10 aa, Artificial Sequence
  Description of Artificial Sequence: Synthetic peptide
  Seed: RGSRSYVPLA (PMEL_HUMAN)
RTSRSYVPLI

SEQ ID NO: 132588 - protein, 9 aa, Artificial Sequence
  Description of Artificial Sequence: Synthetic peptide
  Seed: VSLADTNSL (PMEL_HUMAN)
VMLADTNSM

SEQ ID NO: 132589 - protein, 11 aa, Artificial Sequence
  Description of Artificial Sequence: Synthetic peptide
  Seed: FGDSSGTLISR (PMEL_HUMAN)
FSDSSGTLISF

SEQ ID NO: 132590 - protein, 10 aa, Artificial Sequence
  Description of Artificial Sequence: Synthetic peptide
  Seed: RTKAWNRQLY (PMEL_HUMAN)
RLKAWNRQLY

SEQ ID NO: 132591 - protein, 9 aa, Artificial Sequence
  Description of Artificial Sequence: Synthetic peptide
  Seed: KQDFSVPQL (PMEL_HUMAN)
KGDFSVPQI

SEQ ID NO: 132592 - protein, 9 aa, Artificial Sequence
  Description of Artificial Sequence: Synthetic peptide
  Seed: QAAIPLTSC (PMEL_HUMAN)
QIAIPLTSY

SEQ ID NO: 132593 - protein, 11 aa, Artificial Sequence
  Description of Artificial Sequence: Synthetic peptide
  Seed: LGPLLDGTATL (PMEL_HUMAN)
LRPLLDGTATL

SEQ ID NO: 132594 - protein, 9 aa, Artificial Sequence
  Description of Artificial Sequence: Synthetic peptide
  Seed: ASFSIALNF (PMEL_HUMAN)
AVFSIALNY

SEQ ID NO: 132595 - protein, 10 aa, Artificial Sequence
  Description of Artificial Sequence: Synthetic peptide
  Seed: STAPVQMPTA (PMEL_HUMAN)
SMAPVQMPTI

SEQ ID NO: 132596 - protein, 9 aa, Artificial Sequence
  Description of Artificial Sequence: Synthetic peptide
  Seed: CPIGENSPL (PMEL_HUMAN)
CMIGENSPF

SEQ ID NO: 132597 - protein, 9 aa, Artificial Sequence
  Description of Artificial Sequence: Synthetic peptide
  Seed: SQVWGGQPV (PMEL_HUMAN)
SVVWGGQPV

SEQ ID NO: 132598 - protein, 9 aa, Artificial Sequence
  Description of Artificial Sequence: Synthetic peptide
  Seed: MTPEKVPVS (PMEL_HUMAN)
MTPEKVPVL

SEQ ID NO: 132599 - protein, 10 aa, Artificial Sequence
  Description of Artificial Sequence: Synthetic peptide
  Seed: LIMPGQEAGL (PMEL_HUMAN)
LMMPGQEAGL

SEQ ID NO: 132600 - protein, 10 aa, Artificial Sequence
  Description of Artificial Sequence: Synthetic peptide
  Seed: QVLGGPVSGL (PMEL_HUMAN)
QMLGGPVSGI

SEQ ID NO: 132601 - protein, 11 aa, Artificial Sequence
  Description of Artificial Sequence: Synthetic peptide
  Seed: FGDSSGTLISR (PMEL_HUMAN)
FQDSSGTLISY

SEQ ID NO: 132602 - protein, 10 aa, Artificial Sequence
  Description of Artificial Sequence: Synthetic peptide
  Seed: IFPDGGPCPS (PMEL_HUMAN)
IYPDGGPCPF

SEQ ID NO: 132603 - protein, 10 aa, Artificial Sequence
  Description of Artificial Sequence: Synthetic peptide
  Seed: RALVVTHTYL (PMEL_HUMAN)
RVLVVTHTYF

SEQ ID NO: 132604 - protein, 11 aa, Artificial Sequence
  Description of Artificial Sequence: Synthetic peptide
  Seed: LGPLLDGTATL (PMEL_HUMAN)
LEPLLDGTATI

SEQ ID NO: 132605 - protein, 9 aa, Artificial Sequence
  Description of Artificial Sequence: Synthetic peptide
  Seed: LLVLMAVVL (PMEL_HUMAN)
LMVLMAVVY

SEQ ID NO: 132606 - protein, 10 aa, Artificial Sequence
  Description of Artificial Sequence: Synthetic peptide
  Seed: SVPQLPHSSS (PMEL_HUMAN)
SEPQLPHSSM

SEQ ID NO: 132607 - protein, 11 aa, Artificial Sequence
  Description of Artificial Sequence: Synthetic peptide
  Seed: HSSSHWLRLPR (PMEL_HUMAN)
HRSSHWLRLPR

SEQ ID NO: 132608 - protein, 9 aa, Artificial Sequence
  Description of Artificial Sequence: Synthetic peptide
  Seed: VQVPTTEVI (PMEL_HUMAN)
VMVPTTEVA

SEQ ID NO: 132609 - protein, 9 aa, Artificial Sequence
  Description of Artificial Sequence: Synthetic peptide
  Seed: GQVPTTEVV (PMEL_HUMAN)
GLVPTTEVF

SEQ ID NO: 132610 - protein, 9 aa, Artificial Sequence
  Description of Artificial Sequence: Synthetic peptide
  Seed: QLVLHQILK (PMEL_HUMAN)
QTVLHQILR

SEQ ID NO: 132611 - protein, 9 aa, Artificial Sequence
  Description of Artificial Sequence: Synthetic peptide
  Seed: RQVPLDCVL (PMEL_HUMAN)
RHVPLDCVA

SEQ ID NO: 132612 - protein, 9 aa, Artificial Sequence
  Description of Artificial Sequence: Synthetic peptide
  Seed: RAMLGTHTM (PMEL_HUMAN)
RHMLGTHTL

SEQ ID NO: 132613 - protein, 9 aa, Artificial Sequence
  Description of Artificial Sequence: Synthetic peptide
  Seed: MLGTHTMEV (PMEL_HUMAN)
MMGTHTMEV

SEQ ID NO: 132614 - protein, 10 aa, Artificial Sequence
  Description of Artificial Sequence: Synthetic peptide
  Seed: HTMEVTVYHR (PMEL_HUMAN)
HTMEVTVYHY

SEQ ID NO: 132615 - protein, 9 aa, Artificial Sequence
  Description of Artificial Sequence: Synthetic peptide
  Seed: AVVLASLIY (PMEL_HUMAN)
AQVLASLIY

SEQ ID NO: 132616 - protein, 10 aa, Artificial Sequence
  Description of Artificial Sequence: Synthetic peptide
  Seed: VLMAVVLASL (PMEL_HUMAN)
VDMAVVLASY

SEQ ID NO: 132617 - protein, 10 aa, Artificial Sequence
  Description of Artificial Sequence: Synthetic peptide
  Seed: GYLAEADLSY (PMEL_HUMAN)
GFLAEADLSY

SEQ ID NO: 132618 - protein, 9 aa, Artificial Sequence
  Description of Artificial Sequence: Synthetic peptide
  Seed: RALVVTHTY (PMEL_HUMAN)
RILVVTHTM

SEQ ID NO: 132619 - protein, 10 aa, Artificial Sequence
  Description of Artificial Sequence: Synthetic peptide
  Seed: VLMAVVLASL (PMEL_HUMAN)
VDMAVVLASI

SEQ ID NO: 132620 - protein, 9 aa, Artificial Sequence
  Description of Artificial Sequence: Synthetic peptide
  Seed: AESTGMTPE (PMEL_HUMAN)
AESTGMTPP

SEQ ID NO: 132621 - protein, 10 aa, Artificial Sequence
  Description of Artificial Sequence: Synthetic peptide
  Seed: SRALVVTHTY (PMEL_HUMAN)
SRALVVTHTL

SEQ ID NO: 132622 - protein, 10 aa, Artificial Sequence
  Description of Artificial Sequence: Synthetic peptide
  Seed: LAVIGALLAV (PMEL_HUMAN)
LPVIGALLAV

SEQ ID NO: 132623 - protein, 10 aa, Artificial Sequence
  Description of Artificial Sequence: Synthetic peptide
  Seed: YVPLAHSSSA (PMEL_HUMAN)
YTPLAHSSSL

SEQ ID NO: 132624 - protein, 9 aa, Artificial Sequence
  Description of Artificial Sequence: Synthetic peptide
  Seed: LNFPGSQKV (PMEL_HUMAN)
LRFPGSQKF

SEQ ID NO: 132625 - protein, 9 aa, Artificial Sequence
  Description of Artificial Sequence: Synthetic peptide
  Seed: VVLQAAIPL (PMEL_HUMAN)
VTLQAAIPI

SEQ ID NO: 132626 - protein, 9 aa, Artificial Sequence
  Description of Artificial Sequence: Synthetic peptide
  Seed: TYLEPGPVT (PMEL_HUMAN)
TYLEPGPVF

SEQ ID NO: 132627 - protein, 10 aa, Artificial Sequence
  Description of Artificial Sequence: Synthetic peptide
  Seed: AVVLASLIYR (PMEL_HUMAN)
AEVLASLIYK

SEQ ID NO: 132628 - protein, 9 aa, Artificial Sequence
  Description of Artificial Sequence: Synthetic peptide
  Seed: GTATLRLVK (PMEL_HUMAN)
GMATLRLVK

SEQ ID NO: 132629 - protein, 9 aa, Artificial Sequence
  Description of Artificial Sequence: Synthetic peptide
  Seed: AGLGQVPLI (PMEL_HUMAN)
ATLGQVPLM

SEQ ID NO: 132630 - protein, 10 aa, Artificial Sequence
  Description of Artificial Sequence: Synthetic peptide
  Seed: LAHSSSAFTI (PMEL_HUMAN)
LMHSSSAFTL

SEQ ID NO: 132631 - protein, 10 aa, Artificial Sequence
  Description of Artificial Sequence: Synthetic peptide
  Seed: LADTNSLAVV (PMEL_HUMAN)
LSDTNSLAVL

SEQ ID NO: 132632 - protein, 10 aa, Artificial Sequence
  Description of Artificial Sequence: Synthetic peptide
  Seed: FLRNQPLTFA (PMEL_HUMAN)
FMRNQPLTFV

SEQ ID NO: 132633 - protein, 9 aa, Artificial Sequence
  Description of Artificial Sequence: Synthetic peptide
  Seed: AEPSGTTSV (PMEL_HUMAN)
AEPSGTTSM

SEQ ID NO: 132634 - protein, 9 aa, Artificial Sequence
  Description of Artificial Sequence: Synthetic peptide
  Seed: ISRALVVTH (PMEL_HUMAN)
IARALVVTF

SEQ ID NO: 132635 - protein, 9 aa, Artificial Sequence
  Description of Artificial Sequence: Synthetic peptide
  Seed: DQVPFSVSV (PMEL_HUMAN)
DRVPFSVSL

SEQ ID NO: 132636 - protein, 9 aa, Artificial Sequence
  Description of Artificial Sequence: Synthetic peptide
  Seed: VVLSGTTAA (PMEL_HUMAN)
VALSGTTAV

SEQ ID NO: 132637 - protein, 9 aa, Artificial Sequence
  Description of Artificial Sequence: Synthetic peptide
  Seed: VVLSGTTAA (PMEL_HUMAN)
VSLSGTTAV

SEQ ID NO: 132638 - protein, 9 aa, Artificial Sequence
  Description of Artificial Sequence: Synthetic peptide
  Seed: GQVPTTEVV (PMEL_HUMAN)
GHVPTTEVM

SEQ ID NO: 132639 - protein, 9 aa, Artificial Sequence
  Description of Artificial Sequence: Synthetic peptide
  Seed: VIWVNNTII (PMEL_HUMAN)
VMWVNNTIL

SEQ ID NO: 132640 - protein, 9 aa, Artificial Sequence
  Description of Artificial Sequence: Synthetic peptide
  Seed: GSWSQKRSF (PMEL_HUMAN)
GTWSQKRSW

SEQ ID NO: 132641 - protein, 9 aa, Artificial Sequence
  Description of Artificial Sequence: Synthetic peptide
  Seed: SGLSIGTGR (PMEL_HUMAN)
SALSIGTGF

SEQ ID NO: 132642 - protein, 10 aa, Artificial Sequence
  Description of Artificial Sequence: Synthetic peptide
  Seed: SLIYRRRLMK (PMEL_HUMAN)
SEIYRRRLMK

SEQ ID NO: 132643 - protein, 9 aa, Artificial Sequence
  Description of Artificial Sequence: Synthetic peptide
  Seed: YHRRGSRSY (PMEL_HUMAN)
YIRRGSRSY

SEQ ID NO: 132644 - protein, 10 aa, Artificial Sequence
  Description of Artificial Sequence: Synthetic peptide
  Seed: ASFSIALNFP (PMEL_HUMAN)
ATFSIALNFF

SEQ ID NO: 132645 - protein, 10 aa, Artificial Sequence
  Description of Artificial Sequence: Synthetic peptide
  Seed: MTPAEVSIVV (PMEL_HUMAN)
MEPAEVSIVI

SEQ ID NO: 132646 - protein, 9 aa, Artificial Sequence
  Description of Artificial Sequence: Synthetic peptide
  Seed: HTMEVTVYH (PMEL_HUMAN)
HAMEVTVYH

SEQ ID NO: 132647 - protein, 11 aa, Artificial Sequence
  Description of Artificial Sequence: Synthetic peptide
  Seed: GIESAEILQAV (PMEL_HUMAN)
GQESAEILQAV

SEQ ID NO: 132648 - protein, 9 aa, Artificial Sequence
  Description of Artificial Sequence: Synthetic peptide
  Seed: TLIGANASF (PMEL_HUMAN)
TCIGANASY

SEQ ID NO: 132649 - protein, 9 aa, Artificial Sequence
  Description of Artificial Sequence: Synthetic peptide
  Seed: SYVPLAHSS (PMEL_HUMAN)
SWVPLAHSL

SEQ ID NO: 132650 - protein, 9 aa, Artificial Sequence
  Description of Artificial Sequence: Synthetic peptide
  Seed: VTLDIVQGI (PMEL_HUMAN)
VQLDIVQGL

SEQ ID NO: 132651 - protein, 9 aa, Artificial Sequence
  Description of Artificial Sequence: Synthetic peptide
  Seed: RNQPLTFAL (PMEL_HUMAN)
RAQPLTFAL

SEQ ID NO: 132652 - protein, 10 aa, Artificial Sequence
  Description of Artificial Sequence: Synthetic peptide
  Seed: RQLYPEWTEA (PMEL_HUMAN)
RALYPEWTEY

SEQ ID NO: 132653 - protein, 11 aa, Artificial Sequence
  Description of Artificial Sequence: Synthetic peptide
  Seed: YLAEADLSYTW (PMEL_HUMAN)
YMAEADLSYTA

SEQ ID NO: 132654 - protein, 9 aa, Artificial Sequence
  Description of Artificial Sequence: Synthetic peptide
  Seed: ALDGGNKHF (PMEL_HUMAN)
AYDGGNKHV

SEQ ID NO: 132655 - protein, 9 aa, Artificial Sequence
  Description of Artificial Sequence: Synthetic peptide
  Seed: LMAVVLASL (PMEL_HUMAN)
LQAVVLASA

SEQ ID NO: 132656 - protein, 10 aa, Artificial Sequence
  Description of Artificial Sequence: Synthetic peptide
  Seed: MLGTHTMEVT (PMEL_HUMAN)
MLGTHTMEVA

SEQ ID NO: 132657 - protein, 9 aa, Artificial Sequence
  Description of Artificial Sequence: Synthetic peptide
  Seed: GMTPAEVSI (PMEL_HUMAN)
GLTPAEVSY

SEQ ID NO: 132658 - protein, 10 aa, Artificial Sequence
  Description of Artificial Sequence: Synthetic peptide
  Seed: YRYGSFSVTL (PMEL_HUMAN)
YIYGSFSVTF

SEQ ID NO: 132659 - protein, 9 aa, Artificial Sequence
  Description of Artificial Sequence: Synthetic peptide
  Seed: ALNFPGSQK (PMEL_HUMAN)
ATNFPGSQY

SEQ ID NO: 132660 - protein, 10 aa, Artificial Sequence
  Description of Artificial Sequence: Synthetic peptide
  Seed: IALNFPGSQK (PMEL_HUMAN)
IMLNFPGSQR

SEQ ID NO: 132661 - protein, 10 aa, Artificial Sequence
  Description of Artificial Sequence: Synthetic peptide
  Seed: YRYGSFSVTL (PMEL_HUMAN)
YDYGSFSVTY

SEQ ID NO: 132662 - protein, 9 aa, Artificial Sequence
  Description of Artificial Sequence: Synthetic peptide
  Seed: VLMAVVLAS (PMEL_HUMAN)
VAMAVVLAL

SEQ ID NO: 132663 - protein, 9 aa, Artificial Sequence
  Description of Artificial Sequence: Synthetic peptide
  Seed: TPAEVSIVV (PMEL_HUMAN)
THAEVSIVI

SEQ ID NO: 132664 - protein, 9 aa, Artificial Sequence
  Description of Artificial Sequence: Synthetic peptide
  Seed: ITGSLGPLL (PMEL_HUMAN)
ISGSLGPLF

SEQ ID NO: 132665 - protein, 11 aa, Artificial Sequence
  Description of Artificial Sequence: Synthetic peptide
  Seed: YRYGSFSVTLD (PMEL_HUMAN)
YRYGSFSVTLF

SEQ ID NO: 132666 - protein, 9 aa, Artificial Sequence
  Description of Artificial Sequence: Synthetic peptide
  Seed: KVSNDGPTL (PMEL_HUMAN)
KVSNDGPTV

SEQ ID NO: 132667 - protein, 9 aa, Artificial Sequence
  Description of Artificial Sequence: Synthetic peptide
  Seed: VSEVMGTTL (PMEL_HUMAN)
VEEVMGTTV

SEQ ID NO: 132668 - protein, 11 aa, Artificial Sequence
  Description of Artificial Sequence: Synthetic peptide
  Seed: LGPLLDGTATL (PMEL_HUMAN)
LTPLLDGTATI

SEQ ID NO: 132669 - protein, 9 aa, Artificial Sequence
  Description of Artificial Sequence: Synthetic peptide
  Seed: RTKAWNRQL (PMEL_HUMAN)
RVKAWNRQL

SEQ ID NO: 132670 - protein, 11 aa, Artificial Sequence
  Description of Artificial Sequence: Synthetic peptide
  Seed: SSSHWLRLPRI (PMEL_HUMAN)
SMSHWLRLPRR

SEQ ID NO: 132671 - protein, 9 aa, Artificial Sequence
  Description of Artificial Sequence: Synthetic peptide
  Seed: RNQPLTFAL (PMEL_HUMAN)
RVQPLTFAW

SEQ ID NO: 132672 - protein, 10 aa, Artificial Sequence
  Description of Artificial Sequence: Synthetic peptide
  Seed: VLMAVVLASL (PMEL_HUMAN)
VPMAVVLASA

SEQ ID NO: 132673 - protein, 9 aa, Artificial Sequence
  Description of Artificial Sequence: Synthetic peptide
  Seed: WSQKRSFVY (PMEL_HUMAN)
WRQKRSFVF

SEQ ID NO: 132674 - protein, 9 aa, Artificial Sequence
  Description of Artificial Sequence: Synthetic peptide
  Seed: AHSSSAFTI (PMEL_HUMAN)
AQSSSAFTY

SEQ ID NO: 132675 - protein, 10 aa, Artificial Sequence
  Description of Artificial Sequence: Synthetic peptide
  Seed: ASFSIALNFP (PMEL_HUMAN)
ASFSIALNFM

SEQ ID NO: 132676 - protein, 9 aa, Artificial Sequence
  Description of Artificial Sequence: Synthetic peptide
  Seed: ALDGGNKHF (PMEL_HUMAN)
ALDGGNKHL

SEQ ID NO: 132677 - protein, 9 aa, Artificial Sequence
  Description of Artificial Sequence: Synthetic peptide
  Seed: QPLTFALQL (PMEL_HUMAN)
QPLTFALQW

SEQ ID NO: 132678 - protein, 9 aa, Artificial Sequence
  Description of Artificial Sequence: Synthetic peptide
  Seed: MTPEKVPVS (PMEL_HUMAN)
MAPEKVPVF

SEQ ID NO: 132679 - protein, 9 aa, Artificial Sequence
  Description of Artificial Sequence: Synthetic peptide
  Seed: RELPIPEPE (PMEL_HUMAN)
RDLPIPEPL

SEQ ID NO: 132680 - protein, 10 aa, Artificial Sequence
  Description of Artificial Sequence: Synthetic peptide
  Seed: LHLAVIGALL (PMEL_HUMAN)
LALAVIGALV

SEQ ID NO: 132681 - protein, 11 aa, Artificial Sequence
  Description of Artificial Sequence: Synthetic peptide
  Seed: FGDSSGTLISR (PMEL_HUMAN)
FYDSSGTLISF

SEQ ID NO: 132682 - protein, 9 aa, Artificial Sequence
  Description of Artificial Sequence: Synthetic peptide
  Seed: RLVKRQVPL (PMEL_HUMAN)
RSVKRQVPK

SEQ ID NO: 132683 - protein, 10 aa, Artificial Sequence
  Description of Artificial Sequence: Synthetic peptide
  Seed: MTPAEVSIVV (PMEL_HUMAN)
MYPAEVSIVA

SEQ ID NO: 132684 - protein, 10 aa, Artificial Sequence
  Description of Artificial Sequence: Synthetic peptide
  Seed: LPHSSSHWLR (PMEL_HUMAN)
LAHSSSHWLR

SEQ ID NO: 132685 - protein, 9 aa, Artificial Sequence
  Description of Artificial Sequence: Synthetic peptide
  Seed: QVIWVNNTI (PMEL_HUMAN)
QAIWVNNTK

SEQ ID NO: 132686 - protein, 9 aa, Artificial Sequence
  Description of Artificial Sequence: Synthetic peptide
  Seed: LNFPGSQKV (PMEL_HUMAN)
LAFPGSQKI

SEQ ID NO: 132687 - protein, 10 aa, Artificial Sequence
  Description of Artificial Sequence: Synthetic peptide
  Seed: IALNFPGSQK (PMEL_HUMAN)
IYLNFPGSQR

SEQ ID NO: 132688 - protein, 9 aa, Artificial Sequence
  Description of Artificial Sequence: Synthetic peptide
  Seed: RAMLGTHTM (PMEL_HUMAN)
RKMLGTHTI

SEQ ID NO: 132689 - protein, 11 aa, Artificial Sequence
  Description of Artificial Sequence: Synthetic peptide
  Seed: YLAEADLSYTW (PMEL_HUMAN)
YWAEADLSYTL

SEQ ID NO: 132690 - protein, 10 aa, Artificial Sequence
  Description of Artificial Sequence: Synthetic peptide
  Seed: SCPIGENSPL (PMEL_HUMAN)
SDPIGENSPL

SEQ ID NO: 132691 - protein, 10 aa, Artificial Sequence
  Description of Artificial Sequence: Synthetic peptide
  Seed: LPHSSSHWLR (PMEL_HUMAN)
LFHSSSHWLK

SEQ ID NO: 132692 - protein, 10 aa, Artificial Sequence
  Description of Artificial Sequence: Synthetic peptide
  Seed: FSVSVSQLRA (PMEL_HUMAN)
FTVSVSQLRF

SEQ ID NO: 132693 - protein, 9 aa, Artificial Sequence
  Description of Artificial Sequence: Synthetic peptide
  Seed: IESAEILQA (PMEL_HUMAN)
IESAEILQV

SEQ ID NO: 132694 - protein, 10 aa, Artificial Sequence
  Description of Artificial Sequence: Synthetic peptide
  Seed: VSLADTNSLA (PMEL_HUMAN)
VILADTNSLI

SEQ ID NO: 132695 - protein, 10 aa, Artificial Sequence
  Description of Artificial Sequence: Synthetic peptide
  Seed: LIMPGQEAGL (PMEL_HUMAN)
LQMPGQEAGF

SEQ ID NO: 132696 - protein, 10 aa, Artificial Sequence
  Description of Artificial Sequence: Synthetic peptide
  Seed: LLDGTATLRL (PMEL_HUMAN)
LMDGTATLRV

SEQ ID NO: 132697 - protein, 9 aa, Artificial Sequence
  Description of Artificial Sequence: Synthetic peptide
  Seed: STAPVQMPT (PMEL_HUMAN)
SVAPVQMPV

SEQ ID NO: 132698 - protein, 10 aa, Artificial Sequence
  Description of Artificial Sequence: Synthetic peptide
  Seed: LAVVSTQLIM (PMEL_HUMAN)
LSVVSTQLIL

SEQ ID NO: 132699 - protein, 9 aa, Artificial Sequence
  Description of Artificial Sequence: Synthetic peptide
  Seed: RTKAWNRQL (PMEL_HUMAN)
RTKAWNRQW

SEQ ID NO: 132700 - protein, 11 aa, Artificial Sequence
  Description of Artificial Sequence: Synthetic peptide
  Seed: THTMEVTVYHR (PMEL_HUMAN)
TKTMEVTVYHR

SEQ ID NO: 132701 - protein, 10 aa, Artificial Sequence
  Description of Artificial Sequence: Synthetic peptide
  Seed: YGSFSVTLDI (PMEL_HUMAN)
YSSFSVTLDM

SEQ ID NO: 132702 - protein, 10 aa, Artificial Sequence
  Description of Artificial Sequence: Synthetic peptide
  Seed: SLIYRRRLMK (PMEL_HUMAN)
SWIYRRRLMK

SEQ ID NO: 132703 - protein, 8 aa, Artificial Sequence
  Description of Artificial Sequence: Synthetic peptide
  Seed: LADTNSLA (PMEL_HUMAN)
LVDTNSLV

SEQ ID NO: 132704 - protein, 9 aa, Artificial Sequence
  Description of Artificial Sequence: Synthetic peptide
  Seed: TTPGQAPTA (PMEL_HUMAN)
TVPGQAPTF

SEQ ID NO: 132705 - protein, 9 aa, Artificial Sequence
  Description of Artificial Sequence: Synthetic peptide
  Seed: ASFSIALNF (PMEL_HUMAN)
AKFSIALNL

SEQ ID NO: 132706 - protein, 9 aa, Artificial Sequence
  Description of Artificial Sequence: Synthetic peptide
  Seed: STESITGSL (PMEL_HUMAN)
SAESITGSL

SEQ ID NO: 132707 - protein, 11 aa, Artificial Sequence
  Description of Artificial Sequence: Synthetic peptide
  Seed: ISRALVVTHTY (PMEL_HUMAN)
IARALVVTHTW

SEQ ID NO: 132708 - protein, 9 aa, Artificial Sequence
  Description of Artificial Sequence: Synthetic peptide
  Seed: HLAVIGALL (PMEL_HUMAN)
HVAVIGALI

SEQ ID NO: 132709 - protein, 9 aa, Artificial Sequence
  Description of Artificial Sequence: Synthetic peptide
  Seed: AEPSGTTSV (PMEL_HUMAN)
AVPSGTTSM

SEQ ID NO: 132710 - protein, 11 aa, Artificial Sequence
  Description of Artificial Sequence: Synthetic peptide
  Seed: SLADTNSLAVV (PMEL_HUMAN)
SVADTNSLAVV

SEQ ID NO: 132711 - protein, 9 aa, Artificial Sequence
  Description of Artificial Sequence: Synthetic peptide
  Seed: AGLGQVPLI (PMEL_HUMAN)
ATLGQVPLI

SEQ ID NO: 132712 - protein, 9 aa, Artificial Sequence
  Description of Artificial Sequence: Synthetic peptide
  Seed: AVVSTQLIM (PMEL_HUMAN)
AQVSTQLIY

SEQ ID NO: 132713 - protein, 9 aa, Artificial Sequence
  Description of Artificial Sequence: Synthetic peptide
  Seed: SSHWLRLPR (PMEL_HUMAN)
SSHWLRLPK

SEQ ID NO: 132714 - protein, 10 aa, Artificial Sequence
  Description of Artificial Sequence: Synthetic peptide
  Seed: RGSRSYVPLA (PMEL_HUMAN)
RISRSYVPLS

SEQ ID NO: 132715 - protein, 9 aa, Artificial Sequence
  Description of Artificial Sequence: Synthetic peptide
  Seed: AGLGQVPLI (PMEL_HUMAN)
AILGQVPLV

SEQ ID NO: 132716 - protein, 10 aa, Artificial Sequence
  Description of Artificial Sequence: Synthetic peptide
  Seed: SAEILQAVPS (PMEL_HUMAN)
SAEILQAVPA

SEQ ID NO: 132717 - protein, 9 aa, Artificial Sequence
  Description of Artificial Sequence: Synthetic peptide
  Seed: VLYRYGSFS (PMEL_HUMAN)
VVYRYGSFV

SEQ ID NO: 132718 - protein, 9 aa, Artificial Sequence
  Description of Artificial Sequence: Synthetic peptide
  Seed: AVIGALLAV (PMEL_HUMAN)
ASIGALLAW

SEQ ID NO: 132719 - protein, 9 aa, Artificial Sequence
  Description of Artificial Sequence: Synthetic peptide
  Seed: VTLDIVQGI (PMEL_HUMAN)
VTLDIVQGA

SEQ ID NO: 132720 - protein, 9 aa, Artificial Sequence
  Description of Artificial Sequence: Synthetic peptide
  Seed: FSVSVSQLR (PMEL_HUMAN)
FIVSVSQLM

SEQ ID NO: 132721 - protein, 9 aa, Artificial Sequence
  Description of Artificial Sequence: Synthetic peptide
  Seed: RALVVTHTY (PMEL_HUMAN)
RRLVVTHTM

SEQ ID NO: 132722 - protein, 10 aa, Artificial Sequence
  Description of Artificial Sequence: Synthetic peptide
  Seed: MAVVLASLIY (PMEL_HUMAN)
MPVVLASLIY

SEQ ID NO: 132723 - protein, 9 aa, Artificial Sequence
  Description of Artificial Sequence: Synthetic peptide
  Seed: ANASFSIAL (PMEL_HUMAN)
AHASFSIAY

SEQ ID NO: 132724 - protein, 10 aa, Artificial Sequence
  Description of Artificial Sequence: Synthetic peptide
  Seed: HFLRNQPLTF (PMEL_HUMAN)
HTLRNQPLTY

SEQ ID NO: 132725 - protein, 9 aa, Artificial Sequence
  Description of Artificial Sequence: Synthetic peptide
  Seed: FSIALNFPG (PMEL_HUMAN)
FSIALNFPW

SEQ ID NO: 132726 - protein, 9 aa, Artificial Sequence
  Description of Artificial Sequence: Synthetic peptide
  Seed: SAFTITDQV (PMEL_HUMAN)
SRFTITDQL

SEQ ID NO: 132727 - protein, 9 aa, Artificial Sequence
  Description of Artificial Sequence: Synthetic peptide
  Seed: VLPSPACQL (PMEL_HUMAN)
VRPSPACQM

SEQ ID NO: 132728 - protein, 9 aa, Artificial Sequence
  Description of Artificial Sequence: Synthetic peptide
  Seed: TTDGHRPTA (PMEL_HUMAN)
TVDGHRPTL

SEQ ID NO: 132729 - protein, 8 aa, Artificial Sequence
  Description of Artificial Sequence: Synthetic peptide
  Seed: LAHSSSAF (PMEL_HUMAN)
LLHSSSAF

SEQ ID NO: 132730 - protein, 9 aa, Artificial Sequence
  Description of Artificial Sequence: Synthetic peptide
  Seed: VPFSVSVSQ (PMEL_HUMAN)
VAFSVSVSY

SEQ ID NO: 132731 - protein, 10 aa, Artificial Sequence
  Description of Artificial Sequence: Synthetic peptide
  Seed: LMAVVLASLI (PMEL_HUMAN)
LMAVVLASLK

SEQ ID NO: 132732 - protein, 10 aa, Artificial Sequence
  Description of Artificial Sequence: Synthetic peptide
  Seed: RGSRSYVPLA (PMEL_HUMAN)
RRSRSYVPLI

SEQ ID NO: 132733 - protein, 11 aa, Artificial Sequence
  Description of Artificial Sequence: Synthetic peptide
  Seed: GIESAEILQAV (PMEL_HUMAN)
GMESAEILQAI

SEQ ID NO: 132734 - protein, 11 aa, Artificial Sequence
  Description of Artificial Sequence: Synthetic peptide
  Seed: SAFTITDQVPF (PMEL_HUMAN)
SMFTITDQVPY

SEQ ID NO: 132735 - protein, 9 aa, Artificial Sequence
  Description of Artificial Sequence: Synthetic peptide
  Seed: VWKTWGQYW (PMEL_HUMAN)
VWKTWGQYL

SEQ ID NO: 132736 - protein, 9 aa, Artificial Sequence
  Description of Artificial Sequence: Synthetic peptide
  Seed: RQVPLDCVL (PMEL_HUMAN)
REVPLDCVF

SEQ ID NO: 132737 - protein, 9 aa, Artificial Sequence
  Description of Artificial Sequence: Synthetic peptide
  Seed: LAVVSTQLI (PMEL_HUMAN)
LTVVSTQLY

SEQ ID NO: 132738 - protein, 9 aa, Artificial Sequence
  Description of Artificial Sequence: Synthetic peptide
  Seed: SQKRSFVYV (PMEL_HUMAN)
SLKRSFVYV

SEQ ID NO: 132739 - protein, 9 aa, Artificial Sequence
  Description of Artificial Sequence: Synthetic peptide
  Seed: EKVPVSEVM (PMEL_HUMAN)
ERVPVSEVY

SEQ ID NO: 132740 - protein, 9 aa, Artificial Sequence
  Description of Artificial Sequence: Synthetic peptide
  Seed: RLPRIFCSC (PMEL_HUMAN)
RMPRIFCSI

SEQ ID NO: 132741 - protein, 9 aa, Artificial Sequence
  Description of Artificial Sequence: Synthetic peptide
  Seed: RAMLGTHTM (PMEL_HUMAN)
RFMLGTHTY

SEQ ID NO: 132742 - protein, 10 aa, Artificial Sequence
  Description of Artificial Sequence: Synthetic peptide
  Seed: YVPLAHSSSA (PMEL_HUMAN)
YEPLAHSSSM

SEQ ID NO: 132743 - protein, 8 aa, Artificial Sequence
  Description of Artificial Sequence: Synthetic peptide
  Seed: LLDGTATL (PMEL_HUMAN)
LWDGTATV

SEQ ID NO: 132744 - protein, 10 aa, Artificial Sequence
  Description of Artificial Sequence: Synthetic peptide
  Seed: YRYGSFSVTL (PMEL_HUMAN)
YMYGSFSVTM

SEQ ID NO: 132745 - protein, 11 aa, Artificial Sequence
  Description of Artificial Sequence: Synthetic peptide
  Seed: RRGSRSYVPLA (PMEL_HUMAN)
RTGSRSYVPLV

SEQ ID NO: 132746 - protein, 9 aa, Artificial Sequence
  Description of Artificial Sequence: Synthetic peptide
  Seed: ITDQVPFSV (PMEL_HUMAN)
IGDQVPFSF

SEQ ID NO: 132747 - protein, 9 aa, Artificial Sequence
  Description of Artificial Sequence: Synthetic peptide
  Seed: TEVVGTTPG (PMEL_HUMAN)
TEVVGTTPI

SEQ ID NO: 132748 - protein, 9 aa, Artificial Sequence
  Description of Artificial Sequence: Synthetic peptide
  Seed: TPAEVSIVV (PMEL_HUMAN)
TPAEVSIVW

SEQ ID NO: 132749 - protein, 9 aa, Artificial Sequence
  Description of Artificial Sequence: Synthetic peptide
  Seed: VSNDGPTLI (PMEL_HUMAN)
VQNDGPTLW

SEQ ID NO: 132750 - protein, 9 aa, Artificial Sequence
  Description of Artificial Sequence: Synthetic peptide
  Seed: GENSPLLSG (PMEL_HUMAN)
GENSPLLSI

SEQ ID NO: 132751 - protein, 9 aa, Artificial Sequence
  Description of Artificial Sequence: Synthetic peptide
  Seed: GILLVLMAV (PMEL_HUMAN)
GQLLVLMAA

SEQ ID NO: 132752 - protein, 8 aa, Artificial Sequence
  Description of Artificial Sequence: Synthetic peptide
  Seed: HTMEVTVY (PMEL_HUMAN)
HAMEVTVM

SEQ ID NO: 132753 - protein, 9 aa, Artificial Sequence
  Description of Artificial Sequence: Synthetic peptide
  Seed: QVWGGQPVY (PMEL_HUMAN)
QMWGGQPVW

SEQ ID NO: 132754 - protein, 9 aa, Artificial Sequence
  Description of Artificial Sequence: Synthetic peptide
  Seed: LMAVVLASL (PMEL_HUMAN)
LQAVVLASM

SEQ ID NO: 132755 - protein, 9 aa, Artificial Sequence
  Description of Artificial Sequence: Synthetic peptide
  Seed: HSSSHWLRL (PMEL_HUMAN)
HTSSHWLRA

SEQ ID NO: 132756 - protein, 9 aa, Artificial Sequence
  Description of Artificial Sequence: Synthetic peptide
  Seed: VQMPTAEST (PMEL_HUMAN)
VMMPTAESI

SEQ ID NO: 132757 - protein, 11 aa, Artificial Sequence
  Description of Artificial Sequence: Synthetic peptide
  Seed: LGPLLDGTATL (PMEL_HUMAN)
LDPLLDGTATL

SEQ ID NO: 132758 - protein, 11 aa, Artificial Sequence
  Description of Artificial Sequence: Synthetic peptide
  Seed: RPTAEAPNTTA (PMEL_HUMAN)
RPTAEAPNTTL

SEQ ID NO: 132759 - protein, 10 aa, Artificial Sequence
  Description of Artificial Sequence: Synthetic peptide
  Seed: RSFVYVWKTW (PMEL_HUMAN)
RYFVYVWKTV

SEQ ID NO: 132760 - protein, 9 aa, Artificial Sequence
  Description of Artificial Sequence: Synthetic peptide
  Seed: FLRNQPLTF (PMEL_HUMAN)
FFRNQPLTV

SEQ ID NO: 132761 - protein, 9 aa, Artificial Sequence
  Description of Artificial Sequence: Synthetic peptide
  Seed: AAQVTTTEW (PMEL_HUMAN)
ASQVTTTEW

SEQ ID NO: 132762 - protein, 11 aa, Artificial Sequence
  Description of Artificial Sequence: Synthetic peptide
  Seed: YVPLAHSSSAF (PMEL_HUMAN)
YVPLAHSSSAY

SEQ ID NO: 132763 - protein, 10 aa, Artificial Sequence
  Description of Artificial Sequence: Synthetic peptide
  Seed: MTPAEVSIVV (PMEL_HUMAN)
MVPAEVSIVS

SEQ ID NO: 132764 - protein, 9 aa, Artificial Sequence
  Description of Artificial Sequence: Synthetic peptide
  Seed: YHRRGSRSY (PMEL_HUMAN)
YVRRGSRSF

SEQ ID NO: 132765 - protein, 11 aa, Artificial Sequence
  Description of Artificial Sequence: Synthetic peptide
  Seed: FGDSSGTLISR (PMEL_HUMAN)
FSDSSGTLISL

SEQ ID NO: 132766 - protein, 9 aa, Artificial Sequence
  Description of Artificial Sequence: Synthetic peptide
  Seed: LVLKRCLLH (PMEL_HUMAN)
LILKRCLLR

SEQ ID NO: 132767 - protein, 11 aa, Artificial Sequence
  Description of Artificial Sequence: Synthetic peptide
  Seed: GYLAEADLSYT (PMEL_HUMAN)
GKLAEADLSYI

SEQ ID NO: 132768 - protein, 11 aa, Artificial Sequence
  Description of Artificial Sequence: Synthetic peptide
  Seed: TVYHRRGSRSY (PMEL_HUMAN)
TLYHRRGSRSY

SEQ ID NO: 132769 - protein, 11 aa, Artificial Sequence
  Description of Artificial Sequence: Synthetic peptide
  Seed: FSVSVSQLRAL (PMEL_HUMAN)
FTVSVSQLRAW

SEQ ID NO: 132770 - protein, 10 aa, Artificial Sequence
  Description of Artificial Sequence: Synthetic peptide
  Seed: NASFSIALNF (PMEL_HUMAN)
NNSFSIALNW

SEQ ID NO: 132771 - protein, 9 aa, Artificial Sequence
  Description of Artificial Sequence: Synthetic peptide
  Seed: GQVPLIVGI (PMEL_HUMAN)
GVVPLIVGL

SEQ ID NO: 132772 - protein, 11 aa, Artificial Sequence
  Description of Artificial Sequence: Synthetic peptide
  Seed: LGPLLDGTATL (PMEL_HUMAN)
LIPLLDGTATL

SEQ ID NO: 132773 - protein, 9 aa, Artificial Sequence
  Description of Artificial Sequence: Synthetic peptide
  Seed: HTYLEPGPV (PMEL_HUMAN)
HSYLEPGPM

SEQ ID NO: 132774 - protein, 10 aa, Artificial Sequence
  Description of Artificial Sequence: Synthetic peptide
  Seed: DWLGVSRQLR (PMEL_HUMAN)
DVLGVSRQLR

SEQ ID NO: 132775 - protein, 10 aa, Artificial Sequence
  Description of Artificial Sequence: Synthetic peptide
  Seed: LMAVVLASLI (PMEL_HUMAN)
LLAVVLASLY

SEQ ID NO: 132776 - protein, 10 aa, Artificial Sequence
  Description of Artificial Sequence: Synthetic peptide
  Seed: SVPQLPHSSS (PMEL_HUMAN)
SAPQLPHSSI

SEQ ID NO: 132777 - protein, 9 aa, Artificial Sequence
  Description of Artificial Sequence: Synthetic peptide
  Seed: LSIGTGRAM (PMEL_HUMAN)
LQIGTGRAM

SEQ ID NO: 132778 - protein, 9 aa, Artificial Sequence
  Description of Artificial Sequence: Synthetic peptide
  Seed: RNQPLTFAL (PMEL_HUMAN)
RWQPLTFAY

SEQ ID NO: 132779 - protein, 10 aa, Artificial Sequence
  Description of Artificial Sequence: Synthetic peptide
  Seed: LVLMAVVLAS (PMEL_HUMAN)
LQLMAVVLAA

SEQ ID NO: 132780 - protein, 10 aa, Artificial Sequence
  Description of Artificial Sequence: Synthetic peptide
  Seed: MTPAEVSIVV (PMEL_HUMAN)
MDPAEVSIVH

SEQ ID NO: 132781 - protein, 10 aa, Artificial Sequence
  Description of Artificial Sequence: Synthetic peptide
  Seed: NASFSIALNF (PMEL_HUMAN)
NMSFSIALNW

SEQ ID NO: 132782 - protein, 10 aa, Artificial Sequence
  Description of Artificial Sequence: Synthetic peptide
  Seed: IFPDGGPCPS (PMEL_HUMAN)
IYPDGGPCPI

SEQ ID NO: 132783 - protein, 10 aa, Artificial Sequence
  Description of Artificial Sequence: Synthetic peptide
  Seed: LVLMAVVLAS (PMEL_HUMAN)
LNLMAVVLAA

SEQ ID NO: 132784 - protein, 9 aa, Artificial Sequence
  Description of Artificial Sequence: Synthetic peptide
  Seed: TAPVQMPTA (PMEL_HUMAN)
TSPVQMPTM

SEQ ID NO: 132785 - protein, 9 aa, Artificial Sequence
  Description of Artificial Sequence: Synthetic peptide
  Seed: SSIMSTESI (PMEL_HUMAN)
SQIMSTESH

SEQ ID NO: 132786 - protein, 10 aa, Artificial Sequence
  Description of Artificial Sequence: Synthetic peptide
  Seed: GLPKEACMEI (PMEL_HUMAN)
GMPKEACMEV

SEQ ID NO: 132787 - protein, 9 aa, Artificial Sequence
  Description of Artificial Sequence: Synthetic peptide
  Seed: KVLPDGQVI (PMEL_HUMAN)
KMLPDGQVL

SEQ ID NO: 132788 - protein, 9 aa, Artificial Sequence
  Description of Artificial Sequence: Synthetic peptide
  Seed: GTYCLNVSL (PMEL_HUMAN)
GQYCLNVSL

SEQ ID NO: 132789 - protein, 9 aa, Artificial Sequence
  Description of Artificial Sequence: Synthetic peptide
  Seed: VQMPTAEST (PMEL_HUMAN)
VMMPTAESY

SEQ ID NO: 132790 - protein, 9 aa, Artificial Sequence
  Description of Artificial Sequence: Synthetic peptide
  Seed: MTPEKVPVS (PMEL_HUMAN)
MLPEKVPVL

SEQ ID NO: 132791 - protein, 11 aa, Artificial Sequence
  Description of Artificial Sequence: Synthetic peptide
  Seed: FGDSSGTLISR (PMEL_HUMAN)
FLDSSGTLISV

SEQ ID NO: 132792 - protein, 9 aa, Artificial Sequence
  Description of Artificial Sequence: Synthetic peptide
  Seed: VLGGPVSGL (PMEL_HUMAN)
VAGGPVSGI

SEQ ID NO: 132793 - protein, 10 aa, Artificial Sequence
  Description of Artificial Sequence: Synthetic peptide
  Seed: VLMAVVLASL (PMEL_HUMAN)
VKMAVVLASV

SEQ ID NO: 132794 - protein, 9 aa, Artificial Sequence
  Description of Artificial Sequence: Synthetic peptide
  Seed: ANASFSIAL (PMEL_HUMAN)
ARASFSIAF

SEQ ID NO: 132795 - protein, 9 aa, Artificial Sequence
  Description of Artificial Sequence: Synthetic peptide
  Seed: KHFLRNQPL (PMEL_HUMAN)
KQFLRNQPM

SEQ ID NO: 132796 - protein, 9 aa, Artificial Sequence
  Description of Artificial Sequence: Synthetic peptide
  Seed: VVLQAAIPL (PMEL_HUMAN)
VPLQAAIPY

SEQ ID NO: 132797 - protein, 10 aa, Artificial Sequence
  Description of Artificial Sequence: Synthetic peptide
  Seed: EVVGTTPGQA (PMEL_HUMAN)
EVVGTTPGQR

SEQ ID NO: 132798 - protein, 10 aa, Artificial Sequence
  Description of Artificial Sequence: Synthetic peptide
  Seed: AVIGALLAVG (PMEL_HUMAN)
ALIGALLAVN

SEQ ID NO: 132799 - protein, 10 aa, Artificial Sequence
  Description of Artificial Sequence: Synthetic peptide
  Seed: TDQVPFSVSV (PMEL_HUMAN)
THQVPFSVSV

SEQ ID NO: 132800 - protein, 9 aa, Artificial Sequence
  Description of Artificial Sequence: Synthetic peptide
  Seed: QVWGGQPVY (PMEL_HUMAN)
QQWGGQPVY

SEQ ID NO: 132801 - protein, 10 aa, Artificial Sequence
  Description of Artificial Sequence: Synthetic peptide
  Seed: VSGLSIGTGR (PMEL_HUMAN)
VTGLSIGTGY

SEQ ID NO: 132802 - protein, 10 aa, Artificial Sequence
  Description of Artificial Sequence: Synthetic peptide
  Seed: LVLMAVVLAS (PMEL_HUMAN)
LILMAVVLAL

SEQ ID NO: 132803 - protein, 10 aa, Artificial Sequence
  Description of Artificial Sequence: Synthetic peptide
  Seed: RTKAWNRQLY (PMEL_HUMAN)
RYKAWNRQLA

SEQ ID NO: 132804 - protein, 10 aa, Artificial Sequence
  Description of Artificial Sequence: Synthetic peptide
  Seed: AVPSGEGDAF (PMEL_HUMAN)
AQPSGEGDAF

SEQ ID NO: 132805 - protein, 9 aa, Artificial Sequence
  Description of Artificial Sequence: Synthetic peptide
  Seed: FPDGGPCPS (PMEL_HUMAN)
FVDGGPCPM

SEQ ID NO: 132806 - protein, 10 aa, Artificial Sequence
  Description of Artificial Sequence: Synthetic peptide
  Seed: TGMTPAEVSI (PMEL_HUMAN)
TLMTPAEVSV

SEQ ID NO: 132807 - protein, 9 aa, Artificial Sequence
  Description of Artificial Sequence: Synthetic peptide
  Seed: TPAEVSIVV (PMEL_HUMAN)
TSAEVSIVM

SEQ ID NO: 132808 - protein, 9 aa, Artificial Sequence
  Description of Artificial Sequence: Synthetic peptide
  Seed: WSQKRSFVY (PMEL_HUMAN)
WQQKRSFVM

SEQ ID NO: 132809 - protein, 9 aa, Artificial Sequence
  Description of Artificial Sequence: Synthetic peptide
  Seed: RAMLGTHTM (PMEL_HUMAN)
RDMLGTHTV

SEQ ID NO: 132810 - protein, 9 aa, Artificial Sequence
  Description of Artificial Sequence: Synthetic peptide
  Seed: LADTNSLAV (PMEL_HUMAN)
LPDTNSLAL

SEQ ID NO: 132811 - protein, 9 aa, Artificial Sequence
  Description of Artificial Sequence: Synthetic peptide
  Seed: GSFSVTLDI (PMEL_HUMAN)
GAFSVTLDF

SEQ ID NO: 132812 - protein, 9 aa, Artificial Sequence
  Description of Artificial Sequence: Synthetic peptide
  Seed: LHLAVIGAL (PMEL_HUMAN)
LSLAVIGAY

SEQ ID NO: 132813 - protein, 9 aa, Artificial Sequence
  Description of Artificial Sequence: Synthetic peptide
  Seed: TTDGHRPTA (PMEL_HUMAN)
TRDGHRPTL

SEQ ID NO: 132814 - protein, 10 aa, Artificial Sequence
  Description of Artificial Sequence: Synthetic peptide
  Seed: RGSRSYVPLA (PMEL_HUMAN)
RESRSYVPLV

SEQ ID NO: 132815 - protein, 9 aa, Artificial Sequence
  Description of Artificial Sequence: Synthetic peptide
  Seed: TTDGHRPTA (PMEL_HUMAN)
TSDGHRPTL

SEQ ID NO: 132816 - protein, 11 aa, Artificial Sequence
  Description of Artificial Sequence: Synthetic peptide
  Seed: FLRNQPLTFAL (PMEL_HUMAN)
FLRNQPLTFAM

SEQ ID NO: 132817 - protein, 10 aa, Artificial Sequence
  Description of Artificial Sequence: Synthetic peptide
  Seed: WKTWGQYWQV (PMEL_HUMAN)
WTTWGQYWQV

SEQ ID NO: 132818 - protein, 9 aa, Artificial Sequence
  Description of Artificial Sequence: Synthetic peptide
  Seed: ESAEILQAV (PMEL_HUMAN)
EMAEILQAL

SEQ ID NO: 132819 - protein, 9 aa, Artificial Sequence
  Description of Artificial Sequence: Synthetic peptide
  Seed: ITGSLGPLL (PMEL_HUMAN)
ISGSLGPLM

SEQ ID NO: 132820 - protein, 9 aa, Artificial Sequence
  Description of Artificial Sequence: Synthetic peptide
  Seed: ALLAVGATK (PMEL_HUMAN)
AALAVGATF

SEQ ID NO: 132821 - protein, 9 aa, Artificial Sequence
  Description of Artificial Sequence: Synthetic peptide
  Seed: ALDGGNKHF (PMEL_HUMAN)
AGDGGNKHF

SEQ ID NO: 132822 - protein, 11 aa, Artificial Sequence
  Description of Artificial Sequence: Synthetic peptide
  Seed: FGDSSGTLISR (PMEL_HUMAN)
FFDSSGTLISV

SEQ ID NO: 132823 - protein, 9 aa, Artificial Sequence
  Description of Artificial Sequence: Synthetic peptide
  Seed: SSIMSTESI (PMEL_HUMAN)
SVIMSTESI

SEQ ID NO: 132824 - protein, 9 aa, Artificial Sequence
  Description of Artificial Sequence: Synthetic peptide
  Seed: TPAEVSIVV (PMEL_HUMAN)
TQAEVSIVY

SEQ ID NO: 132825 - protein, 10 aa, Artificial Sequence
  Description of Artificial Sequence: Synthetic peptide
  Seed: VPQLPHSSSH (PMEL_HUMAN)
VSQLPHSSSM

SEQ ID NO: 132826 - protein, 9 aa, Artificial Sequence
  Description of Artificial Sequence: Synthetic peptide
  Seed: TAEAPNTTA (PMEL_HUMAN)
TTEAPNTTV

SEQ ID NO: 132827 - protein, 10 aa, Artificial Sequence
  Description of Artificial Sequence: Synthetic peptide
  Seed: VVLASLIYRR (PMEL_HUMAN)
VMLASLIYRS

SEQ ID NO: 132828 - protein, 10 aa, Artificial Sequence
  Description of Artificial Sequence: Synthetic peptide
  Seed: SSSHWLRLPR (PMEL_HUMAN)
SSSHWLRLPK

SEQ ID NO: 132829 - protein, 9 aa, Artificial Sequence
  Description of Artificial Sequence: Synthetic peptide
  Seed: FTITDQVPF (PMEL_HUMAN)
FPITDQVPM

SEQ ID NO: 132830 - protein, 9 aa, Artificial Sequence
  Description of Artificial Sequence: Synthetic peptide
  Seed: KVLPDGQVI (PMEL_HUMAN)
KMLPDGQVY

SEQ ID NO: 132831 - protein, 9 aa, Artificial Sequence
  Description of Artificial Sequence: Synthetic peptide
  Seed: RALVVTHTY (PMEL_HUMAN)
RALVVTHTW

SEQ ID NO: 132832 - protein, 9 aa, Artificial Sequence
  Description of Artificial Sequence: Synthetic peptide
  Seed: FLRNQPLTF (PMEL_HUMAN)
FRRNQPLTL

SEQ ID NO: 132833 - protein, 10 aa, Artificial Sequence
  Description of Artificial Sequence: Synthetic peptide
  Seed: RQLYPEWTEA (PMEL_HUMAN)
RYLYPEWTEY

SEQ ID NO: 132834 - protein, 10 aa, Artificial Sequence
  Description of Artificial Sequence: Synthetic peptide
  Seed: KVLPDGQVIW (PMEL_HUMAN)
KMLPDGQVIY

SEQ ID NO: 132835 - protein, 11 aa, Artificial Sequence
  Description of Artificial Sequence: Synthetic peptide
  Seed: LVLMAVVLASL (PMEL_HUMAN)
LFLMAVVLASL

SEQ ID NO: 132836 - protein, 11 aa, Artificial Sequence
  Description of Artificial Sequence: Synthetic peptide
  Seed: SGYLAEADLSY (PMEL_HUMAN)
SMYLAEADLSF

SEQ ID NO: 132837 - protein, 9 aa, Artificial Sequence
  Description of Artificial Sequence: Synthetic peptide
  Seed: SQKRSFVYV (PMEL_HUMAN)
SGKRSFVYK

SEQ ID NO: 132838 - protein, 10 aa, Artificial Sequence
  Description of Artificial Sequence: Synthetic peptide
  Seed: SLIYRRRLMK (PMEL_HUMAN)
SIIYRRRLMR

SEQ ID NO: 132839 - protein, 11 aa, Artificial Sequence
  Description of Artificial Sequence: Synthetic peptide
  Seed: LGPLLDGTATL (PMEL_HUMAN)
LHPLLDGTATL

SEQ ID NO: 132840 - protein, 10 aa, Artificial Sequence
  Description of Artificial Sequence: Synthetic peptide
  Seed: RTKAWNRQLY (PMEL_HUMAN)
RSKAWNRQLL

SEQ ID NO: 132841 - protein, 10 aa, Artificial Sequence
  Description of Artificial Sequence: Synthetic peptide
  Seed: MAVVLASLIY (PMEL_HUMAN)
MLVVLASLIR

SEQ ID NO: 132842 - protein, 9 aa, Artificial Sequence
  Description of Artificial Sequence: Synthetic peptide
  Seed: EGDAFELTV (PMEL_HUMAN)
EGDAFELTL

SEQ ID NO: 132843 - protein, 9 aa, Artificial Sequence
  Description of Artificial Sequence: Synthetic peptide
  Seed: TLIGANASF (PMEL_HUMAN)
TYIGANASV

SEQ ID NO: 132844 - protein, 9 aa, Artificial Sequence
  Description of Artificial Sequence: Synthetic peptide
  Seed: TEWVETTAR (PMEL_HUMAN)
TEWVETTAP

SEQ ID NO: 132845 - protein, 9 aa, Artificial Sequence
  Description of Artificial Sequence: Synthetic peptide
  Seed: WSQKRSFVY (PMEL_HUMAN)
WSQKRSFVL

SEQ ID NO: 132846 - protein, 9 aa, Artificial Sequence
  Description of Artificial Sequence: Synthetic peptide
  Seed: SLGPLLDGT (PMEL_HUMAN)
SIGPLLDGA

SEQ ID NO: 132847 - protein, 9 aa, Artificial Sequence
  Description of Artificial Sequence: Synthetic peptide
  Seed: ESAEILQAV (PMEL_HUMAN)
EAAEILQAW

SEQ ID NO: 132848 - protein, 9 aa, Artificial Sequence
  Description of Artificial Sequence: Synthetic peptide
  Seed: ITDQVPFSV (PMEL_HUMAN)
IYDQVPFSC

SEQ ID NO: 132849 - protein, 10 aa, Artificial Sequence
  Description of Artificial Sequence: Synthetic peptide
  Seed: GPLLDGTATL (PMEL_HUMAN)
GKLLDGTATV

SEQ ID NO: 132850 - protein, 10 aa, Artificial Sequence
  Description of Artificial Sequence: Synthetic peptide
  Seed: HFLRNQPLTF (PMEL_HUMAN)
HLLRNQPLTY

SEQ ID NO: 132851 - protein, 8 aa, Artificial Sequence
  Description of Artificial Sequence: Synthetic peptide
  Seed: FSVSVSQL (PMEL_HUMAN)
FQVSVSQI

SEQ ID NO: 132852 - protein, 10 aa, Artificial Sequence
  Description of Artificial Sequence: Synthetic peptide
  Seed: LIGANASFSI (PMEL_HUMAN)
LLGANASFSM

SEQ ID NO: 132853 - protein, 9 aa, Artificial Sequence
  Description of Artificial Sequence: Synthetic peptide
  Seed: RALDGGNKH (PMEL_HUMAN)
RGLDGGNKY

SEQ ID NO: 132854 - protein, 9 aa, Artificial Sequence
  Description of Artificial Sequence: Synthetic peptide
  Seed: SLADTNSLA (PMEL_HUMAN)
SAADTNSLV

SEQ ID NO: 132855 - protein, 11 aa, Artificial Sequence
  Description of Artificial Sequence: Synthetic peptide
  Seed: KVLPDGQVIWV (PMEL_HUMAN)
KTLPDGQVIWF

SEQ ID NO: 132856 - protein, 9 aa, Artificial Sequence
  Description of Artificial Sequence: Synthetic peptide
  Seed: AEPSGTTSV (PMEL_HUMAN)
ALPSGTTSA

SEQ ID NO: 132857 - protein, 9 aa, Artificial Sequence
  Description of Artificial Sequence: Synthetic peptide
  Seed: DSSGTLISR (PMEL_HUMAN)
DMSGTLISK

SEQ ID NO: 132858 - protein, 9 aa, Artificial Sequence
  Description of Artificial Sequence: Synthetic peptide
  Seed: GTYCLNVSL (PMEL_HUMAN)
GLYCLNVSI

SEQ ID NO: 132859 - protein, 10 aa, Artificial Sequence
  Description of Artificial Sequence: Synthetic peptide
  Seed: RELPIPEPEG (PMEL_HUMAN)
RELPIPEPEL

SEQ ID NO: 132860 - protein, 9 aa, Artificial Sequence
  Description of Artificial Sequence: Synthetic peptide
  Seed: VVLSGTTAA (PMEL_HUMAN)
VILSGTTAI

SEQ ID NO: 132861 - protein, 11 aa, Artificial Sequence
  Description of Artificial Sequence: Synthetic peptide
  Seed: FLRNQPLTFAL (PMEL_HUMAN)
FIRNQPLTFAV

SEQ ID NO: 132862 - protein, 9 aa, Artificial Sequence
  Description of Artificial Sequence: Synthetic peptide
  Seed: TYLEPGPVT (PMEL_HUMAN)
TWLEPGPVL

SEQ ID NO: 132863 - protein, 9 aa, Artificial Sequence
  Description of Artificial Sequence: Synthetic peptide
  Seed: EVVGTTPGQ (PMEL_HUMAN)
EVVGTTPGL

SEQ ID NO: 132864 - protein, 10 aa, Artificial Sequence
  Description of Artificial Sequence: Synthetic peptide
  Seed: NASFSIALNF (PMEL_HUMAN)
NVSFSIALNW

SEQ ID NO: 132865 - protein, 10 aa, Artificial Sequence
  Description of Artificial Sequence: Synthetic peptide
  Seed: SVPQLPHSSS (PMEL_HUMAN)
SAPQLPHSSA

SEQ ID NO: 132866 - protein, 9 aa, Artificial Sequence
  Description of Artificial Sequence: Synthetic peptide
  Seed: SSPGCQPPA (PMEL_HUMAN)
SVPGCQPPF

SEQ ID NO: 132867 - protein, 9 aa, Artificial Sequence
  Description of Artificial Sequence: Synthetic peptide
  Seed: VLPDGQVIW (PMEL_HUMAN)
VAPDGQVIF

SEQ ID NO: 132868 - protein, 9 aa, Artificial Sequence
  Description of Artificial Sequence: Synthetic peptide
  Seed: VLPDGQVIW (PMEL_HUMAN)
VVPDGQVII

SEQ ID NO: 132869 - protein, 9 aa, Artificial Sequence
  Description of Artificial Sequence: Synthetic peptide
  Seed: VPFSVSVSQ (PMEL_HUMAN)
VTFSVSVSY

SEQ ID NO: 132870 - protein, 9 aa, Artificial Sequence
  Description of Artificial Sequence: Synthetic peptide
  Seed: GSRSYVPLA (PMEL_HUMAN)
GIRSYVPLV

SEQ ID NO: 132871 - protein, 9 aa, Artificial Sequence
  Description of Artificial Sequence: Synthetic peptide
  Seed: KQDFSVPQL (PMEL_HUMAN)
KQDFSVPQY

SEQ ID NO: 132872 - protein, 9 aa, Artificial Sequence
  Description of Artificial Sequence: Synthetic peptide
  Seed: RLMKQDFSV (PMEL_HUMAN)
RMMKQDFSI

SEQ ID NO: 132873 - protein, 9 aa, Artificial Sequence
  Description of Artificial Sequence: Synthetic peptide
  Seed: VTLDIVQGI (PMEL_HUMAN)
VALDIVQGM

SEQ ID NO: 132874 - protein, 10 aa, Artificial Sequence
  Description of Artificial Sequence: Synthetic peptide
  Seed: FPDGGPCPSG (PMEL_HUMAN)
FPDGGPCPSM

SEQ ID NO: 132875 - protein, 10 aa, Artificial Sequence
  Description of Artificial Sequence: Synthetic peptide
  Seed: SLIYRRRLMK (PMEL_HUMAN)
SRIYRRRLMK

SEQ ID NO: 132876 - protein, 9 aa, Artificial Sequence
  Description of Artificial Sequence: Synthetic peptide
  Seed: ESAEILQAV (PMEL_HUMAN)
EIAEILQAT

SEQ ID NO: 132877 - protein, 10 aa, Artificial Sequence
  Description of Artificial Sequence: Synthetic peptide
  Seed: RQLYPEWTEA (PMEL_HUMAN)
RLLYPEWTEA

SEQ ID NO: 132878 - protein, 10 aa, Artificial Sequence
  Description of Artificial Sequence: Synthetic peptide
  Seed: LADTNSLAVV (PMEL_HUMAN)
LADTNSLAVL

SEQ ID NO: 132879 - protein, 9 aa, Artificial Sequence
  Description of Artificial Sequence: Synthetic peptide
  Seed: WQVLGGPVS (PMEL_HUMAN)
WIVLGGPVF

SEQ ID NO: 132880 - protein, 11 aa, Artificial Sequence
  Description of Artificial Sequence: Synthetic peptide
  Seed: RSYVPLAHSSS (PMEL_HUMAN)
RTYVPLAHSSK

SEQ ID NO: 132881 - protein, 10 aa, Artificial Sequence
  Description of Artificial Sequence: Synthetic peptide
  Seed: LIGANASFSI (PMEL_HUMAN)
LMGANASFSA

SEQ ID NO: 132882 - protein, 10 aa, Artificial Sequence
  Description of Artificial Sequence: Synthetic peptide
  Seed: MSTESITGSL (PMEL_HUMAN)
MATESITGSF

SEQ ID NO: 132883 - protein, 9 aa, Artificial Sequence
  Description of Artificial Sequence: Synthetic peptide
  Seed: TTPGQAPTA (PMEL_HUMAN)
TMPGQAPTF

SEQ ID NO: 132884 - protein, 10 aa, Artificial Sequence
  Description of Artificial Sequence: Synthetic peptide
  Seed: VLMAVVLASL (PMEL_HUMAN)
VLMAVVLASY

SEQ ID NO: 132885 - protein, 10 aa, Artificial Sequence
  Description of Artificial Sequence: Synthetic peptide
  Seed: RNQDWLGVSR (PMEL_HUMAN)
RMQDWLGVSK

SEQ ID NO: 132886 - protein, 10 aa, Artificial Sequence
  Description of Artificial Sequence: Synthetic peptide
  Seed: YGSFSVTLDI (PMEL_HUMAN)
YTSFSVTLDM

SEQ ID NO: 132887 - protein, 9 aa, Artificial Sequence
  Description of Artificial Sequence: Synthetic peptide
  Seed: AEADLSYTW (PMEL_HUMAN)
ADADLSYTL

SEQ ID NO: 132888 - protein, 9 aa, Artificial Sequence
  Description of Artificial Sequence: Synthetic peptide
  Seed: STESITGSL (PMEL_HUMAN)
STESITGSV

SEQ ID NO: 132889 - protein, 9 aa, Artificial Sequence
  Description of Artificial Sequence: Synthetic peptide
  Seed: LADTNSLAV (PMEL_HUMAN)
LEDTNSLAM

SEQ ID NO: 132890 - protein, 11 aa, Artificial Sequence
  Description of Artificial Sequence: Synthetic peptide
  Seed: MTPEKVPVSEV (PMEL_HUMAN)
MAPEKVPVSEM

SEQ ID NO: 132891 - protein, 10 aa, Artificial Sequence
  Description of Artificial Sequence: Synthetic peptide
  Seed: LVLMAVVLAS (PMEL_HUMAN)
LILMAVVLAI

SEQ ID NO: 132892 - protein, 10 aa, Artificial Sequence
  Description of Artificial Sequence: Synthetic peptide
  Seed: SLADTNSLAV (PMEL_HUMAN)
SMADTNSLAM

SEQ ID NO: 132893 - protein, 9 aa, Artificial Sequence
  Description of Artificial Sequence: Synthetic peptide
  Seed: VSNDGPTLI (PMEL_HUMAN)
VSNDGPTLW

SEQ ID NO: 132894 - protein, 9 aa, Artificial Sequence
  Description of Artificial Sequence: Synthetic peptide
  Seed: VQMPTAEST (PMEL_HUMAN)
VHMPTAESM

SEQ ID NO: 132895 - protein, 9 aa, Artificial Sequence
  Description of Artificial Sequence: Synthetic peptide
  Seed: TMEVTVYHR (PMEL_HUMAN)
TMEVTVYHY

SEQ ID NO: 132896 - protein, 9 aa, Artificial Sequence
  Description of Artificial Sequence: Synthetic peptide
  Seed: LQAAIPLTS (PMEL_HUMAN)
LKAAIPLTL

SEQ ID NO: 132897 - protein, 9 aa, Artificial Sequence
  Description of Artificial Sequence: Synthetic peptide
  Seed: SSIMSTESI (PMEL_HUMAN)
SKIMSTESL

SEQ ID NO: 132898 - protein, 10 aa, Artificial Sequence
  Description of Artificial Sequence: Synthetic peptide
  Seed: RRLMKQDFSV (PMEL_HUMAN)
RWLMKQDFSI

SEQ ID NO: 132899 - protein, 10 aa, Artificial Sequence
  Description of Artificial Sequence: Synthetic peptide
  Seed: VLMAVVLASL (PMEL_HUMAN)
VMMAVVLASV

SEQ ID NO: 132900 - protein, 10 aa, Artificial Sequence
  Description of Artificial Sequence: Synthetic peptide
  Seed: LADTNSLAVV (PMEL_HUMAN)
LIDTNSLAVF

SEQ ID NO: 132901 - protein, 8 aa, Artificial Sequence
  Description of Artificial Sequence: Synthetic peptide
  Seed: RSFVYVWK (PMEL_HUMAN)
RLFVYVWR

SEQ ID NO: 132902 - protein, 10 aa, Artificial Sequence
  Description of Artificial Sequence: Synthetic peptide
  Seed: VLMAVVLASL (PMEL_HUMAN)
VPMAVVLASL

SEQ ID NO: 132903 - protein, 11 aa, Artificial Sequence
  Description of Artificial Sequence: Synthetic peptide
  Seed: LVLMAVVLASL (PMEL_HUMAN)
LHLMAVVLASV

SEQ ID NO: 132904 - protein, 9 aa, Artificial Sequence
  Description of Artificial Sequence: Synthetic peptide
  Seed: VVLSGTTAA (PMEL_HUMAN)
VVLSGTTAL

SEQ ID NO: 132905 - protein, 10 aa, Artificial Sequence
  Description of Artificial Sequence: Synthetic peptide
  Seed: SRALVVTHTY (PMEL_HUMAN)
SPALVVTHTY

SEQ ID NO: 132906 - protein, 9 aa, Artificial Sequence
  Description of Artificial Sequence: Synthetic peptide
  Seed: QAAIPLTSC (PMEL_HUMAN)
QPAIPLTSL

SEQ ID NO: 132907 - protein, 9 aa, Artificial Sequence
  Description of Artificial Sequence: Synthetic peptide
  Seed: VQMPTAEST (PMEL_HUMAN)
VIMPTAESL

SEQ ID NO: 132908 - protein, 10 aa, Artificial Sequence
  Description of Artificial Sequence: Synthetic peptide
  Seed: ALLAVGATKV (PMEL_HUMAN)
AILAVGATKV

SEQ ID NO: 132909 - protein, 10 aa, Artificial Sequence
  Description of Artificial Sequence: Synthetic peptide
  Seed: KRQVPLDCVL (PMEL_HUMAN)
KDQVPLDCVF

SEQ ID NO: 132910 - protein, 9 aa, Artificial Sequence
  Description of Artificial Sequence: Synthetic peptide
  Seed: FTITDQVPF (PMEL_HUMAN)
FRITDQVPY

SEQ ID NO: 132911 - protein, 9 aa, Artificial Sequence
  Description of Artificial Sequence: Synthetic peptide
  Seed: TPAEVSIVV (PMEL_HUMAN)
TMAEVSIVF

SEQ ID NO: 132912 - protein, 10 aa, Artificial Sequence
  Description of Artificial Sequence: Synthetic peptide
  Seed: MTPAEVSIVV (PMEL_HUMAN)
MSPAEVSIVW

SEQ ID NO: 132913 - protein, 10 aa, Artificial Sequence
  Description of Artificial Sequence: Synthetic peptide
  Seed: LAEADLSYTW (PMEL_HUMAN)
LWEADLSYTW

SEQ ID NO: 132914 - protein, 9 aa, Artificial Sequence
  Description of Artificial Sequence: Synthetic peptide
  Seed: RAMLGTHTM (PMEL_HUMAN)
RVMLGTHTL

SEQ ID NO: 132915 - protein, 10 aa, Artificial Sequence
  Description of Artificial Sequence: Synthetic peptide
  Seed: GDSSGTLISR (PMEL_HUMAN)
GVSSGTLISK

SEQ ID NO: 132916 - protein, 9 aa, Artificial Sequence
  Description of Artificial Sequence: Synthetic peptide
  Seed: AEADLSYTW (PMEL_HUMAN)
ATADLSYTW

SEQ ID NO: 132917 - protein, 10 aa, Artificial Sequence
  Description of Artificial Sequence: Synthetic peptide
  Seed: VVLASLIYRR (PMEL_HUMAN)
VLLASLIYRR

SEQ ID NO: 132918 - protein, 9 aa, Artificial Sequence
  Description of Artificial Sequence: Synthetic peptide
  Seed: ALDGGNKHF (PMEL_HUMAN)
AQDGGNKHL

SEQ ID NO: 132919 - protein, 9 aa, Artificial Sequence
  Description of Artificial Sequence: Synthetic peptide
  Seed: SSIMSTESI (PMEL_HUMAN)
STIMSTESF

SEQ ID NO: 132920 - protein, 9 aa, Artificial Sequence
  Description of Artificial Sequence: Synthetic peptide
  Seed: HTMEVTVYH (PMEL_HUMAN)
HAMEVTVYK

SEQ ID NO: 132921 - protein, 10 aa, Artificial Sequence
  Description of Artificial Sequence: Synthetic peptide
  Seed: YRYGSFSVTL (PMEL_HUMAN)
YAYGSFSVTF

SEQ ID NO: 132922 - protein, 10 aa, Artificial Sequence
  Description of Artificial Sequence: Synthetic peptide
  Seed: SGTYCLNVSL (PMEL_HUMAN)
SDTYCLNVSF

SEQ ID NO: 132923 - protein, 9 aa, Artificial Sequence
  Description of Artificial Sequence: Synthetic peptide
  Seed: VLPDGQVIW (PMEL_HUMAN)
VNPDGQVIL

SEQ ID NO: 132924 - protein, 10 aa, Artificial Sequence
  Description of Artificial Sequence: Synthetic peptide
  Seed: ALDGGNKHFL (PMEL_HUMAN)
AVDGGNKHFI

SEQ ID NO: 132925 - protein, 10 aa, Artificial Sequence
  Description of Artificial Sequence: Synthetic peptide
  Seed: EVVGTTPGQA (PMEL_HUMAN)
ELVGTTPGQK

SEQ ID NO: 132926 - protein, 10 aa, Artificial Sequence
  Description of Artificial Sequence: Synthetic peptide
  Seed: RALDGGNKHF (PMEL_HUMAN)
RTLDGGNKHR

SEQ ID NO: 132927 - protein, 11 aa, Artificial Sequence
  Description of Artificial Sequence: Synthetic peptide
  Seed: SLKVSNDGPTL (PMEL_HUMAN)
SMKVSNDGPTF

SEQ ID NO: 132928 - protein, 9 aa, Artificial Sequence
  Description of Artificial Sequence: Synthetic peptide
  Seed: AVIGALLAV (PMEL_HUMAN)
ASIGALLAF

SEQ ID NO: 132929 - protein, 9 aa, Artificial Sequence
  Description of Artificial Sequence: Synthetic peptide
  Seed: ASFSIALNF (PMEL_HUMAN)
ARFSIALNV

SEQ ID NO: 132930 - protein, 9 aa, Artificial Sequence
  Description of Artificial Sequence: Synthetic peptide
  Seed: EPGPVTAQV (PMEL_HUMAN)
EPGPVTAQY

SEQ ID NO: 132931 - protein, 8 aa, Artificial Sequence
  Description of Artificial Sequence: Synthetic peptide
  Seed: VVLASLIY (PMEL_HUMAN)
VMLASLIY

SEQ ID NO: 132932 - protein, 9 aa, Artificial Sequence
  Description of Artificial Sequence: Synthetic peptide
  Seed: TEWVETTAR (PMEL_HUMAN)
TYWVETTAR

SEQ ID NO: 132933 - protein, 10 aa, Artificial Sequence
  Description of Artificial Sequence: Synthetic peptide
  Seed: AVIGALLAVG (PMEL_HUMAN)
AMIGALLAVP

SEQ ID NO: 132934 - protein, 9 aa, Artificial Sequence
  Description of Artificial Sequence: Synthetic peptide
  Seed: AVIGALLAV (PMEL_HUMAN)
AAIGALLAA

SEQ ID NO: 132935 - protein, 9 aa, Artificial Sequence
  Description of Artificial Sequence: Synthetic peptide
  Seed: AVVLASLIY (PMEL_HUMAN)
ASVLASLIK

SEQ ID NO: 132936 - protein, 9 aa, Artificial Sequence
  Description of Artificial Sequence: Synthetic peptide
  Seed: TTDGHRPTA (PMEL_HUMAN)
TFDGHRPTF

SEQ ID NO: 132937 - protein, 11 aa, Artificial Sequence
  Description of Artificial Sequence: Synthetic peptide
  Seed: TYLEPGPVTAQ (PMEL_HUMAN)
TWLEPGPVTAF

SEQ ID NO: 132938 - protein, 9 aa, Artificial Sequence
  Description of Artificial Sequence: Synthetic peptide
  Seed: SLAVVSTQL (PMEL_HUMAN)
SLAVVSTQF

SEQ ID NO: 132939 - protein, 9 aa, Artificial Sequence
  Description of Artificial Sequence: Synthetic peptide
  Seed: YLAEADLSY (PMEL_HUMAN)
YGAEADLSF

SEQ ID NO: 132940 - protein, 10 aa, Artificial Sequence
  Description of Artificial Sequence: Synthetic peptide
  Seed: SVPQLPHSSS (PMEL_HUMAN)
SRPQLPHSSL

SEQ ID NO: 132941 - protein, 10 aa, Artificial Sequence
  Description of Artificial Sequence: Synthetic peptide
  Seed: VLMAVVLASL (PMEL_HUMAN)
VVMAVVLASA

SEQ ID NO: 132942 - protein, 10 aa, Artificial Sequence
  Description of Artificial Sequence: Synthetic peptide
  Seed: RTKAWNRQLY (PMEL_HUMAN)
RSKAWNRQLV

SEQ ID NO: 132943 - protein, 9 aa, Artificial Sequence
  Description of Artificial Sequence: Synthetic peptide
  Seed: LPDGQVIWV (PMEL_HUMAN)
LNDGQVIWL

SEQ ID NO: 132944 - protein, 10 aa, Artificial Sequence
  Description of Artificial Sequence: Synthetic peptide
  Seed: ESITGSLGPL (PMEL_HUMAN)
EIITGSLGPW

SEQ ID NO: 132945 - protein, 10 aa, Artificial Sequence
  Description of Artificial Sequence: Synthetic peptide
  Seed: LIYRRRLMKQ (PMEL_HUMAN)
LMYRRRLMKK

SEQ ID NO: 132946 - protein, 9 aa, Artificial Sequence
  Description of Artificial Sequence: Synthetic peptide
  Seed: FSIALNFPG (PMEL_HUMAN)
FSIALNFPM

SEQ ID NO: 132947 - protein, 9 aa, Artificial Sequence
  Description of Artificial Sequence: Synthetic peptide
  Seed: SLADTNSLA (PMEL_HUMAN)
SAADTNSLI

SEQ ID NO: 132948 - protein, 11 aa, Artificial Sequence
  Description of Artificial Sequence: Synthetic peptide
  Seed: SGYLAEADLSY (PMEL_HUMAN)
SLYLAEADLSF

SEQ ID NO: 132949 - protein, 9 aa, Artificial Sequence
  Description of Artificial Sequence: Synthetic peptide
  Seed: LHLAVIGAL (PMEL_HUMAN)
LALAVIGAF

SEQ ID NO: 132950 - protein, 9 aa, Artificial Sequence
  Description of Artificial Sequence: Synthetic peptide
  Seed: RAMLGTHTM (PMEL_HUMAN)
RTMLGTHTW

SEQ ID NO: 132951 - protein, 10 aa, Artificial Sequence
  Description of Artificial Sequence: Synthetic peptide
  Seed: AEILQAVPSG (PMEL_HUMAN)
AEILQAVPSC

SEQ ID NO: 132952 - protein, 9 aa, Artificial Sequence
  Description of Artificial Sequence: Synthetic peptide
  Seed: AGQVPTTEV (PMEL_HUMAN)
AFQVPTTEL

SEQ ID NO: 132953 - protein, 10 aa, Artificial Sequence
  Description of Artificial Sequence: Synthetic peptide
  Seed: MTPAEVSIVV (PMEL_HUMAN)
MRPAEVSIVF

SEQ ID NO: 132954 - protein, 10 aa, Artificial Sequence
  Description of Artificial Sequence: Synthetic peptide
  Seed: LQLHDPSGYL (PMEL_HUMAN)
LWLHDPSGYV

SEQ ID NO: 132955 - protein, 9 aa, Artificial Sequence
  Description of Artificial Sequence: Synthetic peptide
  Seed: MSTPEATGM (PMEL_HUMAN)
MATPEATGM

SEQ ID NO: 132956 - protein, 10 aa, Artificial Sequence
  Description of Artificial Sequence: Synthetic peptide
  Seed: SGTYCLNVSL (PMEL_HUMAN)
SATYCLNVSW

SEQ ID NO: 132957 - protein, 11 aa, Artificial Sequence
  Description of Artificial Sequence: Synthetic peptide
  Seed: KVLPDGQVIWV (PMEL_HUMAN)
KCLPDGQVIWW

SEQ ID NO: 132958 - protein, 10 aa, Artificial Sequence
  Description of Artificial Sequence: Synthetic peptide
  Seed: ESITGSLGPL (PMEL_HUMAN)
ESITGSLGPR

SEQ ID NO: 132959 - protein, 9 aa, Artificial Sequence
  Description of Artificial Sequence: Synthetic peptide
  Seed: HTMEVTVYH (PMEL_HUMAN)
HFMEVTVYK

SEQ ID NO: 132960 - protein, 9 aa, Artificial Sequence
  Description of Artificial Sequence: Synthetic peptide
  Seed: SQVWGGQPV (PMEL_HUMAN)
SRVWGGQPF

SEQ ID NO: 132961 - protein, 9 aa, Artificial Sequence
  Description of Artificial Sequence: Synthetic peptide
  Seed: FTITDQVPF (PMEL_HUMAN)
FSITDQVPW

SEQ ID NO: 132962 - protein, 11 aa, Artificial Sequence
  Description of Artificial Sequence: Synthetic peptide
  Seed: LGPLLDGTATL (PMEL_HUMAN)
LSPLLDGTATI

SEQ ID NO: 132963 - protein, 9 aa, Artificial Sequence
  Description of Artificial Sequence: Synthetic peptide
  Seed: LSIGTGRAM (PMEL_HUMAN)
LNIGTGRAF

SEQ ID NO: 132964 - protein, 9 aa, Artificial Sequence
  Description of Artificial Sequence: Synthetic peptide
  Seed: LTSCGSSPV (PMEL_HUMAN)
LMSCGSSPA

SEQ ID NO: 132965 - protein, 11 aa, Artificial Sequence
  Description of Artificial Sequence: Synthetic peptide
  Seed: MAVVLASLIYR (PMEL_HUMAN)
MCVVLASLIYK

SEQ ID NO: 132966 - protein, 10 aa, Artificial Sequence
  Description of Artificial Sequence: Synthetic peptide
  Seed: AEAPNTTAGQ (PMEL_HUMAN)
AEAPNTTAGA

SEQ ID NO: 132967 - protein, 9 aa, Artificial Sequence
  Description of Artificial Sequence: Synthetic peptide
  Seed: TTDGHRPTA (PMEL_HUMAN)
TNDGHRPTF

SEQ ID NO: 132968 - protein, 8 aa, Artificial Sequence
  Description of Artificial Sequence: Synthetic peptide
  Seed: VSNDGPTL (PMEL_HUMAN)
VANDGPTY

SEQ ID NO: 132969 - protein, 10 aa, Artificial Sequence
  Description of Artificial Sequence: Synthetic peptide
  Seed: MKQDFSVPQL (PMEL_HUMAN)
MVQDFSVPQV

SEQ ID NO: 132970 - protein, 10 aa, Artificial Sequence
  Description of Artificial Sequence: Synthetic peptide
  Seed: SLADTNSLAV (PMEL_HUMAN)
SLADTNSLAA

SEQ ID NO: 132971 - protein, 9 aa, Artificial Sequence
  Description of Artificial Sequence: Synthetic peptide
  Seed: VPLDCVLYR (PMEL_HUMAN)
VTLDCVLYK

SEQ ID NO: 132972 - protein, 10 aa, Artificial Sequence
  Description of Artificial Sequence: Synthetic peptide
  Seed: VPLDCVLYRY (PMEL_HUMAN)
VYLDCVLYRY

SEQ ID NO: 132973 - protein, 9 aa, Artificial Sequence
  Description of Artificial Sequence: Synthetic peptide
  Seed: FTITDQVPF (PMEL_HUMAN)
FSITDQVPF

SEQ ID NO: 132974 - protein, 9 aa, Artificial Sequence
  Description of Artificial Sequence: Synthetic peptide
  Seed: RLMKQDFSV (PMEL_HUMAN)
RRMKQDFSM

SEQ ID NO: 132975 - protein, 9 aa, Artificial Sequence
  Description of Artificial Sequence: Synthetic peptide
  Seed: LLDGTATLR (PMEL_HUMAN)
LNDGTATLY

SEQ ID NO: 132976 - protein, 9 aa, Artificial Sequence
  Description of Artificial Sequence: Synthetic peptide
  Seed: VPFSVSVSQ (PMEL_HUMAN)
VVFSVSVSY

SEQ ID NO: 132977 - protein, 10 aa, Artificial Sequence
  Description of Artificial Sequence: Synthetic peptide
  Seed: EVISTAPVQM (PMEL_HUMAN)
EAISTAPVQW

SEQ ID NO: 132978 - protein, 10 aa, Artificial Sequence
  Description of Artificial Sequence: Synthetic peptide
  Seed: IALNFPGSQK (PMEL_HUMAN)
IRLNFPGSQK

SEQ ID NO: 132979 - protein, 9 aa, Artificial Sequence
  Description of Artificial Sequence: Synthetic peptide
  Seed: SLAVVSTQL (PMEL_HUMAN)
SVAVVSTQI

SEQ ID NO: 132980 - protein, 10 aa, Artificial Sequence
  Description of Artificial Sequence: Synthetic peptide
  Seed: ESAEILQAVP (PMEL_HUMAN)
EVAEILQAVN

SEQ ID NO: 132981 - protein, 11 aa, Artificial Sequence
  Description of Artificial Sequence: Synthetic peptide
  Seed: AEMSTPEATGM (PMEL_HUMAN)
ALMSTPEATGW

SEQ ID NO: 132982 - protein, 9 aa, Artificial Sequence
  Description of Artificial Sequence: Synthetic peptide
  Seed: QVIWVNNTI (PMEL_HUMAN)
QAIWVNNTV

SEQ ID NO: 132983 - protein, 11 aa, Artificial Sequence
  Description of Artificial Sequence: Synthetic peptide
  Seed: VTAQVVLQAAI (PMEL_HUMAN)
VSAQVVLQAAW

SEQ ID NO: 132984 - protein, 9 aa, Artificial Sequence
  Description of Artificial Sequence: Synthetic peptide
  Seed: HSSSHWLRL (PMEL_HUMAN)
HLSSHWLRL

SEQ ID NO: 132985 - protein, 9 aa, Artificial Sequence
  Description of Artificial Sequence: Synthetic peptide
  Seed: VVLSGTTAA (PMEL_HUMAN)
VLLSGTTAV

SEQ ID NO: 132986 - protein, 9 aa, Artificial Sequence
  Description of Artificial Sequence: Synthetic peptide
  Seed: FLRNQPLTF (PMEL_HUMAN)
FYRNQPLTY

SEQ ID NO: 132987 - protein, 9 aa, Artificial Sequence
  Description of Artificial Sequence: Synthetic peptide
  Seed: GQVPLIVGI (PMEL_HUMAN)
GSVPLIVGL

SEQ ID NO: 132988 - protein, 9 aa, Artificial Sequence
  Description of Artificial Sequence: Synthetic peptide
  Seed: ALDGGNKHF (PMEL_HUMAN)
AGDGGNKHM

SEQ ID NO: 132989 - protein, 9 aa, Artificial Sequence
  Description of Artificial Sequence: Synthetic peptide
  Seed: MAVVLASLI (PMEL_HUMAN)
MPVVLASLM

SEQ ID NO: 132990 - protein, 9 aa, Artificial Sequence
  Description of Artificial Sequence: Synthetic peptide
  Seed: SLADTNSLA (PMEL_HUMAN)
SMADTNSLM

SEQ ID NO: 132991 - protein, 11 aa, Artificial Sequence
  Description of Artificial Sequence: Synthetic peptide
  Seed: RTKAWNRQLYP (PMEL_HUMAN)
RFKAWNRQLYK

SEQ ID NO: 132992 - protein, 9 aa, Artificial Sequence
  Description of Artificial Sequence: Synthetic peptide
  Seed: TTDGHRPTA (PMEL_HUMAN)
TYDGHRPTM

SEQ ID NO: 132993 - protein, 8 aa, Artificial Sequence
  Description of Artificial Sequence: Synthetic peptide
  Seed: VQVPTTEV (PMEL_HUMAN)
VQVPTTEF

SEQ ID NO: 132994 - protein, 9 aa, Artificial Sequence
  Description of Artificial Sequence: Synthetic peptide
  Seed: TAQVVLQAA (PMEL_HUMAN)
TPQVVLQAA

SEQ ID NO: 132995 - protein, 9 aa, Artificial Sequence
  Description of Artificial Sequence: Synthetic peptide
  Seed: TEVVGTTPG (PMEL_HUMAN)
TEVVGTTPA

SEQ ID NO: 132996 - protein, 9 aa, Artificial Sequence
  Description of Artificial Sequence: Synthetic peptide
  Seed: HWLRLPRIF (PMEL_HUMAN)
HYLRLPRIL

SEQ ID NO: 132997 - protein, 10 aa, Artificial Sequence
  Description of Artificial Sequence: Synthetic peptide
  Seed: RQLRTKAWNR (PMEL_HUMAN)
RRLRTKAWNK

SEQ ID NO: 132998 - protein, 10 aa, Artificial Sequence
  Description of Artificial Sequence: Synthetic peptide
  Seed: SSHWLRLPRI (PMEL_HUMAN)
STHWLRLPRF

SEQ ID NO: 132999 - protein, 9 aa, Artificial Sequence
  Description of Artificial Sequence: Synthetic peptide
  Seed: HTMEVTVYH (PMEL_HUMAN)
HEMEVTVYY

SEQ ID NO: 133000 - protein, 10 aa, Artificial Sequence
  Description of Artificial Sequence: Synthetic peptide
  Seed: IFPDGGPCPS (PMEL_HUMAN)
IMPDGGPCPM

SEQ ID NO: 133001 - protein, 10 aa, Artificial Sequence
  Description of Artificial Sequence: Synthetic peptide
  Seed: VSLADTNSLA (PMEL_HUMAN)
VFLADTNSLM

SEQ ID NO: 133002 - protein, 9 aa, Artificial Sequence
  Description of Artificial Sequence: Synthetic peptide
  Seed: ANASFSIAL (PMEL_HUMAN)
AFASFSIAY

SEQ ID NO: 133003 - protein, 9 aa, Artificial Sequence
  Description of Artificial Sequence: Synthetic peptide
  Seed: TPAEVSIVV (PMEL_HUMAN)
TAAEVSIVM

SEQ ID NO: 133004 - protein, 10 aa, Artificial Sequence
  Description of Artificial Sequence: Synthetic peptide
  Seed: RQVPLDCVLY (PMEL_HUMAN)
RVVPLDCVLR

SEQ ID NO: 133005 - protein, 9 aa, Artificial Sequence
  Description of Artificial Sequence: Synthetic peptide
  Seed: ALLAVGATK (PMEL_HUMAN)
ASLAVGATM

SEQ ID NO: 133006 - protein, 11 aa, Artificial Sequence
  Description of Artificial Sequence: Synthetic peptide
  Seed: THTMEVTVYHR (PMEL_HUMAN)
TWTMEVTVYHR

SEQ ID NO: 133007 - protein, 9 aa, Artificial Sequence
  Description of Artificial Sequence: Synthetic peptide
  Seed: SLAVVSTQL (PMEL_HUMAN)
SVAVVSTQR

SEQ ID NO: 133008 - protein, 9 aa, Artificial Sequence
  Description of Artificial Sequence: Synthetic peptide
  Seed: VTLDIVQGI (PMEL_HUMAN)
VSLDIVQGL

SEQ ID NO: 133009 - protein, 9 aa, Artificial Sequence
  Description of Artificial Sequence: Synthetic peptide
  Seed: YVWKTWGQY (PMEL_HUMAN)
YMWKTWGQK

SEQ ID NO: 133010 - protein, 9 aa, Artificial Sequence
  Description of Artificial Sequence: Synthetic peptide
  Seed: AVVLASLIY (PMEL_HUMAN)
AAVLASLIF

SEQ ID NO: 133011 - protein, 9 aa, Artificial Sequence
  Description of Artificial Sequence: Synthetic peptide
  Seed: SSIMSTESI (PMEL_HUMAN)
SIIMSTESY

SEQ ID NO: 133012 - protein, 10 aa, Artificial Sequence
  Description of Artificial Sequence: Synthetic peptide
  Seed: AMLGTHTMEV (PMEL_HUMAN)
ATLGTHTMEV

SEQ ID NO: 133013 - protein, 9 aa, Artificial Sequence
  Description of Artificial Sequence: Synthetic peptide
  Seed: EVMGTTLAE (PMEL_HUMAN)
ESMGTTLAK

SEQ ID NO: 133014 - protein, 9 aa, Artificial Sequence
  Description of Artificial Sequence: Synthetic peptide
  Seed: SQKRSFVYV (PMEL_HUMAN)
SMKRSFVYR

SEQ ID NO: 133015 - protein, 9 aa, Artificial Sequence
  Description of Artificial Sequence: Synthetic peptide
  Seed: ESAEILQAV (PMEL_HUMAN)
EPAEILQAI

SEQ ID NO: 133016 - protein, 9 aa, Artificial Sequence
  Description of Artificial Sequence: Synthetic peptide
  Seed: RALVVTHTY (PMEL_HUMAN)
RNLVVTHTW

SEQ ID NO: 133017 - protein, 9 aa, Artificial Sequence
  Description of Artificial Sequence: Synthetic peptide
  Seed: SQVWGGQPV (PMEL_HUMAN)
SQVWGGQPA

SEQ ID NO: 133018 - protein, 11 aa, Artificial Sequence
  Description of Artificial Sequence: Synthetic peptide
  Seed: YLAEADLSYTW (PMEL_HUMAN)
YLAEADLSYTT

SEQ ID NO: 133019 - protein, 9 aa, Artificial Sequence
  Description of Artificial Sequence: Synthetic peptide
  Seed: VQVPTTEVI (PMEL_HUMAN)
VTVPTTEVV

SEQ ID NO: 133020 - protein, 9 aa, Artificial Sequence
  Description of Artificial Sequence: Synthetic peptide
  Seed: LHLAVIGAL (PMEL_HUMAN)
LKLAVIGAL

SEQ ID NO: 133021 - protein, 9 aa, Artificial Sequence
  Description of Artificial Sequence: Synthetic peptide
  Seed: FLRNQPLTF (PMEL_HUMAN)
FSRNQPLTM

SEQ ID NO: 133022 - protein, 9 aa, Artificial Sequence
  Description of Artificial Sequence: Synthetic peptide
  Seed: FGDSSGTLI (PMEL_HUMAN)
FLDSSGTLV

SEQ ID NO: 133023 - protein, 9 aa, Artificial Sequence
  Description of Artificial Sequence: Synthetic peptide
  Seed: YVWKTWGQY (PMEL_HUMAN)
YNWKTWGQY

SEQ ID NO: 133024 - protein, 10 aa, Artificial Sequence
  Description of Artificial Sequence: Synthetic peptide
  Seed: EVMGTTLAEM (PMEL_HUMAN)
EIMGTTLAEI

SEQ ID NO: 133025 - protein, 9 aa, Artificial Sequence
  Description of Artificial Sequence: Synthetic peptide
  Seed: VVLQAAIPL (PMEL_HUMAN)
VNLQAAIPY

SEQ ID NO: 133026 - protein, 9 aa, Artificial Sequence
  Description of Artificial Sequence: Synthetic peptide
  Seed: LLVLMAVVL (PMEL_HUMAN)
LMVLMAVVF

SEQ ID NO: 133027 - protein, 9 aa, Artificial Sequence
  Description of Artificial Sequence: Synthetic peptide
  Seed: TTPGQAPTA (PMEL_HUMAN)
TVPGQAPTY

SEQ ID NO: 133028 - protein, 9 aa, Artificial Sequence
  Description of Artificial Sequence: Synthetic peptide
  Seed: VLGGPVSGL (PMEL_HUMAN)
VAGGPVSGM

SEQ ID NO: 133029 - protein, 11 aa, Artificial Sequence
  Description of Artificial Sequence: Synthetic peptide
  Seed: GSQVWGGQPVY (PMEL_HUMAN)
GMQVWGGQPVF

SEQ ID NO: 133030 - protein, 11 aa, Artificial Sequence
  Description of Artificial Sequence: Synthetic peptide
  Seed: RRGSRSYVPLA (PMEL_HUMAN)
RDGSRSYVPLA

SEQ ID NO: 133031 - protein, 11 aa, Artificial Sequence
  Description of Artificial Sequence: Synthetic peptide
  Seed: DCWRGGQVSLK (PMEL_HUMAN)
DTWRGGQVSLK

SEQ ID NO: 133032 - protein, 10 aa, Artificial Sequence
  Description of Artificial Sequence: Synthetic peptide
  Seed: KVLPDGQVIW (PMEL_HUMAN)
KLLPDGQVIM

SEQ ID NO: 133033 - protein, 10 aa, Artificial Sequence
  Description of Artificial Sequence: Synthetic peptide
  Seed: NSLAVVSTQL (PMEL_HUMAN)
NGLAVVSTQV

SEQ ID NO: 133034 - protein, 10 aa, Artificial Sequence
  Description of Artificial Sequence: Synthetic peptide
  Seed: DGTATLRLVK (PMEL_HUMAN)
DNTATLRLVR

SEQ ID NO: 133035 - protein, 9 aa, Artificial Sequence
  Description of Artificial Sequence: Synthetic peptide
  Seed: KHFLRNQPL (PMEL_HUMAN)
KLFLRNQPM

SEQ ID NO: 133036 - protein, 9 aa, Artificial Sequence
  Description of Artificial Sequence: Synthetic peptide
  Seed: VLPSPACQL (PMEL_HUMAN)
VWPSPACQF

SEQ ID NO: 133037 - protein, 9 aa, Artificial Sequence
  Description of Artificial Sequence: Synthetic peptide
  Seed: GQVPLIVGI (PMEL_HUMAN)
GAVPLIVGL

SEQ ID NO: 133038 - protein, 9 aa, Artificial Sequence
  Description of Artificial Sequence: Synthetic peptide
  Seed: TIINGSQVW (PMEL_HUMAN)
TLINGSQVY

SEQ ID NO: 133039 - protein, 9 aa, Artificial Sequence
  Description of Artificial Sequence: Synthetic peptide
  Seed: VLPSPACQL (PMEL_HUMAN)
VQPSPACQF

SEQ ID NO: 133040 - protein, 10 aa, Artificial Sequence
  Description of Artificial Sequence: Synthetic peptide
  Seed: RSFVYVWKTW (PMEL_HUMAN)
RVFVYVWKTF

SEQ ID NO: 133041 - protein, 9 aa, Artificial Sequence
  Description of Artificial Sequence: Synthetic peptide
  Seed: GSFSVTLDI (PMEL_HUMAN)
GAFSVTLDW

SEQ ID NO: 133042 - protein, 9 aa, Artificial Sequence
  Description of Artificial Sequence: Synthetic peptide
  Seed: SQKRSFVYV (PMEL_HUMAN)
SIKRSFVYI

SEQ ID NO: 133043 - protein, 10 aa, Artificial Sequence
  Description of Artificial Sequence: Synthetic peptide
  Seed: VVLASLIYRR (PMEL_HUMAN)
VTLASLIYRK

SEQ ID NO: 133044 - protein, 9 aa, Artificial Sequence
  Description of Artificial Sequence: Synthetic peptide
  Seed: MEVTVYHRR (PMEL_HUMAN)
MNVTVYHRR

SEQ ID NO: 133045 - protein, 10 aa, Artificial Sequence
  Description of Artificial Sequence: Synthetic peptide
  Seed: RRLMKQDFSV (PMEL_HUMAN)
RALMKQDFSI

SEQ ID NO: 133046 - protein, 10 aa, Artificial Sequence
  Description of Artificial Sequence: Synthetic peptide
  Seed: RGSRSYVPLA (PMEL_HUMAN)
RYSRSYVPLY

SEQ ID NO: 133047 - protein, 9 aa, Artificial Sequence
  Description of Artificial Sequence: Synthetic peptide
  Seed: VISTAPVQM (PMEL_HUMAN)
VGSTAPVQM

SEQ ID NO: 133048 - protein, 10 aa, Artificial Sequence
  Description of Artificial Sequence: Synthetic peptide
  Seed: GQEAGLGQVP (PMEL_HUMAN)
GEEAGLGQVA

SEQ ID NO: 133049 - protein, 10 aa, Artificial Sequence
  Description of Artificial Sequence: Synthetic peptide
  Seed: IPLTSCGSSP (PMEL_HUMAN)
IPLTSCGSSA

SEQ ID NO: 133050 - protein, 9 aa, Artificial Sequence
  Description of Artificial Sequence: Synthetic peptide
  Seed: MLGTHTMEV (PMEL_HUMAN)
MQGTHTMEW

SEQ ID NO: 133051 - protein, 9 aa, Artificial Sequence
  Description of Artificial Sequence: Synthetic peptide
  Seed: VQMPTAEST (PMEL_HUMAN)
VNMPTAESF

SEQ ID NO: 133052 - protein, 10 aa, Artificial Sequence
  Description of Artificial Sequence: Synthetic peptide
  Seed: YRYGSFSVTL (PMEL_HUMAN)
YEYGSFSVTF

SEQ ID NO: 133053 - protein, 9 aa, Artificial Sequence
  Description of Artificial Sequence: Synthetic peptide
  Seed: FSVSVSQLR (PMEL_HUMAN)
FIVSVSQLR

SEQ ID NO: 133054 - protein, 9 aa, Artificial Sequence
  Description of Artificial Sequence: Synthetic peptide
  Seed: TTDGHRPTA (PMEL_HUMAN)
TLDGHRPTM

SEQ ID NO: 133055 - protein, 9 aa, Artificial Sequence
  Description of Artificial Sequence: Synthetic peptide
  Seed: EKVPVSEVM (PMEL_HUMAN)
ERVPVSEVI

SEQ ID NO: 133056 - protein, 9 aa, Artificial Sequence
  Description of Artificial Sequence: Synthetic peptide
  Seed: TAEAPNTTA (PMEL_HUMAN)
TTEAPNTTL

SEQ ID NO: 133057 - protein, 9 aa, Artificial Sequence
  Description of Artificial Sequence: Synthetic peptide
  Seed: YLEPGPVTA (PMEL_HUMAN)
YCEPGPVTI

SEQ ID NO: 133058 - protein, 10 aa, Artificial Sequence
  Description of Artificial Sequence: Synthetic peptide
  Seed: LVLMAVVLAS (PMEL_HUMAN)
LMLMAVVLAV

SEQ ID NO: 133059 - protein, 9 aa, Artificial Sequence
  Description of Artificial Sequence: Synthetic peptide
  Seed: TLIGANASF (PMEL_HUMAN)
TGIGANASY

SEQ ID NO: 133060 - protein, 9 aa, Artificial Sequence
  Description of Artificial Sequence: Synthetic peptide
  Seed: TIINGSQVW (PMEL_HUMAN)
TAINGSQVW

SEQ ID NO: 133061 - protein, 11 aa, Artificial Sequence
  Description of Artificial Sequence: Synthetic peptide
  Seed: YRYGSFSVTLD (PMEL_HUMAN)
YRYGSFSVTLV

SEQ ID NO: 133062 - protein, 11 aa, Artificial Sequence
  Description of Artificial Sequence: Synthetic peptide
  Seed: MTPEKVPVSEV (PMEL_HUMAN)
MAPEKVPVSEL

SEQ ID NO: 133063 - protein, 10 aa, Artificial Sequence
  Description of Artificial Sequence: Synthetic peptide
  Seed: QILKGGSGTY (PMEL_HUMAN)
QILKGGSGTR

SEQ ID NO: 133064 - protein, 9 aa, Artificial Sequence
  Description of Artificial Sequence: Synthetic peptide
  Seed: SVQVPTTEV (PMEL_HUMAN)
STQVPTTEL

SEQ ID NO: 133065 - protein, 9 aa, Artificial Sequence
  Description of Artificial Sequence: Synthetic peptide
  Seed: TTPGQAPTA (PMEL_HUMAN)
TLPGQAPTI

SEQ ID NO: 133066 - protein, 9 aa, Artificial Sequence
  Description of Artificial Sequence: Synthetic peptide
  Seed: ESTGMTPEK (PMEL_HUMAN)
ESTGMTPER

SEQ ID NO: 133067 - protein, 10 aa, Artificial Sequence
  Description of Artificial Sequence: Synthetic peptide
  Seed: VYVWKTWGQY (PMEL_HUMAN)
VFVWKTWGQF

SEQ ID NO: 133068 - protein, 10 aa, Artificial Sequence
  Description of Artificial Sequence: Synthetic peptide
  Seed: RQVPLDCVLY (PMEL_HUMAN)
RQVPLDCVLW

SEQ ID NO: 133069 - protein, 9 aa, Artificial Sequence
  Description of Artificial Sequence: Synthetic peptide
  Seed: VLPDGQVIW (PMEL_HUMAN)
VQPDGQVIL

SEQ ID NO: 133070 - protein, 9 aa, Artificial Sequence
  Description of Artificial Sequence: Synthetic peptide
  Seed: MAVVLASLI (PMEL_HUMAN)
MQVVLASLL

SEQ ID NO: 133071 - protein, 9 aa, Artificial Sequence
  Description of Artificial Sequence: Synthetic peptide
  Seed: KTWGQYWQV (PMEL_HUMAN)
KTWGQYWQI

SEQ ID NO: 133072 - protein, 9 aa, Artificial Sequence
  Description of Artificial Sequence: Synthetic peptide
  Seed: VLPDGQVIW (PMEL_HUMAN)
VVPDGQVIL

SEQ ID NO: 133073 - protein, 9 aa, Artificial Sequence
  Description of Artificial Sequence: Synthetic peptide
  Seed: GMTPAEVSI (PMEL_HUMAN)
GLTPAEVSV

SEQ ID NO: 133074 - protein, 9 aa, Artificial Sequence
  Description of Artificial Sequence: Synthetic peptide
  Seed: RGSRSYVPL (PMEL_HUMAN)
RISRSYVPA

SEQ ID NO: 133075 - protein, 10 aa, Artificial Sequence
  Description of Artificial Sequence: Synthetic peptide
  Seed: YGSFSVTLDI (PMEL_HUMAN)
YHSFSVTLDY

SEQ ID NO: 133076 - protein, 9 aa, Artificial Sequence
  Description of Artificial Sequence: Synthetic peptide
  Seed: QLYPEWTEA (PMEL_HUMAN)
QVYPEWTEL

SEQ ID NO: 133077 - protein, 9 aa, Artificial Sequence
  Description of Artificial Sequence: Synthetic peptide
  Seed: FTITDQVPF (PMEL_HUMAN)
FQITDQVPH

SEQ ID NO: 133078 - protein, 9 aa, Artificial Sequence
  Description of Artificial Sequence: Synthetic peptide
  Seed: TWGQYWQVL (PMEL_HUMAN)
TYGQYWQVI

SEQ ID NO: 133079 - protein, 9 aa, Artificial Sequence
  Description of Artificial Sequence: Synthetic peptide
  Seed: AEADLSYTW (PMEL_HUMAN)
ATADLSYTM

SEQ ID NO: 133080 - protein, 10 aa, Artificial Sequence
  Description of Artificial Sequence: Synthetic peptide
  Seed: SVPQLPHSSS (PMEL_HUMAN)
STPQLPHSSM

SEQ ID NO: 133081 - protein, 9 aa, Artificial Sequence
  Description of Artificial Sequence: Synthetic peptide
  Seed: SLAVVSTQL (PMEL_HUMAN)
SQAVVSTQM

SEQ ID NO: 133082 - protein, 9 aa, Artificial Sequence
  Description of Artificial Sequence: Synthetic peptide
  Seed: LMAVVLASL (PMEL_HUMAN)
LTAVVLASA

SEQ ID NO: 133083 - protein, 9 aa, Artificial Sequence
  Description of Artificial Sequence: Synthetic peptide
  Seed: GQVPTTEVV (PMEL_HUMAN)
GQVPTTEVI

SEQ ID NO: 133084 - protein, 9 aa, Artificial Sequence
  Description of Artificial Sequence: Synthetic peptide
  Seed: GSFSVTLDI (PMEL_HUMAN)
GTFSVTLDY

SEQ ID NO: 133085 - protein, 10 aa, Artificial Sequence
  Description of Artificial Sequence: Synthetic peptide
  Seed: KEACMEISSP (PMEL_HUMAN)
KEACMEISSA

SEQ ID NO: 133086 - protein, 10 aa, Artificial Sequence
  Description of Artificial Sequence: Synthetic peptide
  Seed: MAVVLASLIY (PMEL_HUMAN)
MVVVLASLIK

SEQ ID NO: 133087 - protein, 9 aa, Artificial Sequence
  Description of Artificial Sequence: Synthetic peptide
  Seed: VSNDGPTLI (PMEL_HUMAN)
VFNDGPTLV

SEQ ID NO: 133088 - protein, 9 aa, Artificial Sequence
  Description of Artificial Sequence: Synthetic peptide
  Seed: AEADLSYTW (PMEL_HUMAN)
AIADLSYTF

SEQ ID NO: 133089 - protein, 10 aa, Artificial Sequence
  Description of Artificial Sequence: Synthetic peptide
  Seed: GQEAGLGQVP (PMEL_HUMAN)
GEEAGLGQVC

SEQ ID NO: 133090 - protein, 9 aa, Artificial Sequence
  Description of Artificial Sequence: Synthetic peptide
  Seed: LIVGILLVL (PMEL_HUMAN)
LPVGILLVY

SEQ ID NO: 133091 - protein, 11 aa, Artificial Sequence
  Description of Artificial Sequence: Synthetic peptide
  Seed: YLEPGPVTAQV (PMEL_HUMAN)
YAEPGPVTAQV

SEQ ID NO: 133092 - protein, 9 aa, Artificial Sequence
  Description of Artificial Sequence: Synthetic peptide
  Seed: VSLADTNSL (PMEL_HUMAN)
VSLADTNSY

SEQ ID NO: 133093 - protein, 10 aa, Artificial Sequence
  Description of Artificial Sequence: Synthetic peptide
  Seed: YVPLAHSSSA (PMEL_HUMAN)
YIPLAHSSSA

SEQ ID NO: 133094 - protein, 9 aa, Artificial Sequence
  Description of Artificial Sequence: Synthetic peptide
  Seed: VVLQAAIPL (PMEL_HUMAN)
VQLQAAIPL

SEQ ID NO: 133095 - protein, 10 aa, Artificial Sequence
  Description of Artificial Sequence: Synthetic peptide
  Seed: SQVWGGQPVY (PMEL_HUMAN)
SLVWGGQPVF

SEQ ID NO: 133096 - protein, 10 aa, Artificial Sequence
  Description of Artificial Sequence: Synthetic peptide
  Seed: TPEATGMTPA (PMEL_HUMAN)
TPEATGMTPM

SEQ ID NO: 133097 - protein, 9 aa, Artificial Sequence
  Description of Artificial Sequence: Synthetic peptide
  Seed: FPDGGPCPS (PMEL_HUMAN)
FADGGPCPY

SEQ ID NO: 133098 - protein, 9 aa, Artificial Sequence
  Description of Artificial Sequence: Synthetic peptide
  Seed: RYGSFSVTL (PMEL_HUMAN)
RTGSFSVTV

SEQ ID NO: 133099 - protein, 9 aa, Artificial Sequence
  Description of Artificial Sequence: Synthetic peptide
  Seed: SLADTNSLA (PMEL_HUMAN)
SQADTNSLM

SEQ ID NO: 133100 - protein, 9 aa, Artificial Sequence
  Description of Artificial Sequence: Synthetic peptide
  Seed: HTMEVTVYH (PMEL_HUMAN)
HFMEVTVYF

SEQ ID NO: 133101 - protein, 10 aa, Artificial Sequence
  Description of Artificial Sequence: Synthetic peptide
  Seed: EVSIVVLSGT (PMEL_HUMAN)
EVSIVVLSGI

SEQ ID NO: 133102 - protein, 10 aa, Artificial Sequence
  Description of Artificial Sequence: Synthetic peptide
  Seed: YVPLAHSSSA (PMEL_HUMAN)
YTPLAHSSSI

SEQ ID NO: 133103 - protein, 9 aa, Artificial Sequence
  Description of Artificial Sequence: Synthetic peptide
  Seed: RLMKQDFSV (PMEL_HUMAN)
RRMKQDFSL

SEQ ID NO: 133104 - protein, 10 aa, Artificial Sequence
  Description of Artificial Sequence: Synthetic peptide
  Seed: SGTYCLNVSL (PMEL_HUMAN)
SCTYCLNVSV

SEQ ID NO: 133105 - protein, 9 aa, Artificial Sequence
  Description of Artificial Sequence: Synthetic peptide
  Seed: RTKAWNRQL (PMEL_HUMAN)
RIKAWNRQW

SEQ ID NO: 133106 - protein, 9 aa, Artificial Sequence
  Description of Artificial Sequence: Synthetic peptide
  Seed: LTSCGSSPV (PMEL_HUMAN)
LQSCGSSPL

SEQ ID NO: 133107 - protein, 10 aa, Artificial Sequence
  Description of Artificial Sequence: Synthetic peptide
  Seed: STAPVQMPTA (PMEL_HUMAN)
SIAPVQMPTL

SEQ ID NO: 133108 - protein, 10 aa, Artificial Sequence
  Description of Artificial Sequence: Synthetic peptide
  Seed: TYLEPGPVTA (PMEL_HUMAN)
TFLEPGPVTL

SEQ ID NO: 133109 - protein, 9 aa, Artificial Sequence
  Description of Artificial Sequence: Synthetic peptide
  Seed: VSNDGPTLI (PMEL_HUMAN)
VQNDGPTLM

SEQ ID NO: 133110 - protein, 9 aa, Artificial Sequence
  Description of Artificial Sequence: Synthetic peptide
  Seed: AVVLASLIY (PMEL_HUMAN)
ASVLASLIW

SEQ ID NO: 133111 - protein, 9 aa, Artificial Sequence
  Description of Artificial Sequence: Synthetic peptide
  Seed: FTITDQVPF (PMEL_HUMAN)
FVITDQVPL

SEQ ID NO: 133112 - protein, 10 aa, Artificial Sequence
  Description of Artificial Sequence: Synthetic peptide
  Seed: GPLLDGTATL (PMEL_HUMAN)
GRLLDGTATV

SEQ ID NO: 133113 - protein, 9 aa, Artificial Sequence
  Description of Artificial Sequence: Synthetic peptide
  Seed: KTWGQYWQV (PMEL_HUMAN)
KQWGQYWQA

SEQ ID NO: 133114 - protein, 10 aa, Artificial Sequence
  Description of Artificial Sequence: Synthetic peptide
  Seed: EATGMTPAEV (PMEL_HUMAN)
EVTGMTPAEV

SEQ ID NO: 133115 - protein, 9 aa, Artificial Sequence
  Description of Artificial Sequence: Synthetic peptide
  Seed: KTWGQYWQV (PMEL_HUMAN)
KLWGQYWQF

SEQ ID NO: 133116 - protein, 9 aa, Artificial Sequence
  Description of Artificial Sequence: Synthetic peptide
  Seed: SVQVPTTEV (PMEL_HUMAN)
SIQVPTTEY

SEQ ID NO: 133117 - protein, 9 aa, Artificial Sequence
  Description of Artificial Sequence: Synthetic peptide
  Seed: RLVKRQVPL (PMEL_HUMAN)
RVVKRQVPK

SEQ ID NO: 133118 - protein, 9 aa, Artificial Sequence
  Description of Artificial Sequence: Synthetic peptide
  Seed: HQILKGGSG (PMEL_HUMAN)
HHILKGGSI

SEQ ID NO: 133119 - protein, 11 aa, Artificial Sequence
  Description of Artificial Sequence: Synthetic peptide
  Seed: HQILKGGSGTY (PMEL_HUMAN)
HLILKGGSGTY

SEQ ID NO: 133120 - protein, 11 aa, Artificial Sequence
  Description of Artificial Sequence: Synthetic peptide
  Seed: SSPGCQPPAQR (PMEL_HUMAN)
STPGCQPPAQK

SEQ ID NO: 133121 - protein, 11 aa, Artificial Sequence
  Description of Artificial Sequence: Synthetic peptide
  Seed: YLAEADLSYTW (PMEL_HUMAN)
YQAEADLSYTF

SEQ ID NO: 133122 - protein, 9 aa, Artificial Sequence
  Description of Artificial Sequence: Synthetic peptide
  Seed: YLEPGPVTA (PMEL_HUMAN)
YTEPGPVTY

SEQ ID NO: 133123 - protein, 9 aa, Artificial Sequence
  Description of Artificial Sequence: Synthetic peptide
  Seed: LAVVSTQLI (PMEL_HUMAN)
LIVVSTQLW

SEQ ID NO: 133124 - protein, 9 aa, Artificial Sequence
  Description of Artificial Sequence: Synthetic peptide
  Seed: CPIGENSPL (PMEL_HUMAN)
CVIGENSPF

SEQ ID NO: 133125 - protein, 11 aa, Artificial Sequence
  Description of Artificial Sequence: Synthetic peptide
  Seed: RRGSRSYVPLA (PMEL_HUMAN)
RFGSRSYVPLV

SEQ ID NO: 133126 - protein, 9 aa, Artificial Sequence
  Description of Artificial Sequence: Synthetic peptide
  Seed: RTKAWNRQL (PMEL_HUMAN)
RLKAWNRQY

SEQ ID NO: 133127 - protein, 9 aa, Artificial Sequence
  Description of Artificial Sequence: Synthetic peptide
  Seed: ISRALVVTH (PMEL_HUMAN)
IQRALVVTL

SEQ ID NO: 133128 - protein, 10 aa, Artificial Sequence
  Description of Artificial Sequence: Synthetic peptide
  Seed: EVSIVVLSGT (PMEL_HUMAN)
EESIVVLSGV

SEQ ID NO: 133129 - protein, 10 aa, Artificial Sequence
  Description of Artificial Sequence: Synthetic peptide
  Seed: MKQDFSVPQL (PMEL_HUMAN)
MQQDFSVPQL

SEQ ID NO: 133130 - protein, 9 aa, Artificial Sequence
  Description of Artificial Sequence: Synthetic peptide
  Seed: QVIWVNNTI (PMEL_HUMAN)
QVIWVNNTV

SEQ ID NO: 133131 - protein, 10 aa, Artificial Sequence
  Description of Artificial Sequence: Synthetic peptide
  Seed: MTPAEVSIVV (PMEL_HUMAN)
MRPAEVSIVL

SEQ ID NO: 133132 - protein, 9 aa, Artificial Sequence
  Description of Artificial Sequence: Synthetic peptide
  Seed: RAMLGTHTM (PMEL_HUMAN)
RLMLGTHTV

SEQ ID NO: 133133 - protein, 11 aa, Artificial Sequence
  Description of Artificial Sequence: Synthetic peptide
  Seed: SYVPLAHSSSA (PMEL_HUMAN)
SDVPLAHSSSM

SEQ ID NO: 133134 - protein, 10 aa, Artificial Sequence
  Description of Artificial Sequence: Synthetic peptide
  Seed: VLMAVVLASL (PMEL_HUMAN)
VYMAVVLASL

SEQ ID NO: 133135 - protein, 9 aa, Artificial Sequence
  Description of Artificial Sequence: Synthetic peptide
  Seed: LIVGILLVL (PMEL_HUMAN)
LMVGILLVF

SEQ ID NO: 133136 - protein, 9 aa, Artificial Sequence
  Description of Artificial Sequence: Synthetic peptide
  Seed: SAFTITDQV (PMEL_HUMAN)
SVFTITDQL

SEQ ID NO: 133137 - protein, 10 aa, Artificial Sequence
  Description of Artificial Sequence: Synthetic peptide
  Seed: MSTESITGSL (PMEL_HUMAN)
MTTESITGSA

SEQ ID NO: 133138 - protein, 10 aa, Artificial Sequence
  Description of Artificial Sequence: Synthetic peptide
  Seed: EVMGTTLAEM (PMEL_HUMAN)
EMMGTTLAEM

SEQ ID NO: 133139 - protein, 9 aa, Artificial Sequence
  Description of Artificial Sequence: Synthetic peptide
  Seed: EKVPVSEVM (PMEL_HUMAN)
EVVPVSEVF

SEQ ID NO: 133140 - protein, 9 aa, Artificial Sequence
  Description of Artificial Sequence: Synthetic peptide
  Seed: VVLSGTTAA (PMEL_HUMAN)
VILSGTTAL

SEQ ID NO: 133141 - protein, 9 aa, Artificial Sequence
  Description of Artificial Sequence: Synthetic peptide
  Seed: QLHDPSGYL (PMEL_HUMAN)
QLHDPSGYI

SEQ ID NO: 133142 - protein, 9 aa, Artificial Sequence
  Description of Artificial Sequence: Synthetic peptide
  Seed: AQVVLQAAI (PMEL_HUMAN)
AHVVLQAAA

SEQ ID NO: 133143 - protein, 10 aa, Artificial Sequence
  Description of Artificial Sequence: Synthetic peptide
  Seed: EVSIVVLSGT (PMEL_HUMAN)
EKSIVVLSGI

SEQ ID NO: 133144 - protein, 9 aa, Artificial Sequence
  Description of Artificial Sequence: Synthetic peptide
  Seed: FLRNQPLTF (PMEL_HUMAN)
FQRNQPLTM

SEQ ID NO: 133145 - protein, 11 aa, Artificial Sequence
  Description of Artificial Sequence: Synthetic peptide
  Seed: VVLSGTTAAQV (PMEL_HUMAN)
VMLSGTTAAQV

SEQ ID NO: 133146 - protein, 9 aa, Artificial Sequence
  Description of Artificial Sequence: Synthetic peptide
  Seed: AEILQAVPS (PMEL_HUMAN)
AEILQAVPA

SEQ ID NO: 133147 - protein, 10 aa, Artificial Sequence
  Description of Artificial Sequence: Synthetic peptide
  Seed: AVIGALLAVG (PMEL_HUMAN)
AVIGALLAVT

SEQ ID NO: 133148 - protein, 10 aa, Artificial Sequence
  Description of Artificial Sequence: Synthetic peptide
  Seed: YLAEADLSYT (PMEL_HUMAN)
YMAEADLSYV

SEQ ID NO: 133149 - protein, 10 aa, Artificial Sequence
  Description of Artificial Sequence: Synthetic peptide
  Seed: VLMAVVLASL (PMEL_HUMAN)
VAMAVVLASV

SEQ ID NO: 133150 - protein, 9 aa, Artificial Sequence
  Description of Artificial Sequence: Synthetic peptide
  Seed: RAMLGTHTM (PMEL_HUMAN)
RWMLGTHTK

SEQ ID NO: 133151 - protein, 11 aa, Artificial Sequence
  Description of Artificial Sequence: Synthetic peptide
  Seed: SYVPLAHSSSA (PMEL_HUMAN)
SNVPLAHSSSF

SEQ ID NO: 133152 - protein, 9 aa, Artificial Sequence
  Description of Artificial Sequence: Synthetic peptide
  Seed: VQMPTAEST (PMEL_HUMAN)
VMMPTAESA

SEQ ID NO: 133153 - protein, 9 aa, Artificial Sequence
  Description of Artificial Sequence: Synthetic peptide
  Seed: RAMLGTHTM (PMEL_HUMAN)
RFMLGTHTI

SEQ ID NO: 133154 - protein, 8 aa, Artificial Sequence
  Description of Artificial Sequence: Synthetic peptide
  Seed: YGSFSVTL (PMEL_HUMAN)
YTSFSVTM

SEQ ID NO: 133155 - protein, 10 aa, Artificial Sequence
  Description of Artificial Sequence: Synthetic peptide
  Seed: KTWGQYWQVL (PMEL_HUMAN)
KIWGQYWQVV

SEQ ID NO: 133156 - protein, 8 aa, Artificial Sequence
  Description of Artificial Sequence: Synthetic peptide
  Seed: LHDPSGYL (PMEL_HUMAN)
LVDPSGYI

SEQ ID NO: 133157 - protein, 9 aa, Artificial Sequence
  Description of Artificial Sequence: Synthetic peptide
  Seed: RLMKQDFSV (PMEL_HUMAN)
RVMKQDFSY

SEQ ID NO: 133158 - protein, 10 aa, Artificial Sequence
  Description of Artificial Sequence: Synthetic peptide
  Seed: RGSRSYVPLA (PMEL_HUMAN)
RMSRSYVPLR

SEQ ID NO: 133159 - protein, 10 aa, Artificial Sequence
  Description of Artificial Sequence: Synthetic peptide
  Seed: SVTLDIVQGI (PMEL_HUMAN)
SLTLDIVQGL

SEQ ID NO: 133160 - protein, 11 aa, Artificial Sequence
  Description of Artificial Sequence: Synthetic peptide
  Seed: RALDGGNKHFL (PMEL_HUMAN)
RMLDGGNKHFK

SEQ ID NO: 133161 - protein, 10 aa, Artificial Sequence
  Description of Artificial Sequence: Synthetic peptide
  Seed: RGSRSYVPLA (PMEL_HUMAN)
RWSRSYVPLG

SEQ ID NO: 133162 - protein, 9 aa, Artificial Sequence
  Description of Artificial Sequence: Synthetic peptide
  Seed: YVWKTWGQY (PMEL_HUMAN)
YAWKTWGQL

SEQ ID NO: 133163 - protein, 10 aa, Artificial Sequence
  Description of Artificial Sequence: Synthetic peptide
  Seed: LAVIGALLAV (PMEL_HUMAN)
LHVIGALLAA

SEQ ID NO: 133164 - protein, 10 aa, Artificial Sequence
  Description of Artificial Sequence: Synthetic peptide
  Seed: THTMEVTVYH (PMEL_HUMAN)
TPTMEVTVYR

SEQ ID NO: 133165 - protein, 9 aa, Artificial Sequence
  Description of Artificial Sequence: Synthetic peptide
  Seed: LSIGTGRAM (PMEL_HUMAN)
LPIGTGRAW

SEQ ID NO: 133166 - protein, 10 aa, Artificial Sequence
  Description of Artificial Sequence: Synthetic peptide
  Seed: EVISTAPVQM (PMEL_HUMAN)
EAISTAPVQR

SEQ ID NO: 133167 - protein, 10 aa, Artificial Sequence
  Description of Artificial Sequence: Synthetic peptide
  Seed: VPQLPHSSSH (PMEL_HUMAN)
VVQLPHSSSM

SEQ ID NO: 133168 - protein, 9 aa, Artificial Sequence
  Description of Artificial Sequence: Synthetic peptide
  Seed: MAVVLASLI (PMEL_HUMAN)
MQVVLASLI

SEQ ID NO: 133169 - protein, 9 aa, Artificial Sequence
  Description of Artificial Sequence: Synthetic peptide
  Seed: SQVWGGQPV (PMEL_HUMAN)
SLVWGGQPY

SEQ ID NO: 133170 - protein, 11 aa, Artificial Sequence
  Description of Artificial Sequence: Synthetic peptide
  Seed: KVLPDGQVIWV (PMEL_HUMAN)
KSLPDGQVIWW

SEQ ID NO: 133171 - protein, 9 aa, Artificial Sequence
  Description of Artificial Sequence: Synthetic peptide
  Seed: VLPDGQVIW (PMEL_HUMAN)
VAPDGQVII

SEQ ID NO: 133172 - protein, 10 aa, Artificial Sequence
  Description of Artificial Sequence: Synthetic peptide
  Seed: RRLMKQDFSV (PMEL_HUMAN)
RMLMKQDFSI

SEQ ID NO: 133173 - protein, 10 aa, Artificial Sequence
  Description of Artificial Sequence: Synthetic peptide
  Seed: RQVPLDCVLY (PMEL_HUMAN)
RMVPLDCVLR

SEQ ID NO: 133174 - protein, 11 aa, Artificial Sequence
  Description of Artificial Sequence: Synthetic peptide
  Seed: HTMEVTVYHRR (PMEL_HUMAN)
HTMEVTVYHRE

SEQ ID NO: 133175 - protein, 9 aa, Artificial Sequence
  Description of Artificial Sequence: Synthetic peptide
  Seed: YLAEADLSY (PMEL_HUMAN)
YQAEADLSY

SEQ ID NO: 133176 - protein, 9 aa, Artificial Sequence
  Description of Artificial Sequence: Synthetic peptide
  Seed: SAFTITDQV (PMEL_HUMAN)
SIFTITDQF

SEQ ID NO: 133177 - protein, 9 aa, Artificial Sequence
  Description of Artificial Sequence: Synthetic peptide
  Seed: ITDQVPFSV (PMEL_HUMAN)
ILDQVPFSM

SEQ ID NO: 133178 - protein, 9 aa, Artificial Sequence
  Description of Artificial Sequence: Synthetic peptide
  Seed: TLIGANASF (PMEL_HUMAN)
TSIGANASL

SEQ ID NO: 133179 - protein, 10 aa, Artificial Sequence
  Description of Artificial Sequence: Synthetic peptide
  Seed: QEAGLGQVPL (PMEL_HUMAN)
QEAGLGQVPF

SEQ ID NO: 133180 - protein, 9 aa, Artificial Sequence
  Description of Artificial Sequence: Synthetic peptide
  Seed: LLHLAVIGA (PMEL_HUMAN)
LLHLAVIGI

SEQ ID NO: 133181 - protein, 9 aa, Artificial Sequence
  Description of Artificial Sequence: Synthetic peptide
  Seed: MAVVLASLI (PMEL_HUMAN)
MVVVLASLF

SEQ ID NO: 133182 - protein, 11 aa, Artificial Sequence
  Description of Artificial Sequence: Synthetic peptide
  Seed: VSLADTNSLAV (PMEL_HUMAN)
VSLADTNSLAW

SEQ ID NO: 133183 - protein, 11 aa, Artificial Sequence
  Description of Artificial Sequence: Synthetic peptide
  Seed: WDFGDSSGTLI (PMEL_HUMAN)
WEFGDSSGTLA

SEQ ID NO: 133184 - protein, 9 aa, Artificial Sequence
  Description of Artificial Sequence: Synthetic peptide
  Seed: MSTPEATGM (PMEL_HUMAN)
MGTPEATGW

SEQ ID NO: 133185 - protein, 9 aa, Artificial Sequence
  Description of Artificial Sequence: Synthetic peptide
  Seed: KVSNDGPTL (PMEL_HUMAN)
KQSNDGPTY

SEQ ID NO: 133186 - protein, 9 aa, Artificial Sequence
  Description of Artificial Sequence: Synthetic peptide
  Seed: SFVYVWKTW (PMEL_HUMAN)
SYVYVWKTW

SEQ ID NO: 133187 - protein, 9 aa, Artificial Sequence
  Description of Artificial Sequence: Synthetic peptide
  Seed: TTDGHRPTA (PMEL_HUMAN)
TIDGHRPTI

SEQ ID NO: 133188 - protein, 9 aa, Artificial Sequence
  Description of Artificial Sequence: Synthetic peptide
  Seed: VSVSQLRAL (PMEL_HUMAN)
VLVSQLRAF

SEQ ID NO: 133189 - protein, 8 aa, Artificial Sequence
  Description of Artificial Sequence: Synthetic peptide
  Seed: LLDGTATL (PMEL_HUMAN)
LIDGTATM

SEQ ID NO: 133190 - protein, 11 aa, Artificial Sequence
  Description of Artificial Sequence: Synthetic peptide
  Seed: TWDFGDSSGTL (PMEL_HUMAN)
TLDFGDSSGTL

SEQ ID NO: 133191 - protein, 9 aa, Artificial Sequence
  Description of Artificial Sequence: Synthetic peptide
  Seed: KRCLLHLAV (PMEL_HUMAN)
KHCLLHLAA

SEQ ID NO: 133192 - protein, 9 aa, Artificial Sequence
  Description of Artificial Sequence: Synthetic peptide
  Seed: ITDQVPFSV (PMEL_HUMAN)
ITDQVPFSF

SEQ ID NO: 133193 - protein, 9 aa, Artificial Sequence
  Description of Artificial Sequence: Synthetic peptide
  Seed: CWRGGQVSL (PMEL_HUMAN)
CWRGGQVSF

SEQ ID NO: 133194 - protein, 10 aa, Artificial Sequence
  Description of Artificial Sequence: Synthetic peptide
  Seed: LHLAVIGALL (PMEL_HUMAN)
LFLAVIGALI

SEQ ID NO: 133195 - protein, 10 aa, Artificial Sequence
  Description of Artificial Sequence: Synthetic peptide
  Seed: RNQDWLGVSR (PMEL_HUMAN)
RVQDWLGVSK

SEQ ID NO: 133196 - protein, 10 aa, Artificial Sequence
  Description of Artificial Sequence: Synthetic peptide
  Seed: MKQDFSVPQL (PMEL_HUMAN)
MAQDFSVPQF

SEQ ID NO: 133197 - protein, 9 aa, Artificial Sequence
  Description of Artificial Sequence: Synthetic peptide
  Seed: MAVVLASLI (PMEL_HUMAN)
MMVVLASLY

SEQ ID NO: 133198 - protein, 9 aa, Artificial Sequence
  Description of Artificial Sequence: Synthetic peptide
  Seed: GANASFSIA (PMEL_HUMAN)
GSNASFSIK

SEQ ID NO: 133199 - protein, 8 aa, Artificial Sequence
  Description of Artificial Sequence: Synthetic peptide
  Seed: SQKRSFVY (PMEL_HUMAN)
SQKRSFVM

SEQ ID NO: 133200 - protein, 9 aa, Artificial Sequence
  Description of Artificial Sequence: Synthetic peptide
  Seed: TMEVTVYHR (PMEL_HUMAN)
TTEVTVYHR

SEQ ID NO: 133201 - protein, 9 aa, Artificial Sequence
  Description of Artificial Sequence: Synthetic peptide
  Seed: ESAEILQAV (PMEL_HUMAN)
EQAEILQAM

SEQ ID NO: 133202 - protein, 9 aa, Artificial Sequence
  Description of Artificial Sequence: Synthetic peptide
  Seed: QKRSFVYVW (PMEL_HUMAN)
QRRSFVYVF

SEQ ID NO: 133203 - protein, 9 aa, Artificial Sequence
  Description of Artificial Sequence: Synthetic peptide
  Seed: VQMPTAEST (PMEL_HUMAN)
VMMPTAESW

SEQ ID NO: 133204 - protein, 11 aa, Artificial Sequence
  Description of Artificial Sequence: Synthetic peptide
  Seed: SYVPLAHSSSA (PMEL_HUMAN)
SSVPLAHSSSL

SEQ ID NO: 133205 - protein, 10 aa, Artificial Sequence
  Description of Artificial Sequence: Synthetic peptide
  Seed: RALDGGNKHF (PMEL_HUMAN)
RALDGGNKHW

SEQ ID NO: 133206 - protein, 10 aa, Artificial Sequence
  Description of Artificial Sequence: Synthetic peptide
  Seed: AEVSIVVLSG (PMEL_HUMAN)
AEVSIVVLSY

SEQ ID NO: 133207 - protein, 9 aa, Artificial Sequence
  Description of Artificial Sequence: Synthetic peptide
  Seed: RLMKQDFSV (PMEL_HUMAN)
RSMKQDFSI

SEQ ID NO: 133208 - protein, 10 aa, Artificial Sequence
  Description of Artificial Sequence: Synthetic peptide
  Seed: EVVGTTPGQA (PMEL_HUMAN)
ETVGTTPGQM

SEQ ID NO: 133209 - protein, 9 aa, Artificial Sequence
  Description of Artificial Sequence: Synthetic peptide
  Seed: SLAVVSTQL (PMEL_HUMAN)
SIAVVSTQR

SEQ ID NO: 133210 - protein, 8 aa, Artificial Sequence
  Description of Artificial Sequence: Synthetic peptide
  Seed: LHDPSGYL (PMEL_HUMAN)
LADPSGYV

SEQ ID NO: 133211 - protein, 11 aa, Artificial Sequence
  Description of Artificial Sequence: Synthetic peptide
  Seed: GYLAEADLSYT (PMEL_HUMAN)
GSLAEADLSYV

SEQ ID NO: 133212 - protein, 9 aa, Artificial Sequence
  Description of Artificial Sequence: Synthetic peptide
  Seed: YPQETDDAC (PMEL_HUMAN)
YTQETDDAY

SEQ ID NO: 133213 - protein, 10 aa, Artificial Sequence
  Description of Artificial Sequence: Synthetic peptide
  Seed: YLAEADLSYT (PMEL_HUMAN)
YLAEADLSYI

SEQ ID NO: 133214 - protein, 10 aa, Artificial Sequence
  Description of Artificial Sequence: Synthetic peptide
  Seed: SGTYCLNVSL (PMEL_HUMAN)
SVTYCLNVSV

SEQ ID NO: 133215 - protein, 11 aa, Artificial Sequence
  Description of Artificial Sequence: Synthetic peptide
  Seed: GSQVWGGQPVY (PMEL_HUMAN)
GMQVWGGQPVY

SEQ ID NO: 133216 - protein, 9 aa, Artificial Sequence
  Description of Artificial Sequence: Synthetic peptide
  Seed: AQVVLQAAI (PMEL_HUMAN)
ATVVLQAAF

SEQ ID NO: 133217 - protein, 10 aa, Artificial Sequence
  Description of Artificial Sequence: Synthetic peptide
  Seed: EVMGTTLAEM (PMEL_HUMAN)
EVMGTTLAEA

SEQ ID NO: 133218 - protein, 10 aa, Artificial Sequence
  Description of Artificial Sequence: Synthetic peptide
  Seed: VVLASLIYRR (PMEL_HUMAN)
VKLASLIYRR

SEQ ID NO: 133219 - protein, 9 aa, Artificial Sequence
  Description of Artificial Sequence: Synthetic peptide
  Seed: SGEGDAFEL (PMEL_HUMAN)
SAEGDAFEL

SEQ ID NO: 133220 - protein, 10 aa, Artificial Sequence
  Description of Artificial Sequence: Synthetic peptide
  Seed: RRLMKQDFSV (PMEL_HUMAN)
RHLMKQDFSL

SEQ ID NO: 133221 - protein, 10 aa, Artificial Sequence
  Description of Artificial Sequence: Synthetic peptide
  Seed: MTPAEVSIVV (PMEL_HUMAN)
MIPAEVSIVY

SEQ ID NO: 133222 - protein, 10 aa, Artificial Sequence
  Description of Artificial Sequence: Synthetic peptide
  Seed: VLPSPACQLV (PMEL_HUMAN)
VIPSPACQLL

SEQ ID NO: 133223 - protein, 9 aa, Artificial Sequence
  Description of Artificial Sequence: Synthetic peptide
  Seed: RLVKRQVPL (PMEL_HUMAN)
RRVKRQVPY

SEQ ID NO: 133224 - protein, 9 aa, Artificial Sequence
  Description of Artificial Sequence: Synthetic peptide
  Seed: RTKAWNRQL (PMEL_HUMAN)
RAKAWNRQL

SEQ ID NO: 133225 - protein, 10 aa, Artificial Sequence
  Description of Artificial Sequence: Synthetic peptide
  Seed: MAVVLASLIY (PMEL_HUMAN)
MAVVLASLIF

SEQ ID NO: 133226 - protein, 10 aa, Artificial Sequence
  Description of Artificial Sequence: Synthetic peptide
  Seed: ESAEILQAVP (PMEL_HUMAN)
EAAEILQAVV

SEQ ID NO: 133227 - protein, 9 aa, Artificial Sequence
  Description of Artificial Sequence: Synthetic peptide
  Seed: LNFPGSQKV (PMEL_HUMAN)
LVFPGSQKV

SEQ ID NO: 133228 - protein, 11 aa, Artificial Sequence
  Description of Artificial Sequence: Synthetic peptide
  Seed: SLADTNSLAVV (PMEL_HUMAN)
SMADTNSLAVA

SEQ ID NO: 133229 - protein, 10 aa, Artificial Sequence
  Description of Artificial Sequence: Synthetic peptide
  Seed: SHWLRLPRIF (PMEL_HUMAN)
SWWLRLPRIF

SEQ ID NO: 133230 - protein, 9 aa, Artificial Sequence
  Description of Artificial Sequence: Synthetic peptide
  Seed: RQVPLDCVL (PMEL_HUMAN)
REVPLDCVI

SEQ ID NO: 133231 - protein, 9 aa, Artificial Sequence
  Description of Artificial Sequence: Synthetic peptide
  Seed: TLIGANASF (PMEL_HUMAN)
TRIGANASM

SEQ ID NO: 133232 - protein, 9 aa, Artificial Sequence
  Description of Artificial Sequence: Synthetic peptide
  Seed: WLGVSRQLR (PMEL_HUMAN)
WTGVSRQLR

SEQ ID NO: 133233 - protein, 9 aa, Artificial Sequence
  Description of Artificial Sequence: Synthetic peptide
  Seed: EGDAFELTV (PMEL_HUMAN)
ETDAFELTM

SEQ ID NO: 133234 - protein, 10 aa, Artificial Sequence
  Description of Artificial Sequence: Synthetic peptide
  Seed: MLGTHTMEVT (PMEL_HUMAN)
MLGTHTMEVL

SEQ ID NO: 133235 - protein, 9 aa, Artificial Sequence
  Description of Artificial Sequence: Synthetic peptide
  Seed: RALVVTHTY (PMEL_HUMAN)
RILVVTHTV

SEQ ID NO: 133236 - protein, 9 aa, Artificial Sequence
  Description of Artificial Sequence: Synthetic peptide
  Seed: TWGQYWQVL (PMEL_HUMAN)
TFGQYWQVL

SEQ ID NO: 133237 - protein, 11 aa, Artificial Sequence
  Description of Artificial Sequence: Synthetic peptide
  Seed: RALDGGNKHFL (PMEL_HUMAN)
RSLDGGNKHFM

SEQ ID NO: 133238 - protein, 9 aa, Artificial Sequence
  Description of Artificial Sequence: Synthetic peptide
  Seed: YLEPGPVTA (PMEL_HUMAN)
YCEPGPVTF

SEQ ID NO: 133239 - protein, 9 aa, Artificial Sequence
  Description of Artificial Sequence: Synthetic peptide
  Seed: VTAQVVLQA (PMEL_HUMAN)
VSAQVVLQY

SEQ ID NO: 133240 - protein, 9 aa, Artificial Sequence
  Description of Artificial Sequence: Synthetic peptide
  Seed: GSRSYVPLA (PMEL_HUMAN)
GTRSYVPLI

SEQ ID NO: 133241 - protein, 9 aa, Artificial Sequence
  Description of Artificial Sequence: Synthetic peptide
  Seed: QVWGGQPVY (PMEL_HUMAN)
QQWGGQPVM

SEQ ID NO: 133242 - protein, 9 aa, Artificial Sequence
  Description of Artificial Sequence: Synthetic peptide
  Seed: IESAEILQA (PMEL_HUMAN)
IESAEILQI

SEQ ID NO: 133243 - protein, 9 aa, Artificial Sequence
  Description of Artificial Sequence: Synthetic peptide
  Seed: IYRRRLMKQ (PMEL_HUMAN)
IARRRLMKK

SEQ ID NO: 133244 - protein, 10 aa, Artificial Sequence
  Description of Artificial Sequence: Synthetic peptide
  Seed: LHLAVIGALL (PMEL_HUMAN)
LILAVIGALL

SEQ ID NO: 133245 - protein, 9 aa, Artificial Sequence
  Description of Artificial Sequence: Synthetic peptide
  Seed: LSIGTGRAM (PMEL_HUMAN)
LSIGTGRAW

SEQ ID NO: 133246 - protein, 10 aa, Artificial Sequence
  Description of Artificial Sequence: Synthetic peptide
  Seed: EVISTAPVQM (PMEL_HUMAN)
EIISTAPVQY

SEQ ID NO: 133247 - protein, 9 aa, Artificial Sequence
  Description of Artificial Sequence: Synthetic peptide
  Seed: KQDFSVPQL (PMEL_HUMAN)
KMDFSVPQC

SEQ ID NO: 133248 - protein, 9 aa, Artificial Sequence
  Description of Artificial Sequence: Synthetic peptide
  Seed: RYGSFSVTL (PMEL_HUMAN)
RYGSFSVTI

SEQ ID NO: 133249 - protein, 9 aa, Artificial Sequence
  Description of Artificial Sequence: Synthetic peptide
  Seed: MTPAEVSIV (PMEL_HUMAN)
MFPAEVSIL

SEQ ID NO: 133250 - protein, 10 aa, Artificial Sequence
  Description of Artificial Sequence: Synthetic peptide
  Seed: SVPQLPHSSS (PMEL_HUMAN)
SMPQLPHSSV

SEQ ID NO: 133251 - protein, 9 aa, Artificial Sequence
  Description of Artificial Sequence: Synthetic peptide
  Seed: ISRALVVTH (PMEL_HUMAN)
IVRALVVTF

SEQ ID NO: 133252 - protein, 10 aa, Artificial Sequence
  Description of Artificial Sequence: Synthetic peptide
  Seed: ESAEILQAVP (PMEL_HUMAN)
EVAEILQAVD

SEQ ID NO: 133253 - protein, 10 aa, Artificial Sequence
  Description of Artificial Sequence: Synthetic peptide
  Seed: SQVWGGQPVY (PMEL_HUMAN)
SAVWGGQPVF

SEQ ID NO: 133254 - protein, 10 aa, Artificial Sequence
  Description of Artificial Sequence: Synthetic peptide
  Seed: VSLADTNSLA (PMEL_HUMAN)
VPLADTNSLI

SEQ ID NO: 133255 - protein, 8 aa, Artificial Sequence
  Description of Artificial Sequence: Synthetic peptide
  Seed: RELPIPEP (PMEL_HUMAN)
RELPIPEF

SEQ ID NO: 133256 - protein, 11 aa, Artificial Sequence
  Description of Artificial Sequence: Synthetic peptide
  Seed: KHFLRNQPLTF (PMEL_HUMAN)
KQFLRNQPLTY

SEQ ID NO: 133257 - protein, 9 aa, Artificial Sequence
  Description of Artificial Sequence: Synthetic peptide
  Seed: FTITDQVPF (PMEL_HUMAN)
FQITDQVPW

SEQ ID NO: 133258 - protein, 11 aa, Artificial Sequence
  Description of Artificial Sequence: Synthetic peptide
  Seed: RALDGGNKHFL (PMEL_HUMAN)
RVLDGGNKHFK

SEQ ID NO: 133259 - protein, 9 aa, Artificial Sequence
  Description of Artificial Sequence: Synthetic peptide
  Seed: ALDGGNKHF (PMEL_HUMAN)
ATDGGNKHL

SEQ ID NO: 133260 - protein, 9 aa, Artificial Sequence
  Description of Artificial Sequence: Synthetic peptide
  Seed: SGTLISRAL (PMEL_HUMAN)
SRTLISRAL

SEQ ID NO: 133261 - protein, 11 aa, Artificial Sequence
  Description of Artificial Sequence: Synthetic peptide
  Seed: RLPRIFCSCPI (PMEL_HUMAN)
RCPRIFCSCPL

SEQ ID NO: 133262 - protein, 9 aa, Artificial Sequence
  Description of Artificial Sequence: Synthetic peptide
  Seed: HLAVIGALL (PMEL_HUMAN)
HSAVIGALI

SEQ ID NO: 133263 - protein, 9 aa, Artificial Sequence
  Description of Artificial Sequence: Synthetic peptide
  Seed: KTWGQYWQV (PMEL_HUMAN)
KIWGQYWQF

SEQ ID NO: 133264 - protein, 10 aa, Artificial Sequence
  Description of Artificial Sequence: Synthetic peptide
  Seed: RTKAWNRQLY (PMEL_HUMAN)
RAKAWNRQLK

SEQ ID NO: 133265 - protein, 9 aa, Artificial Sequence
  Description of Artificial Sequence: Synthetic peptide
  Seed: ISRALVVTH (PMEL_HUMAN)
ISRALVVTV

SEQ ID NO: 133266 - protein, 9 aa, Artificial Sequence
  Description of Artificial Sequence: Synthetic peptide
  Seed: VPFSVSVSQ (PMEL_HUMAN)
VPFSVSVSA

SEQ ID NO: 133267 - protein, 9 aa, Artificial Sequence
  Description of Artificial Sequence: Synthetic peptide
  Seed: HLAVIGALL (PMEL_HUMAN)
HAAVIGALL

SEQ ID NO: 133268 - protein, 9 aa, Artificial Sequence
  Description of Artificial Sequence: Synthetic peptide
  Seed: GMTPAEVSI (PMEL_HUMAN)
GVTPAEVSF

SEQ ID NO: 133269 - protein, 10 aa, Artificial Sequence
  Description of Artificial Sequence: Synthetic peptide
  Seed: GDSSGTLISR (PMEL_HUMAN)
GDSSGTLISK

SEQ ID NO: 133270 - protein, 11 aa, Artificial Sequence
  Description of Artificial Sequence: Synthetic peptide
  Seed: LVLMAVVLASL (PMEL_HUMAN)
LYLMAVVLASI

SEQ ID NO: 133271 - protein, 9 aa, Artificial Sequence
  Description of Artificial Sequence: Synthetic peptide
  Seed: HQILKGGSG (PMEL_HUMAN)
HHILKGGSV

SEQ ID NO: 133272 - protein, 9 aa, Artificial Sequence
  Description of Artificial Sequence: Synthetic peptide
  Seed: QLRTKAWNR (PMEL_HUMAN)
QYRTKAWNR

SEQ ID NO: 133273 - protein, 10 aa, Artificial Sequence
  Description of Artificial Sequence: Synthetic peptide
  Seed: RALVVTHTYL (PMEL_HUMAN)
RTLVVTHTYY

SEQ ID NO: 133274 - protein, 9 aa, Artificial Sequence
  Description of Artificial Sequence: Synthetic peptide
  Seed: TPAEVSIVV (PMEL_HUMAN)
TFAEVSIVY

SEQ ID NO: 133275 - protein, 10 aa, Artificial Sequence
  Description of Artificial Sequence: Synthetic peptide
  Seed: YLAEADLSYT (PMEL_HUMAN)
YIAEADLSYT

SEQ ID NO: 133276 - protein, 9 aa, Artificial Sequence
  Description of Artificial Sequence: Synthetic peptide
  Seed: AHSSSAFTI (PMEL_HUMAN)
AHSSSAFTV

SEQ ID NO: 133277 - protein, 10 aa, Artificial Sequence
  Description of Artificial Sequence: Synthetic peptide
  Seed: LVLMAVVLAS (PMEL_HUMAN)
LLLMAVVLAI

SEQ ID NO: 133278 - protein, 9 aa, Artificial Sequence
  Description of Artificial Sequence: Synthetic peptide
  Seed: LSIGTGRAM (PMEL_HUMAN)
LWIGTGRAI

SEQ ID NO: 133279 - protein, 8 aa, Artificial Sequence
  Description of Artificial Sequence: Synthetic peptide
  Seed: LLDGTATL (PMEL_HUMAN)
LFDGTATM

SEQ ID NO: 133280 - protein, 9 aa, Artificial Sequence
  Description of Artificial Sequence: Synthetic peptide
  Seed: TTAGQVPTT (PMEL_HUMAN)
TAAGQVPTI

SEQ ID NO: 133281 - protein, 9 aa, Artificial Sequence
  Description of Artificial Sequence: Synthetic peptide
  Seed: LSIGTGRAM (PMEL_HUMAN)
LPIGTGRAI

SEQ ID NO: 133282 - protein, 9 aa, Artificial Sequence
  Description of Artificial Sequence: Synthetic peptide
  Seed: FGDSSGTLI (PMEL_HUMAN)
FADSSGTLA

SEQ ID NO: 133283 - protein, 10 aa, Artificial Sequence
  Description of Artificial Sequence: Synthetic peptide
  Seed: SLIYRRRLMK (PMEL_HUMAN)
SFIYRRRLMR

SEQ ID NO: 133284 - protein, 11 aa, Artificial Sequence
  Description of Artificial Sequence: Synthetic peptide
  Seed: SLADTNSLAVV (PMEL_HUMAN)
SMADTNSLAVV

SEQ ID NO: 133285 - protein, 10 aa, Artificial Sequence
  Description of Artificial Sequence: Synthetic peptide
  Seed: GRAMLGTHTM (PMEL_HUMAN)
GQAMLGTHTY

SEQ ID NO: 133286 - protein, 10 aa, Artificial Sequence
  Description of Artificial Sequence: Synthetic peptide
  Seed: QVLGGPVSGL (PMEL_HUMAN)
QSLGGPVSGV

SEQ ID NO: 133287 - protein, 9 aa, Artificial Sequence
  Description of Artificial Sequence: Synthetic peptide
  Seed: LHLAVIGAL (PMEL_HUMAN)
LTLAVIGAF

SEQ ID NO: 133288 - protein, 9 aa, Artificial Sequence
  Description of Artificial Sequence: Synthetic peptide
  Seed: SSIMSTESI (PMEL_HUMAN)
SSIMSTESM

SEQ ID NO: 133289 - protein, 9 aa, Artificial Sequence
  Description of Artificial Sequence: Synthetic peptide
  Seed: GGPVSGLSI (PMEL_HUMAN)
GGPVSGLSM

SEQ ID NO: 133290 - protein, 9 aa, Artificial Sequence
  Description of Artificial Sequence: Synthetic peptide
  Seed: VISTAPVQM (PMEL_HUMAN)
VYSTAPVQI

SEQ ID NO: 133291 - protein, 10 aa, Artificial Sequence
  Description of Artificial Sequence: Synthetic peptide
  Seed: FSVSVSQLRA (PMEL_HUMAN)
FTVSVSQLRL

SEQ ID NO: 133292 - protein, 9 aa, Artificial Sequence
  Description of Artificial Sequence: Synthetic peptide
  Seed: KHFLRNQPL (PMEL_HUMAN)
KQFLRNQPW

SEQ ID NO: 133293 - protein, 10 aa, Artificial Sequence
  Description of Artificial Sequence: Synthetic peptide
  Seed: LIMPGQEAGL (PMEL_HUMAN)
LMMPGQEAGA

SEQ ID NO: 133294 - protein, 9 aa, Artificial Sequence
  Description of Artificial Sequence: Synthetic peptide
  Seed: ALDGGNKHF (PMEL_HUMAN)
ASDGGNKHF

SEQ ID NO: 133295 - protein, 10 aa, Artificial Sequence
  Description of Artificial Sequence: Synthetic peptide
  Seed: RSFVYVWKTW (PMEL_HUMAN)
RAFVYVWKTY

SEQ ID NO: 133296 - protein, 10 aa, Artificial Sequence
  Description of Artificial Sequence: Synthetic peptide
  Seed: THTMEVTVYH (PMEL_HUMAN)
TVTMEVTVYR

SEQ ID NO: 133297 - protein, 9 aa, Artificial Sequence
  Description of Artificial Sequence: Synthetic peptide
  Seed: RTKAWNRQL (PMEL_HUMAN)
RTKAWNRQY

SEQ ID NO: 133298 - protein, 9 aa, Artificial Sequence
  Description of Artificial Sequence: Synthetic peptide
  Seed: VSLADTNSL (PMEL_HUMAN)
VLLADTNSY

SEQ ID NO: 133299 - protein, 10 aa, Artificial Sequence
  Description of Artificial Sequence: Synthetic peptide
  Seed: EVMGTTLAEM (PMEL_HUMAN)
EVMGTTLAER

SEQ ID NO: 133300 - protein, 10 aa, Artificial Sequence
  Description of Artificial Sequence: Synthetic peptide
  Seed: SHWLRLPRIF (PMEL_HUMAN)
SQWLRLPRIF

SEQ ID NO: 133301 - protein, 9 aa, Artificial Sequence
  Description of Artificial Sequence: Synthetic peptide
  Seed: GILLVLMAV (PMEL_HUMAN)
GMLLVLMAV

SEQ ID NO: 133302 - protein, 11 aa, Artificial Sequence
  Description of Artificial Sequence: Synthetic peptide
  Seed: LGPLLDGTATL (PMEL_HUMAN)
LAPLLDGTATI

SEQ ID NO: 133303 - protein, 9 aa, Artificial Sequence
  Description of Artificial Sequence: Synthetic peptide
  Seed: LPDGQVIWV (PMEL_HUMAN)
LWDGQVIWF

SEQ ID NO: 133304 - protein, 9 aa, Artificial Sequence
  Description of Artificial Sequence: Synthetic peptide
  Seed: MEVTVYHRR (PMEL_HUMAN)
MAVTVYHRR

SEQ ID NO: 133305 - protein, 11 aa, Artificial Sequence
  Description of Artificial Sequence: Synthetic peptide
  Seed: MTPEKVPVSEV (PMEL_HUMAN)
MMPEKVPVSEI

SEQ ID NO: 133306 - protein, 10 aa, Artificial Sequence
  Description of Artificial Sequence: Synthetic peptide
  Seed: STAPVQMPTA (PMEL_HUMAN)
SQAPVQMPTV

SEQ ID NO: 133307 - protein, 11 aa, Artificial Sequence
  Description of Artificial Sequence: Synthetic peptide
  Seed: RLPRIFCSCPI (PMEL_HUMAN)
RRPRIFCSCPL

SEQ ID NO: 133308 - protein, 10 aa, Artificial Sequence
  Description of Artificial Sequence: Synthetic peptide
  Seed: VLYRYGSFSV (PMEL_HUMAN)
VRYRYGSFSK

SEQ ID NO: 133309 - protein, 10 aa, Artificial Sequence
  Description of Artificial Sequence: Synthetic peptide
  Seed: TITDQVPFSV (PMEL_HUMAN)
TLTDQVPFSL

SEQ ID NO: 133310 - protein, 11 aa, Artificial Sequence
  Description of Artificial Sequence: Synthetic peptide
  Seed: SYVPLAHSSSA (PMEL_HUMAN)
SPVPLAHSSSF

SEQ ID NO: 133311 - protein, 10 aa, Artificial Sequence
  Description of Artificial Sequence: Synthetic peptide
  Seed: IESAEILQAV (PMEL_HUMAN)
IMSAEILQAL

SEQ ID NO: 133312 - protein, 9 aa, Artificial Sequence
  Description of Artificial Sequence: Synthetic peptide
  Seed: EVMGTTLAE (PMEL_HUMAN)
EVMGTTLAM

SEQ ID NO: 133313 - protein, 10 aa, Artificial Sequence
  Description of Artificial Sequence: Synthetic peptide
  Seed: LMAVVLASLI (PMEL_HUMAN)
LLAVVLASLF

SEQ ID NO: 133314 - protein, 9 aa, Artificial Sequence
  Description of Artificial Sequence: Synthetic peptide
  Seed: VSNDGPTLI (PMEL_HUMAN)
VRNDGPTLY

SEQ ID NO: 133315 - protein, 11 aa, Artificial Sequence
  Description of Artificial Sequence: Synthetic peptide
  Seed: FLRNQPLTFAL (PMEL_HUMAN)
FMRNQPLTFAL

SEQ ID NO: 133316 - protein, 10 aa, Artificial Sequence
  Description of Artificial Sequence: Synthetic peptide
  Seed: LAVVSTQLIM (PMEL_HUMAN)
LQVVSTQLIY

SEQ ID NO: 133317 - protein, 11 aa, Artificial Sequence
  Description of Artificial Sequence: Synthetic peptide
  Seed: YVPLAHSSSAF (PMEL_HUMAN)
YHPLAHSSSAF

SEQ ID NO: 133318 - protein, 9 aa, Artificial Sequence
  Description of Artificial Sequence: Synthetic peptide
  Seed: SGLSIGTGR (PMEL_HUMAN)
STLSIGTGK

SEQ ID NO: 133319 - protein, 10 aa, Artificial Sequence
  Description of Artificial Sequence: Synthetic peptide
  Seed: VSLADTNSLA (PMEL_HUMAN)
VHLADTNSLV

SEQ ID NO: 133320 - protein, 10 aa, Artificial Sequence
  Description of Artificial Sequence: Synthetic peptide
  Seed: ESAEILQAVP (PMEL_HUMAN)
ETAEILQAVG

SEQ ID NO: 133321 - protein, 10 aa, Artificial Sequence
  Description of Artificial Sequence: Synthetic peptide
  Seed: MTPAEVSIVV (PMEL_HUMAN)
MFPAEVSIVA

SEQ ID NO: 133322 - protein, 9 aa, Artificial Sequence
  Description of Artificial Sequence: Synthetic peptide
  Seed: VSNDGPTLI (PMEL_HUMAN)
VLNDGPTLW

SEQ ID NO: 133323 - protein, 10 aa, Artificial Sequence
  Description of Artificial Sequence: Synthetic peptide
  Seed: LVLMAVVLAS (PMEL_HUMAN)
LSLMAVVLAA

SEQ ID NO: 133324 - protein, 9 aa, Artificial Sequence
  Description of Artificial Sequence: Synthetic peptide
  Seed: AAQVTTTEW (PMEL_HUMAN)
AGQVTTTEY

SEQ ID NO: 133325 - protein, 9 aa, Artificial Sequence
  Description of Artificial Sequence: Synthetic peptide
  Seed: CVLYRYGSF (PMEL_HUMAN)
CTLYRYGSY

SEQ ID NO: 133326 - protein, 9 aa, Artificial Sequence
  Description of Artificial Sequence: Synthetic peptide
  Seed: EVMGTTLAE (PMEL_HUMAN)
ETMGTTLAY

SEQ ID NO: 133327 - protein, 9 aa, Artificial Sequence
  Description of Artificial Sequence: Synthetic peptide
  Seed: KTWGQYWQV (PMEL_HUMAN)
KQWGQYWQT

SEQ ID NO: 133328 - protein, 10 aa, Artificial Sequence
  Description of Artificial Sequence: Synthetic peptide
  Seed: AMLGTHTMEV (PMEL_HUMAN)
AGLGTHTMEV

SEQ ID NO: 133329 - protein, 9 aa, Artificial Sequence
  Description of Artificial Sequence: Synthetic peptide
  Seed: RALVVTHTY (PMEL_HUMAN)
RLLVVTHTY

SEQ ID NO: 133330 - protein, 10 aa, Artificial Sequence
  Description of Artificial Sequence: Synthetic peptide
  Seed: LVLMAVVLAS (PMEL_HUMAN)
LELMAVVLAI

SEQ ID NO: 133331 - protein, 9 aa, Artificial Sequence
  Description of Artificial Sequence: Synthetic peptide
  Seed: TGRAMLGTH (PMEL_HUMAN)
TARAMLGTF

SEQ ID NO: 133332 - protein, 9 aa, Artificial Sequence
  Description of Artificial Sequence: Synthetic peptide
  Seed: LSIGTGRAM (PMEL_HUMAN)
LMIGTGRAF

SEQ ID NO: 133333 - protein, 9 aa, Artificial Sequence
  Description of Artificial Sequence: Synthetic peptide
  Seed: RLVKRQVPL (PMEL_HUMAN)
RMVKRQVPL

SEQ ID NO: 133334 - protein, 9 aa, Artificial Sequence
  Description of Artificial Sequence: Synthetic peptide
  Seed: RALVVTHTY (PMEL_HUMAN)
RILVVTHTW

SEQ ID NO: 133335 - protein, 9 aa, Artificial Sequence
  Description of Artificial Sequence: Synthetic peptide
  Seed: FGDSSGTLI (PMEL_HUMAN)
FYDSSGTLF

SEQ ID NO: 133336 - protein, 9 aa, Artificial Sequence
  Description of Artificial Sequence: Synthetic peptide
  Seed: LADTNSLAV (PMEL_HUMAN)
LYDTNSLAY

SEQ ID NO: 133337 - protein, 9 aa, Artificial Sequence
  Description of Artificial Sequence: Synthetic peptide
  Seed: FLRNQPLTF (PMEL_HUMAN)
FPRNQPLTL

SEQ ID NO: 133338 - protein, 11 aa, Artificial Sequence
  Description of Artificial Sequence: Synthetic peptide
  Seed: VQMPTAESTGM (PMEL_HUMAN)
VHMPTAESTGL

SEQ ID NO: 133339 - protein, 10 aa, Artificial Sequence
  Description of Artificial Sequence: Synthetic peptide
  Seed: RQVPLDCVLY (PMEL_HUMAN)
RQVPLDCVLF

SEQ ID NO: 133340 - protein, 11 aa, Artificial Sequence
  Description of Artificial Sequence: Synthetic peptide
  Seed: QAVPSGEGDAF (PMEL_HUMAN)
QQVPSGEGDAM

SEQ ID NO: 133341 - protein, 9 aa, Artificial Sequence
  Description of Artificial Sequence: Synthetic peptide
  Seed: AEPSGTTSV (PMEL_HUMAN)
AAPSGTTSH

SEQ ID NO: 133342 - protein, 9 aa, Artificial Sequence
  Description of Artificial Sequence: Synthetic peptide
  Seed: VVLASLIYR (PMEL_HUMAN)
VMLASLIYK

SEQ ID NO: 133343 - protein, 10 aa, Artificial Sequence
  Description of Artificial Sequence: Synthetic peptide
  Seed: YLAEADLSYT (PMEL_HUMAN)
YTAEADLSYI

SEQ ID NO: 133344 - protein, 11 aa, Artificial Sequence
  Description of Artificial Sequence: Synthetic peptide
  Seed: MAVVLASLIYR (PMEL_HUMAN)
MLVVLASLIYK

SEQ ID NO: 133345 - protein, 9 aa, Artificial Sequence
  Description of Artificial Sequence: Synthetic peptide
  Seed: RNQPLTFAL (PMEL_HUMAN)
RKQPLTFAY

SEQ ID NO: 133346 - protein, 10 aa, Artificial Sequence
  Description of Artificial Sequence: Synthetic peptide
  Seed: NASFSIALNF (PMEL_HUMAN)
NWSFSIALNW

SEQ ID NO: 133347 - protein, 9 aa, Artificial Sequence
  Description of Artificial Sequence: Synthetic peptide
  Seed: RLVKRQVPL (PMEL_HUMAN)
RVVKRQVPL

SEQ ID NO: 133348 - protein, 9 aa, Artificial Sequence
  Description of Artificial Sequence: Synthetic peptide
  Seed: MLGTHTMEV (PMEL_HUMAN)
MIGTHTMEY

SEQ ID NO: 133349 - protein, 9 aa, Artificial Sequence
  Description of Artificial Sequence: Synthetic peptide
  Seed: KHFLRNQPL (PMEL_HUMAN)
KIFLRNQPF

SEQ ID NO: 133350 - protein, 10 aa, Artificial Sequence
  Description of Artificial Sequence: Synthetic peptide
  Seed: RSFVYVWKTW (PMEL_HUMAN)
RWFVYVWKTF

SEQ ID NO: 133351 - protein, 9 aa, Artificial Sequence
  Description of Artificial Sequence: Synthetic peptide
  Seed: ISRALVVTH (PMEL_HUMAN)
IARALVVTY

SEQ ID NO: 133352 - protein, 10 aa, Artificial Sequence
  Description of Artificial Sequence: Synthetic peptide
  Seed: KRQVPLDCVL (PMEL_HUMAN)
KWQVPLDCVY

SEQ ID NO: 133353 - protein, 9 aa, Artificial Sequence
  Description of Artificial Sequence: Synthetic peptide
  Seed: YLEPGPVTA (PMEL_HUMAN)
YWEPGPVTI

SEQ ID NO: 133354 - protein, 10 aa, Artificial Sequence
  Description of Artificial Sequence: Synthetic peptide
  Seed: SVPQLPHSSS (PMEL_HUMAN)
SLPQLPHSSM

SEQ ID NO: 133355 - protein, 9 aa, Artificial Sequence
  Description of Artificial Sequence: Synthetic peptide
  Seed: SQKRSFVYV (PMEL_HUMAN)
SAKRSFVYA

SEQ ID NO: 133356 - protein, 9 aa, Artificial Sequence
  Description of Artificial Sequence: Synthetic peptide
  Seed: CVLYRYGSF (PMEL_HUMAN)
CSLYRYGSY

SEQ ID NO: 133357 - protein, 10 aa, Artificial Sequence
  Description of Artificial Sequence: Synthetic peptide
  Seed: RGSRSYVPLA (PMEL_HUMAN)
RDSRSYVPLA

SEQ ID NO: 133358 - protein, 9 aa, Artificial Sequence
  Description of Artificial Sequence: Synthetic peptide
  Seed: KAWNRQLYP (PMEL_HUMAN)
KIWNRQLYA

SEQ ID NO: 133359 - protein, 10 aa, Artificial Sequence
  Description of Artificial Sequence: Synthetic peptide
  Seed: ASSIMSTESI (PMEL_HUMAN)
ATSIMSTESY

SEQ ID NO: 133360 - protein, 9 aa, Artificial Sequence
  Description of Artificial Sequence: Synthetic peptide
  Seed: RGSRSYVPL (PMEL_HUMAN)
RSSRSYVPL

SEQ ID NO: 133361 - protein, 9 aa, Artificial Sequence
  Description of Artificial Sequence: Synthetic peptide
  Seed: AAQVTTTEW (PMEL_HUMAN)
AQQVTTTEI

SEQ ID NO: 133362 - protein, 10 aa, Artificial Sequence
  Description of Artificial Sequence: Synthetic peptide
  Seed: LVLMAVVLAS (PMEL_HUMAN)
LHLMAVVLAA

SEQ ID NO: 133363 - protein, 11 aa, Artificial Sequence
  Description of Artificial Sequence: Synthetic peptide
  Seed: LGPLLDGTATL (PMEL_HUMAN)
LVPLLDGTATI

SEQ ID NO: 133364 - protein, 10 aa, Artificial Sequence
  Description of Artificial Sequence: Synthetic peptide
  Seed: ALDGGNKHFL (PMEL_HUMAN)
ACDGGNKHFL

SEQ ID NO: 133365 - protein, 9 aa, Artificial Sequence
  Description of Artificial Sequence: Synthetic peptide
  Seed: KVLPDGQVI (PMEL_HUMAN)
KILPDGQVL

SEQ ID NO: 133366 - protein, 8 aa, Artificial Sequence
  Description of Artificial Sequence: Synthetic peptide
  Seed: FGDSSGTL (PMEL_HUMAN)
FWDSSGTF

SEQ ID NO: 133367 - protein, 9 aa, Artificial Sequence
  Description of Artificial Sequence: Synthetic peptide
  Seed: ANASFSIAL (PMEL_HUMAN)
AVASFSIAM

SEQ ID NO: 133368 - protein, 10 aa, Artificial Sequence
  Description of Artificial Sequence: Synthetic peptide
  Seed: MTPAEVSIVV (PMEL_HUMAN)
MPPAEVSIVV

SEQ ID NO: 133369 - protein, 11 aa, Artificial Sequence
  Description of Artificial Sequence: Synthetic peptide
  Seed: KHFLRNQPLTF (PMEL_HUMAN)
KQFLRNQPLTF

SEQ ID NO: 133370 - protein, 11 aa, Artificial Sequence
  Description of Artificial Sequence: Synthetic peptide
  Seed: KVLPDGQVIWV (PMEL_HUMAN)
KALPDGQVIWW

SEQ ID NO: 133371 - protein, 10 aa, Artificial Sequence
  Description of Artificial Sequence: Synthetic peptide
  Seed: AVIGALLAVG (PMEL_HUMAN)
AQIGALLAVV

SEQ ID NO: 133372 - protein, 10 aa, Artificial Sequence
  Description of Artificial Sequence: Synthetic peptide
  Seed: EVVGTTPGQA (PMEL_HUMAN)
EVVGTTPGQI

SEQ ID NO: 133373 - protein, 10 aa, Artificial Sequence
  Description of Artificial Sequence: Synthetic peptide
  Seed: THTMEVTVYH (PMEL_HUMAN)
TTTMEVTVYR

SEQ ID NO: 133374 - protein, 10 aa, Artificial Sequence
  Description of Artificial Sequence: Synthetic peptide
  Seed: SLIYRRRLMK (PMEL_HUMAN)
STIYRRRLMK

SEQ ID NO: 133375 - protein, 9 aa, Artificial Sequence
  Description of Artificial Sequence: Synthetic peptide
  Seed: VVLQAAIPL (PMEL_HUMAN)
VMLQAAIPA

SEQ ID NO: 133376 - protein, 9 aa, Artificial Sequence
  Description of Artificial Sequence: Synthetic peptide
  Seed: LIVGILLVL (PMEL_HUMAN)
LAVGILLVW

SEQ ID NO: 133377 - protein, 9 aa, Artificial Sequence
  Description of Artificial Sequence: Synthetic peptide
  Seed: LADTNSLAV (PMEL_HUMAN)
LYDTNSLAL

SEQ ID NO: 133378 - protein, 10 aa, Artificial Sequence
  Description of Artificial Sequence: Synthetic peptide
  Seed: ELTVSCQGGL (PMEL_HUMAN)
EDTVSCQGGV

SEQ ID NO: 133379 - protein, 9 aa, Artificial Sequence
  Description of Artificial Sequence: Synthetic peptide
  Seed: VSNDGPTLI (PMEL_HUMAN)
VGNDGPTLW

SEQ ID NO: 133380 - protein, 9 aa, Artificial Sequence
  Description of Artificial Sequence: Synthetic peptide
  Seed: LMAVVLASL (PMEL_HUMAN)
LHAVVLASY

SEQ ID NO: 133381 - protein, 10 aa, Artificial Sequence
  Description of Artificial Sequence: Synthetic peptide
  Seed: RQVPLDCVLY (PMEL_HUMAN)
RKVPLDCVLM

SEQ ID NO: 133382 - protein, 10 aa, Artificial Sequence
  Description of Artificial Sequence: Synthetic peptide
  Seed: MPTAESTGMT (PMEL_HUMAN)
MNTAESTGMA

SEQ ID NO: 133383 - protein, 11 aa, Artificial Sequence
  Description of Artificial Sequence: Synthetic peptide
  Seed: VSLADTNSLAV (PMEL_HUMAN)
VLLADTNSLAV

SEQ ID NO: 133384 - protein, 9 aa, Artificial Sequence
  Description of Artificial Sequence: Synthetic peptide
  Seed: KEACMEISS (PMEL_HUMAN)
KEACMEISL

SEQ ID NO: 133385 - protein, 9 aa, Artificial Sequence
  Description of Artificial Sequence: Synthetic peptide
  Seed: RALVVTHTY (PMEL_HUMAN)
RMLVVTHTF

SEQ ID NO: 133386 - protein, 10 aa, Artificial Sequence
  Description of Artificial Sequence: Synthetic peptide
  Seed: RTKAWNRQLY (PMEL_HUMAN)
RMKAWNRQLW

SEQ ID NO: 133387 - protein, 9 aa, Artificial Sequence
  Description of Artificial Sequence: Synthetic peptide
  Seed: RELPIPEPE (PMEL_HUMAN)
RELPIPEPS

SEQ ID NO: 133388 - protein, 10 aa, Artificial Sequence
  Description of Artificial Sequence: Synthetic peptide
  Seed: AEMSTPEATG (PMEL_HUMAN)
AEMSTPEATT

SEQ ID NO: 133389 - protein, 10 aa, Artificial Sequence
  Description of Artificial Sequence: Synthetic peptide
  Seed: RYGSFSVTLD (PMEL_HUMAN)
RFGSFSVTLW

SEQ ID NO: 133390 - protein, 8 aa, Artificial Sequence
  Description of Artificial Sequence: Synthetic peptide
  Seed: LIYRRRLM (PMEL_HUMAN)
LMYRRRLM

SEQ ID NO: 133391 - protein, 9 aa, Artificial Sequence
  Description of Artificial Sequence: Synthetic peptide
  Seed: KTWGQYWQV (PMEL_HUMAN)
KIWGQYWQA

SEQ ID NO: 133392 - protein, 10 aa, Artificial Sequence
  Description of Artificial Sequence: Synthetic peptide
  Seed: RTKAWNRQLY (PMEL_HUMAN)
RTKAWNRQLF

SEQ ID NO: 133393 - protein, 9 aa, Artificial Sequence
  Description of Artificial Sequence: Synthetic peptide
  Seed: SFVYVWKTW (PMEL_HUMAN)
SWVYVWKTW

SEQ ID NO: 133394 - protein, 10 aa, Artificial Sequence
  Description of Artificial Sequence: Synthetic peptide
  Seed: YVPLAHSSSA (PMEL_HUMAN)
YSPLAHSSSA

SEQ ID NO: 133395 - protein, 9 aa, Artificial Sequence
  Description of Artificial Sequence: Synthetic peptide
  Seed: LPDGQVIWV (PMEL_HUMAN)
LGDGQVIWV

SEQ ID NO: 133396 - protein, 9 aa, Artificial Sequence
  Description of Artificial Sequence: Synthetic peptide
  Seed: TTDGHRPTA (PMEL_HUMAN)
TSDGHRPTM

SEQ ID NO: 133397 - protein, 10 aa, Artificial Sequence
  Description of Artificial Sequence: Synthetic peptide
  Seed: KVLPDGQVIW (PMEL_HUMAN)
KILPDGQVIL

SEQ ID NO: 133398 - protein, 10 aa, Artificial Sequence
  Description of Artificial Sequence: Synthetic peptide
  Seed: KVSNDGPTLI (PMEL_HUMAN)
KTSNDGPTLW

SEQ ID NO: 133399 - protein, 11 aa, Artificial Sequence
  Description of Artificial Sequence: Synthetic peptide
  Seed: FSVTLDIVQGI (PMEL_HUMAN)
FFVTLDIVQGV

SEQ ID NO: 133400 - protein, 10 aa, Artificial Sequence
  Description of Artificial Sequence: Synthetic peptide
  Seed: HFLRNQPLTF (PMEL_HUMAN)
HWLRNQPLTW

SEQ ID NO: 133401 - protein, 9 aa, Artificial Sequence
  Description of Artificial Sequence: Synthetic peptide
  Seed: TLIGANASF (PMEL_HUMAN)
TMIGANASV

SEQ ID NO: 133402 - protein, 11 aa, Artificial Sequence
  Description of Artificial Sequence: Synthetic peptide
  Seed: MAVVLASLIYR (PMEL_HUMAN)
MYVVLASLIYR

SEQ ID NO: 133403 - protein, 9 aa, Artificial Sequence
  Description of Artificial Sequence: Synthetic peptide
  Seed: EPGPVTAQV (PMEL_HUMAN)
EAGPVTAQV

SEQ ID NO: 133404 - protein, 10 aa, Artificial Sequence
  Description of Artificial Sequence: Synthetic peptide
  Seed: EVMGTTLAEM (PMEL_HUMAN)
ESMGTTLAEF

SEQ ID NO: 133405 - protein, 9 aa, Artificial Sequence
  Description of Artificial Sequence: Synthetic peptide
  Seed: RALVVTHTY (PMEL_HUMAN)
RFLVVTHTF

SEQ ID NO: 133406 - protein, 9 aa, Artificial Sequence
  Description of Artificial Sequence: Synthetic peptide
  Seed: QLYPEWTEA (PMEL_HUMAN)
QVYPEWTEI

SEQ ID NO: 133407 - protein, 11 aa, Artificial Sequence
  Description of Artificial Sequence: Synthetic peptide
  Seed: QEAGLGQVPLI (PMEL_HUMAN)
QEAGLGQVPLW

SEQ ID NO: 133408 - protein, 10 aa, Artificial Sequence
  Description of Artificial Sequence: Synthetic peptide
  Seed: QVLGGPVSGL (PMEL_HUMAN)
QALGGPVSGF

SEQ ID NO: 133409 - protein, 10 aa, Artificial Sequence
  Description of Artificial Sequence: Synthetic peptide
  Seed: LVLMAVVLAS (PMEL_HUMAN)
LELMAVVLAL

SEQ ID NO: 133410 - protein, 10 aa, Artificial Sequence
  Description of Artificial Sequence: Synthetic peptide
  Seed: RGSRSYVPLA (PMEL_HUMAN)
RLSRSYVPLY

SEQ ID NO: 133411 - protein, 10 aa, Artificial Sequence
  Description of Artificial Sequence: Synthetic peptide
  Seed: MKQDFSVPQL (PMEL_HUMAN)
MMQDFSVPQF

SEQ ID NO: 133412 - protein, 10 aa, Artificial Sequence
  Description of Artificial Sequence: Synthetic peptide
  Seed: SQVWGGQPVY (PMEL_HUMAN)
STVWGGQPVY

SEQ ID NO: 133413 - protein, 9 aa, Artificial Sequence
  Description of Artificial Sequence: Synthetic peptide
  Seed: MLGTHTMEV (PMEL_HUMAN)
MRGTHTMEI

SEQ ID NO: 133414 - protein, 10 aa, Artificial Sequence
  Description of Artificial Sequence: Synthetic peptide
  Seed: SQKRSFVYVW (PMEL_HUMAN)
SGKRSFVYVY

SEQ ID NO: 133415 - protein, 9 aa, Artificial Sequence
  Description of Artificial Sequence: Synthetic peptide
  Seed: QVWGGQPVY (PMEL_HUMAN)
QYWGGQPVY

SEQ ID NO: 133416 - protein, 10 aa, Artificial Sequence
  Description of Artificial Sequence: Synthetic peptide
  Seed: VLMAVVLASL (PMEL_HUMAN)
VPMAVVLASV

SEQ ID NO: 133417 - protein, 10 aa, Artificial Sequence
  Description of Artificial Sequence: Synthetic peptide
  Seed: MKQDFSVPQL (PMEL_HUMAN)
MEQDFSVPQY

SEQ ID NO: 133418 - protein, 9 aa, Artificial Sequence
  Description of Artificial Sequence: Synthetic peptide
  Seed: AVVLASLIY (PMEL_HUMAN)
ALVLASLIF

SEQ ID NO: 133419 - protein, 9 aa, Artificial Sequence
  Description of Artificial Sequence: Synthetic peptide
  Seed: TWGQYWQVL (PMEL_HUMAN)
TYGQYWQVY

SEQ ID NO: 133420 - protein, 10 aa, Artificial Sequence
  Description of Artificial Sequence: Synthetic peptide
  Seed: RGSRSYVPLA (PMEL_HUMAN)
RHSRSYVPLI

SEQ ID NO: 133421 - protein, 9 aa, Artificial Sequence
  Description of Artificial Sequence: Synthetic peptide
  Seed: RTKAWNRQL (PMEL_HUMAN)
RYKAWNRQA

SEQ ID NO: 133422 - protein, 9 aa, Artificial Sequence
  Description of Artificial Sequence: Synthetic peptide
  Seed: VPLAHSSSA (PMEL_HUMAN)
VHLAHSSSA

SEQ ID NO: 133423 - protein, 9 aa, Artificial Sequence
  Description of Artificial Sequence: Synthetic peptide
  Seed: VSLADTNSL (PMEL_HUMAN)
VILADTNSL

SEQ ID NO: 133424 - protein, 10 aa, Artificial Sequence
  Description of Artificial Sequence: Synthetic peptide
  Seed: NASFSIALNF (PMEL_HUMAN)
NTSFSIALNW

SEQ ID NO: 133425 - protein, 9 aa, Artificial Sequence
  Description of Artificial Sequence: Synthetic peptide
  Seed: RNQPLTFAL (PMEL_HUMAN)
RTQPLTFAF

SEQ ID NO: 133426 - protein, 11 aa, Artificial Sequence
  Description of Artificial Sequence: Synthetic peptide
  Seed: SRQLRTKAWNR (PMEL_HUMAN)
SMQLRTKAWNR

SEQ ID NO: 133427 - protein, 10 aa, Artificial Sequence
  Description of Artificial Sequence: Synthetic peptide
  Seed: RRLMKQDFSV (PMEL_HUMAN)
RQLMKQDFSL

SEQ ID NO: 133428 - protein, 10 aa, Artificial Sequence
  Description of Artificial Sequence: Synthetic peptide
  Seed: MAVVLASLIY (PMEL_HUMAN)
MVVVLASLIW

SEQ ID NO: 133429 - protein, 10 aa, Artificial Sequence
  Description of Artificial Sequence: Synthetic peptide
  Seed: YRYGSFSVTL (PMEL_HUMAN)
YHYGSFSVTI

SEQ ID NO: 133430 - protein, 10 aa, Artificial Sequence
  Description of Artificial Sequence: Synthetic peptide
  Seed: KTWGQYWQVL (PMEL_HUMAN)
KCWGQYWQVF

SEQ ID NO: 133431 - protein, 9 aa, Artificial Sequence
  Description of Artificial Sequence: Synthetic peptide
  Seed: VPLDCVLYR (PMEL_HUMAN)
VQLDCVLYK

SEQ ID NO: 133432 - protein, 11 aa, Artificial Sequence
  Description of Artificial Sequence: Synthetic peptide
  Seed: TTAAQVTTTEW (PMEL_HUMAN)
TRAAQVTTTEW

SEQ ID NO: 133433 - protein, 10 aa, Artificial Sequence
  Description of Artificial Sequence: Synthetic peptide
  Seed: MTPAEVSIVV (PMEL_HUMAN)
MKPAEVSIVI

SEQ ID NO: 133434 - protein, 10 aa, Artificial Sequence
  Description of Artificial Sequence: Synthetic peptide
  Seed: GYLAEADLSY (PMEL_HUMAN)
GLLAEADLSY

SEQ ID NO: 133435 - protein, 9 aa, Artificial Sequence
  Description of Artificial Sequence: Synthetic peptide
  Seed: AEPSGTTSV (PMEL_HUMAN)
AEPSGTTSI

SEQ ID NO: 133436 - protein, 9 aa, Artificial Sequence
  Description of Artificial Sequence: Synthetic peptide
  Seed: AVVSTQLIM (PMEL_HUMAN)
AAVSTQLIL

SEQ ID NO: 133437 - protein, 9 aa, Artificial Sequence
  Description of Artificial Sequence: Synthetic peptide
  Seed: RYGSFSVTL (PMEL_HUMAN)
RYGSFSVTW

SEQ ID NO: 133438 - protein, 9 aa, Artificial Sequence
  Description of Artificial Sequence: Synthetic peptide
  Seed: ITDQVPFSV (PMEL_HUMAN)
IIDQVPFSV

SEQ ID NO: 133439 - protein, 10 aa, Artificial Sequence
  Description of Artificial Sequence: Synthetic peptide
  Seed: STAPVQMPTA (PMEL_HUMAN)
SVAPVQMPTV

SEQ ID NO: 133440 - protein, 9 aa, Artificial Sequence
  Description of Artificial Sequence: Synthetic peptide
  Seed: SQVWGGQPV (PMEL_HUMAN)
SHVWGGQPF

SEQ ID NO: 133441 - protein, 10 aa, Artificial Sequence
  Description of Artificial Sequence: Synthetic peptide
  Seed: GSFSVTLDIV (PMEL_HUMAN)
GIFSVTLDIL

SEQ ID NO: 133442 - protein, 9 aa, Artificial Sequence
  Description of Artificial Sequence: Synthetic peptide
  Seed: SSIMSTESI (PMEL_HUMAN)
SHIMSTESF

SEQ ID NO: 133443 - protein, 9 aa, Artificial Sequence
  Description of Artificial Sequence: Synthetic peptide
  Seed: GGPVSGLSI (PMEL_HUMAN)
GGPVSGLSL

SEQ ID NO: 133444 - protein, 9 aa, Artificial Sequence
  Description of Artificial Sequence: Synthetic peptide
  Seed: VMGTTLAEM (PMEL_HUMAN)
VFGTTLAEM

SEQ ID NO: 133445 - protein, 10 aa, Artificial Sequence
  Description of Artificial Sequence: Synthetic peptide
  Seed: AVVLASLIYR (PMEL_HUMAN)
APVLASLIYK

SEQ ID NO: 133446 - protein, 9 aa, Artificial Sequence
  Description of Artificial Sequence: Synthetic peptide
  Seed: TKAWNRQLY (PMEL_HUMAN)
TMAWNRQLY

SEQ ID NO: 133447 - protein, 9 aa, Artificial Sequence
  Description of Artificial Sequence: Synthetic peptide
  Seed: TAEAPNTTA (PMEL_HUMAN)
TAEAPNTTL

SEQ ID NO: 133448 - protein, 9 aa, Artificial Sequence
  Description of Artificial Sequence: Synthetic peptide
  Seed: VTLDIVQGI (PMEL_HUMAN)
VVLDIVQGM

SEQ ID NO: 133449 - protein, 10 aa, Artificial Sequence
  Description of Artificial Sequence: Synthetic peptide
  Seed: LAVVSTQLIM (PMEL_HUMAN)
LMVVSTQLIF

SEQ ID NO: 133450 - protein, 9 aa, Artificial Sequence
  Description of Artificial Sequence: Synthetic peptide
  Seed: FTITDQVPF (PMEL_HUMAN)
FQITDQVPI

SEQ ID NO: 133451 - protein, 9 aa, Artificial Sequence
  Description of Artificial Sequence: Synthetic peptide
  Seed: KHFLRNQPL (PMEL_HUMAN)
KKFLRNQPM

SEQ ID NO: 133452 - protein, 9 aa, Artificial Sequence
  Description of Artificial Sequence: Synthetic peptide
  Seed: QVIWVNNTI (PMEL_HUMAN)
QTIWVNNTK

SEQ ID NO: 133453 - protein, 9 aa, Artificial Sequence
  Description of Artificial Sequence: Synthetic peptide
  Seed: TEWVETTAR (PMEL_HUMAN)
TEWVETTAF

SEQ ID NO: 133454 - protein, 10 aa, Artificial Sequence
  Description of Artificial Sequence: Synthetic peptide
  Seed: RGSRSYVPLA (PMEL_HUMAN)
RMSRSYVPLM

SEQ ID NO: 133455 - protein, 9 aa, Artificial Sequence
  Description of Artificial Sequence: Synthetic peptide
  Seed: ASFSIALNF (PMEL_HUMAN)
ATFSIALNI

SEQ ID NO: 133456 - protein, 10 aa, Artificial Sequence
  Description of Artificial Sequence: Synthetic peptide
  Seed: QVLGGPVSGL (PMEL_HUMAN)
QMLGGPVSGL

SEQ ID NO: 133457 - protein, 11 aa, Artificial Sequence
  Description of Artificial Sequence: Synthetic peptide
  Seed: YVPLAHSSSAF (PMEL_HUMAN)
YAPLAHSSSAM

SEQ ID NO: 133458 - protein, 10 aa, Artificial Sequence
  Description of Artificial Sequence: Synthetic peptide
  Seed: ESAEILQAVP (PMEL_HUMAN)
ETAEILQAVY

SEQ ID NO: 133459 - protein, 9 aa, Artificial Sequence
  Description of Artificial Sequence: Synthetic peptide
  Seed: DQVPFSVSV (PMEL_HUMAN)
DEVPFSVSF

SEQ ID NO: 133460 - protein, 9 aa, Artificial Sequence
  Description of Artificial Sequence: Synthetic peptide
  Seed: TPAEVSIVV (PMEL_HUMAN)
TAAEVSIVL

SEQ ID NO: 133461 - protein, 11 aa, Artificial Sequence
  Description of Artificial Sequence: Synthetic peptide
  Seed: HQILKGGSGTY (PMEL_HUMAN)
HRILKGGSGTF

SEQ ID NO: 133462 - protein, 10 aa, Artificial Sequence
  Description of Artificial Sequence: Synthetic peptide
  Seed: SAEILQAVPS (PMEL_HUMAN)
SYEILQAVPA

SEQ ID NO: 133463 - protein, 9 aa, Artificial Sequence
  Description of Artificial Sequence: Synthetic peptide
  Seed: LSIGTGRAM (PMEL_HUMAN)
LYIGTGRAF

SEQ ID NO: 133464 - protein, 10 aa, Artificial Sequence
  Description of Artificial Sequence: Synthetic peptide
  Seed: SSSHWLRLPR (PMEL_HUMAN)
SYSHWLRLPR

SEQ ID NO: 133465 - protein, 9 aa, Artificial Sequence
  Description of Artificial Sequence: Synthetic peptide
  Seed: SLADTNSLA (PMEL_HUMAN)
SVADTNSLV

SEQ ID NO: 133466 - protein, 9 aa, Artificial Sequence
  Description of Artificial Sequence: Synthetic peptide
  Seed: RALVVTHTY (PMEL_HUMAN)
RVLVVTHTY

SEQ ID NO: 133467 - protein, 10 aa, Artificial Sequence
  Description of Artificial Sequence: Synthetic peptide
  Seed: RGSRSYVPLA (PMEL_HUMAN)
RGSRSYVPLV

SEQ ID NO: 133468 - protein, 9 aa, Artificial Sequence
  Description of Artificial Sequence: Synthetic peptide
  Seed: LYPEWTEAQ (PMEL_HUMAN)
LWPEWTEAY

SEQ ID NO: 133469 - protein, 9 aa, Artificial Sequence
  Description of Artificial Sequence: Synthetic peptide
  Seed: TAPVQMPTA (PMEL_HUMAN)
TPPVQMPTA

SEQ ID NO: 133470 - protein, 8 aa, Artificial Sequence
  Description of Artificial Sequence: Synthetic peptide
  Seed: FGDSSGTL (PMEL_HUMAN)
FYDSSGTF

SEQ ID NO: 133471 - protein, 9 aa, Artificial Sequence
  Description of Artificial Sequence: Synthetic peptide
  Seed: ISRALVVTH (PMEL_HUMAN)
IMRALVVTF

SEQ ID NO: 133472 - protein, 9 aa, Artificial Sequence
  Description of Artificial Sequence: Synthetic peptide
  Seed: FSVSVSQLR (PMEL_HUMAN)
FMVSVSQLR

SEQ ID NO: 133473 - protein, 9 aa, Artificial Sequence
  Description of Artificial Sequence: Synthetic peptide
  Seed: MSTPEATGM (PMEL_HUMAN)
MVTPEATGW

SEQ ID NO: 133474 - protein, 10 aa, Artificial Sequence
  Description of Artificial Sequence: Synthetic peptide
  Seed: RRLMKQDFSV (PMEL_HUMAN)
RALMKQDFSV

SEQ ID NO: 133475 - protein, 10 aa, Artificial Sequence
  Description of Artificial Sequence: Synthetic peptide
  Seed: RQLYPEWTEA (PMEL_HUMAN)
RQLYPEWTEV

SEQ ID NO: 133476 - protein, 11 aa, Artificial Sequence
  Description of Artificial Sequence: Synthetic peptide
  Seed: TEWVETTAREL (PMEL_HUMAN)
TEWVETTAREW

SEQ ID NO: 133477 - protein, 10 aa, Artificial Sequence
  Description of Artificial Sequence: Synthetic peptide
  Seed: THTMEVTVYH (PMEL_HUMAN)
TRTMEVTVYR

SEQ ID NO: 133478 - protein, 9 aa, Artificial Sequence
  Description of Artificial Sequence: Synthetic peptide
  Seed: TLIGANASF (PMEL_HUMAN)
TVIGANASL

SEQ ID NO: 133479 - protein, 10 aa, Artificial Sequence
  Description of Artificial Sequence: Synthetic peptide
  Seed: MAVVLASLIY (PMEL_HUMAN)
MQVVLASLIW

SEQ ID NO: 133480 - protein, 10 aa, Artificial Sequence
  Description of Artificial Sequence: Synthetic peptide
  Seed: RQLRTKAWNR (PMEL_HUMAN)
RWLRTKAWNR

SEQ ID NO: 133481 - protein, 9 aa, Artificial Sequence
  Description of Artificial Sequence: Synthetic peptide
  Seed: TLISRALVV (PMEL_HUMAN)
TSISRALVL

SEQ ID NO: 133482 - protein, 9 aa, Artificial Sequence
  Description of Artificial Sequence: Synthetic peptide
  Seed: LPHSSSHWL (PMEL_HUMAN)
LPHSSSHWA

SEQ ID NO: 133483 - protein, 9 aa, Artificial Sequence
  Description of Artificial Sequence: Synthetic peptide
  Seed: YLAEADLSY (PMEL_HUMAN)
YYAEADLSW

SEQ ID NO: 133484 - protein, 10 aa, Artificial Sequence
  Description of Artificial Sequence: Synthetic peptide
  Seed: ESAEILQAVP (PMEL_HUMAN)
ETAEILQAVI

SEQ ID NO: 133485 - protein, 9 aa, Artificial Sequence
  Description of Artificial Sequence: Synthetic peptide
  Seed: YLAEADLSY (PMEL_HUMAN)
YIAEADLSV

SEQ ID NO: 133486 - protein, 10 aa, Artificial Sequence
  Description of Artificial Sequence: Synthetic peptide
  Seed: RGSRSYVPLA (PMEL_HUMAN)
RRSRSYVPLM

SEQ ID NO: 133487 - protein, 10 aa, Artificial Sequence
  Description of Artificial Sequence: Synthetic peptide
  Seed: YRYGSFSVTL (PMEL_HUMAN)
YCYGSFSVTW

SEQ ID NO: 133488 - protein, 8 aa, Artificial Sequence
  Description of Artificial Sequence: Synthetic peptide
  Seed: SNDGPTLI (PMEL_HUMAN)
STDGPTLI

SEQ ID NO: 133489 - protein, 9 aa, Artificial Sequence
  Description of Artificial Sequence: Synthetic peptide
  Seed: AHSSSAFTI (PMEL_HUMAN)
AMSSSAFTY

SEQ ID NO: 133490 - protein, 9 aa, Artificial Sequence
  Description of Artificial Sequence: Synthetic peptide
  Seed: SRALVVTHT (PMEL_HUMAN)
SRALVVTHM

SEQ ID NO: 133491 - protein, 9 aa, Artificial Sequence
  Description of Artificial Sequence: Synthetic peptide
  Seed: VQVPTTEVI (PMEL_HUMAN)
VSVPTTEVM

SEQ ID NO: 133492 - protein, 9 aa, Artificial Sequence
  Description of Artificial Sequence: Synthetic peptide
  Seed: KHFLRNQPL (PMEL_HUMAN)
KLFLRNQPF

SEQ ID NO: 133493 - protein, 9 aa, Artificial Sequence
  Description of Artificial Sequence: Synthetic peptide
  Seed: FGDSSGTLI (PMEL_HUMAN)
FNDSSGTLI

SEQ ID NO: 133494 - protein, 9 aa, Artificial Sequence
  Description of Artificial Sequence: Synthetic peptide
  Seed: LPDGQVIWV (PMEL_HUMAN)
LSDGQVIWL

SEQ ID NO: 133495 - protein, 10 aa, Artificial Sequence
  Description of Artificial Sequence: Synthetic peptide
  Seed: AVIGALLAVG (PMEL_HUMAN)
AVIGALLAVE

SEQ ID NO: 133496 - protein, 10 aa, Artificial Sequence
  Description of Artificial Sequence: Synthetic peptide
  Seed: WKTWGQYWQV (PMEL_HUMAN)
WITWGQYWQV

SEQ ID NO: 133497 - protein, 9 aa, Artificial Sequence
  Description of Artificial Sequence: Synthetic peptide
  Seed: RGSRSYVPL (PMEL_HUMAN)
RQSRSYVPK

SEQ ID NO: 133498 - protein, 9 aa, Artificial Sequence
  Description of Artificial Sequence: Synthetic peptide
  Seed: GQVPTTEVV (PMEL_HUMAN)
GHVPTTEVV

SEQ ID NO: 133499 - protein, 10 aa, Artificial Sequence
  Description of Artificial Sequence: Synthetic peptide
  Seed: VYHRRGSRSY (PMEL_HUMAN)
VQHRRGSRSM

SEQ ID NO: 133500 - protein, 9 aa, Artificial Sequence
  Description of Artificial Sequence: Synthetic peptide
  Seed: MTPAEVSIV (PMEL_HUMAN)
MTPAEVSIL

SEQ ID NO: 133501 - protein, 10 aa, Artificial Sequence
  Description of Artificial Sequence: Synthetic peptide
  Seed: SLIYRRRLMK (PMEL_HUMAN)
SMIYRRRLMY

SEQ ID NO: 133502 - protein, 9 aa, Artificial Sequence
  Description of Artificial Sequence: Synthetic peptide
  Seed: HTMEVTVYH (PMEL_HUMAN)
HQMEVTVYR

SEQ ID NO: 133503 - protein, 9 aa, Artificial Sequence
  Description of Artificial Sequence: Synthetic peptide
  Seed: VVLQAAIPL (PMEL_HUMAN)
VELQAAIPY

SEQ ID NO: 133504 - protein, 8 aa, Artificial Sequence
  Description of Artificial Sequence: Synthetic peptide
  Seed: YRYGSFSV (PMEL_HUMAN)
YRYGSFSL

SEQ ID NO: 133505 - protein, 10 aa, Artificial Sequence
  Description of Artificial Sequence: Synthetic peptide
  Seed: EVISTAPVQM (PMEL_HUMAN)
EVISTAPVQV

SEQ ID NO: 133506 - protein, 9 aa, Artificial Sequence
  Description of Artificial Sequence: Synthetic peptide
  Seed: ITDQVPFSV (PMEL_HUMAN)
IFDQVPFSM

SEQ ID NO: 133507 - protein, 10 aa, Artificial Sequence
  Description of Artificial Sequence: Synthetic peptide
  Seed: TYLEPGPVTA (PMEL_HUMAN)
TYLEPGPVTM

SEQ ID NO: 133508 - protein, 9 aa, Artificial Sequence
  Description of Artificial Sequence: Synthetic peptide
  Seed: EGDAFELTV (PMEL_HUMAN)
EIDAFELTL

SEQ ID NO: 133509 - protein, 9 aa, Artificial Sequence
  Description of Artificial Sequence: Synthetic peptide
  Seed: LAVVSTQLI (PMEL_HUMAN)
LQVVSTQLV

SEQ ID NO: 133510 - protein, 9 aa, Artificial Sequence
  Description of Artificial Sequence: Synthetic peptide
  Seed: LADTNSLAV (PMEL_HUMAN)
LYDTNSLAI

SEQ ID NO: 133511 - protein, 9 aa, Artificial Sequence
  Description of Artificial Sequence: Synthetic peptide
  Seed: WQVLGGPVS (PMEL_HUMAN)
WMVLGGPVI

SEQ ID NO: 133512 - protein, 10 aa, Artificial Sequence
  Description of Artificial Sequence: Synthetic peptide
  Seed: RALVVTHTYL (PMEL_HUMAN)
RTLVVTHTYW

SEQ ID NO: 133513 - protein, 11 aa, Artificial Sequence
  Description of Artificial Sequence: Synthetic peptide
  Seed: RYGSFSVTLDI (PMEL_HUMAN)
RAGSFSVTLDW

SEQ ID NO: 133514 - protein, 9 aa, Artificial Sequence
  Description of Artificial Sequence: Synthetic peptide
  Seed: AVIGALLAV (PMEL_HUMAN)
AAIGALLAF

SEQ ID NO: 133515 - protein, 9 aa, Artificial Sequence
  Description of Artificial Sequence: Synthetic peptide
  Seed: ASFSIALNF (PMEL_HUMAN)
AQFSIALNW

SEQ ID NO: 133516 - protein, 9 aa, Artificial Sequence
  Description of Artificial Sequence: Synthetic peptide
  Seed: FSVSVSQLR (PMEL_HUMAN)
FTVSVSQLM

SEQ ID NO: 133517 - protein, 9 aa, Artificial Sequence
  Description of Artificial Sequence: Synthetic peptide
  Seed: AVVSTQLIM (PMEL_HUMAN)
AQVSTQLIL

SEQ ID NO: 133518 - protein, 9 aa, Artificial Sequence
  Description of Artificial Sequence: Synthetic peptide
  Seed: LAVVSTQLI (PMEL_HUMAN)
LAVVSTQLL

SEQ ID NO: 133519 - protein, 8 aa, Artificial Sequence
  Description of Artificial Sequence: Synthetic peptide
  Seed: LLDGTATL (PMEL_HUMAN)
LYDGTATF

SEQ ID NO: 133520 - protein, 9 aa, Artificial Sequence
  Description of Artificial Sequence: Synthetic peptide
  Seed: LMAVVLASL (PMEL_HUMAN)
LTAVVLASL

SEQ ID NO: 133521 - protein, 9 aa, Artificial Sequence
  Description of Artificial Sequence: Synthetic peptide
  Seed: SSIMSTESI (PMEL_HUMAN)
SVIMSTESW

SEQ ID NO: 133522 - protein, 10 aa, Artificial Sequence
  Description of Artificial Sequence: Synthetic peptide
  Seed: YVWKTWGQYW (PMEL_HUMAN)
YSWKTWGQYF

SEQ ID NO: 133523 - protein, 8 aa, Artificial Sequence
  Description of Artificial Sequence: Synthetic peptide
  Seed: LADTNSLA (PMEL_HUMAN)
LIDTNSLI

SEQ ID NO: 133524 - protein, 10 aa, Artificial Sequence
  Description of Artificial Sequence: Synthetic peptide
  Seed: VPQLPHSSSH (PMEL_HUMAN)
VKQLPHSSSY

SEQ ID NO: 133525 - protein, 10 aa, Artificial Sequence
  Description of Artificial Sequence: Synthetic peptide
  Seed: AEVSIVVLSG (PMEL_HUMAN)
AEVSIVVLSF

SEQ ID NO: 133526 - protein, 9 aa, Artificial Sequence
  Description of Artificial Sequence: Synthetic peptide
  Seed: AVIGALLAV (PMEL_HUMAN)
ASIGALLAY

SEQ ID NO: 133527 - protein, 9 aa, Artificial Sequence
  Description of Artificial Sequence: Synthetic peptide
  Seed: YHRRGSRSY (PMEL_HUMAN)
YNRRGSRSY

SEQ ID NO: 133528 - protein, 9 aa, Artificial Sequence
  Description of Artificial Sequence: Synthetic peptide
  Seed: ASFSIALNF (PMEL_HUMAN)
AMFSIALNK

SEQ ID NO: 133529 - protein, 9 aa, Artificial Sequence
  Description of Artificial Sequence: Synthetic peptide
  Seed: QPVLPSPAC (PMEL_HUMAN)
QRVLPSPAA

SEQ ID NO: 133530 - protein, 9 aa, Artificial Sequence
  Description of Artificial Sequence: Synthetic peptide
  Seed: RALVVTHTY (PMEL_HUMAN)
RRLVVTHTL

SEQ ID NO: 133531 - protein, 10 aa, Artificial Sequence
  Description of Artificial Sequence: Synthetic peptide
  Seed: RGSRSYVPLA (PMEL_HUMAN)
RWSRSYVPLI

SEQ ID NO: 133532 - protein, 10 aa, Artificial Sequence
  Description of Artificial Sequence: Synthetic peptide
  Seed: VSLADTNSLA (PMEL_HUMAN)
VTLADTNSLI

SEQ ID NO: 133533 - protein, 9 aa, Artificial Sequence
  Description of Artificial Sequence: Synthetic peptide
  Seed: QVWGGQPVY (PMEL_HUMAN)
QTWGGQPVR

SEQ ID NO: 133534 - protein, 11 aa, Artificial Sequence
  Description of Artificial Sequence: Synthetic peptide
  Seed: VQMPTAESTGM (PMEL_HUMAN)
VVMPTAESTGY

SEQ ID NO: 133535 - protein, 9 aa, Artificial Sequence
  Description of Artificial Sequence: Synthetic peptide
  Seed: RNQPLTFAL (PMEL_HUMAN)
RHQPLTFAL

SEQ ID NO: 133536 - protein, 10 aa, Artificial Sequence
  Description of Artificial Sequence: Synthetic peptide
  Seed: MAVVLASLIY (PMEL_HUMAN)
MYVVLASLIY

SEQ ID NO: 133537 - protein, 10 aa, Artificial Sequence
  Description of Artificial Sequence: Synthetic peptide
  Seed: APTAEPSGTT (PMEL_HUMAN)
APTAEPSGTA

SEQ ID NO: 133538 - protein, 10 aa, Artificial Sequence
  Description of Artificial Sequence: Synthetic peptide
  Seed: RALVVTHTYL (PMEL_HUMAN)
RSLVVTHTYL

SEQ ID NO: 133539 - protein, 9 aa, Artificial Sequence
  Description of Artificial Sequence: Synthetic peptide
  Seed: DAFELTVSC (PMEL_HUMAN)
DGFELTVSV

SEQ ID NO: 133540 - protein, 11 aa, Artificial Sequence
  Description of Artificial Sequence: Synthetic peptide
  Seed: AESTGMTPEKV (PMEL_HUMAN)
AESTGMTPEKY

SEQ ID NO: 133541 - protein, 9 aa, Artificial Sequence
  Description of Artificial Sequence: Synthetic peptide
  Seed: LTVSCQGGL (PMEL_HUMAN)
LMVSCQGGV

SEQ ID NO: 133542 - protein, 9 aa, Artificial Sequence
  Description of Artificial Sequence: Synthetic peptide
  Seed: MPTAESTGM (PMEL_HUMAN)
MLTAESTGF

SEQ ID NO: 133543 - protein, 9 aa, Artificial Sequence
  Description of Artificial Sequence: Synthetic peptide
  Seed: TPAEVSIVV (PMEL_HUMAN)
TAAEVSIVF

SEQ ID NO: 133544 - protein, 9 aa, Artificial Sequence
  Description of Artificial Sequence: Synthetic peptide
  Seed: VTLDIVQGI (PMEL_HUMAN)
VALDIVQGF

SEQ ID NO: 133545 - protein, 11 aa, Artificial Sequence
  Description of Artificial Sequence: Synthetic peptide
  Seed: APVQMPTAEST (PMEL_HUMAN)
APVQMPTAESA

SEQ ID NO: 133546 - protein, 9 aa, Artificial Sequence
  Description of Artificial Sequence: Synthetic peptide
  Seed: SLGPLLDGT (PMEL_HUMAN)
SLGPLLDGA

SEQ ID NO: 133547 - protein, 9 aa, Artificial Sequence
  Description of Artificial Sequence: Synthetic peptide
  Seed: WQVLGGPVS (PMEL_HUMAN)
WSVLGGPVF

SEQ ID NO: 133548 - protein, 10 aa, Artificial Sequence
  Description of Artificial Sequence: Synthetic peptide
  Seed: YLAEADLSYT (PMEL_HUMAN)
YMAEADLSYA

SEQ ID NO: 133549 - protein, 10 aa, Artificial Sequence
  Description of Artificial Sequence: Synthetic peptide
  Seed: RGSRSYVPLA (PMEL_HUMAN)
RQSRSYVPLI

SEQ ID NO: 133550 - protein, 10 aa, Artificial Sequence
  Description of Artificial Sequence: Synthetic peptide
  Seed: SQKRSFVYVW (PMEL_HUMAN)
SSKRSFVYVF

SEQ ID NO: 133551 - protein, 10 aa, Artificial Sequence
  Description of Artificial Sequence: Synthetic peptide
  Seed: QVPLDCVLYR (PMEL_HUMAN)
QYPLDCVLYR

SEQ ID NO: 133552 - protein, 10 aa, Artificial Sequence
  Description of Artificial Sequence: Synthetic peptide
  Seed: SCPIGENSPL (PMEL_HUMAN)
SEPIGENSPL

SEQ ID NO: 133553 - protein, 9 aa, Artificial Sequence
  Description of Artificial Sequence: Synthetic peptide
  Seed: VWKTWGQYW (PMEL_HUMAN)
VFKTWGQYF

SEQ ID NO: 133554 - protein, 9 aa, Artificial Sequence
  Description of Artificial Sequence: Synthetic peptide
  Seed: SQVWGGQPV (PMEL_HUMAN)
SIVWGGQPF

SEQ ID NO: 133555 - protein, 10 aa, Artificial Sequence
  Description of Artificial Sequence: Synthetic peptide
  Seed: TPAEVSIVVL (PMEL_HUMAN)
TPAEVSIVVA

SEQ ID NO: 133556 - protein, 9 aa, Artificial Sequence
  Description of Artificial Sequence: Synthetic peptide
  Seed: AVVSTQLIM (PMEL_HUMAN)
AAVSTQLIM

SEQ ID NO: 133557 - protein, 9 aa, Artificial Sequence
  Description of Artificial Sequence: Synthetic peptide
  Seed: KTWGQYWQV (PMEL_HUMAN)
KQWGQYWQW

SEQ ID NO: 133558 - protein, 11 aa, Artificial Sequence
  Description of Artificial Sequence: Synthetic peptide
  Seed: RPTAEAPNTTA (PMEL_HUMAN)
RPTAEAPNTTI

SEQ ID NO: 133559 - protein, 9 aa, Artificial Sequence
  Description of Artificial Sequence: Synthetic peptide
  Seed: GTYCLNVSL (PMEL_HUMAN)
GTYCLNVSV

SEQ ID NO: 133560 - protein, 11 aa, Artificial Sequence
  Description of Artificial Sequence: Synthetic peptide
  Seed: TLIGANASFSI (PMEL_HUMAN)
TLIGANASFSL

SEQ ID NO: 133561 - protein, 9 aa, Artificial Sequence
  Description of Artificial Sequence: Synthetic peptide
  Seed: VLPDGQVIW (PMEL_HUMAN)
VLPDGQVIV

SEQ ID NO: 133562 - protein, 8 aa, Artificial Sequence
  Description of Artificial Sequence: Synthetic peptide
  Seed: LLDGTATL (PMEL_HUMAN)
LTDGTATL

SEQ ID NO: 133563 - protein, 10 aa, Artificial Sequence
  Description of Artificial Sequence: Synthetic peptide
  Seed: THTMEVTVYH (PMEL_HUMAN)
TMTMEVTVYY

SEQ ID NO: 133564 - protein, 9 aa, Artificial Sequence
  Description of Artificial Sequence: Synthetic peptide
  Seed: VPLDCVLYR (PMEL_HUMAN)
VYLDCVLYK

SEQ ID NO: 133565 - protein, 9 aa, Artificial Sequence
  Description of Artificial Sequence: Synthetic peptide
  Seed: CWRGGQVSL (PMEL_HUMAN)
CYRGGQVSI

SEQ ID NO: 133566 - protein, 10 aa, Artificial Sequence
  Description of Artificial Sequence: Synthetic peptide
  Seed: SLIYRRRLMK (PMEL_HUMAN)
SLIYRRRLMR

SEQ ID NO: 133567 - protein, 9 aa, Artificial Sequence
  Description of Artificial Sequence: Synthetic peptide
  Seed: AGQVPTTEV (PMEL_HUMAN)
ATQVPTTEF

SEQ ID NO: 133568 - protein, 9 aa, Artificial Sequence
  Description of Artificial Sequence: Synthetic peptide
  Seed: VLGGPVSGL (PMEL_HUMAN)
VMGGPVSGL

SEQ ID NO: 133569 - protein, 9 aa, Artificial Sequence
  Description of Artificial Sequence: Synthetic peptide
  Seed: TTDGHRPTA (PMEL_HUMAN)
TLDGHRPTI

SEQ ID NO: 133570 - protein, 10 aa, Artificial Sequence
  Description of Artificial Sequence: Synthetic peptide
  Seed: RTKAWNRQLY (PMEL_HUMAN)
RQKAWNRQLY

SEQ ID NO: 133571 - protein, 9 aa, Artificial Sequence
  Description of Artificial Sequence: Synthetic peptide
  Seed: TATLRLVKR (PMEL_HUMAN)
TYTLRLVKR

SEQ ID NO: 133572 - protein, 10 aa, Artificial Sequence
  Description of Artificial Sequence: Synthetic peptide
  Seed: VPLAHSSSAF (PMEL_HUMAN)
VFLAHSSSAY

SEQ ID NO: 133573 - protein, 8 aa, Artificial Sequence
  Description of Artificial Sequence: Synthetic peptide
  Seed: SIGTGRAM (PMEL_HUMAN)
SAGTGRAM

SEQ ID NO: 133574 - protein, 9 aa, Artificial Sequence
  Description of Artificial Sequence: Synthetic peptide
  Seed: DAFELTVSC (PMEL_HUMAN)
DPFELTVSF

SEQ ID NO: 133575 - protein, 10 aa, Artificial Sequence
  Description of Artificial Sequence: Synthetic peptide
  Seed: MTPAEVSIVV (PMEL_HUMAN)
MWPAEVSIVM

SEQ ID NO: 133576 - protein, 9 aa, Artificial Sequence
  Description of Artificial Sequence: Synthetic peptide
  Seed: AESTGMTPE (PMEL_HUMAN)
AESTGMTPV

SEQ ID NO: 133577 - protein, 11 aa, Artificial Sequence
  Description of Artificial Sequence: Synthetic peptide
  Seed: QAVPSGEGDAF (PMEL_HUMAN)
QSVPSGEGDAW

SEQ ID NO: 133578 - protein, 11 aa, Artificial Sequence
  Description of Artificial Sequence: Synthetic peptide
  Seed: QPVLPSPACQL (PMEL_HUMAN)
QPVLPSPACQM

SEQ ID NO: 133579 - protein, 9 aa, Artificial Sequence
  Description of Artificial Sequence: Synthetic peptide
  Seed: TLISRALVV (PMEL_HUMAN)
TAISRALVI

SEQ ID NO: 133580 - protein, 10 aa, Artificial Sequence
  Description of Artificial Sequence: Synthetic peptide
  Seed: SGTYCLNVSL (PMEL_HUMAN)
SKTYCLNVSY

SEQ ID NO: 133581 - protein, 10 aa, Artificial Sequence
  Description of Artificial Sequence: Synthetic peptide
  Seed: YRYGSFSVTL (PMEL_HUMAN)
YAYGSFSVTY

SEQ ID NO: 133582 - protein, 10 aa, Artificial Sequence
  Description of Artificial Sequence: Synthetic peptide
  Seed: SGTYCLNVSL (PMEL_HUMAN)
STTYCLNVSI

SEQ ID NO: 133583 - protein, 9 aa, Artificial Sequence
  Description of Artificial Sequence: Synthetic peptide
  Seed: VLMAVVLAS (PMEL_HUMAN)
VMMAVVLAA

SEQ ID NO: 133584 - protein, 9 aa, Artificial Sequence
  Description of Artificial Sequence: Synthetic peptide
  Seed: WSQKRSFVY (PMEL_HUMAN)
WEQKRSFVY

SEQ ID NO: 133585 - protein, 9 aa, Artificial Sequence
  Description of Artificial Sequence: Synthetic peptide
  Seed: GSFSVTLDI (PMEL_HUMAN)
GVFSVTLDL

SEQ ID NO: 133586 - protein, 9 aa, Artificial Sequence
  Description of Artificial Sequence: Synthetic peptide
  Seed: YVWKTWGQY (PMEL_HUMAN)
YKWKTWGQY

SEQ ID NO: 133587 - protein, 10 aa, Artificial Sequence
  Description of Artificial Sequence: Synthetic peptide
  Seed: LQLHDPSGYL (PMEL_HUMAN)
LALHDPSGYV

SEQ ID NO: 133588 - protein, 9 aa, Artificial Sequence
  Description of Artificial Sequence: Synthetic peptide
  Seed: AVIGALLAV (PMEL_HUMAN)
AGIGALLAY

SEQ ID NO: 133589 - protein, 10 aa, Artificial Sequence
  Description of Artificial Sequence: Synthetic peptide
  Seed: LAVGATKVPR (PMEL_HUMAN)
LAVGATKVPY

SEQ ID NO: 133590 - protein, 9 aa, Artificial Sequence
  Description of Artificial Sequence: Synthetic peptide
  Seed: YLAEADLSY (PMEL_HUMAN)
YVAEADLSR

SEQ ID NO: 133591 - protein, 9 aa, Artificial Sequence
  Description of Artificial Sequence: Synthetic peptide
  Seed: IVVLSGTTA (PMEL_HUMAN)
IPVLSGTTT

SEQ ID NO: 133592 - protein, 9 aa, Artificial Sequence
  Description of Artificial Sequence: Synthetic peptide
  Seed: SFVYVWKTW (PMEL_HUMAN)
SYVYVWKTL

SEQ ID NO: 133593 - protein, 9 aa, Artificial Sequence
  Description of Artificial Sequence: Synthetic peptide
  Seed: AQRLCQPVL (PMEL_HUMAN)
ATRLCQPVY

SEQ ID NO: 133594 - protein, 9 aa, Artificial Sequence
  Description of Artificial Sequence: Synthetic peptide
  Seed: TAQVVLQAA (PMEL_HUMAN)
TPQVVLQAI

SEQ ID NO: 133595 - protein, 10 aa, Artificial Sequence
  Description of Artificial Sequence: Synthetic peptide
  Seed: SGTYCLNVSL (PMEL_HUMAN)
SKTYCLNVSF

SEQ ID NO: 133596 - protein, 10 aa, Artificial Sequence
  Description of Artificial Sequence: Synthetic peptide
  Seed: VPQLPHSSSH (PMEL_HUMAN)
VGQLPHSSSY

SEQ ID NO: 133597 - protein, 9 aa, Artificial Sequence
  Description of Artificial Sequence: Synthetic peptide
  Seed: YLEPGPVTA (PMEL_HUMAN)
YTEPGPVTM

SEQ ID NO: 133598 - protein, 11 aa, Artificial Sequence
  Description of Artificial Sequence: Synthetic peptide
  Seed: SYVPLAHSSSA (PMEL_HUMAN)
SKVPLAHSSSL

SEQ ID NO: 133599 - protein, 10 aa, Artificial Sequence
  Description of Artificial Sequence: Synthetic peptide
  Seed: LQLHDPSGYL (PMEL_HUMAN)
LVLHDPSGYY

SEQ ID NO: 133600 - protein, 10 aa, Artificial Sequence
  Description of Artificial Sequence: Synthetic peptide
  Seed: ASSIMSTESI (PMEL_HUMAN)
AWSIMSTESF

SEQ ID NO: 133601 - protein, 9 aa, Artificial Sequence
  Description of Artificial Sequence: Synthetic peptide
  Seed: RTKAWNRQL (PMEL_HUMAN)
RLKAWNRQV

SEQ ID NO: 133602 - protein, 10 aa, Artificial Sequence
  Description of Artificial Sequence: Synthetic peptide
  Seed: EVISTAPVQM (PMEL_HUMAN)
EVISTAPVQW

SEQ ID NO: 133603 - protein, 9 aa, Artificial Sequence
  Description of Artificial Sequence: Synthetic peptide
  Seed: RTKAWNRQL (PMEL_HUMAN)
RSKAWNRQL

SEQ ID NO: 133604 - protein, 10 aa, Artificial Sequence
  Description of Artificial Sequence: Synthetic peptide
  Seed: AVVLASLIYR (PMEL_HUMAN)
ADVLASLIYK

SEQ ID NO: 133605 - protein, 10 aa, Artificial Sequence
  Description of Artificial Sequence: Synthetic peptide
  Seed: SQVWGGQPVY (PMEL_HUMAN)
SVVWGGQPVY

SEQ ID NO: 133606 - protein, 9 aa, Artificial Sequence
  Description of Artificial Sequence: Synthetic peptide
  Seed: AVIGALLAV (PMEL_HUMAN)
APIGALLAY

SEQ ID NO: 133607 - protein, 9 aa, Artificial Sequence
  Description of Artificial Sequence: Synthetic peptide
  Seed: KHFLRNQPL (PMEL_HUMAN)
KLFLRNQPY

SEQ ID NO: 133608 - protein, 9 aa, Artificial Sequence
  Description of Artificial Sequence: Synthetic peptide
  Seed: IYRRRLMKQ (PMEL_HUMAN)
ITRRRLMKL

SEQ ID NO: 133609 - protein, 9 aa, Artificial Sequence
  Description of Artificial Sequence: Synthetic peptide
  Seed: YVWKTWGQY (PMEL_HUMAN)
YPWKTWGQF

SEQ ID NO: 133610 - protein, 10 aa, Artificial Sequence
  Description of Artificial Sequence: Synthetic peptide
  Seed: SGTYCLNVSL (PMEL_HUMAN)
SNTYCLNVSW

SEQ ID NO: 133611 - protein, 10 aa, Artificial Sequence
  Description of Artificial Sequence: Synthetic peptide
  Seed: YLAEADLSYT (PMEL_HUMAN)
YQAEADLSYY

SEQ ID NO: 133612 - protein, 10 aa, Artificial Sequence
  Description of Artificial Sequence: Synthetic peptide
  Seed: LVLMAVVLAS (PMEL_HUMAN)
LILMAVVLAA

SEQ ID NO: 133613 - protein, 9 aa, Artificial Sequence
  Description of Artificial Sequence: Synthetic peptide
  Seed: RLMKQDFSV (PMEL_HUMAN)
RSMKQDFSF

SEQ ID NO: 133614 - protein, 9 aa, Artificial Sequence
  Description of Artificial Sequence: Synthetic peptide
  Seed: VQMPTAEST (PMEL_HUMAN)
VRMPTAESM

SEQ ID NO: 133615 - protein, 9 aa, Artificial Sequence
  Description of Artificial Sequence: Synthetic peptide
  Seed: FLRNQPLTF (PMEL_HUMAN)
FHRNQPLTY

SEQ ID NO: 133616 - protein, 10 aa, Artificial Sequence
  Description of Artificial Sequence: Synthetic peptide
  Seed: VLMAVVLASL (PMEL_HUMAN)
VEMAVVLASA

SEQ ID NO: 133617 - protein, 9 aa, Artificial Sequence
  Description of Artificial Sequence: Synthetic peptide
  Seed: LSIGTGRAM (PMEL_HUMAN)
LTIGTGRAY

SEQ ID NO: 133618 - protein, 11 aa, Artificial Sequence
  Description of Artificial Sequence: Synthetic peptide
  Seed: HQILKGGSGTY (PMEL_HUMAN)
HMILKGGSGTY

SEQ ID NO: 133619 - protein, 9 aa, Artificial Sequence
  Description of Artificial Sequence: Synthetic peptide
  Seed: GTYCLNVSL (PMEL_HUMAN)
GIYCLNVSL

SEQ ID NO: 133620 - protein, 9 aa, Artificial Sequence
  Description of Artificial Sequence: Synthetic peptide
  Seed: SLGPLLDGT (PMEL_HUMAN)
SIGPLLDGL

SEQ ID NO: 133621 - protein, 8 aa, Artificial Sequence
  Description of Artificial Sequence: Synthetic peptide
  Seed: LHDPSGYL (PMEL_HUMAN)
LIDPSGYL

SEQ ID NO: 133622 - protein, 11 aa, Artificial Sequence
  Description of Artificial Sequence: Synthetic peptide
  Seed: HQILKGGSGTY (PMEL_HUMAN)
HEILKGGSGTY

SEQ ID NO: 133623 - protein, 10 aa, Artificial Sequence
  Description of Artificial Sequence: Synthetic peptide
  Seed: LVLMAVVLAS (PMEL_HUMAN)
LALMAVVLAV

SEQ ID NO: 133624 - protein, 10 aa, Artificial Sequence
  Description of Artificial Sequence: Synthetic peptide
  Seed: SVTLDIVQGI (PMEL_HUMAN)
SYTLDIVQGV

SEQ ID NO: 133625 - protein, 9 aa, Artificial Sequence
  Description of Artificial Sequence: Synthetic peptide
  Seed: SQKRSFVYV (PMEL_HUMAN)
SIKRSFVYM

SEQ ID NO: 133626 - protein, 9 aa, Artificial Sequence
  Description of Artificial Sequence: Synthetic peptide
  Seed: TLISRALVV (PMEL_HUMAN)
TMISRALVV

SEQ ID NO: 133627 - protein, 9 aa, Artificial Sequence
  Description of Artificial Sequence: Synthetic peptide
  Seed: MAVVLASLI (PMEL_HUMAN)
MPVVLASLI

SEQ ID NO: 133628 - protein, 9 aa, Artificial Sequence
  Description of Artificial Sequence: Synthetic peptide
  Seed: RAMLGTHTM (PMEL_HUMAN)
RAMLGTHTH

SEQ ID NO: 133629 - protein, 10 aa, Artificial Sequence
  Description of Artificial Sequence: Synthetic peptide
  Seed: KVLPDGQVIW (PMEL_HUMAN)
KMLPDGQVIM

SEQ ID NO: 133630 - protein, 10 aa, Artificial Sequence
  Description of Artificial Sequence: Synthetic peptide
  Seed: VLASLIYRRR (PMEL_HUMAN)
VYASLIYRRR

SEQ ID NO: 133631 - protein, 9 aa, Artificial Sequence
  Description of Artificial Sequence: Synthetic peptide
  Seed: AVIGALLAV (PMEL_HUMAN)
AMIGALLAC

SEQ ID NO: 133632 - protein, 10 aa, Artificial Sequence
  Description of Artificial Sequence: Synthetic peptide
  Seed: AVIGALLAVG (PMEL_HUMAN)
AVIGALLAVM

SEQ ID NO: 133633 - protein, 10 aa, Artificial Sequence
  Description of Artificial Sequence: Synthetic peptide
  Seed: SSSHWLRLPR (PMEL_HUMAN)
STSHWLRLPY

SEQ ID NO: 133634 - protein, 10 aa, Artificial Sequence
  Description of Artificial Sequence: Synthetic peptide
  Seed: LIVGILLVLM (PMEL_HUMAN)
LMVGILLVLV

SEQ ID NO: 133635 - protein, 10 aa, Artificial Sequence
  Description of Artificial Sequence: Synthetic peptide
  Seed: VTAQVVLQAA (PMEL_HUMAN)
VIAQVVLQAI

SEQ ID NO: 133636 - protein, 9 aa, Artificial Sequence
  Description of Artificial Sequence: Synthetic peptide
  Seed: VPQLPHSSS (PMEL_HUMAN)
VPQLPHSSC

SEQ ID NO: 133637 - protein, 9 aa, Artificial Sequence
  Description of Artificial Sequence: Synthetic peptide
  Seed: LLHLAVIGA (PMEL_HUMAN)
LMHLAVIGV

SEQ ID NO: 133638 - protein, 9 aa, Artificial Sequence
  Description of Artificial Sequence: Synthetic peptide
  Seed: LPDGQVIWV (PMEL_HUMAN)
LWDGQVIWM

SEQ ID NO: 133639 - protein, 10 aa, Artificial Sequence
  Description of Artificial Sequence: Synthetic peptide
  Seed: YRYGSFSVTL (PMEL_HUMAN)
YKYGSFSVTW

SEQ ID NO: 133640 - protein, 8 aa, Artificial Sequence
  Description of Artificial Sequence: Synthetic peptide
  Seed: QDFSVPQL (PMEL_HUMAN)
QEFSVPQM

SEQ ID NO: 133641 - protein, 9 aa, Artificial Sequence
  Description of Artificial Sequence: Synthetic peptide
  Seed: VLASLIYRR (PMEL_HUMAN)
VYASLIYRR

SEQ ID NO: 133642 - protein, 9 aa, Artificial Sequence
  Description of Artificial Sequence: Synthetic peptide
  Seed: RALVVTHTY (PMEL_HUMAN)
RALVVTHTI

SEQ ID NO: 133643 - protein, 9 aa, Artificial Sequence
  Description of Artificial Sequence: Synthetic peptide
  Seed: WQVLGGPVS (PMEL_HUMAN)
WMVLGGPVF

SEQ ID NO: 133644 - protein, 9 aa, Artificial Sequence
  Description of Artificial Sequence: Synthetic peptide
  Seed: ALDGGNKHF (PMEL_HUMAN)
AQDGGNKHW

SEQ ID NO: 133645 - protein, 8 aa, Artificial Sequence
  Description of Artificial Sequence: Synthetic peptide
  Seed: LADTNSLA (PMEL_HUMAN)
LSDTNSLV

SEQ ID NO: 133646 - protein, 9 aa, Artificial Sequence
  Description of Artificial Sequence: Synthetic peptide
  Seed: MTPEKVPVS (PMEL_HUMAN)
MCPEKVPVF

SEQ ID NO: 133647 - protein, 9 aa, Artificial Sequence
  Description of Artificial Sequence: Synthetic peptide
  Seed: RQVPLDCVL (PMEL_HUMAN)
REVPLDCVV

SEQ ID NO: 133648 - protein, 9 aa, Artificial Sequence
  Description of Artificial Sequence: Synthetic peptide
  Seed: ANASFSIAL (PMEL_HUMAN)
AFASFSIAF

SEQ ID NO: 133649 - protein, 10 aa, Artificial Sequence
  Description of Artificial Sequence: Synthetic peptide
  Seed: RQLRTKAWNR (PMEL_HUMAN)
RLLRTKAWNR

SEQ ID NO: 133650 - protein, 10 aa, Artificial Sequence
  Description of Artificial Sequence: Synthetic peptide
  Seed: VSLADTNSLA (PMEL_HUMAN)
VTLADTNSLL

SEQ ID NO: 133651 - protein, 9 aa, Artificial Sequence
  Description of Artificial Sequence: Synthetic peptide
  Seed: YLEPGPVTA (PMEL_HUMAN)
YLEPGPVTR

SEQ ID NO: 133652 - protein, 11 aa, Artificial Sequence
  Description of Artificial Sequence: Synthetic peptide
  Seed: FSVTLDIVQGI (PMEL_HUMAN)
FMVTLDIVQGM

SEQ ID NO: 133653 - protein, 9 aa, Artificial Sequence
  Description of Artificial Sequence: Synthetic peptide
  Seed: SLAVVSTQL (PMEL_HUMAN)
STAVVSTQR

SEQ ID NO: 133654 - protein, 9 aa, Artificial Sequence
  Description of Artificial Sequence: Synthetic peptide
  Seed: KHFLRNQPL (PMEL_HUMAN)
KFFLRNQPV

SEQ ID NO: 133655 - protein, 10 aa, Artificial Sequence
  Description of Artificial Sequence: Synthetic peptide
  Seed: GQVPLIVGIL (PMEL_HUMAN)
GMVPLIVGIV

SEQ ID NO: 133656 - protein, 9 aa, Artificial Sequence
  Description of Artificial Sequence: Synthetic peptide
  Seed: RSYVPLAHS (PMEL_HUMAN)
RTYVPLAHV

SEQ ID NO: 133657 - protein, 9 aa, Artificial Sequence
  Description of Artificial Sequence: Synthetic peptide
  Seed: RALVVTHTY (PMEL_HUMAN)
RFLVVTHTK

SEQ ID NO: 133658 - protein, 9 aa, Artificial Sequence
  Description of Artificial Sequence: Synthetic peptide
  Seed: RLMKQDFSV (PMEL_HUMAN)
RIMKQDFSL

SEQ ID NO: 133659 - protein, 9 aa, Artificial Sequence
  Description of Artificial Sequence: Synthetic peptide
  Seed: ALDGGNKHF (PMEL_HUMAN)
AMDGGNKHF

SEQ ID NO: 133660 - protein, 9 aa, Artificial Sequence
  Description of Artificial Sequence: Synthetic peptide
  Seed: RAMLGTHTM (PMEL_HUMAN)
RYMLGTHTA

SEQ ID NO: 133661 - protein, 10 aa, Artificial Sequence
  Description of Artificial Sequence: Synthetic peptide
  Seed: SLADTNSLAV (PMEL_HUMAN)
SMADTNSLAL

SEQ ID NO: 133662 - protein, 9 aa, Artificial Sequence
  Description of Artificial Sequence: Synthetic peptide
  Seed: SVPQLPHSS (PMEL_HUMAN)
SAPQLPHSI

SEQ ID NO: 133663 - protein, 9 aa, Artificial Sequence
  Description of Artificial Sequence: Synthetic peptide
  Seed: VSLADTNSL (PMEL_HUMAN)
VSLADTNSF

SEQ ID NO: 133664 - protein, 9 aa, Artificial Sequence
  Description of Artificial Sequence: Synthetic peptide
  Seed: KQDFSVPQL (PMEL_HUMAN)
KGDFSVPQV

SEQ ID NO: 133665 - protein, 9 aa, Artificial Sequence
  Description of Artificial Sequence: Synthetic peptide
  Seed: FSIALNFPG (PMEL_HUMAN)
FAIALNFPF

SEQ ID NO: 133666 - protein, 11 aa, Artificial Sequence
  Description of Artificial Sequence: Synthetic peptide
  Seed: RALDGGNKHFL (PMEL_HUMAN)
RSLDGGNKHFW

SEQ ID NO: 133667 - protein, 9 aa, Artificial Sequence
  Description of Artificial Sequence: Synthetic peptide
  Seed: YLEPGPVTA (PMEL_HUMAN)
YTEPGPVTA

SEQ ID NO: 133668 - protein, 10 aa, Artificial Sequence
  Description of Artificial Sequence: Synthetic peptide
  Seed: MTPAEVSIVV (PMEL_HUMAN)
MEPAEVSIVL

SEQ ID NO: 133669 - protein, 10 aa, Artificial Sequence
  Description of Artificial Sequence: Synthetic peptide
  Seed: SVPQLPHSSS (PMEL_HUMAN)
SGPQLPHSSI

SEQ ID NO: 133670 - protein, 10 aa, Artificial Sequence
  Description of Artificial Sequence: Synthetic peptide
  Seed: MTPAEVSIVV (PMEL_HUMAN)
MRPAEVSIVT

SEQ ID NO: 133671 - protein, 9 aa, Artificial Sequence
  Description of Artificial Sequence: Synthetic peptide
  Seed: AVIGALLAV (PMEL_HUMAN)
ATIGALLAA

SEQ ID NO: 133672 - protein, 8 aa, Artificial Sequence
  Description of Artificial Sequence: Synthetic peptide
  Seed: SNDGPTLI (PMEL_HUMAN)
SLDGPTLM

SEQ ID NO: 133673 - protein, 9 aa, Artificial Sequence
  Description of Artificial Sequence: Synthetic peptide
  Seed: RYGSFSVTL (PMEL_HUMAN)
RWGSFSVTV

SEQ ID NO: 133674 - protein, 9 aa, Artificial Sequence
  Description of Artificial Sequence: Synthetic peptide
  Seed: ASFSIALNF (PMEL_HUMAN)
ATFSIALNL

SEQ ID NO: 133675 - protein, 9 aa, Artificial Sequence
  Description of Artificial Sequence: Synthetic peptide
  Seed: AEMSTPEAT (PMEL_HUMAN)
AEMSTPEAL

SEQ ID NO: 133676 - protein, 9 aa, Artificial Sequence
  Description of Artificial Sequence: Synthetic peptide
  Seed: VLPSPACQL (PMEL_HUMAN)
VTPSPACQM

SEQ ID NO: 133677 - protein, 8 aa, Artificial Sequence
  Description of Artificial Sequence: Synthetic peptide
  Seed: FSVSVSQL (PMEL_HUMAN)
FAVSVSQY

SEQ ID NO: 133678 - protein, 9 aa, Artificial Sequence
  Description of Artificial Sequence: Synthetic peptide
  Seed: LLAVGATKV (PMEL_HUMAN)
LLAVGATKL

SEQ ID NO: 133679 - protein, 9 aa, Artificial Sequence
  Description of Artificial Sequence: Synthetic peptide
  Seed: TTDGHRPTA (PMEL_HUMAN)
TIDGHRPTV

SEQ ID NO: 133680 - protein, 9 aa, Artificial Sequence
  Description of Artificial Sequence: Synthetic peptide
  Seed: KHFLRNQPL (PMEL_HUMAN)
KTFLRNQPM

SEQ ID NO: 133681 - protein, 9 aa, Artificial Sequence
  Description of Artificial Sequence: Synthetic peptide
  Seed: VLASLIYRR (PMEL_HUMAN)
VNASLIYRR

SEQ ID NO: 133682 - protein, 11 aa, Artificial Sequence
  Description of Artificial Sequence: Synthetic peptide
  Seed: HTMEVTVYHRR (PMEL_HUMAN)
HYMEVTVYHRR

SEQ ID NO: 133683 - protein, 9 aa, Artificial Sequence
  Description of Artificial Sequence: Synthetic peptide
  Seed: LADTNSLAV (PMEL_HUMAN)
LIDTNSLAM

SEQ ID NO: 133684 - protein, 8 aa, Artificial Sequence
  Description of Artificial Sequence: Synthetic peptide
  Seed: LIYRRRLM (PMEL_HUMAN)
LVYRRRLL

SEQ ID NO: 133685 - protein, 9 aa, Artificial Sequence
  Description of Artificial Sequence: Synthetic peptide
  Seed: SSHWLRLPR (PMEL_HUMAN)
SSHWLRLPV

SEQ ID NO: 133686 - protein, 9 aa, Artificial Sequence
  Description of Artificial Sequence: Synthetic peptide
  Seed: HTYLEPGPV (PMEL_HUMAN)
HTYLEPGPY

SEQ ID NO: 133687 - protein, 10 aa, Artificial Sequence
  Description of Artificial Sequence: Synthetic peptide
  Seed: SSAFTITDQV (PMEL_HUMAN)
SLAFTITDQI

SEQ ID NO: 133688 - protein, 10 aa, Artificial Sequence
  Description of Artificial Sequence: Synthetic peptide
  Seed: ELTVSCQGGL (PMEL_HUMAN)
EITVSCQGGV

SEQ ID NO: 133689 - protein, 10 aa, Artificial Sequence
  Description of Artificial Sequence: Synthetic peptide
  Seed: YGSFSVTLDI (PMEL_HUMAN)
YISFSVTLDF

SEQ ID NO: 133690 - protein, 10 aa, Artificial Sequence
  Description of Artificial Sequence: Synthetic peptide
  Seed: ESAEILQAVP (PMEL_HUMAN)
ETAEILQAVN

SEQ ID NO: 133691 - protein, 9 aa, Artificial Sequence
  Description of Artificial Sequence: Synthetic peptide
  Seed: FSIALNFPG (PMEL_HUMAN)
FSIALNFPY

SEQ ID NO: 133692 - protein, 9 aa, Artificial Sequence
  Description of Artificial Sequence: Synthetic peptide
  Seed: ASFSIALNF (PMEL_HUMAN)
ASFSIALNL

SEQ ID NO: 133693 - protein, 9 aa, Artificial Sequence
  Description of Artificial Sequence: Synthetic peptide
  Seed: ASFSIALNF (PMEL_HUMAN)
AWFSIALNF

SEQ ID NO: 133694 - protein, 9 aa, Artificial Sequence
  Description of Artificial Sequence: Synthetic peptide
  Seed: RYGSFSVTL (PMEL_HUMAN)
RFGSFSVTM

SEQ ID NO: 133695 - protein, 10 aa, Artificial Sequence
  Description of Artificial Sequence: Synthetic peptide
  Seed: MTPAEVSIVV (PMEL_HUMAN)
MGPAEVSIVM

SEQ ID NO: 133696 - protein, 9 aa, Artificial Sequence
  Description of Artificial Sequence: Synthetic peptide
  Seed: LEPGPVTAQ (PMEL_HUMAN)
LEPGPVTAL

SEQ ID NO: 133697 - protein, 9 aa, Artificial Sequence
  Description of Artificial Sequence: Synthetic peptide
  Seed: SAFTITDQV (PMEL_HUMAN)
SMFTITDQT

SEQ ID NO: 133698 - protein, 10 aa, Artificial Sequence
  Description of Artificial Sequence: Synthetic peptide
  Seed: YGSFSVTLDI (PMEL_HUMAN)
YASFSVTLDY

SEQ ID NO: 133699 - protein, 10 aa, Artificial Sequence
  Description of Artificial Sequence: Synthetic peptide
  Seed: LGGPVSGLSI (PMEL_HUMAN)
LSGPVSGLSL

SEQ ID NO: 133700 - protein, 9 aa, Artificial Sequence
  Description of Artificial Sequence: Synthetic peptide
  Seed: HLAVIGALL (PMEL_HUMAN)
HTAVIGALM

SEQ ID NO: 133701 - protein, 9 aa, Artificial Sequence
  Description of Artificial Sequence: Synthetic peptide
  Seed: AVVLASLIY (PMEL_HUMAN)
ATVLASLIF

SEQ ID NO: 133702 - protein, 10 aa, Artificial Sequence
  Description of Artificial Sequence: Synthetic peptide
  Seed: ESITGSLGPL (PMEL_HUMAN)
ETITGSLGPI

SEQ ID NO: 133703 - protein, 9 aa, Artificial Sequence
  Description of Artificial Sequence: Synthetic peptide
  Seed: GTYCLNVSL (PMEL_HUMAN)
GVYCLNVSV

SEQ ID NO: 133704 - protein, 9 aa, Artificial Sequence
  Description of Artificial Sequence: Synthetic peptide
  Seed: MTPAEVSIV (PMEL_HUMAN)
MMPAEVSII

SEQ ID NO: 133705 - protein, 11 aa, Artificial Sequence
  Description of Artificial Sequence: Synthetic peptide
  Seed: VQMPTAESTGM (PMEL_HUMAN)
VIMPTAESTGY

SEQ ID NO: 133706 - protein, 10 aa, Artificial Sequence
  Description of Artificial Sequence: Synthetic peptide
  Seed: KRQVPLDCVL (PMEL_HUMAN)
KWQVPLDCVM

SEQ ID NO: 133707 - protein, 10 aa, Artificial Sequence
  Description of Artificial Sequence: Synthetic peptide
  Seed: GALLAVGATK (PMEL_HUMAN)
GMLLAVGATK

SEQ ID NO: 133708 - protein, 9 aa, Artificial Sequence
  Description of Artificial Sequence: Synthetic peptide
  Seed: TEVISTAPV (PMEL_HUMAN)
TEVISTAPM

SEQ ID NO: 133709 - protein, 11 aa, Artificial Sequence
  Description of Artificial Sequence: Synthetic peptide
  Seed: FTITDQVPFSV (PMEL_HUMAN)
FMITDQVPFSV

SEQ ID NO: 133710 - protein, 9 aa, Artificial Sequence
  Description of Artificial Sequence: Synthetic peptide
  Seed: LSIGTGRAM (PMEL_HUMAN)
LTIGTGRAI

SEQ ID NO: 133711 - protein, 10 aa, Artificial Sequence
  Description of Artificial Sequence: Synthetic peptide
  Seed: AVPSGEGDAF (PMEL_HUMAN)
AQPSGEGDAW

SEQ ID NO: 133712 - protein, 10 aa, Artificial Sequence
  Description of Artificial Sequence: Synthetic peptide
  Seed: ESITGSLGPL (PMEL_HUMAN)
ETITGSLGPT

SEQ ID NO: 133713 - protein, 10 aa, Artificial Sequence
  Description of Artificial Sequence: Synthetic peptide
  Seed: IFPDGGPCPS (PMEL_HUMAN)
IYPDGGPCPL

SEQ ID NO: 133714 - protein, 10 aa, Artificial Sequence
  Description of Artificial Sequence: Synthetic peptide
  Seed: TAAQVTTTEW (PMEL_HUMAN)
TSAQVTTTEY

SEQ ID NO: 133715 - protein, 8 aa, Artificial Sequence
  Description of Artificial Sequence: Synthetic peptide
  Seed: SNDGPTLI (PMEL_HUMAN)
SFDGPTLL

SEQ ID NO: 133716 - protein, 10 aa, Artificial Sequence
  Description of Artificial Sequence: Synthetic peptide
  Seed: THTMEVTVYH (PMEL_HUMAN)
TRTMEVTVYY

SEQ ID NO: 133717 - protein, 9 aa, Artificial Sequence
  Description of Artificial Sequence: Synthetic peptide
  Seed: ESAEILQAV (PMEL_HUMAN)
ETAEILQAY

SEQ ID NO: 133718 - protein, 9 aa, Artificial Sequence
  Description of Artificial Sequence: Synthetic peptide
  Seed: SVQVPTTEV (PMEL_HUMAN)
SVQVPTTEY

SEQ ID NO: 133719 - protein, 9 aa, Artificial Sequence
  Description of Artificial Sequence: Synthetic peptide
  Seed: RAMLGTHTM (PMEL_HUMAN)
RIMLGTHTV

SEQ ID NO: 133720 - protein, 11 aa, Artificial Sequence
  Description of Artificial Sequence: Synthetic peptide
  Seed: RALDGGNKHFL (PMEL_HUMAN)
RVLDGGNKHFL

SEQ ID NO: 133721 - protein, 9 aa, Artificial Sequence
  Description of Artificial Sequence: Synthetic peptide
  Seed: TAEAPNTTA (PMEL_HUMAN)
TSEAPNTTL

SEQ ID NO: 133722 - protein, 9 aa, Artificial Sequence
  Description of Artificial Sequence: Synthetic peptide
  Seed: ILLVLMAVV (PMEL_HUMAN)
IMLVLMAVV

SEQ ID NO: 133723 - protein, 9 aa, Artificial Sequence
  Description of Artificial Sequence: Synthetic peptide
  Seed: VTLDIVQGI (PMEL_HUMAN)
VLLDIVQGW

SEQ ID NO: 133724 - protein, 9 aa, Artificial Sequence
  Description of Artificial Sequence: Synthetic peptide
  Seed: LPDGQVIWV (PMEL_HUMAN)
LSDGQVIWI

SEQ ID NO: 133725 - protein, 9 aa, Artificial Sequence
  Description of Artificial Sequence: Synthetic peptide
  Seed: VSVSQLRAL (PMEL_HUMAN)
VLVSQLRAV

SEQ ID NO: 133726 - protein, 8 aa, Artificial Sequence
  Description of Artificial Sequence: Synthetic peptide
  Seed: VLPDGQVI (PMEL_HUMAN)
VSPDGQVL

SEQ ID NO: 133727 - protein, 11 aa, Artificial Sequence
  Description of Artificial Sequence: Synthetic peptide
  Seed: VQMPTAESTGM (PMEL_HUMAN)
VVMPTAESTGF

SEQ ID NO: 133728 - protein, 9 aa, Artificial Sequence
  Description of Artificial Sequence: Synthetic peptide
  Seed: LIYRRRLMK (PMEL_HUMAN)
LIYRRRLMY

SEQ ID NO: 133729 - protein, 9 aa, Artificial Sequence
  Description of Artificial Sequence: Synthetic peptide
  Seed: TTTEWVETT (PMEL_HUMAN)
TVTEWVETI

SEQ ID NO: 133730 - protein, 10 aa, Artificial Sequence
  Description of Artificial Sequence: Synthetic peptide
  Seed: ASFSIALNFP (PMEL_HUMAN)
ATFSIALNFW

SEQ ID NO: 133731 - protein, 10 aa, Artificial Sequence
  Description of Artificial Sequence: Synthetic peptide
  Seed: KTWGQYWQVL (PMEL_HUMAN)
KYWGQYWQVY

SEQ ID NO: 133732 - protein, 9 aa, Artificial Sequence
  Description of Artificial Sequence: Synthetic peptide
  Seed: HTMEVTVYH (PMEL_HUMAN)
HLMEVTVYK

SEQ ID NO: 133733 - protein, 10 aa, Artificial Sequence
  Description of Artificial Sequence: Synthetic peptide
  Seed: ALLAVGATKV (PMEL_HUMAN)
AQLAVGATKI

SEQ ID NO: 133734 - protein, 9 aa, Artificial Sequence
  Description of Artificial Sequence: Synthetic peptide
  Seed: ESAEILQAV (PMEL_HUMAN)
ELAEILQAY

SEQ ID NO: 133735 - protein, 10 aa, Artificial Sequence
  Description of Artificial Sequence: Synthetic peptide
  Seed: GPLLDGTATL (PMEL_HUMAN)
GQLLDGTATL

SEQ ID NO: 133736 - protein, 9 aa, Artificial Sequence
  Description of Artificial Sequence: Synthetic peptide
  Seed: LQAAIPLTS (PMEL_HUMAN)
LQAAIPLTA

SEQ ID NO: 133737 - protein, 9 aa, Artificial Sequence
  Description of Artificial Sequence: Synthetic peptide
  Seed: FTITDQVPF (PMEL_HUMAN)
FVITDQVPI

SEQ ID NO: 133738 - protein, 10 aa, Artificial Sequence
  Description of Artificial Sequence: Synthetic peptide
  Seed: SSSHWLRLPR (PMEL_HUMAN)
SASHWLRLPR

SEQ ID NO: 133739 - protein, 10 aa, Artificial Sequence
  Description of Artificial Sequence: Synthetic peptide
  Seed: LADTNSLAVV (PMEL_HUMAN)
LIDTNSLAVL

SEQ ID NO: 133740 - protein, 9 aa, Artificial Sequence
  Description of Artificial Sequence: Synthetic peptide
  Seed: TTPGQAPTA (PMEL_HUMAN)
TRPGQAPTL

SEQ ID NO: 133741 - protein, 9 aa, Artificial Sequence
  Description of Artificial Sequence: Synthetic peptide
  Seed: MTPAEVSIV (PMEL_HUMAN)
MGPAEVSIL

SEQ ID NO: 133742 - protein, 10 aa, Artificial Sequence
  Description of Artificial Sequence: Synthetic peptide
  Seed: RYGSFSVTLD (PMEL_HUMAN)
RYGSFSVTLF

SEQ ID NO: 133743 - protein, 10 aa, Artificial Sequence
  Description of Artificial Sequence: Synthetic peptide
  Seed: LVLMAVVLAS (PMEL_HUMAN)
LYLMAVVLAI

SEQ ID NO: 133744 - protein, 9 aa, Artificial Sequence
  Description of Artificial Sequence: Synthetic peptide
  Seed: RAMLGTHTM (PMEL_HUMAN)
RIMLGTHTI

SEQ ID NO: 133745 - protein, 9 aa, Artificial Sequence
  Description of Artificial Sequence: Synthetic peptide
  Seed: AVVLASLIY (PMEL_HUMAN)
AQVLASLIW

SEQ ID NO: 133746 - protein, 10 aa, Artificial Sequence
  Description of Artificial Sequence: Synthetic peptide
  Seed: AVPSGEGDAF (PMEL_HUMAN)
AAPSGEGDAY

SEQ ID NO: 133747 - protein, 9 aa, Artificial Sequence
  Description of Artificial Sequence: Synthetic peptide
  Seed: SPLLSGQQV (PMEL_HUMAN)
SPLLSGQQM

SEQ ID NO: 133748 - protein, 9 aa, Artificial Sequence
  Description of Artificial Sequence: Synthetic peptide
  Seed: MLGTHTMEV (PMEL_HUMAN)
MTGTHTMEF

SEQ ID NO: 133749 - protein, 9 aa, Artificial Sequence
  Description of Artificial Sequence: Synthetic peptide
  Seed: GTYCLNVSL (PMEL_HUMAN)
GTYCLNVSY

SEQ ID NO: 133750 - protein, 9 aa, Artificial Sequence
  Description of Artificial Sequence: Synthetic peptide
  Seed: RYGSFSVTL (PMEL_HUMAN)
RRGSFSVTV

SEQ ID NO: 133751 - protein, 9 aa, Artificial Sequence
  Description of Artificial Sequence: Synthetic peptide
  Seed: AEPSGTTSV (PMEL_HUMAN)
ANPSGTTSL

SEQ ID NO: 133752 - protein, 9 aa, Artificial Sequence
  Description of Artificial Sequence: Synthetic peptide
  Seed: LTVSCQGGL (PMEL_HUMAN)
LLVSCQGGV

SEQ ID NO: 133753 - protein, 11 aa, Artificial Sequence
  Description of Artificial Sequence: Synthetic peptide
  Seed: HTMEVTVYHRR (PMEL_HUMAN)
HIMEVTVYHRR

SEQ ID NO: 133754 - protein, 11 aa, Artificial Sequence
  Description of Artificial Sequence: Synthetic peptide
  Seed: HLAVIGALLAV (PMEL_HUMAN)
HQAVIGALLAV

SEQ ID NO: 133755 - protein, 11 aa, Artificial Sequence
  Description of Artificial Sequence: Synthetic peptide
  Seed: ISRALVVTHTY (PMEL_HUMAN)
IYRALVVTHTW

SEQ ID NO: 133756 - protein, 10 aa, Artificial Sequence
  Description of Artificial Sequence: Synthetic peptide
  Seed: KVSNDGPTLI (PMEL_HUMAN)
KASNDGPTLF

SEQ ID NO: 133757 - protein, 11 aa, Artificial Sequence
  Description of Artificial Sequence: Synthetic peptide
  Seed: RALDGGNKHFL (PMEL_HUMAN)
RNLDGGNKHFW

SEQ ID NO: 133758 - protein, 9 aa, Artificial Sequence
  Description of Artificial Sequence: Synthetic peptide
  Seed: SEVMGTTLA (PMEL_HUMAN)
SEVMGTTLY

SEQ ID NO: 133759 - protein, 9 aa, Artificial Sequence
  Description of Artificial Sequence: Synthetic peptide
  Seed: HTYLEPGPV (PMEL_HUMAN)
HSYLEPGPY

SEQ ID NO: 133760 - protein, 10 aa, Artificial Sequence
  Description of Artificial Sequence: Synthetic peptide
  Seed: MAVVLASLIY (PMEL_HUMAN)
MDVVLASLIY

SEQ ID NO: 133761 - protein, 9 aa, Artificial Sequence
  Description of Artificial Sequence: Synthetic peptide
  Seed: RAMLGTHTM (PMEL_HUMAN)
RIMLGTHTF

SEQ ID NO: 133762 - protein, 9 aa, Artificial Sequence
  Description of Artificial Sequence: Synthetic peptide
  Seed: MTPAEVSIV (PMEL_HUMAN)
MVPAEVSIM

SEQ ID NO: 133763 - protein, 9 aa, Artificial Sequence
  Description of Artificial Sequence: Synthetic peptide
  Seed: LIYRRRLMK (PMEL_HUMAN)
LYYRRRLMR

SEQ ID NO: 133764 - protein, 9 aa, Artificial Sequence
  Description of Artificial Sequence: Synthetic peptide
  Seed: TAEAPNTTA (PMEL_HUMAN)
TMEAPNTTM

SEQ ID NO: 133765 - protein, 9 aa, Artificial Sequence
  Description of Artificial Sequence: Synthetic peptide
  Seed: RAMLGTHTM (PMEL_HUMAN)
RKMLGTHTL

SEQ ID NO: 133766 - protein, 9 aa, Artificial Sequence
  Description of Artificial Sequence: Synthetic peptide
  Seed: IVVLSGTTA (PMEL_HUMAN)
ILVLSGTTV

SEQ ID NO: 133767 - protein, 11 aa, Artificial Sequence
  Description of Artificial Sequence: Synthetic peptide
  Seed: LGPLLDGTATL (PMEL_HUMAN)
LVPLLDGTATV

SEQ ID NO: 133768 - protein, 9 aa, Artificial Sequence
  Description of Artificial Sequence: Synthetic peptide
  Seed: AAIPLTSCG (PMEL_HUMAN)
ATIPLTSCY

SEQ ID NO: 133769 - protein, 9 aa, Artificial Sequence
  Description of Artificial Sequence: Synthetic peptide
  Seed: SLGPLLDGT (PMEL_HUMAN)
SVGPLLDGL

SEQ ID NO: 133770 - protein, 10 aa, Artificial Sequence
  Description of Artificial Sequence: Synthetic peptide
  Seed: SLGPLLDGTA (PMEL_HUMAN)
SLGPLLDGTL

SEQ ID NO: 133771 - protein, 9 aa, Artificial Sequence
  Description of Artificial Sequence: Synthetic peptide
  Seed: ESTGMTPEK (PMEL_HUMAN)
EVTGMTPEM

SEQ ID NO: 133772 - protein, 9 aa, Artificial Sequence
  Description of Artificial Sequence: Synthetic peptide
  Seed: SLAVVSTQL (PMEL_HUMAN)
STAVVSTQI

SEQ ID NO: 133773 - protein, 9 aa, Artificial Sequence
  Description of Artificial Sequence: Synthetic peptide
  Seed: MDLVLKRCL (PMEL_HUMAN)
MELVLKRCL

SEQ ID NO: 133774 - protein, 9 aa, Artificial Sequence
  Description of Artificial Sequence: Synthetic peptide
  Seed: KTWGQYWQV (PMEL_HUMAN)
KQWGQYWQF

SEQ ID NO: 133775 - protein, 8 aa, Artificial Sequence
  Description of Artificial Sequence: Synthetic peptide
  Seed: VETTAREL (PMEL_HUMAN)
VQTTAREI

SEQ ID NO: 133776 - protein, 9 aa, Artificial Sequence
  Description of Artificial Sequence: Synthetic peptide
  Seed: MLGTHTMEV (PMEL_HUMAN)
MLGTHTMET

SEQ ID NO: 133777 - protein, 11 aa, Artificial Sequence
  Description of Artificial Sequence: Synthetic peptide
  Seed: FGDSSGTLISR (PMEL_HUMAN)
FADSSGTLISC

SEQ ID NO: 133778 - protein, 9 aa, Artificial Sequence
  Description of Artificial Sequence: Synthetic peptide
  Seed: RLVKRQVPL (PMEL_HUMAN)
RHVKRQVPM

SEQ ID NO: 133779 - protein, 10 aa, Artificial Sequence
  Description of Artificial Sequence: Synthetic peptide
  Seed: LMAVVLASLI (PMEL_HUMAN)
LQAVVLASLL

SEQ ID NO: 133780 - protein, 10 aa, Artificial Sequence
  Description of Artificial Sequence: Synthetic peptide
  Seed: RGSRSYVPLA (PMEL_HUMAN)
RTSRSYVPLV

SEQ ID NO: 133781 - protein, 9 aa, Artificial Sequence
  Description of Artificial Sequence: Synthetic peptide
  Seed: RTKAWNRQL (PMEL_HUMAN)
RYKAWNRQK

SEQ ID NO: 133782 - protein, 11 aa, Artificial Sequence
  Description of Artificial Sequence: Synthetic peptide
  Seed: RRGSRSYVPLA (PMEL_HUMAN)
RPGSRSYVPLA

SEQ ID NO: 133783 - protein, 9 aa, Artificial Sequence
  Description of Artificial Sequence: Synthetic peptide
  Seed: QVIWVNNTI (PMEL_HUMAN)
QAIWVNNTW

SEQ ID NO: 133784 - protein, 10 aa, Artificial Sequence
  Description of Artificial Sequence: Synthetic peptide
  Seed: AEADLSYTWD (PMEL_HUMAN)
AEADLSYTWG

SEQ ID NO: 133785 - protein, 10 aa, Artificial Sequence
  Description of Artificial Sequence: Synthetic peptide
  Seed: MTPAEVSIVV (PMEL_HUMAN)
MSPAEVSIVT

SEQ ID NO: 133786 - protein, 9 aa, Artificial Sequence
  Description of Artificial Sequence: Synthetic peptide
  Seed: VPLDCVLYR (PMEL_HUMAN)
VLLDCVLYK

SEQ ID NO: 133787 - protein, 9 aa, Artificial Sequence
  Description of Artificial Sequence: Synthetic peptide
  Seed: VVLASLIYR (PMEL_HUMAN)
VGLASLIYK

SEQ ID NO: 133788 - protein, 9 aa, Artificial Sequence
  Description of Artificial Sequence: Synthetic peptide
  Seed: KTWGQYWQV (PMEL_HUMAN)
KMWGQYWQS

SEQ ID NO: 133789 - protein, 9 aa, Artificial Sequence
  Description of Artificial Sequence: Synthetic peptide
  Seed: RNQPLTFAL (PMEL_HUMAN)
RIQPLTFAF

SEQ ID NO: 133790 - protein, 9 aa, Artificial Sequence
  Description of Artificial Sequence: Synthetic peptide
  Seed: RQVPLDCVL (PMEL_HUMAN)
RTVPLDCVY

SEQ ID NO: 133791 - protein, 10 aa, Artificial Sequence
  Description of Artificial Sequence: Synthetic peptide
  Seed: MAVVLASLIY (PMEL_HUMAN)
MLVVLASLIY

SEQ ID NO: 133792 - protein, 9 aa, Artificial Sequence
  Description of Artificial Sequence: Synthetic peptide
  Seed: YLAEADLSY (PMEL_HUMAN)
YSAEADLSM

SEQ ID NO: 133793 - protein, 9 aa, Artificial Sequence
  Description of Artificial Sequence: Synthetic peptide
  Seed: TLISRALVV (PMEL_HUMAN)
TTISRALVI

SEQ ID NO: 133794 - protein, 9 aa, Artificial Sequence
  Description of Artificial Sequence: Synthetic peptide
  Seed: RAMLGTHTM (PMEL_HUMAN)
REMLGTHTI

SEQ ID NO: 133795 - protein, 9 aa, Artificial Sequence
  Description of Artificial Sequence: Synthetic peptide
  Seed: VVLQAAIPL (PMEL_HUMAN)
VPLQAAIPI

SEQ ID NO: 133796 - protein, 10 aa, Artificial Sequence
  Description of Artificial Sequence: Synthetic peptide
  Seed: RTKAWNRQLY (PMEL_HUMAN)
RGKAWNRQLK

SEQ ID NO: 133797 - protein, 10 aa, Artificial Sequence
  Description of Artificial Sequence: Synthetic peptide
  Seed: ALDGGNKHFL (PMEL_HUMAN)
AADGGNKHFW

SEQ ID NO: 133798 - protein, 9 aa, Artificial Sequence
  Description of Artificial Sequence: Synthetic peptide
  Seed: LHDPSGYLA (PMEL_HUMAN)
LHDPSGYLL

SEQ ID NO: 133799 - protein, 9 aa, Artificial Sequence
  Description of Artificial Sequence: Synthetic peptide
  Seed: WSQKRSFVY (PMEL_HUMAN)
WYQKRSFVM

SEQ ID NO: 133800 - protein, 10 aa, Artificial Sequence
  Description of Artificial Sequence: Synthetic peptide
  Seed: RGSRSYVPLA (PMEL_HUMAN)
RQSRSYVPLL

SEQ ID NO: 133801 - protein, 11 aa, Artificial Sequence
  Description of Artificial Sequence: Synthetic peptide
  Seed: FSVTLDIVQGI (PMEL_HUMAN)
FVVTLDIVQGV

SEQ ID NO: 133802 - protein, 10 aa, Artificial Sequence
  Description of Artificial Sequence: Synthetic peptide
  Seed: LAVIGALLAV (PMEL_HUMAN)
LGVIGALLAA

SEQ ID NO: 133803 - protein, 9 aa, Artificial Sequence
  Description of Artificial Sequence: Synthetic peptide
  Seed: MSTPEATGM (PMEL_HUMAN)
MRTPEATGM

SEQ ID NO: 133804 - protein, 10 aa, Artificial Sequence
  Description of Artificial Sequence: Synthetic peptide
  Seed: LHLAVIGALL (PMEL_HUMAN)
LDLAVIGALL

SEQ ID NO: 133805 - protein, 11 aa, Artificial Sequence
  Description of Artificial Sequence: Synthetic peptide
  Seed: SAFTITDQVPF (PMEL_HUMAN)
SSFTITDQVPW

SEQ ID NO: 133806 - protein, 9 aa, Artificial Sequence
  Description of Artificial Sequence: Synthetic peptide
  Seed: RGGQVSLKV (PMEL_HUMAN)
RLGQVSLKI

SEQ ID NO: 133807 - protein, 9 aa, Artificial Sequence
  Description of Artificial Sequence: Synthetic peptide
  Seed: GSSPVPGTT (PMEL_HUMAN)
GASPVPGTL

SEQ ID NO: 133808 - protein, 11 aa, Artificial Sequence
  Description of Artificial Sequence: Synthetic peptide
  Seed: KVLPDGQVIWV (PMEL_HUMAN)
KQLPDGQVIWV

SEQ ID NO: 133809 - protein, 9 aa, Artificial Sequence
  Description of Artificial Sequence: Synthetic peptide
  Seed: ALNFPGSQK (PMEL_HUMAN)
AANFPGSQL

SEQ ID NO: 133810 - protein, 9 aa, Artificial Sequence
  Description of Artificial Sequence: Synthetic peptide
  Seed: WNRQLYPEW (PMEL_HUMAN)
WTRQLYPEW

SEQ ID NO: 133811 - protein, 10 aa, Artificial Sequence
  Description of Artificial Sequence: Synthetic peptide
  Seed: SVPQLPHSSS (PMEL_HUMAN)
SNPQLPHSSA

SEQ ID NO: 133812 - protein, 10 aa, Artificial Sequence
  Description of Artificial Sequence: Synthetic peptide
  Seed: LADTNSLAVV (PMEL_HUMAN)
LADTNSLAVM

SEQ ID NO: 133813 - protein, 8 aa, Artificial Sequence
  Description of Artificial Sequence: Synthetic peptide
  Seed: LHDPSGYL (PMEL_HUMAN)
LNDPSGYL

SEQ ID NO: 133814 - protein, 10 aa, Artificial Sequence
  Description of Artificial Sequence: Synthetic peptide
  Seed: PTLIGANASF (PMEL_HUMAN)
PRLIGANASY

SEQ ID NO: 133815 - protein, 10 aa, Artificial Sequence
  Description of Artificial Sequence: Synthetic peptide
  Seed: NSLAVVSTQL (PMEL_HUMAN)
NMLAVVSTQL

SEQ ID NO: 133816 - protein, 9 aa, Artificial Sequence
  Description of Artificial Sequence: Synthetic peptide
  Seed: RAMLGTHTM (PMEL_HUMAN)
RAMLGTHTV

SEQ ID NO: 133817 - protein, 9 aa, Artificial Sequence
  Description of Artificial Sequence: Synthetic peptide
  Seed: HTMEVTVYH (PMEL_HUMAN)
HSMEVTVYL

SEQ ID NO: 133818 - protein, 10 aa, Artificial Sequence
  Description of Artificial Sequence: Synthetic peptide
  Seed: YVPLAHSSSA (PMEL_HUMAN)
YYPLAHSSSM

SEQ ID NO: 133819 - protein, 10 aa, Artificial Sequence
  Description of Artificial Sequence: Synthetic peptide
  Seed: SGTYCLNVSL (PMEL_HUMAN)
SMTYCLNVSV

SEQ ID NO: 133820 - protein, 9 aa, Artificial Sequence
  Description of Artificial Sequence: Synthetic peptide
  Seed: AEPSGTTSV (PMEL_HUMAN)
AFPSGTTSM

SEQ ID NO: 133821 - protein, 9 aa, Artificial Sequence
  Description of Artificial Sequence: Synthetic peptide
  Seed: LHLAVIGAL (PMEL_HUMAN)
LQLAVIGAM

SEQ ID NO: 133822 - protein, 9 aa, Artificial Sequence
  Description of Artificial Sequence: Synthetic peptide
  Seed: HSSSHWLRL (PMEL_HUMAN)
HSSSHWLRY

SEQ ID NO: 133823 - protein, 9 aa, Artificial Sequence
  Description of Artificial Sequence: Synthetic peptide
  Seed: ALDGGNKHF (PMEL_HUMAN)
ACDGGNKHM

SEQ ID NO: 133824 - protein, 9 aa, Artificial Sequence
  Description of Artificial Sequence: Synthetic peptide
  Seed: AQRLCQPVL (PMEL_HUMAN)
ALRLCQPVK

SEQ ID NO: 133825 - protein, 9 aa, Artificial Sequence
  Description of Artificial Sequence: Synthetic peptide
  Seed: VQMPTAEST (PMEL_HUMAN)
VAMPTAESF

SEQ ID NO: 133826 - protein, 9 aa, Artificial Sequence
  Description of Artificial Sequence: Synthetic peptide
  Seed: VSVSQLRAL (PMEL_HUMAN)
VMVSQLRAF

SEQ ID NO: 133827 - protein, 10 aa, Artificial Sequence
  Description of Artificial Sequence: Synthetic peptide
  Seed: SVPQLPHSSS (PMEL_HUMAN)
SAPQLPHSSV

SEQ ID NO: 133828 - protein, 9 aa, Artificial Sequence
  Description of Artificial Sequence: Synthetic peptide
  Seed: RAMLGTHTM (PMEL_HUMAN)
RAMLGTHTK

SEQ ID NO: 133829 - protein, 9 aa, Artificial Sequence
  Description of Artificial Sequence: Synthetic peptide
  Seed: YHRRGSRSY (PMEL_HUMAN)
YQRRGSRSI

SEQ ID NO: 133830 - protein, 10 aa, Artificial Sequence
  Description of Artificial Sequence: Synthetic peptide
  Seed: SITGSLGPLL (PMEL_HUMAN)
SLTGSLGPLL

SEQ ID NO: 133831 - protein, 10 aa, Artificial Sequence
  Description of Artificial Sequence: Synthetic peptide
  Seed: NASFSIALNF (PMEL_HUMAN)
NISFSIALNW

SEQ ID NO: 133832 - protein, 10 aa, Artificial Sequence
  Description of Artificial Sequence: Synthetic peptide
  Seed: GTHTMEVTVY (PMEL_HUMAN)
GQHTMEVTVY

SEQ ID NO: 133833 - protein, 10 aa, Artificial Sequence
  Description of Artificial Sequence: Synthetic peptide
  Seed: VSLADTNSLA (PMEL_HUMAN)
VWLADTNSLL

SEQ ID NO: 133834 - protein, 8 aa, Artificial Sequence
  Description of Artificial Sequence: Synthetic peptide
  Seed: TEVVGTTP (PMEL_HUMAN)
TEVVGTTI

SEQ ID NO: 133835 - protein, 10 aa, Artificial Sequence
  Description of Artificial Sequence: Synthetic peptide
  Seed: YLAEADLSYT (PMEL_HUMAN)
YVAEADLSYM

SEQ ID NO: 133836 - protein, 10 aa, Artificial Sequence
  Description of Artificial Sequence: Synthetic peptide
  Seed: HTMEVTVYHR (PMEL_HUMAN)
HYMEVTVYHR

SEQ ID NO: 133837 - protein, 10 aa, Artificial Sequence
  Description of Artificial Sequence: Synthetic peptide
  Seed: MTPAEVSIVV (PMEL_HUMAN)
MGPAEVSIVH

SEQ ID NO: 133838 - protein, 10 aa, Artificial Sequence
  Description of Artificial Sequence: Synthetic peptide
  Seed: RGSRSYVPLA (PMEL_HUMAN)
RVSRSYVPLT

SEQ ID NO: 133839 - protein, 9 aa, Artificial Sequence
  Description of Artificial Sequence: Synthetic peptide
  Seed: AVVSTQLIM (PMEL_HUMAN)
ATVSTQLIM

SEQ ID NO: 133840 - protein, 9 aa, Artificial Sequence
  Description of Artificial Sequence: Synthetic peptide
  Seed: RAMLGTHTM (PMEL_HUMAN)
RTMLGTHTK

SEQ ID NO: 133841 - protein, 11 aa, Artificial Sequence
  Description of Artificial Sequence: Synthetic peptide
  Seed: AEMSTPEATGM (PMEL_HUMAN)
AIMSTPEATGY

SEQ ID NO: 133842 - protein, 9 aa, Artificial Sequence
  Description of Artificial Sequence: Synthetic peptide
  Seed: GMTPAEVSI (PMEL_HUMAN)
GQTPAEVSF

SEQ ID NO: 133843 - protein, 9 aa, Artificial Sequence
  Description of Artificial Sequence: Synthetic peptide
  Seed: ILKGGSGTY (PMEL_HUMAN)
IPKGGSGTF

SEQ ID NO: 133844 - protein, 9 aa, Artificial Sequence
  Description of Artificial Sequence: Synthetic peptide
  Seed: EKVPVSEVM (PMEL_HUMAN)
EAVPVSEVF

SEQ ID NO: 133845 - protein, 10 aa, Artificial Sequence
  Description of Artificial Sequence: Synthetic peptide
  Seed: RNQDWLGVSR (PMEL_HUMAN)
RAQDWLGVSR

SEQ ID NO: 133846 - protein, 9 aa, Artificial Sequence
  Description of Artificial Sequence: Synthetic peptide
  Seed: LYRYGSFSV (PMEL_HUMAN)
LFRYGSFSF

SEQ ID NO: 133847 - protein, 9 aa, Artificial Sequence
  Description of Artificial Sequence: Synthetic peptide
  Seed: ANASFSIAL (PMEL_HUMAN)
ASASFSIAI

SEQ ID NO: 133848 - protein, 9 aa, Artificial Sequence
  Description of Artificial Sequence: Synthetic peptide
  Seed: FLRNQPLTF (PMEL_HUMAN)
FNRNQPLTF

SEQ ID NO: 133849 - protein, 10 aa, Artificial Sequence
  Description of Artificial Sequence: Synthetic peptide
  Seed: SSHWLRLPRI (PMEL_HUMAN)
SVHWLRLPRR

SEQ ID NO: 133850 - protein, 9 aa, Artificial Sequence
  Description of Artificial Sequence: Synthetic peptide
  Seed: YVWKTWGQY (PMEL_HUMAN)
YRWKTWGQY

SEQ ID NO: 133851 - protein, 9 aa, Artificial Sequence
  Description of Artificial Sequence: Synthetic peptide
  Seed: SQKRSFVYV (PMEL_HUMAN)
STKRSFVYQ

SEQ ID NO: 133852 - protein, 11 aa, Artificial Sequence
  Description of Artificial Sequence: Synthetic peptide
  Seed: QAVPSGEGDAF (PMEL_HUMAN)
QMVPSGEGDAF

SEQ ID NO: 133853 - protein, 9 aa, Artificial Sequence
  Description of Artificial Sequence: Synthetic peptide
  Seed: ITDQVPFSV (PMEL_HUMAN)
IFDQVPFSC

SEQ ID NO: 133854 - protein, 10 aa, Artificial Sequence
  Description of Artificial Sequence: Synthetic peptide
  Seed: LADTNSLAVV (PMEL_HUMAN)
LMDTNSLAVL

SEQ ID NO: 133855 - protein, 11 aa, Artificial Sequence
  Description of Artificial Sequence: Synthetic peptide
  Seed: RRGSRSYVPLA (PMEL_HUMAN)
RAGSRSYVPLK

SEQ ID NO: 133856 - protein, 9 aa, Artificial Sequence
  Description of Artificial Sequence: Synthetic peptide
  Seed: LADTNSLAV (PMEL_HUMAN)
LFDTNSLAL

SEQ ID NO: 133857 - protein, 11 aa, Artificial Sequence
  Description of Artificial Sequence: Synthetic peptide
  Seed: QAVPSGEGDAF (PMEL_HUMAN)
QHVPSGEGDAI

SEQ ID NO: 133858 - protein, 11 aa, Artificial Sequence
  Description of Artificial Sequence: Synthetic peptide
  Seed: QAVPSGEGDAF (PMEL_HUMAN)
QHVPSGEGDAL

SEQ ID NO: 133859 - protein, 10 aa, Artificial Sequence
  Description of Artificial Sequence: Synthetic peptide
  Seed: RRLMKQDFSV (PMEL_HUMAN)
RVLMKQDFSL

SEQ ID NO: 133860 - protein, 9 aa, Artificial Sequence
  Description of Artificial Sequence: Synthetic peptide
  Seed: KRCLLHLAV (PMEL_HUMAN)
KRCLLHLAM

SEQ ID NO: 133861 - protein, 9 aa, Artificial Sequence
  Description of Artificial Sequence: Synthetic peptide
  Seed: LMAVVLASL (PMEL_HUMAN)
LLAVVLASY

SEQ ID NO: 133862 - protein, 10 aa, Artificial Sequence
  Description of Artificial Sequence: Synthetic peptide
  Seed: EVMGTTLAEM (PMEL_HUMAN)
ESMGTTLAEL

SEQ ID NO: 133863 - protein, 9 aa, Artificial Sequence
  Description of Artificial Sequence: Synthetic peptide
  Seed: HTMEVTVYH (PMEL_HUMAN)
HMMEVTVYM

SEQ ID NO: 133864 - protein, 10 aa, Artificial Sequence
  Description of Artificial Sequence: Synthetic peptide
  Seed: VSLADTNSLA (PMEL_HUMAN)
VALADTNSLV

SEQ ID NO: 133865 - protein, 9 aa, Artificial Sequence
  Description of Artificial Sequence: Synthetic peptide
  Seed: ESAEILQAV (PMEL_HUMAN)
EQAEILQAV

SEQ ID NO: 133866 - protein, 10 aa, Artificial Sequence
  Description of Artificial Sequence: Synthetic peptide
  Seed: YVPLAHSSSA (PMEL_HUMAN)
YQPLAHSSSM

SEQ ID NO: 133867 - protein, 10 aa, Artificial Sequence
  Description of Artificial Sequence: Synthetic peptide
  Seed: MTPAEVSIVV (PMEL_HUMAN)
MSPAEVSIVA

SEQ ID NO: 133868 - protein, 9 aa, Artificial Sequence
  Description of Artificial Sequence: Synthetic peptide
  Seed: YLAEADLSY (PMEL_HUMAN)
YEAEADLSF

SEQ ID NO: 133869 - protein, 9 aa, Artificial Sequence
  Description of Artificial Sequence: Synthetic peptide
  Seed: ILKGGSGTY (PMEL_HUMAN)
IIKGGSGTF

SEQ ID NO: 133870 - protein, 9 aa, Artificial Sequence
  Description of Artificial Sequence: Synthetic peptide
  Seed: IYRRRLMKQ (PMEL_HUMAN)
IYRRRLMKK

SEQ ID NO: 133871 - protein, 11 aa, Artificial Sequence
  Description of Artificial Sequence: Synthetic peptide
  Seed: RYGSFSVTLDI (PMEL_HUMAN)
RMGSFSVTLDF

SEQ ID NO: 133872 - protein, 9 aa, Artificial Sequence
  Description of Artificial Sequence: Synthetic peptide
  Seed: YLAEADLSY (PMEL_HUMAN)
YRAEADLSY

SEQ ID NO: 133873 - protein, 9 aa, Artificial Sequence
  Description of Artificial Sequence: Synthetic peptide
  Seed: VLPDGQVIW (PMEL_HUMAN)
VTPDGQVIW

SEQ ID NO: 133874 - protein, 9 aa, Artificial Sequence
  Description of Artificial Sequence: Synthetic peptide
  Seed: HLAVIGALL (PMEL_HUMAN)
HVAVIGALA

SEQ ID NO: 133875 - protein, 10 aa, Artificial Sequence
  Description of Artificial Sequence: Synthetic peptide
  Seed: SQVWGGQPVY (PMEL_HUMAN)
SEVWGGQPVW

SEQ ID NO: 133876 - protein, 9 aa, Artificial Sequence
  Description of Artificial Sequence: Synthetic peptide
  Seed: VPFSVSVSQ (PMEL_HUMAN)
VIFSVSVSY

SEQ ID NO: 133877 - protein, 9 aa, Artificial Sequence
  Description of Artificial Sequence: Synthetic peptide
  Seed: GQVPLIVGI (PMEL_HUMAN)
GHVPLIVGI

SEQ ID NO: 133878 - protein, 9 aa, Artificial Sequence
  Description of Artificial Sequence: Synthetic peptide
  Seed: LYPEWTEAQ (PMEL_HUMAN)
LYPEWTEAM

SEQ ID NO: 133879 - protein, 9 aa, Artificial Sequence
  Description of Artificial Sequence: Synthetic peptide
  Seed: GQVPTTEVV (PMEL_HUMAN)
GLVPTTEVV

SEQ ID NO: 133880 - protein, 9 aa, Artificial Sequence
  Description of Artificial Sequence: Synthetic peptide
  Seed: TTAAQVTTT (PMEL_HUMAN)
TTAAQVTTV

SEQ ID NO: 133881 - protein, 9 aa, Artificial Sequence
  Description of Artificial Sequence: Synthetic peptide
  Seed: AHSSSAFTI (PMEL_HUMAN)
ARSSSAFTY

SEQ ID NO: 133882 - protein, 9 aa, Artificial Sequence
  Description of Artificial Sequence: Synthetic peptide
  Seed: RGGQVSLKV (PMEL_HUMAN)
RAGQVSLKL

SEQ ID NO: 133883 - protein, 10 aa, Artificial Sequence
  Description of Artificial Sequence: Synthetic peptide
  Seed: AVIGALLAVG (PMEL_HUMAN)
AMIGALLAVR

SEQ ID NO: 133884 - protein, 9 aa, Artificial Sequence
  Description of Artificial Sequence: Synthetic peptide
  Seed: LADTNSLAV (PMEL_HUMAN)
LSDTNSLAY

SEQ ID NO: 133885 - protein, 10 aa, Artificial Sequence
  Description of Artificial Sequence: Synthetic peptide
  Seed: NSLAVVSTQL (PMEL_HUMAN)
NFLAVVSTQL

SEQ ID NO: 133886 - protein, 10 aa, Artificial Sequence
  Description of Artificial Sequence: Synthetic peptide
  Seed: SVPQLPHSSS (PMEL_HUMAN)
SLPQLPHSSI

SEQ ID NO: 133887 - protein, 9 aa, Artificial Sequence
  Description of Artificial Sequence: Synthetic peptide
  Seed: LLDGTATLR (PMEL_HUMAN)
LGDGTATLY

SEQ ID NO: 133888 - protein, 9 aa, Artificial Sequence
  Description of Artificial Sequence: Synthetic peptide
  Seed: MTPEKVPVS (PMEL_HUMAN)
MLPEKVPVF

SEQ ID NO: 133889 - protein, 9 aa, Artificial Sequence
  Description of Artificial Sequence: Synthetic peptide
  Seed: AEADLSYTW (PMEL_HUMAN)
ALADLSYTY

SEQ ID NO: 133890 - protein, 9 aa, Artificial Sequence
  Description of Artificial Sequence: Synthetic peptide
  Seed: AVIGALLAV (PMEL_HUMAN)
AAIGALLAM

SEQ ID NO: 133891 - protein, 9 aa, Artificial Sequence
  Description of Artificial Sequence: Synthetic peptide
  Seed: MPTAESTGM (PMEL_HUMAN)
MPTAESTGV

SEQ ID NO: 133892 - protein, 9 aa, Artificial Sequence
  Description of Artificial Sequence: Synthetic peptide
  Seed: VQVPTTEVI (PMEL_HUMAN)
VLVPTTEVI

SEQ ID NO: 133893 - protein, 9 aa, Artificial Sequence
  Description of Artificial Sequence: Synthetic peptide
  Seed: QLHDPSGYL (PMEL_HUMAN)
QIHDPSGYY

SEQ ID NO: 133894 - protein, 10 aa, Artificial Sequence
  Description of Artificial Sequence: Synthetic peptide
  Seed: AVIGALLAVG (PMEL_HUMAN)
AMIGALLAVS

SEQ ID NO: 133895 - protein, 9 aa, Artificial Sequence
  Description of Artificial Sequence: Synthetic peptide
  Seed: TPAEVSIVV (PMEL_HUMAN)
TTAEVSIVL

SEQ ID NO: 133896 - protein, 10 aa, Artificial Sequence
  Description of Artificial Sequence: Synthetic peptide
  Seed: KTWGQYWQVL (PMEL_HUMAN)
KIWGQYWQVL

SEQ ID NO: 133897 - protein, 9 aa, Artificial Sequence
  Description of Artificial Sequence: Synthetic peptide
  Seed: TDQVPFSVS (PMEL_HUMAN)
TEQVPFSVT

SEQ ID NO: 133898 - protein, 9 aa, Artificial Sequence
  Description of Artificial Sequence: Synthetic peptide
  Seed: SQVWGGQPV (PMEL_HUMAN)
SIVWGGQPL

SEQ ID NO: 133899 - protein, 9 aa, Artificial Sequence
  Description of Artificial Sequence: Synthetic peptide
  Seed: AHSSSAFTI (PMEL_HUMAN)
AQSSSAFTL

SEQ ID NO: 133900 - protein, 10 aa, Artificial Sequence
  Description of Artificial Sequence: Synthetic peptide
  Seed: LHLAVIGALL (PMEL_HUMAN)
LLLAVIGALL

SEQ ID NO: 133901 - protein, 9 aa, Artificial Sequence
  Description of Artificial Sequence: Synthetic peptide
  Seed: AEADLSYTW (PMEL_HUMAN)
AQADLSYTL

SEQ ID NO: 133902 - protein, 9 aa, Artificial Sequence
  Description of Artificial Sequence: Synthetic peptide
  Seed: RQVPLDCVL (PMEL_HUMAN)
RAVPLDCVY

SEQ ID NO: 133903 - protein, 9 aa, Artificial Sequence
  Description of Artificial Sequence: Synthetic peptide
  Seed: SLAVVSTQL (PMEL_HUMAN)
SSAVVSTQV

SEQ ID NO: 133904 - protein, 9 aa, Artificial Sequence
  Description of Artificial Sequence: Synthetic peptide
  Seed: WNRQLYPEW (PMEL_HUMAN)
WSRQLYPEW

SEQ ID NO: 133905 - protein, 9 aa, Artificial Sequence
  Description of Artificial Sequence: Synthetic peptide
  Seed: ALNFPGSQK (PMEL_HUMAN)
AVNFPGSQR

SEQ ID NO: 133906 - protein, 10 aa, Artificial Sequence
  Description of Artificial Sequence: Synthetic peptide
  Seed: AVVLASLIYR (PMEL_HUMAN)
APVLASLIYR

SEQ ID NO: 133907 - protein, 10 aa, Artificial Sequence
  Description of Artificial Sequence: Synthetic peptide
  Seed: AVVLASLIYR (PMEL_HUMAN)
AKVLASLIYR

SEQ ID NO: 133908 - protein, 9 aa, Artificial Sequence
  Description of Artificial Sequence: Synthetic peptide
  Seed: RLPRIFCSC (PMEL_HUMAN)
RVPRIFCSV

SEQ ID NO: 133909 - protein, 11 aa, Artificial Sequence
  Description of Artificial Sequence: Synthetic peptide
  Seed: KVLPDGQVIWV (PMEL_HUMAN)
KLLPDGQVIWF

SEQ ID NO: 133910 - protein, 9 aa, Artificial Sequence
  Description of Artificial Sequence: Synthetic peptide
  Seed: YHRRGSRSY (PMEL_HUMAN)
YMRRGSRSL

SEQ ID NO: 133911 - protein, 10 aa, Artificial Sequence
  Description of Artificial Sequence: Synthetic peptide
  Seed: KTWGQYWQVL (PMEL_HUMAN)
KLWGQYWQVY

SEQ ID NO: 133912 - protein, 10 aa, Artificial Sequence
  Description of Artificial Sequence: Synthetic peptide
  Seed: LVLMAVVLAS (PMEL_HUMAN)
LALMAVVLAL

SEQ ID NO: 133913 - protein, 10 aa, Artificial Sequence
  Description of Artificial Sequence: Synthetic peptide
  Seed: SCPIGENSPL (PMEL_HUMAN)
SLPIGENSPM

SEQ ID NO: 133914 - protein, 10 aa, Artificial Sequence
  Description of Artificial Sequence: Synthetic peptide
  Seed: RQLYPEWTEA (PMEL_HUMAN)
RQLYPEWTEL

SEQ ID NO: 133915 - protein, 9 aa, Artificial Sequence
  Description of Artificial Sequence: Synthetic peptide
  Seed: YVWKTWGQY (PMEL_HUMAN)
YFWKTWGQF

SEQ ID NO: 133916 - protein, 9 aa, Artificial Sequence
  Description of Artificial Sequence: Synthetic peptide
  Seed: YLAEADLSY (PMEL_HUMAN)
YTAEADLSW

SEQ ID NO: 133917 - protein, 9 aa, Artificial Sequence
  Description of Artificial Sequence: Synthetic peptide
  Seed: TTDGHRPTA (PMEL_HUMAN)
TNDGHRPTM

SEQ ID NO: 133918 - protein, 9 aa, Artificial Sequence
  Description of Artificial Sequence: Synthetic peptide
  Seed: VMGTTLAEM (PMEL_HUMAN)
VSGTTLAEY

SEQ ID NO: 133919 - protein, 9 aa, Artificial Sequence
  Description of Artificial Sequence: Synthetic peptide
  Seed: QKRSFVYVW (PMEL_HUMAN)
QHRSFVYVF

SEQ ID NO: 133920 - protein, 9 aa, Artificial Sequence
  Description of Artificial Sequence: Synthetic peptide
  Seed: VVLSGTTAA (PMEL_HUMAN)
VGLSGTTAM

SEQ ID NO: 133921 - protein, 10 aa, Artificial Sequence
  Description of Artificial Sequence: Synthetic peptide
  Seed: RGSRSYVPLA (PMEL_HUMAN)
RTSRSYVPLT

SEQ ID NO: 133922 - protein, 10 aa, Artificial Sequence
  Description of Artificial Sequence: Synthetic peptide
  Seed: LMAVVLASLI (PMEL_HUMAN)
LVAVVLASLV

SEQ ID NO: 133923 - protein, 9 aa, Artificial Sequence
  Description of Artificial Sequence: Synthetic peptide
  Seed: KVSNDGPTL (PMEL_HUMAN)
KVSNDGPTK

SEQ ID NO: 133924 - protein, 11 aa, Artificial Sequence
  Description of Artificial Sequence: Synthetic peptide
  Seed: VLYRYGSFSVT (PMEL_HUMAN)
VMYRYGSFSVV

SEQ ID NO: 133925 - protein, 9 aa, Artificial Sequence
  Description of Artificial Sequence: Synthetic peptide
  Seed: ITDQVPFSV (PMEL_HUMAN)
IFDQVPFSI

SEQ ID NO: 133926 - protein, 8 aa, Artificial Sequence
  Description of Artificial Sequence: Synthetic peptide
  Seed: SNDGPTLI (PMEL_HUMAN)
SADGPTLV

SEQ ID NO: 133927 - protein, 9 aa, Artificial Sequence
  Description of Artificial Sequence: Synthetic peptide
  Seed: HSSSHWLRL (PMEL_HUMAN)
HSSSHWLRF

SEQ ID NO: 133928 - protein, 11 aa, Artificial Sequence
  Description of Artificial Sequence: Synthetic peptide
  Seed: SYVPLAHSSSA (PMEL_HUMAN)
SFVPLAHSSSM

SEQ ID NO: 133929 - protein, 10 aa, Artificial Sequence
  Description of Artificial Sequence: Synthetic peptide
  Seed: IESAEILQAV (PMEL_HUMAN)
IESAEILQAA

SEQ ID NO: 133930 - protein, 9 aa, Artificial Sequence
  Description of Artificial Sequence: Synthetic peptide
  Seed: LHLAVIGAL (PMEL_HUMAN)
LQLAVIGAI

SEQ ID NO: 133931 - protein, 9 aa, Artificial Sequence
  Description of Artificial Sequence: Synthetic peptide
  Seed: AVVSTQLIM (PMEL_HUMAN)
ATVSTQLII

SEQ ID NO: 133932 - protein, 10 aa, Artificial Sequence
  Description of Artificial Sequence: Synthetic peptide
  Seed: RALDGGNKHF (PMEL_HUMAN)
RVLDGGNKHY

SEQ ID NO: 133933 - protein, 10 aa, Artificial Sequence
  Description of Artificial Sequence: Synthetic peptide
  Seed: SVPQLPHSSS (PMEL_HUMAN)
SNPQLPHSSI

SEQ ID NO: 133934 - protein, 9 aa, Artificial Sequence
  Description of Artificial Sequence: Synthetic peptide
  Seed: KQDFSVPQL (PMEL_HUMAN)
KEDFSVPQM

SEQ ID NO: 133935 - protein, 10 aa, Artificial Sequence
  Description of Artificial Sequence: Synthetic peptide
  Seed: KVLPDGQVIW (PMEL_HUMAN)
KLLPDGQVII

SEQ ID NO: 133936 - protein, 10 aa, Artificial Sequence
  Description of Artificial Sequence: Synthetic peptide
  Seed: KVLPDGQVIW (PMEL_HUMAN)
KQLPDGQVIF

SEQ ID NO: 133937 - protein, 9 aa, Artificial Sequence
  Description of Artificial Sequence: Synthetic peptide
  Seed: MTPEKVPVS (PMEL_HUMAN)
MFPEKVPVI

SEQ ID NO: 133938 - protein, 9 aa, Artificial Sequence
  Description of Artificial Sequence: Synthetic peptide
  Seed: FSIALNFPG (PMEL_HUMAN)
FAIALNFPW

SEQ ID NO: 133939 - protein, 9 aa, Artificial Sequence
  Description of Artificial Sequence: Synthetic peptide
  Seed: ITDQVPFSV (PMEL_HUMAN)
ISDQVPFSY

SEQ ID NO: 133940 - protein, 10 aa, Artificial Sequence
  Description of Artificial Sequence: Synthetic peptide
  Seed: SRALVVTHTY (PMEL_HUMAN)
SKALVVTHTY

SEQ ID NO: 133941 - protein, 11 aa, Artificial Sequence
  Description of Artificial Sequence: Synthetic peptide
  Seed: SAFTITDQVPF (PMEL_HUMAN)
SKFTITDQVPY

SEQ ID NO: 133942 - protein, 11 aa, Artificial Sequence
  Description of Artificial Sequence: Synthetic peptide
  Seed: YVPLAHSSSAF (PMEL_HUMAN)
YTPLAHSSSAF

SEQ ID NO: 133943 - protein, 9 aa, Artificial Sequence
  Description of Artificial Sequence: Synthetic peptide
  Seed: ILKGGSGTY (PMEL_HUMAN)
IHKGGSGTY

SEQ ID NO: 133944 - protein, 10 aa, Artificial Sequence
  Description of Artificial Sequence: Synthetic peptide
  Seed: QVLGGPVSGL (PMEL_HUMAN)
QLLGGPVSGK

SEQ ID NO: 133945 - protein, 9 aa, Artificial Sequence
  Description of Artificial Sequence: Synthetic peptide
  Seed: ITDQVPFSV (PMEL_HUMAN)
IADQVPFSF

SEQ ID NO: 133946 - protein, 11 aa, Artificial Sequence
  Description of Artificial Sequence: Synthetic peptide
  Seed: YVPLAHSSSAF (PMEL_HUMAN)
YSPLAHSSSAF

SEQ ID NO: 133947 - protein, 9 aa, Artificial Sequence
  Description of Artificial Sequence: Synthetic peptide
  Seed: SHWLRLPRI (PMEL_HUMAN)
SQWLRLPRL

SEQ ID NO: 133948 - protein, 10 aa, Artificial Sequence
  Description of Artificial Sequence: Synthetic peptide
  Seed: LGGPVSGLSI (PMEL_HUMAN)
LTGPVSGLSL

SEQ ID NO: 133949 - protein, 9 aa, Artificial Sequence
  Description of Artificial Sequence: Synthetic peptide
  Seed: TEVVGTTPG (PMEL_HUMAN)
TEVVGTTPT

SEQ ID NO: 133950 - protein, 9 aa, Artificial Sequence
  Description of Artificial Sequence: Synthetic peptide
  Seed: QKRSFVYVW (PMEL_HUMAN)
QQRSFVYVL

SEQ ID NO: 133951 - protein, 10 aa, Artificial Sequence
  Description of Artificial Sequence: Synthetic peptide
  Seed: MPTAESTGMT (PMEL_HUMAN)
MFTAESTGMI

SEQ ID NO: 133952 - protein, 10 aa, Artificial Sequence
  Description of Artificial Sequence: Synthetic peptide
  Seed: AVIGALLAVG (PMEL_HUMAN)
AMIGALLAVV

SEQ ID NO: 133953 - protein, 9 aa, Artificial Sequence
  Description of Artificial Sequence: Synthetic peptide
  Seed: KTWGQYWQV (PMEL_HUMAN)
KSWGQYWQM

SEQ ID NO: 133954 - protein, 10 aa, Artificial Sequence
  Description of Artificial Sequence: Synthetic peptide
  Seed: RSYVPLAHSS (PMEL_HUMAN)
RTYVPLAHSA

SEQ ID NO: 133955 - protein, 9 aa, Artificial Sequence
  Description of Artificial Sequence: Synthetic peptide
  Seed: SSHWLRLPR (PMEL_HUMAN)
SVHWLRLPR

SEQ ID NO: 133956 - protein, 9 aa, Artificial Sequence
  Description of Artificial Sequence: Synthetic peptide
  Seed: VPLAHSSSA (PMEL_HUMAN)
VMLAHSSSY

SEQ ID NO: 133957 - protein, 9 aa, Artificial Sequence
  Description of Artificial Sequence: Synthetic peptide
  Seed: AVIGALLAV (PMEL_HUMAN)
ASIGALLAH

SEQ ID NO: 133958 - protein, 9 aa, Artificial Sequence
  Description of Artificial Sequence: Synthetic peptide
  Seed: RALDGGNKH (PMEL_HUMAN)
RTLDGGNKL

SEQ ID NO: 133959 - protein, 9 aa, Artificial Sequence
  Description of Artificial Sequence: Synthetic peptide
  Seed: ALDGGNKHF (PMEL_HUMAN)
AFDGGNKHI

SEQ ID NO: 133960 - protein, 10 aa, Artificial Sequence
  Description of Artificial Sequence: Synthetic peptide
  Seed: AEADLSYTWD (PMEL_HUMAN)
AEADLSYTWL

SEQ ID NO: 133961 - protein, 10 aa, Artificial Sequence
  Description of Artificial Sequence: Synthetic peptide
  Seed: SLAVVSTQLI (PMEL_HUMAN)
SMAVVSTQLA

SEQ ID NO: 133962 - protein, 10 aa, Artificial Sequence
  Description of Artificial Sequence: Synthetic peptide
  Seed: SSAFTITDQV (PMEL_HUMAN)
SMAFTITDQI

SEQ ID NO: 133963 - protein, 9 aa, Artificial Sequence
  Description of Artificial Sequence: Synthetic peptide
  Seed: VSLADTNSL (PMEL_HUMAN)
VKLADTNSF

SEQ ID NO: 133964 - protein, 9 aa, Artificial Sequence
  Description of Artificial Sequence: Synthetic peptide
  Seed: FLRNQPLTF (PMEL_HUMAN)
FHRNQPLTF

SEQ ID NO: 133965 - protein, 10 aa, Artificial Sequence
  Description of Artificial Sequence: Synthetic peptide
  Seed: EVVGTTPGQA (PMEL_HUMAN)
EAVGTTPGQV

SEQ ID NO: 133966 - protein, 9 aa, Artificial Sequence
  Description of Artificial Sequence: Synthetic peptide
  Seed: KVSNDGPTL (PMEL_HUMAN)
KMSNDGPTF

SEQ ID NO: 133967 - protein, 8 aa, Artificial Sequence
  Description of Artificial Sequence: Synthetic peptide
  Seed: FGDSSGTL (PMEL_HUMAN)
FGDSSGTM

SEQ ID NO: 133968 - protein, 9 aa, Artificial Sequence
  Description of Artificial Sequence: Synthetic peptide
  Seed: VQVPTTEVI (PMEL_HUMAN)
VAVPTTEVV

SEQ ID NO: 133969 - protein, 9 aa, Artificial Sequence
  Description of Artificial Sequence: Synthetic peptide
  Seed: QLHDPSGYL (PMEL_HUMAN)
QVHDPSGYY

SEQ ID NO: 133970 - protein, 9 aa, Artificial Sequence
  Description of Artificial Sequence: Synthetic peptide
  Seed: VTAQVVLQA (PMEL_HUMAN)
VSAQVVLQL

SEQ ID NO: 133971 - protein, 10 aa, Artificial Sequence
  Description of Artificial Sequence: Synthetic peptide
  Seed: YLAEADLSYT (PMEL_HUMAN)
YVAEADLSYA

SEQ ID NO: 133972 - protein, 9 aa, Artificial Sequence
  Description of Artificial Sequence: Synthetic peptide
  Seed: AEAPNTTAG (PMEL_HUMAN)
AEAPNTTAM

SEQ ID NO: 133973 - protein, 11 aa, Artificial Sequence
  Description of Artificial Sequence: Synthetic peptide
  Seed: RQVPLDCVLYR (PMEL_HUMAN)
RTVPLDCVLYR

SEQ ID NO: 133974 - protein, 10 aa, Artificial Sequence
  Description of Artificial Sequence: Synthetic peptide
  Seed: AVVLASLIYR (PMEL_HUMAN)
ALVLASLIYR

SEQ ID NO: 133975 - protein, 10 aa, Artificial Sequence
  Description of Artificial Sequence: Synthetic peptide
  Seed: SCPIGENSPL (PMEL_HUMAN)
SAPIGENSPM

SEQ ID NO: 133976 - protein, 9 aa, Artificial Sequence
  Description of Artificial Sequence: Synthetic peptide
  Seed: FTITDQVPF (PMEL_HUMAN)
FWITDQVPW

SEQ ID NO: 133977 - protein, 9 aa, Artificial Sequence
  Description of Artificial Sequence: Synthetic peptide
  Seed: ANASFSIAL (PMEL_HUMAN)
AIASFSIAM

SEQ ID NO: 133978 - protein, 11 aa, Artificial Sequence
  Description of Artificial Sequence: Synthetic peptide
  Seed: RRRLMKQDFSV (PMEL_HUMAN)
RMRLMKQDFSV

SEQ ID NO: 133979 - protein, 9 aa, Artificial Sequence
  Description of Artificial Sequence: Synthetic peptide
  Seed: AQRLCQPVL (PMEL_HUMAN)
AQRLCQPVV

SEQ ID NO: 133980 - protein, 9 aa, Artificial Sequence
  Description of Artificial Sequence: Synthetic peptide
  Seed: VLPDGQVIW (PMEL_HUMAN)
VFPDGQVIL

SEQ ID NO: 133981 - protein, 10 aa, Artificial Sequence
  Description of Artificial Sequence: Synthetic peptide
  Seed: RALDGGNKHF (PMEL_HUMAN)
RILDGGNKHL

SEQ ID NO: 133982 - protein, 10 aa, Artificial Sequence
  Description of Artificial Sequence: Synthetic peptide
  Seed: VLMAVVLASL (PMEL_HUMAN)
VCMAVVLASA

SEQ ID NO: 133983 - protein, 10 aa, Artificial Sequence
  Description of Artificial Sequence: Synthetic peptide
  Seed: SSSHWLRLPR (PMEL_HUMAN)
SQSHWLRLPK

SEQ ID NO: 133984 - protein, 9 aa, Artificial Sequence
  Description of Artificial Sequence: Synthetic peptide
  Seed: RLVKRQVPL (PMEL_HUMAN)
RMVKRQVPI

SEQ ID NO: 133985 - protein, 9 aa, Artificial Sequence
  Description of Artificial Sequence: Synthetic peptide
  Seed: QVPLIVGIL (PMEL_HUMAN)
QAPLIVGIL

SEQ ID NO: 133986 - protein, 9 aa, Artificial Sequence
  Description of Artificial Sequence: Synthetic peptide
  Seed: GENSPLLSG (PMEL_HUMAN)
GENSPLLSY

SEQ ID NO: 133987 - protein, 10 aa, Artificial Sequence
  Description of Artificial Sequence: Synthetic peptide
  Seed: RALVVTHTYL (PMEL_HUMAN)
RQLVVTHTYM

SEQ ID NO: 133988 - protein, 9 aa, Artificial Sequence
  Description of Artificial Sequence: Synthetic peptide
  Seed: SLGPLLDGT (PMEL_HUMAN)
SVGPLLDGI

SEQ ID NO: 133989 - protein, 9 aa, Artificial Sequence
  Description of Artificial Sequence: Synthetic peptide
  Seed: LADTNSLAV (PMEL_HUMAN)
LTDTNSLAL

SEQ ID NO: 133990 - protein, 9 aa, Artificial Sequence
  Description of Artificial Sequence: Synthetic peptide
  Seed: SGTLISRAL (PMEL_HUMAN)
STTLISRAY

SEQ ID NO: 133991 - protein, 10 aa, Artificial Sequence
  Description of Artificial Sequence: Synthetic peptide
  Seed: IALNFPGSQK (PMEL_HUMAN)
INLNFPGSQK

SEQ ID NO: 133992 - protein, 9 aa, Artificial Sequence
  Description of Artificial Sequence: Synthetic peptide
  Seed: LTSCGSSPV (PMEL_HUMAN)
LLSCGSSPM

SEQ ID NO: 133993 - protein, 10 aa, Artificial Sequence
  Description of Artificial Sequence: Synthetic peptide
  Seed: MSTESITGSL (PMEL_HUMAN)
MHTESITGSV

SEQ ID NO: 133994 - protein, 10 aa, Artificial Sequence
  Description of Artificial Sequence: Synthetic peptide
  Seed: RGSRSYVPLA (PMEL_HUMAN)
RFSRSYVPLV

SEQ ID NO: 133995 - protein, 9 aa, Artificial Sequence
  Description of Artificial Sequence: Synthetic peptide
  Seed: WQVLGGPVS (PMEL_HUMAN)
WMVLGGPVW

SEQ ID NO: 133996 - protein, 10 aa, Artificial Sequence
  Description of Artificial Sequence: Synthetic peptide
  Seed: ELTVSCQGGL (PMEL_HUMAN)
EFTVSCQGGV

SEQ ID NO: 133997 - protein, 10 aa, Artificial Sequence
  Description of Artificial Sequence: Synthetic peptide
  Seed: MAVVLASLIY (PMEL_HUMAN)
MPVVLASLIF

SEQ ID NO: 133998 - protein, 9 aa, Artificial Sequence
  Description of Artificial Sequence: Synthetic peptide
  Seed: HSSSHWLRL (PMEL_HUMAN)
HMSSHWLRY

SEQ ID NO: 133999 - protein, 10 aa, Artificial Sequence
  Description of Artificial Sequence: Synthetic peptide
  Seed: EVMGTTLAEM (PMEL_HUMAN)
EAMGTTLAEI

SEQ ID NO: 134000 - protein, 10 aa, Artificial Sequence
  Description of Artificial Sequence: Synthetic peptide
  Seed: SRALVVTHTY (PMEL_HUMAN)
SEALVVTHTW

SEQ ID NO: 134001 - protein, 9 aa, Artificial Sequence
  Description of Artificial Sequence: Synthetic peptide
  Seed: SGLSIGTGR (PMEL_HUMAN)
SNLSIGTGR

SEQ ID NO: 134002 - protein, 9 aa, Artificial Sequence
  Description of Artificial Sequence: Synthetic peptide
  Seed: AEPSGTTSV (PMEL_HUMAN)
ASPSGTTSI

SEQ ID NO: 134003 - protein, 9 aa, Artificial Sequence
  Description of Artificial Sequence: Synthetic peptide
  Seed: AVVLASLIY (PMEL_HUMAN)
AFVLASLIY

SEQ ID NO: 134004 - protein, 9 aa, Artificial Sequence
  Description of Artificial Sequence: Synthetic peptide
  Seed: SQVWGGQPV (PMEL_HUMAN)
SSVWGGQPM

SEQ ID NO: 134005 - protein, 9 aa, Artificial Sequence
  Description of Artificial Sequence: Synthetic peptide
  Seed: VSNDGPTLI (PMEL_HUMAN)
VQNDGPTLV

SEQ ID NO: 134006 - protein, 10 aa, Artificial Sequence
  Description of Artificial Sequence: Synthetic peptide
  Seed: CLLHLAVIGA (PMEL_HUMAN)
CLLHLAVIGL

SEQ ID NO: 134007 - protein, 11 aa, Artificial Sequence
  Description of Artificial Sequence: Synthetic peptide
  Seed: VLMAVVLASLI (PMEL_HUMAN)
VMMAVVLASLL

SEQ ID NO: 134008 - protein, 10 aa, Artificial Sequence
  Description of Artificial Sequence: Synthetic peptide
  Seed: ALDGGNKHFL (PMEL_HUMAN)
ATDGGNKHFY

SEQ ID NO: 134009 - protein, 10 aa, Artificial Sequence
  Description of Artificial Sequence: Synthetic peptide
  Seed: TITDQVPFSV (PMEL_HUMAN)
TLTDQVPFSI

SEQ ID NO: 134010 - protein, 9 aa, Artificial Sequence
  Description of Artificial Sequence: Synthetic peptide
  Seed: VQVPTTEVI (PMEL_HUMAN)
VIVPTTEVF

SEQ ID NO: 134011 - protein, 9 aa, Artificial Sequence
  Description of Artificial Sequence: Synthetic peptide
  Seed: TTDGHRPTA (PMEL_HUMAN)
TIDGHRPTM

SEQ ID NO: 134012 - protein, 9 aa, Artificial Sequence
  Description of Artificial Sequence: Synthetic peptide
  Seed: IMPGQEAGL (PMEL_HUMAN)
IIPGQEAGL

SEQ ID NO: 134013 - protein, 9 aa, Artificial Sequence
  Description of Artificial Sequence: Synthetic peptide
  Seed: SFVYVWKTW (PMEL_HUMAN)
SWVYVWKTF

SEQ ID NO: 134014 - protein, 9 aa, Artificial Sequence
  Description of Artificial Sequence: Synthetic peptide
  Seed: GQVPLIVGI (PMEL_HUMAN)
GQVPLIVGL

SEQ ID NO: 134015 - protein, 10 aa, Artificial Sequence
  Description of Artificial Sequence: Synthetic peptide
  Seed: IESAEILQAV (PMEL_HUMAN)
ILSAEILQAL

SEQ ID NO: 134016 - protein, 10 aa, Artificial Sequence
  Description of Artificial Sequence: Synthetic peptide
  Seed: RRLMKQDFSV (PMEL_HUMAN)
RLLMKQDFSI

SEQ ID NO: 134017 - protein, 10 aa, Artificial Sequence
  Description of Artificial Sequence: Synthetic peptide
  Seed: SQKRSFVYVW (PMEL_HUMAN)
SRKRSFVYVY

SEQ ID NO: 134018 - protein, 9 aa, Artificial Sequence
  Description of Artificial Sequence: Synthetic peptide
  Seed: ANASFSIAL (PMEL_HUMAN)
ANASFSIAF

SEQ ID NO: 134019 - protein, 10 aa, Artificial Sequence
  Description of Artificial Sequence: Synthetic peptide
  Seed: SVPQLPHSSS (PMEL_HUMAN)
SAPQLPHSSF

SEQ ID NO: 134020 - protein, 10 aa, Artificial Sequence
  Description of Artificial Sequence: Synthetic peptide
  Seed: THTMEVTVYH (PMEL_HUMAN)
TYTMEVTVYK

SEQ ID NO: 134021 - protein, 9 aa, Artificial Sequence
  Description of Artificial Sequence: Synthetic peptide
  Seed: WQVLGGPVS (PMEL_HUMAN)
WVVLGGPVF

SEQ ID NO: 134022 - protein, 11 aa, Artificial Sequence
  Description of Artificial Sequence: Synthetic peptide
  Seed: SYVPLAHSSSA (PMEL_HUMAN)
SEVPLAHSSSM

SEQ ID NO: 134023 - protein, 10 aa, Artificial Sequence
  Description of Artificial Sequence: Synthetic peptide
  Seed: MTPAEVSIVV (PMEL_HUMAN)
MCPAEVSIVI

SEQ ID NO: 134024 - protein, 11 aa, Artificial Sequence
  Description of Artificial Sequence: Synthetic peptide
  Seed: LMKQDFSVPQL (PMEL_HUMAN)
LMKQDFSVPQV

SEQ ID NO: 134025 - protein, 9 aa, Artificial Sequence
  Description of Artificial Sequence: Synthetic peptide
  Seed: ASFSIALNF (PMEL_HUMAN)
AQFSIALNV

SEQ ID NO: 134026 - protein, 9 aa, Artificial Sequence
  Description of Artificial Sequence: Synthetic peptide
  Seed: YLAEADLSY (PMEL_HUMAN)
YSAEADLSL

SEQ ID NO: 134027 - protein, 9 aa, Artificial Sequence
  Description of Artificial Sequence: Synthetic peptide
  Seed: AVVSTQLIM (PMEL_HUMAN)
ATVSTQLIF

SEQ ID NO: 134028 - protein, 11 aa, Artificial Sequence
  Description of Artificial Sequence: Synthetic peptide
  Seed: APTAEPSGTTS (PMEL_HUMAN)
APTAEPSGTTI

SEQ ID NO: 134029 - protein, 9 aa, Artificial Sequence
  Description of Artificial Sequence: Synthetic peptide
  Seed: RYGSFSVTL (PMEL_HUMAN)
RVGSFSVTW

SEQ ID NO: 134030 - protein, 11 aa, Artificial Sequence
  Description of Artificial Sequence: Synthetic peptide
  Seed: YLAEADLSYTW (PMEL_HUMAN)
YSAEADLSYTF

SEQ ID NO: 134031 - protein, 11 aa, Artificial Sequence
  Description of Artificial Sequence: Synthetic peptide
  Seed: VSLADTNSLAV (PMEL_HUMAN)
VFLADTNSLAI

SEQ ID NO: 134032 - protein, 10 aa, Artificial Sequence
  Description of Artificial Sequence: Synthetic peptide
  Seed: RSFVYVWKTW (PMEL_HUMAN)
RFFVYVWKTF

SEQ ID NO: 134033 - protein, 8 aa, Artificial Sequence
  Description of Artificial Sequence: Synthetic peptide
  Seed: QDFSVPQL (PMEL_HUMAN)
QEFSVPQA

SEQ ID NO: 134034 - protein, 10 aa, Artificial Sequence
  Description of Artificial Sequence: Synthetic peptide
  Seed: THTMEVTVYH (PMEL_HUMAN)
TGTMEVTVYY

SEQ ID NO: 134035 - protein, 11 aa, Artificial Sequence
  Description of Artificial Sequence: Synthetic peptide
  Seed: TLIGANASFSI (PMEL_HUMAN)
TMIGANASFSL

SEQ ID NO: 134036 - protein, 10 aa, Artificial Sequence
  Description of Artificial Sequence: Synthetic peptide
  Seed: RRLMKQDFSV (PMEL_HUMAN)
RCLMKQDFSL

SEQ ID NO: 134037 - protein, 9 aa, Artificial Sequence
  Description of Artificial Sequence: Synthetic peptide
  Seed: LLHLAVIGA (PMEL_HUMAN)
LIHLAVIGV

SEQ ID NO: 134038 - protein, 9 aa, Artificial Sequence
  Description of Artificial Sequence: Synthetic peptide
  Seed: ALDGGNKHF (PMEL_HUMAN)
AADGGNKHF

SEQ ID NO: 134039 - protein, 9 aa, Artificial Sequence
  Description of Artificial Sequence: Synthetic peptide
  Seed: DIVQGIESA (PMEL_HUMAN)
DTVQGIESI

SEQ ID NO: 134040 - protein, 9 aa, Artificial Sequence
  Description of Artificial Sequence: Synthetic peptide
  Seed: ANASFSIAL (PMEL_HUMAN)
AAASFSIAY

SEQ ID NO: 134041 - protein, 9 aa, Artificial Sequence
  Description of Artificial Sequence: Synthetic peptide
  Seed: DAFELTVSC (PMEL_HUMAN)
DQFELTVSI

SEQ ID NO: 134042 - protein, 9 aa, Artificial Sequence
  Description of Artificial Sequence: Synthetic peptide
  Seed: VSLADTNSL (PMEL_HUMAN)
VHLADTNSF

SEQ ID NO: 134043 - protein, 9 aa, Artificial Sequence
  Description of Artificial Sequence: Synthetic peptide
  Seed: MSTPEATGM (PMEL_HUMAN)
MRTPEATGL

SEQ ID NO: 134044 - protein, 10 aa, Artificial Sequence
  Description of Artificial Sequence: Synthetic peptide
  Seed: IFPDGGPCPS (PMEL_HUMAN)
IFPDGGPCPF

SEQ ID NO: 134045 - protein, 9 aa, Artificial Sequence
  Description of Artificial Sequence: Synthetic peptide
  Seed: QAAIPLTSC (PMEL_HUMAN)
QPAIPLTSA

SEQ ID NO: 134046 - protein, 10 aa, Artificial Sequence
  Description of Artificial Sequence: Synthetic peptide
  Seed: ILKGGSGTYC (PMEL_HUMAN)
ILKGGSGTYY

SEQ ID NO: 134047 - protein, 10 aa, Artificial Sequence
  Description of Artificial Sequence: Synthetic peptide
  Seed: YGSFSVTLDI (PMEL_HUMAN)
YTSFSVTLDF

SEQ ID NO: 134048 - protein, 10 aa, Artificial Sequence
  Description of Artificial Sequence: Synthetic peptide
  Seed: NASFSIALNF (PMEL_HUMAN)
NRSFSIALNW

SEQ ID NO: 134049 - protein, 10 aa, Artificial Sequence
  Description of Artificial Sequence: Synthetic peptide
  Seed: SQVWGGQPVY (PMEL_HUMAN)
SAVWGGQPVW

SEQ ID NO: 134050 - protein, 9 aa, Artificial Sequence
  Description of Artificial Sequence: Synthetic peptide
  Seed: THTMEVTVY (PMEL_HUMAN)
TKTMEVTVY

SEQ ID NO: 134051 - protein, 11 aa, Artificial Sequence
  Description of Artificial Sequence: Synthetic peptide
  Seed: DCWRGGQVSLK (PMEL_HUMAN)
DAWRGGQVSLK

SEQ ID NO: 134052 - protein, 9 aa, Artificial Sequence
  Description of Artificial Sequence: Synthetic peptide
  Seed: QLHDPSGYL (PMEL_HUMAN)
QAHDPSGYY

SEQ ID NO: 134053 - protein, 9 aa, Artificial Sequence
  Description of Artificial Sequence: Synthetic peptide
  Seed: SVPQLPHSS (PMEL_HUMAN)
SSPQLPHSM

SEQ ID NO: 134054 - protein, 9 aa, Artificial Sequence
  Description of Artificial Sequence: Synthetic peptide
  Seed: VTLDIVQGI (PMEL_HUMAN)
VRLDIVQGL

SEQ ID NO: 134055 - protein, 11 aa, Artificial Sequence
  Description of Artificial Sequence: Synthetic peptide
  Seed: MAVVLASLIYR (PMEL_HUMAN)
MKVVLASLIYR

SEQ ID NO: 134056 - protein, 9 aa, Artificial Sequence
  Description of Artificial Sequence: Synthetic peptide
  Seed: DQVPFSVSV (PMEL_HUMAN)
DPVPFSVSV

SEQ ID NO: 134057 - protein, 10 aa, Artificial Sequence
  Description of Artificial Sequence: Synthetic peptide
  Seed: AVIGALLAVG (PMEL_HUMAN)
AQIGALLAVY

SEQ ID NO: 134058 - protein, 11 aa, Artificial Sequence
  Description of Artificial Sequence: Synthetic peptide
  Seed: HSSSHWLRLPR (PMEL_HUMAN)
HASSHWLRLPR

SEQ ID NO: 134059 - protein, 9 aa, Artificial Sequence
  Description of Artificial Sequence: Synthetic peptide
  Seed: EKVPVSEVM (PMEL_HUMAN)
EIVPVSEVY

SEQ ID NO: 134060 - protein, 9 aa, Artificial Sequence
  Description of Artificial Sequence: Synthetic peptide
  Seed: LNFPGSQKV (PMEL_HUMAN)
LLFPGSQKW

SEQ ID NO: 134061 - protein, 11 aa, Artificial Sequence
  Description of Artificial Sequence: Synthetic peptide
  Seed: VSLADTNSLAV (PMEL_HUMAN)
VMLADTNSLAV

SEQ ID NO: 134062 - protein, 10 aa, Artificial Sequence
  Description of Artificial Sequence: Synthetic peptide
  Seed: LADTNSLAVV (PMEL_HUMAN)
LLDTNSLAVF

SEQ ID NO: 134063 - protein, 9 aa, Artificial Sequence
  Description of Artificial Sequence: Synthetic peptide
  Seed: AQVTTTEWV (PMEL_HUMAN)
ALVTTTEWI

SEQ ID NO: 134064 - protein, 9 aa, Artificial Sequence
  Description of Artificial Sequence: Synthetic peptide
  Seed: VMGTTLAEM (PMEL_HUMAN)
VAGTTLAEL

SEQ ID NO: 134065 - protein, 9 aa, Artificial Sequence
  Description of Artificial Sequence: Synthetic peptide
  Seed: ALDGGNKHF (PMEL_HUMAN)
AMDGGNKHV

SEQ ID NO: 134066 - protein, 9 aa, Artificial Sequence
  Description of Artificial Sequence: Synthetic peptide
  Seed: VLPDGQVIW (PMEL_HUMAN)
VGPDGQVIM

SEQ ID NO: 134067 - protein, 10 aa, Artificial Sequence
  Description of Artificial Sequence: Synthetic peptide
  Seed: MPTAESTGMT (PMEL_HUMAN)
MCTAESTGML

SEQ ID NO: 134068 - protein, 10 aa, Artificial Sequence
  Description of Artificial Sequence: Synthetic peptide
  Seed: SVPQLPHSSS (PMEL_HUMAN)
SCPQLPHSSI

SEQ ID NO: 134069 - protein, 9 aa, Artificial Sequence
  Description of Artificial Sequence: Synthetic peptide
  Seed: VVLQAAIPL (PMEL_HUMAN)
VGLQAAIPY

SEQ ID NO: 134070 - protein, 9 aa, Artificial Sequence
  Description of Artificial Sequence: Synthetic peptide
  Seed: RALVVTHTY (PMEL_HUMAN)
RKLVVTHTF

SEQ ID NO: 134071 - protein, 10 aa, Artificial Sequence
  Description of Artificial Sequence: Synthetic peptide
  Seed: YRYGSFSVTL (PMEL_HUMAN)
YTYGSFSVTL

SEQ ID NO: 134072 - protein, 10 aa, Artificial Sequence
  Description of Artificial Sequence: Synthetic peptide
  Seed: PTLIGANASF (PMEL_HUMAN)
PYLIGANASY

SEQ ID NO: 134073 - protein, 10 aa, Artificial Sequence
  Description of Artificial Sequence: Synthetic peptide
  Seed: KVSNDGPTLI (PMEL_HUMAN)
KQSNDGPTLF

SEQ ID NO: 134074 - protein, 9 aa, Artificial Sequence
  Description of Artificial Sequence: Synthetic peptide
  Seed: AVIGALLAV (PMEL_HUMAN)
AIIGALLAR

SEQ ID NO: 134075 - protein, 9 aa, Artificial Sequence
  Description of Artificial Sequence: Synthetic peptide
  Seed: RLPRIFCSC (PMEL_HUMAN)
RQPRIFCSI

SEQ ID NO: 134076 - protein, 9 aa, Artificial Sequence
  Description of Artificial Sequence: Synthetic peptide
  Seed: NFPGSQKVL (PMEL_HUMAN)
NVPGSQKVM

SEQ ID NO: 134077 - protein, 10 aa, Artificial Sequence
  Description of Artificial Sequence: Synthetic peptide
  Seed: KTWGQYWQVL (PMEL_HUMAN)
KMWGQYWQVT

SEQ ID NO: 134078 - protein, 9 aa, Artificial Sequence
  Description of Artificial Sequence: Synthetic peptide
  Seed: SLGPLLDGT (PMEL_HUMAN)
SAGPLLDGI

SEQ ID NO: 134079 - protein, 9 aa, Artificial Sequence
  Description of Artificial Sequence: Synthetic peptide
  Seed: HSSSHWLRL (PMEL_HUMAN)
HVSSHWLRY

SEQ ID NO: 134080 - protein, 9 aa, Artificial Sequence
  Description of Artificial Sequence: Synthetic peptide
  Seed: AEPSGTTSV (PMEL_HUMAN)
AIPSGTTSM

SEQ ID NO: 134081 - protein, 9 aa, Artificial Sequence
  Description of Artificial Sequence: Synthetic peptide
  Seed: VSRQLRTKA (PMEL_HUMAN)
VLRQLRTKK

SEQ ID NO: 134082 - protein, 9 aa, Artificial Sequence
  Description of Artificial Sequence: Synthetic peptide
  Seed: FPDGGPCPS (PMEL_HUMAN)
FPDGGPCPW

SEQ ID NO: 134083 - protein, 9 aa, Artificial Sequence
  Description of Artificial Sequence: Synthetic peptide
  Seed: GQVPLIVGI (PMEL_HUMAN)
GRVPLIVGV

SEQ ID NO: 134084 - protein, 10 aa, Artificial Sequence
  Description of Artificial Sequence: Synthetic peptide
  Seed: MTPAEVSIVV (PMEL_HUMAN)
MPPAEVSIVA

SEQ ID NO: 134085 - protein, 10 aa, Artificial Sequence
  Description of Artificial Sequence: Synthetic peptide
  Seed: MPTAESTGMT (PMEL_HUMAN)
MQTAESTGMI

SEQ ID NO: 134086 - protein, 10 aa, Artificial Sequence
  Description of Artificial Sequence: Synthetic peptide
  Seed: VLMAVVLASL (PMEL_HUMAN)
VTMAVVLASK

SEQ ID NO: 134087 - protein, 9 aa, Artificial Sequence
  Description of Artificial Sequence: Synthetic peptide
  Seed: HTYLEPGPV (PMEL_HUMAN)
HMYLEPGPA

SEQ ID NO: 134088 - protein, 11 aa, Artificial Sequence
  Description of Artificial Sequence: Synthetic peptide
  Seed: YVPLAHSSSAF (PMEL_HUMAN)
YLPLAHSSSAY

SEQ ID NO: 134089 - protein, 10 aa, Artificial Sequence
  Description of Artificial Sequence: Synthetic peptide
  Seed: VPLDCVLYRY (PMEL_HUMAN)
VTLDCVLYRY

SEQ ID NO: 134090 - protein, 9 aa, Artificial Sequence
  Description of Artificial Sequence: Synthetic peptide
  Seed: ALLAVGATK (PMEL_HUMAN)
AALAVGATM

SEQ ID NO: 134091 - protein, 10 aa, Artificial Sequence
  Description of Artificial Sequence: Synthetic peptide
  Seed: ALDGGNKHFL (PMEL_HUMAN)
AIDGGNKHFV

SEQ ID NO: 134092 - protein, 9 aa, Artificial Sequence
  Description of Artificial Sequence: Synthetic peptide
  Seed: LHLAVIGAL (PMEL_HUMAN)
LMLAVIGAF

SEQ ID NO: 134093 - protein, 9 aa, Artificial Sequence
  Description of Artificial Sequence: Synthetic peptide
  Seed: DGGNKHFLR (PMEL_HUMAN)
DIGNKHFLR

SEQ ID NO: 134094 - protein, 9 aa, Artificial Sequence
  Description of Artificial Sequence: Synthetic peptide
  Seed: SSIMSTESI (PMEL_HUMAN)
SIIMSTESV

SEQ ID NO: 134095 - protein, 9 aa, Artificial Sequence
  Description of Artificial Sequence: Synthetic peptide
  Seed: RNQPLTFAL (PMEL_HUMAN)
RVQPLTFAV

SEQ ID NO: 134096 - protein, 11 aa, Artificial Sequence
  Description of Artificial Sequence: Synthetic peptide
  Seed: LGPLLDGTATL (PMEL_HUMAN)
LQPLLDGTATI

SEQ ID NO: 134097 - protein, 9 aa, Artificial Sequence
  Description of Artificial Sequence: Synthetic peptide
  Seed: LAVVSTQLI (PMEL_HUMAN)
LVVVSTQLW

SEQ ID NO: 134098 - protein, 10 aa, Artificial Sequence
  Description of Artificial Sequence: Synthetic peptide
  Seed: IALNFPGSQK (PMEL_HUMAN)
ISLNFPGSQY

SEQ ID NO: 134099 - protein, 9 aa, Artificial Sequence
  Description of Artificial Sequence: Synthetic peptide
  Seed: LPIPEPEGP (PMEL_HUMAN)
LPIPEPEGV

SEQ ID NO: 134100 - protein, 9 aa, Artificial Sequence
  Description of Artificial Sequence: Synthetic peptide
  Seed: VQVPTTEVI (PMEL_HUMAN)
VSVPTTEVV

SEQ ID NO: 134101 - protein, 9 aa, Artificial Sequence
  Description of Artificial Sequence: Synthetic peptide
  Seed: HTYLEPGPV (PMEL_HUMAN)
HSYLEPGPW

SEQ ID NO: 134102 - protein, 9 aa, Artificial Sequence
  Description of Artificial Sequence: Synthetic peptide
  Seed: KHFLRNQPL (PMEL_HUMAN)
KKFLRNQPY

SEQ ID NO: 134103 - protein, 10 aa, Artificial Sequence
  Description of Artificial Sequence: Synthetic peptide
  Seed: LMAVVLASLI (PMEL_HUMAN)
LMAVVLASLG

SEQ ID NO: 134104 - protein, 10 aa, Artificial Sequence
  Description of Artificial Sequence: Synthetic peptide
  Seed: SVTLDIVQGI (PMEL_HUMAN)
SMTLDIVQGI

SEQ ID NO: 134105 - protein, 9 aa, Artificial Sequence
  Description of Artificial Sequence: Synthetic peptide
  Seed: GQVPLIVGI (PMEL_HUMAN)
GVVPLIVGA

SEQ ID NO: 134106 - protein, 9 aa, Artificial Sequence
  Description of Artificial Sequence: Synthetic peptide
  Seed: FGDSSGTLI (PMEL_HUMAN)
FTDSSGTLW

SEQ ID NO: 134107 - protein, 10 aa, Artificial Sequence
  Description of Artificial Sequence: Synthetic peptide
  Seed: AMLGTHTMEV (PMEL_HUMAN)
ALLGTHTMEV

SEQ ID NO: 134108 - protein, 8 aa, Artificial Sequence
  Description of Artificial Sequence: Synthetic peptide
  Seed: FGDSSGTL (PMEL_HUMAN)
FFDSSGTM

SEQ ID NO: 134109 - protein, 9 aa, Artificial Sequence
  Description of Artificial Sequence: Synthetic peptide
  Seed: SQKRSFVYV (PMEL_HUMAN)
SKKRSFVYK

SEQ ID NO: 134110 - protein, 11 aa, Artificial Sequence
  Description of Artificial Sequence: Synthetic peptide
  Seed: TTAAQVTTTEW (PMEL_HUMAN)
TTAAQVTTTEF

SEQ ID NO: 134111 - protein, 9 aa, Artificial Sequence
  Description of Artificial Sequence: Synthetic peptide
  Seed: GTYCLNVSL (PMEL_HUMAN)
GQYCLNVSM

SEQ ID NO: 134112 - protein, 10 aa, Artificial Sequence
  Description of Artificial Sequence: Synthetic peptide
  Seed: RALDGGNKHF (PMEL_HUMAN)
RNLDGGNKHW

SEQ ID NO: 134113 - protein, 11 aa, Artificial Sequence
  Description of Artificial Sequence: Synthetic peptide
  Seed: RALDGGNKHFL (PMEL_HUMAN)
RRLDGGNKHFF

SEQ ID NO: 134114 - protein, 10 aa, Artificial Sequence
  Description of Artificial Sequence: Synthetic peptide
  Seed: AEMSTPEATG (PMEL_HUMAN)
AEMSTPEATA

SEQ ID NO: 134115 - protein, 10 aa, Artificial Sequence
  Description of Artificial Sequence: Synthetic peptide
  Seed: EVSIVVLSGT (PMEL_HUMAN)
ENSIVVLSGI

SEQ ID NO: 134116 - protein, 10 aa, Artificial Sequence
  Description of Artificial Sequence: Synthetic peptide
  Seed: LAHSSSAFTI (PMEL_HUMAN)
LSHSSSAFTY

SEQ ID NO: 134117 - protein, 11 aa, Artificial Sequence
  Description of Artificial Sequence: Synthetic peptide
  Seed: RAMLGTHTMEV (PMEL_HUMAN)
RWMLGTHTMEV

SEQ ID NO: 134118 - protein, 11 aa, Artificial Sequence
  Description of Artificial Sequence: Synthetic peptide
  Seed: HLAVIGALLAV (PMEL_HUMAN)
HYAVIGALLAV

SEQ ID NO: 134119 - protein, 10 aa, Artificial Sequence
  Description of Artificial Sequence: Synthetic peptide
  Seed: RGSRSYVPLA (PMEL_HUMAN)
RDSRSYVPLM

SEQ ID NO: 134120 - protein, 9 aa, Artificial Sequence
  Description of Artificial Sequence: Synthetic peptide
  Seed: NFPGSQKVL (PMEL_HUMAN)
NFPGSQKVY

SEQ ID NO: 134121 - protein, 10 aa, Artificial Sequence
  Description of Artificial Sequence: Synthetic peptide
  Seed: SVPQLPHSSS (PMEL_HUMAN)
SKPQLPHSSV

SEQ ID NO: 134122 - protein, 9 aa, Artificial Sequence
  Description of Artificial Sequence: Synthetic peptide
  Seed: SLADTNSLA (PMEL_HUMAN)
SMADTNSLA

SEQ ID NO: 134123 - protein, 9 aa, Artificial Sequence
  Description of Artificial Sequence: Synthetic peptide
  Seed: WSQKRSFVY (PMEL_HUMAN)
WKQKRSFVF

SEQ ID NO: 134124 - protein, 11 aa, Artificial Sequence
  Description of Artificial Sequence: Synthetic peptide
  Seed: LGPLLDGTATL (PMEL_HUMAN)
LNPLLDGTATI

SEQ ID NO: 134125 - protein, 9 aa, Artificial Sequence
  Description of Artificial Sequence: Synthetic peptide
  Seed: WSQKRSFVY (PMEL_HUMAN)
WPQKRSFVL

SEQ ID NO: 134126 - protein, 9 aa, Artificial Sequence
  Description of Artificial Sequence: Synthetic peptide
  Seed: TPAEVSIVV (PMEL_HUMAN)
TQAEVSIVI

SEQ ID NO: 134127 - protein, 10 aa, Artificial Sequence
  Description of Artificial Sequence: Synthetic peptide
  Seed: VLYRYGSFSV (PMEL_HUMAN)
VAYRYGSFSK

SEQ ID NO: 134128 - protein, 10 aa, Artificial Sequence
  Description of Artificial Sequence: Synthetic peptide
  Seed: WSQKRSFVYV (PMEL_HUMAN)
WKQKRSFVYK

SEQ ID NO: 134129 - protein, 9 aa, Artificial Sequence
  Description of Artificial Sequence: Synthetic peptide
  Seed: VMGTTLAEM (PMEL_HUMAN)
VYGTTLAEY

SEQ ID NO: 134130 - protein, 9 aa, Artificial Sequence
  Description of Artificial Sequence: Synthetic peptide
  Seed: CWRGGQVSL (PMEL_HUMAN)
CYRGGQVSM

SEQ ID NO: 134131 - protein, 9 aa, Artificial Sequence
  Description of Artificial Sequence: Synthetic peptide
  Seed: AQRLCQPVL (PMEL_HUMAN)
AHRLCQPVY

SEQ ID NO: 134132 - protein, 10 aa, Artificial Sequence
  Description of Artificial Sequence: Synthetic peptide
  Seed: LQLHDPSGYL (PMEL_HUMAN)
LSLHDPSGYV

SEQ ID NO: 134133 - protein, 10 aa, Artificial Sequence
  Description of Artificial Sequence: Synthetic peptide
  Seed: LAEADLSYTW (PMEL_HUMAN)
LMEADLSYTW

SEQ ID NO: 134134 - protein, 9 aa, Artificial Sequence
  Description of Artificial Sequence: Synthetic peptide
  Seed: AEPSGTTSV (PMEL_HUMAN)
AHPSGTTSL

SEQ ID NO: 134135 - protein, 9 aa, Artificial Sequence
  Description of Artificial Sequence: Synthetic peptide
  Seed: DSSGTLISR (PMEL_HUMAN)
DTSGTLISY

SEQ ID NO: 134136 - protein, 9 aa, Artificial Sequence
  Description of Artificial Sequence: Synthetic peptide
  Seed: MAVVLASLI (PMEL_HUMAN)
MTVVLASLL

SEQ ID NO: 134137 - protein, 9 aa, Artificial Sequence
  Description of Artificial Sequence: Synthetic peptide
  Seed: FLRNQPLTF (PMEL_HUMAN)
FPRNQPLTY

SEQ ID NO: 134138 - protein, 10 aa, Artificial Sequence
  Description of Artificial Sequence: Synthetic peptide
  Seed: SGTYCLNVSL (PMEL_HUMAN)
SPTYCLNVSY

SEQ ID NO: 134139 - protein, 10 aa, Artificial Sequence
  Description of Artificial Sequence: Synthetic peptide
  Seed: VPQLPHSSSH (PMEL_HUMAN)
VEQLPHSSSF

SEQ ID NO: 134140 - protein, 9 aa, Artificial Sequence
  Description of Artificial Sequence: Synthetic peptide
  Seed: AEADLSYTW (PMEL_HUMAN)
ASADLSYTL

SEQ ID NO: 134141 - protein, 9 aa, Artificial Sequence
  Description of Artificial Sequence: Synthetic peptide
  Seed: LHLAVIGAL (PMEL_HUMAN)
LHLAVIGAM

SEQ ID NO: 134142 - protein, 9 aa, Artificial Sequence
  Description of Artificial Sequence: Synthetic peptide
  Seed: ITGSLGPLL (PMEL_HUMAN)
ISGSLGPLW

SEQ ID NO: 134143 - protein, 9 aa, Artificial Sequence
  Description of Artificial Sequence: Synthetic peptide
  Seed: LADTNSLAV (PMEL_HUMAN)
LADTNSLAF

SEQ ID NO: 134144 - protein, 9 aa, Artificial Sequence
  Description of Artificial Sequence: Synthetic peptide
  Seed: LSIGTGRAM (PMEL_HUMAN)
LEIGTGRAM

SEQ ID NO: 134145 - protein, 9 aa, Artificial Sequence
  Description of Artificial Sequence: Synthetic peptide
  Seed: VTAQVVLQA (PMEL_HUMAN)
VMAQVVLQL

SEQ ID NO: 134146 - protein, 10 aa, Artificial Sequence
  Description of Artificial Sequence: Synthetic peptide
  Seed: VPQLPHSSSH (PMEL_HUMAN)
VKQLPHSSSM

SEQ ID NO: 134147 - protein, 9 aa, Artificial Sequence
  Description of Artificial Sequence: Synthetic peptide
  Seed: VLGGPVSGL (PMEL_HUMAN)
VIGGPVSGY

SEQ ID NO: 134148 - protein, 11 aa, Artificial Sequence
  Description of Artificial Sequence: Synthetic peptide
  Seed: TWDFGDSSGTL (PMEL_HUMAN)
TTDFGDSSGTF

SEQ ID NO: 134149 - protein, 9 aa, Artificial Sequence
  Description of Artificial Sequence: Synthetic peptide
  Seed: VSNDGPTLI (PMEL_HUMAN)
VVNDGPTLW

SEQ ID NO: 134150 - protein, 9 aa, Artificial Sequence
  Description of Artificial Sequence: Synthetic peptide
  Seed: VTLDIVQGI (PMEL_HUMAN)
VMLDIVQGF

SEQ ID NO: 134151 - protein, 9 aa, Artificial Sequence
  Description of Artificial Sequence: Synthetic peptide
  Seed: VQVPTTEVI (PMEL_HUMAN)
VMVPTTEVW

SEQ ID NO: 134152 - protein, 11 aa, Artificial Sequence
  Description of Artificial Sequence: Synthetic peptide
  Seed: WDFGDSSGTLI (PMEL_HUMAN)
WEFGDSSGTLL

SEQ ID NO: 134153 - protein, 8 aa, Artificial Sequence
  Description of Artificial Sequence: Synthetic peptide
  Seed: VLPDGQVI (PMEL_HUMAN)
VGPDGQVL

SEQ ID NO: 134154 - protein, 9 aa, Artificial Sequence
  Description of Artificial Sequence: Synthetic peptide
  Seed: LIVGILLVL (PMEL_HUMAN)
LSVGILLVL

SEQ ID NO: 134155 - protein, 10 aa, Artificial Sequence
  Description of Artificial Sequence: Synthetic peptide
  Seed: GLSIGTGRAM (PMEL_HUMAN)
GMSIGTGRAM

SEQ ID NO: 134156 - protein, 9 aa, Artificial Sequence
  Description of Artificial Sequence: Synthetic peptide
  Seed: YLAEADLSY (PMEL_HUMAN)
YFAEADLSF

SEQ ID NO: 134157 - protein, 9 aa, Artificial Sequence
  Description of Artificial Sequence: Synthetic peptide
  Seed: SQVWGGQPV (PMEL_HUMAN)
SEVWGGQPA

SEQ ID NO: 134158 - protein, 9 aa, Artificial Sequence
  Description of Artificial Sequence: Synthetic peptide
  Seed: VTLDIVQGI (PMEL_HUMAN)
VMLDIVQGC

SEQ ID NO: 134159 - protein, 9 aa, Artificial Sequence
  Description of Artificial Sequence: Synthetic peptide
  Seed: VSVSQLRAL (PMEL_HUMAN)
VQVSQLRAF

SEQ ID NO: 134160 - protein, 9 aa, Artificial Sequence
  Description of Artificial Sequence: Synthetic peptide
  Seed: LADTNSLAV (PMEL_HUMAN)
LTDTNSLAI

SEQ ID NO: 134161 - protein, 9 aa, Artificial Sequence
  Description of Artificial Sequence: Synthetic peptide
  Seed: LNFPGSQKV (PMEL_HUMAN)
LLFPGSQKM

SEQ ID NO: 134162 - protein, 9 aa, Artificial Sequence
  Description of Artificial Sequence: Synthetic peptide
  Seed: EVMGTTLAE (PMEL_HUMAN)
EVMGTTLAY

SEQ ID NO: 134163 - protein, 9 aa, Artificial Sequence
  Description of Artificial Sequence: Synthetic peptide
  Seed: VISTAPVQM (PMEL_HUMAN)
VYSTAPVQM

SEQ ID NO: 134164 - protein, 9 aa, Artificial Sequence
  Description of Artificial Sequence: Synthetic peptide
  Seed: KRCLLHLAV (PMEL_HUMAN)
KRCLLHLAI

SEQ ID NO: 134165 - protein, 10 aa, Artificial Sequence
  Description of Artificial Sequence: Synthetic peptide
  Seed: LIMPGQEAGL (PMEL_HUMAN)
LLMPGQEAGL

SEQ ID NO: 134166 - protein, 9 aa, Artificial Sequence
  Description of Artificial Sequence: Synthetic peptide
  Seed: ITDQVPFSV (PMEL_HUMAN)
IVDQVPFSM

SEQ ID NO: 134167 - protein, 10 aa, Artificial Sequence
  Description of Artificial Sequence: Synthetic peptide
  Seed: LHLAVIGALL (PMEL_HUMAN)
LDLAVIGALV

SEQ ID NO: 134168 - protein, 10 aa, Artificial Sequence
  Description of Artificial Sequence: Synthetic peptide
  Seed: YVWKTWGQYW (PMEL_HUMAN)
YMWKTWGQYF

SEQ ID NO: 134169 - protein, 9 aa, Artificial Sequence
  Description of Artificial Sequence: Synthetic peptide
  Seed: YLAEADLSY (PMEL_HUMAN)
YLAEADLSW

SEQ ID NO: 134170 - protein, 9 aa, Artificial Sequence
  Description of Artificial Sequence: Synthetic peptide
  Seed: VQVPTTEVI (PMEL_HUMAN)
VMVPTTEVV

SEQ ID NO: 134171 - protein, 9 aa, Artificial Sequence
  Description of Artificial Sequence: Synthetic peptide
  Seed: SLAVVSTQL (PMEL_HUMAN)
SVAVVSTQV

SEQ ID NO: 134172 - protein, 10 aa, Artificial Sequence
  Description of Artificial Sequence: Synthetic peptide
  Seed: YLAEADLSYT (PMEL_HUMAN)
YAAEADLSYA

SEQ ID NO: 134173 - protein, 9 aa, Artificial Sequence
  Description of Artificial Sequence: Synthetic peptide
  Seed: FTITDQVPF (PMEL_HUMAN)
FPITDQVPH

SEQ ID NO: 134174 - protein, 9 aa, Artificial Sequence
  Description of Artificial Sequence: Synthetic peptide
  Seed: VVLQAAIPL (PMEL_HUMAN)
VQLQAAIPF

SEQ ID NO: 134175 - protein, 9 aa, Artificial Sequence
  Description of Artificial Sequence: Synthetic peptide
  Seed: AEADLSYTW (PMEL_HUMAN)
AVADLSYTY

SEQ ID NO: 134176 - protein, 9 aa, Artificial Sequence
  Description of Artificial Sequence: Synthetic peptide
  Seed: FGDSSGTLI (PMEL_HUMAN)
FEDSSGTLL

SEQ ID NO: 134177 - protein, 10 aa, Artificial Sequence
  Description of Artificial Sequence: Synthetic peptide
  Seed: VTAQVVLQAA (PMEL_HUMAN)
VMAQVVLQAA

SEQ ID NO: 134178 - protein, 10 aa, Artificial Sequence
  Description of Artificial Sequence: Synthetic peptide
  Seed: ESAEILQAVP (PMEL_HUMAN)
EVAEILQAVG

SEQ ID NO: 134179 - protein, 10 aa, Artificial Sequence
  Description of Artificial Sequence: Synthetic peptide
  Seed: YGSFSVTLDI (PMEL_HUMAN)
YGSFSVTLDF

SEQ ID NO: 134180 - protein, 10 aa, Artificial Sequence
  Description of Artificial Sequence: Synthetic peptide
  Seed: KTWGQYWQVL (PMEL_HUMAN)
KLWGQYWQVW

SEQ ID NO: 134181 - protein, 10 aa, Artificial Sequence
  Description of Artificial Sequence: Synthetic peptide
  Seed: SLADTNSLAV (PMEL_HUMAN)
SIADTNSLAI

SEQ ID NO: 134182 - protein, 10 aa, Artificial Sequence
  Description of Artificial Sequence: Synthetic peptide
  Seed: GRAMLGTHTM (PMEL_HUMAN)
GMAMLGTHTF

SEQ ID NO: 134183 - protein, 9 aa, Artificial Sequence
  Description of Artificial Sequence: Synthetic peptide
  Seed: KVLPDGQVI (PMEL_HUMAN)
KTLPDGQVF

SEQ ID NO: 134184 - protein, 9 aa, Artificial Sequence
  Description of Artificial Sequence: Synthetic peptide
  Seed: LYRYGSFSV (PMEL_HUMAN)
LSRYGSFSV

SEQ ID NO: 134185 - protein, 9 aa, Artificial Sequence
  Description of Artificial Sequence: Synthetic peptide
  Seed: VTAQVVLQA (PMEL_HUMAN)
VSAQVVLQV

SEQ ID NO: 134186 - protein, 10 aa, Artificial Sequence
  Description of Artificial Sequence: Synthetic peptide
  Seed: MTPAEVSIVV (PMEL_HUMAN)
MTPAEVSIVA

SEQ ID NO: 134187 - protein, 10 aa, Artificial Sequence
  Description of Artificial Sequence: Synthetic peptide
  Seed: RGSRSYVPLA (PMEL_HUMAN)
RKSRSYVPLS

SEQ ID NO: 134188 - protein, 11 aa, Artificial Sequence
  Description of Artificial Sequence: Synthetic peptide
  Seed: RQVPLDCVLYR (PMEL_HUMAN)
RKVPLDCVLYF

SEQ ID NO: 134189 - protein, 11 aa, Artificial Sequence
  Description of Artificial Sequence: Synthetic peptide
  Seed: RRGSRSYVPLA (PMEL_HUMAN)
RRGSRSYVPLK

SEQ ID NO: 134190 - protein, 10 aa, Artificial Sequence
  Description of Artificial Sequence: Synthetic peptide
  Seed: MTPAEVSIVV (PMEL_HUMAN)
MLPAEVSIVI

SEQ ID NO: 134191 - protein, 9 aa, Artificial Sequence
  Description of Artificial Sequence: Synthetic peptide
  Seed: HTMEVTVYH (PMEL_HUMAN)
HSMEVTVYM

SEQ ID NO: 134192 - protein, 8 aa, Artificial Sequence
  Description of Artificial Sequence: Synthetic peptide
  Seed: TLDIVQGI (PMEL_HUMAN)
TSDIVQGV

SEQ ID NO: 134193 - protein, 10 aa, Artificial Sequence
  Description of Artificial Sequence: Synthetic peptide
  Seed: RGSRSYVPLA (PMEL_HUMAN)
RWSRSYVPLA

SEQ ID NO: 134194 - protein, 9 aa, Artificial Sequence
  Description of Artificial Sequence: Synthetic peptide
  Seed: HTMEVTVYH (PMEL_HUMAN)
HCMEVTVYY

SEQ ID NO: 134195 - protein, 10 aa, Artificial Sequence
  Description of Artificial Sequence: Synthetic peptide
  Seed: AVIGALLAVG (PMEL_HUMAN)
ATIGALLAVL

SEQ ID NO: 134196 - protein, 9 aa, Artificial Sequence
  Description of Artificial Sequence: Synthetic peptide
  Seed: LPDGQVIWV (PMEL_HUMAN)
LFDGQVIWV

SEQ ID NO: 134197 - protein, 10 aa, Artificial Sequence
  Description of Artificial Sequence: Synthetic peptide
  Seed: AVVLASLIYR (PMEL_HUMAN)
AWVLASLIYR

SEQ ID NO: 134198 - protein, 10 aa, Artificial Sequence
  Description of Artificial Sequence: Synthetic peptide
  Seed: TLAEMSTPEA (PMEL_HUMAN)
TMAEMSTPEV

SEQ ID NO: 134199 - protein, 9 aa, Artificial Sequence
  Description of Artificial Sequence: Synthetic peptide
  Seed: ISRALVVTH (PMEL_HUMAN)
ISRALVVTM

SEQ ID NO: 134200 - protein, 9 aa, Artificial Sequence
  Description of Artificial Sequence: Synthetic peptide
  Seed: KAWNRQLYP (PMEL_HUMAN)
KSWNRQLYS

SEQ ID NO: 134201 - protein, 11 aa, Artificial Sequence
  Description of Artificial Sequence: Synthetic peptide
  Seed: FGDSSGTLISR (PMEL_HUMAN)
FLDSSGTLISI

SEQ ID NO: 134202 - protein, 9 aa, Artificial Sequence
  Description of Artificial Sequence: Synthetic peptide
  Seed: EVVGTTPGQ (PMEL_HUMAN)
ESVGTTPGR

SEQ ID NO: 134203 - protein, 9 aa, Artificial Sequence
  Description of Artificial Sequence: Synthetic peptide
  Seed: VQMPTAEST (PMEL_HUMAN)
VIMPTAESF

SEQ ID NO: 134204 - protein, 9 aa, Artificial Sequence
  Description of Artificial Sequence: Synthetic peptide
  Seed: TTPGQAPTA (PMEL_HUMAN)
TSPGQAPTY

SEQ ID NO: 134205 - protein, 9 aa, Artificial Sequence
  Description of Artificial Sequence: Synthetic peptide
  Seed: AVVLASLIY (PMEL_HUMAN)
AIVLASLIY

SEQ ID NO: 134206 - protein, 9 aa, Artificial Sequence
  Description of Artificial Sequence: Synthetic peptide
  Seed: SLAVVSTQL (PMEL_HUMAN)
SAAVVSTQL

SEQ ID NO: 134207 - protein, 10 aa, Artificial Sequence
  Description of Artificial Sequence: Synthetic peptide
  Seed: RSFVYVWKTW (PMEL_HUMAN)
RYFVYVWKTW

SEQ ID NO: 134208 - protein, 11 aa, Artificial Sequence
  Description of Artificial Sequence: Synthetic peptide
  Seed: RRRLMKQDFSV (PMEL_HUMAN)
RRRLMKQDFSI

SEQ ID NO: 134209 - protein, 9 aa, Artificial Sequence
  Description of Artificial Sequence: Synthetic peptide
  Seed: TIINGSQVW (PMEL_HUMAN)
TTINGSQVM

SEQ ID NO: 134210 - protein, 9 aa, Artificial Sequence
  Description of Artificial Sequence: Synthetic peptide
  Seed: ILKGGSGTY (PMEL_HUMAN)
IYKGGSGTV

SEQ ID NO: 134211 - protein, 9 aa, Artificial Sequence
  Description of Artificial Sequence: Synthetic peptide
  Seed: QKRSFVYVW (PMEL_HUMAN)
QSRSFVYVY

SEQ ID NO: 134212 - protein, 10 aa, Artificial Sequence
  Description of Artificial Sequence: Synthetic peptide
  Seed: LHLAVIGALL (PMEL_HUMAN)
LVLAVIGALL

SEQ ID NO: 134213 - protein, 10 aa, Artificial Sequence
  Description of Artificial Sequence: Synthetic peptide
  Seed: MAVVLASLIY (PMEL_HUMAN)
MIVVLASLIR

SEQ ID NO: 134214 - protein, 10 aa, Artificial Sequence
  Description of Artificial Sequence: Synthetic peptide
  Seed: LVLMAVVLAS (PMEL_HUMAN)
LFLMAVVLAM

SEQ ID NO: 134215 - protein, 9 aa, Artificial Sequence
  Description of Artificial Sequence: Synthetic peptide
  Seed: RALVVTHTY (PMEL_HUMAN)
RSLVVTHTL

SEQ ID NO: 134216 - protein, 10 aa, Artificial Sequence
  Description of Artificial Sequence: Synthetic peptide
  Seed: RYGSFSVTLD (PMEL_HUMAN)
RWGSFSVTLW

SEQ ID NO: 134217 - protein, 9 aa, Artificial Sequence
  Description of Artificial Sequence: Synthetic peptide
  Seed: VSNDGPTLI (PMEL_HUMAN)
VLNDGPTLY

SEQ ID NO: 134218 - protein, 9 aa, Artificial Sequence
  Description of Artificial Sequence: Synthetic peptide
  Seed: ASFSIALNF (PMEL_HUMAN)
ASFSIALNI

SEQ ID NO: 134219 - protein, 9 aa, Artificial Sequence
  Description of Artificial Sequence: Synthetic peptide
  Seed: FPDGGPCPS (PMEL_HUMAN)
FPDGGPCPY

SEQ ID NO: 134220 - protein, 9 aa, Artificial Sequence
  Description of Artificial Sequence: Synthetic peptide
  Seed: ALNFPGSQK (PMEL_HUMAN)
AANFPGSQK

SEQ ID NO: 134221 - protein, 11 aa, Artificial Sequence
  Description of Artificial Sequence: Synthetic peptide
  Seed: TEWVETTAREL (PMEL_HUMAN)
TEWVETTAREF

SEQ ID NO: 134222 - protein, 10 aa, Artificial Sequence
  Description of Artificial Sequence: Synthetic peptide
  Seed: SVPQLPHSSS (PMEL_HUMAN)
STPQLPHSSV

SEQ ID NO: 134223 - protein, 10 aa, Artificial Sequence
  Description of Artificial Sequence: Synthetic peptide
  Seed: RQLYPEWTEA (PMEL_HUMAN)
RYLYPEWTEI

SEQ ID NO: 134224 - protein, 9 aa, Artificial Sequence
  Description of Artificial Sequence: Synthetic peptide
  Seed: VQVPTTEVI (PMEL_HUMAN)
VLVPTTEVY

SEQ ID NO: 134225 - protein, 9 aa, Artificial Sequence
  Description of Artificial Sequence: Synthetic peptide
  Seed: VLQAAIPLT (PMEL_HUMAN)
VMQAAIPLL

SEQ ID NO: 134226 - protein, 9 aa, Artificial Sequence
  Description of Artificial Sequence: Synthetic peptide
  Seed: VLPDGQVIW (PMEL_HUMAN)
VIPDGQVIV

SEQ ID NO: 134227 - protein, 9 aa, Artificial Sequence
  Description of Artificial Sequence: Synthetic peptide
  Seed: SSIMSTESI (PMEL_HUMAN)
SSIMSTESY

SEQ ID NO: 134228 - protein, 10 aa, Artificial Sequence
  Description of Artificial Sequence: Synthetic peptide
  Seed: TYLEPGPVTA (PMEL_HUMAN)
THLEPGPVTT

SEQ ID NO: 134229 - protein, 9 aa, Artificial Sequence
  Description of Artificial Sequence: Synthetic peptide
  Seed: TLIGANASF (PMEL_HUMAN)
TGIGANASF

SEQ ID NO: 134230 - protein, 10 aa, Artificial Sequence
  Description of Artificial Sequence: Synthetic peptide
  Seed: LAVIGALLAV (PMEL_HUMAN)
LRVIGALLAI

SEQ ID NO: 134231 - protein, 10 aa, Artificial Sequence
  Description of Artificial Sequence: Synthetic peptide
  Seed: IALNFPGSQK (PMEL_HUMAN)
IWLNFPGSQR

SEQ ID NO: 134232 - protein, 10 aa, Artificial Sequence
  Description of Artificial Sequence: Synthetic peptide
  Seed: RGSRSYVPLA (PMEL_HUMAN)
RGSRSYVPLY

SEQ ID NO: 134233 - protein, 10 aa, Artificial Sequence
  Description of Artificial Sequence: Synthetic peptide
  Seed: LVLMAVVLAS (PMEL_HUMAN)
LWLMAVVLAL

SEQ ID NO: 134234 - protein, 9 aa, Artificial Sequence
  Description of Artificial Sequence: Synthetic peptide
  Seed: ITDQVPFSV (PMEL_HUMAN)
IMDQVPFSR

SEQ ID NO: 134235 - protein, 10 aa, Artificial Sequence
  Description of Artificial Sequence: Synthetic peptide
  Seed: VLMAVVLASL (PMEL_HUMAN)
VHMAVVLASL

SEQ ID NO: 134236 - protein, 9 aa, Artificial Sequence
  Description of Artificial Sequence: Synthetic peptide
  Seed: KTWGQYWQV (PMEL_HUMAN)
KFWGQYWQF

SEQ ID NO: 134237 - protein, 9 aa, Artificial Sequence
  Description of Artificial Sequence: Synthetic peptide
  Seed: VQMPTAEST (PMEL_HUMAN)
VTMPTAESF

SEQ ID NO: 134238 - protein, 9 aa, Artificial Sequence
  Description of Artificial Sequence: Synthetic peptide
  Seed: ITGSLGPLL (PMEL_HUMAN)
ILGSLGPLL

SEQ ID NO: 134239 - protein, 9 aa, Artificial Sequence
  Description of Artificial Sequence: Synthetic peptide
  Seed: TYLEPGPVT (PMEL_HUMAN)
TFLEPGPVY

SEQ ID NO: 134240 - protein, 10 aa, Artificial Sequence
  Description of Artificial Sequence: Synthetic peptide
  Seed: RGSRSYVPLA (PMEL_HUMAN)
RDSRSYVPLT

SEQ ID NO: 134241 - protein, 9 aa, Artificial Sequence
  Description of Artificial Sequence: Synthetic peptide
  Seed: RQVPLDCVL (PMEL_HUMAN)
RRVPLDCVM

SEQ ID NO: 134242 - protein, 9 aa, Artificial Sequence
  Description of Artificial Sequence: Synthetic peptide
  Seed: VMGTTLAEM (PMEL_HUMAN)
VIGTTLAEF

SEQ ID NO: 134243 - protein, 9 aa, Artificial Sequence
  Description of Artificial Sequence: Synthetic peptide
  Seed: VPLDCVLYR (PMEL_HUMAN)
VSLDCVLYK

SEQ ID NO: 134244 - protein, 10 aa, Artificial Sequence
  Description of Artificial Sequence: Synthetic peptide
  Seed: VLASLIYRRR (PMEL_HUMAN)
VIASLIYRRR

SEQ ID NO: 134245 - protein, 10 aa, Artificial Sequence
  Description of Artificial Sequence: Synthetic peptide
  Seed: YLAEADLSYT (PMEL_HUMAN)
YLAEADLSYL

SEQ ID NO: 134246 - protein, 9 aa, Artificial Sequence
  Description of Artificial Sequence: Synthetic peptide
  Seed: QVWGGQPVY (PMEL_HUMAN)
QSWGGQPVL

SEQ ID NO: 134247 - protein, 10 aa, Artificial Sequence
  Description of Artificial Sequence: Synthetic peptide
  Seed: MTPAEVSIVV (PMEL_HUMAN)
MEPAEVSIVT

SEQ ID NO: 134248 - protein, 9 aa, Artificial Sequence
  Description of Artificial Sequence: Synthetic peptide
  Seed: FTITDQVPF (PMEL_HUMAN)
FLITDQVPA

SEQ ID NO: 134249 - protein, 9 aa, Artificial Sequence
  Description of Artificial Sequence: Synthetic peptide
  Seed: SGTLISRAL (PMEL_HUMAN)
SATLISRAM

SEQ ID NO: 134250 - protein, 9 aa, Artificial Sequence
  Description of Artificial Sequence: Synthetic peptide
  Seed: LHDPSGYLA (PMEL_HUMAN)
LHDPSGYLI

SEQ ID NO: 134251 - protein, 10 aa, Artificial Sequence
  Description of Artificial Sequence: Synthetic peptide
  Seed: YVWKTWGQYW (PMEL_HUMAN)
YHWKTWGQYF

SEQ ID NO: 134252 - protein, 9 aa, Artificial Sequence
  Description of Artificial Sequence: Synthetic peptide
  Seed: VQMPTAEST (PMEL_HUMAN)
VMMPTAESV

SEQ ID NO: 134253 - protein, 11 aa, Artificial Sequence
  Description of Artificial Sequence: Synthetic peptide
  Seed: SAFTITDQVPF (PMEL_HUMAN)
SQFTITDQVPM

SEQ ID NO: 134254 - protein, 9 aa, Artificial Sequence
  Description of Artificial Sequence: Synthetic peptide
  Seed: WSQKRSFVY (PMEL_HUMAN)
WPQKRSFVY

SEQ ID NO: 134255 - protein, 10 aa, Artificial Sequence
  Description of Artificial Sequence: Synthetic peptide
  Seed: IFPDGGPCPS (PMEL_HUMAN)
IWPDGGPCPL

SEQ ID NO: 134256 - protein, 11 aa, Artificial Sequence
  Description of Artificial Sequence: Synthetic peptide
  Seed: YLAEADLSYTW (PMEL_HUMAN)
YLAEADLSYTL

SEQ ID NO: 134257 - protein, 10 aa, Artificial Sequence
  Description of Artificial Sequence: Synthetic peptide
  Seed: LHLAVIGALL (PMEL_HUMAN)
LMLAVIGALL

SEQ ID NO: 134258 - protein, 11 aa, Artificial Sequence
  Description of Artificial Sequence: Synthetic peptide
  Seed: VSLADTNSLAV (PMEL_HUMAN)
VYLADTNSLAV

SEQ ID NO: 134259 - protein, 8 aa, Artificial Sequence
  Description of Artificial Sequence: Synthetic peptide
  Seed: YGSFSVTL (PMEL_HUMAN)
YTSFSVTL

SEQ ID NO: 134260 - protein, 11 aa, Artificial Sequence
  Description of Artificial Sequence: Synthetic peptide
  Seed: SLADTNSLAVV (PMEL_HUMAN)
SLADTNSLAVM

SEQ ID NO: 134261 - protein, 9 aa, Artificial Sequence
  Description of Artificial Sequence: Synthetic peptide
  Seed: RLVKRQVPL (PMEL_HUMAN)
RVVKRQVPI

SEQ ID NO: 134262 - protein, 9 aa, Artificial Sequence
  Description of Artificial Sequence: Synthetic peptide
  Seed: HTMEVTVYH (PMEL_HUMAN)
HVMEVTVYA

SEQ ID NO: 134263 - protein, 10 aa, Artificial Sequence
  Description of Artificial Sequence: Synthetic peptide
  Seed: RGSRSYVPLA (PMEL_HUMAN)
RWSRSYVPLR

SEQ ID NO: 134264 - protein, 10 aa, Artificial Sequence
  Description of Artificial Sequence: Synthetic peptide
  Seed: LAEADLSYTW (PMEL_HUMAN)
LPEADLSYTW

SEQ ID NO: 134265 - protein, 9 aa, Artificial Sequence
  Description of Artificial Sequence: Synthetic peptide
  Seed: RGGQVSLKV (PMEL_HUMAN)
RSGQVSLKV

SEQ ID NO: 134266 - protein, 9 aa, Artificial Sequence
  Description of Artificial Sequence: Synthetic peptide
  Seed: KTWGQYWQV (PMEL_HUMAN)
KAWGQYWQR

SEQ ID NO: 134267 - protein, 9 aa, Artificial Sequence
  Description of Artificial Sequence: Synthetic peptide
  Seed: MTPEKVPVS (PMEL_HUMAN)
MGPEKVPVL

SEQ ID NO: 134268 - protein, 9 aa, Artificial Sequence
  Description of Artificial Sequence: Synthetic peptide
  Seed: LAVGATKVP (PMEL_HUMAN)
LSVGATKVF

SEQ ID NO: 134269 - protein, 10 aa, Artificial Sequence
  Description of Artificial Sequence: Synthetic peptide
  Seed: MTPAEVSIVV (PMEL_HUMAN)
MGPAEVSIVW

SEQ ID NO: 134270 - protein, 9 aa, Artificial Sequence
  Description of Artificial Sequence: Synthetic peptide
  Seed: HSSSHWLRL (PMEL_HUMAN)
HTSSHWLRV

SEQ ID NO: 134271 - protein, 9 aa, Artificial Sequence
  Description of Artificial Sequence: Synthetic peptide
  Seed: KTWGQYWQV (PMEL_HUMAN)
KIWGQYWQR

SEQ ID NO: 134272 - protein, 9 aa, Artificial Sequence
  Description of Artificial Sequence: Synthetic peptide
  Seed: GTYCLNVSL (PMEL_HUMAN)
GMYCLNVSR

SEQ ID NO: 134273 - protein, 9 aa, Artificial Sequence
  Description of Artificial Sequence: Synthetic peptide
  Seed: LMAVVLASL (PMEL_HUMAN)
LEAVVLASY

SEQ ID NO: 134274 - protein, 10 aa, Artificial Sequence
  Description of Artificial Sequence: Synthetic peptide
  Seed: LVLMAVVLAS (PMEL_HUMAN)
LMLMAVVLAI

SEQ ID NO: 134275 - protein, 9 aa, Artificial Sequence
  Description of Artificial Sequence: Synthetic peptide
  Seed: QAAIPLTSC (PMEL_HUMAN)
QAAIPLTSH

SEQ ID NO: 134276 - protein, 10 aa, Artificial Sequence
  Description of Artificial Sequence: Synthetic peptide
  Seed: LHLAVIGALL (PMEL_HUMAN)
LKLAVIGALL

SEQ ID NO: 134277 - protein, 9 aa, Artificial Sequence
  Description of Artificial Sequence: Synthetic peptide
  Seed: VISTAPVQM (PMEL_HUMAN)
VLSTAPVQA

SEQ ID NO: 134278 - protein, 10 aa, Artificial Sequence
  Description of Artificial Sequence: Synthetic peptide
  Seed: MTPAEVSIVV (PMEL_HUMAN)
MFPAEVSIVW

SEQ ID NO: 134279 - protein, 9 aa, Artificial Sequence
  Description of Artificial Sequence: Synthetic peptide
  Seed: RNQPLTFAL (PMEL_HUMAN)
RMQPLTFAW

SEQ ID NO: 134280 - protein, 10 aa, Artificial Sequence
  Description of Artificial Sequence: Synthetic peptide
  Seed: GEGDAFELTV (PMEL_HUMAN)
GQGDAFELTI

SEQ ID NO: 134281 - protein, 9 aa, Artificial Sequence
  Description of Artificial Sequence: Synthetic peptide
  Seed: RLVKRQVPL (PMEL_HUMAN)
RAVKRQVPM

SEQ ID NO: 134282 - protein, 10 aa, Artificial Sequence
  Description of Artificial Sequence: Synthetic peptide
  Seed: VPQLPHSSSH (PMEL_HUMAN)
VAQLPHSSSF

SEQ ID NO: 134283 - protein, 10 aa, Artificial Sequence
  Description of Artificial Sequence: Synthetic peptide
  Seed: RQLRTKAWNR (PMEL_HUMAN)
RDLRTKAWNR

SEQ ID NO: 134284 - protein, 10 aa, Artificial Sequence
  Description of Artificial Sequence: Synthetic peptide
  Seed: YRYGSFSVTL (PMEL_HUMAN)
YSYGSFSVTL

SEQ ID NO: 134285 - protein, 9 aa, Artificial Sequence
  Description of Artificial Sequence: Synthetic peptide
  Seed: VSLADTNSL (PMEL_HUMAN)
VRLADTNSY

SEQ ID NO: 134286 - protein, 9 aa, Artificial Sequence
  Description of Artificial Sequence: Synthetic peptide
  Seed: VLPDGQVIW (PMEL_HUMAN)
VAPDGQVIM

SEQ ID NO: 134287 - protein, 8 aa, Artificial Sequence
  Description of Artificial Sequence: Synthetic peptide
  Seed: HTMEVTVY (PMEL_HUMAN)
HPMEVTVM

SEQ ID NO: 134288 - protein, 10 aa, Artificial Sequence
  Description of Artificial Sequence: Synthetic peptide
  Seed: MTPAEVSIVV (PMEL_HUMAN)
MNPAEVSIVT

SEQ ID NO: 134289 - protein, 10 aa, Artificial Sequence
  Description of Artificial Sequence: Synthetic peptide
  Seed: VLMAVVLASL (PMEL_HUMAN)
VRMAVVLASL

SEQ ID NO: 134290 - protein, 10 aa, Artificial Sequence
  Description of Artificial Sequence: Synthetic peptide
  Seed: YGSFSVTLDI (PMEL_HUMAN)
YASFSVTLDW

SEQ ID NO: 134291 - protein, 9 aa, Artificial Sequence
  Description of Artificial Sequence: Synthetic peptide
  Seed: HSSSHWLRL (PMEL_HUMAN)
HQSSHWLRM

SEQ ID NO: 134292 - protein, 9 aa, Artificial Sequence
  Description of Artificial Sequence: Synthetic peptide
  Seed: QLVLHQILK (PMEL_HUMAN)
QAVLHQILR

SEQ ID NO: 134293 - protein, 9 aa, Artificial Sequence
  Description of Artificial Sequence: Synthetic peptide
  Seed: TTDGHRPTA (PMEL_HUMAN)
TVDGHRPTY

SEQ ID NO: 134294 - protein, 10 aa, Artificial Sequence
  Description of Artificial Sequence: Synthetic peptide
  Seed: AVIGALLAVG (PMEL_HUMAN)
AQIGALLAVL

SEQ ID NO: 134295 - protein, 9 aa, Artificial Sequence
  Description of Artificial Sequence: Synthetic peptide
  Seed: SLIYRRRLM (PMEL_HUMAN)
SMIYRRRLM

SEQ ID NO: 134296 - protein, 9 aa, Artificial Sequence
  Description of Artificial Sequence: Synthetic peptide
  Seed: VPLAHSSSA (PMEL_HUMAN)
VPLAHSSSV

SEQ ID NO: 134297 - protein, 9 aa, Artificial Sequence
  Description of Artificial Sequence: Synthetic peptide
  Seed: KQDFSVPQL (PMEL_HUMAN)
KSDFSVPQF

SEQ ID NO: 134298 - protein, 9 aa, Artificial Sequence
  Description of Artificial Sequence: Synthetic peptide
  Seed: SQKRSFVYV (PMEL_HUMAN)
SMKRSFVYI

SEQ ID NO: 134299 - protein, 9 aa, Artificial Sequence
  Description of Artificial Sequence: Synthetic peptide
  Seed: TTDGHRPTA (PMEL_HUMAN)
TCDGHRPTM

SEQ ID NO: 134300 - protein, 9 aa, Artificial Sequence
  Description of Artificial Sequence: Synthetic peptide
  Seed: RQVPLDCVL (PMEL_HUMAN)
RIVPLDCVI

SEQ ID NO: 134301 - protein, 10 aa, Artificial Sequence
  Description of Artificial Sequence: Synthetic peptide
  Seed: SGTLISRALV (PMEL_HUMAN)
SVTLISRALV

SEQ ID NO: 134302 - protein, 9 aa, Artificial Sequence
  Description of Artificial Sequence: Synthetic peptide
  Seed: RAMLGTHTM (PMEL_HUMAN)
RLMLGTHTM

SEQ ID NO: 134303 - protein, 9 aa, Artificial Sequence
  Description of Artificial Sequence: Synthetic peptide
  Seed: ANASFSIAL (PMEL_HUMAN)
AGASFSIAF

SEQ ID NO: 134304 - protein, 10 aa, Artificial Sequence
  Description of Artificial Sequence: Synthetic peptide
  Seed: EVVGTTPGQA (PMEL_HUMAN)
ETVGTTPGQF

SEQ ID NO: 134305 - protein, 9 aa, Artificial Sequence
  Description of Artificial Sequence: Synthetic peptide
  Seed: AEVSIVVLS (PMEL_HUMAN)
AEVSIVVLM

SEQ ID NO: 134306 - protein, 10 aa, Artificial Sequence
  Description of Artificial Sequence: Synthetic peptide
  Seed: VYVWKTWGQY (PMEL_HUMAN)
VYVWKTWGQF

SEQ ID NO: 134307 - protein, 9 aa, Artificial Sequence
  Description of Artificial Sequence: Synthetic peptide
  Seed: RSFVYVWKT (PMEL_HUMAN)
RMFVYVWKK

SEQ ID NO: 134308 - protein, 10 aa, Artificial Sequence
  Description of Artificial Sequence: Synthetic peptide
  Seed: SVPQLPHSSS (PMEL_HUMAN)
SHPQLPHSSV

SEQ ID NO: 134309 - protein, 9 aa, Artificial Sequence
  Description of Artificial Sequence: Synthetic peptide
  Seed: ASFSIALNF (PMEL_HUMAN)
AKFSIALNF

SEQ ID NO: 134310 - protein, 9 aa, Artificial Sequence
  Description of Artificial Sequence: Synthetic peptide
  Seed: SSIMSTESI (PMEL_HUMAN)
STIMSTESI

SEQ ID NO: 134311 - protein, 9 aa, Artificial Sequence
  Description of Artificial Sequence: Synthetic peptide
  Seed: SGTLISRAL (PMEL_HUMAN)
SSTLISRAF

SEQ ID NO: 134312 - protein, 10 aa, Artificial Sequence
  Description of Artificial Sequence: Synthetic peptide
  Seed: VYVWKTWGQY (PMEL_HUMAN)
VYVWKTWGQM

SEQ ID NO: 134313 - protein, 10 aa, Artificial Sequence
  Description of Artificial Sequence: Synthetic peptide
  Seed: VPLAHSSSAF (PMEL_HUMAN)
VMLAHSSSAY

SEQ ID NO: 134314 - protein, 11 aa, Artificial Sequence
  Description of Artificial Sequence: Synthetic peptide
  Seed: VSLADTNSLAV (PMEL_HUMAN)
VYLADTNSLAL

SEQ ID NO: 134315 - protein, 11 aa, Artificial Sequence
  Description of Artificial Sequence: Synthetic peptide
  Seed: MAVVLASLIYR (PMEL_HUMAN)
MPVVLASLIYK

SEQ ID NO: 134316 - protein, 10 aa, Artificial Sequence
  Description of Artificial Sequence: Synthetic peptide
  Seed: SGTYCLNVSL (PMEL_HUMAN)
SPTYCLNVSV

SEQ ID NO: 134317 - protein, 9 aa, Artificial Sequence
  Description of Artificial Sequence: Synthetic peptide
  Seed: ASFSIALNF (PMEL_HUMAN)
AFFSIALNY

SEQ ID NO: 134318 - protein, 10 aa, Artificial Sequence
  Description of Artificial Sequence: Synthetic peptide
  Seed: ALDGGNKHFL (PMEL_HUMAN)
AGDGGNKHFF

SEQ ID NO: 134319 - protein, 9 aa, Artificial Sequence
  Description of Artificial Sequence: Synthetic peptide
  Seed: MAVVLASLI (PMEL_HUMAN)
MMVVLASLW

SEQ ID NO: 134320 - protein, 11 aa, Artificial Sequence
  Description of Artificial Sequence: Synthetic peptide
  Seed: RRGSRSYVPLA (PMEL_HUMAN)
RIGSRSYVPLV

SEQ ID NO: 134321 - protein, 8 aa, Artificial Sequence
  Description of Artificial Sequence: Synthetic peptide
  Seed: RELPIPEP (PMEL_HUMAN)
RELPIPEM

SEQ ID NO: 134322 - protein, 9 aa, Artificial Sequence
  Description of Artificial Sequence: Synthetic peptide
  Seed: AVGATKVPR (PMEL_HUMAN)
AMGATKVPK

SEQ ID NO: 134323 - protein, 11 aa, Artificial Sequence
  Description of Artificial Sequence: Synthetic peptide
  Seed: TLIGANASFSI (PMEL_HUMAN)
TQIGANASFSF

SEQ ID NO: 134324 - protein, 10 aa, Artificial Sequence
  Description of Artificial Sequence: Synthetic peptide
  Seed: LKRCLLHLAV (PMEL_HUMAN)
LRRCLLHLAL

SEQ ID NO: 134325 - protein, 9 aa, Artificial Sequence
  Description of Artificial Sequence: Synthetic peptide
  Seed: HTMEVTVYH (PMEL_HUMAN)
HDMEVTVYR

SEQ ID NO: 134326 - protein, 10 aa, Artificial Sequence
  Description of Artificial Sequence: Synthetic peptide
  Seed: LMAVVLASLI (PMEL_HUMAN)
LMAVVLASLF

SEQ ID NO: 134327 - protein, 11 aa, Artificial Sequence
  Description of Artificial Sequence: Synthetic peptide
  Seed: RRRLMKQDFSV (PMEL_HUMAN)
RPRLMKQDFSV

SEQ ID NO: 134328 - protein, 9 aa, Artificial Sequence
  Description of Artificial Sequence: Synthetic peptide
  Seed: RALVVTHTY (PMEL_HUMAN)
RILVVTHTI

SEQ ID NO: 134329 - protein, 10 aa, Artificial Sequence
  Description of Artificial Sequence: Synthetic peptide
  Seed: SVTLDIVQGI (PMEL_HUMAN)
SHTLDIVQGV

SEQ ID NO: 134330 - protein, 11 aa, Artificial Sequence
  Description of Artificial Sequence: Synthetic peptide
  Seed: RALDGGNKHFL (PMEL_HUMAN)
RYLDGGNKHFF

SEQ ID NO: 134331 - protein, 11 aa, Artificial Sequence
  Description of Artificial Sequence: Synthetic peptide
  Seed: FGDSSGTLISR (PMEL_HUMAN)
FTDSSGTLISL

SEQ ID NO: 134332 - protein, 11 aa, Artificial Sequence
  Description of Artificial Sequence: Synthetic peptide
  Seed: TWDFGDSSGTL (PMEL_HUMAN)
TADFGDSSGTL

SEQ ID NO: 134333 - protein, 10 aa, Artificial Sequence
  Description of Artificial Sequence: Synthetic peptide
  Seed: VLMAVVLASL (PMEL_HUMAN)
VMMAVVLASM

SEQ ID NO: 134334 - protein, 9 aa, Artificial Sequence
  Description of Artificial Sequence: Synthetic peptide
  Seed: SQKRSFVYV (PMEL_HUMAN)
SVKRSFVYM

SEQ ID NO: 134335 - protein, 9 aa, Artificial Sequence
  Description of Artificial Sequence: Synthetic peptide
  Seed: FLRNQPLTF (PMEL_HUMAN)
FMRNQPLTL

SEQ ID NO: 134336 - protein, 9 aa, Artificial Sequence
  Description of Artificial Sequence: Synthetic peptide
  Seed: CVLYRYGSF (PMEL_HUMAN)
CQLYRYGSM

SEQ ID NO: 134337 - protein, 9 aa, Artificial Sequence
  Description of Artificial Sequence: Synthetic peptide
  Seed: SLADTNSLA (PMEL_HUMAN)
STADTNSLL

SEQ ID NO: 134338 - protein, 9 aa, Artificial Sequence
  Description of Artificial Sequence: Synthetic peptide
  Seed: VTAQVVLQA (PMEL_HUMAN)
VMAQVVLQM

SEQ ID NO: 134339 - protein, 9 aa, Artificial Sequence
  Description of Artificial Sequence: Synthetic peptide
  Seed: VLPSPACQL (PMEL_HUMAN)
VIPSPACQM

SEQ ID NO: 134340 - protein, 10 aa, Artificial Sequence
  Description of Artificial Sequence: Synthetic peptide
  Seed: MTPAEVSIVV (PMEL_HUMAN)
MKPAEVSIVS

SEQ ID NO: 134341 - protein, 9 aa, Artificial Sequence
  Description of Artificial Sequence: Synthetic peptide
  Seed: FSIALNFPG (PMEL_HUMAN)
FNIALNFPW

SEQ ID NO: 134342 - protein, 10 aa, Artificial Sequence
  Description of Artificial Sequence: Synthetic peptide
  Seed: IESAEILQAV (PMEL_HUMAN)
ILSAEILQAV

SEQ ID NO: 134343 - protein, 11 aa, Artificial Sequence
  Description of Artificial Sequence: Synthetic peptide
  Seed: QAVPSGEGDAF (PMEL_HUMAN)
QVVPSGEGDAF

SEQ ID NO: 134344 - protein, 8 aa, Artificial Sequence
  Description of Artificial Sequence: Synthetic peptide
  Seed: AEVSIVVL (PMEL_HUMAN)
AEVSIVVM

SEQ ID NO: 134345 - protein, 9 aa, Artificial Sequence
  Description of Artificial Sequence: Synthetic peptide
  Seed: VTAQVVLQA (PMEL_HUMAN)
VAAQVVLQL

SEQ ID NO: 134346 - protein, 10 aa, Artificial Sequence
  Description of Artificial Sequence: Synthetic peptide
  Seed: YRYGSFSVTL (PMEL_HUMAN)
YQYGSFSVTY

SEQ ID NO: 134347 - protein, 9 aa, Artificial Sequence
  Description of Artificial Sequence: Synthetic peptide
  Seed: TAEAPNTTA (PMEL_HUMAN)
TVEAPNTTY

SEQ ID NO: 134348 - protein, 9 aa, Artificial Sequence
  Description of Artificial Sequence: Synthetic peptide
  Seed: VSNDGPTLI (PMEL_HUMAN)
VYNDGPTLF

SEQ ID NO: 134349 - protein, 9 aa, Artificial Sequence
  Description of Artificial Sequence: Synthetic peptide
  Seed: LAVVSTQLI (PMEL_HUMAN)
LAVVSTQLY

SEQ ID NO: 134350 - protein, 10 aa, Artificial Sequence
  Description of Artificial Sequence: Synthetic peptide
  Seed: LGQVPLIVGI (PMEL_HUMAN)
LQQVPLIVGV

SEQ ID NO: 134351 - protein, 9 aa, Artificial Sequence
  Description of Artificial Sequence: Synthetic peptide
  Seed: RALVVTHTY (PMEL_HUMAN)
RELVVTHTF

SEQ ID NO: 134352 - protein, 10 aa, Artificial Sequence
  Description of Artificial Sequence: Synthetic peptide
  Seed: FSVSVSQLRA (PMEL_HUMAN)
FTVSVSQLRT

SEQ ID NO: 134353 - protein, 9 aa, Artificial Sequence
  Description of Artificial Sequence: Synthetic peptide
  Seed: LIVGILLVL (PMEL_HUMAN)
LTVGILLVV

SEQ ID NO: 134354 - protein, 9 aa, Artificial Sequence
  Description of Artificial Sequence: Synthetic peptide
  Seed: DQVPFSVSV (PMEL_HUMAN)
DSVPFSVSY

SEQ ID NO: 134355 - protein, 10 aa, Artificial Sequence
  Description of Artificial Sequence: Synthetic peptide
  Seed: LADTNSLAVV (PMEL_HUMAN)
LADTNSLAVF

SEQ ID NO: 134356 - protein, 9 aa, Artificial Sequence
  Description of Artificial Sequence: Synthetic peptide
  Seed: LYRYGSFSV (PMEL_HUMAN)
LSRYGSFSI

SEQ ID NO: 134357 - protein, 10 aa, Artificial Sequence
  Description of Artificial Sequence: Synthetic peptide
  Seed: EVMGTTLAEM (PMEL_HUMAN)
EVMGTTLAEF

SEQ ID NO: 134358 - protein, 10 aa, Artificial Sequence
  Description of Artificial Sequence: Synthetic peptide
  Seed: SGTYCLNVSL (PMEL_HUMAN)
SCTYCLNVSW

SEQ ID NO: 134359 - protein, 11 aa, Artificial Sequence
  Description of Artificial Sequence: Synthetic peptide
  Seed: SGYLAEADLSY (PMEL_HUMAN)
SKYLAEADLSY

SEQ ID NO: 134360 - protein, 8 aa, Artificial Sequence
  Description of Artificial Sequence: Synthetic peptide
  Seed: YGSFSVTL (PMEL_HUMAN)
YSSFSVTL

SEQ ID NO: 134361 - protein, 10 aa, Artificial Sequence
  Description of Artificial Sequence: Synthetic peptide
  Seed: PFSVSVSQLR (PMEL_HUMAN)
PESVSVSQLR

SEQ ID NO: 134362 - protein, 8 aa, Artificial Sequence
  Description of Artificial Sequence: Synthetic peptide
  Seed: LHDPSGYL (PMEL_HUMAN)
LIDPSGYF

SEQ ID NO: 134363 - protein, 9 aa, Artificial Sequence
  Description of Artificial Sequence: Synthetic peptide
  Seed: RGGQVSLKV (PMEL_HUMAN)
RIGQVSLKV

SEQ ID NO: 134364 - protein, 9 aa, Artificial Sequence
  Description of Artificial Sequence: Synthetic peptide
  Seed: GSRSYVPLA (PMEL_HUMAN)
GARSYVPLV

SEQ ID NO: 134365 - protein, 10 aa, Artificial Sequence
  Description of Artificial Sequence: Synthetic peptide
  Seed: SVPQLPHSSS (PMEL_HUMAN)
SMPQLPHSSF

SEQ ID NO: 134366 - protein, 9 aa, Artificial Sequence
  Description of Artificial Sequence: Synthetic peptide
  Seed: AVIGALLAV (PMEL_HUMAN)
AGIGALLAV

SEQ ID NO: 134367 - protein, 11 aa, Artificial Sequence
  Description of Artificial Sequence: Synthetic peptide
  Seed: YVPLAHSSSAF (PMEL_HUMAN)
YCPLAHSSSAY

SEQ ID NO: 134368 - protein, 10 aa, Artificial Sequence
  Description of Artificial Sequence: Synthetic peptide
  Seed: SRALVVTHTY (PMEL_HUMAN)
SMALVVTHTY

SEQ ID NO: 134369 - protein, 10 aa, Artificial Sequence
  Description of Artificial Sequence: Synthetic peptide
  Seed: YRYGSFSVTL (PMEL_HUMAN)
YVYGSFSVTL

SEQ ID NO: 134370 - protein, 9 aa, Artificial Sequence
  Description of Artificial Sequence: Synthetic peptide
  Seed: TLIGANASF (PMEL_HUMAN)
TRIGANASY

SEQ ID NO: 134371 - protein, 9 aa, Artificial Sequence
  Description of Artificial Sequence: Synthetic peptide
  Seed: DAFELTVSC (PMEL_HUMAN)
DTFELTVSY

SEQ ID NO: 134372 - protein, 9 aa, Artificial Sequence
  Description of Artificial Sequence: Synthetic peptide
  Seed: KAWNRQLYP (PMEL_HUMAN)
KTWNRQLYT

SEQ ID NO: 134373 - protein, 9 aa, Artificial Sequence
  Description of Artificial Sequence: Synthetic peptide
  Seed: LSIGTGRAM (PMEL_HUMAN)
LFIGTGRAY

SEQ ID NO: 134374 - protein, 10 aa, Artificial Sequence
  Description of Artificial Sequence: Synthetic peptide
  Seed: RGSRSYVPLA (PMEL_HUMAN)
RTSRSYVPLG

SEQ ID NO: 134375 - protein, 11 aa, Artificial Sequence
  Description of Artificial Sequence: Synthetic peptide
  Seed: FGDSSGTLISR (PMEL_HUMAN)
FGDSSGTLISL

SEQ ID NO: 134376 - protein, 10 aa, Artificial Sequence
  Description of Artificial Sequence: Synthetic peptide
  Seed: SLADTNSLAV (PMEL_HUMAN)
SQADTNSLAW

SEQ ID NO: 134377 - protein, 9 aa, Artificial Sequence
  Description of Artificial Sequence: Synthetic peptide
  Seed: FSVSVSQLR (PMEL_HUMAN)
FVVSVSQLK

SEQ ID NO: 134378 - protein, 10 aa, Artificial Sequence
  Description of Artificial Sequence: Synthetic peptide
  Seed: MTPAEVSIVV (PMEL_HUMAN)
MEPAEVSIVV

SEQ ID NO: 134379 - protein, 9 aa, Artificial Sequence
  Description of Artificial Sequence: Synthetic peptide
  Seed: SAFTITDQV (PMEL_HUMAN)
SMFTITDQA

SEQ ID NO: 134380 - protein, 10 aa, Artificial Sequence
  Description of Artificial Sequence: Synthetic peptide
  Seed: ALDGGNKHFL (PMEL_HUMAN)
AVDGGNKHFY

SEQ ID NO: 134381 - protein, 9 aa, Artificial Sequence
  Description of Artificial Sequence: Synthetic peptide
  Seed: ALDGGNKHF (PMEL_HUMAN)
ATDGGNKHI

SEQ ID NO: 134382 - protein, 11 aa, Artificial Sequence
  Description of Artificial Sequence: Synthetic peptide
  Seed: QLYPEWTEAQR (PMEL_HUMAN)
QIYPEWTEAQK

SEQ ID NO: 134383 - protein, 10 aa, Artificial Sequence
  Description of Artificial Sequence: Synthetic peptide
  Seed: THTYLEPGPV (PMEL_HUMAN)
TTTYLEPGPV

SEQ ID NO: 134384 - protein, 10 aa, Artificial Sequence
  Description of Artificial Sequence: Synthetic peptide
  Seed: AESTGMTPEK (PMEL_HUMAN)
ATSTGMTPEK

SEQ ID NO: 134385 - protein, 9 aa, Artificial Sequence
  Description of Artificial Sequence: Synthetic peptide
  Seed: TTDGHRPTA (PMEL_HUMAN)
TSDGHRPTV

SEQ ID NO: 134386 - protein, 10 aa, Artificial Sequence
  Description of Artificial Sequence: Synthetic peptide
  Seed: RELPIPEPEG (PMEL_HUMAN)
RELPIPEPEC

SEQ ID NO: 134387 - protein, 11 aa, Artificial Sequence
  Description of Artificial Sequence: Synthetic peptide
  Seed: SYVPLAHSSSA (PMEL_HUMAN)
SGVPLAHSSSF

SEQ ID NO: 134388 - protein, 9 aa, Artificial Sequence
  Description of Artificial Sequence: Synthetic peptide
  Seed: RAMLGTHTM (PMEL_HUMAN)
RPMLGTHTT

SEQ ID NO: 134389 - protein, 10 aa, Artificial Sequence
  Description of Artificial Sequence: Synthetic peptide
  Seed: GYLAEADLSY (PMEL_HUMAN)
GALAEADLSY

SEQ ID NO: 134390 - protein, 10 aa, Artificial Sequence
  Description of Artificial Sequence: Synthetic peptide
  Seed: IFPDGGPCPS (PMEL_HUMAN)
IWPDGGPCPY

SEQ ID NO: 134391 - protein, 9 aa, Artificial Sequence
  Description of Artificial Sequence: Synthetic peptide
  Seed: MTPEKVPVS (PMEL_HUMAN)
MIPEKVPVM

SEQ ID NO: 134392 - protein, 9 aa, Artificial Sequence
  Description of Artificial Sequence: Synthetic peptide
  Seed: VVLQAAIPL (PMEL_HUMAN)
VALQAAIPL

SEQ ID NO: 134393 - protein, 9 aa, Artificial Sequence
  Description of Artificial Sequence: Synthetic peptide
  Seed: SVPQLPHSS (PMEL_HUMAN)
SMPQLPHSF

SEQ ID NO: 134394 - protein, 10 aa, Artificial Sequence
  Description of Artificial Sequence: Synthetic peptide
  Seed: RGSRSYVPLA (PMEL_HUMAN)
RYSRSYVPLL

SEQ ID NO: 134395 - protein, 9 aa, Artificial Sequence
  Description of Artificial Sequence: Synthetic peptide
  Seed: TYLEPGPVT (PMEL_HUMAN)
TYLEPGPVL

SEQ ID NO: 134396 - protein, 9 aa, Artificial Sequence
  Description of Artificial Sequence: Synthetic peptide
  Seed: TYLEPGPVT (PMEL_HUMAN)
TWLEPGPVF

SEQ ID NO: 134397 - protein, 10 aa, Artificial Sequence
  Description of Artificial Sequence: Synthetic peptide
  Seed: KVSNDGPTLI (PMEL_HUMAN)
KTSNDGPTLF

SEQ ID NO: 134398 - protein, 10 aa, Artificial Sequence
  Description of Artificial Sequence: Synthetic peptide
  Seed: MTPAEVSIVV (PMEL_HUMAN)
MRPAEVSIVH

SEQ ID NO: 134399 - protein, 9 aa, Artificial Sequence
  Description of Artificial Sequence: Synthetic peptide
  Seed: GQVPLIVGI (PMEL_HUMAN)
GAVPLIVGI

SEQ ID NO: 134400 - protein, 10 aa, Artificial Sequence
  Description of Artificial Sequence: Synthetic peptide
  Seed: TPAEVSIVVL (PMEL_HUMAN)
TPAEVSIVVW

SEQ ID NO: 134401 - protein, 9 aa, Artificial Sequence
  Description of Artificial Sequence: Synthetic peptide
  Seed: VLKRCLLHL (PMEL_HUMAN)
VTKRCLLHK

SEQ ID NO: 134402 - protein, 8 aa, Artificial Sequence
  Description of Artificial Sequence: Synthetic peptide
  Seed: HTMEVTVY (PMEL_HUMAN)
HQMEVTVL

SEQ ID NO: 134403 - protein, 10 aa, Artificial Sequence
  Description of Artificial Sequence: Synthetic peptide
  Seed: LAVIGALLAV (PMEL_HUMAN)
LKVIGALLAV

SEQ ID NO: 134404 - protein, 9 aa, Artificial Sequence
  Description of Artificial Sequence: Synthetic peptide
  Seed: AEPSGTTSV (PMEL_HUMAN)
AQPSGTTSW

SEQ ID NO: 134405 - protein, 9 aa, Artificial Sequence
  Description of Artificial Sequence: Synthetic peptide
  Seed: RIFCSCPIG (PMEL_HUMAN)
RTFCSCPIM

SEQ ID NO: 134406 - protein, 9 aa, Artificial Sequence
  Description of Artificial Sequence: Synthetic peptide
  Seed: VLPSPACQL (PMEL_HUMAN)
VVPSPACQY

SEQ ID NO: 134407 - protein, 9 aa, Artificial Sequence
  Description of Artificial Sequence: Synthetic peptide
  Seed: VSCQGGLPK (PMEL_HUMAN)
VVCQGGLPK

SEQ ID NO: 134408 - protein, 10 aa, Artificial Sequence
  Description of Artificial Sequence: Synthetic peptide
  Seed: RGSRSYVPLA (PMEL_HUMAN)
RWSRSYVPLV

SEQ ID NO: 134409 - protein, 9 aa, Artificial Sequence
  Description of Artificial Sequence: Synthetic peptide
  Seed: AAQVTTTEW (PMEL_HUMAN)
AMQVTTTEF

SEQ ID NO: 134410 - protein, 9 aa, Artificial Sequence
  Description of Artificial Sequence: Synthetic peptide
  Seed: TVYHRRGSR (PMEL_HUMAN)
TTYHRRGSK

SEQ ID NO: 134411 - protein, 9 aa, Artificial Sequence
  Description of Artificial Sequence: Synthetic peptide
  Seed: RALDGGNKH (PMEL_HUMAN)
RILDGGNKY

SEQ ID NO: 134412 - protein, 9 aa, Artificial Sequence
  Description of Artificial Sequence: Synthetic peptide
  Seed: GSWSQKRSF (PMEL_HUMAN)
GQWSQKRSF

SEQ ID NO: 134413 - protein, 10 aa, Artificial Sequence
  Description of Artificial Sequence: Synthetic peptide
  Seed: SGTYCLNVSL (PMEL_HUMAN)
SITYCLNVSW

SEQ ID NO: 134414 - protein, 9 aa, Artificial Sequence
  Description of Artificial Sequence: Synthetic peptide
  Seed: VPLAHSSSA (PMEL_HUMAN)
VPLAHSSSI

SEQ ID NO: 134415 - protein, 11 aa, Artificial Sequence
  Description of Artificial Sequence: Synthetic peptide
  Seed: VYVWKTWGQYW (PMEL_HUMAN)
VYVWKTWGQYF

SEQ ID NO: 134416 - protein, 8 aa, Artificial Sequence
  Description of Artificial Sequence: Synthetic peptide
  Seed: LADTNSLA (PMEL_HUMAN)
LIDTNSLL

SEQ ID NO: 134417 - protein, 9 aa, Artificial Sequence
  Description of Artificial Sequence: Synthetic peptide
  Seed: AEPSGTTSV (PMEL_HUMAN)
ACPSGTTSI

SEQ ID NO: 134418 - protein, 9 aa, Artificial Sequence
  Description of Artificial Sequence: Synthetic peptide
  Seed: WSQKRSFVY (PMEL_HUMAN)
WTQKRSFVM

SEQ ID NO: 134419 - protein, 9 aa, Artificial Sequence
  Description of Artificial Sequence: Synthetic peptide
  Seed: FPDGGPCPS (PMEL_HUMAN)
FADGGPCPL

SEQ ID NO: 134420 - protein, 9 aa, Artificial Sequence
  Description of Artificial Sequence: Synthetic peptide
  Seed: LSIGTGRAM (PMEL_HUMAN)
LNIGTGRAY

SEQ ID NO: 134421 - protein, 8 aa, Artificial Sequence
  Description of Artificial Sequence: Synthetic peptide
  Seed: SNDGPTLI (PMEL_HUMAN)
SVDGPTLI

SEQ ID NO: 134422 - protein, 9 aa, Artificial Sequence
  Description of Artificial Sequence: Synthetic peptide
  Seed: KHFLRNQPL (PMEL_HUMAN)
KIFLRNQPY

SEQ ID NO: 134423 - protein, 10 aa, Artificial Sequence
  Description of Artificial Sequence: Synthetic peptide
  Seed: MDLVLKRCLL (PMEL_HUMAN)
MPLVLKRCLL

SEQ ID NO: 134424 - protein, 11 aa, Artificial Sequence
  Description of Artificial Sequence: Synthetic peptide
  Seed: LYRYGSFSVTL (PMEL_HUMAN)
LSRYGSFSVTF

SEQ ID NO: 134425 - protein, 9 aa, Artificial Sequence
  Description of Artificial Sequence: Synthetic peptide
  Seed: VSNDGPTLI (PMEL_HUMAN)
VFNDGPTLI

SEQ ID NO: 134426 - protein, 9 aa, Artificial Sequence
  Description of Artificial Sequence: Synthetic peptide
  Seed: MSTPEATGM (PMEL_HUMAN)
MPTPEATGL

SEQ ID NO: 134427 - protein, 9 aa, Artificial Sequence
  Description of Artificial Sequence: Synthetic peptide
  Seed: SQVWGGQPV (PMEL_HUMAN)
SGVWGGQPY

SEQ ID NO: 134428 - protein, 9 aa, Artificial Sequence
  Description of Artificial Sequence: Synthetic peptide
  Seed: AGQVPTTEV (PMEL_HUMAN)
AAQVPTTEM

SEQ ID NO: 134429 - protein, 11 aa, Artificial Sequence
  Description of Artificial Sequence: Synthetic peptide
  Seed: RYGSFSVTLDI (PMEL_HUMAN)
RMGSFSVTLDY

SEQ ID NO: 134430 - protein, 11 aa, Artificial Sequence
  Description of Artificial Sequence: Synthetic peptide
  Seed: ALDGGNKHFLR (PMEL_HUMAN)
AADGGNKHFLY

SEQ ID NO: 134431 - protein, 9 aa, Artificial Sequence
  Description of Artificial Sequence: Synthetic peptide
  Seed: YHRRGSRSY (PMEL_HUMAN)
YVRRGSRSM

SEQ ID NO: 134432 - protein, 11 aa, Artificial Sequence
  Description of Artificial Sequence: Synthetic peptide
  Seed: LPIPEPEGPDA (PMEL_HUMAN)
LPIPEPEGPDF

SEQ ID NO: 134433 - protein, 9 aa, Artificial Sequence
  Description of Artificial Sequence: Synthetic peptide
  Seed: DQVPFSVSV (PMEL_HUMAN)
DQVPFSVSY

SEQ ID NO: 134434 - protein, 10 aa, Artificial Sequence
  Description of Artificial Sequence: Synthetic peptide
  Seed: VLMAVVLASL (PMEL_HUMAN)
VEMAVVLASI

SEQ ID NO: 134435 - protein, 9 aa, Artificial Sequence
  Description of Artificial Sequence: Synthetic peptide
  Seed: RQVPLDCVL (PMEL_HUMAN)
REVPLDCVY

SEQ ID NO: 134436 - protein, 10 aa, Artificial Sequence
  Description of Artificial Sequence: Synthetic peptide
  Seed: RGSRSYVPLA (PMEL_HUMAN)
RRSRSYVPLT

SEQ ID NO: 134437 - protein, 10 aa, Artificial Sequence
  Description of Artificial Sequence: Synthetic peptide
  Seed: GPLLDGTATL (PMEL_HUMAN)
GTLLDGTATL

SEQ ID NO: 134438 - protein, 10 aa, Artificial Sequence
  Description of Artificial Sequence: Synthetic peptide
  Seed: LAVIGALLAV (PMEL_HUMAN)
LIVIGALLAI

SEQ ID NO: 134439 - protein, 8 aa, Artificial Sequence
  Description of Artificial Sequence: Synthetic peptide
  Seed: LVLKRCLL (PMEL_HUMAN)
LMLKRCLL

SEQ ID NO: 134440 - protein, 11 aa, Artificial Sequence
  Description of Artificial Sequence: Synthetic peptide
  Seed: MAVVLASLIYR (PMEL_HUMAN)
MLVVLASLIYR

SEQ ID NO: 134441 - protein, 10 aa, Artificial Sequence
  Description of Artificial Sequence: Synthetic peptide
  Seed: GTYCLNVSLA (PMEL_HUMAN)
GLYCLNVSLA

SEQ ID NO: 134442 - protein, 9 aa, Artificial Sequence
  Description of Artificial Sequence: Synthetic peptide
  Seed: RGSRSYVPL (PMEL_HUMAN)
RISRSYVPK

SEQ ID NO: 134443 - protein, 10 aa, Artificial Sequence
  Description of Artificial Sequence: Synthetic peptide
  Seed: RGSRSYVPLA (PMEL_HUMAN)
RMSRSYVPLS

SEQ ID NO: 134444 - protein, 9 aa, Artificial Sequence
  Description of Artificial Sequence: Synthetic peptide
  Seed: MTPAEVSIV (PMEL_HUMAN)
MPPAEVSII

SEQ ID NO: 134445 - protein, 9 aa, Artificial Sequence
  Description of Artificial Sequence: Synthetic peptide
  Seed: MTPEKVPVS (PMEL_HUMAN)
MYPEKVPVL

SEQ ID NO: 134446 - protein, 9 aa, Artificial Sequence
  Description of Artificial Sequence: Synthetic peptide
  Seed: FSIALNFPG (PMEL_HUMAN)
FGIALNFPW

SEQ ID NO: 134447 - protein, 9 aa, Artificial Sequence
  Description of Artificial Sequence: Synthetic peptide
  Seed: LQAAIPLTS (PMEL_HUMAN)
LNAAIPLTF

SEQ ID NO: 134448 - protein, 9 aa, Artificial Sequence
  Description of Artificial Sequence: Synthetic peptide
  Seed: RYGSFSVTL (PMEL_HUMAN)
RLGSFSVTI

SEQ ID NO: 134449 - protein, 9 aa, Artificial Sequence
  Description of Artificial Sequence: Synthetic peptide
  Seed: LNFPGSQKV (PMEL_HUMAN)
LVFPGSQKA

SEQ ID NO: 134450 - protein, 10 aa, Artificial Sequence
  Description of Artificial Sequence: Synthetic peptide
  Seed: LVLMAVVLAS (PMEL_HUMAN)
LSLMAVVLAI

SEQ ID NO: 134451 - protein, 9 aa, Artificial Sequence
  Description of Artificial Sequence: Synthetic peptide
  Seed: LAVVSTQLI (PMEL_HUMAN)
LSVVSTQLF

SEQ ID NO: 134452 - protein, 9 aa, Artificial Sequence
  Description of Artificial Sequence: Synthetic peptide
  Seed: AQRLCQPVL (PMEL_HUMAN)
AVRLCQPVF

SEQ ID NO: 134453 - protein, 9 aa, Artificial Sequence
  Description of Artificial Sequence: Synthetic peptide
  Seed: VSNDGPTLI (PMEL_HUMAN)
VSNDGPTLL

SEQ ID NO: 134454 - protein, 9 aa, Artificial Sequence
  Description of Artificial Sequence: Synthetic peptide
  Seed: ALVVTHTYL (PMEL_HUMAN)
AQVVTHTYI

SEQ ID NO: 134455 - protein, 11 aa, Artificial Sequence
  Description of Artificial Sequence: Synthetic peptide
  Seed: RRRLMKQDFSV (PMEL_HUMAN)
RERLMKQDFSV

SEQ ID NO: 134456 - protein, 9 aa, Artificial Sequence
  Description of Artificial Sequence: Synthetic peptide
  Seed: LAVGATKVP (PMEL_HUMAN)
LVVGATKVY

SEQ ID NO: 134457 - protein, 11 aa, Artificial Sequence
  Description of Artificial Sequence: Synthetic peptide
  Seed: RALDGGNKHFL (PMEL_HUMAN)
RCLDGGNKHFW

SEQ ID NO: 134458 - protein, 10 aa, Artificial Sequence
  Description of Artificial Sequence: Synthetic peptide
  Seed: KRQVPLDCVL (PMEL_HUMAN)
KHQVPLDCVM

SEQ ID NO: 134459 - protein, 9 aa, Artificial Sequence
  Description of Artificial Sequence: Synthetic peptide
  Seed: PLLDGTATL (PMEL_HUMAN)
PVLDGTATY

SEQ ID NO: 134460 - protein, 8 aa, Artificial Sequence
  Description of Artificial Sequence: Synthetic peptide
  Seed: AEAPNTTA (PMEL_HUMAN)
ADAPNTTL

SEQ ID NO: 134461 - protein, 10 aa, Artificial Sequence
  Description of Artificial Sequence: Synthetic peptide
  Seed: AEADLSYTWD (PMEL_HUMAN)
AEADLSYTWN

SEQ ID NO: 134462 - protein, 8 aa, Artificial Sequence
  Description of Artificial Sequence: Synthetic peptide
  Seed: KAWNRQLY (PMEL_HUMAN)
KQWNRQLY

SEQ ID NO: 134463 - protein, 9 aa, Artificial Sequence
  Description of Artificial Sequence: Synthetic peptide
  Seed: CVLYRYGSF (PMEL_HUMAN)
CSLYRYGSF

SEQ ID NO: 134464 - protein, 9 aa, Artificial Sequence
  Description of Artificial Sequence: Synthetic peptide
  Seed: GGPVSGLSI (PMEL_HUMAN)
GVPVSGLSM

SEQ ID NO: 134465 - protein, 10 aa, Artificial Sequence
  Description of Artificial Sequence: Synthetic peptide
  Seed: RRLMKQDFSV (PMEL_HUMAN)
RSLMKQDFSV

SEQ ID NO: 134466 - protein, 9 aa, Artificial Sequence
  Description of Artificial Sequence: Synthetic peptide
  Seed: SQKRSFVYV (PMEL_HUMAN)
SSKRSFVYT

SEQ ID NO: 134467 - protein, 9 aa, Artificial Sequence
  Description of Artificial Sequence: Synthetic peptide
  Seed: RLMKQDFSV (PMEL_HUMAN)
RIMKQDFSR

SEQ ID NO: 134468 - protein, 9 aa, Artificial Sequence
  Description of Artificial Sequence: Synthetic peptide
  Seed: SQVWGGQPV (PMEL_HUMAN)
STVWGGQPL

SEQ ID NO: 134469 - protein, 9 aa, Artificial Sequence
  Description of Artificial Sequence: Synthetic peptide
  Seed: SSIMSTESI (PMEL_HUMAN)
SRIMSTESF

SEQ ID NO: 134470 - protein, 9 aa, Artificial Sequence
  Description of Artificial Sequence: Synthetic peptide
  Seed: QVIWVNNTI (PMEL_HUMAN)
QLIWVNNTA

SEQ ID NO: 134471 - protein, 9 aa, Artificial Sequence
  Description of Artificial Sequence: Synthetic peptide
  Seed: KVLPDGQVI (PMEL_HUMAN)
KALPDGQVY

SEQ ID NO: 134472 - protein, 10 aa, Artificial Sequence
  Description of Artificial Sequence: Synthetic peptide
  Seed: AMLGTHTMEV (PMEL_HUMAN)
ALLGTHTMEA

SEQ ID NO: 134473 - protein, 11 aa, Artificial Sequence
  Description of Artificial Sequence: Synthetic peptide
  Seed: GIESAEILQAV (PMEL_HUMAN)
GMESAEILQAV

SEQ ID NO: 134474 - protein, 9 aa, Artificial Sequence
  Description of Artificial Sequence: Synthetic peptide
  Seed: SSIMSTESI (PMEL_HUMAN)
SAIMSTESY

SEQ ID NO: 134475 - protein, 10 aa, Artificial Sequence
  Description of Artificial Sequence: Synthetic peptide
  Seed: RRLMKQDFSV (PMEL_HUMAN)
RCLMKQDFSV

SEQ ID NO: 134476 - protein, 11 aa, Artificial Sequence
  Description of Artificial Sequence: Synthetic peptide
  Seed: FLRNQPLTFAL (PMEL_HUMAN)
FLRNQPLTFAA

SEQ ID NO: 134477 - protein, 10 aa, Artificial Sequence
  Description of Artificial Sequence: Synthetic peptide
  Seed: SCPIGENSPL (PMEL_HUMAN)
SMPIGENSPL

SEQ ID NO: 134478 - protein, 9 aa, Artificial Sequence
  Description of Artificial Sequence: Synthetic peptide
  Seed: LAVVSTQLI (PMEL_HUMAN)
LTVVSTQLM

SEQ ID NO: 134479 - protein, 9 aa, Artificial Sequence
  Description of Artificial Sequence: Synthetic peptide
  Seed: FSVSVSQLR (PMEL_HUMAN)
FAVSVSQLM

SEQ ID NO: 134480 - protein, 9 aa, Artificial Sequence
  Description of Artificial Sequence: Synthetic peptide
  Seed: AGQVPTTEV (PMEL_HUMAN)
ASQVPTTEF

SEQ ID NO: 134481 - protein, 9 aa, Artificial Sequence
  Description of Artificial Sequence: Synthetic peptide
  Seed: AEADLSYTW (PMEL_HUMAN)
AEADLSYTP

SEQ ID NO: 134482 - protein, 9 aa, Artificial Sequence
  Description of Artificial Sequence: Synthetic peptide
  Seed: YLAEADLSY (PMEL_HUMAN)
YAAEADLSV

SEQ ID NO: 134483 - protein, 9 aa, Artificial Sequence
  Description of Artificial Sequence: Synthetic peptide
  Seed: VLPDGQVIW (PMEL_HUMAN)
VIPDGQVIF

SEQ ID NO: 134484 - protein, 9 aa, Artificial Sequence
  Description of Artificial Sequence: Synthetic peptide
  Seed: ESAEILQAV (PMEL_HUMAN)
EIAEILQAH

SEQ ID NO: 134485 - protein, 9 aa, Artificial Sequence
  Description of Artificial Sequence: Synthetic peptide
  Seed: SSPGCQPPA (PMEL_HUMAN)
SLPGCQPPL

SEQ ID NO: 134486 - protein, 9 aa, Artificial Sequence
  Description of Artificial Sequence: Synthetic peptide
  Seed: LIVGILLVL (PMEL_HUMAN)
LIVGILLVY

SEQ ID NO: 134487 - protein, 9 aa, Artificial Sequence
  Description of Artificial Sequence: Synthetic peptide
  Seed: EVMGTTLAE (PMEL_HUMAN)
ETMGTTLAR

SEQ ID NO: 134488 - protein, 9 aa, Artificial Sequence
  Description of Artificial Sequence: Synthetic peptide
  Seed: TEWVETTAR (PMEL_HUMAN)
TDWVETTAL

SEQ ID NO: 134489 - protein, 10 aa, Artificial Sequence
  Description of Artificial Sequence: Synthetic peptide
  Seed: SVTLDIVQGI (PMEL_HUMAN)
SSTLDIVQGV

SEQ ID NO: 134490 - protein, 9 aa, Artificial Sequence
  Description of Artificial Sequence: Synthetic peptide
  Seed: SQKRSFVYV (PMEL_HUMAN)
STKRSFVYC

SEQ ID NO: 134491 - protein, 10 aa, Artificial Sequence
  Description of Artificial Sequence: Synthetic peptide
  Seed: FLRNQPLTFA (PMEL_HUMAN)
FMRNQPLTFI

SEQ ID NO: 134492 - protein, 10 aa, Artificial Sequence
  Description of Artificial Sequence: Synthetic peptide
  Seed: VLMAVVLASL (PMEL_HUMAN)
VLMAVVLASM

SEQ ID NO: 134493 - protein, 9 aa, Artificial Sequence
  Description of Artificial Sequence: Synthetic peptide
  Seed: RLPRIFCSC (PMEL_HUMAN)
RMPRIFCSA

SEQ ID NO: 134494 - protein, 9 aa, Artificial Sequence
  Description of Artificial Sequence: Synthetic peptide
  Seed: RAMLGTHTM (PMEL_HUMAN)
RWMLGTHTV

SEQ ID NO: 134495 - protein, 9 aa, Artificial Sequence
  Description of Artificial Sequence: Synthetic peptide
  Seed: VLMAVVLAS (PMEL_HUMAN)
VLMAVVLAA

SEQ ID NO: 134496 - protein, 11 aa, Artificial Sequence
  Description of Artificial Sequence: Synthetic peptide
  Seed: KRSFVYVWKTW (PMEL_HUMAN)
KTSFVYVWKTW

SEQ ID NO: 134497 - protein, 10 aa, Artificial Sequence
  Description of Artificial Sequence: Synthetic peptide
  Seed: YVPLAHSSSA (PMEL_HUMAN)
YPPLAHSSSA

SEQ ID NO: 134498 - protein, 9 aa, Artificial Sequence
  Description of Artificial Sequence: Synthetic peptide
  Seed: ALNFPGSQK (PMEL_HUMAN)
AFNFPGSQR

SEQ ID NO: 134499 - protein, 9 aa, Artificial Sequence
  Description of Artificial Sequence: Synthetic peptide
  Seed: FPDGGPCPS (PMEL_HUMAN)
FTDGGPCPF

SEQ ID NO: 134500 - protein, 9 aa, Artificial Sequence
  Description of Artificial Sequence: Synthetic peptide
  Seed: GQVPLIVGI (PMEL_HUMAN)
GEVPLIVGY

SEQ ID NO: 134501 - protein, 10 aa, Artificial Sequence
  Description of Artificial Sequence: Synthetic peptide
  Seed: SQKRSFVYVW (PMEL_HUMAN)
STKRSFVYVW

SEQ ID NO: 134502 - protein, 9 aa, Artificial Sequence
  Description of Artificial Sequence: Synthetic peptide
  Seed: LIVGILLVL (PMEL_HUMAN)
LLVGILLVY

SEQ ID NO: 134503 - protein, 9 aa, Artificial Sequence
  Description of Artificial Sequence: Synthetic peptide
  Seed: VLPDGQVIW (PMEL_HUMAN)
VLPDGQVIY

SEQ ID NO: 134504 - protein, 10 aa, Artificial Sequence
  Description of Artificial Sequence: Synthetic peptide
  Seed: VTAQVVLQAA (PMEL_HUMAN)
VTAQVVLQAI

SEQ ID NO: 134505 - protein, 10 aa, Artificial Sequence
  Description of Artificial Sequence: Synthetic peptide
  Seed: RGSRSYVPLA (PMEL_HUMAN)
RHSRSYVPLL

SEQ ID NO: 134506 - protein, 11 aa, Artificial Sequence
  Description of Artificial Sequence: Synthetic peptide
  Seed: RALDGGNKHFL (PMEL_HUMAN)
RLLDGGNKHFY

SEQ ID NO: 134507 - protein, 9 aa, Artificial Sequence
  Description of Artificial Sequence: Synthetic peptide
  Seed: VVLQAAIPL (PMEL_HUMAN)
VQLQAAIPM

SEQ ID NO: 134508 - protein, 10 aa, Artificial Sequence
  Description of Artificial Sequence: Synthetic peptide
  Seed: RTKAWNRQLY (PMEL_HUMAN)
RVKAWNRQLR

SEQ ID NO: 134509 - protein, 9 aa, Artificial Sequence
  Description of Artificial Sequence: Synthetic peptide
  Seed: VTLDIVQGI (PMEL_HUMAN)
VILDIVQGW

SEQ ID NO: 134510 - protein, 10 aa, Artificial Sequence
  Description of Artificial Sequence: Synthetic peptide
  Seed: RRLMKQDFSV (PMEL_HUMAN)
RGLMKQDFSL

SEQ ID NO: 134511 - protein, 9 aa, Artificial Sequence
  Description of Artificial Sequence: Synthetic peptide
  Seed: DAFELTVSC (PMEL_HUMAN)
DQFELTVSA

SEQ ID NO: 134512 - protein, 9 aa, Artificial Sequence
  Description of Artificial Sequence: Synthetic peptide
  Seed: KTWGQYWQV (PMEL_HUMAN)
KGWGQYWQR

SEQ ID NO: 134513 - protein, 11 aa, Artificial Sequence
  Description of Artificial Sequence: Synthetic peptide
  Seed: SGYLAEADLSY (PMEL_HUMAN)
SKYLAEADLSF

SEQ ID NO: 134514 - protein, 9 aa, Artificial Sequence
  Description of Artificial Sequence: Synthetic peptide
  Seed: LHLAVIGAL (PMEL_HUMAN)
LKLAVIGAF

SEQ ID NO: 134515 - protein, 8 aa, Artificial Sequence
  Description of Artificial Sequence: Synthetic peptide
  Seed: STPEATGM (PMEL_HUMAN)
SVPEATGL

SEQ ID NO: 134516 - protein, 10 aa, Artificial Sequence
  Description of Artificial Sequence: Synthetic peptide
  Seed: NASFSIALNF (PMEL_HUMAN)
NRSFSIALNF

SEQ ID NO: 134517 - protein, 9 aa, Artificial Sequence
  Description of Artificial Sequence: Synthetic peptide
  Seed: YPQETDDAC (PMEL_HUMAN)
YVQETDDAY

SEQ ID NO: 134518 - protein, 9 aa, Artificial Sequence
  Description of Artificial Sequence: Synthetic peptide
  Seed: VSVSQLRAL (PMEL_HUMAN)
VSVSQLRAW

SEQ ID NO: 134519 - protein, 10 aa, Artificial Sequence
  Description of Artificial Sequence: Synthetic peptide
  Seed: ESITGSLGPL (PMEL_HUMAN)
ESITGSLGPK

SEQ ID NO: 134520 - protein, 9 aa, Artificial Sequence
  Description of Artificial Sequence: Synthetic peptide
  Seed: ALDGGNKHF (PMEL_HUMAN)
AADGGNKHI

SEQ ID NO: 134521 - protein, 9 aa, Artificial Sequence
  Description of Artificial Sequence: Synthetic peptide
  Seed: RAMLGTHTM (PMEL_HUMAN)
RLMLGTHTK

SEQ ID NO: 134522 - protein, 8 aa, Artificial Sequence
  Description of Artificial Sequence: Synthetic peptide
  Seed: SHWLRLPR (PMEL_HUMAN)
SLWLRLPR

SEQ ID NO: 134523 - protein, 9 aa, Artificial Sequence
  Description of Artificial Sequence: Synthetic peptide
  Seed: GMTPAEVSI (PMEL_HUMAN)
GQTPAEVSL

SEQ ID NO: 134524 - protein, 9 aa, Artificial Sequence
  Description of Artificial Sequence: Synthetic peptide
  Seed: GMTPAEVSI (PMEL_HUMAN)
GMTPAEVSL

SEQ ID NO: 134525 - protein, 9 aa, Artificial Sequence
  Description of Artificial Sequence: Synthetic peptide
  Seed: AEPSGTTSV (PMEL_HUMAN)
ATPSGTTSM

SEQ ID NO: 134526 - protein, 9 aa, Artificial Sequence
  Description of Artificial Sequence: Synthetic peptide
  Seed: ASFSIALNF (PMEL_HUMAN)
AMFSIALNF

SEQ ID NO: 134527 - protein, 9 aa, Artificial Sequence
  Description of Artificial Sequence: Synthetic peptide
  Seed: WSQKRSFVY (PMEL_HUMAN)
WFQKRSFVF

SEQ ID NO: 134528 - protein, 9 aa, Artificial Sequence
  Description of Artificial Sequence: Synthetic peptide
  Seed: TLIGANASF (PMEL_HUMAN)
TPIGANASM

SEQ ID NO: 134529 - protein, 10 aa, Artificial Sequence
  Description of Artificial Sequence: Synthetic peptide
  Seed: SLADTNSLAV (PMEL_HUMAN)
SMADTNSLAA

SEQ ID NO: 134530 - protein, 10 aa, Artificial Sequence
  Description of Artificial Sequence: Synthetic peptide
  Seed: RRLMKQDFSV (PMEL_HUMAN)
RTLMKQDFSI

SEQ ID NO: 134531 - protein, 9 aa, Artificial Sequence
  Description of Artificial Sequence: Synthetic peptide
  Seed: SVQVPTTEV (PMEL_HUMAN)
SLQVPTTEF

SEQ ID NO: 134532 - protein, 8 aa, Artificial Sequence
  Description of Artificial Sequence: Synthetic peptide
  Seed: TLDIVQGI (PMEL_HUMAN)
TTDIVQGM

SEQ ID NO: 134533 - protein, 9 aa, Artificial Sequence
  Description of Artificial Sequence: Synthetic peptide
  Seed: VISTAPVQM (PMEL_HUMAN)
VSSTAPVQL

SEQ ID NO: 134534 - protein, 9 aa, Artificial Sequence
  Description of Artificial Sequence: Synthetic peptide
  Seed: KHFLRNQPL (PMEL_HUMAN)
KRFLRNQPL

SEQ ID NO: 134535 - protein, 9 aa, Artificial Sequence
  Description of Artificial Sequence: Synthetic peptide
  Seed: HTMEVTVYH (PMEL_HUMAN)
HVMEVTVYL

SEQ ID NO: 134536 - protein, 10 aa, Artificial Sequence
  Description of Artificial Sequence: Synthetic peptide
  Seed: LVLMAVVLAS (PMEL_HUMAN)
LSLMAVVLAM

SEQ ID NO: 134537 - protein, 9 aa, Artificial Sequence
  Description of Artificial Sequence: Synthetic peptide
  Seed: TPAEVSIVV (PMEL_HUMAN)
TPAEVSIVM

SEQ ID NO: 134538 - protein, 10 aa, Artificial Sequence
  Description of Artificial Sequence: Synthetic peptide
  Seed: MTPAEVSIVV (PMEL_HUMAN)
MFPAEVSIVY

SEQ ID NO: 134539 - protein, 9 aa, Artificial Sequence
  Description of Artificial Sequence: Synthetic peptide
  Seed: AQVVLQAAI (PMEL_HUMAN)
AEVVLQAAC

SEQ ID NO: 134540 - protein, 10 aa, Artificial Sequence
  Description of Artificial Sequence: Synthetic peptide
  Seed: EVSIVVLSGT (PMEL_HUMAN)
ELSIVVLSGV

SEQ ID NO: 134541 - protein, 10 aa, Artificial Sequence
  Description of Artificial Sequence: Synthetic peptide
  Seed: YVPLAHSSSA (PMEL_HUMAN)
YLPLAHSSSV

SEQ ID NO: 134542 - protein, 10 aa, Artificial Sequence
  Description of Artificial Sequence: Synthetic peptide
  Seed: MTPAEVSIVV (PMEL_HUMAN)
MCPAEVSIVW

SEQ ID NO: 134543 - protein, 10 aa, Artificial Sequence
  Description of Artificial Sequence: Synthetic peptide
  Seed: WSQKRSFVYV (PMEL_HUMAN)
WVQKRSFVYK

SEQ ID NO: 134544 - protein, 9 aa, Artificial Sequence
  Description of Artificial Sequence: Synthetic peptide
  Seed: DQVPFSVSV (PMEL_HUMAN)
DIVPFSVSF

SEQ ID NO: 134545 - protein, 9 aa, Artificial Sequence
  Description of Artificial Sequence: Synthetic peptide
  Seed: HSSSHWLRL (PMEL_HUMAN)
HGSSHWLRY

SEQ ID NO: 134546 - protein, 10 aa, Artificial Sequence
  Description of Artificial Sequence: Synthetic peptide
  Seed: QILKGGSGTY (PMEL_HUMAN)
QSLKGGSGTR

SEQ ID NO: 134547 - protein, 10 aa, Artificial Sequence
  Description of Artificial Sequence: Synthetic peptide
  Seed: CLLHLAVIGA (PMEL_HUMAN)
CMLHLAVIGI

SEQ ID NO: 134548 - protein, 9 aa, Artificial Sequence
  Description of Artificial Sequence: Synthetic peptide
  Seed: AGLGQVPLI (PMEL_HUMAN)
AALGQVPLY

SEQ ID NO: 134549 - protein, 9 aa, Artificial Sequence
  Description of Artificial Sequence: Synthetic peptide
  Seed: RALVVTHTY (PMEL_HUMAN)
RALVVTHTF

SEQ ID NO: 134550 - protein, 9 aa, Artificial Sequence
  Description of Artificial Sequence: Synthetic peptide
  Seed: RQVPLDCVL (PMEL_HUMAN)
RVVPLDCVM

SEQ ID NO: 134551 - protein, 11 aa, Artificial Sequence
  Description of Artificial Sequence: Synthetic peptide
  Seed: YLAEADLSYTW (PMEL_HUMAN)
YFAEADLSYTW

SEQ ID NO: 134552 - protein, 11 aa, Artificial Sequence
  Description of Artificial Sequence: Synthetic peptide
  Seed: VSLADTNSLAV (PMEL_HUMAN)
VTLADTNSLAL

SEQ ID NO: 134553 - protein, 9 aa, Artificial Sequence
  Description of Artificial Sequence: Synthetic peptide
  Seed: RALVVTHTY (PMEL_HUMAN)
RMLVVTHTM

SEQ ID NO: 134554 - protein, 9 aa, Artificial Sequence
  Description of Artificial Sequence: Synthetic peptide
  Seed: NFPGSQKVL (PMEL_HUMAN)
NGPGSQKVL

SEQ ID NO: 134555 - protein, 9 aa, Artificial Sequence
  Description of Artificial Sequence: Synthetic peptide
  Seed: GPVTAQVVL (PMEL_HUMAN)
GPVTAQVVA

SEQ ID NO: 134556 - protein, 9 aa, Artificial Sequence
  Description of Artificial Sequence: Synthetic peptide
  Seed: ILLVLMAVV (PMEL_HUMAN)
IILVLMAVV

SEQ ID NO: 134557 - protein, 8 aa, Artificial Sequence
  Description of Artificial Sequence: Synthetic peptide
  Seed: TLDIVQGI (PMEL_HUMAN)
TYDIVQGF

SEQ ID NO: 134558 - protein, 9 aa, Artificial Sequence
  Description of Artificial Sequence: Synthetic peptide
  Seed: ESAEILQAV (PMEL_HUMAN)
ETAEILQAI

SEQ ID NO: 134559 - protein, 10 aa, Artificial Sequence
  Description of Artificial Sequence: Synthetic peptide
  Seed: SQVWGGQPVY (PMEL_HUMAN)
SRVWGGQPVY

SEQ ID NO: 134560 - protein, 10 aa, Artificial Sequence
  Description of Artificial Sequence: Synthetic peptide
  Seed: TVSCQGGLPK (PMEL_HUMAN)
TISCQGGLPK

SEQ ID NO: 134561 - protein, 9 aa, Artificial Sequence
  Description of Artificial Sequence: Synthetic peptide
  Seed: GMTPAEVSI (PMEL_HUMAN)
GTTPAEVSL

SEQ ID NO: 134562 - protein, 10 aa, Artificial Sequence
  Description of Artificial Sequence: Synthetic peptide
  Seed: SVPQLPHSSS (PMEL_HUMAN)
SAPQLPHSSM

SEQ ID NO: 134563 - protein, 10 aa, Artificial Sequence
  Description of Artificial Sequence: Synthetic peptide
  Seed: ESAEILQAVP (PMEL_HUMAN)
EVAEILQAVK

SEQ ID NO: 134564 - protein, 9 aa, Artificial Sequence
  Description of Artificial Sequence: Synthetic peptide
  Seed: RNQPLTFAL (PMEL_HUMAN)
RYQPLTFAY

SEQ ID NO: 134565 - protein, 9 aa, Artificial Sequence
  Description of Artificial Sequence: Synthetic peptide
  Seed: VSEVMGTTL (PMEL_HUMAN)
VSEVMGTTF

SEQ ID NO: 134566 - protein, 10 aa, Artificial Sequence
  Description of Artificial Sequence: Synthetic peptide
  Seed: VPLAHSSSAF (PMEL_HUMAN)
VYLAHSSSAF

SEQ ID NO: 134567 - protein, 10 aa, Artificial Sequence
  Description of Artificial Sequence: Synthetic peptide
  Seed: YVPLAHSSSA (PMEL_HUMAN)
YKPLAHSSSF

SEQ ID NO: 134568 - protein, 10 aa, Artificial Sequence
  Description of Artificial Sequence: Synthetic peptide
  Seed: LMAVVLASLI (PMEL_HUMAN)
LLAVVLASLW

SEQ ID NO: 134569 - protein, 11 aa, Artificial Sequence
  Description of Artificial Sequence: Synthetic peptide
  Seed: FGDSSGTLISR (PMEL_HUMAN)
FSDSSGTLISI

SEQ ID NO: 134570 - protein, 9 aa, Artificial Sequence
  Description of Artificial Sequence: Synthetic peptide
  Seed: RYGSFSVTL (PMEL_HUMAN)
RSGSFSVTY

SEQ ID NO: 134571 - protein, 9 aa, Artificial Sequence
  Description of Artificial Sequence: Synthetic peptide
  Seed: LSIGTGRAM (PMEL_HUMAN)
LAIGTGRAI

SEQ ID NO: 134572 - protein, 8 aa, Artificial Sequence
  Description of Artificial Sequence: Synthetic peptide
  Seed: SNDGPTLI (PMEL_HUMAN)
SMDGPTLM

SEQ ID NO: 134573 - protein, 10 aa, Artificial Sequence
  Description of Artificial Sequence: Synthetic peptide
  Seed: MPTAESTGMT (PMEL_HUMAN)
MRTAESTGMI

SEQ ID NO: 134574 - protein, 8 aa, Artificial Sequence
  Description of Artificial Sequence: Synthetic peptide
  Seed: MAVVLASL (PMEL_HUMAN)
MQVVLASL

SEQ ID NO: 134575 - protein, 9 aa, Artificial Sequence
  Description of Artificial Sequence: Synthetic peptide
  Seed: ETTARELPI (PMEL_HUMAN)
ETTARELPV

SEQ ID NO: 134576 - protein, 9 aa, Artificial Sequence
  Description of Artificial Sequence: Synthetic peptide
  Seed: QVIWVNNTI (PMEL_HUMAN)
QMIWVNNTW

SEQ ID NO: 134577 - protein, 11 aa, Artificial Sequence
  Description of Artificial Sequence: Synthetic peptide
  Seed: YVPLAHSSSAF (PMEL_HUMAN)
YCPLAHSSSAF

SEQ ID NO: 134578 - protein, 10 aa, Artificial Sequence
  Description of Artificial Sequence: Synthetic peptide
  Seed: VPQLPHSSSH (PMEL_HUMAN)
VAQLPHSSSY

SEQ ID NO: 134579 - protein, 10 aa, Artificial Sequence
  Description of Artificial Sequence: Synthetic peptide
  Seed: YRYGSFSVTL (PMEL_HUMAN)
YMYGSFSVTH

SEQ ID NO: 134580 - protein, 9 aa, Artificial Sequence
  Description of Artificial Sequence: Synthetic peptide
  Seed: SGLSIGTGR (PMEL_HUMAN)
SWLSIGTGR

SEQ ID NO: 134581 - protein, 10 aa, Artificial Sequence
  Description of Artificial Sequence: Synthetic peptide
  Seed: SVPQLPHSSS (PMEL_HUMAN)
SCPQLPHSSF

SEQ ID NO: 134582 - protein, 9 aa, Artificial Sequence
  Description of Artificial Sequence: Synthetic peptide
  Seed: ILKGGSGTY (PMEL_HUMAN)
IAKGGSGTL

SEQ ID NO: 134583 - protein, 9 aa, Artificial Sequence
  Description of Artificial Sequence: Synthetic peptide
  Seed: ADTNSLAVV (PMEL_HUMAN)
AETNSLAVA

SEQ ID NO: 134584 - protein, 9 aa, Artificial Sequence
  Description of Artificial Sequence: Synthetic peptide
  Seed: FTITDQVPF (PMEL_HUMAN)
FKITDQVPF

SEQ ID NO: 134585 - protein, 9 aa, Artificial Sequence
  Description of Artificial Sequence: Synthetic peptide
  Seed: GMTPAEVSI (PMEL_HUMAN)
GQTPAEVSW

SEQ ID NO: 134586 - protein, 9 aa, Artificial Sequence
  Description of Artificial Sequence: Synthetic peptide
  Seed: GSWSQKRSF (PMEL_HUMAN)
GMWSQKRSW

SEQ ID NO: 134587 - protein, 10 aa, Artificial Sequence
  Description of Artificial Sequence: Synthetic peptide
  Seed: MPTAESTGMT (PMEL_HUMAN)
METAESTGMV

SEQ ID NO: 134588 - protein, 9 aa, Artificial Sequence
  Description of Artificial Sequence: Synthetic peptide
  Seed: VMGTTLAEM (PMEL_HUMAN)
VAGTTLAEV

SEQ ID NO: 134589 - protein, 9 aa, Artificial Sequence
  Description of Artificial Sequence: Synthetic peptide
  Seed: YLEPGPVTA (PMEL_HUMAN)
YPEPGPVTA

SEQ ID NO: 134590 - protein, 10 aa, Artificial Sequence
  Description of Artificial Sequence: Synthetic peptide
  Seed: KVSNDGPTLI (PMEL_HUMAN)
KISNDGPTLW

SEQ ID NO: 134591 - protein, 9 aa, Artificial Sequence
  Description of Artificial Sequence: Synthetic peptide
  Seed: ASFSIALNF (PMEL_HUMAN)
ATFSIALNK

SEQ ID NO: 134592 - protein, 10 aa, Artificial Sequence
  Description of Artificial Sequence: Synthetic peptide
  Seed: VLPSPACQLV (PMEL_HUMAN)
VMPSPACQLV

SEQ ID NO: 134593 - protein, 10 aa, Artificial Sequence
  Description of Artificial Sequence: Synthetic peptide
  Seed: RQLRTKAWNR (PMEL_HUMAN)
RTLRTKAWNR

SEQ ID NO: 134594 - protein, 9 aa, Artificial Sequence
  Description of Artificial Sequence: Synthetic peptide
  Seed: RAMLGTHTM (PMEL_HUMAN)
RVMLGTHTR

SEQ ID NO: 134595 - protein, 9 aa, Artificial Sequence
  Description of Artificial Sequence: Synthetic peptide
  Seed: SRSYVPLAH (PMEL_HUMAN)
SRSYVPLAV

SEQ ID NO: 134596 - protein, 10 aa, Artificial Sequence
  Description of Artificial Sequence: Synthetic peptide
  Seed: VPQLPHSSSH (PMEL_HUMAN)
VPQLPHSSSY

SEQ ID NO: 134597 - protein, 9 aa, Artificial Sequence
  Description of Artificial Sequence: Synthetic peptide
  Seed: HSSSHWLRL (PMEL_HUMAN)
HSSSHWLRM

SEQ ID NO: 134598 - protein, 10 aa, Artificial Sequence
  Description of Artificial Sequence: Synthetic peptide
  Seed: ALDGGNKHFL (PMEL_HUMAN)
ASDGGNKHFL

SEQ ID NO: 134599 - protein, 9 aa, Artificial Sequence
  Description of Artificial Sequence: Synthetic peptide
  Seed: RTKAWNRQL (PMEL_HUMAN)
RTKAWNRQS

SEQ ID NO: 134600 - protein, 10 aa, Artificial Sequence
  Description of Artificial Sequence: Synthetic peptide
  Seed: LAVVSTQLIM (PMEL_HUMAN)
LQVVSTQLIM

SEQ ID NO: 134601 - protein, 10 aa, Artificial Sequence
  Description of Artificial Sequence: Synthetic peptide
  Seed: YGSFSVTLDI (PMEL_HUMAN)
YGSFSVTLDW

SEQ ID NO: 134602 - protein, 9 aa, Artificial Sequence
  Description of Artificial Sequence: Synthetic peptide
  Seed: ITDQVPFSV (PMEL_HUMAN)
ICDQVPFSM

SEQ ID NO: 134603 - protein, 9 aa, Artificial Sequence
  Description of Artificial Sequence: Synthetic peptide
  Seed: FTITDQVPF (PMEL_HUMAN)
FYITDQVPL

SEQ ID NO: 134604 - protein, 10 aa, Artificial Sequence
  Description of Artificial Sequence: Synthetic peptide
  Seed: LHLAVIGALL (PMEL_HUMAN)
LTLAVIGALL

SEQ ID NO: 134605 - protein, 9 aa, Artificial Sequence
  Description of Artificial Sequence: Synthetic peptide
  Seed: ITDQVPFSV (PMEL_HUMAN)
IFDQVPFSY

SEQ ID NO: 134606 - protein, 10 aa, Artificial Sequence
  Description of Artificial Sequence: Synthetic peptide
  Seed: RQLRTKAWNR (PMEL_HUMAN)
RILRTKAWNR

SEQ ID NO: 134607 - protein, 9 aa, Artificial Sequence
  Description of Artificial Sequence: Synthetic peptide
  Seed: AEVSIVVLS (PMEL_HUMAN)
ADVSIVVLM

SEQ ID NO: 134608 - protein, 10 aa, Artificial Sequence
  Description of Artificial Sequence: Synthetic peptide
  Seed: MSTESITGSL (PMEL_HUMAN)
MATESITGSY

SEQ ID NO: 134609 - protein, 10 aa, Artificial Sequence
  Description of Artificial Sequence: Synthetic peptide
  Seed: LIGANASFSI (PMEL_HUMAN)
LMGANASFSM

SEQ ID NO: 134610 - protein, 9 aa, Artificial Sequence
  Description of Artificial Sequence: Synthetic peptide
  Seed: ALVVTHTYL (PMEL_HUMAN)
AQVVTHTYY

SEQ ID NO: 134611 - protein, 9 aa, Artificial Sequence
  Description of Artificial Sequence: Synthetic peptide
  Seed: VQMPTAEST (PMEL_HUMAN)
VIMPTAESV

SEQ ID NO: 134612 - protein, 9 aa, Artificial Sequence
  Description of Artificial Sequence: Synthetic peptide
  Seed: ALLAVGATK (PMEL_HUMAN)
AALAVGATK

SEQ ID NO: 134613 - protein, 9 aa, Artificial Sequence
  Description of Artificial Sequence: Synthetic peptide
  Seed: ESAEILQAV (PMEL_HUMAN)
ESAEILQAL

SEQ ID NO: 134614 - protein, 10 aa, Artificial Sequence
  Description of Artificial Sequence: Synthetic peptide
  Seed: KVLPDGQVIW (PMEL_HUMAN)
KFLPDGQVIY

SEQ ID NO: 134615 - protein, 10 aa, Artificial Sequence
  Description of Artificial Sequence: Synthetic peptide
  Seed: AMLGTHTMEV (PMEL_HUMAN)
AILGTHTMEV

SEQ ID NO: 134616 - protein, 9 aa, Artificial Sequence
  Description of Artificial Sequence: Synthetic peptide
  Seed: TTAGQVPTT (PMEL_HUMAN)
TSAGQVPTV

SEQ ID NO: 134617 - protein, 10 aa, Artificial Sequence
  Description of Artificial Sequence: Synthetic peptide
  Seed: AVIGALLAVG (PMEL_HUMAN)
ATIGALLAVA

SEQ ID NO: 134618 - protein, 9 aa, Artificial Sequence
  Description of Artificial Sequence: Synthetic peptide
  Seed: AQRLCQPVL (PMEL_HUMAN)
ATRLCQPVV

SEQ ID NO: 134619 - protein, 9 aa, Artificial Sequence
  Description of Artificial Sequence: Synthetic peptide
  Seed: LLHLAVIGA (PMEL_HUMAN)
LMHLAVIGL

SEQ ID NO: 134620 - protein, 9 aa, Artificial Sequence
  Description of Artificial Sequence: Synthetic peptide
  Seed: SQVWGGQPV (PMEL_HUMAN)
SAVWGGQPY

SEQ ID NO: 134621 - protein, 9 aa, Artificial Sequence
  Description of Artificial Sequence: Synthetic peptide
  Seed: AVIGALLAV (PMEL_HUMAN)
AVIGALLAK

SEQ ID NO: 134622 - protein, 10 aa, Artificial Sequence
  Description of Artificial Sequence: Synthetic peptide
  Seed: RQVPLDCVLY (PMEL_HUMAN)
RLVPLDCVLW

SEQ ID NO: 134623 - protein, 9 aa, Artificial Sequence
  Description of Artificial Sequence: Synthetic peptide
  Seed: SRSYVPLAH (PMEL_HUMAN)
SRSYVPLAI

SEQ ID NO: 134624 - protein, 10 aa, Artificial Sequence
  Description of Artificial Sequence: Synthetic peptide
  Seed: GQVPLIVGIL (PMEL_HUMAN)
GQVPLIVGIV

SEQ ID NO: 134625 - protein, 9 aa, Artificial Sequence
  Description of Artificial Sequence: Synthetic peptide
  Seed: TAQVVLQAA (PMEL_HUMAN)
THQVVLQAT

SEQ ID NO: 134626 - protein, 10 aa, Artificial Sequence
  Description of Artificial Sequence: Synthetic peptide
  Seed: MPTAESTGMT (PMEL_HUMAN)
MYTAESTGMV

SEQ ID NO: 134627 - protein, 10 aa, Artificial Sequence
  Description of Artificial Sequence: Synthetic peptide
  Seed: RGSRSYVPLA (PMEL_HUMAN)
RPSRSYVPLS

SEQ ID NO: 134628 - protein, 9 aa, Artificial Sequence
  Description of Artificial Sequence: Synthetic peptide
  Seed: LPDGQVIWV (PMEL_HUMAN)
LFDGQVIWI

SEQ ID NO: 134629 - protein, 10 aa, Artificial Sequence
  Description of Artificial Sequence: Synthetic peptide
  Seed: ASSIMSTESI (PMEL_HUMAN)
AMSIMSTESW

SEQ ID NO: 134630 - protein, 11 aa, Artificial Sequence
  Description of Artificial Sequence: Synthetic peptide
  Seed: KAWNRQLYPEW (PMEL_HUMAN)
KAWNRQLYPEF

SEQ ID NO: 134631 - protein, 9 aa, Artificial Sequence
  Description of Artificial Sequence: Synthetic peptide
  Seed: LADTNSLAV (PMEL_HUMAN)
LVDTNSLAM

SEQ ID NO: 134632 - protein, 10 aa, Artificial Sequence
  Description of Artificial Sequence: Synthetic peptide
  Seed: MTPAEVSIVV (PMEL_HUMAN)
MDPAEVSIVS

SEQ ID NO: 134633 - protein, 9 aa, Artificial Sequence
  Description of Artificial Sequence: Synthetic peptide
  Seed: MEVTVYHRR (PMEL_HUMAN)
MGVTVYHRR

SEQ ID NO: 134634 - protein, 9 aa, Artificial Sequence
  Description of Artificial Sequence: Synthetic peptide
  Seed: SGLSIGTGR (PMEL_HUMAN)
SVLSIGTGR

SEQ ID NO: 134635 - protein, 10 aa, Artificial Sequence
  Description of Artificial Sequence: Synthetic peptide
  Seed: VLMAVVLASL (PMEL_HUMAN)
VMMAVVLAST

SEQ ID NO: 134636 - protein, 9 aa, Artificial Sequence
  Description of Artificial Sequence: Synthetic peptide
  Seed: KHFLRNQPL (PMEL_HUMAN)
KNFLRNQPF

SEQ ID NO: 134637 - protein, 10 aa, Artificial Sequence
  Description of Artificial Sequence: Synthetic peptide
  Seed: RGSRSYVPLA (PMEL_HUMAN)
RKSRSYVPLY

SEQ ID NO: 134638 - protein, 9 aa, Artificial Sequence
  Description of Artificial Sequence: Synthetic peptide
  Seed: RIFCSCPIG (PMEL_HUMAN)
RTFCSCPIK

SEQ ID NO: 134639 - protein, 9 aa, Artificial Sequence
  Description of Artificial Sequence: Synthetic peptide
  Seed: SQKRSFVYV (PMEL_HUMAN)
SAKRSFVYI

SEQ ID NO: 134640 - protein, 9 aa, Artificial Sequence
  Description of Artificial Sequence: Synthetic peptide
  Seed: VVLQAAIPL (PMEL_HUMAN)
VLLQAAIPF

SEQ ID NO: 134641 - protein, 9 aa, Artificial Sequence
  Description of Artificial Sequence: Synthetic peptide
  Seed: RTKAWNRQL (PMEL_HUMAN)
RMKAWNRQI

SEQ ID NO: 134642 - protein, 10 aa, Artificial Sequence
  Description of Artificial Sequence: Synthetic peptide
  Seed: ESAEILQAVP (PMEL_HUMAN)
EIAEILQAVA

SEQ ID NO: 134643 - protein, 9 aa, Artificial Sequence
  Description of Artificial Sequence: Synthetic peptide
  Seed: VPLAHSSSA (PMEL_HUMAN)
VPLAHSSSL

SEQ ID NO: 134644 - protein, 10 aa, Artificial Sequence
  Description of Artificial Sequence: Synthetic peptide
  Seed: WKTWGQYWQV (PMEL_HUMAN)
WQTWGQYWQL

SEQ ID NO: 134645 - protein, 9 aa, Artificial Sequence
  Description of Artificial Sequence: Synthetic peptide
  Seed: WSQKRSFVY (PMEL_HUMAN)
WVQKRSFVY

SEQ ID NO: 134646 - protein, 9 aa, Artificial Sequence
  Description of Artificial Sequence: Synthetic peptide
  Seed: SVPQLPHSS (PMEL_HUMAN)
STPQLPHSF

SEQ ID NO: 134647 - protein, 10 aa, Artificial Sequence
  Description of Artificial Sequence: Synthetic peptide
  Seed: MTPAEVSIVV (PMEL_HUMAN)
MSPAEVSIVV

SEQ ID NO: 134648 - protein, 9 aa, Artificial Sequence
  Description of Artificial Sequence: Synthetic peptide
  Seed: VTAQVVLQA (PMEL_HUMAN)
VGAQVVLQM

SEQ ID NO: 134649 - protein, 10 aa, Artificial Sequence
  Description of Artificial Sequence: Synthetic peptide
  Seed: LQLHDPSGYL (PMEL_HUMAN)
LVLHDPSGYV

SEQ ID NO: 134650 - protein, 9 aa, Artificial Sequence
  Description of Artificial Sequence: Synthetic peptide
  Seed: QPVLPSPAC (PMEL_HUMAN)
QPVLPSPAA

SEQ ID NO: 134651 - protein, 9 aa, Artificial Sequence
  Description of Artificial Sequence: Synthetic peptide
  Seed: RALDGGNKH (PMEL_HUMAN)
RALDGGNKF

SEQ ID NO: 134652 - protein, 10 aa, Artificial Sequence
  Description of Artificial Sequence: Synthetic peptide
  Seed: LHLAVIGALL (PMEL_HUMAN)
LSLAVIGALL

SEQ ID NO: 134653 - protein, 10 aa, Artificial Sequence
  Description of Artificial Sequence: Synthetic peptide
  Seed: MPTAESTGMT (PMEL_HUMAN)
MLTAESTGMV

SEQ ID NO: 134654 - protein, 9 aa, Artificial Sequence
  Description of Artificial Sequence: Synthetic peptide
  Seed: SAFTITDQV (PMEL_HUMAN)
SMFTITDQI

SEQ ID NO: 134655 - protein, 8 aa, Artificial Sequence
  Description of Artificial Sequence: Synthetic peptide
  Seed: VETTAREL (PMEL_HUMAN)
VQTTAREV

SEQ ID NO: 134656 - protein, 8 aa, Artificial Sequence
  Description of Artificial Sequence: Synthetic peptide
  Seed: TEWVETTA (PMEL_HUMAN)
TEWVETTL

SEQ ID NO: 134657 - protein, 10 aa, Artificial Sequence
  Description of Artificial Sequence: Synthetic peptide
  Seed: LAVIGALLAV (PMEL_HUMAN)
LRVIGALLAA

SEQ ID NO: 134658 - protein, 9 aa, Artificial Sequence
  Description of Artificial Sequence: Synthetic peptide
  Seed: RTKAWNRQL (PMEL_HUMAN)
RSKAWNRQV

SEQ ID NO: 134659 - protein, 9 aa, Artificial Sequence
  Description of Artificial Sequence: Synthetic peptide
  Seed: RSYVPLAHS (PMEL_HUMAN)
RAYVPLAHK

SEQ ID NO: 134660 - protein, 10 aa, Artificial Sequence
  Description of Artificial Sequence: Synthetic peptide
  Seed: MTPAEVSIVV (PMEL_HUMAN)
MEPAEVSIVY

SEQ ID NO: 134661 - protein, 9 aa, Artificial Sequence
  Description of Artificial Sequence: Synthetic peptide
  Seed: MEVTVYHRR (PMEL_HUMAN)
MTVTVYHRR

SEQ ID NO: 134662 - protein, 10 aa, Artificial Sequence
  Description of Artificial Sequence: Synthetic peptide
  Seed: LVLMAVVLAS (PMEL_HUMAN)
LKLMAVVLAV

SEQ ID NO: 134663 - protein, 10 aa, Artificial Sequence
  Description of Artificial Sequence: Synthetic peptide
  Seed: YLAEADLSYT (PMEL_HUMAN)
YQAEADLSYV

SEQ ID NO: 134664 - protein, 11 aa, Artificial Sequence
  Description of Artificial Sequence: Synthetic peptide
  Seed: APTAEPSGTTS (PMEL_HUMAN)
APTAEPSGTTM

SEQ ID NO: 134665 - protein, 11 aa, Artificial Sequence
  Description of Artificial Sequence: Synthetic peptide
  Seed: IPLTSCGSSPV (PMEL_HUMAN)
IPLTSCGSSPA

SEQ ID NO: 134666 - protein, 9 aa, Artificial Sequence
  Description of Artificial Sequence: Synthetic peptide
  Seed: RQVPLDCVL (PMEL_HUMAN)
RTVPLDCVL

SEQ ID NO: 134667 - protein, 9 aa, Artificial Sequence
  Description of Artificial Sequence: Synthetic peptide
  Seed: ESAEILQAV (PMEL_HUMAN)
EVAEILQAF

SEQ ID NO: 134668 - protein, 9 aa, Artificial Sequence
  Description of Artificial Sequence: Synthetic peptide
  Seed: FLRNQPLTF (PMEL_HUMAN)
FSRNQPLTH

SEQ ID NO: 134669 - protein, 9 aa, Artificial Sequence
  Description of Artificial Sequence: Synthetic peptide
  Seed: VTLDIVQGI (PMEL_HUMAN)
VLLDIVQGC

SEQ ID NO: 134670 - protein, 9 aa, Artificial Sequence
  Description of Artificial Sequence: Synthetic peptide
  Seed: VTLDIVQGI (PMEL_HUMAN)
VTLDIVQGF

SEQ ID NO: 134671 - protein, 9 aa, Artificial Sequence
  Description of Artificial Sequence: Synthetic peptide
  Seed: HTMEVTVYH (PMEL_HUMAN)
HWMEVTVYF

SEQ ID NO: 134672 - protein, 11 aa, Artificial Sequence
  Description of Artificial Sequence: Synthetic peptide
  Seed: RYGSFSVTLDI (PMEL_HUMAN)
RSGSFSVTLDY

SEQ ID NO: 134673 - protein, 10 aa, Artificial Sequence
  Description of Artificial Sequence: Synthetic peptide
  Seed: MTPAEVSIVV (PMEL_HUMAN)
MAPAEVSIVM

SEQ ID NO: 134674 - protein, 9 aa, Artificial Sequence
  Description of Artificial Sequence: Synthetic peptide
  Seed: FTITDQVPF (PMEL_HUMAN)
FLITDQVPI

SEQ ID NO: 134675 - protein, 10 aa, Artificial Sequence
  Description of Artificial Sequence: Synthetic peptide
  Seed: LVLMAVVLAS (PMEL_HUMAN)
LYLMAVVLAA

SEQ ID NO: 134676 - protein, 9 aa, Artificial Sequence
  Description of Artificial Sequence: Synthetic peptide
  Seed: MTPEKVPVS (PMEL_HUMAN)
MTPEKVPVV

SEQ ID NO: 134677 - protein, 9 aa, Artificial Sequence
  Description of Artificial Sequence: Synthetic peptide
  Seed: ALVVTHTYL (PMEL_HUMAN)
AVVVTHTYY

SEQ ID NO: 134678 - protein, 10 aa, Artificial Sequence
  Description of Artificial Sequence: Synthetic peptide
  Seed: MKQDFSVPQL (PMEL_HUMAN)
MMQDFSVPQM

SEQ ID NO: 134679 - protein, 10 aa, Artificial Sequence
  Description of Artificial Sequence: Synthetic peptide
  Seed: SGTYCLNVSL (PMEL_HUMAN)
SHTYCLNVSW

SEQ ID NO: 134680 - protein, 9 aa, Artificial Sequence
  Description of Artificial Sequence: Synthetic peptide
  Seed: YLAEADLSY (PMEL_HUMAN)
YQAEADLSL

SEQ ID NO: 134681 - protein, 9 aa, Artificial Sequence
  Description of Artificial Sequence: Synthetic peptide
  Seed: TEWVETTAR (PMEL_HUMAN)
TTWVETTAR

SEQ ID NO: 134682 - protein, 10 aa, Artificial Sequence
  Description of Artificial Sequence: Synthetic peptide
  Seed: KVSNDGPTLI (PMEL_HUMAN)
KMSNDGPTLW

SEQ ID NO: 134683 - protein, 9 aa, Artificial Sequence
  Description of Artificial Sequence: Synthetic peptide
  Seed: YLAEADLSY (PMEL_HUMAN)
YIAEADLSM

SEQ ID NO: 134684 - protein, 9 aa, Artificial Sequence
  Description of Artificial Sequence: Synthetic peptide
  Seed: VVLSGTTAA (PMEL_HUMAN)
VTLSGTTAV

SEQ ID NO: 134685 - protein, 11 aa, Artificial Sequence
  Description of Artificial Sequence: Synthetic peptide
  Seed: GSQVWGGQPVY (PMEL_HUMAN)
GYQVWGGQPVY

SEQ ID NO: 134686 - protein, 9 aa, Artificial Sequence
  Description of Artificial Sequence: Synthetic peptide
  Seed: VVLQAAIPL (PMEL_HUMAN)
VPLQAAIPV

SEQ ID NO: 134687 - protein, 9 aa, Artificial Sequence
  Description of Artificial Sequence: Synthetic peptide
  Seed: GGPVSGLSI (PMEL_HUMAN)
GYPVSGLSM

SEQ ID NO: 134688 - protein, 9 aa, Artificial Sequence
  Description of Artificial Sequence: Synthetic peptide
  Seed: RAMLGTHTM (PMEL_HUMAN)
RNMLGTHTW

SEQ ID NO: 134689 - protein, 9 aa, Artificial Sequence
  Description of Artificial Sequence: Synthetic peptide
  Seed: VQMPTAEST (PMEL_HUMAN)
VLMPTAESA

SEQ ID NO: 134690 - protein, 10 aa, Artificial Sequence
  Description of Artificial Sequence: Synthetic peptide
  Seed: MAVVLASLIY (PMEL_HUMAN)
MRVVLASLIY

SEQ ID NO: 134691 - protein, 9 aa, Artificial Sequence
  Description of Artificial Sequence: Synthetic peptide
  Seed: ALDGGNKHF (PMEL_HUMAN)
AWDGGNKHI

SEQ ID NO: 134692 - protein, 9 aa, Artificial Sequence
  Description of Artificial Sequence: Synthetic peptide
  Seed: FTITDQVPF (PMEL_HUMAN)
FTITDQVPA

SEQ ID NO: 134693 - protein, 9 aa, Artificial Sequence
  Description of Artificial Sequence: Synthetic peptide
  Seed: YVWKTWGQY (PMEL_HUMAN)
YGWKTWGQY

SEQ ID NO: 134694 - protein, 10 aa, Artificial Sequence
  Description of Artificial Sequence: Synthetic peptide
  Seed: LAHSSSAFTI (PMEL_HUMAN)
LFHSSSAFTL

SEQ ID NO: 134695 - protein, 10 aa, Artificial Sequence
  Description of Artificial Sequence: Synthetic peptide
  Seed: SVTLDIVQGI (PMEL_HUMAN)
SPTLDIVQGV

SEQ ID NO: 134696 - protein, 9 aa, Artificial Sequence
  Description of Artificial Sequence: Synthetic peptide
  Seed: VLMAVVLAS (PMEL_HUMAN)
VIMAVVLAI

SEQ ID NO: 134697 - protein, 10 aa, Artificial Sequence
  Description of Artificial Sequence: Synthetic peptide
  Seed: AEVSIVVLSG (PMEL_HUMAN)
AEVSIVVLSV

SEQ ID NO: 134698 - protein, 9 aa, Artificial Sequence
  Description of Artificial Sequence: Synthetic peptide
  Seed: ILKGGSGTY (PMEL_HUMAN)
IAKGGSGTF

SEQ ID NO: 134699 - protein, 10 aa, Artificial Sequence
  Description of Artificial Sequence: Synthetic peptide
  Seed: RRLMKQDFSV (PMEL_HUMAN)
RHLMKQDFSV

SEQ ID NO: 134700 - protein, 10 aa, Artificial Sequence
  Description of Artificial Sequence: Synthetic peptide
  Seed: VTAQVVLQAA (PMEL_HUMAN)
VVAQVVLQAL

SEQ ID NO: 134701 - protein, 10 aa, Artificial Sequence
  Description of Artificial Sequence: Synthetic peptide
  Seed: WKTWGQYWQV (PMEL_HUMAN)
WVTWGQYWQV

SEQ ID NO: 134702 - protein, 9 aa, Artificial Sequence
  Description of Artificial Sequence: Synthetic peptide
  Seed: LQAAIPLTS (PMEL_HUMAN)
LQAAIPLTY

SEQ ID NO: 134703 - protein, 10 aa, Artificial Sequence
  Description of Artificial Sequence: Synthetic peptide
  Seed: YVPLAHSSSA (PMEL_HUMAN)
YWPLAHSSSL

SEQ ID NO: 134704 - protein, 10 aa, Artificial Sequence
  Description of Artificial Sequence: Synthetic peptide
  Seed: VPLAHSSSAF (PMEL_HUMAN)
VKLAHSSSAM

SEQ ID NO: 134705 - protein, 9 aa, Artificial Sequence
  Description of Artificial Sequence: Synthetic peptide
  Seed: GSRSYVPLA (PMEL_HUMAN)
GGRSYVPLK

SEQ ID NO: 134706 - protein, 9 aa, Artificial Sequence
  Description of Artificial Sequence: Synthetic peptide
  Seed: EKVPVSEVM (PMEL_HUMAN)
EIVPVSEVF

SEQ ID NO: 134707 - protein, 10 aa, Artificial Sequence
  Description of Artificial Sequence: Synthetic peptide
  Seed: ESAEILQAVP (PMEL_HUMAN)
EIAEILQAVV

SEQ ID NO: 134708 - protein, 10 aa, Artificial Sequence
  Description of Artificial Sequence: Synthetic peptide
  Seed: RQLYPEWTEA (PMEL_HUMAN)
RCLYPEWTEV

SEQ ID NO: 134709 - protein, 9 aa, Artificial Sequence
  Description of Artificial Sequence: Synthetic peptide
  Seed: STAPVQMPT (PMEL_HUMAN)
SLAPVQMPI

SEQ ID NO: 134710 - protein, 9 aa, Artificial Sequence
  Description of Artificial Sequence: Synthetic peptide
  Seed: VLGGPVSGL (PMEL_HUMAN)
VMGGPVSGY

SEQ ID NO: 134711 - protein, 9 aa, Artificial Sequence
  Description of Artificial Sequence: Synthetic peptide
  Seed: QKRSFVYVW (PMEL_HUMAN)
QMRSFVYVY

SEQ ID NO: 134712 - protein, 9 aa, Artificial Sequence
  Description of Artificial Sequence: Synthetic peptide
  Seed: ITDQVPFSV (PMEL_HUMAN)
ILDQVPFST

SEQ ID NO: 134713 - protein, 10 aa, Artificial Sequence
  Description of Artificial Sequence: Synthetic peptide
  Seed: SAEILQAVPS (PMEL_HUMAN)
SDEILQAVPA

SEQ ID NO: 134714 - protein, 10 aa, Artificial Sequence
  Description of Artificial Sequence: Synthetic peptide
  Seed: ALLAVGATKV (PMEL_HUMAN)
AMLAVGATKI

SEQ ID NO: 134715 - protein, 9 aa, Artificial Sequence
  Description of Artificial Sequence: Synthetic peptide
  Seed: LIYRRRLMK (PMEL_HUMAN)
LWYRRRLMR

SEQ ID NO: 134716 - protein, 9 aa, Artificial Sequence
  Description of Artificial Sequence: Synthetic peptide
  Seed: KQDFSVPQL (PMEL_HUMAN)
KLDFSVPQM

SEQ ID NO: 134717 - protein, 9 aa, Artificial Sequence
  Description of Artificial Sequence: Synthetic peptide
  Seed: ITDQVPFSV (PMEL_HUMAN)
IGDQVPFSV

SEQ ID NO: 134718 - protein, 9 aa, Artificial Sequence
  Description of Artificial Sequence: Synthetic peptide
  Seed: KAWNRQLYP (PMEL_HUMAN)
KIWNRQLYV

SEQ ID NO: 134719 - protein, 9 aa, Artificial Sequence
  Description of Artificial Sequence: Synthetic peptide
  Seed: AVVSTQLIM (PMEL_HUMAN)
ATVSTQLIV

SEQ ID NO: 134720 - protein, 9 aa, Artificial Sequence
  Description of Artificial Sequence: Synthetic peptide
  Seed: HLAVIGALL (PMEL_HUMAN)
HLAVIGALF

SEQ ID NO: 134721 - protein, 9 aa, Artificial Sequence
  Description of Artificial Sequence: Synthetic peptide
  Seed: RNQPLTFAL (PMEL_HUMAN)
RLQPLTFAV

SEQ ID NO: 134722 - protein, 9 aa, Artificial Sequence
  Description of Artificial Sequence: Synthetic peptide
  Seed: CVLYRYGSF (PMEL_HUMAN)
CLLYRYGSL

SEQ ID NO: 134723 - protein, 9 aa, Artificial Sequence
  Description of Artificial Sequence: Synthetic peptide
  Seed: CPIGENSPL (PMEL_HUMAN)
CPIGENSPI

SEQ ID NO: 134724 - protein, 9 aa, Artificial Sequence
  Description of Artificial Sequence: Synthetic peptide
  Seed: RAMLGTHTM (PMEL_HUMAN)
RAMLGTHTY

SEQ ID NO: 134725 - protein, 9 aa, Artificial Sequence
  Description of Artificial Sequence: Synthetic peptide
  Seed: KTWGQYWQV (PMEL_HUMAN)
KLWGQYWQW

SEQ ID NO: 134726 - protein, 9 aa, Artificial Sequence
  Description of Artificial Sequence: Synthetic peptide
  Seed: FGDSSGTLI (PMEL_HUMAN)
FSDSSGTLM

SEQ ID NO: 134727 - protein, 9 aa, Artificial Sequence
  Description of Artificial Sequence: Synthetic peptide
  Seed: SVQVPTTEV (PMEL_HUMAN)
SQQVPTTEV

SEQ ID NO: 134728 - protein, 10 aa, Artificial Sequence
  Description of Artificial Sequence: Synthetic peptide
  Seed: VSLADTNSLA (PMEL_HUMAN)
VQLADTNSLV

SEQ ID NO: 134729 - protein, 9 aa, Artificial Sequence
  Description of Artificial Sequence: Synthetic peptide
  Seed: KVSNDGPTL (PMEL_HUMAN)
KLSNDGPTA

SEQ ID NO: 134730 - protein, 9 aa, Artificial Sequence
  Description of Artificial Sequence: Synthetic peptide
  Seed: LMAVVLASL (PMEL_HUMAN)
LKAVVLASM

SEQ ID NO: 134731 - protein, 9 aa, Artificial Sequence
  Description of Artificial Sequence: Synthetic peptide
  Seed: RAMLGTHTM (PMEL_HUMAN)
RIMLGTHTL

SEQ ID NO: 134732 - protein, 9 aa, Artificial Sequence
  Description of Artificial Sequence: Synthetic peptide
  Seed: VPLDCVLYR (PMEL_HUMAN)
VLLDCVLYM

SEQ ID NO: 134733 - protein, 10 aa, Artificial Sequence
  Description of Artificial Sequence: Synthetic peptide
  Seed: AVPSGEGDAF (PMEL_HUMAN)
AIPSGEGDAL

SEQ ID NO: 134734 - protein, 8 aa, Artificial Sequence
  Description of Artificial Sequence: Synthetic peptide
  Seed: LHDPSGYL (PMEL_HUMAN)
LVDPSGYM

SEQ ID NO: 134735 - protein, 11 aa, Artificial Sequence
  Description of Artificial Sequence: Synthetic peptide
  Seed: FLRNQPLTFAL (PMEL_HUMAN)
FLRNQPLTFAV

SEQ ID NO: 134736 - protein, 10 aa, Artificial Sequence
  Description of Artificial Sequence: Synthetic peptide
  Seed: RQLYPEWTEA (PMEL_HUMAN)
RVLYPEWTEY

SEQ ID NO: 134737 - protein, 10 aa, Artificial Sequence
  Description of Artificial Sequence: Synthetic peptide
  Seed: GDSSGTLISR (PMEL_HUMAN)
GASSGTLISK

SEQ ID NO: 134738 - protein, 11 aa, Artificial Sequence
  Description of Artificial Sequence: Synthetic peptide
  Seed: KHFLRNQPLTF (PMEL_HUMAN)
KYFLRNQPLTI

SEQ ID NO: 134739 - protein, 9 aa, Artificial Sequence
  Description of Artificial Sequence: Synthetic peptide
  Seed: MPTAESTGM (PMEL_HUMAN)
MMTAESTGY

SEQ ID NO: 134740 - protein, 9 aa, Artificial Sequence
  Description of Artificial Sequence: Synthetic peptide
  Seed: GGPVSGLSI (PMEL_HUMAN)
GYPVSGLSY

SEQ ID NO: 134741 - protein, 9 aa, Artificial Sequence
  Description of Artificial Sequence: Synthetic peptide
  Seed: KQDFSVPQL (PMEL_HUMAN)
KADFSVPQV

SEQ ID NO: 134742 - protein, 9 aa, Artificial Sequence
  Description of Artificial Sequence: Synthetic peptide
  Seed: VSNDGPTLI (PMEL_HUMAN)
VPNDGPTLI

SEQ ID NO: 134743 - protein, 11 aa, Artificial Sequence
  Description of Artificial Sequence: Synthetic peptide
  Seed: FGDSSGTLISR (PMEL_HUMAN)
FADSSGTLISL

SEQ ID NO: 134744 - protein, 8 aa, Artificial Sequence
  Description of Artificial Sequence: Synthetic peptide
  Seed: KAWNRQLY (PMEL_HUMAN)
KQWNRQLF

SEQ ID NO: 134745 - protein, 10 aa, Artificial Sequence
  Description of Artificial Sequence: Synthetic peptide
  Seed: RQLYPEWTEA (PMEL_HUMAN)
RFLYPEWTEL

SEQ ID NO: 134746 - protein, 9 aa, Artificial Sequence
  Description of Artificial Sequence: Synthetic peptide
  Seed: SPGCQPPAQ (PMEL_HUMAN)
SPGCQPPAV

SEQ ID NO: 134747 - protein, 9 aa, Artificial Sequence
  Description of Artificial Sequence: Synthetic peptide
  Seed: AVIGALLAV (PMEL_HUMAN)
APIGALLAI

SEQ ID NO: 134748 - protein, 9 aa, Artificial Sequence
  Description of Artificial Sequence: Synthetic peptide
  Seed: ASFSIALNF (PMEL_HUMAN)
ALFSIALNR

SEQ ID NO: 134749 - protein, 9 aa, Artificial Sequence
  Description of Artificial Sequence: Synthetic peptide
  Seed: SEVMGTTLA (PMEL_HUMAN)
SRVMGTTLA

SEQ ID NO: 134750 - protein, 9 aa, Artificial Sequence
  Description of Artificial Sequence: Synthetic peptide
  Seed: ESTGMTPEK (PMEL_HUMAN)
EITGMTPEK

SEQ ID NO: 134751 - protein, 10 aa, Artificial Sequence
  Description of Artificial Sequence: Synthetic peptide
  Seed: LHLAVIGALL (PMEL_HUMAN)
LYLAVIGALV

SEQ ID NO: 134752 - protein, 10 aa, Artificial Sequence
  Description of Artificial Sequence: Synthetic peptide
  Seed: YPEWTEAQRL (PMEL_HUMAN)
YPEWTEAQRW

SEQ ID NO: 134753 - protein, 10 aa, Artificial Sequence
  Description of Artificial Sequence: Synthetic peptide
  Seed: LGQVPLIVGI (PMEL_HUMAN)
LMQVPLIVGI

SEQ ID NO: 134754 - protein, 9 aa, Artificial Sequence
  Description of Artificial Sequence: Synthetic peptide
  Seed: THTMEVTVY (PMEL_HUMAN)
THTMEVTVV

SEQ ID NO: 134755 - protein, 10 aa, Artificial Sequence
  Description of Artificial Sequence: Synthetic peptide
  Seed: SRALVVTHTY (PMEL_HUMAN)
SNALVVTHTW

SEQ ID NO: 134756 - protein, 9 aa, Artificial Sequence
  Description of Artificial Sequence: Synthetic peptide
  Seed: VLGGPVSGL (PMEL_HUMAN)
VLGGPVSGI

SEQ ID NO: 134757 - protein, 10 aa, Artificial Sequence
  Description of Artificial Sequence: Synthetic peptide
  Seed: TDQVPFSVSV (PMEL_HUMAN)
TAQVPFSVSV

SEQ ID NO: 134758 - protein, 9 aa, Artificial Sequence
  Description of Artificial Sequence: Synthetic peptide
  Seed: KVLPDGQVI (PMEL_HUMAN)
KTLPDGQVM

SEQ ID NO: 134759 - protein, 10 aa, Artificial Sequence
  Description of Artificial Sequence: Synthetic peptide
  Seed: LVLMAVVLAS (PMEL_HUMAN)
LTLMAVVLAA

SEQ ID NO: 134760 - protein, 9 aa, Artificial Sequence
  Description of Artificial Sequence: Synthetic peptide
  Seed: LIVGILLVL (PMEL_HUMAN)
LAVGILLVM

SEQ ID NO: 134761 - protein, 9 aa, Artificial Sequence
  Description of Artificial Sequence: Synthetic peptide
  Seed: VISTAPVQM (PMEL_HUMAN)
VSSTAPVQM

SEQ ID NO: 134762 - protein, 11 aa, Artificial Sequence
  Description of Artificial Sequence: Synthetic peptide
  Seed: VSLADTNSLAV (PMEL_HUMAN)
VILADTNSLAW

SEQ ID NO: 134763 - protein, 9 aa, Artificial Sequence
  Description of Artificial Sequence: Synthetic peptide
  Seed: RSYVPLAHS (PMEL_HUMAN)
RTYVPLAHM

SEQ ID NO: 134764 - protein, 9 aa, Artificial Sequence
  Description of Artificial Sequence: Synthetic peptide
  Seed: VVLQAAIPL (PMEL_HUMAN)
VALQAAIPF

SEQ ID NO: 134765 - protein, 11 aa, Artificial Sequence
  Description of Artificial Sequence: Synthetic peptide
  Seed: SYVPLAHSSSA (PMEL_HUMAN)
SHVPLAHSSSL

SEQ ID NO: 134766 - protein, 9 aa, Artificial Sequence
  Description of Artificial Sequence: Synthetic peptide
  Seed: LQAAIPLTS (PMEL_HUMAN)
LGAAIPLTF

SEQ ID NO: 134767 - protein, 9 aa, Artificial Sequence
  Description of Artificial Sequence: Synthetic peptide
  Seed: LLAVGATKV (PMEL_HUMAN)
LMAVGATKV

SEQ ID NO: 134768 - protein, 10 aa, Artificial Sequence
  Description of Artificial Sequence: Synthetic peptide
  Seed: HFLRNQPLTF (PMEL_HUMAN)
HFLRNQPLTY

SEQ ID NO: 134769 - protein, 9 aa, Artificial Sequence
  Description of Artificial Sequence: Synthetic peptide
  Seed: VSNDGPTLI (PMEL_HUMAN)
VSNDGPTLF

SEQ ID NO: 134770 - protein, 11 aa, Artificial Sequence
  Description of Artificial Sequence: Synthetic peptide
  Seed: RYGSFSVTLDI (PMEL_HUMAN)
REGSFSVTLDW

SEQ ID NO: 134771 - protein, 10 aa, Artificial Sequence
  Description of Artificial Sequence: Synthetic peptide
  Seed: WSQKRSFVYV (PMEL_HUMAN)
WTQKRSFVYK

SEQ ID NO: 134772 - protein, 11 aa, Artificial Sequence
  Description of Artificial Sequence: Synthetic peptide
  Seed: MTPEKVPVSEV (PMEL_HUMAN)
MMPEKVPVSEL

SEQ ID NO: 134773 - protein, 9 aa, Artificial Sequence
  Description of Artificial Sequence: Synthetic peptide
  Seed: MSTPEATGM (PMEL_HUMAN)
MRTPEATGF

SEQ ID NO: 134774 - protein, 11 aa, Artificial Sequence
  Description of Artificial Sequence: Synthetic peptide
  Seed: FSVSVSQLRAL (PMEL_HUMAN)
FSVSVSQLRAW

SEQ ID NO: 134775 - protein, 9 aa, Artificial Sequence
  Description of Artificial Sequence: Synthetic peptide
  Seed: YLEPGPVTA (PMEL_HUMAN)
YYEPGPVTC

SEQ ID NO: 134776 - protein, 9 aa, Artificial Sequence
  Description of Artificial Sequence: Synthetic peptide
  Seed: LNFPGSQKV (PMEL_HUMAN)
LSFPGSQKL

SEQ ID NO: 134777 - protein, 9 aa, Artificial Sequence
  Description of Artificial Sequence: Synthetic peptide
  Seed: TLIGANASF (PMEL_HUMAN)
THIGANASY

SEQ ID NO: 134778 - protein, 9 aa, Artificial Sequence
  Description of Artificial Sequence: Synthetic peptide
  Seed: YHRRGSRSY (PMEL_HUMAN)
YYRRGSRSI

SEQ ID NO: 134779 - protein, 9 aa, Artificial Sequence
  Description of Artificial Sequence: Synthetic peptide
  Seed: SSIMSTESI (PMEL_HUMAN)
SMIMSTESL

SEQ ID NO: 134780 - protein, 9 aa, Artificial Sequence
  Description of Artificial Sequence: Synthetic peptide
  Seed: VVLSGTTAA (PMEL_HUMAN)
VVLSGTTAM

SEQ ID NO: 134781 - protein, 10 aa, Artificial Sequence
  Description of Artificial Sequence: Synthetic peptide
  Seed: PTLIGANASF (PMEL_HUMAN)
PMLIGANASY

SEQ ID NO: 134782 - protein, 9 aa, Artificial Sequence
  Description of Artificial Sequence: Synthetic peptide
  Seed: RIFCSCPIG (PMEL_HUMAN)
RGFCSCPIK

SEQ ID NO: 134783 - protein, 9 aa, Artificial Sequence
  Description of Artificial Sequence: Synthetic peptide
  Seed: STAPVQMPT (PMEL_HUMAN)
SSAPVQMPL

SEQ ID NO: 134784 - protein, 9 aa, Artificial Sequence
  Description of Artificial Sequence: Synthetic peptide
  Seed: ALDGGNKHF (PMEL_HUMAN)
AVDGGNKHY

SEQ ID NO: 134785 - protein, 11 aa, Artificial Sequence
  Description of Artificial Sequence: Synthetic peptide
  Seed: RAMLGTHTMEV (PMEL_HUMAN)
RIMLGTHTMEV

SEQ ID NO: 134786 - protein, 9 aa, Artificial Sequence
  Description of Artificial Sequence: Synthetic peptide
  Seed: HTMEVTVYH (PMEL_HUMAN)
HCMEVTVYR

SEQ ID NO: 134787 - protein, 9 aa, Artificial Sequence
  Description of Artificial Sequence: Synthetic peptide
  Seed: RLVKRQVPL (PMEL_HUMAN)
RQVKRQVPY

SEQ ID NO: 134788 - protein, 9 aa, Artificial Sequence
  Description of Artificial Sequence: Synthetic peptide
  Seed: VLMAVVLAS (PMEL_HUMAN)
VTMAVVLAL

SEQ ID NO: 134789 - protein, 10 aa, Artificial Sequence
  Description of Artificial Sequence: Synthetic peptide
  Seed: TAEPSGTTSV (PMEL_HUMAN)
TLEPSGTTSL

SEQ ID NO: 134790 - protein, 9 aa, Artificial Sequence
  Description of Artificial Sequence: Synthetic peptide
  Seed: TPAEVSIVV (PMEL_HUMAN)
TSAEVSIVW

SEQ ID NO: 134791 - protein, 11 aa, Artificial Sequence
  Description of Artificial Sequence: Synthetic peptide
  Seed: RQVPLDCVLYR (PMEL_HUMAN)
RYVPLDCVLYR

SEQ ID NO: 134792 - protein, 10 aa, Artificial Sequence
  Description of Artificial Sequence: Synthetic peptide
  Seed: AVVLASLIYR (PMEL_HUMAN)
AFVLASLIYR

SEQ ID NO: 134793 - protein, 9 aa, Artificial Sequence
  Description of Artificial Sequence: Synthetic peptide
  Seed: KTWGQYWQV (PMEL_HUMAN)
KAWGQYWQI

SEQ ID NO: 134794 - protein, 9 aa, Artificial Sequence
  Description of Artificial Sequence: Synthetic peptide
  Seed: SSHWLRLPR (PMEL_HUMAN)
SNHWLRLPK

SEQ ID NO: 134795 - protein, 9 aa, Artificial Sequence
  Description of Artificial Sequence: Synthetic peptide
  Seed: DQVPFSVSV (PMEL_HUMAN)
DHVPFSVSF

SEQ ID NO: 134796 - protein, 9 aa, Artificial Sequence
  Description of Artificial Sequence: Synthetic peptide
  Seed: SQKRSFVYV (PMEL_HUMAN)
SAKRSFVYS

SEQ ID NO: 134797 - protein, 9 aa, Artificial Sequence
  Description of Artificial Sequence: Synthetic peptide
  Seed: VLPSPACQL (PMEL_HUMAN)
VIPSPACQL

SEQ ID NO: 134798 - protein, 11 aa, Artificial Sequence
  Description of Artificial Sequence: Synthetic peptide
  Seed: MAVVLASLIYR (PMEL_HUMAN)
MDVVLASLIYR

SEQ ID NO: 134799 - protein, 9 aa, Artificial Sequence
  Description of Artificial Sequence: Synthetic peptide
  Seed: VTLDIVQGI (PMEL_HUMAN)
VSLDIVQGF

SEQ ID NO: 134800 - protein, 9 aa, Artificial Sequence
  Description of Artificial Sequence: Synthetic peptide
  Seed: LMAVVLASL (PMEL_HUMAN)
LIAVVLASI

SEQ ID NO: 134801 - protein, 10 aa, Artificial Sequence
  Description of Artificial Sequence: Synthetic peptide
  Seed: RGSRSYVPLA (PMEL_HUMAN)
RPSRSYVPLI

SEQ ID NO: 134802 - protein, 9 aa, Artificial Sequence
  Description of Artificial Sequence: Synthetic peptide
  Seed: QPVLPSPAC (PMEL_HUMAN)
QHVLPSPAA

SEQ ID NO: 134803 - protein, 9 aa, Artificial Sequence
  Description of Artificial Sequence: Synthetic peptide
  Seed: VQVPTTEVI (PMEL_HUMAN)
VIVPTTEVY

SEQ ID NO: 134804 - protein, 10 aa, Artificial Sequence
  Description of Artificial Sequence: Synthetic peptide
  Seed: KVSNDGPTLI (PMEL_HUMAN)
KLSNDGPTLL

SEQ ID NO: 134805 - protein, 10 aa, Artificial Sequence
  Description of Artificial Sequence: Synthetic peptide
  Seed: ASSIMSTESI (PMEL_HUMAN)
ALSIMSTESF

SEQ ID NO: 134806 - protein, 9 aa, Artificial Sequence
  Description of Artificial Sequence: Synthetic peptide
  Seed: VQMPTAEST (PMEL_HUMAN)
VMMPTAESM

SEQ ID NO: 134807 - protein, 10 aa, Artificial Sequence
  Description of Artificial Sequence: Synthetic peptide
  Seed: AWNRQLYPEW (PMEL_HUMAN)
AWNRQLYPEF

SEQ ID NO: 134808 - protein, 9 aa, Artificial Sequence
  Description of Artificial Sequence: Synthetic peptide
  Seed: LASLIYRRR (PMEL_HUMAN)
LSSLIYRRR

SEQ ID NO: 134809 - protein, 10 aa, Artificial Sequence
  Description of Artificial Sequence: Synthetic peptide
  Seed: VTAQVVLQAA (PMEL_HUMAN)
VLAQVVLQAV

SEQ ID NO: 134810 - protein, 10 aa, Artificial Sequence
  Description of Artificial Sequence: Synthetic peptide
  Seed: STAPVQMPTA (PMEL_HUMAN)
SIAPVQMPTI

SEQ ID NO: 134811 - protein, 10 aa, Artificial Sequence
  Description of Artificial Sequence: Synthetic peptide
  Seed: VPLAHSSSAF (PMEL_HUMAN)
VALAHSSSAF

SEQ ID NO: 134812 - protein, 9 aa, Artificial Sequence
  Description of Artificial Sequence: Synthetic peptide
  Seed: TPAEVSIVV (PMEL_HUMAN)
TAAEVSIVI

SEQ ID NO: 134813 - protein, 9 aa, Artificial Sequence
  Description of Artificial Sequence: Synthetic peptide
  Seed: AQVVLQAAI (PMEL_HUMAN)
AEVVLQAAP

SEQ ID NO: 134814 - protein, 11 aa, Artificial Sequence
  Description of Artificial Sequence: Synthetic peptide
  Seed: RTKAWNRQLYP (PMEL_HUMAN)
RYKAWNRQLYA

SEQ ID NO: 134815 - protein, 9 aa, Artificial Sequence
  Description of Artificial Sequence: Synthetic peptide
  Seed: VPSGEGDAF (PMEL_HUMAN)
VASGEGDAY

SEQ ID NO: 134816 - protein, 9 aa, Artificial Sequence
  Description of Artificial Sequence: Synthetic peptide
  Seed: SVQVPTTEV (PMEL_HUMAN)
SYQVPTTEL

SEQ ID NO: 134817 - protein, 9 aa, Artificial Sequence
  Description of Artificial Sequence: Synthetic peptide
  Seed: VSRQLRTKA (PMEL_HUMAN)
VTRQLRTKK

SEQ ID NO: 134818 - protein, 10 aa, Artificial Sequence
  Description of Artificial Sequence: Synthetic peptide
  Seed: YRYGSFSVTL (PMEL_HUMAN)
YIYGSFSVTY

SEQ ID NO: 134819 - protein, 10 aa, Artificial Sequence
  Description of Artificial Sequence: Synthetic peptide
  Seed: LRLVKRQVPL (PMEL_HUMAN)
LLLVKRQVPL

SEQ ID NO: 134820 - protein, 10 aa, Artificial Sequence
  Description of Artificial Sequence: Synthetic peptide
  Seed: LSIGTGRAML (PMEL_HUMAN)
LVIGTGRAMW

SEQ ID NO: 134821 - protein, 9 aa, Artificial Sequence
  Description of Artificial Sequence: Synthetic peptide
  Seed: ITGSLGPLL (PMEL_HUMAN)
IVGSLGPLV

SEQ ID NO: 134822 - protein, 9 aa, Artificial Sequence
  Description of Artificial Sequence: Synthetic peptide
  Seed: SLAVVSTQL (PMEL_HUMAN)
STAVVSTQW

SEQ ID NO: 134823 - protein, 8 aa, Artificial Sequence
  Description of Artificial Sequence: Synthetic peptide
  Seed: TEVVGTTP (PMEL_HUMAN)
TEVVGTTA

SEQ ID NO: 134824 - protein, 10 aa, Artificial Sequence
  Description of Artificial Sequence: Synthetic peptide
  Seed: NSLAVVSTQL (PMEL_HUMAN)
NILAVVSTQL

SEQ ID NO: 134825 - protein, 9 aa, Artificial Sequence
  Description of Artificial Sequence: Synthetic peptide
  Seed: STAPVQMPT (PMEL_HUMAN)
SIAPVQMPI

SEQ ID NO: 134826 - protein, 10 aa, Artificial Sequence
  Description of Artificial Sequence: Synthetic peptide
  Seed: VLMAVVLASL (PMEL_HUMAN)
VRMAVVLASA

SEQ ID NO: 134827 - protein, 9 aa, Artificial Sequence
  Description of Artificial Sequence: Synthetic peptide
  Seed: RLVKRQVPL (PMEL_HUMAN)
RTVKRQVPW

SEQ ID NO: 134828 - protein, 9 aa, Artificial Sequence
  Description of Artificial Sequence: Synthetic peptide
  Seed: RLVKRQVPL (PMEL_HUMAN)
RPVKRQVPT

SEQ ID NO: 134829 - protein, 11 aa, Artificial Sequence
  Description of Artificial Sequence: Synthetic peptide
  Seed: RAMLGTHTMEV (PMEL_HUMAN)
RMMLGTHTMEV

SEQ ID NO: 134830 - protein, 9 aa, Artificial Sequence
  Description of Artificial Sequence: Synthetic peptide
  Seed: YLAEADLSY (PMEL_HUMAN)
YWAEADLSM

SEQ ID NO: 134831 - protein, 9 aa, Artificial Sequence
  Description of Artificial Sequence: Synthetic peptide
  Seed: AGLGQVPLI (PMEL_HUMAN)
ASLGQVPLI

SEQ ID NO: 134832 - protein, 9 aa, Artificial Sequence
  Description of Artificial Sequence: Synthetic peptide
  Seed: AVIGALLAV (PMEL_HUMAN)
ASIGALLAA

SEQ ID NO: 134833 - protein, 9 aa, Artificial Sequence
  Description of Artificial Sequence: Synthetic peptide
  Seed: LTVSCQGGL (PMEL_HUMAN)
LMVSCQGGI

SEQ ID NO: 134834 - protein, 9 aa, Artificial Sequence
  Description of Artificial Sequence: Synthetic peptide
  Seed: VTAQVVLQA (PMEL_HUMAN)
VVAQVVLQL

SEQ ID NO: 134835 - protein, 9 aa, Artificial Sequence
  Description of Artificial Sequence: Synthetic peptide
  Seed: AVVSTQLIM (PMEL_HUMAN)
AEVSTQLIF

SEQ ID NO: 134836 - protein, 9 aa, Artificial Sequence
  Description of Artificial Sequence: Synthetic peptide
  Seed: FTITDQVPF (PMEL_HUMAN)
FTITDQVPI

SEQ ID NO: 134837 - protein, 9 aa, Artificial Sequence
  Description of Artificial Sequence: Synthetic peptide
  Seed: KVSNDGPTL (PMEL_HUMAN)
KASNDGPTL

SEQ ID NO: 134838 - protein, 10 aa, Artificial Sequence
  Description of Artificial Sequence: Synthetic peptide
  Seed: KRQVPLDCVL (PMEL_HUMAN)
KPQVPLDCVF

SEQ ID NO: 134839 - protein, 10 aa, Artificial Sequence
  Description of Artificial Sequence: Synthetic peptide
  Seed: VSLADTNSLA (PMEL_HUMAN)
VFLADTNSLI

SEQ ID NO: 134840 - protein, 9 aa, Artificial Sequence
  Description of Artificial Sequence: Synthetic peptide
  Seed: CVLYRYGSF (PMEL_HUMAN)
CPLYRYGSM

SEQ ID NO: 134841 - protein, 9 aa, Artificial Sequence
  Description of Artificial Sequence: Synthetic peptide
  Seed: LHLAVIGAL (PMEL_HUMAN)
LMLAVIGAL

SEQ ID NO: 134842 - protein, 10 aa, Artificial Sequence
  Description of Artificial Sequence: Synthetic peptide
  Seed: TAGQVPTTEV (PMEL_HUMAN)
TAGQVPTTEY

SEQ ID NO: 134843 - protein, 11 aa, Artificial Sequence
  Description of Artificial Sequence: Synthetic peptide
  Seed: RALDGGNKHFL (PMEL_HUMAN)
RILDGGNKHFM

SEQ ID NO: 134844 - protein, 9 aa, Artificial Sequence
  Description of Artificial Sequence: Synthetic peptide
  Seed: GMTPAEVSI (PMEL_HUMAN)
GQTPAEVSY

SEQ ID NO: 134845 - protein, 10 aa, Artificial Sequence
  Description of Artificial Sequence: Synthetic peptide
  Seed: RSYVPLAHSS (PMEL_HUMAN)
RVYVPLAHSK

SEQ ID NO: 134846 - protein, 10 aa, Artificial Sequence
  Description of Artificial Sequence: Synthetic peptide
  Seed: GQEAGLGQVP (PMEL_HUMAN)
GEEAGLGQVI

SEQ ID NO: 134847 - protein, 10 aa, Artificial Sequence
  Description of Artificial Sequence: Synthetic peptide
  Seed: SVPQLPHSSS (PMEL_HUMAN)
SCPQLPHSSV

SEQ ID NO: 134848 - protein, 9 aa, Artificial Sequence
  Description of Artificial Sequence: Synthetic peptide
  Seed: VVLQAAIPL (PMEL_HUMAN)
VVLQAAIPF

SEQ ID NO: 134849 - protein, 10 aa, Artificial Sequence
  Description of Artificial Sequence: Synthetic peptide
  Seed: MSTESITGSL (PMEL_HUMAN)
MCTESITGSV

SEQ ID NO: 134850 - protein, 9 aa, Artificial Sequence
  Description of Artificial Sequence: Synthetic peptide
  Seed: ISRALVVTH (PMEL_HUMAN)
IWRALVVTK

SEQ ID NO: 134851 - protein, 11 aa, Artificial Sequence
  Description of Artificial Sequence: Synthetic peptide
  Seed: RYGSFSVTLDI (PMEL_HUMAN)
RLGSFSVTLDW

SEQ ID NO: 134852 - protein, 9 aa, Artificial Sequence
  Description of Artificial Sequence: Synthetic peptide
  Seed: SQKRSFVYV (PMEL_HUMAN)
SLKRSFVYM

SEQ ID NO: 134853 - protein, 9 aa, Artificial Sequence
  Description of Artificial Sequence: Synthetic peptide
  Seed: RAMLGTHTM (PMEL_HUMAN)
RYMLGTHTC

SEQ ID NO: 134854 - protein, 9 aa, Artificial Sequence
  Description of Artificial Sequence: Synthetic peptide
  Seed: AAQVTTTEW (PMEL_HUMAN)
APQVTTTEY

SEQ ID NO: 134855 - protein, 9 aa, Artificial Sequence
  Description of Artificial Sequence: Synthetic peptide
  Seed: ITGSLGPLL (PMEL_HUMAN)
IQGSLGPLV

SEQ ID NO: 134856 - protein, 9 aa, Artificial Sequence
  Description of Artificial Sequence: Synthetic peptide
  Seed: YVWKTWGQY (PMEL_HUMAN)
YSWKTWGQF

SEQ ID NO: 134857 - protein, 9 aa, Artificial Sequence
  Description of Artificial Sequence: Synthetic peptide
  Seed: FLRNQPLTF (PMEL_HUMAN)
FWRNQPLTL

SEQ ID NO: 134858 - protein, 10 aa, Artificial Sequence
  Description of Artificial Sequence: Synthetic peptide
  Seed: ALNFPGSQKV (PMEL_HUMAN)
ALNFPGSQKK

SEQ ID NO: 134859 - protein, 9 aa, Artificial Sequence
  Description of Artificial Sequence: Synthetic peptide
  Seed: NFPGSQKVL (PMEL_HUMAN)
NFPGSQKVF

SEQ ID NO: 134860 - protein, 9 aa, Artificial Sequence
  Description of Artificial Sequence: Synthetic peptide
  Seed: SQKRSFVYV (PMEL_HUMAN)
SGKRSFVYA

SEQ ID NO: 134861 - protein, 9 aa, Artificial Sequence
  Description of Artificial Sequence: Synthetic peptide
  Seed: YLAEADLSY (PMEL_HUMAN)
YSAEADLSI

SEQ ID NO: 134862 - protein, 9 aa, Artificial Sequence
  Description of Artificial Sequence: Synthetic peptide
  Seed: RAMLGTHTM (PMEL_HUMAN)
RKMLGTHTM

SEQ ID NO: 134863 - protein, 11 aa, Artificial Sequence
  Description of Artificial Sequence: Synthetic peptide
  Seed: SAFTITDQVPF (PMEL_HUMAN)
SMFTITDQVPF

SEQ ID NO: 134864 - protein, 10 aa, Artificial Sequence
  Description of Artificial Sequence: Synthetic peptide
  Seed: YVWKTWGQYW (PMEL_HUMAN)
YYWKTWGQYV

SEQ ID NO: 134865 - protein, 10 aa, Artificial Sequence
  Description of Artificial Sequence: Synthetic peptide
  Seed: KVSNDGPTLI (PMEL_HUMAN)
KMSNDGPTLI

SEQ ID NO: 134866 - protein, 9 aa, Artificial Sequence
  Description of Artificial Sequence: Synthetic peptide
  Seed: RLVKRQVPL (PMEL_HUMAN)
REVKRQVPM

SEQ ID NO: 134867 - protein, 8 aa, Artificial Sequence
  Description of Artificial Sequence: Synthetic peptide
  Seed: LADTNSLA (PMEL_HUMAN)
LTDTNSLL

SEQ ID NO: 134868 - protein, 10 aa, Artificial Sequence
  Description of Artificial Sequence: Synthetic peptide
  Seed: VPLAHSSSAF (PMEL_HUMAN)
VWLAHSSSAF

SEQ ID NO: 134869 - protein, 9 aa, Artificial Sequence
  Description of Artificial Sequence: Synthetic peptide
  Seed: FTITDQVPF (PMEL_HUMAN)
FGITDQVPF

SEQ ID NO: 134870 - protein, 9 aa, Artificial Sequence
  Description of Artificial Sequence: Synthetic peptide
  Seed: MAVVLASLI (PMEL_HUMAN)
MEVVLASLF

SEQ ID NO: 134871 - protein, 9 aa, Artificial Sequence
  Description of Artificial Sequence: Synthetic peptide
  Seed: AVIGALLAV (PMEL_HUMAN)
AVIGALLAT

SEQ ID NO: 134872 - protein, 10 aa, Artificial Sequence
  Description of Artificial Sequence: Synthetic peptide
  Seed: LGQVPLIVGI (PMEL_HUMAN)
LWQVPLIVGV

SEQ ID NO: 134873 - protein, 9 aa, Artificial Sequence
  Description of Artificial Sequence: Synthetic peptide
  Seed: MTPEKVPVS (PMEL_HUMAN)
MGPEKVPVI

SEQ ID NO: 134874 - protein, 10 aa, Artificial Sequence
  Description of Artificial Sequence: Synthetic peptide
  Seed: VLMAVVLASL (PMEL_HUMAN)
VIMAVVLASF

SEQ ID NO: 134875 - protein, 9 aa, Artificial Sequence
  Description of Artificial Sequence: Synthetic peptide
  Seed: ALDGGNKHF (PMEL_HUMAN)
ATDGGNKHM

SEQ ID NO: 134876 - protein, 10 aa, Artificial Sequence
  Description of Artificial Sequence: Synthetic peptide
  Seed: GPLLDGTATL (PMEL_HUMAN)
GKLLDGTATA

SEQ ID NO: 134877 - protein, 10 aa, Artificial Sequence
  Description of Artificial Sequence: Synthetic peptide
  Seed: RRLMKQDFSV (PMEL_HUMAN)
RELMKQDFSL

SEQ ID NO: 134878 - protein, 9 aa, Artificial Sequence
  Description of Artificial Sequence: Synthetic peptide
  Seed: ALNFPGSQK (PMEL_HUMAN)
AVNFPGSQM

SEQ ID NO: 134879 - protein, 10 aa, Artificial Sequence
  Description of Artificial Sequence: Synthetic peptide
  Seed: RTKAWNRQLY (PMEL_HUMAN)
RMKAWNRQLA

SEQ ID NO: 134880 - protein, 10 aa, Artificial Sequence
  Description of Artificial Sequence: Synthetic peptide
  Seed: LVLKRCLLHL (PMEL_HUMAN)
LKLKRCLLHV

SEQ ID NO: 134881 - protein, 9 aa, Artificial Sequence
  Description of Artificial Sequence: Synthetic peptide
  Seed: AVIGALLAV (PMEL_HUMAN)
AMIGALLAY

SEQ ID NO: 134882 - protein, 9 aa, Artificial Sequence
  Description of Artificial Sequence: Synthetic peptide
  Seed: ASFSIALNF (PMEL_HUMAN)
ASFSIALNV

SEQ ID NO: 134883 - protein, 9 aa, Artificial Sequence
  Description of Artificial Sequence: Synthetic peptide
  Seed: FGDSSGTLI (PMEL_HUMAN)
FSDSSGTLF

SEQ ID NO: 134884 - protein, 9 aa, Artificial Sequence
  Description of Artificial Sequence: Synthetic peptide
  Seed: GQVPTTEVV (PMEL_HUMAN)
GHVPTTEVI

SEQ ID NO: 134885 - protein, 9 aa, Artificial Sequence
  Description of Artificial Sequence: Synthetic peptide
  Seed: YWQVLGGPV (PMEL_HUMAN)
YYQVLGGPV

SEQ ID NO: 134886 - protein, 10 aa, Artificial Sequence
  Description of Artificial Sequence: Synthetic peptide
  Seed: VPQLPHSSSH (PMEL_HUMAN)
VGQLPHSSSL

SEQ ID NO: 134887 - protein, 9 aa, Artificial Sequence
  Description of Artificial Sequence: Synthetic peptide
  Seed: SSPGCQPPA (PMEL_HUMAN)
SMPGCQPPI

SEQ ID NO: 134888 - protein, 9 aa, Artificial Sequence
  Description of Artificial Sequence: Synthetic peptide
  Seed: AQRLCQPVL (PMEL_HUMAN)
ATRLCQPVS

SEQ ID NO: 134889 - protein, 9 aa, Artificial Sequence
  Description of Artificial Sequence: Synthetic peptide
  Seed: FTITDQVPF (PMEL_HUMAN)
FMITDQVPL

SEQ ID NO: 134890 - protein, 11 aa, Artificial Sequence
  Description of Artificial Sequence: Synthetic peptide
  Seed: TVYHRRGSRSY (PMEL_HUMAN)
TMYHRRGSRSY

SEQ ID NO: 134891 - protein, 9 aa, Artificial Sequence
  Description of Artificial Sequence: Synthetic peptide
  Seed: WQVLGGPVS (PMEL_HUMAN)
WTVLGGPVF

SEQ ID NO: 134892 - protein, 9 aa, Artificial Sequence
  Description of Artificial Sequence: Synthetic peptide
  Seed: LSIGTGRAM (PMEL_HUMAN)
LPIGTGRAL

SEQ ID NO: 134893 - protein, 9 aa, Artificial Sequence
  Description of Artificial Sequence: Synthetic peptide
  Seed: NDGPTLIGA (PMEL_HUMAN)
NEGPTLIGA

SEQ ID NO: 134894 - protein, 9 aa, Artificial Sequence
  Description of Artificial Sequence: Synthetic peptide
  Seed: TAQVVLQAA (PMEL_HUMAN)
TSQVVLQAF

SEQ ID NO: 134895 - protein, 10 aa, Artificial Sequence
  Description of Artificial Sequence: Synthetic peptide
  Seed: YPQETDDACI (PMEL_HUMAN)
YPQETDDACF

SEQ ID NO: 134896 - protein, 10 aa, Artificial Sequence
  Description of Artificial Sequence: Synthetic peptide
  Seed: AMLGTHTMEV (PMEL_HUMAN)
ASLGTHTMEV

SEQ ID NO: 134897 - protein, 9 aa, Artificial Sequence
  Description of Artificial Sequence: Synthetic peptide
  Seed: SRSYVPLAH (PMEL_HUMAN)
SRSYVPLAY

SEQ ID NO: 134898 - protein, 10 aa, Artificial Sequence
  Description of Artificial Sequence: Synthetic peptide
  Seed: SVPQLPHSSS (PMEL_HUMAN)
SMPQLPHSSI

SEQ ID NO: 134899 - protein, 9 aa, Artificial Sequence
  Description of Artificial Sequence: Synthetic peptide
  Seed: DQVPFSVSV (PMEL_HUMAN)
DSVPFSVSA

SEQ ID NO: 134900 - protein, 9 aa, Artificial Sequence
  Description of Artificial Sequence: Synthetic peptide
  Seed: WQVLGGPVS (PMEL_HUMAN)
WQVLGGPVM

SEQ ID NO: 134901 - protein, 11 aa, Artificial Sequence
  Description of Artificial Sequence: Synthetic peptide
  Seed: QLYPEWTEAQR (PMEL_HUMAN)
QFYPEWTEAQR

SEQ ID NO: 134902 - protein, 9 aa, Artificial Sequence
  Description of Artificial Sequence: Synthetic peptide
  Seed: VPFSVSVSQ (PMEL_HUMAN)
VAFSVSVSL

SEQ ID NO: 134903 - protein, 10 aa, Artificial Sequence
  Description of Artificial Sequence: Synthetic peptide
  Seed: LPHSSSHWLR (PMEL_HUMAN)
LFHSSSHWLR

SEQ ID NO: 134904 - protein, 10 aa, Artificial Sequence
  Description of Artificial Sequence: Synthetic peptide
  Seed: AMLGTHTMEV (PMEL_HUMAN)
AQLGTHTMEV

SEQ ID NO: 134905 - protein, 10 aa, Artificial Sequence
  Description of Artificial Sequence: Synthetic peptide
  Seed: RPTAEAPNTT (PMEL_HUMAN)
RPTAEAPNTM

SEQ ID NO: 134906 - protein, 11 aa, Artificial Sequence
  Description of Artificial Sequence: Synthetic peptide
  Seed: FGDSSGTLISR (PMEL_HUMAN)
FADSSGTLISF

SEQ ID NO: 134907 - protein, 9 aa, Artificial Sequence
  Description of Artificial Sequence: Synthetic peptide
  Seed: TDQVPFSVS (PMEL_HUMAN)
TEQVPFSVC

SEQ ID NO: 134908 - protein, 9 aa, Artificial Sequence
  Description of Artificial Sequence: Synthetic peptide
  Seed: TTDGHRPTA (PMEL_HUMAN)
THDGHRPTL

SEQ ID NO: 134909 - protein, 8 aa, Artificial Sequence
  Description of Artificial Sequence: Synthetic peptide
  Seed: TLDIVQGI (PMEL_HUMAN)
TIDIVQGL

SEQ ID NO: 134910 - protein, 10 aa, Artificial Sequence
  Description of Artificial Sequence: Synthetic peptide
  Seed: RGSRSYVPLA (PMEL_HUMAN)
RPSRSYVPLY

SEQ ID NO: 134911 - protein, 10 aa, Artificial Sequence
  Description of Artificial Sequence: Synthetic peptide
  Seed: ESAEILQAVP (PMEL_HUMAN)
ETAEILQAVR

SEQ ID NO: 134912 - protein, 9 aa, Artificial Sequence
  Description of Artificial Sequence: Synthetic peptide
  Seed: TTTEWVETT (PMEL_HUMAN)
TTTEWVETV

SEQ ID NO: 134913 - protein, 11 aa, Artificial Sequence
  Description of Artificial Sequence: Synthetic peptide
  Seed: RTKAWNRQLYP (PMEL_HUMAN)
RTKAWNRQLYL

SEQ ID NO: 134914 - protein, 11 aa, Artificial Sequence
  Description of Artificial Sequence: Synthetic peptide
  Seed: LGPLLDGTATL (PMEL_HUMAN)
LHPLLDGTATV

SEQ ID NO: 134915 - protein, 10 aa, Artificial Sequence
  Description of Artificial Sequence: Synthetic peptide
  Seed: LAVVSTQLIM (PMEL_HUMAN)
LPVVSTQLIY

SEQ ID NO: 134916 - protein, 9 aa, Artificial Sequence
  Description of Artificial Sequence: Synthetic peptide
  Seed: AEPSGTTSV (PMEL_HUMAN)
ACPSGTTSV

SEQ ID NO: 134917 - protein, 9 aa, Artificial Sequence
  Description of Artificial Sequence: Synthetic peptide
  Seed: RQVPLDCVL (PMEL_HUMAN)
RNVPLDCVF

SEQ ID NO: 134918 - protein, 11 aa, Artificial Sequence
  Description of Artificial Sequence: Synthetic peptide
  Seed: QAVPSGEGDAF (PMEL_HUMAN)
QAVPSGEGDAW

SEQ ID NO: 134919 - protein, 9 aa, Artificial Sequence
  Description of Artificial Sequence: Synthetic peptide
  Seed: FTITDQVPF (PMEL_HUMAN)
FVITDQVPV

SEQ ID NO: 134920 - protein, 10 aa, Artificial Sequence
  Description of Artificial Sequence: Synthetic peptide
  Seed: MPTAESTGMT (PMEL_HUMAN)
MVTAESTGMA

SEQ ID NO: 134921 - protein, 9 aa, Artificial Sequence
  Description of Artificial Sequence: Synthetic peptide
  Seed: GMTPAEVSI (PMEL_HUMAN)
GLTPAEVSL

SEQ ID NO: 134922 - protein, 9 aa, Artificial Sequence
  Description of Artificial Sequence: Synthetic peptide
  Seed: KRCLLHLAV (PMEL_HUMAN)
KRCLLHLAL

SEQ ID NO: 134923 - protein, 10 aa, Artificial Sequence
  Description of Artificial Sequence: Synthetic peptide
  Seed: SAEILQAVPS (PMEL_HUMAN)
SIEILQAVPA

SEQ ID NO: 134924 - protein, 11 aa, Artificial Sequence
  Description of Artificial Sequence: Synthetic peptide
  Seed: KHFLRNQPLTF (PMEL_HUMAN)
KKFLRNQPLTY

SEQ ID NO: 134925 - protein, 10 aa, Artificial Sequence
  Description of Artificial Sequence: Synthetic peptide
  Seed: SVPQLPHSSS (PMEL_HUMAN)
SWPQLPHSSI

SEQ ID NO: 134926 - protein, 11 aa, Artificial Sequence
  Description of Artificial Sequence: Synthetic peptide
  Seed: GYLAEADLSYT (PMEL_HUMAN)
GTLAEADLSYL

SEQ ID NO: 134927 - protein, 10 aa, Artificial Sequence
  Description of Artificial Sequence: Synthetic peptide
  Seed: LIMPGQEAGL (PMEL_HUMAN)
LMMPGQEAGR

SEQ ID NO: 134928 - protein, 11 aa, Artificial Sequence
  Description of Artificial Sequence: Synthetic peptide
  Seed: MTPAEVSIVVL (PMEL_HUMAN)
MSPAEVSIVVW

SEQ ID NO: 134929 - protein, 9 aa, Artificial Sequence
  Description of Artificial Sequence: Synthetic peptide
  Seed: VMGTTLAEM (PMEL_HUMAN)
VIGTTLAEI

SEQ ID NO: 134930 - protein, 11 aa, Artificial Sequence
  Description of Artificial Sequence: Synthetic peptide
  Seed: AEMSTPEATGM (PMEL_HUMAN)
AQMSTPEATGW

SEQ ID NO: 134931 - protein, 9 aa, Artificial Sequence
  Description of Artificial Sequence: Synthetic peptide
  Seed: VVLASLIYR (PMEL_HUMAN)
VLLASLIYK

SEQ ID NO: 134932 - protein, 8 aa, Artificial Sequence
  Description of Artificial Sequence: Synthetic peptide
  Seed: QDFSVPQL (PMEL_HUMAN)
QAFSVPQV

SEQ ID NO: 134933 - protein, 10 aa, Artificial Sequence
  Description of Artificial Sequence: Synthetic peptide
  Seed: MTPAEVSIVV (PMEL_HUMAN)
MLPAEVSIVL

SEQ ID NO: 134934 - protein, 9 aa, Artificial Sequence
  Description of Artificial Sequence: Synthetic peptide
  Seed: RAMLGTHTM (PMEL_HUMAN)
RPMLGTHTW

SEQ ID NO: 134935 - protein, 11 aa, Artificial Sequence
  Description of Artificial Sequence: Synthetic peptide
  Seed: TLIGANASFSI (PMEL_HUMAN)
TMIGANASFSV

SEQ ID NO: 134936 - protein, 9 aa, Artificial Sequence
  Description of Artificial Sequence: Synthetic peptide
  Seed: RALVVTHTY (PMEL_HUMAN)
RMLVVTHTV

SEQ ID NO: 134937 - protein, 10 aa, Artificial Sequence
  Description of Artificial Sequence: Synthetic peptide
  Seed: GEGDAFELTV (PMEL_HUMAN)
GEGDAFELTL

SEQ ID NO: 134938 - protein, 10 aa, Artificial Sequence
  Description of Artificial Sequence: Synthetic peptide
  Seed: NASFSIALNF (PMEL_HUMAN)
NKSFSIALNF

SEQ ID NO: 134939 - protein, 11 aa, Artificial Sequence
  Description of Artificial Sequence: Synthetic peptide
  Seed: FGDSSGTLISR (PMEL_HUMAN)
FSDSSGTLISC

SEQ ID NO: 134940 - protein, 10 aa, Artificial Sequence
  Description of Artificial Sequence: Synthetic peptide
  Seed: MPTAESTGMT (PMEL_HUMAN)
MLTAESTGMI

SEQ ID NO: 134941 - protein, 9 aa, Artificial Sequence
  Description of Artificial Sequence: Synthetic peptide
  Seed: KVLPDGQVI (PMEL_HUMAN)
KILPDGQVF

SEQ ID NO: 134942 - protein, 10 aa, Artificial Sequence
  Description of Artificial Sequence: Synthetic peptide
  Seed: GPLLDGTATL (PMEL_HUMAN)
GELLDGTATV

SEQ ID NO: 134943 - protein, 9 aa, Artificial Sequence
  Description of Artificial Sequence: Synthetic peptide
  Seed: AQVVLQAAI (PMEL_HUMAN)
ATVVLQAAY

SEQ ID NO: 134944 - protein, 9 aa, Artificial Sequence
  Description of Artificial Sequence: Synthetic peptide
  Seed: KQDFSVPQL (PMEL_HUMAN)
KNDFSVPQL

SEQ ID NO: 134945 - protein, 10 aa, Artificial Sequence
  Description of Artificial Sequence: Synthetic peptide
  Seed: SVPQLPHSSS (PMEL_HUMAN)
SHPQLPHSSA

SEQ ID NO: 134946 - protein, 9 aa, Artificial Sequence
  Description of Artificial Sequence: Synthetic peptide
  Seed: EVVGTTPGQ (PMEL_HUMAN)
EGVGTTPGR

SEQ ID NO: 134947 - protein, 10 aa, Artificial Sequence
  Description of Artificial Sequence: Synthetic peptide
  Seed: NSLAVVSTQL (PMEL_HUMAN)
NVLAVVSTQV

SEQ ID NO: 134948 - protein, 9 aa, Artificial Sequence
  Description of Artificial Sequence: Synthetic peptide
  Seed: RGSRSYVPL (PMEL_HUMAN)
RSSRSYVPV

SEQ ID NO: 134949 - protein, 9 aa, Artificial Sequence
  Description of Artificial Sequence: Synthetic peptide
  Seed: AGQVPTTEV (PMEL_HUMAN)
ASQVPTTEV

SEQ ID NO: 134950 - protein, 11 aa, Artificial Sequence
  Description of Artificial Sequence: Synthetic peptide
  Seed: RRGSRSYVPLA (PMEL_HUMAN)
RAGSRSYVPLV

SEQ ID NO: 134951 - protein, 9 aa, Artificial Sequence
  Description of Artificial Sequence: Synthetic peptide
  Seed: IYRRRLMKQ (PMEL_HUMAN)
IVRRRLMKA

SEQ ID NO: 134952 - protein, 9 aa, Artificial Sequence
  Description of Artificial Sequence: Synthetic peptide
  Seed: FGDSSGTLI (PMEL_HUMAN)
FIDSSGTLI

SEQ ID NO: 134953 - protein, 10 aa, Artificial Sequence
  Description of Artificial Sequence: Synthetic peptide
  Seed: EVMGTTLAEM (PMEL_HUMAN)
ELMGTTLAER

SEQ ID NO: 134954 - protein, 10 aa, Artificial Sequence
  Description of Artificial Sequence: Synthetic peptide
  Seed: RPTAEAPNTT (PMEL_HUMAN)
RPTAEAPNTI

SEQ ID NO: 134955 - protein, 10 aa, Artificial Sequence
  Description of Artificial Sequence: Synthetic peptide
  Seed: ALDGGNKHFL (PMEL_HUMAN)
AVDGGNKHFV

SEQ ID NO: 134956 - protein, 9 aa, Artificial Sequence
  Description of Artificial Sequence: Synthetic peptide
  Seed: GSWSQKRSF (PMEL_HUMAN)
GRWSQKRSM

SEQ ID NO: 134957 - protein, 10 aa, Artificial Sequence
  Description of Artificial Sequence: Synthetic peptide
  Seed: KTWGQYWQVL (PMEL_HUMAN)
KVWGQYWQVA

SEQ ID NO: 134958 - protein, 9 aa, Artificial Sequence
  Description of Artificial Sequence: Synthetic peptide
  Seed: AEADLSYTW (PMEL_HUMAN)
ARADLSYTF

SEQ ID NO: 134959 - protein, 11 aa, Artificial Sequence
  Description of Artificial Sequence: Synthetic peptide
  Seed: AEMSTPEATGM (PMEL_HUMAN)
AEMSTPEATGA

SEQ ID NO: 134960 - protein, 9 aa, Artificial Sequence
  Description of Artificial Sequence: Synthetic peptide
  Seed: GANASFSIA (PMEL_HUMAN)
GANASFSIF

SEQ ID NO: 134961 - protein, 9 aa, Artificial Sequence
  Description of Artificial Sequence: Synthetic peptide
  Seed: AEPSGTTSV (PMEL_HUMAN)
ASPSGTTSL

SEQ ID NO: 134962 - protein, 9 aa, Artificial Sequence
  Description of Artificial Sequence: Synthetic peptide
  Seed: STAPVQMPT (PMEL_HUMAN)
SSAPVQMPA

SEQ ID NO: 134963 - protein, 9 aa, Artificial Sequence
  Description of Artificial Sequence: Synthetic peptide
  Seed: RAMLGTHTM (PMEL_HUMAN)
RRMLGTHTM

SEQ ID NO: 134964 - protein, 9 aa, Artificial Sequence
  Description of Artificial Sequence: Synthetic peptide
  Seed: MTPAEVSIV (PMEL_HUMAN)
MVPAEVSIL

SEQ ID NO: 134965 - protein, 11 aa, Artificial Sequence
  Description of Artificial Sequence: Synthetic peptide
  Seed: RELPIPEPEGP (PMEL_HUMAN)
RELPIPEPEGI

SEQ ID NO: 134966 - protein, 10 aa, Artificial Sequence
  Description of Artificial Sequence: Synthetic peptide
  Seed: RRLMKQDFSV (PMEL_HUMAN)
RDLMKQDFSV

SEQ ID NO: 134967 - protein, 9 aa, Artificial Sequence
  Description of Artificial Sequence: Synthetic peptide
  Seed: VLYRYGSFS (PMEL_HUMAN)
VMYRYGSFM

SEQ ID NO: 134968 - protein, 9 aa, Artificial Sequence
  Description of Artificial Sequence: Synthetic peptide
  Seed: GSFSVTLDI (PMEL_HUMAN)
GAFSVTLDL

SEQ ID NO: 134969 - protein, 10 aa, Artificial Sequence
  Description of Artificial Sequence: Synthetic peptide
  Seed: AEVSIVVLSG (PMEL_HUMAN)
AEVSIVVLSW

SEQ ID NO: 134970 - protein, 9 aa, Artificial Sequence
  Description of Artificial Sequence: Synthetic peptide
  Seed: LQAAIPLTS (PMEL_HUMAN)
LRAAIPLTF

SEQ ID NO: 134971 - protein, 9 aa, Artificial Sequence
  Description of Artificial Sequence: Synthetic peptide
  Seed: ESAEILQAV (PMEL_HUMAN)
EAAEILQAL

SEQ ID NO: 134972 - protein, 10 aa, Artificial Sequence
  Description of Artificial Sequence: Synthetic peptide
  Seed: RTKAWNRQLY (PMEL_HUMAN)
RIKAWNRQLY

SEQ ID NO: 134973 - protein, 10 aa, Artificial Sequence
  Description of Artificial Sequence: Synthetic peptide
  Seed: LHLAVIGALL (PMEL_HUMAN)
LVLAVIGALV

SEQ ID NO: 134974 - protein, 9 aa, Artificial Sequence
  Description of Artificial Sequence: Synthetic peptide
  Seed: SQVWGGQPV (PMEL_HUMAN)
SEVWGGQPV

SEQ ID NO: 134975 - protein, 10 aa, Artificial Sequence
  Description of Artificial Sequence: Synthetic peptide
  Seed: NSLAVVSTQL (PMEL_HUMAN)
NYLAVVSTQV

SEQ ID NO: 134976 - protein, 10 aa, Artificial Sequence
  Description of Artificial Sequence: Synthetic peptide
  Seed: YRYGSFSVTL (PMEL_HUMAN)
YHYGSFSVTA

SEQ ID NO: 134977 - protein, 11 aa, Artificial Sequence
  Description of Artificial Sequence: Synthetic peptide
  Seed: RPTAEAPNTTA (PMEL_HUMAN)
RPTAEAPNTTF

SEQ ID NO: 134978 - protein, 9 aa, Artificial Sequence
  Description of Artificial Sequence: Synthetic peptide
  Seed: RALVVTHTY (PMEL_HUMAN)
RSLVVTHTI

SEQ ID NO: 134979 - protein, 10 aa, Artificial Sequence
  Description of Artificial Sequence: Synthetic peptide
  Seed: EVMGTTLAEM (PMEL_HUMAN)
EMMGTTLAEY

SEQ ID NO: 134980 - protein, 10 aa, Artificial Sequence
  Description of Artificial Sequence: Synthetic peptide
  Seed: SVPQLPHSSS (PMEL_HUMAN)
SLPQLPHSSL

SEQ ID NO: 134981 - protein, 10 aa, Artificial Sequence
  Description of Artificial Sequence: Synthetic peptide
  Seed: GQVIWVNNTI (PMEL_HUMAN)
GLVIWVNNTV

SEQ ID NO: 134982 - protein, 10 aa, Artificial Sequence
  Description of Artificial Sequence: Synthetic peptide
  Seed: IESAEILQAV (PMEL_HUMAN)
IESAEILQAI

SEQ ID NO: 134983 - protein, 9 aa, Artificial Sequence
  Description of Artificial Sequence: Synthetic peptide
  Seed: LSGTTAAQV (PMEL_HUMAN)
LTGTTAAQW

SEQ ID NO: 134984 - protein, 9 aa, Artificial Sequence
  Description of Artificial Sequence: Synthetic peptide
  Seed: VTAQVVLQA (PMEL_HUMAN)
VAAQVVLQY

SEQ ID NO: 134985 - protein, 9 aa, Artificial Sequence
  Description of Artificial Sequence: Synthetic peptide
  Seed: RGSRSYVPL (PMEL_HUMAN)
RSSRSYVPK

SEQ ID NO: 134986 - protein, 9 aa, Artificial Sequence
  Description of Artificial Sequence: Synthetic peptide
  Seed: ILKGGSGTY (PMEL_HUMAN)
IVKGGSGTF

SEQ ID NO: 134987 - protein, 9 aa, Artificial Sequence
  Description of Artificial Sequence: Synthetic peptide
  Seed: VVLSGTTAA (PMEL_HUMAN)
VMLSGTTAA

SEQ ID NO: 134988 - protein, 9 aa, Artificial Sequence
  Description of Artificial Sequence: Synthetic peptide
  Seed: YLAEADLSY (PMEL_HUMAN)
YRAEADLSV

SEQ ID NO: 134989 - protein, 9 aa, Artificial Sequence
  Description of Artificial Sequence: Synthetic peptide
  Seed: HLAVIGALL (PMEL_HUMAN)
HVAVIGALF

SEQ ID NO: 134990 - protein, 9 aa, Artificial Sequence
  Description of Artificial Sequence: Synthetic peptide
  Seed: RYGSFSVTL (PMEL_HUMAN)
RAGSFSVTL

SEQ ID NO: 134991 - protein, 10 aa, Artificial Sequence
  Description of Artificial Sequence: Synthetic peptide
  Seed: VVLASLIYRR (PMEL_HUMAN)
VALASLIYRR

SEQ ID NO: 134992 - protein, 9 aa, Artificial Sequence
  Description of Artificial Sequence: Synthetic peptide
  Seed: SAFTITDQV (PMEL_HUMAN)
SAFTITDQY

SEQ ID NO: 134993 - protein, 10 aa, Artificial Sequence
  Description of Artificial Sequence: Synthetic peptide
  Seed: SQKRSFVYVW (PMEL_HUMAN)
SEKRSFVYVY

SEQ ID NO: 134994 - protein, 9 aa, Artificial Sequence
  Description of Artificial Sequence: Synthetic peptide
  Seed: AEAPNTTAG (PMEL_HUMAN)
AEAPNTTAI

SEQ ID NO: 134995 - protein, 9 aa, Artificial Sequence
  Description of Artificial Sequence: Synthetic peptide
  Seed: RALVVTHTY (PMEL_HUMAN)
RMLVVTHTW

SEQ ID NO: 134996 - protein, 9 aa, Artificial Sequence
  Description of Artificial Sequence: Synthetic peptide
  Seed: VISTAPVQM (PMEL_HUMAN)
VRSTAPVQL

SEQ ID NO: 134997 - protein, 9 aa, Artificial Sequence
  Description of Artificial Sequence: Synthetic peptide
  Seed: RNQPLTFAL (PMEL_HUMAN)
RQQPLTFAH

SEQ ID NO: 134998 - protein, 10 aa, Artificial Sequence
  Description of Artificial Sequence: Synthetic peptide
  Seed: YVPLAHSSSA (PMEL_HUMAN)
YFPLAHSSSM

SEQ ID NO: 134999 - protein, 11 aa, Artificial Sequence
  Description of Artificial Sequence: Synthetic peptide
  Seed: VLGGPVSGLSI (PMEL_HUMAN)
VTGGPVSGLSL

SEQ ID NO: 135000 - protein, 9 aa, Artificial Sequence
  Description of Artificial Sequence: Synthetic peptide
  Seed: KVSNDGPTL (PMEL_HUMAN)
KTSNDGPTF

SEQ ID NO: 135001 - protein, 10 aa, Artificial Sequence
  Description of Artificial Sequence: Synthetic peptide
  Seed: VLMAVVLASL (PMEL_HUMAN)
VSMAVVLASI

SEQ ID NO: 135002 - protein, 9 aa, Artificial Sequence
  Description of Artificial Sequence: Synthetic peptide
  Seed: RYGSFSVTL (PMEL_HUMAN)
RVGSFSVTF

SEQ ID NO: 135003 - protein, 10 aa, Artificial Sequence
  Description of Artificial Sequence: Synthetic peptide
  Seed: RQVPLDCVLY (PMEL_HUMAN)
RRVPLDCVLF

SEQ ID NO: 135004 - protein, 10 aa, Artificial Sequence
  Description of Artificial Sequence: Synthetic peptide
  Seed: EVSIVVLSGT (PMEL_HUMAN)
EGSIVVLSGV

SEQ ID NO: 135005 - protein, 9 aa, Artificial Sequence
  Description of Artificial Sequence: Synthetic peptide
  Seed: ADTNSLAVV (PMEL_HUMAN)
AETNSLAVT

SEQ ID NO: 135006 - protein, 9 aa, Artificial Sequence
  Description of Artificial Sequence: Synthetic peptide
  Seed: TGRAMLGTH (PMEL_HUMAN)
TARAMLGTM

SEQ ID NO: 135007 - protein, 9 aa, Artificial Sequence
  Description of Artificial Sequence: Synthetic peptide
  Seed: STAPVQMPT (PMEL_HUMAN)
SAAPVQMPI

SEQ ID NO: 135008 - protein, 9 aa, Artificial Sequence
  Description of Artificial Sequence: Synthetic peptide
  Seed: FGDSSGTLI (PMEL_HUMAN)
FLDSSGTLF

SEQ ID NO: 135009 - protein, 11 aa, Artificial Sequence
  Description of Artificial Sequence: Synthetic peptide
  Seed: KVLPDGQVIWV (PMEL_HUMAN)
KLLPDGQVIWV

SEQ ID NO: 135010 - protein, 9 aa, Artificial Sequence
  Description of Artificial Sequence: Synthetic peptide
  Seed: SLAVVSTQL (PMEL_HUMAN)
SMAVVSTQL

SEQ ID NO: 135011 - protein, 10 aa, Artificial Sequence
  Description of Artificial Sequence: Synthetic peptide
  Seed: YGSFSVTLDI (PMEL_HUMAN)
YLSFSVTLDY

SEQ ID NO: 135012 - protein, 9 aa, Artificial Sequence
  Description of Artificial Sequence: Synthetic peptide
  Seed: ESAEILQAV (PMEL_HUMAN)
ELAEILQAA

SEQ ID NO: 135013 - protein, 9 aa, Artificial Sequence
  Description of Artificial Sequence: Synthetic peptide
  Seed: RALDGGNKH (PMEL_HUMAN)
RWLDGGNKY

SEQ ID NO: 135014 - protein, 10 aa, Artificial Sequence
  Description of Artificial Sequence: Synthetic peptide
  Seed: YLAEADLSYT (PMEL_HUMAN)
YMAEADLSYF

SEQ ID NO: 135015 - protein, 9 aa, Artificial Sequence
  Description of Artificial Sequence: Synthetic peptide
  Seed: EVMGTTLAE (PMEL_HUMAN)
ETMGTTLAL

SEQ ID NO: 135016 - protein, 9 aa, Artificial Sequence
  Description of Artificial Sequence: Synthetic peptide
  Seed: VQMPTAEST (PMEL_HUMAN)
VKMPTAESY

SEQ ID NO: 135017 - protein, 9 aa, Artificial Sequence
  Description of Artificial Sequence: Synthetic peptide
  Seed: SRSYVPLAH (PMEL_HUMAN)
SYSYVPLAL

SEQ ID NO: 135018 - protein, 11 aa, Artificial Sequence
  Description of Artificial Sequence: Synthetic peptide
  Seed: RYGSFSVTLDI (PMEL_HUMAN)
RGGSFSVTLDW

SEQ ID NO: 135019 - protein, 9 aa, Artificial Sequence
  Description of Artificial Sequence: Synthetic peptide
  Seed: SVQVPTTEV (PMEL_HUMAN)
SVQVPTTEL

SEQ ID NO: 135020 - protein, 9 aa, Artificial Sequence
  Description of Artificial Sequence: Synthetic peptide
  Seed: LIYRRRLMK (PMEL_HUMAN)
LYYRRRLMK

SEQ ID NO: 135021 - protein, 9 aa, Artificial Sequence
  Description of Artificial Sequence: Synthetic peptide
  Seed: AEADLSYTW (PMEL_HUMAN)
AMADLSYTM

SEQ ID NO: 135022 - protein, 9 aa, Artificial Sequence
  Description of Artificial Sequence: Synthetic peptide
  Seed: MLGTHTMEV (PMEL_HUMAN)
MSGTHTMEF

SEQ ID NO: 135023 - protein, 9 aa, Artificial Sequence
  Description of Artificial Sequence: Synthetic peptide
  Seed: VLPDGQVIW (PMEL_HUMAN)
VFPDGQVIM

SEQ ID NO: 135024 - protein, 9 aa, Artificial Sequence
  Description of Artificial Sequence: Synthetic peptide
  Seed: WSQKRSFVY (PMEL_HUMAN)
WYQKRSFVY

SEQ ID NO: 135025 - protein, 9 aa, Artificial Sequence
  Description of Artificial Sequence: Synthetic peptide
  Seed: LPDGQVIWV (PMEL_HUMAN)
LVDGQVIWM

SEQ ID NO: 135026 - protein, 9 aa, Artificial Sequence
  Description of Artificial Sequence: Synthetic peptide
  Seed: KHFLRNQPL (PMEL_HUMAN)
KMFLRNQPW

SEQ ID NO: 135027 - protein, 9 aa, Artificial Sequence
  Description of Artificial Sequence: Synthetic peptide
  Seed: WSQKRSFVY (PMEL_HUMAN)
WPQKRSFVM

SEQ ID NO: 135028 - protein, 9 aa, Artificial Sequence
  Description of Artificial Sequence: Synthetic peptide
  Seed: FSVSVSQLR (PMEL_HUMAN)
FYVSVSQLR

SEQ ID NO: 135029 - protein, 9 aa, Artificial Sequence
  Description of Artificial Sequence: Synthetic peptide
  Seed: SLIYRRRLM (PMEL_HUMAN)
SYIYRRRLL

SEQ ID NO: 135030 - protein, 9 aa, Artificial Sequence
  Description of Artificial Sequence: Synthetic peptide
  Seed: LADTNSLAV (PMEL_HUMAN)
LSDTNSLAF

SEQ ID NO: 135031 - protein, 11 aa, Artificial Sequence
  Description of Artificial Sequence: Synthetic peptide
  Seed: QAVPSGEGDAF (PMEL_HUMAN)
QLVPSGEGDAY

SEQ ID NO: 135032 - protein, 9 aa, Artificial Sequence
  Description of Artificial Sequence: Synthetic peptide
  Seed: SLAVVSTQL (PMEL_HUMAN)
STAVVSTQY

SEQ ID NO: 135033 - protein, 10 aa, Artificial Sequence
  Description of Artificial Sequence: Synthetic peptide
  Seed: GSFSVTLDIV (PMEL_HUMAN)
GIFSVTLDII

SEQ ID NO: 135034 - protein, 10 aa, Artificial Sequence
  Description of Artificial Sequence: Synthetic peptide
  Seed: VSLADTNSLA (PMEL_HUMAN)
VVLADTNSLL

SEQ ID NO: 135035 - protein, 9 aa, Artificial Sequence
  Description of Artificial Sequence: Synthetic peptide
  Seed: HTMEVTVYH (PMEL_HUMAN)
HAMEVTVYA

SEQ ID NO: 135036 - protein, 9 aa, Artificial Sequence
  Description of Artificial Sequence: Synthetic peptide
  Seed: VQMPTAEST (PMEL_HUMAN)
VLMPTAESF

SEQ ID NO: 135037 - protein, 9 aa, Artificial Sequence
  Description of Artificial Sequence: Synthetic peptide
  Seed: RALVVTHTY (PMEL_HUMAN)
RQLVVTHTR

SEQ ID NO: 135038 - protein, 10 aa, Artificial Sequence
  Description of Artificial Sequence: Synthetic peptide
  Seed: VPLAHSSSAF (PMEL_HUMAN)
VQLAHSSSAY

SEQ ID NO: 135039 - protein, 9 aa, Artificial Sequence
  Description of Artificial Sequence: Synthetic peptide
  Seed: ALVVTHTYL (PMEL_HUMAN)
AAVVTHTYY

SEQ ID NO: 135040 - protein, 10 aa, Artificial Sequence
  Description of Artificial Sequence: Synthetic peptide
  Seed: SCPIGENSPL (PMEL_HUMAN)
SHPIGENSPM

SEQ ID NO: 135041 - protein, 11 aa, Artificial Sequence
  Description of Artificial Sequence: Synthetic peptide
  Seed: FGDSSGTLISR (PMEL_HUMAN)
FVDSSGTLISY

SEQ ID NO: 135042 - protein, 9 aa, Artificial Sequence
  Description of Artificial Sequence: Synthetic peptide
  Seed: AQRLCQPVL (PMEL_HUMAN)
AARLCQPVY

SEQ ID NO: 135043 - protein, 10 aa, Artificial Sequence
  Description of Artificial Sequence: Synthetic peptide
  Seed: ESAEILQAVP (PMEL_HUMAN)
ETAEILQAVM

SEQ ID NO: 135044 - protein, 9 aa, Artificial Sequence
  Description of Artificial Sequence: Synthetic peptide
  Seed: VSLADTNSL (PMEL_HUMAN)
VILADTNSY

SEQ ID NO: 135045 - protein, 9 aa, Artificial Sequence
  Description of Artificial Sequence: Synthetic peptide
  Seed: NQDWLGVSR (PMEL_HUMAN)
NMDWLGVSY

SEQ ID NO: 135046 - protein, 9 aa, Artificial Sequence
  Description of Artificial Sequence: Synthetic peptide
  Seed: KTWGQYWQV (PMEL_HUMAN)
KMWGQYWQF

SEQ ID NO: 135047 - protein, 10 aa, Artificial Sequence
  Description of Artificial Sequence: Synthetic peptide
  Seed: LVLMAVVLAS (PMEL_HUMAN)
LKLMAVVLAI

SEQ ID NO: 135048 - protein, 9 aa, Artificial Sequence
  Description of Artificial Sequence: Synthetic peptide
  Seed: SQKRSFVYV (PMEL_HUMAN)
SIKRSFVYG

SEQ ID NO: 135049 - protein, 9 aa, Artificial Sequence
  Description of Artificial Sequence: Synthetic peptide
  Seed: SLAVVSTQL (PMEL_HUMAN)
SMAVVSTQR

SEQ ID NO: 135050 - protein, 9 aa, Artificial Sequence
  Description of Artificial Sequence: Synthetic peptide
  Seed: FTITDQVPF (PMEL_HUMAN)
FMITDQVPV

SEQ ID NO: 135051 - protein, 10 aa, Artificial Sequence
  Description of Artificial Sequence: Synthetic peptide
  Seed: LAVIGALLAV (PMEL_HUMAN)
LHVIGALLAI

SEQ ID NO: 135052 - protein, 9 aa, Artificial Sequence
  Description of Artificial Sequence: Synthetic peptide
  Seed: WSQKRSFVY (PMEL_HUMAN)
WPQKRSFVF

SEQ ID NO: 135053 - protein, 11 aa, Artificial Sequence
  Description of Artificial Sequence: Synthetic peptide
  Seed: AEMSTPEATGM (PMEL_HUMAN)
ALMSTPEATGF

SEQ ID NO: 135054 - protein, 9 aa, Artificial Sequence
  Description of Artificial Sequence: Synthetic peptide
  Seed: VLKRCLLHL (PMEL_HUMAN)
VMKRCLLHY

SEQ ID NO: 135055 - protein, 10 aa, Artificial Sequence
  Description of Artificial Sequence: Synthetic peptide
  Seed: KTWGQYWQVL (PMEL_HUMAN)
KMWGQYWQVI

SEQ ID NO: 135056 - protein, 9 aa, Artificial Sequence
  Description of Artificial Sequence: Synthetic peptide
  Seed: ITDQVPFSV (PMEL_HUMAN)
IQDQVPFSM

SEQ ID NO: 135057 - protein, 9 aa, Artificial Sequence
  Description of Artificial Sequence: Synthetic peptide
  Seed: RAMLGTHTM (PMEL_HUMAN)
RMMLGTHTW

SEQ ID NO: 135058 - protein, 10 aa, Artificial Sequence
  Description of Artificial Sequence: Synthetic peptide
  Seed: LQLHDPSGYL (PMEL_HUMAN)
LKLHDPSGYY

SEQ ID NO: 135059 - protein, 10 aa, Artificial Sequence
  Description of Artificial Sequence: Synthetic peptide
  Seed: YRYGSFSVTL (PMEL_HUMAN)
YQYGSFSVTL

SEQ ID NO: 135060 - protein, 9 aa, Artificial Sequence
  Description of Artificial Sequence: Synthetic peptide
  Seed: GQVPLIVGI (PMEL_HUMAN)
GQVPLIVGY

SEQ ID NO: 135061 - protein, 10 aa, Artificial Sequence
  Description of Artificial Sequence: Synthetic peptide
  Seed: TPAEVSIVVL (PMEL_HUMAN)
TPAEVSIVVY

SEQ ID NO: 135062 - protein, 9 aa, Artificial Sequence
  Description of Artificial Sequence: Synthetic peptide
  Seed: KTWGQYWQV (PMEL_HUMAN)
KMWGQYWQR

SEQ ID NO: 135063 - protein, 9 aa, Artificial Sequence
  Description of Artificial Sequence: Synthetic peptide
  Seed: VSLADTNSL (PMEL_HUMAN)
VCLADTNSW

SEQ ID NO: 135064 - protein, 10 aa, Artificial Sequence
  Description of Artificial Sequence: Synthetic peptide
  Seed: RRLMKQDFSV (PMEL_HUMAN)
RGLMKQDFSI

SEQ ID NO: 135065 - protein, 9 aa, Artificial Sequence
  Description of Artificial Sequence: Synthetic peptide
  Seed: GSRSYVPLA (PMEL_HUMAN)
GFRSYVPLK

SEQ ID NO: 135066 - protein, 10 aa, Artificial Sequence
  Description of Artificial Sequence: Synthetic peptide
  Seed: LAEADLSYTW (PMEL_HUMAN)
LSEADLSYTW

SEQ ID NO: 135067 - protein, 10 aa, Artificial Sequence
  Description of Artificial Sequence: Synthetic peptide
  Seed: LVLMAVVLAS (PMEL_HUMAN)
LWLMAVVLAM

SEQ ID NO: 135068 - protein, 9 aa, Artificial Sequence
  Description of Artificial Sequence: Synthetic peptide
  Seed: TPAEVSIVV (PMEL_HUMAN)
TMAEVSIVV

SEQ ID NO: 135069 - protein, 9 aa, Artificial Sequence
  Description of Artificial Sequence: Synthetic peptide
  Seed: STAPVQMPT (PMEL_HUMAN)
SLAPVQMPV

SEQ ID NO: 135070 - protein, 9 aa, Artificial Sequence
  Description of Artificial Sequence: Synthetic peptide
  Seed: AVVLASLIY (PMEL_HUMAN)
ASVLASLIY

SEQ ID NO: 135071 - protein, 9 aa, Artificial Sequence
  Description of Artificial Sequence: Synthetic peptide
  Seed: TTAGQVPTT (PMEL_HUMAN)
TAAGQVPTV

SEQ ID NO: 135072 - protein, 9 aa, Artificial Sequence
  Description of Artificial Sequence: Synthetic peptide
  Seed: GSWSQKRSF (PMEL_HUMAN)
GSWSQKRSY

SEQ ID NO: 135073 - protein, 9 aa, Artificial Sequence
  Description of Artificial Sequence: Synthetic peptide
  Seed: AVVLASLIY (PMEL_HUMAN)
AQVLASLIH

SEQ ID NO: 135074 - protein, 9 aa, Artificial Sequence
  Description of Artificial Sequence: Synthetic peptide
  Seed: LPDGQVIWV (PMEL_HUMAN)
LQDGQVIWM

SEQ ID NO: 135075 - protein, 9 aa, Artificial Sequence
  Description of Artificial Sequence: Synthetic peptide
  Seed: TLISRALVV (PMEL_HUMAN)
TAISRALVF

SEQ ID NO: 135076 - protein, 9 aa, Artificial Sequence
  Description of Artificial Sequence: Synthetic peptide
  Seed: RSYVPLAHS (PMEL_HUMAN)
RFYVPLAHK

SEQ ID NO: 135077 - protein, 9 aa, Artificial Sequence
  Description of Artificial Sequence: Synthetic peptide
  Seed: AVGATKVPR (PMEL_HUMAN)
AYGATKVPR

SEQ ID NO: 135078 - protein, 9 aa, Artificial Sequence
  Description of Artificial Sequence: Synthetic peptide
  Seed: SAFTITDQV (PMEL_HUMAN)
SIFTITDQL

SEQ ID NO: 135079 - protein, 9 aa, Artificial Sequence
  Description of Artificial Sequence: Synthetic peptide
  Seed: ILKGGSGTY (PMEL_HUMAN)
IQKGGSGTM

SEQ ID NO: 135080 - protein, 9 aa, Artificial Sequence
  Description of Artificial Sequence: Synthetic peptide
  Seed: VTLDIVQGI (PMEL_HUMAN)
VVLDIVQGY

SEQ ID NO: 135081 - protein, 10 aa, Artificial Sequence
  Description of Artificial Sequence: Synthetic peptide
  Seed: RGSRSYVPLA (PMEL_HUMAN)
RCSRSYVPLI

SEQ ID NO: 135082 - protein, 8 aa, Artificial Sequence
  Description of Artificial Sequence: Synthetic peptide
  Seed: LADTNSLA (PMEL_HUMAN)
LTDTNSLF

SEQ ID NO: 135083 - protein, 9 aa, Artificial Sequence
  Description of Artificial Sequence: Synthetic peptide
  Seed: LQLHDPSGY (PMEL_HUMAN)
LLLHDPSGF

SEQ ID NO: 135084 - protein, 9 aa, Artificial Sequence
  Description of Artificial Sequence: Synthetic peptide
  Seed: MAVVLASLI (PMEL_HUMAN)
MGVVLASLW

SEQ ID NO: 135085 - protein, 11 aa, Artificial Sequence
  Description of Artificial Sequence: Synthetic peptide
  Seed: RLPRIFCSCPI (PMEL_HUMAN)
RVPRIFCSCPL

SEQ ID NO: 135086 - protein, 10 aa, Artificial Sequence
  Description of Artificial Sequence: Synthetic peptide
  Seed: VPLAHSSSAF (PMEL_HUMAN)
VPLAHSSSAY

SEQ ID NO: 135087 - protein, 9 aa, Artificial Sequence
  Description of Artificial Sequence: Synthetic peptide
  Seed: VPQLPHSSS (PMEL_HUMAN)
VPQLPHSSA

SEQ ID NO: 135088 - protein, 9 aa, Artificial Sequence
  Description of Artificial Sequence: Synthetic peptide
  Seed: IYRRRLMKQ (PMEL_HUMAN)
IIRRRLMKK

SEQ ID NO: 135089 - protein, 11 aa, Artificial Sequence
  Description of Artificial Sequence: Synthetic peptide
  Seed: VPQLPHSSSHW (PMEL_HUMAN)
VAQLPHSSSHW

SEQ ID NO: 135090 - protein, 11 aa, Artificial Sequence
  Description of Artificial Sequence: Synthetic peptide
  Seed: IMSTESITGSL (PMEL_HUMAN)
ILSTESITGSV

SEQ ID NO: 135091 - protein, 9 aa, Artificial Sequence
  Description of Artificial Sequence: Synthetic peptide
  Seed: RGSRSYVPL (PMEL_HUMAN)
RTSRSYVPK

SEQ ID NO: 135092 - protein, 10 aa, Artificial Sequence
  Description of Artificial Sequence: Synthetic peptide
  Seed: VPQLPHSSSH (PMEL_HUMAN)
VWQLPHSSSM

SEQ ID NO: 135093 - protein, 9 aa, Artificial Sequence
  Description of Artificial Sequence: Synthetic peptide
  Seed: FLRNQPLTF (PMEL_HUMAN)
FPRNQPLTI

SEQ ID NO: 135094 - protein, 10 aa, Artificial Sequence
  Description of Artificial Sequence: Synthetic peptide
  Seed: NASFSIALNF (PMEL_HUMAN)
NPSFSIALNW

SEQ ID NO: 135095 - protein, 10 aa, Artificial Sequence
  Description of Artificial Sequence: Synthetic peptide
  Seed: VPLDCVLYRY (PMEL_HUMAN)
VFLDCVLYRY

SEQ ID NO: 135096 - protein, 9 aa, Artificial Sequence
  Description of Artificial Sequence: Synthetic peptide
  Seed: VLMAVVLAS (PMEL_HUMAN)
VQMAVVLAA

SEQ ID NO: 135097 - protein, 10 aa, Artificial Sequence
  Description of Artificial Sequence: Synthetic peptide
  Seed: STAPVQMPTA (PMEL_HUMAN)
SVAPVQMPTI

SEQ ID NO: 135098 - protein, 9 aa, Artificial Sequence
  Description of Artificial Sequence: Synthetic peptide
  Seed: VETTARELP (PMEL_HUMAN)
VETTARELI

SEQ ID NO: 135099 - protein, 10 aa, Artificial Sequence
  Description of Artificial Sequence: Synthetic peptide
  Seed: DGTATLRLVK (PMEL_HUMAN)
DYTATLRLVR

SEQ ID NO: 135100 - protein, 11 aa, Artificial Sequence
  Description of Artificial Sequence: Synthetic peptide
  Seed: LVLMAVVLASL (PMEL_HUMAN)
LRLMAVVLASV

SEQ ID NO: 135101 - protein, 9 aa, Artificial Sequence
  Description of Artificial Sequence: Synthetic peptide
  Seed: VTLDIVQGI (PMEL_HUMAN)
VLLDIVQGA

SEQ ID NO: 135102 - protein, 10 aa, Artificial Sequence
  Description of Artificial Sequence: Synthetic peptide
  Seed: KTWGQYWQVL (PMEL_HUMAN)
KLWGQYWQVQ

SEQ ID NO: 135103 - protein, 9 aa, Artificial Sequence
  Description of Artificial Sequence: Synthetic peptide
  Seed: SLAVVSTQL (PMEL_HUMAN)
SFAVVSTQY

SEQ ID NO: 135104 - protein, 10 aa, Artificial Sequence
  Description of Artificial Sequence: Synthetic peptide
  Seed: SQKRSFVYVW (PMEL_HUMAN)
SCKRSFVYVF

SEQ ID NO: 135105 - protein, 9 aa, Artificial Sequence
  Description of Artificial Sequence: Synthetic peptide
  Seed: TLISRALVV (PMEL_HUMAN)
TTISRALVM

SEQ ID NO: 135106 - protein, 10 aa, Artificial Sequence
  Description of Artificial Sequence: Synthetic peptide
  Seed: AVVLASLIYR (PMEL_HUMAN)
AWVLASLIYK

SEQ ID NO: 135107 - protein, 9 aa, Artificial Sequence
  Description of Artificial Sequence: Synthetic peptide
  Seed: AVVSTQLIM (PMEL_HUMAN)
AMVSTQLIY

SEQ ID NO: 135108 - protein, 11 aa, Artificial Sequence
  Description of Artificial Sequence: Synthetic peptide
  Seed: SYVPLAHSSSA (PMEL_HUMAN)
SDVPLAHSSSF

SEQ ID NO: 135109 - protein, 10 aa, Artificial Sequence
  Description of Artificial Sequence: Synthetic peptide
  Seed: SVTLDIVQGI (PMEL_HUMAN)
SATLDIVQGV

SEQ ID NO: 135110 - protein, 10 aa, Artificial Sequence
  Description of Artificial Sequence: Synthetic peptide
  Seed: WSQKRSFVYV (PMEL_HUMAN)
WAQKRSFVYK

SEQ ID NO: 135111 - protein, 9 aa, Artificial Sequence
  Description of Artificial Sequence: Synthetic peptide
  Seed: VSVSQLRAL (PMEL_HUMAN)
VRVSQLRAF

SEQ ID NO: 135112 - protein, 9 aa, Artificial Sequence
  Description of Artificial Sequence: Synthetic peptide
  Seed: SLADTNSLA (PMEL_HUMAN)
SLADTNSLL

SEQ ID NO: 135113 - protein, 10 aa, Artificial Sequence
  Description of Artificial Sequence: Synthetic peptide
  Seed: KRQVPLDCVL (PMEL_HUMAN)
KFQVPLDCVM

SEQ ID NO: 135114 - protein, 10 aa, Artificial Sequence
  Description of Artificial Sequence: Synthetic peptide
  Seed: AMLGTHTMEV (PMEL_HUMAN)
AELGTHTMEV

SEQ ID NO: 135115 - protein, 10 aa, Artificial Sequence
  Description of Artificial Sequence: Synthetic peptide
  Seed: SSHWLRLPRI (PMEL_HUMAN)
SSHWLRLPRW

SEQ ID NO: 135116 - protein, 9 aa, Artificial Sequence
  Description of Artificial Sequence: Synthetic peptide
  Seed: GSWSQKRSF (PMEL_HUMAN)
GVWSQKRSW

SEQ ID NO: 135117 - protein, 9 aa, Artificial Sequence
  Description of Artificial Sequence: Synthetic peptide
  Seed: VISTAPVQM (PMEL_HUMAN)
VVSTAPVQI

SEQ ID NO: 135118 - protein, 9 aa, Artificial Sequence
  Description of Artificial Sequence: Synthetic peptide
  Seed: HTYLEPGPV (PMEL_HUMAN)
HTYLEPGPM

SEQ ID NO: 135119 - protein, 9 aa, Artificial Sequence
  Description of Artificial Sequence: Synthetic peptide
  Seed: SQKRSFVYV (PMEL_HUMAN)
SAKRSFVYF

SEQ ID NO: 135120 - protein, 10 aa, Artificial Sequence
  Description of Artificial Sequence: Synthetic peptide
  Seed: AEADLSYTWD (PMEL_HUMAN)
AEADLSYTWI

SEQ ID NO: 135121 - protein, 9 aa, Artificial Sequence
  Description of Artificial Sequence: Synthetic peptide
  Seed: KAWNRQLYP (PMEL_HUMAN)
KSWNRQLYV

SEQ ID NO: 135122 - protein, 10 aa, Artificial Sequence
  Description of Artificial Sequence: Synthetic peptide
  Seed: SVPQLPHSSS (PMEL_HUMAN)
SCPQLPHSSL

SEQ ID NO: 135123 - protein, 8 aa, Artificial Sequence
  Description of Artificial Sequence: Synthetic peptide
  Seed: LAVVSTQL (PMEL_HUMAN)
LQVVSTQV

SEQ ID NO: 135124 - protein, 10 aa, Artificial Sequence
  Description of Artificial Sequence: Synthetic peptide
  Seed: APNTTAGQVP (PMEL_HUMAN)
APNTTAGQVA

SEQ ID NO: 135125 - protein, 9 aa, Artificial Sequence
  Description of Artificial Sequence: Synthetic peptide
  Seed: AQVVLQAAI (PMEL_HUMAN)
ASVVLQAAY

SEQ ID NO: 135126 - protein, 10 aa, Artificial Sequence
  Description of Artificial Sequence: Synthetic peptide
  Seed: LMAVVLASLI (PMEL_HUMAN)
LLAVVLASLL

SEQ ID NO: 135127 - protein, 11 aa, Artificial Sequence
  Description of Artificial Sequence: Synthetic peptide
  Seed: KVLPDGQVIWV (PMEL_HUMAN)
KILPDGQVIWY

SEQ ID NO: 135128 - protein, 9 aa, Artificial Sequence
  Description of Artificial Sequence: Synthetic peptide
  Seed: VQVPTTEVI (PMEL_HUMAN)
VIVPTTEVM

SEQ ID NO: 135129 - protein, 9 aa, Artificial Sequence
  Description of Artificial Sequence: Synthetic peptide
  Seed: LPSPACQLV (PMEL_HUMAN)
LPSPACQLI

SEQ ID NO: 135130 - protein, 9 aa, Artificial Sequence
  Description of Artificial Sequence: Synthetic peptide
  Seed: GQVPTTEVV (PMEL_HUMAN)
GEVPTTEVS

SEQ ID NO: 135131 - protein, 9 aa, Artificial Sequence
  Description of Artificial Sequence: Synthetic peptide
  Seed: AQRLCQPVL (PMEL_HUMAN)
AQRLCQPVF

SEQ ID NO: 135132 - protein, 10 aa, Artificial Sequence
  Description of Artificial Sequence: Synthetic peptide
  Seed: VPQLPHSSSH (PMEL_HUMAN)
VCQLPHSSSF

SEQ ID NO: 135133 - protein, 8 aa, Artificial Sequence
  Description of Artificial Sequence: Synthetic peptide
  Seed: HSSSHWLR (PMEL_HUMAN)
HTSSHWLR

SEQ ID NO: 135134 - protein, 10 aa, Artificial Sequence
  Description of Artificial Sequence: Synthetic peptide
  Seed: VTAQVVLQAA (PMEL_HUMAN)
VQAQVVLQAV

SEQ ID NO: 135135 - protein, 10 aa, Artificial Sequence
  Description of Artificial Sequence: Synthetic peptide
  Seed: TLISRALVVT (PMEL_HUMAN)
TMISRALVVL

SEQ ID NO: 135136 - protein, 9 aa, Artificial Sequence
  Description of Artificial Sequence: Synthetic peptide
  Seed: RYGSFSVTL (PMEL_HUMAN)
RVGSFSVTY

SEQ ID NO: 135137 - protein, 9 aa, Artificial Sequence
  Description of Artificial Sequence: Synthetic peptide
  Seed: RLMKQDFSV (PMEL_HUMAN)
RAMKQDFSI

SEQ ID NO: 135138 - protein, 11 aa, Artificial Sequence
  Description of Artificial Sequence: Synthetic peptide
  Seed: TWDFGDSSGTL (PMEL_HUMAN)
TYDFGDSSGTL

SEQ ID NO: 135139 - protein, 9 aa, Artificial Sequence
  Description of Artificial Sequence: Synthetic peptide
  Seed: MEVTVYHRR (PMEL_HUMAN)
MIVTVYHRR

SEQ ID NO: 135140 - protein, 9 aa, Artificial Sequence
  Description of Artificial Sequence: Synthetic peptide
  Seed: TWGQYWQVL (PMEL_HUMAN)
TFGQYWQVM

SEQ ID NO: 135141 - protein, 9 aa, Artificial Sequence
  Description of Artificial Sequence: Synthetic peptide
  Seed: LADTNSLAV (PMEL_HUMAN)
LNDTNSLAI

SEQ ID NO: 135142 - protein, 9 aa, Artificial Sequence
  Description of Artificial Sequence: Synthetic peptide
  Seed: ALLAVGATK (PMEL_HUMAN)
AALAVGATL

SEQ ID NO: 135143 - protein, 11 aa, Artificial Sequence
  Description of Artificial Sequence: Synthetic peptide
  Seed: RYGSFSVTLDI (PMEL_HUMAN)
RDGSFSVTLDF

SEQ ID NO: 135144 - protein, 11 aa, Artificial Sequence
  Description of Artificial Sequence: Synthetic peptide
  Seed: GEGDAFELTVS (PMEL_HUMAN)
GEGDAFELTVA

SEQ ID NO: 135145 - protein, 10 aa, Artificial Sequence
  Description of Artificial Sequence: Synthetic peptide
  Seed: RQLYPEWTEA (PMEL_HUMAN)
RHLYPEWTEV

SEQ ID NO: 135146 - protein, 9 aa, Artificial Sequence
  Description of Artificial Sequence: Synthetic peptide
  Seed: LVLKRCLLH (PMEL_HUMAN)
LVLKRCLLK

SEQ ID NO: 135147 - protein, 9 aa, Artificial Sequence
  Description of Artificial Sequence: Synthetic peptide
  Seed: VSEVMGTTL (PMEL_HUMAN)
VSEVMGTTI

SEQ ID NO: 135148 - protein, 9 aa, Artificial Sequence
  Description of Artificial Sequence: Synthetic peptide
  Seed: KAWNRQLYP (PMEL_HUMAN)
KYWNRQLYA

SEQ ID NO: 135149 - protein, 9 aa, Artificial Sequence
  Description of Artificial Sequence: Synthetic peptide
  Seed: VVLQAAIPL (PMEL_HUMAN)
VMLQAAIPM

SEQ ID NO: 135150 - protein, 9 aa, Artificial Sequence
  Description of Artificial Sequence: Synthetic peptide
  Seed: ESAEILQAV (PMEL_HUMAN)
ESAEILQAW

SEQ ID NO: 135151 - protein, 10 aa, Artificial Sequence
  Description of Artificial Sequence: Synthetic peptide
  Seed: LIYRRRLMKQ (PMEL_HUMAN)
LLYRRRLMKK

SEQ ID NO: 135152 - protein, 8 aa, Artificial Sequence
  Description of Artificial Sequence: Synthetic peptide
  Seed: QDFSVPQL (PMEL_HUMAN)
QMFSVPQI

SEQ ID NO: 135153 - protein, 9 aa, Artificial Sequence
  Description of Artificial Sequence: Synthetic peptide
  Seed: AEPSGTTSV (PMEL_HUMAN)
APPSGTTSM

SEQ ID NO: 135154 - protein, 9 aa, Artificial Sequence
  Description of Artificial Sequence: Synthetic peptide
  Seed: ITDQVPFSV (PMEL_HUMAN)
IGDQVPFSL

SEQ ID NO: 135155 - protein, 9 aa, Artificial Sequence
  Description of Artificial Sequence: Synthetic peptide
  Seed: VLGGPVSGL (PMEL_HUMAN)
VLGGPVSGF

SEQ ID NO: 135156 - protein, 10 aa, Artificial Sequence
  Description of Artificial Sequence: Synthetic peptide
  Seed: AVPSGEGDAF (PMEL_HUMAN)
AGPSGEGDAL

SEQ ID NO: 135157 - protein, 10 aa, Artificial Sequence
  Description of Artificial Sequence: Synthetic peptide
  Seed: SQKRSFVYVW (PMEL_HUMAN)
SWKRSFVYVF

SEQ ID NO: 135158 - protein, 9 aa, Artificial Sequence
  Description of Artificial Sequence: Synthetic peptide
  Seed: RALVVTHTY (PMEL_HUMAN)
RGLVVTHTR

SEQ ID NO: 135159 - protein, 9 aa, Artificial Sequence
  Description of Artificial Sequence: Synthetic peptide
  Seed: ESAEILQAV (PMEL_HUMAN)
ELAEILQAF

SEQ ID NO: 135160 - protein, 9 aa, Artificial Sequence
  Description of Artificial Sequence: Synthetic peptide
  Seed: RAMLGTHTM (PMEL_HUMAN)
RQMLGTHTF

SEQ ID NO: 135161 - protein, 9 aa, Artificial Sequence
  Description of Artificial Sequence: Synthetic peptide
  Seed: VSLADTNSL (PMEL_HUMAN)
VKLADTNSY

SEQ ID NO: 135162 - protein, 9 aa, Artificial Sequence
  Description of Artificial Sequence: Synthetic peptide
  Seed: VQMPTAEST (PMEL_HUMAN)
VVMPTAESL

SEQ ID NO: 135163 - protein, 9 aa, Artificial Sequence
  Description of Artificial Sequence: Synthetic peptide
  Seed: AGQVPTTEV (PMEL_HUMAN)
ARQVPTTEL

SEQ ID NO: 135164 - protein, 9 aa, Artificial Sequence
  Description of Artificial Sequence: Synthetic peptide
  Seed: WSQKRSFVY (PMEL_HUMAN)
WSQKRSFVW

SEQ ID NO: 135165 - protein, 9 aa, Artificial Sequence
  Description of Artificial Sequence: Synthetic peptide
  Seed: DQVPFSVSV (PMEL_HUMAN)
DHVPFSVSY

SEQ ID NO: 135166 - protein, 10 aa, Artificial Sequence
  Description of Artificial Sequence: Synthetic peptide
  Seed: VPQLPHSSSH (PMEL_HUMAN)
VHQLPHSSSY

SEQ ID NO: 135167 - protein, 10 aa, Artificial Sequence
  Description of Artificial Sequence: Synthetic peptide
  Seed: AVPSGEGDAF (PMEL_HUMAN)
AYPSGEGDAM

SEQ ID NO: 135168 - protein, 9 aa, Artificial Sequence
  Description of Artificial Sequence: Synthetic peptide
  Seed: PLLDGTATL (PMEL_HUMAN)
PALDGTATY

SEQ ID NO: 135169 - protein, 9 aa, Artificial Sequence
  Description of Artificial Sequence: Synthetic peptide
  Seed: FTITDQVPF (PMEL_HUMAN)
FIITDQVPM

SEQ ID NO: 135170 - protein, 9 aa, Artificial Sequence
  Description of Artificial Sequence: Synthetic peptide
  Seed: QVWGGQPVY (PMEL_HUMAN)
QVWGGQPVW

SEQ ID NO: 135171 - protein, 10 aa, Artificial Sequence
  Description of Artificial Sequence: Synthetic peptide
  Seed: LVLMAVVLAS (PMEL_HUMAN)
LLLMAVVLAM

SEQ ID NO: 135172 - protein, 10 aa, Artificial Sequence
  Description of Artificial Sequence: Synthetic peptide
  Seed: ALDGGNKHFL (PMEL_HUMAN)
AQDGGNKHFF

SEQ ID NO: 135173 - protein, 10 aa, Artificial Sequence
  Description of Artificial Sequence: Synthetic peptide
  Seed: KVLPDGQVIW (PMEL_HUMAN)
KILPDGQVIF

SEQ ID NO: 135174 - protein, 10 aa, Artificial Sequence
  Description of Artificial Sequence: Synthetic peptide
  Seed: YLAEADLSYT (PMEL_HUMAN)
YMAEADLSYP

SEQ ID NO: 135175 - protein, 10 aa, Artificial Sequence
  Description of Artificial Sequence: Synthetic peptide
  Seed: GTLISRALVV (PMEL_HUMAN)
GMLISRALVV

SEQ ID NO: 135176 - protein, 10 aa, Artificial Sequence
  Description of Artificial Sequence: Synthetic peptide
  Seed: MTPAEVSIVV (PMEL_HUMAN)
MYPAEVSIVY

SEQ ID NO: 135177 - protein, 9 aa, Artificial Sequence
  Description of Artificial Sequence: Synthetic peptide
  Seed: VVLQAAIPL (PMEL_HUMAN)
VTLQAAIPM

SEQ ID NO: 135178 - protein, 9 aa, Artificial Sequence
  Description of Artificial Sequence: Synthetic peptide
  Seed: YHRRGSRSY (PMEL_HUMAN)
YQRRGSRSH

SEQ ID NO: 135179 - protein, 9 aa, Artificial Sequence
  Description of Artificial Sequence: Synthetic peptide
  Seed: AEPSGTTSV (PMEL_HUMAN)
AQPSGTTSY

SEQ ID NO: 135180 - protein, 9 aa, Artificial Sequence
  Description of Artificial Sequence: Synthetic peptide
  Seed: RAMLGTHTM (PMEL_HUMAN)
RPMLGTHTG

SEQ ID NO: 135181 - protein, 9 aa, Artificial Sequence
  Description of Artificial Sequence: Synthetic peptide
  Seed: EPGPVTAQV (PMEL_HUMAN)
EPGPVTAQF

SEQ ID NO: 135182 - protein, 10 aa, Artificial Sequence
  Description of Artificial Sequence: Synthetic peptide
  Seed: SGTYCLNVSL (PMEL_HUMAN)
SRTYCLNVSF

SEQ ID NO: 135183 - protein, 10 aa, Artificial Sequence
  Description of Artificial Sequence: Synthetic peptide
  Seed: ESAEILQAVP (PMEL_HUMAN)
ESAEILQAVI

SEQ ID NO: 135184 - protein, 9 aa, Artificial Sequence
  Description of Artificial Sequence: Synthetic peptide
  Seed: SAFTITDQV (PMEL_HUMAN)
SAFTITDQM

SEQ ID NO: 135185 - protein, 9 aa, Artificial Sequence
  Description of Artificial Sequence: Synthetic peptide
  Seed: ESAEILQAV (PMEL_HUMAN)
EQAEILQAL

SEQ ID NO: 135186 - protein, 9 aa, Artificial Sequence
  Description of Artificial Sequence: Synthetic peptide
  Seed: ALDGGNKHF (PMEL_HUMAN)
ASDGGNKHL

SEQ ID NO: 135187 - protein, 9 aa, Artificial Sequence
  Description of Artificial Sequence: Synthetic peptide
  Seed: LPSPACQLV (PMEL_HUMAN)
LASPACQLW

SEQ ID NO: 135188 - protein, 11 aa, Artificial Sequence
  Description of Artificial Sequence: Synthetic peptide
  Seed: GYLAEADLSYT (PMEL_HUMAN)
GFLAEADLSYM

SEQ ID NO: 135189 - protein, 10 aa, Artificial Sequence
  Description of Artificial Sequence: Synthetic peptide
  Seed: GSRSYVPLAH (PMEL_HUMAN)
GFRSYVPLAK

SEQ ID NO: 135190 - protein, 9 aa, Artificial Sequence
  Description of Artificial Sequence: Synthetic peptide
  Seed: FPGSQKVLP (PMEL_HUMAN)
FPGSQKVLM

SEQ ID NO: 135191 - protein, 9 aa, Artificial Sequence
  Description of Artificial Sequence: Synthetic peptide
  Seed: VISTAPVQM (PMEL_HUMAN)
VQSTAPVQM

SEQ ID NO: 135192 - protein, 9 aa, Artificial Sequence
  Description of Artificial Sequence: Synthetic peptide
  Seed: LADTNSLAV (PMEL_HUMAN)
LWDTNSLAV

SEQ ID NO: 135193 - protein, 11 aa, Artificial Sequence
  Description of Artificial Sequence: Synthetic peptide
  Seed: QAVPSGEGDAF (PMEL_HUMAN)
QHVPSGEGDAV

SEQ ID NO: 135194 - protein, 11 aa, Artificial Sequence
  Description of Artificial Sequence: Synthetic peptide
  Seed: RRRLMKQDFSV (PMEL_HUMAN)
RLRLMKQDFSV

SEQ ID NO: 135195 - protein, 9 aa, Artificial Sequence
  Description of Artificial Sequence: Synthetic peptide
  Seed: TTAGQVPTT (PMEL_HUMAN)
TIAGQVPTV

SEQ ID NO: 135196 - protein, 9 aa, Artificial Sequence
  Description of Artificial Sequence: Synthetic peptide
  Seed: VSNDGPTLI (PMEL_HUMAN)
VMNDGPTLI

SEQ ID NO: 135197 - protein, 10 aa, Artificial Sequence
  Description of Artificial Sequence: Synthetic peptide
  Seed: VPLAHSSSAF (PMEL_HUMAN)
VPLAHSSSAW

SEQ ID NO: 135198 - protein, 10 aa, Artificial Sequence
  Description of Artificial Sequence: Synthetic peptide
  Seed: MAVVLASLIY (PMEL_HUMAN)
MWVVLASLIY

SEQ ID NO: 135199 - protein, 10 aa, Artificial Sequence
  Description of Artificial Sequence: Synthetic peptide
  Seed: RQLRTKAWNR (PMEL_HUMAN)
RTLRTKAWNK

SEQ ID NO: 135200 - protein, 9 aa, Artificial Sequence
  Description of Artificial Sequence: Synthetic peptide
  Seed: GMTPAEVSI (PMEL_HUMAN)
GQTPAEVSM

SEQ ID NO: 135201 - protein, 10 aa, Artificial Sequence
  Description of Artificial Sequence: Synthetic peptide
  Seed: MAVVLASLIY (PMEL_HUMAN)
MKVVLASLIF

SEQ ID NO: 135202 - protein, 11 aa, Artificial Sequence
  Description of Artificial Sequence: Synthetic peptide
  Seed: GYLAEADLSYT (PMEL_HUMAN)
GILAEADLSYV

SEQ ID NO: 135203 - protein, 9 aa, Artificial Sequence
  Description of Artificial Sequence: Synthetic peptide
  Seed: SSPGCQPPA (PMEL_HUMAN)
SQPGCQPPL

SEQ ID NO: 135204 - protein, 10 aa, Artificial Sequence
  Description of Artificial Sequence: Synthetic peptide
  Seed: SLGPLLDGTA (PMEL_HUMAN)
SLGPLLDGTV

SEQ ID NO: 135205 - protein, 9 aa, Artificial Sequence
  Description of Artificial Sequence: Synthetic peptide
  Seed: RAMLGTHTM (PMEL_HUMAN)
RFMLGTHTL

SEQ ID NO: 135206 - protein, 9 aa, Artificial Sequence
  Description of Artificial Sequence: Synthetic peptide
  Seed: GGPVSGLSI (PMEL_HUMAN)
GRPVSGLSF

SEQ ID NO: 135207 - protein, 9 aa, Artificial Sequence
  Description of Artificial Sequence: Synthetic peptide
  Seed: LAVVSTQLI (PMEL_HUMAN)
LQVVSTQLF

SEQ ID NO: 135208 - protein, 11 aa, Artificial Sequence
  Description of Artificial Sequence: Synthetic peptide
  Seed: RRGSRSYVPLA (PMEL_HUMAN)
RHGSRSYVPLV

SEQ ID NO: 135209 - protein, 10 aa, Artificial Sequence
  Description of Artificial Sequence: Synthetic peptide
  Seed: LAHSSSAFTI (PMEL_HUMAN)
LMHSSSAFTW

SEQ ID NO: 135210 - protein, 8 aa, Artificial Sequence
  Description of Artificial Sequence: Synthetic peptide
  Seed: FSVSVSQL (PMEL_HUMAN)
FQVSVSQV

SEQ ID NO: 135211 - protein, 10 aa, Artificial Sequence
  Description of Artificial Sequence: Synthetic peptide
  Seed: VVLASLIYRR (PMEL_HUMAN)
VQLASLIYRR

SEQ ID NO: 135212 - protein, 9 aa, Artificial Sequence
  Description of Artificial Sequence: Synthetic peptide
  Seed: ADTNSLAVV (PMEL_HUMAN)
AETNSLAVP

SEQ ID NO: 135213 - protein, 9 aa, Artificial Sequence
  Description of Artificial Sequence: Synthetic peptide
  Seed: RNQPLTFAL (PMEL_HUMAN)
RMQPLTFAF

SEQ ID NO: 135214 - protein, 10 aa, Artificial Sequence
  Description of Artificial Sequence: Synthetic peptide
  Seed: KVLPDGQVIW (PMEL_HUMAN)
KQLPDGQVIW

SEQ ID NO: 135215 - protein, 9 aa, Artificial Sequence
  Description of Artificial Sequence: Synthetic peptide
  Seed: VLPSPACQL (PMEL_HUMAN)
VFPSPACQM

SEQ ID NO: 135216 - protein, 9 aa, Artificial Sequence
  Description of Artificial Sequence: Synthetic peptide
  Seed: LIVGILLVL (PMEL_HUMAN)
LTVGILLVF

SEQ ID NO: 135217 - protein, 10 aa, Artificial Sequence
  Description of Artificial Sequence: Synthetic peptide
  Seed: RGSRSYVPLA (PMEL_HUMAN)
RSSRSYVPLR

SEQ ID NO: 135218 - protein, 10 aa, Artificial Sequence
  Description of Artificial Sequence: Synthetic peptide
  Seed: WKTWGQYWQV (PMEL_HUMAN)
WYTWGQYWQV

SEQ ID NO: 135219 - protein, 10 aa, Artificial Sequence
  Description of Artificial Sequence: Synthetic peptide
  Seed: ALLAVGATKV (PMEL_HUMAN)
AMLAVGATKV

SEQ ID NO: 135220 - protein, 9 aa, Artificial Sequence
  Description of Artificial Sequence: Synthetic peptide
  Seed: TLIGANASF (PMEL_HUMAN)
TQIGANASL

SEQ ID NO: 135221 - protein, 10 aa, Artificial Sequence
  Description of Artificial Sequence: Synthetic peptide
  Seed: HLAVIGALLA (PMEL_HUMAN)
HMAVIGALLL

SEQ ID NO: 135222 - protein, 9 aa, Artificial Sequence
  Description of Artificial Sequence: Synthetic peptide
  Seed: DQVPFSVSV (PMEL_HUMAN)
DTVPFSVST

SEQ ID NO: 135223 - protein, 9 aa, Artificial Sequence
  Description of Artificial Sequence: Synthetic peptide
  Seed: YWQVLGGPV (PMEL_HUMAN)
YYQVLGGPL

SEQ ID NO: 135224 - protein, 9 aa, Artificial Sequence
  Description of Artificial Sequence: Synthetic peptide
  Seed: AVIGALLAV (PMEL_HUMAN)
ATIGALLAY

SEQ ID NO: 135225 - protein, 9 aa, Artificial Sequence
  Description of Artificial Sequence: Synthetic peptide
  Seed: LHLAVIGAL (PMEL_HUMAN)
LLLAVIGAF

SEQ ID NO: 135226 - protein, 10 aa, Artificial Sequence
  Description of Artificial Sequence: Synthetic peptide
  Seed: MPTAESTGMT (PMEL_HUMAN)
MPTAESTGMV

SEQ ID NO: 135227 - protein, 10 aa, Artificial Sequence
  Description of Artificial Sequence: Synthetic peptide
  Seed: MTPAEVSIVV (PMEL_HUMAN)
MAPAEVSIVL

SEQ ID NO: 135228 - protein, 11 aa, Artificial Sequence
  Description of Artificial Sequence: Synthetic peptide
  Seed: SYVPLAHSSSA (PMEL_HUMAN)
SYVPLAHSSSF

SEQ ID NO: 135229 - protein, 9 aa, Artificial Sequence
  Description of Artificial Sequence: Synthetic peptide
  Seed: VTLDIVQGI (PMEL_HUMAN)
VMLDIVQGL

SEQ ID NO: 135230 - protein, 10 aa, Artificial Sequence
  Description of Artificial Sequence: Synthetic peptide
  Seed: VLYRYGSFSV (PMEL_HUMAN)
VSYRYGSFSK

SEQ ID NO: 135231 - protein, 9 aa, Artificial Sequence
  Description of Artificial Sequence: Synthetic peptide
  Seed: YLAEADLSY (PMEL_HUMAN)
YSAEADLSF

SEQ ID NO: 135232 - protein, 8 aa, Artificial Sequence
  Description of Artificial Sequence: Synthetic peptide
  Seed: FGDSSGTL (PMEL_HUMAN)
FTDSSGTV

SEQ ID NO: 135233 - protein, 9 aa, Artificial Sequence
  Description of Artificial Sequence: Synthetic peptide
  Seed: FTITDQVPF (PMEL_HUMAN)
FSITDQVPV

SEQ ID NO: 135234 - protein, 11 aa, Artificial Sequence
  Description of Artificial Sequence: Synthetic peptide
  Seed: TTAAQVTTTEW (PMEL_HUMAN)
TMAAQVTTTEW

SEQ ID NO: 135235 - protein, 9 aa, Artificial Sequence
  Description of Artificial Sequence: Synthetic peptide
  Seed: RLMKQDFSV (PMEL_HUMAN)
RSMKQDFSR

SEQ ID NO: 135236 - protein, 10 aa, Artificial Sequence
  Description of Artificial Sequence: Synthetic peptide
  Seed: YRYGSFSVTL (PMEL_HUMAN)
YFYGSFSVTV

SEQ ID NO: 135237 - protein, 9 aa, Artificial Sequence
  Description of Artificial Sequence: Synthetic peptide
  Seed: SQKRSFVYV (PMEL_HUMAN)
SVKRSFVYI

SEQ ID NO: 135238 - protein, 9 aa, Artificial Sequence
  Description of Artificial Sequence: Synthetic peptide
  Seed: KQDFSVPQL (PMEL_HUMAN)
KTDFSVPQI

SEQ ID NO: 135239 - protein, 9 aa, Artificial Sequence
  Description of Artificial Sequence: Synthetic peptide
  Seed: SGEGDAFEL (PMEL_HUMAN)
SFEGDAFEL

SEQ ID NO: 135240 - protein, 9 aa, Artificial Sequence
  Description of Artificial Sequence: Synthetic peptide
  Seed: SQVWGGQPV (PMEL_HUMAN)
SMVWGGQPL

SEQ ID NO: 135241 - protein, 9 aa, Artificial Sequence
  Description of Artificial Sequence: Synthetic peptide
  Seed: QVIWVNNTI (PMEL_HUMAN)
QMIWVNNTV

SEQ ID NO: 135242 - protein, 9 aa, Artificial Sequence
  Description of Artificial Sequence: Synthetic peptide
  Seed: SAFTITDQV (PMEL_HUMAN)
SAFTITDQL

SEQ ID NO: 135243 - protein, 8 aa, Artificial Sequence
  Description of Artificial Sequence: Synthetic peptide
  Seed: TGMTPEKV (PMEL_HUMAN)
TQMTPEKI

SEQ ID NO: 135244 - protein, 9 aa, Artificial Sequence
  Description of Artificial Sequence: Synthetic peptide
  Seed: DQVPFSVSV (PMEL_HUMAN)
DLVPFSVSV

SEQ ID NO: 135245 - protein, 9 aa, Artificial Sequence
  Description of Artificial Sequence: Synthetic peptide
  Seed: YRYGSFSVT (PMEL_HUMAN)
YHYGSFSVT

SEQ ID NO: 135246 - protein, 9 aa, Artificial Sequence
  Description of Artificial Sequence: Synthetic peptide
  Seed: YRYGSFSVT (PMEL_HUMAN)
YHYGSFSVM

SEQ ID NO: 135247 - protein, 9 aa, Artificial Sequence
  Description of Artificial Sequence: Synthetic peptide
  Seed: STAPVQMPT (PMEL_HUMAN)
SIAPVQMPL

SEQ ID NO: 135248 - protein, 9 aa, Artificial Sequence
  Description of Artificial Sequence: Synthetic peptide
  Seed: AEADLSYTW (PMEL_HUMAN)
ATADLSYTF

SEQ ID NO: 135249 - protein, 10 aa, Artificial Sequence
  Description of Artificial Sequence: Synthetic peptide
  Seed: MTPAEVSIVV (PMEL_HUMAN)
MMPAEVSIVI

SEQ ID NO: 135250 - protein, 10 aa, Artificial Sequence
  Description of Artificial Sequence: Synthetic peptide
  Seed: GPLLDGTATL (PMEL_HUMAN)
GQLLDGTATV

SEQ ID NO: 135251 - protein, 10 aa, Artificial Sequence
  Description of Artificial Sequence: Synthetic peptide
  Seed: EVMGTTLAEM (PMEL_HUMAN)
EIMGTTLAEK

SEQ ID NO: 135252 - protein, 9 aa, Artificial Sequence
  Description of Artificial Sequence: Synthetic peptide
  Seed: LPDGQVIWV (PMEL_HUMAN)
LMDGQVIWI

SEQ ID NO: 135253 - protein, 9 aa, Artificial Sequence
  Description of Artificial Sequence: Synthetic peptide
  Seed: LADTNSLAV (PMEL_HUMAN)
LVDTNSLAY

SEQ ID NO: 135254 - protein, 9 aa, Artificial Sequence
  Description of Artificial Sequence: Synthetic peptide
  Seed: SVPQLPHSS (PMEL_HUMAN)
SMPQLPHSL

SEQ ID NO: 135255 - protein, 10 aa, Artificial Sequence
  Description of Artificial Sequence: Synthetic peptide
  Seed: ESITGSLGPL (PMEL_HUMAN)
EMITGSLGPK

SEQ ID NO: 135256 - protein, 10 aa, Artificial Sequence
  Description of Artificial Sequence: Synthetic peptide
  Seed: VTAQVVLQAA (PMEL_HUMAN)
VMAQVVLQAL

SEQ ID NO: 135257 - protein, 11 aa, Artificial Sequence
  Description of Artificial Sequence: Synthetic peptide
  Seed: AEADLSYTWDF (PMEL_HUMAN)
AEADLSYTWDY

SEQ ID NO: 135258 - protein, 11 aa, Artificial Sequence
  Description of Artificial Sequence: Synthetic peptide
  Seed: RTKAWNRQLYP (PMEL_HUMAN)
RAKAWNRQLYA

SEQ ID NO: 135259 - protein, 9 aa, Artificial Sequence
  Description of Artificial Sequence: Synthetic peptide
  Seed: YVWKTWGQY (PMEL_HUMAN)
YSWKTWGQW

SEQ ID NO: 135260 - protein, 9 aa, Artificial Sequence
  Description of Artificial Sequence: Synthetic peptide
  Seed: RSYVPLAHS (PMEL_HUMAN)
RMYVPLAHK

SEQ ID NO: 135261 - protein, 9 aa, Artificial Sequence
  Description of Artificial Sequence: Synthetic peptide
  Seed: EPGPVTAQV (PMEL_HUMAN)
EAGPVTAQI

SEQ ID NO: 135262 - protein, 9 aa, Artificial Sequence
  Description of Artificial Sequence: Synthetic peptide
  Seed: VPFSVSVSQ (PMEL_HUMAN)
VPFSVSVSW

SEQ ID NO: 135263 - protein, 10 aa, Artificial Sequence
  Description of Artificial Sequence: Synthetic peptide
  Seed: YVPLAHSSSA (PMEL_HUMAN)
YTPLAHSSSM

SEQ ID NO: 135264 - protein, 10 aa, Artificial Sequence
  Description of Artificial Sequence: Synthetic peptide
  Seed: MTPAEVSIVV (PMEL_HUMAN)
MSPAEVSIVF

SEQ ID NO: 135265 - protein, 9 aa, Artificial Sequence
  Description of Artificial Sequence: Synthetic peptide
  Seed: AQVVLQAAI (PMEL_HUMAN)
AIVVLQAAF

SEQ ID NO: 135266 - protein, 9 aa, Artificial Sequence
  Description of Artificial Sequence: Synthetic peptide
  Seed: SYVPLAHSS (PMEL_HUMAN)
SYVPLAHSL

SEQ ID NO: 135267 - protein, 9 aa, Artificial Sequence
  Description of Artificial Sequence: Synthetic peptide
  Seed: LPKEACMEI (PMEL_HUMAN)
LAKEACMEY

SEQ ID NO: 135268 - protein, 9 aa, Artificial Sequence
  Description of Artificial Sequence: Synthetic peptide
  Seed: AQRLCQPVL (PMEL_HUMAN)
ATRLCQPVL

SEQ ID NO: 135269 - protein, 9 aa, Artificial Sequence
  Description of Artificial Sequence: Synthetic peptide
  Seed: DQVPFSVSV (PMEL_HUMAN)
DEVPFSVSM

SEQ ID NO: 135270 - protein, 8 aa, Artificial Sequence
  Description of Artificial Sequence: Synthetic peptide
  Seed: LIYRRRLM (PMEL_HUMAN)
LPYRRRLM

SEQ ID NO: 135271 - protein, 10 aa, Artificial Sequence
  Description of Artificial Sequence: Synthetic peptide
  Seed: FSVSVSQLRA (PMEL_HUMAN)
FPVSVSQLRR

SEQ ID NO: 135272 - protein, 10 aa, Artificial Sequence
  Description of Artificial Sequence: Synthetic peptide
  Seed: SLADTNSLAV (PMEL_HUMAN)
SFADTNSLAL

SEQ ID NO: 135273 - protein, 9 aa, Artificial Sequence
  Description of Artificial Sequence: Synthetic peptide
  Seed: LMAVVLASL (PMEL_HUMAN)
LIAVVLASY

SEQ ID NO: 135274 - protein, 9 aa, Artificial Sequence
  Description of Artificial Sequence: Synthetic peptide
  Seed: RGGQVSLKV (PMEL_HUMAN)
RVGQVSLKI

SEQ ID NO: 135275 - protein, 10 aa, Artificial Sequence
  Description of Artificial Sequence: Synthetic peptide
  Seed: LAVIGALLAV (PMEL_HUMAN)
LIVIGALLAA

SEQ ID NO: 135276 - protein, 10 aa, Artificial Sequence
  Description of Artificial Sequence: Synthetic peptide
  Seed: GPLLDGTATL (PMEL_HUMAN)
GCLLDGTATI

SEQ ID NO: 135277 - protein, 10 aa, Artificial Sequence
  Description of Artificial Sequence: Synthetic peptide
  Seed: VSLADTNSLA (PMEL_HUMAN)
VYLADTNSLL

SEQ ID NO: 135278 - protein, 9 aa, Artificial Sequence
  Description of Artificial Sequence: Synthetic peptide
  Seed: RYGSFSVTL (PMEL_HUMAN)
RGGSFSVTY

SEQ ID NO: 135279 - protein, 11 aa, Artificial Sequence
  Description of Artificial Sequence: Synthetic peptide
  Seed: ISRALVVTHTY (PMEL_HUMAN)
IMRALVVTHTW

SEQ ID NO: 135280 - protein, 9 aa, Artificial Sequence
  Description of Artificial Sequence: Synthetic peptide
  Seed: KVLPDGQVI (PMEL_HUMAN)
KMLPDGQVM

SEQ ID NO: 135281 - protein, 9 aa, Artificial Sequence
  Description of Artificial Sequence: Synthetic peptide
  Seed: AEILQAVPS (PMEL_HUMAN)
AEILQAVPI

SEQ ID NO: 135282 - protein, 9 aa, Artificial Sequence
  Description of Artificial Sequence: Synthetic peptide
  Seed: DQVPFSVSV (PMEL_HUMAN)
DRVPFSVSI

SEQ ID NO: 135283 - protein, 9 aa, Artificial Sequence
  Description of Artificial Sequence: Synthetic peptide
  Seed: SSPGCQPPA (PMEL_HUMAN)
SQPGCQPPV

SEQ ID NO: 135284 - protein, 9 aa, Artificial Sequence
  Description of Artificial Sequence: Synthetic peptide
  Seed: SSIMSTESI (PMEL_HUMAN)
SVIMSTESL

SEQ ID NO: 135285 - protein, 9 aa, Artificial Sequence
  Description of Artificial Sequence: Synthetic peptide
  Seed: ATGMTPAEV (PMEL_HUMAN)
AAGMTPAEM

SEQ ID NO: 135286 - protein, 10 aa, Artificial Sequence
  Description of Artificial Sequence: Synthetic peptide
  Seed: AVIGALLAVG (PMEL_HUMAN)
AVIGALLAVC

SEQ ID NO: 135287 - protein, 9 aa, Artificial Sequence
  Description of Artificial Sequence: Synthetic peptide
  Seed: LYPEWTEAQ (PMEL_HUMAN)
LWPEWTEAF

SEQ ID NO: 135288 - protein, 10 aa, Artificial Sequence
  Description of Artificial Sequence: Synthetic peptide
  Seed: GPLLDGTATL (PMEL_HUMAN)
GYLLDGTATA

SEQ ID NO: 135289 - protein, 11 aa, Artificial Sequence
  Description of Artificial Sequence: Synthetic peptide
  Seed: KVLPDGQVIWV (PMEL_HUMAN)
KLLPDGQVIWI

SEQ ID NO: 135290 - protein, 9 aa, Artificial Sequence
  Description of Artificial Sequence: Synthetic peptide
  Seed: GQVPTTEVV (PMEL_HUMAN)
GLVPTTEVY

SEQ ID NO: 135291 - protein, 9 aa, Artificial Sequence
  Description of Artificial Sequence: Synthetic peptide
  Seed: VLGGPVSGL (PMEL_HUMAN)
VLGGPVSGY

SEQ ID NO: 135292 - protein, 9 aa, Artificial Sequence
  Description of Artificial Sequence: Synthetic peptide
  Seed: VISTAPVQM (PMEL_HUMAN)
VMSTAPVQV

SEQ ID NO: 135293 - protein, 9 aa, Artificial Sequence
  Description of Artificial Sequence: Synthetic peptide
  Seed: DQVPFSVSV (PMEL_HUMAN)
DHVPFSVSV

SEQ ID NO: 135294 - protein, 11 aa, Artificial Sequence
  Description of Artificial Sequence: Synthetic peptide
  Seed: RALDGGNKHFL (PMEL_HUMAN)
RILDGGNKHFF

SEQ ID NO: 135295 - protein, 10 aa, Artificial Sequence
  Description of Artificial Sequence: Synthetic peptide
  Seed: EVSIVVLSGT (PMEL_HUMAN)
EVSIVVLSGA

SEQ ID NO: 135296 - protein, 10 aa, Artificial Sequence
  Description of Artificial Sequence: Synthetic peptide
  Seed: THTMEVTVYH (PMEL_HUMAN)
TATMEVTVYR

SEQ ID NO: 135297 - protein, 9 aa, Artificial Sequence
  Description of Artificial Sequence: Synthetic peptide
  Seed: GGPVSGLSI (PMEL_HUMAN)
GYPVSGLSF

SEQ ID NO: 135298 - protein, 9 aa, Artificial Sequence
  Description of Artificial Sequence: Synthetic peptide
  Seed: FLRNQPLTF (PMEL_HUMAN)
FGRNQPLTY

SEQ ID NO: 135299 - protein, 9 aa, Artificial Sequence
  Description of Artificial Sequence: Synthetic peptide
  Seed: MAVVLASLI (PMEL_HUMAN)
MCVVLASLW

SEQ ID NO: 135300 - protein, 10 aa, Artificial Sequence
  Description of Artificial Sequence: Synthetic peptide
  Seed: RALVVTHTYL (PMEL_HUMAN)
RLLVVTHTYM

SEQ ID NO: 135301 - protein, 9 aa, Artificial Sequence
  Description of Artificial Sequence: Synthetic peptide
  Seed: LPDGQVIWV (PMEL_HUMAN)
LADGQVIWL

SEQ ID NO: 135302 - protein, 9 aa, Artificial Sequence
  Description of Artificial Sequence: Synthetic peptide
  Seed: ANASFSIAL (PMEL_HUMAN)
ASASFSIAF

SEQ ID NO: 135303 - protein, 10 aa, Artificial Sequence
  Description of Artificial Sequence: Synthetic peptide
  Seed: LMAVVLASLI (PMEL_HUMAN)
LLAVVLASLT

SEQ ID NO: 135304 - protein, 10 aa, Artificial Sequence
  Description of Artificial Sequence: Synthetic peptide
  Seed: YRYGSFSVTL (PMEL_HUMAN)
YGYGSFSVTW

SEQ ID NO: 135305 - protein, 9 aa, Artificial Sequence
  Description of Artificial Sequence: Synthetic peptide
  Seed: VLKRCLLHL (PMEL_HUMAN)
VMKRCLLHW

SEQ ID NO: 135306 - protein, 10 aa, Artificial Sequence
  Description of Artificial Sequence: Synthetic peptide
  Seed: VLYRYGSFSV (PMEL_HUMAN)
VLYRYGSFSM

SEQ ID NO: 135307 - protein, 9 aa, Artificial Sequence
  Description of Artificial Sequence: Synthetic peptide
  Seed: GQVPTTEVV (PMEL_HUMAN)
GMVPTTEVI

SEQ ID NO: 135308 - protein, 10 aa, Artificial Sequence
  Description of Artificial Sequence: Synthetic peptide
  Seed: SSSHWLRLPR (PMEL_HUMAN)
SLSHWLRLPR

SEQ ID NO: 135309 - protein, 9 aa, Artificial Sequence
  Description of Artificial Sequence: Synthetic peptide
  Seed: LNFPGSQKV (PMEL_HUMAN)
LAFPGSQKF

SEQ ID NO: 135310 - protein, 9 aa, Artificial Sequence
  Description of Artificial Sequence: Synthetic peptide
  Seed: AGLGQVPLI (PMEL_HUMAN)
AILGQVPLI

SEQ ID NO: 135311 - protein, 9 aa, Artificial Sequence
  Description of Artificial Sequence: Synthetic peptide
  Seed: QVWGGQPVY (PMEL_HUMAN)
QIWGGQPVW

SEQ ID NO: 135312 - protein, 9 aa, Artificial Sequence
  Description of Artificial Sequence: Synthetic peptide
  Seed: VVLQAAIPL (PMEL_HUMAN)
VSLQAAIPM

SEQ ID NO: 135313 - protein, 9 aa, Artificial Sequence
  Description of Artificial Sequence: Synthetic peptide
  Seed: RSYVPLAHS (PMEL_HUMAN)
RSYVPLAHV

SEQ ID NO: 135314 - protein, 9 aa, Artificial Sequence
  Description of Artificial Sequence: Synthetic peptide
  Seed: KTWGQYWQV (PMEL_HUMAN)
KHWGQYWQY

SEQ ID NO: 135315 - protein, 10 aa, Artificial Sequence
  Description of Artificial Sequence: Synthetic peptide
  Seed: EVMGTTLAEM (PMEL_HUMAN)
ETMGTTLAEI

SEQ ID NO: 135316 - protein, 9 aa, Artificial Sequence
  Description of Artificial Sequence: Synthetic peptide
  Seed: VLKRCLLHL (PMEL_HUMAN)
VQKRCLLHY

SEQ ID NO: 135317 - protein, 9 aa, Artificial Sequence
  Description of Artificial Sequence: Synthetic peptide
  Seed: RQVPLDCVL (PMEL_HUMAN)
RLVPLDCVI

SEQ ID NO: 135318 - protein, 9 aa, Artificial Sequence
  Description of Artificial Sequence: Synthetic peptide
  Seed: YLEPGPVTA (PMEL_HUMAN)
YGEPGPVTI

SEQ ID NO: 135319 - protein, 9 aa, Artificial Sequence
  Description of Artificial Sequence: Synthetic peptide
  Seed: VSVSQLRAL (PMEL_HUMAN)
VQVSQLRAY

SEQ ID NO: 135320 - protein, 9 aa, Artificial Sequence
  Description of Artificial Sequence: Synthetic peptide
  Seed: RNQPLTFAL (PMEL_HUMAN)
RLQPLTFAI

SEQ ID NO: 135321 - protein, 10 aa, Artificial Sequence
  Description of Artificial Sequence: Synthetic peptide
  Seed: RYGSFSVTLD (PMEL_HUMAN)
RYGSFSVTLI

SEQ ID NO: 135322 - protein, 9 aa, Artificial Sequence
  Description of Artificial Sequence: Synthetic peptide
  Seed: DAFELTVSC (PMEL_HUMAN)
DHFELTVSM

SEQ ID NO: 135323 - protein, 9 aa, Artificial Sequence
  Description of Artificial Sequence: Synthetic peptide
  Seed: AQVTTTEWV (PMEL_HUMAN)
AMVTTTEWI

SEQ ID NO: 135324 - protein, 10 aa, Artificial Sequence
  Description of Artificial Sequence: Synthetic peptide
  Seed: LMAVVLASLI (PMEL_HUMAN)
LLAVVLASLE

SEQ ID NO: 135325 - protein, 9 aa, Artificial Sequence
  Description of Artificial Sequence: Synthetic peptide
  Seed: VISTAPVQM (PMEL_HUMAN)
VTSTAPVQM

SEQ ID NO: 135326 - protein, 10 aa, Artificial Sequence
  Description of Artificial Sequence: Synthetic peptide
  Seed: VLPSPACQLV (PMEL_HUMAN)
VSPSPACQLL

SEQ ID NO: 135327 - protein, 9 aa, Artificial Sequence
  Description of Artificial Sequence: Synthetic peptide
  Seed: AVVLASLIY (PMEL_HUMAN)
AQVLASLIF

SEQ ID NO: 135328 - protein, 9 aa, Artificial Sequence
  Description of Artificial Sequence: Synthetic peptide
  Seed: CPSGSWSQK (PMEL_HUMAN)
CVSGSWSQR

SEQ ID NO: 135329 - protein, 10 aa, Artificial Sequence
  Description of Artificial Sequence: Synthetic peptide
  Seed: GQVIWVNNTI (PMEL_HUMAN)
GVVIWVNNTV

SEQ ID NO: 135330 - protein, 10 aa, Artificial Sequence
  Description of Artificial Sequence: Synthetic peptide
  Seed: MPTAESTGMT (PMEL_HUMAN)
MTTAESTGMI

SEQ ID NO: 135331 - protein, 8 aa, Artificial Sequence
  Description of Artificial Sequence: Synthetic peptide
  Seed: FGDSSGTL (PMEL_HUMAN)
FTDSSGTF

SEQ ID NO: 135332 - protein, 9 aa, Artificial Sequence
  Description of Artificial Sequence: Synthetic peptide
  Seed: LAVGATKVP (PMEL_HUMAN)
LAVGATKVM

SEQ ID NO: 135333 - protein, 10 aa, Artificial Sequence
  Description of Artificial Sequence: Synthetic peptide
  Seed: CQLVLHQILK (PMEL_HUMAN)
CTLVLHQILR

SEQ ID NO: 135334 - protein, 9 aa, Artificial Sequence
  Description of Artificial Sequence: Synthetic peptide
  Seed: KHFLRNQPL (PMEL_HUMAN)
KFFLRNQPY

SEQ ID NO: 135335 - protein, 10 aa, Artificial Sequence
  Description of Artificial Sequence: Synthetic peptide
  Seed: MPTAESTGMT (PMEL_HUMAN)
MWTAESTGMA

SEQ ID NO: 135336 - protein, 9 aa, Artificial Sequence
  Description of Artificial Sequence: Synthetic peptide
  Seed: MLGTHTMEV (PMEL_HUMAN)
MLGTHTMEM

SEQ ID NO: 135337 - protein, 10 aa, Artificial Sequence
  Description of Artificial Sequence: Synthetic peptide
  Seed: YVPLAHSSSA (PMEL_HUMAN)
YFPLAHSSSV

SEQ ID NO: 135338 - protein, 9 aa, Artificial Sequence
  Description of Artificial Sequence: Synthetic peptide
  Seed: RQVPLDCVL (PMEL_HUMAN)
RQVPLDCVM

SEQ ID NO: 135339 - protein, 9 aa, Artificial Sequence
  Description of Artificial Sequence: Synthetic peptide
  Seed: KHFLRNQPL (PMEL_HUMAN)
KMFLRNQPM

SEQ ID NO: 135340 - protein, 9 aa, Artificial Sequence
  Description of Artificial Sequence: Synthetic peptide
  Seed: RLVKRQVPL (PMEL_HUMAN)
RTVKRQVPK

SEQ ID NO: 135341 - protein, 10 aa, Artificial Sequence
  Description of Artificial Sequence: Synthetic peptide
  Seed: HTMEVTVYHR (PMEL_HUMAN)
HSMEVTVYHR

SEQ ID NO: 135342 - protein, 10 aa, Artificial Sequence
  Description of Artificial Sequence: Synthetic peptide
  Seed: LGQVPLIVGI (PMEL_HUMAN)
LAQVPLIVGV

SEQ ID NO: 135343 - protein, 10 aa, Artificial Sequence
  Description of Artificial Sequence: Synthetic peptide
  Seed: GQVPLIVGIL (PMEL_HUMAN)
GMVPLIVGIF

SEQ ID NO: 135344 - protein, 11 aa, Artificial Sequence
  Description of Artificial Sequence: Synthetic peptide
  Seed: LVLMAVVLASL (PMEL_HUMAN)
LKLMAVVLASV

SEQ ID NO: 135345 - protein, 9 aa, Artificial Sequence
  Description of Artificial Sequence: Synthetic peptide
  Seed: AVIGALLAV (PMEL_HUMAN)
ALIGALLAS

SEQ ID NO: 135346 - protein, 10 aa, Artificial Sequence
  Description of Artificial Sequence: Synthetic peptide
  Seed: SCPIGENSPL (PMEL_HUMAN)
SFPIGENSPM

SEQ ID NO: 135347 - protein, 9 aa, Artificial Sequence
  Description of Artificial Sequence: Synthetic peptide
  Seed: RPTAEAPNT (PMEL_HUMAN)
RPTAEAPNM

SEQ ID NO: 135348 - protein, 9 aa, Artificial Sequence
  Description of Artificial Sequence: Synthetic peptide
  Seed: AQRLCQPVL (PMEL_HUMAN)
AKRLCQPVM

SEQ ID NO: 135349 - protein, 9 aa, Artificial Sequence
  Description of Artificial Sequence: Synthetic peptide
  Seed: TYLEPGPVT (PMEL_HUMAN)
TYLEPGPVY

SEQ ID NO: 135350 - protein, 9 aa, Artificial Sequence
  Description of Artificial Sequence: Synthetic peptide
  Seed: SQKRSFVYV (PMEL_HUMAN)
STKRSFVYP

SEQ ID NO: 135351 - protein, 10 aa, Artificial Sequence
  Description of Artificial Sequence: Synthetic peptide
  Seed: YVPLAHSSSA (PMEL_HUMAN)
YVPLAHSSSL

SEQ ID NO: 135352 - protein, 10 aa, Artificial Sequence
  Description of Artificial Sequence: Synthetic peptide
  Seed: MTPAEVSIVV (PMEL_HUMAN)
MLPAEVSIVV

SEQ ID NO: 135353 - protein, 9 aa, Artificial Sequence
  Description of Artificial Sequence: Synthetic peptide
  Seed: TTTEWVETT (PMEL_HUMAN)
TITEWVETV

SEQ ID NO: 135354 - protein, 10 aa, Artificial Sequence
  Description of Artificial Sequence: Synthetic peptide
  Seed: VLMAVVLASL (PMEL_HUMAN)
VEMAVVLASV

SEQ ID NO: 135355 - protein, 10 aa, Artificial Sequence
  Description of Artificial Sequence: Synthetic peptide
  Seed: AFTITDQVPF (PMEL_HUMAN)
AQTITDQVPF

SEQ ID NO: 135356 - protein, 9 aa, Artificial Sequence
  Description of Artificial Sequence: Synthetic peptide
  Seed: VLPSPACQL (PMEL_HUMAN)
VPPSPACQY

SEQ ID NO: 135357 - protein, 11 aa, Artificial Sequence
  Description of Artificial Sequence: Synthetic peptide
  Seed: AEMSTPEATGM (PMEL_HUMAN)
AQMSTPEATGF

SEQ ID NO: 135358 - protein, 9 aa, Artificial Sequence
  Description of Artificial Sequence: Synthetic peptide
  Seed: AAQVTTTEW (PMEL_HUMAN)
AQQVTTTEF

SEQ ID NO: 135359 - protein, 9 aa, Artificial Sequence
  Description of Artificial Sequence: Synthetic peptide
  Seed: SRALVVTHT (PMEL_HUMAN)
SHALVVTHV

SEQ ID NO: 135360 - protein, 9 aa, Artificial Sequence
  Description of Artificial Sequence: Synthetic peptide
  Seed: LMAVVLASL (PMEL_HUMAN)
LAAVVLASL

SEQ ID NO: 135361 - protein, 9 aa, Artificial Sequence
  Description of Artificial Sequence: Synthetic peptide
  Seed: AAQVTTTEW (PMEL_HUMAN)
APQVTTTEW

SEQ ID NO: 135362 - protein, 10 aa, Artificial Sequence
  Description of Artificial Sequence: Synthetic peptide
  Seed: SGTYCLNVSL (PMEL_HUMAN)
SWTYCLNVSF

SEQ ID NO: 135363 - protein, 9 aa, Artificial Sequence
  Description of Artificial Sequence: Synthetic peptide
  Seed: AVVSTQLIM (PMEL_HUMAN)
AAVSTQLIW

SEQ ID NO: 135364 - protein, 10 aa, Artificial Sequence
  Description of Artificial Sequence: Synthetic peptide
  Seed: VLSGTTAAQV (PMEL_HUMAN)
VLSGTTAAQI

SEQ ID NO: 135365 - protein, 10 aa, Artificial Sequence
  Description of Artificial Sequence: Synthetic peptide
  Seed: YRYGSFSVTL (PMEL_HUMAN)
YAYGSFSVTW

SEQ ID NO: 135366 - protein, 10 aa, Artificial Sequence
  Description of Artificial Sequence: Synthetic peptide
  Seed: VLPSPACQLV (PMEL_HUMAN)
VAPSPACQLL

SEQ ID NO: 135367 - protein, 9 aa, Artificial Sequence
  Description of Artificial Sequence: Synthetic peptide
  Seed: RAMLGTHTM (PMEL_HUMAN)
RRMLGTHTV

SEQ ID NO: 135368 - protein, 10 aa, Artificial Sequence
  Description of Artificial Sequence: Synthetic peptide
  Seed: MPTAESTGMT (PMEL_HUMAN)
MMTAESTGMI

SEQ ID NO: 135369 - protein, 9 aa, Artificial Sequence
  Description of Artificial Sequence: Synthetic peptide
  Seed: AEPSGTTSV (PMEL_HUMAN)
ATPSGTTSY

SEQ ID NO: 135370 - protein, 10 aa, Artificial Sequence
  Description of Artificial Sequence: Synthetic peptide
  Seed: AVIGALLAVG (PMEL_HUMAN)
AIIGALLAVL

SEQ ID NO: 135371 - protein, 9 aa, Artificial Sequence
  Description of Artificial Sequence: Synthetic peptide
  Seed: KTWGQYWQV (PMEL_HUMAN)
KYWGQYWQM

SEQ ID NO: 135372 - protein, 11 aa, Artificial Sequence
  Description of Artificial Sequence: Synthetic peptide
  Seed: ISRALVVTHTY (PMEL_HUMAN)
IRRALVVTHTW

SEQ ID NO: 135373 - protein, 10 aa, Artificial Sequence
  Description of Artificial Sequence: Synthetic peptide
  Seed: LRLVKRQVPL (PMEL_HUMAN)
LMLVKRQVPV

SEQ ID NO: 135374 - protein, 11 aa, Artificial Sequence
  Description of Artificial Sequence: Synthetic peptide
  Seed: SQKRSFVYVWK (PMEL_HUMAN)
SAKRSFVYVWK

SEQ ID NO: 135375 - protein, 9 aa, Artificial Sequence
  Description of Artificial Sequence: Synthetic peptide
  Seed: MTPEKVPVS (PMEL_HUMAN)
MTPEKVPVF

SEQ ID NO: 135376 - protein, 9 aa, Artificial Sequence
  Description of Artificial Sequence: Synthetic peptide
  Seed: LNFPGSQKV (PMEL_HUMAN)
LQFPGSQKA

SEQ ID NO: 135377 - protein, 11 aa, Artificial Sequence
  Description of Artificial Sequence: Synthetic peptide
  Seed: LVLMAVVLASL (PMEL_HUMAN)
LYLMAVVLASV

SEQ ID NO: 135378 - protein, 9 aa, Artificial Sequence
  Description of Artificial Sequence: Synthetic peptide
  Seed: RTKAWNRQL (PMEL_HUMAN)
RSKAWNRQY

SEQ ID NO: 135379 - protein, 10 aa, Artificial Sequence
  Description of Artificial Sequence: Synthetic peptide
  Seed: RGSRSYVPLA (PMEL_HUMAN)
RYSRSYVPLQ

SEQ ID NO: 135380 - protein, 9 aa, Artificial Sequence
  Description of Artificial Sequence: Synthetic peptide
  Seed: LIVGILLVL (PMEL_HUMAN)
LSVGILLVV

SEQ ID NO: 135381 - protein, 9 aa, Artificial Sequence
  Description of Artificial Sequence: Synthetic peptide
  Seed: LQAAIPLTS (PMEL_HUMAN)
LHAAIPLTM

SEQ ID NO: 135382 - protein, 9 aa, Artificial Sequence
  Description of Artificial Sequence: Synthetic peptide
  Seed: AEPSGTTSV (PMEL_HUMAN)
AMPSGTTSI

SEQ ID NO: 135383 - protein, 10 aa, Artificial Sequence
  Description of Artificial Sequence: Synthetic peptide
  Seed: YRYGSFSVTL (PMEL_HUMAN)
YWYGSFSVTW

SEQ ID NO: 135384 - protein, 9 aa, Artificial Sequence
  Description of Artificial Sequence: Synthetic peptide
  Seed: VLPSPACQL (PMEL_HUMAN)
VRPSPACQF

SEQ ID NO: 135385 - protein, 10 aa, Artificial Sequence
  Description of Artificial Sequence: Synthetic peptide
  Seed: ASSIMSTESI (PMEL_HUMAN)
AYSIMSTESF

SEQ ID NO: 135386 - protein, 11 aa, Artificial Sequence
  Description of Artificial Sequence: Synthetic peptide
  Seed: TEWVETTAREL (PMEL_HUMAN)
TEWVETTAREY

SEQ ID NO: 135387 - protein, 10 aa, Artificial Sequence
  Description of Artificial Sequence: Synthetic peptide
  Seed: RQLRTKAWNR (PMEL_HUMAN)
RGLRTKAWNR

SEQ ID NO: 135388 - protein, 10 aa, Artificial Sequence
  Description of Artificial Sequence: Synthetic peptide
  Seed: KTWGQYWQVL (PMEL_HUMAN)
KFWGQYWQVW

SEQ ID NO: 135389 - protein, 9 aa, Artificial Sequence
  Description of Artificial Sequence: Synthetic peptide
  Seed: FGDSSGTLI (PMEL_HUMAN)
FLDSSGTLI

SEQ ID NO: 135390 - protein, 9 aa, Artificial Sequence
  Description of Artificial Sequence: Synthetic peptide
  Seed: DAFELTVSC (PMEL_HUMAN)
DIFELTVSY

SEQ ID NO: 135391 - protein, 9 aa, Artificial Sequence
  Description of Artificial Sequence: Synthetic peptide
  Seed: KVSNDGPTL (PMEL_HUMAN)
KISNDGPTI

SEQ ID NO: 135392 - protein, 8 aa, Artificial Sequence
  Description of Artificial Sequence: Synthetic peptide
  Seed: LHDPSGYL (PMEL_HUMAN)
LYDPSGYF

SEQ ID NO: 135393 - protein, 8 aa, Artificial Sequence
  Description of Artificial Sequence: Synthetic peptide
  Seed: YGSFSVTL (PMEL_HUMAN)
YASFSVTY

SEQ ID NO: 135394 - protein, 10 aa, Artificial Sequence
  Description of Artificial Sequence: Synthetic peptide
  Seed: RPTAEAPNTT (PMEL_HUMAN)
RPTAEAPNTA

SEQ ID NO: 135395 - protein, 10 aa, Artificial Sequence
  Description of Artificial Sequence: Synthetic peptide
  Seed: VPLAHSSSAF (PMEL_HUMAN)
VMLAHSSSAM

SEQ ID NO: 135396 - protein, 9 aa, Artificial Sequence
  Description of Artificial Sequence: Synthetic peptide
  Seed: VQVPTTEVI (PMEL_HUMAN)
VSVPTTEVI

SEQ ID NO: 135397 - protein, 9 aa, Artificial Sequence
  Description of Artificial Sequence: Synthetic peptide
  Seed: YHRRGSRSY (PMEL_HUMAN)
YYRRGSRSY

SEQ ID NO: 135398 - protein, 9 aa, Artificial Sequence
  Description of Artificial Sequence: Synthetic peptide
  Seed: NQDWLGVSR (PMEL_HUMAN)
NLDWLGVSY

SEQ ID NO: 135399 - protein, 9 aa, Artificial Sequence
  Description of Artificial Sequence: Synthetic peptide
  Seed: RTKAWNRQL (PMEL_HUMAN)
RQKAWNRQY

SEQ ID NO: 135400 - protein, 10 aa, Artificial Sequence
  Description of Artificial Sequence: Synthetic peptide
  Seed: VPQLPHSSSH (PMEL_HUMAN)
VYQLPHSSSL

SEQ ID NO: 135401 - protein, 11 aa, Artificial Sequence
  Description of Artificial Sequence: Synthetic peptide
  Seed: AEAPNTTAGQV (PMEL_HUMAN)
AEAPNTTAGQI

SEQ ID NO: 135402 - protein, 9 aa, Artificial Sequence
  Description of Artificial Sequence: Synthetic peptide
  Seed: LNFPGSQKV (PMEL_HUMAN)
LQFPGSQKF

SEQ ID NO: 135403 - protein, 10 aa, Artificial Sequence
  Description of Artificial Sequence: Synthetic peptide
  Seed: LQLHDPSGYL (PMEL_HUMAN)
LLLHDPSGYF

SEQ ID NO: 135404 - protein, 9 aa, Artificial Sequence
  Description of Artificial Sequence: Synthetic peptide
  Seed: HTMEVTVYH (PMEL_HUMAN)
HQMEVTVYF

SEQ ID NO: 135405 - protein, 10 aa, Artificial Sequence
  Description of Artificial Sequence: Synthetic peptide
  Seed: LVLMAVVLAS (PMEL_HUMAN)
LRLMAVVLAV

SEQ ID NO: 135406 - protein, 9 aa, Artificial Sequence
  Description of Artificial Sequence: Synthetic peptide
  Seed: TLIGANASF (PMEL_HUMAN)
TIIGANASY

SEQ ID NO: 135407 - protein, 11 aa, Artificial Sequence
  Description of Artificial Sequence: Synthetic peptide
  Seed: APNTTAGQVPT (PMEL_HUMAN)
APNTTAGQVPM

SEQ ID NO: 135408 - protein, 11 aa, Artificial Sequence
  Description of Artificial Sequence: Synthetic peptide
  Seed: ISRALVVTHTY (PMEL_HUMAN)
IERALVVTHTW

SEQ ID NO: 135409 - protein, 10 aa, Artificial Sequence
  Description of Artificial Sequence: Synthetic peptide
  Seed: MTPAEVSIVV (PMEL_HUMAN)
MLPAEVSIVF

SEQ ID NO: 135410 - protein, 9 aa, Artificial Sequence
  Description of Artificial Sequence: Synthetic peptide
  Seed: YLEPGPVTA (PMEL_HUMAN)
YGEPGPVTM

SEQ ID NO: 135411 - protein, 10 aa, Artificial Sequence
  Description of Artificial Sequence: Synthetic peptide
  Seed: KVLPDGQVIW (PMEL_HUMAN)
KLLPDGQVIF

SEQ ID NO: 135412 - protein, 9 aa, Artificial Sequence
  Description of Artificial Sequence: Synthetic peptide
  Seed: ITDQVPFSV (PMEL_HUMAN)
IVDQVPFSF

SEQ ID NO: 135413 - protein, 9 aa, Artificial Sequence
  Description of Artificial Sequence: Synthetic peptide
  Seed: SLAVVSTQL (PMEL_HUMAN)
SIAVVSTQY

SEQ ID NO: 135414 - protein, 10 aa, Artificial Sequence
  Description of Artificial Sequence: Synthetic peptide
  Seed: TLISRALVVT (PMEL_HUMAN)
TIISRALVVV

SEQ ID NO: 135415 - protein, 9 aa, Artificial Sequence
  Description of Artificial Sequence: Synthetic peptide
  Seed: LYRYGSFSV (PMEL_HUMAN)
LVRYGSFSK

SEQ ID NO: 135416 - protein, 11 aa, Artificial Sequence
  Description of Artificial Sequence: Synthetic peptide
  Seed: AEAPNTTAGQV (PMEL_HUMAN)
AEAPNTTAGQA

SEQ ID NO: 135417 - protein, 9 aa, Artificial Sequence
  Description of Artificial Sequence: Synthetic peptide
  Seed: EGDAFELTV (PMEL_HUMAN)
EMDAFELTM

SEQ ID NO: 135418 - protein, 9 aa, Artificial Sequence
  Description of Artificial Sequence: Synthetic peptide
  Seed: KHFLRNQPL (PMEL_HUMAN)
KQFLRNQPI

SEQ ID NO: 135419 - protein, 11 aa, Artificial Sequence
  Description of Artificial Sequence: Synthetic peptide
  Seed: RLPRIFCSCPI (PMEL_HUMAN)
RSPRIFCSCPL

SEQ ID NO: 135420 - protein, 9 aa, Artificial Sequence
  Description of Artificial Sequence: Synthetic peptide
  Seed: RAMLGTHTM (PMEL_HUMAN)
RQMLGTHTA

SEQ ID NO: 135421 - protein, 10 aa, Artificial Sequence
  Description of Artificial Sequence: Synthetic peptide
  Seed: SGTYCLNVSL (PMEL_HUMAN)
SVTYCLNVSF

SEQ ID NO: 135422 - protein, 9 aa, Artificial Sequence
  Description of Artificial Sequence: Synthetic peptide
  Seed: LLVLMAVVL (PMEL_HUMAN)
LAVLMAVVY

SEQ ID NO: 135423 - protein, 9 aa, Artificial Sequence
  Description of Artificial Sequence: Synthetic peptide
  Seed: STAPVQMPT (PMEL_HUMAN)
SLAPVQMPT

SEQ ID NO: 135424 - protein, 10 aa, Artificial Sequence
  Description of Artificial Sequence: Synthetic peptide
  Seed: LHLAVIGALL (PMEL_HUMAN)
LLLAVIGALV

SEQ ID NO: 135425 - protein, 8 aa, Artificial Sequence
  Description of Artificial Sequence: Synthetic peptide
  Seed: LNFPGSQK (PMEL_HUMAN)
LAFPGSQM

SEQ ID NO: 135426 - protein, 10 aa, Artificial Sequence
  Description of Artificial Sequence: Synthetic peptide
  Seed: MEISSPGCQP (PMEL_HUMAN)
MEISSPGCQA

SEQ ID NO: 135427 - protein, 9 aa, Artificial Sequence
  Description of Artificial Sequence: Synthetic peptide
  Seed: YHRRGSRSY (PMEL_HUMAN)
YARRGSRSF

SEQ ID NO: 135428 - protein, 9 aa, Artificial Sequence
  Description of Artificial Sequence: Synthetic peptide
  Seed: SQVWGGQPV (PMEL_HUMAN)
SGVWGGQPF

SEQ ID NO: 135429 - protein, 9 aa, Artificial Sequence
  Description of Artificial Sequence: Synthetic peptide
  Seed: SSHWLRLPR (PMEL_HUMAN)
SSHWLRLPA

SEQ ID NO: 135430 - protein, 9 aa, Artificial Sequence
  Description of Artificial Sequence: Synthetic peptide
  Seed: VLQAAIPLT (PMEL_HUMAN)
VLQAAIPLL

SEQ ID NO: 135431 - protein, 9 aa, Artificial Sequence
  Description of Artificial Sequence: Synthetic peptide
  Seed: YVWKTWGQY (PMEL_HUMAN)
YQWKTWGQF

SEQ ID NO: 135432 - protein, 9 aa, Artificial Sequence
  Description of Artificial Sequence: Synthetic peptide
  Seed: RGGQVSLKV (PMEL_HUMAN)
RVGQVSLKV

SEQ ID NO: 135433 - protein, 9 aa, Artificial Sequence
  Description of Artificial Sequence: Synthetic peptide
  Seed: VLASLIYRR (PMEL_HUMAN)
VWASLIYRR

SEQ ID NO: 135434 - protein, 9 aa, Artificial Sequence
  Description of Artificial Sequence: Synthetic peptide
  Seed: AGQVPTTEV (PMEL_HUMAN)
ALQVPTTEL

SEQ ID NO: 135435 - protein, 9 aa, Artificial Sequence
  Description of Artificial Sequence: Synthetic peptide
  Seed: MTPEKVPVS (PMEL_HUMAN)
MAPEKVPVC

SEQ ID NO: 135436 - protein, 9 aa, Artificial Sequence
  Description of Artificial Sequence: Synthetic peptide
  Seed: FSIALNFPG (PMEL_HUMAN)
FTIALNFPW

SEQ ID NO: 135437 - protein, 9 aa, Artificial Sequence
  Description of Artificial Sequence: Synthetic peptide
  Seed: SQKRSFVYV (PMEL_HUMAN)
SQKRSFVYY

SEQ ID NO: 135438 - protein, 11 aa, Artificial Sequence
  Description of Artificial Sequence: Synthetic peptide
  Seed: FGDSSGTLISR (PMEL_HUMAN)
FCDSSGTLISV

SEQ ID NO: 135439 - protein, 11 aa, Artificial Sequence
  Description of Artificial Sequence: Synthetic peptide
  Seed: RRGSRSYVPLA (PMEL_HUMAN)
RSGSRSYVPLA

SEQ ID NO: 135440 - protein, 9 aa, Artificial Sequence
  Description of Artificial Sequence: Synthetic peptide
  Seed: DQVPFSVSV (PMEL_HUMAN)
DIVPFSVSL

SEQ ID NO: 135441 - protein, 10 aa, Artificial Sequence
  Description of Artificial Sequence: Synthetic peptide
  Seed: MTPAEVSIVV (PMEL_HUMAN)
MYPAEVSIVS

SEQ ID NO: 135442 - protein, 9 aa, Artificial Sequence
  Description of Artificial Sequence: Synthetic peptide
  Seed: GTHTMEVTV (PMEL_HUMAN)
GQHTMEVTV

SEQ ID NO: 135443 - protein, 9 aa, Artificial Sequence
  Description of Artificial Sequence: Synthetic peptide
  Seed: TLIGANASF (PMEL_HUMAN)
TPIGANASL

SEQ ID NO: 135444 - protein, 11 aa, Artificial Sequence
  Description of Artificial Sequence: Synthetic peptide
  Seed: SPVPGTTDGHR (PMEL_HUMAN)
SVVPGTTDGHK

SEQ ID NO: 135445 - protein, 11 aa, Artificial Sequence
  Description of Artificial Sequence: Synthetic peptide
  Seed: RYGSFSVTLDI (PMEL_HUMAN)
RTGSFSVTLDF

SEQ ID NO: 135446 - protein, 9 aa, Artificial Sequence
  Description of Artificial Sequence: Synthetic peptide
  Seed: KHFLRNQPL (PMEL_HUMAN)
KKFLRNQPL

SEQ ID NO: 135447 - protein, 9 aa, Artificial Sequence
  Description of Artificial Sequence: Synthetic peptide
  Seed: LSIGTGRAM (PMEL_HUMAN)
LYIGTGRAI

SEQ ID NO: 135448 - protein, 10 aa, Artificial Sequence
  Description of Artificial Sequence: Synthetic peptide
  Seed: SSAFTITDQV (PMEL_HUMAN)
SQAFTITDQV

SEQ ID NO: 135449 - protein, 10 aa, Artificial Sequence
  Description of Artificial Sequence: Synthetic peptide
  Seed: FLRNQPLTFA (PMEL_HUMAN)
FMRNQPLTFL

SEQ ID NO: 135450 - protein, 10 aa, Artificial Sequence
  Description of Artificial Sequence: Synthetic peptide
  Seed: LQLHDPSGYL (PMEL_HUMAN)
LTLHDPSGYY

SEQ ID NO: 135451 - protein, 10 aa, Artificial Sequence
  Description of Artificial Sequence: Synthetic peptide
  Seed: TVSCQGGLPK (PMEL_HUMAN)
TTSCQGGLPR

SEQ ID NO: 135452 - protein, 10 aa, Artificial Sequence
  Description of Artificial Sequence: Synthetic peptide
  Seed: VLYRYGSFSV (PMEL_HUMAN)
VVYRYGSFSV

SEQ ID NO: 135453 - protein, 9 aa, Artificial Sequence
  Description of Artificial Sequence: Synthetic peptide
  Seed: WQVLGGPVS (PMEL_HUMAN)
WHVLGGPVF

SEQ ID NO: 135454 - protein, 10 aa, Artificial Sequence
  Description of Artificial Sequence: Synthetic peptide
  Seed: VPLIVGILLV (PMEL_HUMAN)
VSLIVGILLV

SEQ ID NO: 135455 - protein, 9 aa, Artificial Sequence
  Description of Artificial Sequence: Synthetic peptide
  Seed: AEILQAVPS (PMEL_HUMAN)
AEILQAVPF

SEQ ID NO: 135456 - protein, 9 aa, Artificial Sequence
  Description of Artificial Sequence: Synthetic peptide
  Seed: YPQETDDAC (PMEL_HUMAN)
YPQETDDAI

SEQ ID NO: 135457 - protein, 9 aa, Artificial Sequence
  Description of Artificial Sequence: Synthetic peptide
  Seed: LLDGTATLR (PMEL_HUMAN)
LVDGTATLY

SEQ ID NO: 135458 - protein, 9 aa, Artificial Sequence
  Description of Artificial Sequence: Synthetic peptide
  Seed: TLIGANASF (PMEL_HUMAN)
TVIGANASW

SEQ ID NO: 135459 - protein, 10 aa, Artificial Sequence
  Description of Artificial Sequence: Synthetic peptide
  Seed: AVIGALLAVG (PMEL_HUMAN)
AMIGALLAVY

SEQ ID NO: 135460 - protein, 10 aa, Artificial Sequence
  Description of Artificial Sequence: Synthetic peptide
  Seed: LGQVPLIVGI (PMEL_HUMAN)
LCQVPLIVGV

SEQ ID NO: 135461 - protein, 9 aa, Artificial Sequence
  Description of Artificial Sequence: Synthetic peptide
  Seed: RLPRIFCSC (PMEL_HUMAN)
RQPRIFCSV

SEQ ID NO: 135462 - protein, 10 aa, Artificial Sequence
  Description of Artificial Sequence: Synthetic peptide
  Seed: YRYGSFSVTL (PMEL_HUMAN)
YYYGSFSVTI

SEQ ID NO: 135463 - protein, 9 aa, Artificial Sequence
  Description of Artificial Sequence: Synthetic peptide
  Seed: TAEAPNTTA (PMEL_HUMAN)
TSEAPNTTY

SEQ ID NO: 135464 - protein, 11 aa, Artificial Sequence
  Description of Artificial Sequence: Synthetic peptide
  Seed: GYLAEADLSYT (PMEL_HUMAN)
GFLAEADLSYV

SEQ ID NO: 135465 - protein, 10 aa, Artificial Sequence
  Description of Artificial Sequence: Synthetic peptide
  Seed: YRYGSFSVTL (PMEL_HUMAN)
YKYGSFSVTL

SEQ ID NO: 135466 - protein, 9 aa, Artificial Sequence
  Description of Artificial Sequence: Synthetic peptide
  Seed: ITDQVPFSV (PMEL_HUMAN)
IIDQVPFSL

SEQ ID NO: 135467 - protein, 9 aa, Artificial Sequence
  Description of Artificial Sequence: Synthetic peptide
  Seed: YLAEADLSY (PMEL_HUMAN)
YPAEADLSA

SEQ ID NO: 135468 - protein, 9 aa, Artificial Sequence
  Description of Artificial Sequence: Synthetic peptide
  Seed: LYRYGSFSV (PMEL_HUMAN)
LWRYGSFSF

SEQ ID NO: 135469 - protein, 10 aa, Artificial Sequence
  Description of Artificial Sequence: Synthetic peptide
  Seed: ALDGGNKHFL (PMEL_HUMAN)
AIDGGNKHFY

SEQ ID NO: 135470 - protein, 9 aa, Artificial Sequence
  Description of Artificial Sequence: Synthetic peptide
  Seed: KQDFSVPQL (PMEL_HUMAN)
KEDFSVPQL

SEQ ID NO: 135471 - protein, 9 aa, Artificial Sequence
  Description of Artificial Sequence: Synthetic peptide
  Seed: VSVSQLRAL (PMEL_HUMAN)
VIVSQLRAY

SEQ ID NO: 135472 - protein, 8 aa, Artificial Sequence
  Description of Artificial Sequence: Synthetic peptide
  Seed: FGDSSGTL (PMEL_HUMAN)
FFDSSGTI

SEQ ID NO: 135473 - protein, 11 aa, Artificial Sequence
  Description of Artificial Sequence: Synthetic peptide
  Seed: SYVPLAHSSSA (PMEL_HUMAN)
SWVPLAHSSSM

SEQ ID NO: 135474 - protein, 10 aa, Artificial Sequence
  Description of Artificial Sequence: Synthetic peptide
  Seed: ESAEILQAVP (PMEL_HUMAN)
EIAEILQAVL

SEQ ID NO: 135475 - protein, 10 aa, Artificial Sequence
  Description of Artificial Sequence: Synthetic peptide
  Seed: LVLMAVVLAS (PMEL_HUMAN)
LVLMAVVLAA

SEQ ID NO: 135476 - protein, 9 aa, Artificial Sequence
  Description of Artificial Sequence: Synthetic peptide
  Seed: KTWGQYWQV (PMEL_HUMAN)
KSWGQYWQL

SEQ ID NO: 135477 - protein, 10 aa, Artificial Sequence
  Description of Artificial Sequence: Synthetic peptide
  Seed: YVPLAHSSSA (PMEL_HUMAN)
YHPLAHSSSF

SEQ ID NO: 135478 - protein, 11 aa, Artificial Sequence
  Description of Artificial Sequence: Synthetic peptide
  Seed: LGPLLDGTATL (PMEL_HUMAN)
LQPLLDGTATL

SEQ ID NO: 135479 - protein, 9 aa, Artificial Sequence
  Description of Artificial Sequence: Synthetic peptide
  Seed: CPIGENSPL (PMEL_HUMAN)
CPIGENSPM

SEQ ID NO: 135480 - protein, 9 aa, Artificial Sequence
  Description of Artificial Sequence: Synthetic peptide
  Seed: RALDGGNKH (PMEL_HUMAN)
RVLDGGNKF

SEQ ID NO: 135481 - protein, 10 aa, Artificial Sequence
  Description of Artificial Sequence: Synthetic peptide
  Seed: YGSFSVTLDI (PMEL_HUMAN)
YKSFSVTLDW

SEQ ID NO: 135482 - protein, 9 aa, Artificial Sequence
  Description of Artificial Sequence: Synthetic peptide
  Seed: MEVTVYHRR (PMEL_HUMAN)
MFVTVYHRK

SEQ ID NO: 135483 - protein, 10 aa, Artificial Sequence
  Description of Artificial Sequence: Synthetic peptide
  Seed: QVLGGPVSGL (PMEL_HUMAN)
QILGGPVSGI

SEQ ID NO: 135484 - protein, 10 aa, Artificial Sequence
  Description of Artificial Sequence: Synthetic peptide
  Seed: LAVIGALLAV (PMEL_HUMAN)
LMVIGALLAV

SEQ ID NO: 135485 - protein, 9 aa, Artificial Sequence
  Description of Artificial Sequence: Synthetic peptide
  Seed: VLMAVVLAS (PMEL_HUMAN)
VAMAVVLAI

SEQ ID NO: 135486 - protein, 9 aa, Artificial Sequence
  Description of Artificial Sequence: Synthetic peptide
  Seed: GSSPVPGTT (PMEL_HUMAN)
GGSPVPGTY

SEQ ID NO: 135487 - protein, 10 aa, Artificial Sequence
  Description of Artificial Sequence: Synthetic peptide
  Seed: LAHSSSAFTI (PMEL_HUMAN)
LAHSSSAFTW

SEQ ID NO: 135488 - protein, 9 aa, Artificial Sequence
  Description of Artificial Sequence: Synthetic peptide
  Seed: ITGSLGPLL (PMEL_HUMAN)
ILGSLGPLA

SEQ ID NO: 135489 - protein, 9 aa, Artificial Sequence
  Description of Artificial Sequence: Synthetic peptide
  Seed: VVLSGTTAA (PMEL_HUMAN)
VPLSGTTAV

SEQ ID NO: 135490 - protein, 10 aa, Artificial Sequence
  Description of Artificial Sequence: Synthetic peptide
  Seed: ILKGGSGTYC (PMEL_HUMAN)
IQKGGSGTYF

SEQ ID NO: 135491 - protein, 10 aa, Artificial Sequence
  Description of Artificial Sequence: Synthetic peptide
  Seed: YRYGSFSVTL (PMEL_HUMAN)
YQYGSFSVTW

SEQ ID NO: 135492 - protein, 10 aa, Artificial Sequence
  Description of Artificial Sequence: Synthetic peptide
  Seed: LVLKRCLLHL (PMEL_HUMAN)
LELKRCLLHV

SEQ ID NO: 135493 - protein, 8 aa, Artificial Sequence
  Description of Artificial Sequence: Synthetic peptide
  Seed: RSFVYVWK (PMEL_HUMAN)
RWFVYVWR

SEQ ID NO: 135494 - protein, 8 aa, Artificial Sequence
  Description of Artificial Sequence: Synthetic peptide
  Seed: AEAPNTTA (PMEL_HUMAN)
AEAPNTTV

SEQ ID NO: 135495 - protein, 9 aa, Artificial Sequence
  Description of Artificial Sequence: Synthetic peptide
  Seed: HTMEVTVYH (PMEL_HUMAN)
HAMEVTVYR

SEQ ID NO: 135496 - protein, 11 aa, Artificial Sequence
  Description of Artificial Sequence: Synthetic peptide
  Seed: YVPLAHSSSAF (PMEL_HUMAN)
YNPLAHSSSAF

SEQ ID NO: 135497 - protein, 10 aa, Artificial Sequence
  Description of Artificial Sequence: Synthetic peptide
  Seed: AMLGTHTMEV (PMEL_HUMAN)
AALGTHTMEV

SEQ ID NO: 135498 - protein, 9 aa, Artificial Sequence
  Description of Artificial Sequence: Synthetic peptide
  Seed: RYGSFSVTL (PMEL_HUMAN)
RTGSFSVTY

SEQ ID NO: 135499 - protein, 11 aa, Artificial Sequence
  Description of Artificial Sequence: Synthetic peptide
  Seed: RALDGGNKHFL (PMEL_HUMAN)
RQLDGGNKHFV

SEQ ID NO: 135500 - protein, 11 aa, Artificial Sequence
  Description of Artificial Sequence: Synthetic peptide
  Seed: SYVPLAHSSSA (PMEL_HUMAN)
SMVPLAHSSSL

SEQ ID NO: 135501 - protein, 9 aa, Artificial Sequence
  Description of Artificial Sequence: Synthetic peptide
  Seed: VQVPTTEVI (PMEL_HUMAN)
VVVPTTEVM

SEQ ID NO: 135502 - protein, 11 aa, Artificial Sequence
  Description of Artificial Sequence: Synthetic peptide
  Seed: RRLMKQDFSVP (PMEL_HUMAN)
RMLMKQDFSVV

SEQ ID NO: 135503 - protein, 9 aa, Artificial Sequence
  Description of Artificial Sequence: Synthetic peptide
  Seed: FTITDQVPF (PMEL_HUMAN)
FYITDQVPW

SEQ ID NO: 135504 - protein, 10 aa, Artificial Sequence
  Description of Artificial Sequence: Synthetic peptide
  Seed: SSHWLRLPRI (PMEL_HUMAN)
SYHWLRLPRK

SEQ ID NO: 135505 - protein, 10 aa, Artificial Sequence
  Description of Artificial Sequence: Synthetic peptide
  Seed: SLADTNSLAV (PMEL_HUMAN)
SIADTNSLAL

SEQ ID NO: 135506 - protein, 9 aa, Artificial Sequence
  Description of Artificial Sequence: Synthetic peptide
  Seed: TTDGHRPTA (PMEL_HUMAN)
TADGHRPTI

SEQ ID NO: 135507 - protein, 9 aa, Artificial Sequence
  Description of Artificial Sequence: Synthetic peptide
  Seed: LTSCGSSPV (PMEL_HUMAN)
LSSCGSSPF

SEQ ID NO: 135508 - protein, 10 aa, Artificial Sequence
  Description of Artificial Sequence: Synthetic peptide
  Seed: ESITGSLGPL (PMEL_HUMAN)
ESITGSLGPY

SEQ ID NO: 135509 - protein, 10 aa, Artificial Sequence
  Description of Artificial Sequence: Synthetic peptide
  Seed: AMLGTHTMEV (PMEL_HUMAN)
AQLGTHTMEI

SEQ ID NO: 135510 - protein, 8 aa, Artificial Sequence
  Description of Artificial Sequence: Synthetic peptide
  Seed: TLDIVQGI (PMEL_HUMAN)
TGDIVQGL

SEQ ID NO: 135511 - protein, 10 aa, Artificial Sequence
  Description of Artificial Sequence: Synthetic peptide
  Seed: GPLLDGTATL (PMEL_HUMAN)
GHLLDGTATM

SEQ ID NO: 135512 - protein, 10 aa, Artificial Sequence
  Description of Artificial Sequence: Synthetic peptide
  Seed: YVPLAHSSSA (PMEL_HUMAN)
YWPLAHSSSM

SEQ ID NO: 135513 - protein, 9 aa, Artificial Sequence
  Description of Artificial Sequence: Synthetic peptide
  Seed: MLGTHTMEV (PMEL_HUMAN)
MAGTHTMEV

SEQ ID NO: 135514 - protein, 10 aa, Artificial Sequence
  Description of Artificial Sequence: Synthetic peptide
  Seed: RRLMKQDFSV (PMEL_HUMAN)
RNLMKQDFSV

SEQ ID NO: 135515 - protein, 10 aa, Artificial Sequence
  Description of Artificial Sequence: Synthetic peptide
  Seed: EVMGTTLAEM (PMEL_HUMAN)
ETMGTTLAEW

SEQ ID NO: 135516 - protein, 9 aa, Artificial Sequence
  Description of Artificial Sequence: Synthetic peptide
  Seed: SSPGCQPPA (PMEL_HUMAN)
SLPGCQPPI

SEQ ID NO: 135517 - protein, 10 aa, Artificial Sequence
  Description of Artificial Sequence: Synthetic peptide
  Seed: THTMEVTVYH (PMEL_HUMAN)
TPTMEVTVYK

SEQ ID NO: 135518 - protein, 9 aa, Artificial Sequence
  Description of Artificial Sequence: Synthetic peptide
  Seed: HSSSHWLRL (PMEL_HUMAN)
HSSSHWLRI

SEQ ID NO: 135519 - protein, 9 aa, Artificial Sequence
  Description of Artificial Sequence: Synthetic peptide
  Seed: VTAQVVLQA (PMEL_HUMAN)
VTAQVVLQM

SEQ ID NO: 135520 - protein, 11 aa, Artificial Sequence
  Description of Artificial Sequence: Synthetic peptide
  Seed: YVPLAHSSSAF (PMEL_HUMAN)
YLPLAHSSSAF

SEQ ID NO: 135521 - protein, 10 aa, Artificial Sequence
  Description of Artificial Sequence: Synthetic peptide
  Seed: RNQDWLGVSR (PMEL_HUMAN)
RSQDWLGVSK

SEQ ID NO: 135522 - protein, 10 aa, Artificial Sequence
  Description of Artificial Sequence: Synthetic peptide
  Seed: RGSRSYVPLA (PMEL_HUMAN)
RKSRSYVPLV

SEQ ID NO: 135523 - protein, 9 aa, Artificial Sequence
  Description of Artificial Sequence: Synthetic peptide
  Seed: VLGGPVSGL (PMEL_HUMAN)
VIGGPVSGV

SEQ ID NO: 135524 - protein, 11 aa, Artificial Sequence
  Description of Artificial Sequence: Synthetic peptide
  Seed: GYLAEADLSYT (PMEL_HUMAN)
GMLAEADLSYV

SEQ ID NO: 135525 - protein, 9 aa, Artificial Sequence
  Description of Artificial Sequence: Synthetic peptide
  Seed: VSNDGPTLI (PMEL_HUMAN)
VANDGPTLL

SEQ ID NO: 135526 - protein, 9 aa, Artificial Sequence
  Description of Artificial Sequence: Synthetic peptide
  Seed: TVYHRRGSR (PMEL_HUMAN)
TTYHRRGSR

SEQ ID NO: 135527 - protein, 10 aa, Artificial Sequence
  Description of Artificial Sequence: Synthetic peptide
  Seed: HFLRNQPLTF (PMEL_HUMAN)
HWLRNQPLTF

SEQ ID NO: 135528 - protein, 9 aa, Artificial Sequence
  Description of Artificial Sequence: Synthetic peptide
  Seed: HSSSHWLRL (PMEL_HUMAN)
HRSSHWLRF

SEQ ID NO: 135529 - protein, 11 aa, Artificial Sequence
  Description of Artificial Sequence: Synthetic peptide
  Seed: FGDSSGTLISR (PMEL_HUMAN)
FNDSSGTLISM

SEQ ID NO: 135530 - protein, 9 aa, Artificial Sequence
  Description of Artificial Sequence: Synthetic peptide
  Seed: YLEPGPVTA (PMEL_HUMAN)
YFEPGPVTF

SEQ ID NO: 135531 - protein, 10 aa, Artificial Sequence
  Description of Artificial Sequence: Synthetic peptide
  Seed: RRLMKQDFSV (PMEL_HUMAN)
RPLMKQDFSI

SEQ ID NO: 135532 - protein, 9 aa, Artificial Sequence
  Description of Artificial Sequence: Synthetic peptide
  Seed: AHSSSAFTI (PMEL_HUMAN)
AHSSSAFTA

SEQ ID NO: 135533 - protein, 9 aa, Artificial Sequence
  Description of Artificial Sequence: Synthetic peptide
  Seed: SLGPLLDGT (PMEL_HUMAN)
STGPLLDGI

SEQ ID NO: 135534 - protein, 11 aa, Artificial Sequence
  Description of Artificial Sequence: Synthetic peptide
  Seed: VVLASLIYRRR (PMEL_HUMAN)
VMLASLIYRRR

SEQ ID NO: 135535 - protein, 10 aa, Artificial Sequence
  Description of Artificial Sequence: Synthetic peptide
  Seed: SGTYCLNVSL (PMEL_HUMAN)
SVTYCLNVSW

SEQ ID NO: 135536 - protein, 11 aa, Artificial Sequence
  Description of Artificial Sequence: Synthetic peptide
  Seed: RRRLMKQDFSV (PMEL_HUMAN)
RSRLMKQDFSV

SEQ ID NO: 135537 - protein, 9 aa, Artificial Sequence
  Description of Artificial Sequence: Synthetic peptide
  Seed: HLAVIGALL (PMEL_HUMAN)
HIAVIGALV

SEQ ID NO: 135538 - protein, 11 aa, Artificial Sequence
  Description of Artificial Sequence: Synthetic peptide
  Seed: RALDGGNKHFL (PMEL_HUMAN)
RALDGGNKHFR

SEQ ID NO: 135539 - protein, 8 aa, Artificial Sequence
  Description of Artificial Sequence: Synthetic peptide
  Seed: LHDPSGYL (PMEL_HUMAN)
LGDPSGYM

SEQ ID NO: 135540 - protein, 10 aa, Artificial Sequence
  Description of Artificial Sequence: Synthetic peptide
  Seed: EVSIVVLSGT (PMEL_HUMAN)
ECSIVVLSGI

SEQ ID NO: 135541 - protein, 9 aa, Artificial Sequence
  Description of Artificial Sequence: Synthetic peptide
  Seed: SITGSLGPL (PMEL_HUMAN)
SSTGSLGPR

SEQ ID NO: 135542 - protein, 9 aa, Artificial Sequence
  Description of Artificial Sequence: Synthetic peptide
  Seed: VVLQAAIPL (PMEL_HUMAN)
VSLQAAIPL

SEQ ID NO: 135543 - protein, 10 aa, Artificial Sequence
  Description of Artificial Sequence: Synthetic peptide
  Seed: VLPDGQVIWV (PMEL_HUMAN)
VVPDGQVIWV

SEQ ID NO: 135544 - protein, 9 aa, Artificial Sequence
  Description of Artificial Sequence: Synthetic peptide
  Seed: IYRRRLMKQ (PMEL_HUMAN)
ISRRRLMKK

SEQ ID NO: 135545 - protein, 10 aa, Artificial Sequence
  Description of Artificial Sequence: Synthetic peptide
  Seed: EVISTAPVQM (PMEL_HUMAN)
EMISTAPVQR

SEQ ID NO: 135546 - protein, 10 aa, Artificial Sequence
  Description of Artificial Sequence: Synthetic peptide
  Seed: GDSSGTLISR (PMEL_HUMAN)
GASSGTLISR

SEQ ID NO: 135547 - protein, 9 aa, Artificial Sequence
  Description of Artificial Sequence: Synthetic peptide
  Seed: DAFELTVSC (PMEL_HUMAN)
DTFELTVSI

SEQ ID NO: 135548 - protein, 10 aa, Artificial Sequence
  Description of Artificial Sequence: Synthetic peptide
  Seed: EVSIVVLSGT (PMEL_HUMAN)
EHSIVVLSGI

SEQ ID NO: 135549 - protein, 9 aa, Artificial Sequence
  Description of Artificial Sequence: Synthetic peptide
  Seed: LMAVVLASL (PMEL_HUMAN)
LQAVVLASI

SEQ ID NO: 135550 - protein, 10 aa, Artificial Sequence
  Description of Artificial Sequence: Synthetic peptide
  Seed: QILKGGSGTY (PMEL_HUMAN)
QKLKGGSGTF

SEQ ID NO: 135551 - protein, 9 aa, Artificial Sequence
  Description of Artificial Sequence: Synthetic peptide
  Seed: SLAVVSTQL (PMEL_HUMAN)
STAVVSTQL

SEQ ID NO: 135552 - protein, 9 aa, Artificial Sequence
  Description of Artificial Sequence: Synthetic peptide
  Seed: VQMPTAEST (PMEL_HUMAN)
VYMPTAESY

SEQ ID NO: 135553 - protein, 9 aa, Artificial Sequence
  Description of Artificial Sequence: Synthetic peptide
  Seed: MAVVLASLI (PMEL_HUMAN)
MHVVLASLM

SEQ ID NO: 135554 - protein, 9 aa, Artificial Sequence
  Description of Artificial Sequence: Synthetic peptide
  Seed: LPDGQVIWV (PMEL_HUMAN)
LYDGQVIWF

SEQ ID NO: 135555 - protein, 10 aa, Artificial Sequence
  Description of Artificial Sequence: Synthetic peptide
  Seed: LIGANASFSI (PMEL_HUMAN)
LMGANASFSI

SEQ ID NO: 135556 - protein, 9 aa, Artificial Sequence
  Description of Artificial Sequence: Synthetic peptide
  Seed: RAMLGTHTM (PMEL_HUMAN)
RMMLGTHTI

SEQ ID NO: 135557 - protein, 10 aa, Artificial Sequence
  Description of Artificial Sequence: Synthetic peptide
  Seed: FSVSVSQLRA (PMEL_HUMAN)
FTVSVSQLRG

SEQ ID NO: 135558 - protein, 10 aa, Artificial Sequence
  Description of Artificial Sequence: Synthetic peptide
  Seed: FPDGGPCPSG (PMEL_HUMAN)
FADGGPCPSY

SEQ ID NO: 135559 - protein, 9 aa, Artificial Sequence
  Description of Artificial Sequence: Synthetic peptide
  Seed: AVIGALLAV (PMEL_HUMAN)
AAIGALLAL

SEQ ID NO: 135560 - protein, 9 aa, Artificial Sequence
  Description of Artificial Sequence: Synthetic peptide
  Seed: VVLSGTTAA (PMEL_HUMAN)
VPLSGTTAS

SEQ ID NO: 135561 - protein, 8 aa, Artificial Sequence
  Description of Artificial Sequence: Synthetic peptide
  Seed: RELPIPEP (PMEL_HUMAN)
RDLPIPEL

SEQ ID NO: 135562 - protein, 9 aa, Artificial Sequence
  Description of Artificial Sequence: Synthetic peptide
  Seed: VVLASLIYR (PMEL_HUMAN)
VTLASLIYY

SEQ ID NO: 135563 - protein, 9 aa, Artificial Sequence
  Description of Artificial Sequence: Synthetic peptide
  Seed: ASFSIALNF (PMEL_HUMAN)
ASFSIALNR

SEQ ID NO: 135564 - protein, 10 aa, Artificial Sequence
  Description of Artificial Sequence: Synthetic peptide
  Seed: RALDGGNKHF (PMEL_HUMAN)
RMLDGGNKHV

SEQ ID NO: 135565 - protein, 9 aa, Artificial Sequence
  Description of Artificial Sequence: Synthetic peptide
  Seed: ISRALVVTH (PMEL_HUMAN)
IIRALVVTK

SEQ ID NO: 135566 - protein, 11 aa, Artificial Sequence
  Description of Artificial Sequence: Synthetic peptide
  Seed: SGYLAEADLSY (PMEL_HUMAN)
SLYLAEADLSY

SEQ ID NO: 135567 - protein, 10 aa, Artificial Sequence
  Description of Artificial Sequence: Synthetic peptide
  Seed: ESAEILQAVP (PMEL_HUMAN)
EVAEILQAVP

SEQ ID NO: 135568 - protein, 8 aa, Artificial Sequence
  Description of Artificial Sequence: Synthetic peptide
  Seed: LHDPSGYL (PMEL_HUMAN)
LLDPSGYL

SEQ ID NO: 135569 - protein, 9 aa, Artificial Sequence
  Description of Artificial Sequence: Synthetic peptide
  Seed: TMEVTVYHR (PMEL_HUMAN)
TIEVTVYHY

SEQ ID NO: 135570 - protein, 9 aa, Artificial Sequence
  Description of Artificial Sequence: Synthetic peptide
  Seed: LTSCGSSPV (PMEL_HUMAN)
LMSCGSSPL

SEQ ID NO: 135571 - protein, 11 aa, Artificial Sequence
  Description of Artificial Sequence: Synthetic peptide
  Seed: YLAEADLSYTW (PMEL_HUMAN)
YTAEADLSYTF

SEQ ID NO: 135572 - protein, 10 aa, Artificial Sequence
  Description of Artificial Sequence: Synthetic peptide
  Seed: LAVIGALLAV (PMEL_HUMAN)
LFVIGALLAA

SEQ ID NO: 135573 - protein, 9 aa, Artificial Sequence
  Description of Artificial Sequence: Synthetic peptide
  Seed: FTITDQVPF (PMEL_HUMAN)
FLITDQVPT

SEQ ID NO: 135574 - protein, 9 aa, Artificial Sequence
  Description of Artificial Sequence: Synthetic peptide
  Seed: LMAVVLASL (PMEL_HUMAN)
LPAVVLASV

SEQ ID NO: 135575 - protein, 10 aa, Artificial Sequence
  Description of Artificial Sequence: Synthetic peptide
  Seed: KTWGQYWQVL (PMEL_HUMAN)
KPWGQYWQVF

SEQ ID NO: 135576 - protein, 10 aa, Artificial Sequence
  Description of Artificial Sequence: Synthetic peptide
  Seed: GQEAGLGQVP (PMEL_HUMAN)
GEEAGLGQVV

SEQ ID NO: 135577 - protein, 9 aa, Artificial Sequence
  Description of Artificial Sequence: Synthetic peptide
  Seed: VSEVMGTTL (PMEL_HUMAN)
VFEVMGTTF

SEQ ID NO: 135578 - protein, 9 aa, Artificial Sequence
  Description of Artificial Sequence: Synthetic peptide
  Seed: FLRNQPLTF (PMEL_HUMAN)
FGRNQPLTF

SEQ ID NO: 135579 - protein, 9 aa, Artificial Sequence
  Description of Artificial Sequence: Synthetic peptide
  Seed: AEADLSYTW (PMEL_HUMAN)
AMADLSYTY

SEQ ID NO: 135580 - protein, 9 aa, Artificial Sequence
  Description of Artificial Sequence: Synthetic peptide
  Seed: DAFELTVSC (PMEL_HUMAN)
DSFELTVSY

SEQ ID NO: 135581 - protein, 9 aa, Artificial Sequence
  Description of Artificial Sequence: Synthetic peptide
  Seed: GSSPVPGTT (PMEL_HUMAN)
GSSPVPGTM

SEQ ID NO: 135582 - protein, 10 aa, Artificial Sequence
  Description of Artificial Sequence: Synthetic peptide
  Seed: FSVSVSQLRA (PMEL_HUMAN)
FVVSVSQLRR

SEQ ID NO: 135583 - protein, 9 aa, Artificial Sequence
  Description of Artificial Sequence: Synthetic peptide
  Seed: ALLAVGATK (PMEL_HUMAN)
ATLAVGATK

SEQ ID NO: 135584 - protein, 9 aa, Artificial Sequence
  Description of Artificial Sequence: Synthetic peptide
  Seed: KTWGQYWQV (PMEL_HUMAN)
KAWGQYWQL

SEQ ID NO: 135585 - protein, 9 aa, Artificial Sequence
  Description of Artificial Sequence: Synthetic peptide
  Seed: IVVLSGTTA (PMEL_HUMAN)
IAVLSGTTY

SEQ ID NO: 135586 - protein, 10 aa, Artificial Sequence
  Description of Artificial Sequence: Synthetic peptide
  Seed: SVPQLPHSSS (PMEL_HUMAN)
SSPQLPHSSF

SEQ ID NO: 135587 - protein, 10 aa, Artificial Sequence
  Description of Artificial Sequence: Synthetic peptide
  Seed: QVIWVNNTII (PMEL_HUMAN)
QVIWVNNTIV

SEQ ID NO: 135588 - protein, 8 aa, Artificial Sequence
  Description of Artificial Sequence: Synthetic peptide
  Seed: YRYGSFSV (PMEL_HUMAN)
YRYGSFSA

SEQ ID NO: 135589 - protein, 9 aa, Artificial Sequence
  Description of Artificial Sequence: Synthetic peptide
  Seed: AQVVLQAAI (PMEL_HUMAN)
AAVVLQAAF

SEQ ID NO: 135590 - protein, 10 aa, Artificial Sequence
  Description of Artificial Sequence: Synthetic peptide
  Seed: CLLHLAVIGA (PMEL_HUMAN)
CSLHLAVIGV

SEQ ID NO: 135591 - protein, 9 aa, Artificial Sequence
  Description of Artificial Sequence: Synthetic peptide
  Seed: CWRGGQVSL (PMEL_HUMAN)
CYRGGQVSL

SEQ ID NO: 135592 - protein, 9 aa, Artificial Sequence
  Description of Artificial Sequence: Synthetic peptide
  Seed: ALNFPGSQK (PMEL_HUMAN)
AVNFPGSQL

SEQ ID NO: 135593 - protein, 9 aa, Artificial Sequence
  Description of Artificial Sequence: Synthetic peptide
  Seed: EPGPVTAQV (PMEL_HUMAN)
EAGPVTAQY

SEQ ID NO: 135594 - protein, 9 aa, Artificial Sequence
  Description of Artificial Sequence: Synthetic peptide
  Seed: ASFSIALNF (PMEL_HUMAN)
AVFSIALNL

SEQ ID NO: 135595 - protein, 10 aa, Artificial Sequence
  Description of Artificial Sequence: Synthetic peptide
  Seed: LMAVVLASLI (PMEL_HUMAN)
LLAVVLASLK

SEQ ID NO: 135596 - protein, 10 aa, Artificial Sequence
  Description of Artificial Sequence: Synthetic peptide
  Seed: GRAMLGTHTM (PMEL_HUMAN)
GRAMLGTHTV

SEQ ID NO: 135597 - protein, 9 aa, Artificial Sequence
  Description of Artificial Sequence: Synthetic peptide
  Seed: LADTNSLAV (PMEL_HUMAN)
LTDTNSLAF

SEQ ID NO: 135598 - protein, 11 aa, Artificial Sequence
  Description of Artificial Sequence: Synthetic peptide
  Seed: KVLPDGQVIWV (PMEL_HUMAN)
KGLPDGQVIWF

SEQ ID NO: 135599 - protein, 10 aa, Artificial Sequence
  Description of Artificial Sequence: Synthetic peptide
  Seed: VLMAVVLASL (PMEL_HUMAN)
VQMAVVLASA

SEQ ID NO: 135600 - protein, 9 aa, Artificial Sequence
  Description of Artificial Sequence: Synthetic peptide
  Seed: AQVTTTEWV (PMEL_HUMAN)
AQVTTTEWW

SEQ ID NO: 135601 - protein, 9 aa, Artificial Sequence
  Description of Artificial Sequence: Synthetic peptide
  Seed: VMGTTLAEM (PMEL_HUMAN)
VMGTTLAEF

SEQ ID NO: 135602 - protein, 10 aa, Artificial Sequence
  Description of Artificial Sequence: Synthetic peptide
  Seed: ALDGGNKHFL (PMEL_HUMAN)
AGDGGNKHFM

SEQ ID NO: 135603 - protein, 9 aa, Artificial Sequence
  Description of Artificial Sequence: Synthetic peptide
  Seed: QVIWVNNTI (PMEL_HUMAN)
QQIWVNNTW

SEQ ID NO: 135604 - protein, 9 aa, Artificial Sequence
  Description of Artificial Sequence: Synthetic peptide
  Seed: YLAEADLSY (PMEL_HUMAN)
YTAEADLSL

SEQ ID NO: 135605 - protein, 9 aa, Artificial Sequence
  Description of Artificial Sequence: Synthetic peptide
  Seed: LADTNSLAV (PMEL_HUMAN)
LGDTNSLAV

SEQ ID NO: 135606 - protein, 10 aa, Artificial Sequence
  Description of Artificial Sequence: Synthetic peptide
  Seed: RQLYPEWTEA (PMEL_HUMAN)
RTLYPEWTEI

SEQ ID NO: 135607 - protein, 10 aa, Artificial Sequence
  Description of Artificial Sequence: Synthetic peptide
  Seed: VVLASLIYRR (PMEL_HUMAN)
VMLASLIYRI

SEQ ID NO: 135608 - protein, 10 aa, Artificial Sequence
  Description of Artificial Sequence: Synthetic peptide
  Seed: MTPAEVSIVV (PMEL_HUMAN)
MSPAEVSIVI

SEQ ID NO: 135609 - protein, 9 aa, Artificial Sequence
  Description of Artificial Sequence: Synthetic peptide
  Seed: TATLRLVKR (PMEL_HUMAN)
TTTLRLVKR

SEQ ID NO: 135610 - protein, 10 aa, Artificial Sequence
  Description of Artificial Sequence: Synthetic peptide
  Seed: VLPSPACQLV (PMEL_HUMAN)
VAPSPACQLM

SEQ ID NO: 135611 - protein, 10 aa, Artificial Sequence
  Description of Artificial Sequence: Synthetic peptide
  Seed: RGSRSYVPLA (PMEL_HUMAN)
RISRSYVPLM

SEQ ID NO: 135612 - protein, 9 aa, Artificial Sequence
  Description of Artificial Sequence: Synthetic peptide
  Seed: KQDFSVPQL (PMEL_HUMAN)
KFDFSVPQM

SEQ ID NO: 135613 - protein, 9 aa, Artificial Sequence
  Description of Artificial Sequence: Synthetic peptide
  Seed: RTKAWNRQL (PMEL_HUMAN)
RYKAWNRQY

SEQ ID NO: 135614 - protein, 9 aa, Artificial Sequence
  Description of Artificial Sequence: Synthetic peptide
  Seed: AQRLCQPVL (PMEL_HUMAN)
AQRLCQPVK

SEQ ID NO: 135615 - protein, 9 aa, Artificial Sequence
  Description of Artificial Sequence: Synthetic peptide
  Seed: DQVPFSVSV (PMEL_HUMAN)
DGVPFSVSV

SEQ ID NO: 135616 - protein, 11 aa, Artificial Sequence
  Description of Artificial Sequence: Synthetic peptide
  Seed: CVLYRYGSFSV (PMEL_HUMAN)
CMLYRYGSFSL

SEQ ID NO: 135617 - protein, 9 aa, Artificial Sequence
  Description of Artificial Sequence: Synthetic peptide
  Seed: VLASLIYRR (PMEL_HUMAN)
VQASLIYRR

SEQ ID NO: 135618 - protein, 9 aa, Artificial Sequence
  Description of Artificial Sequence: Synthetic peptide
  Seed: GQVPTTEVV (PMEL_HUMAN)
GEVPTTEVI

SEQ ID NO: 135619 - protein, 9 aa, Artificial Sequence
  Description of Artificial Sequence: Synthetic peptide
  Seed: SQVWGGQPV (PMEL_HUMAN)
SMVWGGQPY

SEQ ID NO: 135620 - protein, 9 aa, Artificial Sequence
  Description of Artificial Sequence: Synthetic peptide
  Seed: LLAVGATKV (PMEL_HUMAN)
LLAVGATKA

SEQ ID NO: 135621 - protein, 9 aa, Artificial Sequence
  Description of Artificial Sequence: Synthetic peptide
  Seed: TTDGHRPTA (PMEL_HUMAN)
TCDGHRPTV

SEQ ID NO: 135622 - protein, 9 aa, Artificial Sequence
  Description of Artificial Sequence: Synthetic peptide
  Seed: HSSSHWLRL (PMEL_HUMAN)
HISSHWLRK

SEQ ID NO: 135623 - protein, 9 aa, Artificial Sequence
  Description of Artificial Sequence: Synthetic peptide
  Seed: AAQVTTTEW (PMEL_HUMAN)
ASQVTTTEM

SEQ ID NO: 135624 - protein, 9 aa, Artificial Sequence
  Description of Artificial Sequence: Synthetic peptide
  Seed: LLDGTATLR (PMEL_HUMAN)
LVDGTATLL

SEQ ID NO: 135625 - protein, 10 aa, Artificial Sequence
  Description of Artificial Sequence: Synthetic peptide
  Seed: VPQLPHSSSH (PMEL_HUMAN)
VCQLPHSSSL

SEQ ID NO: 135626 - protein, 9 aa, Artificial Sequence
  Description of Artificial Sequence: Synthetic peptide
  Seed: FPDGGPCPS (PMEL_HUMAN)
FVDGGPCPF

SEQ ID NO: 135627 - protein, 10 aa, Artificial Sequence
  Description of Artificial Sequence: Synthetic peptide
  Seed: SGTYCLNVSL (PMEL_HUMAN)
SLTYCLNVSF

SEQ ID NO: 135628 - protein, 8 aa, Artificial Sequence
  Description of Artificial Sequence: Synthetic peptide
  Seed: SNDGPTLI (PMEL_HUMAN)
SLDGPTLI

SEQ ID NO: 135629 - protein, 10 aa, Artificial Sequence
  Description of Artificial Sequence: Synthetic peptide
  Seed: EVMGTTLAEM (PMEL_HUMAN)
EQMGTTLAEF

SEQ ID NO: 135630 - protein, 9 aa, Artificial Sequence
  Description of Artificial Sequence: Synthetic peptide
  Seed: ISRALVVTH (PMEL_HUMAN)
IFRALVVTK

SEQ ID NO: 135631 - protein, 10 aa, Artificial Sequence
  Description of Artificial Sequence: Synthetic peptide
  Seed: VLMAVVLASL (PMEL_HUMAN)
VNMAVVLASA

SEQ ID NO: 135632 - protein, 9 aa, Artificial Sequence
  Description of Artificial Sequence: Synthetic peptide
  Seed: AQRLCQPVL (PMEL_HUMAN)
AERLCQPVI

SEQ ID NO: 135633 - protein, 9 aa, Artificial Sequence
  Description of Artificial Sequence: Synthetic peptide
  Seed: KHFLRNQPL (PMEL_HUMAN)
KYFLRNQPY

SEQ ID NO: 135634 - protein, 9 aa, Artificial Sequence
  Description of Artificial Sequence: Synthetic peptide
  Seed: LLHLAVIGA (PMEL_HUMAN)
LMHLAVIGA

SEQ ID NO: 135635 - protein, 9 aa, Artificial Sequence
  Description of Artificial Sequence: Synthetic peptide
  Seed: QPLTFALQL (PMEL_HUMAN)
QPLTFALQY

SEQ ID NO: 135636 - protein, 9 aa, Artificial Sequence
  Description of Artificial Sequence: Synthetic peptide
  Seed: LHDPSGYLA (PMEL_HUMAN)
LHDPSGYLV

SEQ ID NO: 135637 - protein, 10 aa, Artificial Sequence
  Description of Artificial Sequence: Synthetic peptide
  Seed: YRYGSFSVTL (PMEL_HUMAN)
YHYGSFSVTL

SEQ ID NO: 135638 - protein, 9 aa, Artificial Sequence
  Description of Artificial Sequence: Synthetic peptide
  Seed: AVVSTQLIM (PMEL_HUMAN)
AHVSTQLIY

SEQ ID NO: 135639 - protein, 10 aa, Artificial Sequence
  Description of Artificial Sequence: Synthetic peptide
  Seed: MPTAESTGMT (PMEL_HUMAN)
MMTAESTGMV

SEQ ID NO: 135640 - protein, 10 aa, Artificial Sequence
  Description of Artificial Sequence: Synthetic peptide
  Seed: VLMAVVLASL (PMEL_HUMAN)
VAMAVVLASA

SEQ ID NO: 135641 - protein, 10 aa, Artificial Sequence
  Description of Artificial Sequence: Synthetic peptide
  Seed: VVLASLIYRR (PMEL_HUMAN)
VSLASLIYRK

SEQ ID NO: 135642 - protein, 10 aa, Artificial Sequence
  Description of Artificial Sequence: Synthetic peptide
  Seed: KTWGQYWQVL (PMEL_HUMAN)
KMWGQYWQVY

SEQ ID NO: 135643 - protein, 10 aa, Artificial Sequence
  Description of Artificial Sequence: Synthetic peptide
  Seed: SVPQLPHSSS (PMEL_HUMAN)
SMPQLPHSSM

SEQ ID NO: 135644 - protein, 10 aa, Artificial Sequence
  Description of Artificial Sequence: Synthetic peptide
  Seed: YVWKTWGQYW (PMEL_HUMAN)
YPWKTWGQYW

SEQ ID NO: 135645 - protein, 9 aa, Artificial Sequence
  Description of Artificial Sequence: Synthetic peptide
  Seed: LSIGTGRAM (PMEL_HUMAN)
LFIGTGRAI

SEQ ID NO: 135646 - protein, 9 aa, Artificial Sequence
  Description of Artificial Sequence: Synthetic peptide
  Seed: MLGTHTMEV (PMEL_HUMAN)
MTGTHTMEY

SEQ ID NO: 135647 - protein, 9 aa, Artificial Sequence
  Description of Artificial Sequence: Synthetic peptide
  Seed: LTSCGSSPV (PMEL_HUMAN)
LISCGSSPI

SEQ ID NO: 135648 - protein, 9 aa, Artificial Sequence
  Description of Artificial Sequence: Synthetic peptide
  Seed: KQDFSVPQL (PMEL_HUMAN)
KFDFSVPQI

SEQ ID NO: 135649 - protein, 9 aa, Artificial Sequence
  Description of Artificial Sequence: Synthetic peptide
  Seed: AVIGALLAV (PMEL_HUMAN)
AQIGALLAV

SEQ ID NO: 135650 - protein, 10 aa, Artificial Sequence
  Description of Artificial Sequence: Synthetic peptide
  Seed: GRAMLGTHTM (PMEL_HUMAN)
GRAMLGTHTI

SEQ ID NO: 135651 - protein, 10 aa, Artificial Sequence
  Description of Artificial Sequence: Synthetic peptide
  Seed: YRYGSFSVTL (PMEL_HUMAN)
YCYGSFSVTM

SEQ ID NO: 135652 - protein, 9 aa, Artificial Sequence
  Description of Artificial Sequence: Synthetic peptide
  Seed: KTWGQYWQV (PMEL_HUMAN)
KGWGQYWQW

SEQ ID NO: 135653 - protein, 10 aa, Artificial Sequence
  Description of Artificial Sequence: Synthetic peptide
  Seed: DGTATLRLVK (PMEL_HUMAN)
DCTATLRLVR

SEQ ID NO: 135654 - protein, 10 aa, Artificial Sequence
  Description of Artificial Sequence: Synthetic peptide
  Seed: GTATLRLVKR (PMEL_HUMAN)
GMATLRLVKR

SEQ ID NO: 135655 - protein, 10 aa, Artificial Sequence
  Description of Artificial Sequence: Synthetic peptide
  Seed: RQLYPEWTEA (PMEL_HUMAN)
RWLYPEWTEF

SEQ ID NO: 135656 - protein, 9 aa, Artificial Sequence
  Description of Artificial Sequence: Synthetic peptide
  Seed: LPDGQVIWV (PMEL_HUMAN)
LYDGQVIWV

SEQ ID NO: 135657 - protein, 10 aa, Artificial Sequence
  Description of Artificial Sequence: Synthetic peptide
  Seed: RGSRSYVPLA (PMEL_HUMAN)
RPSRSYVPLM

SEQ ID NO: 135658 - protein, 9 aa, Artificial Sequence
  Description of Artificial Sequence: Synthetic peptide
  Seed: ASFSIALNF (PMEL_HUMAN)
AHFSIALNY

SEQ ID NO: 135659 - protein, 9 aa, Artificial Sequence
  Description of Artificial Sequence: Synthetic peptide
  Seed: VISTAPVQM (PMEL_HUMAN)
VASTAPVQI

SEQ ID NO: 135660 - protein, 11 aa, Artificial Sequence
  Description of Artificial Sequence: Synthetic peptide
  Seed: LAEADLSYTWD (PMEL_HUMAN)
LSEADLSYTWW

SEQ ID NO: 135661 - protein, 10 aa, Artificial Sequence
  Description of Artificial Sequence: Synthetic peptide
  Seed: LAVGATKVPR (PMEL_HUMAN)
LFVGATKVPR

SEQ ID NO: 135662 - protein, 9 aa, Artificial Sequence
  Description of Artificial Sequence: Synthetic peptide
  Seed: VSEVMGTTL (PMEL_HUMAN)
VIEVMGTTM

SEQ ID NO: 135663 - protein, 9 aa, Artificial Sequence
  Description of Artificial Sequence: Synthetic peptide
  Seed: SQVWGGQPV (PMEL_HUMAN)
SKVWGGQPI

SEQ ID NO: 135664 - protein, 9 aa, Artificial Sequence
  Description of Artificial Sequence: Synthetic peptide
  Seed: QEAGLGQVP (PMEL_HUMAN)
QEAGLGQVF

SEQ ID NO: 135665 - protein, 8 aa, Artificial Sequence
  Description of Artificial Sequence: Synthetic peptide
  Seed: TEWVETTA (PMEL_HUMAN)
TEWVETTY

SEQ ID NO: 135666 - protein, 9 aa, Artificial Sequence
  Description of Artificial Sequence: Synthetic peptide
  Seed: QLHDPSGYL (PMEL_HUMAN)
QMHDPSGYL

SEQ ID NO: 135667 - protein, 9 aa, Artificial Sequence
  Description of Artificial Sequence: Synthetic peptide
  Seed: EVVGTTPGQ (PMEL_HUMAN)
EIVGTTPGR

SEQ ID NO: 135668 - protein, 9 aa, Artificial Sequence
  Description of Artificial Sequence: Synthetic peptide
  Seed: TAEAPNTTA (PMEL_HUMAN)
TTEAPNTTF

SEQ ID NO: 135669 - protein, 9 aa, Artificial Sequence
  Description of Artificial Sequence: Synthetic peptide
  Seed: WQVLGGPVS (PMEL_HUMAN)
WKVLGGPVY

SEQ ID NO: 135670 - protein, 9 aa, Artificial Sequence
  Description of Artificial Sequence: Synthetic peptide
  Seed: FSVSVSQLR (PMEL_HUMAN)
FTVSVSQLR

SEQ ID NO: 135671 - protein, 9 aa, Artificial Sequence
  Description of Artificial Sequence: Synthetic peptide
  Seed: AQVVLQAAI (PMEL_HUMAN)
AHVVLQAAI

SEQ ID NO: 135672 - protein, 10 aa, Artificial Sequence
  Description of Artificial Sequence: Synthetic peptide
  Seed: MTPAEVSIVV (PMEL_HUMAN)
MSPAEVSIVY

SEQ ID NO: 135673 - protein, 9 aa, Artificial Sequence
  Description of Artificial Sequence: Synthetic peptide
  Seed: MSTPEATGM (PMEL_HUMAN)
MATPEATGW

SEQ ID NO: 135674 - protein, 9 aa, Artificial Sequence
  Description of Artificial Sequence: Synthetic peptide
  Seed: SQVWGGQPV (PMEL_HUMAN)
STVWGGQPV

SEQ ID NO: 135675 - protein, 9 aa, Artificial Sequence
  Description of Artificial Sequence: Synthetic peptide
  Seed: LTSCGSSPV (PMEL_HUMAN)
LVSCGSSPI

SEQ ID NO: 135676 - protein, 11 aa, Artificial Sequence
  Description of Artificial Sequence: Synthetic peptide
  Seed: APTAEPSGTTS (PMEL_HUMAN)
APTAEPSGTTL

SEQ ID NO: 135677 - protein, 10 aa, Artificial Sequence
  Description of Artificial Sequence: Synthetic peptide
  Seed: MTPAEVSIVV (PMEL_HUMAN)
MYPAEVSIVV

SEQ ID NO: 135678 - protein, 10 aa, Artificial Sequence
  Description of Artificial Sequence: Synthetic peptide
  Seed: YLAEADLSYT (PMEL_HUMAN)
YVAEADLSYT

SEQ ID NO: 135679 - protein, 9 aa, Artificial Sequence
  Description of Artificial Sequence: Synthetic peptide
  Seed: NFPGSQKVL (PMEL_HUMAN)
NAPGSQKVM

SEQ ID NO: 135680 - protein, 10 aa, Artificial Sequence
  Description of Artificial Sequence: Synthetic peptide
  Seed: VLMAVVLASL (PMEL_HUMAN)
VHMAVVLASI

SEQ ID NO: 135681 - protein, 9 aa, Artificial Sequence
  Description of Artificial Sequence: Synthetic peptide
  Seed: RALVVTHTY (PMEL_HUMAN)
RALVVTHTM

SEQ ID NO: 135682 - protein, 11 aa, Artificial Sequence
  Description of Artificial Sequence: Synthetic peptide
  Seed: SLADTNSLAVV (PMEL_HUMAN)
SIADTNSLAVL

SEQ ID NO: 135683 - protein, 10 aa, Artificial Sequence
  Description of Artificial Sequence: Synthetic peptide
  Seed: NSLAVVSTQL (PMEL_HUMAN)
NSLAVVSTQW

SEQ ID NO: 135684 - protein, 10 aa, Artificial Sequence
  Description of Artificial Sequence: Synthetic peptide
  Seed: RGSRSYVPLA (PMEL_HUMAN)
RCSRSYVPLV

SEQ ID NO: 135685 - protein, 10 aa, Artificial Sequence
  Description of Artificial Sequence: Synthetic peptide
  Seed: KTWGQYWQVL (PMEL_HUMAN)
KTWGQYWQVY

SEQ ID NO: 135686 - protein, 9 aa, Artificial Sequence
  Description of Artificial Sequence: Synthetic peptide
  Seed: MAVVLASLI (PMEL_HUMAN)
MMVVLASLA

SEQ ID NO: 135687 - protein, 10 aa, Artificial Sequence
  Description of Artificial Sequence: Synthetic peptide
  Seed: LAEADLSYTW (PMEL_HUMAN)
LCEADLSYTW

SEQ ID NO: 135688 - protein, 9 aa, Artificial Sequence
  Description of Artificial Sequence: Synthetic peptide
  Seed: VQVPTTEVI (PMEL_HUMAN)
VTVPTTEVM

SEQ ID NO: 135689 - protein, 9 aa, Artificial Sequence
  Description of Artificial Sequence: Synthetic peptide
  Seed: AQVVLQAAI (PMEL_HUMAN)
AKVVLQAAY

SEQ ID NO: 135690 - protein, 9 aa, Artificial Sequence
  Description of Artificial Sequence: Synthetic peptide
  Seed: LNFPGSQKV (PMEL_HUMAN)
LLFPGSQKI

SEQ ID NO: 135691 - protein, 9 aa, Artificial Sequence
  Description of Artificial Sequence: Synthetic peptide
  Seed: SSIMSTESI (PMEL_HUMAN)
SVIMSTESF

SEQ ID NO: 135692 - protein, 9 aa, Artificial Sequence
  Description of Artificial Sequence: Synthetic peptide
  Seed: RALVVTHTY (PMEL_HUMAN)
RRLVVTHTY

SEQ ID NO: 135693 - protein, 9 aa, Artificial Sequence
  Description of Artificial Sequence: Synthetic peptide
  Seed: GSRSYVPLA (PMEL_HUMAN)
GSRSYVPLY

SEQ ID NO: 135694 - protein, 9 aa, Artificial Sequence
  Description of Artificial Sequence: Synthetic peptide
  Seed: VLPSPACQL (PMEL_HUMAN)
VAPSPACQV

SEQ ID NO: 135695 - protein, 9 aa, Artificial Sequence
  Description of Artificial Sequence: Synthetic peptide
  Seed: KTWGQYWQV (PMEL_HUMAN)
KLWGQYWQT

SEQ ID NO: 135696 - protein, 9 aa, Artificial Sequence
  Description of Artificial Sequence: Synthetic peptide
  Seed: TPAEVSIVV (PMEL_HUMAN)
TIAEVSIVV

SEQ ID NO: 135697 - protein, 9 aa, Artificial Sequence
  Description of Artificial Sequence: Synthetic peptide
  Seed: VVLSGTTAA (PMEL_HUMAN)
VVLSGTTAF

SEQ ID NO: 135698 - protein, 9 aa, Artificial Sequence
  Description of Artificial Sequence: Synthetic peptide
  Seed: YHRRGSRSY (PMEL_HUMAN)
YFRRGSRSL

SEQ ID NO: 135699 - protein, 10 aa, Artificial Sequence
  Description of Artificial Sequence: Synthetic peptide
  Seed: VPLAHSSSAF (PMEL_HUMAN)
VLLAHSSSAM

SEQ ID NO: 135700 - protein, 10 aa, Artificial Sequence
  Description of Artificial Sequence: Synthetic peptide
  Seed: AVVLASLIYR (PMEL_HUMAN)
ACVLASLIYK

SEQ ID NO: 135701 - protein, 10 aa, Artificial Sequence
  Description of Artificial Sequence: Synthetic peptide
  Seed: GRAMLGTHTM (PMEL_HUMAN)
GFAMLGTHTY

SEQ ID NO: 135702 - protein, 9 aa, Artificial Sequence
  Description of Artificial Sequence: Synthetic peptide
  Seed: VTLDIVQGI (PMEL_HUMAN)
VILDIVQGI

SEQ ID NO: 135703 - protein, 9 aa, Artificial Sequence
  Description of Artificial Sequence: Synthetic peptide
  Seed: VSVSQLRAL (PMEL_HUMAN)
VRVSQLRAV

SEQ ID NO: 135704 - protein, 9 aa, Artificial Sequence
  Description of Artificial Sequence: Synthetic peptide
  Seed: AQRLCQPVL (PMEL_HUMAN)
ATRLCQPVR

SEQ ID NO: 135705 - protein, 9 aa, Artificial Sequence
  Description of Artificial Sequence: Synthetic peptide
  Seed: RAMLGTHTM (PMEL_HUMAN)
RRMLGTHTF

SEQ ID NO: 135706 - protein, 10 aa, Artificial Sequence
  Description of Artificial Sequence: Synthetic peptide
  Seed: SVTLDIVQGI (PMEL_HUMAN)
SCTLDIVQGV

SEQ ID NO: 135707 - protein, 11 aa, Artificial Sequence
  Description of Artificial Sequence: Synthetic peptide
  Seed: SYVPLAHSSSA (PMEL_HUMAN)
SWVPLAHSSSL

SEQ ID NO: 135708 - protein, 9 aa, Artificial Sequence
  Description of Artificial Sequence: Synthetic peptide
  Seed: AAQVTTTEW (PMEL_HUMAN)
AIQVTTTEF

SEQ ID NO: 135709 - protein, 10 aa, Artificial Sequence
  Description of Artificial Sequence: Synthetic peptide
  Seed: RQVPLDCVLY (PMEL_HUMAN)
RIVPLDCVLF

SEQ ID NO: 135710 - protein, 9 aa, Artificial Sequence
  Description of Artificial Sequence: Synthetic peptide
  Seed: VQMPTAEST (PMEL_HUMAN)
VAMPTAESY

SEQ ID NO: 135711 - protein, 9 aa, Artificial Sequence
  Description of Artificial Sequence: Synthetic peptide
  Seed: RAMLGTHTM (PMEL_HUMAN)
RSMLGTHTW

SEQ ID NO: 135712 - protein, 9 aa, Artificial Sequence
  Description of Artificial Sequence: Synthetic peptide
  Seed: AQVVLQAAI (PMEL_HUMAN)
ALVVLQAAV

SEQ ID NO: 135713 - protein, 9 aa, Artificial Sequence
  Description of Artificial Sequence: Synthetic peptide
  Seed: VQMPTAEST (PMEL_HUMAN)
VAMPTAESM

SEQ ID NO: 135714 - protein, 10 aa, Artificial Sequence
  Description of Artificial Sequence: Synthetic peptide
  Seed: TYLEPGPVTA (PMEL_HUMAN)
THLEPGPVTL

SEQ ID NO: 135715 - protein, 10 aa, Artificial Sequence
  Description of Artificial Sequence: Synthetic peptide
  Seed: MPTAESTGMT (PMEL_HUMAN)
MRTAESTGML

SEQ ID NO: 135716 - protein, 10 aa, Artificial Sequence
  Description of Artificial Sequence: Synthetic peptide
  Seed: RTKAWNRQLY (PMEL_HUMAN)
RAKAWNRQLY

SEQ ID NO: 135717 - protein, 9 aa, Artificial Sequence
  Description of Artificial Sequence: Synthetic peptide
  Seed: AVIGALLAV (PMEL_HUMAN)
ANIGALLAY

SEQ ID NO: 135718 - protein, 9 aa, Artificial Sequence
  Description of Artificial Sequence: Synthetic peptide
  Seed: ITDQVPFSV (PMEL_HUMAN)
IMDQVPFSM

SEQ ID NO: 135719 - protein, 9 aa, Artificial Sequence
  Description of Artificial Sequence: Synthetic peptide
  Seed: RAMLGTHTM (PMEL_HUMAN)
RPMLGTHTY

SEQ ID NO: 135720 - protein, 9 aa, Artificial Sequence
  Description of Artificial Sequence: Synthetic peptide
  Seed: VPSGEGDAF (PMEL_HUMAN)
VVSGEGDAY

SEQ ID NO: 135721 - protein, 9 aa, Artificial Sequence
  Description of Artificial Sequence: Synthetic peptide
  Seed: RLVKRQVPL (PMEL_HUMAN)
RKVKRQVPY

SEQ ID NO: 135722 - protein, 10 aa, Artificial Sequence
  Description of Artificial Sequence: Synthetic peptide
  Seed: EVISTAPVQM (PMEL_HUMAN)
EVISTAPVQY

SEQ ID NO: 135723 - protein, 9 aa, Artificial Sequence
  Description of Artificial Sequence: Synthetic peptide
  Seed: SSHWLRLPR (PMEL_HUMAN)
SYHWLRLPR

SEQ ID NO: 135724 - protein, 9 aa, Artificial Sequence
  Description of Artificial Sequence: Synthetic peptide
  Seed: FSVSVSQLR (PMEL_HUMAN)
FSVSVSQLY

SEQ ID NO: 135725 - protein, 10 aa, Artificial Sequence
  Description of Artificial Sequence: Synthetic peptide
  Seed: LHLAVIGALL (PMEL_HUMAN)
LWLAVIGALV

SEQ ID NO: 135726 - protein, 9 aa, Artificial Sequence
  Description of Artificial Sequence: Synthetic peptide
  Seed: GQVPLIVGI (PMEL_HUMAN)
GTVPLIVGA

SEQ ID NO: 135727 - protein, 9 aa, Artificial Sequence
  Description of Artificial Sequence: Synthetic peptide
  Seed: RLMKQDFSV (PMEL_HUMAN)
RMMKQDFSA

SEQ ID NO: 135728 - protein, 9 aa, Artificial Sequence
  Description of Artificial Sequence: Synthetic peptide
  Seed: FLRNQPLTF (PMEL_HUMAN)
FARNQPLTA

SEQ ID NO: 135729 - protein, 11 aa, Artificial Sequence
  Description of Artificial Sequence: Synthetic peptide
  Seed: RTKAWNRQLYP (PMEL_HUMAN)
RMKAWNRQLYK

SEQ ID NO: 135730 - protein, 9 aa, Artificial Sequence
  Description of Artificial Sequence: Synthetic peptide
  Seed: VQMPTAEST (PMEL_HUMAN)
VSMPTAESM

SEQ ID NO: 135731 - protein, 9 aa, Artificial Sequence
  Description of Artificial Sequence: Synthetic peptide
  Seed: ANASFSIAL (PMEL_HUMAN)
ALASFSIAY

SEQ ID NO: 135732 - protein, 9 aa, Artificial Sequence
  Description of Artificial Sequence: Synthetic peptide
  Seed: QVIWVNNTI (PMEL_HUMAN)
QQIWVNNTF

SEQ ID NO: 135733 - protein, 10 aa, Artificial Sequence
  Description of Artificial Sequence: Synthetic peptide
  Seed: LAVIGALLAV (PMEL_HUMAN)
LYVIGALLAV

SEQ ID NO: 135734 - protein, 10 aa, Artificial Sequence
  Description of Artificial Sequence: Synthetic peptide
  Seed: SCPIGENSPL (PMEL_HUMAN)
SHPIGENSPL

SEQ ID NO: 135735 - protein, 11 aa, Artificial Sequence
  Description of Artificial Sequence: Synthetic peptide
  Seed: RRGSRSYVPLA (PMEL_HUMAN)
RYGSRSYVPLK

SEQ ID NO: 135736 - protein, 9 aa, Artificial Sequence
  Description of Artificial Sequence: Synthetic peptide
  Seed: VVLQAAIPL (PMEL_HUMAN)
VLLQAAIPL

SEQ ID NO: 135737 - protein, 9 aa, Artificial Sequence
  Description of Artificial Sequence: Synthetic peptide
  Seed: MAVVLASLI (PMEL_HUMAN)
MVVVLASLY

SEQ ID NO: 135738 - protein, 10 aa, Artificial Sequence
  Description of Artificial Sequence: Synthetic peptide
  Seed: LAHSSSAFTI (PMEL_HUMAN)
LAHSSSAFTY

SEQ ID NO: 135739 - protein, 11 aa, Artificial Sequence
  Description of Artificial Sequence: Synthetic peptide
  Seed: FVYVWKTWGQY (PMEL_HUMAN)
FFYVWKTWGQY

SEQ ID NO: 135740 - protein, 9 aa, Artificial Sequence
  Description of Artificial Sequence: Synthetic peptide
  Seed: TVYHRRGSR (PMEL_HUMAN)
TSYHRRGSR

SEQ ID NO: 135741 - protein, 11 aa, Artificial Sequence
  Description of Artificial Sequence: Synthetic peptide
  Seed: YVPLAHSSSAF (PMEL_HUMAN)
YKPLAHSSSAF

SEQ ID NO: 135742 - protein, 10 aa, Artificial Sequence
  Description of Artificial Sequence: Synthetic peptide
  Seed: TAEPSGTTSV (PMEL_HUMAN)
TAEPSGTTSL

SEQ ID NO: 135743 - protein, 10 aa, Artificial Sequence
  Description of Artificial Sequence: Synthetic peptide
  Seed: QILKGGSGTY (PMEL_HUMAN)
QVLKGGSGTR

SEQ ID NO: 135744 - protein, 10 aa, Artificial Sequence
  Description of Artificial Sequence: Synthetic peptide
  Seed: VPQLPHSSSH (PMEL_HUMAN)
VRQLPHSSSY

SEQ ID NO: 135745 - protein, 10 aa, Artificial Sequence
  Description of Artificial Sequence: Synthetic peptide
  Seed: VGILLVLMAV (PMEL_HUMAN)
VQILLVLMAV

SEQ ID NO: 135746 - protein, 9 aa, Artificial Sequence
  Description of Artificial Sequence: Synthetic peptide
  Seed: MAVVLASLI (PMEL_HUMAN)
MRVVLASLY

SEQ ID NO: 135747 - protein, 9 aa, Artificial Sequence
  Description of Artificial Sequence: Synthetic peptide
  Seed: QLRTKAWNR (PMEL_HUMAN)
QMRTKAWNR

SEQ ID NO: 135748 - protein, 10 aa, Artificial Sequence
  Description of Artificial Sequence: Synthetic peptide
  Seed: TLISRALVVT (PMEL_HUMAN)
TVISRALVVV

SEQ ID NO: 135749 - protein, 9 aa, Artificial Sequence
  Description of Artificial Sequence: Synthetic peptide
  Seed: VSEVMGTTL (PMEL_HUMAN)
VYEVMGTTL

SEQ ID NO: 135750 - protein, 9 aa, Artificial Sequence
  Description of Artificial Sequence: Synthetic peptide
  Seed: FTITDQVPF (PMEL_HUMAN)
FPITDQVPA

SEQ ID NO: 135751 - protein, 10 aa, Artificial Sequence
  Description of Artificial Sequence: Synthetic peptide
  Seed: AEADLSYTWD (PMEL_HUMAN)
AEADLSYTWR

SEQ ID NO: 135752 - protein, 9 aa, Artificial Sequence
  Description of Artificial Sequence: Synthetic peptide
  Seed: KQDFSVPQL (PMEL_HUMAN)
KMDFSVPQT

SEQ ID NO: 135753 - protein, 8 aa, Artificial Sequence
  Description of Artificial Sequence: Synthetic peptide
  Seed: SSGTLISR (PMEL_HUMAN)
SAGTLISL

SEQ ID NO: 135754 - protein, 9 aa, Artificial Sequence
  Description of Artificial Sequence: Synthetic peptide
  Seed: WQVLGGPVS (PMEL_HUMAN)
WMVLGGPVL

SEQ ID NO: 135755 - protein, 9 aa, Artificial Sequence
  Description of Artificial Sequence: Synthetic peptide
  Seed: TPAEVSIVV (PMEL_HUMAN)
TIAEVSIVL

SEQ ID NO: 135756 - protein, 11 aa, Artificial Sequence
  Description of Artificial Sequence: Synthetic peptide
  Seed: GYLAEADLSYT (PMEL_HUMAN)
GRLAEADLSYV

SEQ ID NO: 135757 - protein, 9 aa, Artificial Sequence
  Description of Artificial Sequence: Synthetic peptide
  Seed: SQKRSFVYV (PMEL_HUMAN)
SQKRSFVYF

SEQ ID NO: 135758 - protein, 9 aa, Artificial Sequence
  Description of Artificial Sequence: Synthetic peptide
  Seed: YLAEADLSY (PMEL_HUMAN)
YIAEADLSW

SEQ ID NO: 135759 - protein, 10 aa, Artificial Sequence
  Description of Artificial Sequence: Synthetic peptide
  Seed: RQLRTKAWNR (PMEL_HUMAN)
RALRTKAWNR

SEQ ID NO: 135760 - protein, 8 aa, Artificial Sequence
  Description of Artificial Sequence: Synthetic peptide
  Seed: SHWLRLPR (PMEL_HUMAN)
SFWLRLPR

SEQ ID NO: 135761 - protein, 9 aa, Artificial Sequence
  Description of Artificial Sequence: Synthetic peptide
  Seed: GMTPAEVSI (PMEL_HUMAN)
GLTPAEVSI

SEQ ID NO: 135762 - protein, 9 aa, Artificial Sequence
  Description of Artificial Sequence: Synthetic peptide
  Seed: ITDQVPFSV (PMEL_HUMAN)
IQDQVPFSY

SEQ ID NO: 135763 - protein, 9 aa, Artificial Sequence
  Description of Artificial Sequence: Synthetic peptide
  Seed: TAQVVLQAA (PMEL_HUMAN)
THQVVLQAI

SEQ ID NO: 135764 - protein, 9 aa, Artificial Sequence
  Description of Artificial Sequence: Synthetic peptide
  Seed: VVLSGTTAA (PMEL_HUMAN)
VALSGTTAM

SEQ ID NO: 135765 - protein, 9 aa, Artificial Sequence
  Description of Artificial Sequence: Synthetic peptide
  Seed: HSSSHWLRL (PMEL_HUMAN)
HASSHWLRV

SEQ ID NO: 135766 - protein, 10 aa, Artificial Sequence
  Description of Artificial Sequence: Synthetic peptide
  Seed: THTMEVTVYH (PMEL_HUMAN)
TTTMEVTVYK

SEQ ID NO: 135767 - protein, 9 aa, Artificial Sequence
  Description of Artificial Sequence: Synthetic peptide
  Seed: SLAVVSTQL (PMEL_HUMAN)
STAVVSTQF

SEQ ID NO: 135768 - protein, 8 aa, Artificial Sequence
  Description of Artificial Sequence: Synthetic peptide
  Seed: SNDGPTLI (PMEL_HUMAN)
SGDGPTLM

SEQ ID NO: 135769 - protein, 11 aa, Artificial Sequence
  Description of Artificial Sequence: Synthetic peptide
  Seed: RSYVPLAHSSS (PMEL_HUMAN)
RVYVPLAHSSK

SEQ ID NO: 135770 - protein, 9 aa, Artificial Sequence
  Description of Artificial Sequence: Synthetic peptide
  Seed: SLAVVSTQL (PMEL_HUMAN)
SAAVVSTQV

SEQ ID NO: 135771 - protein, 9 aa, Artificial Sequence
  Description of Artificial Sequence: Synthetic peptide
  Seed: RYGSFSVTL (PMEL_HUMAN)
RFGSFSVTI

SEQ ID NO: 135772 - protein, 11 aa, Artificial Sequence
  Description of Artificial Sequence: Synthetic peptide
  Seed: QLYPEWTEAQR (PMEL_HUMAN)
QAYPEWTEAQR

SEQ ID NO: 135773 - protein, 10 aa, Artificial Sequence
  Description of Artificial Sequence: Synthetic peptide
  Seed: SQVWGGQPVY (PMEL_HUMAN)
SQVWGGQPVL

SEQ ID NO: 135774 - protein, 9 aa, Artificial Sequence
  Description of Artificial Sequence: Synthetic peptide
  Seed: MAVVLASLI (PMEL_HUMAN)
MAVVLASLM

SEQ ID NO: 135775 - protein, 10 aa, Artificial Sequence
  Description of Artificial Sequence: Synthetic peptide
  Seed: SLIYRRRLMK (PMEL_HUMAN)
SCIYRRRLMK

SEQ ID NO: 135776 - protein, 10 aa, Artificial Sequence
  Description of Artificial Sequence: Synthetic peptide
  Seed: VPLAHSSSAF (PMEL_HUMAN)
VALAHSSSAY

SEQ ID NO: 135777 - protein, 9 aa, Artificial Sequence
  Description of Artificial Sequence: Synthetic peptide
  Seed: FTITDQVPF (PMEL_HUMAN)
FEITDQVPY

SEQ ID NO: 135778 - protein, 10 aa, Artificial Sequence
  Description of Artificial Sequence: Synthetic peptide
  Seed: MLGTHTMEVT (PMEL_HUMAN)
MLGTHTMEVV

SEQ ID NO: 135779 - protein, 10 aa, Artificial Sequence
  Description of Artificial Sequence: Synthetic peptide
  Seed: SLIYRRRLMK (PMEL_HUMAN)
SAIYRRRLMK

SEQ ID NO: 135780 - protein, 10 aa, Artificial Sequence
  Description of Artificial Sequence: Synthetic peptide
  Seed: SVPQLPHSSS (PMEL_HUMAN)
SDPQLPHSSI

SEQ ID NO: 135781 - protein, 10 aa, Artificial Sequence
  Description of Artificial Sequence: Synthetic peptide
  Seed: KVLPDGQVIW (PMEL_HUMAN)
KVLPDGQVIY

SEQ ID NO: 135782 - protein, 9 aa, Artificial Sequence
  Description of Artificial Sequence: Synthetic peptide
  Seed: ALNFPGSQK (PMEL_HUMAN)
ATNFPGSQL

SEQ ID NO: 135783 - protein, 9 aa, Artificial Sequence
  Description of Artificial Sequence: Synthetic peptide
  Seed: LNFPGSQKV (PMEL_HUMAN)
LAFPGSQKM

SEQ ID NO: 135784 - protein, 9 aa, Artificial Sequence
  Description of Artificial Sequence: Synthetic peptide
  Seed: HLAVIGALL (PMEL_HUMAN)
HVAVIGALM

SEQ ID NO: 135785 - protein, 8 aa, Artificial Sequence
  Description of Artificial Sequence: Synthetic peptide
  Seed: VLYRYGSF (PMEL_HUMAN)
VQYRYGSM

SEQ ID NO: 135786 - protein, 9 aa, Artificial Sequence
  Description of Artificial Sequence: Synthetic peptide
  Seed: EVMGTTLAE (PMEL_HUMAN)
ETMGTTLAF

SEQ ID NO: 135787 - protein, 9 aa, Artificial Sequence
  Description of Artificial Sequence: Synthetic peptide
  Seed: AVIGALLAV (PMEL_HUMAN)
ALIGALLAV

SEQ ID NO: 135788 - protein, 10 aa, Artificial Sequence
  Description of Artificial Sequence: Synthetic peptide
  Seed: KRQVPLDCVL (PMEL_HUMAN)
KPQVPLDCVM

SEQ ID NO: 135789 - protein, 10 aa, Artificial Sequence
  Description of Artificial Sequence: Synthetic peptide
  Seed: WKTWGQYWQV (PMEL_HUMAN)
WITWGQYWQL

SEQ ID NO: 135790 - protein, 9 aa, Artificial Sequence
  Description of Artificial Sequence: Synthetic peptide
  Seed: GSSPVPGTT (PMEL_HUMAN)
GISPVPGTY

SEQ ID NO: 135791 - protein, 10 aa, Artificial Sequence
  Description of Artificial Sequence: Synthetic peptide
  Seed: MAVVLASLIY (PMEL_HUMAN)
MEVVLASLIR

SEQ ID NO: 135792 - protein, 9 aa, Artificial Sequence
  Description of Artificial Sequence: Synthetic peptide
  Seed: ALDGGNKHF (PMEL_HUMAN)
AMDGGNKHM

SEQ ID NO: 135793 - protein, 8 aa, Artificial Sequence
  Description of Artificial Sequence: Synthetic peptide
  Seed: TEWVETTA (PMEL_HUMAN)
TEWVETTV

SEQ ID NO: 135794 - protein, 9 aa, Artificial Sequence
  Description of Artificial Sequence: Synthetic peptide
  Seed: AVVSTQLIM (PMEL_HUMAN)
ASVSTQLIL

SEQ ID NO: 135795 - protein, 9 aa, Artificial Sequence
  Description of Artificial Sequence: Synthetic peptide
  Seed: GILLVLMAV (PMEL_HUMAN)
GMLLVLMAA

SEQ ID NO: 135796 - protein, 11 aa, Artificial Sequence
  Description of Artificial Sequence: Synthetic peptide
  Seed: SYVPLAHSSSA (PMEL_HUMAN)
STVPLAHSSSL

SEQ ID NO: 135797 - protein, 10 aa, Artificial Sequence
  Description of Artificial Sequence: Synthetic peptide
  Seed: YGSFSVTLDI (PMEL_HUMAN)
YDSFSVTLDF

SEQ ID NO: 135798 - protein, 9 aa, Artificial Sequence
  Description of Artificial Sequence: Synthetic peptide
  Seed: KVLPDGQVI (PMEL_HUMAN)
KILPDGQVV

SEQ ID NO: 135799 - protein, 11 aa, Artificial Sequence
  Description of Artificial Sequence: Synthetic peptide
  Seed: KAWNRQLYPEW (PMEL_HUMAN)
KSWNRQLYPEW

SEQ ID NO: 135800 - protein, 10 aa, Artificial Sequence
  Description of Artificial Sequence: Synthetic peptide
  Seed: SVTLDIVQGI (PMEL_HUMAN)
SMTLDIVQGM

SEQ ID NO: 135801 - protein, 10 aa, Artificial Sequence
  Description of Artificial Sequence: Synthetic peptide
  Seed: LAVVSTQLIM (PMEL_HUMAN)
LVVVSTQLIY

SEQ ID NO: 135802 - protein, 10 aa, Artificial Sequence
  Description of Artificial Sequence: Synthetic peptide
  Seed: MPTAESTGMT (PMEL_HUMAN)
MLTAESTGML

SEQ ID NO: 135803 - protein, 9 aa, Artificial Sequence
  Description of Artificial Sequence: Synthetic peptide
  Seed: AEAPNTTAG (PMEL_HUMAN)
AEAPNTTAC

SEQ ID NO: 135804 - protein, 9 aa, Artificial Sequence
  Description of Artificial Sequence: Synthetic peptide
  Seed: TAEAPNTTA (PMEL_HUMAN)
TAEAPNTTI

SEQ ID NO: 135805 - protein, 10 aa, Artificial Sequence
  Description of Artificial Sequence: Synthetic peptide
  Seed: RALDGGNKHF (PMEL_HUMAN)
RSLDGGNKHY

SEQ ID NO: 135806 - protein, 9 aa, Artificial Sequence
  Description of Artificial Sequence: Synthetic peptide
  Seed: KQDFSVPQL (PMEL_HUMAN)
KVDFSVPQI

SEQ ID NO: 135807 - protein, 10 aa, Artificial Sequence
  Description of Artificial Sequence: Synthetic peptide
  Seed: GSFSVTLDIV (PMEL_HUMAN)
GLFSVTLDIL

SEQ ID NO: 135808 - protein, 9 aa, Artificial Sequence
  Description of Artificial Sequence: Synthetic peptide
  Seed: SVQVPTTEV (PMEL_HUMAN)
SAQVPTTEL

SEQ ID NO: 135809 - protein, 10 aa, Artificial Sequence
  Description of Artificial Sequence: Synthetic peptide
  Seed: RALDGGNKHF (PMEL_HUMAN)
RRLDGGNKHL

SEQ ID NO: 135810 - protein, 10 aa, Artificial Sequence
  Description of Artificial Sequence: Synthetic peptide
  Seed: LVLMAVVLAS (PMEL_HUMAN)
LGLMAVVLAL

SEQ ID NO: 135811 - protein, 9 aa, Artificial Sequence
  Description of Artificial Sequence: Synthetic peptide
  Seed: LIYRRRLMK (PMEL_HUMAN)
LNYRRRLMR

SEQ ID NO: 135812 - protein, 10 aa, Artificial Sequence
  Description of Artificial Sequence: Synthetic peptide
  Seed: EVSIVVLSGT (PMEL_HUMAN)
ETSIVVLSGI

SEQ ID NO: 135813 - protein, 11 aa, Artificial Sequence
  Description of Artificial Sequence: Synthetic peptide
  Seed: FGDSSGTLISR (PMEL_HUMAN)
FMDSSGTLISI

SEQ ID NO: 135814 - protein, 9 aa, Artificial Sequence
  Description of Artificial Sequence: Synthetic peptide
  Seed: GQVPLIVGI (PMEL_HUMAN)
GLVPLIVGV

SEQ ID NO: 135815 - protein, 9 aa, Artificial Sequence
  Description of Artificial Sequence: Synthetic peptide
  Seed: RAMLGTHTM (PMEL_HUMAN)
RSMLGTHTI

SEQ ID NO: 135816 - protein, 9 aa, Artificial Sequence
  Description of Artificial Sequence: Synthetic peptide
  Seed: AEADLSYTW (PMEL_HUMAN)
AAADLSYTY

SEQ ID NO: 135817 - protein, 11 aa, Artificial Sequence
  Description of Artificial Sequence: Synthetic peptide
  Seed: RALDGGNKHFL (PMEL_HUMAN)
RMLDGGNKHFL

SEQ ID NO: 135818 - protein, 9 aa, Artificial Sequence
  Description of Artificial Sequence: Synthetic peptide
  Seed: ASFSIALNF (PMEL_HUMAN)
AGFSIALNW

SEQ ID NO: 135819 - protein, 9 aa, Artificial Sequence
  Description of Artificial Sequence: Synthetic peptide
  Seed: KVSNDGPTL (PMEL_HUMAN)
KYSNDGPTY

SEQ ID NO: 135820 - protein, 9 aa, Artificial Sequence
  Description of Artificial Sequence: Synthetic peptide
  Seed: SSIMSTESI (PMEL_HUMAN)
STIMSTESW

SEQ ID NO: 135821 - protein, 9 aa, Artificial Sequence
  Description of Artificial Sequence: Synthetic peptide
  Seed: RGSRSYVPL (PMEL_HUMAN)
RASRSYVPK

SEQ ID NO: 135822 - protein, 10 aa, Artificial Sequence
  Description of Artificial Sequence: Synthetic peptide
  Seed: RQLRTKAWNR (PMEL_HUMAN)
RNLRTKAWNR

SEQ ID NO: 135823 - protein, 9 aa, Artificial Sequence
  Description of Artificial Sequence: Synthetic peptide
  Seed: SITGSLGPL (PMEL_HUMAN)
SVTGSLGPL

SEQ ID NO: 135824 - protein, 11 aa, Artificial Sequence
  Description of Artificial Sequence: Synthetic peptide
  Seed: TEWVETTAREL (PMEL_HUMAN)
TEWVETTAREA

SEQ ID NO: 135825 - protein, 10 aa, Artificial Sequence
  Description of Artificial Sequence: Synthetic peptide
  Seed: LVLMAVVLAS (PMEL_HUMAN)
LSLMAVVLAV

SEQ ID NO: 135826 - protein, 9 aa, Artificial Sequence
  Description of Artificial Sequence: Synthetic peptide
  Seed: KAWNRQLYP (PMEL_HUMAN)
KFWNRQLYK

SEQ ID NO: 135827 - protein, 11 aa, Artificial Sequence
  Description of Artificial Sequence: Synthetic peptide
  Seed: FALQLHDPSGY (PMEL_HUMAN)
FPLQLHDPSGY

SEQ ID NO: 135828 - protein, 10 aa, Artificial Sequence
  Description of Artificial Sequence: Synthetic peptide
  Seed: GPLLDGTATL (PMEL_HUMAN)
GMLLDGTATV

SEQ ID NO: 135829 - protein, 9 aa, Artificial Sequence
  Description of Artificial Sequence: Synthetic peptide
  Seed: AQVVLQAAI (PMEL_HUMAN)
AQVVLQAAF

SEQ ID NO: 135830 - protein, 9 aa, Artificial Sequence
  Description of Artificial Sequence: Synthetic peptide
  Seed: ESTGMTPEK (PMEL_HUMAN)
EVTGMTPER

SEQ ID NO: 135831 - protein, 10 aa, Artificial Sequence
  Description of Artificial Sequence: Synthetic peptide
  Seed: VVLASLIYRR (PMEL_HUMAN)
VMLASLIYRQ

SEQ ID NO: 135832 - protein, 10 aa, Artificial Sequence
  Description of Artificial Sequence: Synthetic peptide
  Seed: SLIYRRRLMK (PMEL_HUMAN)
SAIYRRRLMR

SEQ ID NO: 135833 - protein, 10 aa, Artificial Sequence
  Description of Artificial Sequence: Synthetic peptide
  Seed: KVSNDGPTLI (PMEL_HUMAN)
KVSNDGPTLV

SEQ ID NO: 135834 - protein, 9 aa, Artificial Sequence
  Description of Artificial Sequence: Synthetic peptide
  Seed: YLEPGPVTA (PMEL_HUMAN)
YCEPGPVTV

SEQ ID NO: 135835 - protein, 9 aa, Artificial Sequence
  Description of Artificial Sequence: Synthetic peptide
  Seed: RYGSFSVTL (PMEL_HUMAN)
RTGSFSVTM

SEQ ID NO: 135836 - protein, 9 aa, Artificial Sequence
  Description of Artificial Sequence: Synthetic peptide
  Seed: MLGTHTMEV (PMEL_HUMAN)
MVGTHTMEV

SEQ ID NO: 135837 - protein, 9 aa, Artificial Sequence
  Description of Artificial Sequence: Synthetic peptide
  Seed: WQVLGGPVS (PMEL_HUMAN)
WRVLGGPVF

SEQ ID NO: 135838 - protein, 9 aa, Artificial Sequence
  Description of Artificial Sequence: Synthetic peptide
  Seed: YVWKTWGQY (PMEL_HUMAN)
YSWKTWGQM

SEQ ID NO: 135839 - protein, 9 aa, Artificial Sequence
  Description of Artificial Sequence: Synthetic peptide
  Seed: MPTAESTGM (PMEL_HUMAN)
MVTAESTGY

SEQ ID NO: 135840 - protein, 9 aa, Artificial Sequence
  Description of Artificial Sequence: Synthetic peptide
  Seed: GQVPTTEVV (PMEL_HUMAN)
GMVPTTEVM

SEQ ID NO: 135841 - protein, 9 aa, Artificial Sequence
  Description of Artificial Sequence: Synthetic peptide
  Seed: MSTPEATGM (PMEL_HUMAN)
MTTPEATGF

SEQ ID NO: 135842 - protein, 9 aa, Artificial Sequence
  Description of Artificial Sequence: Synthetic peptide
  Seed: YVWKTWGQY (PMEL_HUMAN)
YVWKTWGQK

SEQ ID NO: 135843 - protein, 8 aa, Artificial Sequence
  Description of Artificial Sequence: Synthetic peptide
  Seed: FGDSSGTL (PMEL_HUMAN)
FTDSSGTM

SEQ ID NO: 135844 - protein, 10 aa, Artificial Sequence
  Description of Artificial Sequence: Synthetic peptide
  Seed: EVSIVVLSGT (PMEL_HUMAN)
EYSIVVLSGI

SEQ ID NO: 135845 - protein, 9 aa, Artificial Sequence
  Description of Artificial Sequence: Synthetic peptide
  Seed: ITDQVPFSV (PMEL_HUMAN)
IADQVPFSW

SEQ ID NO: 135846 - protein, 9 aa, Artificial Sequence
  Description of Artificial Sequence: Synthetic peptide
  Seed: YLAEADLSY (PMEL_HUMAN)
YQAEADLSF

SEQ ID NO: 135847 - protein, 10 aa, Artificial Sequence
  Description of Artificial Sequence: Synthetic peptide
  Seed: MAVVLASLIY (PMEL_HUMAN)
MRVVLASLIR

SEQ ID NO: 135848 - protein, 10 aa, Artificial Sequence
  Description of Artificial Sequence: Synthetic peptide
  Seed: KVLPDGQVIW (PMEL_HUMAN)
KQLPDGQVIM

SEQ ID NO: 135849 - protein, 11 aa, Artificial Sequence
  Description of Artificial Sequence: Synthetic peptide
  Seed: LGPLLDGTATL (PMEL_HUMAN)
LIPLLDGTATV

SEQ ID NO: 135850 - protein, 9 aa, Artificial Sequence
  Description of Artificial Sequence: Synthetic peptide
  Seed: FSVSVSQLR (PMEL_HUMAN)
FIVSVSQLK

SEQ ID NO: 135851 - protein, 9 aa, Artificial Sequence
  Description of Artificial Sequence: Synthetic peptide
  Seed: GQVPTTEVV (PMEL_HUMAN)
GSVPTTEVF

SEQ ID NO: 135852 - protein, 9 aa, Artificial Sequence
  Description of Artificial Sequence: Synthetic peptide
  Seed: SIGTGRAML (PMEL_HUMAN)
SAGTGRAMF

SEQ ID NO: 135853 - protein, 11 aa, Artificial Sequence
  Description of Artificial Sequence: Synthetic peptide
  Seed: SLADTNSLAVV (PMEL_HUMAN)
SLADTNSLAVI

SEQ ID NO: 135854 - protein, 10 aa, Artificial Sequence
  Description of Artificial Sequence: Synthetic peptide
  Seed: LAVGATKVPR (PMEL_HUMAN)
LIVGATKVPR

SEQ ID NO: 135855 - protein, 9 aa, Artificial Sequence
  Description of Artificial Sequence: Synthetic peptide
  Seed: KAWNRQLYP (PMEL_HUMAN)
KLWNRQLYK

SEQ ID NO: 135856 - protein, 10 aa, Artificial Sequence
  Description of Artificial Sequence: Synthetic peptide
  Seed: RSYVPLAHSS (PMEL_HUMAN)
RIYVPLAHSK

SEQ ID NO: 135857 - protein, 9 aa, Artificial Sequence
  Description of Artificial Sequence: Synthetic peptide
  Seed: QVIWVNNTI (PMEL_HUMAN)
QMIWVNNTA

SEQ ID NO: 135858 - protein, 9 aa, Artificial Sequence
  Description of Artificial Sequence: Synthetic peptide
  Seed: VVLQAAIPL (PMEL_HUMAN)
VVLQAAIPY

SEQ ID NO: 135859 - protein, 9 aa, Artificial Sequence
  Description of Artificial Sequence: Synthetic peptide
  Seed: YLEPGPVTA (PMEL_HUMAN)
YREPGPVTV

SEQ ID NO: 135860 - protein, 10 aa, Artificial Sequence
  Description of Artificial Sequence: Synthetic peptide
  Seed: MTPAEVSIVV (PMEL_HUMAN)
MYPAEVSIVI

SEQ ID NO: 135861 - protein, 9 aa, Artificial Sequence
  Description of Artificial Sequence: Synthetic peptide
  Seed: TEWVETTAR (PMEL_HUMAN)
TFWVETTAR

SEQ ID NO: 135862 - protein, 10 aa, Artificial Sequence
  Description of Artificial Sequence: Synthetic peptide
  Seed: EATGMTPAEV (PMEL_HUMAN)
ETTGMTPAEL

SEQ ID NO: 135863 - protein, 10 aa, Artificial Sequence
  Description of Artificial Sequence: Synthetic peptide
  Seed: IESAEILQAV (PMEL_HUMAN)
IMSAEILQAV

SEQ ID NO: 135864 - protein, 9 aa, Artificial Sequence
  Description of Artificial Sequence: Synthetic peptide
  Seed: VISTAPVQM (PMEL_HUMAN)
VLSTAPVQI

SEQ ID NO: 135865 - protein, 10 aa, Artificial Sequence
  Description of Artificial Sequence: Synthetic peptide
  Seed: LGQVPLIVGI (PMEL_HUMAN)
LVQVPLIVGV

SEQ ID NO: 135866 - protein, 10 aa, Artificial Sequence
  Description of Artificial Sequence: Synthetic peptide
  Seed: WKTWGQYWQV (PMEL_HUMAN)
WCTWGQYWQV

SEQ ID NO: 135867 - protein, 9 aa, Artificial Sequence
  Description of Artificial Sequence: Synthetic peptide
  Seed: HSSSHWLRL (PMEL_HUMAN)
HVSSHWLRV

SEQ ID NO: 135868 - protein, 11 aa, Artificial Sequence
  Description of Artificial Sequence: Synthetic peptide
  Seed: ISRALVVTHTY (PMEL_HUMAN)
IVRALVVTHTW

SEQ ID NO: 135869 - protein, 10 aa, Artificial Sequence
  Description of Artificial Sequence: Synthetic peptide
  Seed: VPQLPHSSSH (PMEL_HUMAN)
VIQLPHSSSY

SEQ ID NO: 135870 - protein, 10 aa, Artificial Sequence
  Description of Artificial Sequence: Synthetic peptide
  Seed: LVLKRCLLHL (PMEL_HUMAN)
LYLKRCLLHV

SEQ ID NO: 135871 - protein, 9 aa, Artificial Sequence
  Description of Artificial Sequence: Synthetic peptide
  Seed: FTITDQVPF (PMEL_HUMAN)
FQITDQVPA

SEQ ID NO: 135872 - protein, 10 aa, Artificial Sequence
  Description of Artificial Sequence: Synthetic peptide
  Seed: SVPQLPHSSS (PMEL_HUMAN)
SSPQLPHSSI

SEQ ID NO: 135873 - protein, 9 aa, Artificial Sequence
  Description of Artificial Sequence: Synthetic peptide
  Seed: VPQLPHSSS (PMEL_HUMAN)
VPQLPHSSL

SEQ ID NO: 135874 - protein, 10 aa, Artificial Sequence
  Description of Artificial Sequence: Synthetic peptide
  Seed: IESAEILQAV (PMEL_HUMAN)
IVSAEILQAV

SEQ ID NO: 135875 - protein, 9 aa, Artificial Sequence
  Description of Artificial Sequence: Synthetic peptide
  Seed: LTVSCQGGL (PMEL_HUMAN)
LVVSCQGGV

SEQ ID NO: 135876 - protein, 10 aa, Artificial Sequence
  Description of Artificial Sequence: Synthetic peptide
  Seed: EVISTAPVQM (PMEL_HUMAN)
EMISTAPVQY

SEQ ID NO: 135877 - protein, 11 aa, Artificial Sequence
  Description of Artificial Sequence: Synthetic peptide
  Seed: TTAAQVTTTEW (PMEL_HUMAN)
TAAAQVTTTEW

SEQ ID NO: 135878 - protein, 9 aa, Artificial Sequence
  Description of Artificial Sequence: Synthetic peptide
  Seed: AEADLSYTW (PMEL_HUMAN)
AAADLSYTI

SEQ ID NO: 135879 - protein, 9 aa, Artificial Sequence
  Description of Artificial Sequence: Synthetic peptide
  Seed: LSIGTGRAM (PMEL_HUMAN)
LFIGTGRAF

SEQ ID NO: 135880 - protein, 9 aa, Artificial Sequence
  Description of Artificial Sequence: Synthetic peptide
  Seed: HWLRLPRIF (PMEL_HUMAN)
HYLRLPRIM

SEQ ID NO: 135881 - protein, 9 aa, Artificial Sequence
  Description of Artificial Sequence: Synthetic peptide
  Seed: LNFPGSQKV (PMEL_HUMAN)
LTFPGSQKV

SEQ ID NO: 135882 - protein, 9 aa, Artificial Sequence
  Description of Artificial Sequence: Synthetic peptide
  Seed: VSEVMGTTL (PMEL_HUMAN)
VAEVMGTTI

SEQ ID NO: 135883 - protein, 9 aa, Artificial Sequence
  Description of Artificial Sequence: Synthetic peptide
  Seed: TTTEWVETT (PMEL_HUMAN)
TSTEWVETV

SEQ ID NO: 135884 - protein, 9 aa, Artificial Sequence
  Description of Artificial Sequence: Synthetic peptide
  Seed: GSWSQKRSF (PMEL_HUMAN)
GTWSQKRSF

SEQ ID NO: 135885 - protein, 9 aa, Artificial Sequence
  Description of Artificial Sequence: Synthetic peptide
  Seed: DSSGTLISR (PMEL_HUMAN)
DTSGTLISF

SEQ ID NO: 135886 - protein, 9 aa, Artificial Sequence
  Description of Artificial Sequence: Synthetic peptide
  Seed: VSNDGPTLI (PMEL_HUMAN)
VANDGPTLV

SEQ ID NO: 135887 - protein, 10 aa, Artificial Sequence
  Description of Artificial Sequence: Synthetic peptide
  Seed: SSHWLRLPRI (PMEL_HUMAN)
SSHWLRLPRR

SEQ ID NO: 135888 - protein, 9 aa, Artificial Sequence
  Description of Artificial Sequence: Synthetic peptide
  Seed: FLRNQPLTF (PMEL_HUMAN)
FARNQPLTH

SEQ ID NO: 135889 - protein, 11 aa, Artificial Sequence
  Description of Artificial Sequence: Synthetic peptide
  Seed: LYRYGSFSVTL (PMEL_HUMAN)
LVRYGSFSVTF

SEQ ID NO: 135890 - protein, 11 aa, Artificial Sequence
  Description of Artificial Sequence: Synthetic peptide
  Seed: RYGSFSVTLDI (PMEL_HUMAN)
RCGSFSVTLDW

SEQ ID NO: 135891 - protein, 10 aa, Artificial Sequence
  Description of Artificial Sequence: Synthetic peptide
  Seed: SSSHWLRLPR (PMEL_HUMAN)
SISHWLRLPR

SEQ ID NO: 135892 - protein, 10 aa, Artificial Sequence
  Description of Artificial Sequence: Synthetic peptide
  Seed: LQLHDPSGYL (PMEL_HUMAN)
LFLHDPSGYV

SEQ ID NO: 135893 - protein, 9 aa, Artificial Sequence
  Description of Artificial Sequence: Synthetic peptide
  Seed: YVWKTWGQY (PMEL_HUMAN)
YPWKTWGQY

SEQ ID NO: 135894 - protein, 10 aa, Artificial Sequence
  Description of Artificial Sequence: Synthetic peptide
  Seed: FSVSVSQLRA (PMEL_HUMAN)
FTVSVSQLRW

SEQ ID NO: 135895 - protein, 9 aa, Artificial Sequence
  Description of Artificial Sequence: Synthetic peptide
  Seed: ALDGGNKHF (PMEL_HUMAN)
AMDGGNKHI

SEQ ID NO: 135896 - protein, 9 aa, Artificial Sequence
  Description of Artificial Sequence: Synthetic peptide
  Seed: WSQKRSFVY (PMEL_HUMAN)
WQQKRSFVH

SEQ ID NO: 135897 - protein, 10 aa, Artificial Sequence
  Description of Artificial Sequence: Synthetic peptide
  Seed: VSLADTNSLA (PMEL_HUMAN)
VLLADTNSLV

SEQ ID NO: 135898 - protein, 9 aa, Artificial Sequence
  Description of Artificial Sequence: Synthetic peptide
  Seed: AEPSGTTSV (PMEL_HUMAN)
ASPSGTTSV

SEQ ID NO: 135899 - protein, 9 aa, Artificial Sequence
  Description of Artificial Sequence: Synthetic peptide
  Seed: RIFCSCPIG (PMEL_HUMAN)
RTFCSCPIL

SEQ ID NO: 135900 - protein, 9 aa, Artificial Sequence
  Description of Artificial Sequence: Synthetic peptide
  Seed: EVMGTTLAE (PMEL_HUMAN)
ETMGTTLAK

SEQ ID NO: 135901 - protein, 9 aa, Artificial Sequence
  Description of Artificial Sequence: Synthetic peptide
  Seed: VPLDCVLYR (PMEL_HUMAN)
VLLDCVLYL

SEQ ID NO: 135902 - protein, 10 aa, Artificial Sequence
  Description of Artificial Sequence: Synthetic peptide
  Seed: MSTESITGSL (PMEL_HUMAN)
MITESITGSW

SEQ ID NO: 135903 - protein, 9 aa, Artificial Sequence
  Description of Artificial Sequence: Synthetic peptide
  Seed: LQAAIPLTS (PMEL_HUMAN)
LEAAIPLTM

SEQ ID NO: 135904 - protein, 10 aa, Artificial Sequence
  Description of Artificial Sequence: Synthetic peptide
  Seed: THTMEVTVYH (PMEL_HUMAN)
TFTMEVTVYK

SEQ ID NO: 135905 - protein, 10 aa, Artificial Sequence
  Description of Artificial Sequence: Synthetic peptide
  Seed: ASSIMSTESI (PMEL_HUMAN)
ASSIMSTESY

SEQ ID NO: 135906 - protein, 11 aa, Artificial Sequence
  Description of Artificial Sequence: Synthetic peptide
  Seed: VYVWKTWGQYW (PMEL_HUMAN)
VYVWKTWGQYI

SEQ ID NO: 135907 - protein, 10 aa, Artificial Sequence
  Description of Artificial Sequence: Synthetic peptide
  Seed: FSVSVSQLRA (PMEL_HUMAN)
FTVSVSQLRN

SEQ ID NO: 135908 - protein, 9 aa, Artificial Sequence
  Description of Artificial Sequence: Synthetic peptide
  Seed: GSRSYVPLA (PMEL_HUMAN)
GTRSYVPLY

SEQ ID NO: 135909 - protein, 9 aa, Artificial Sequence
  Description of Artificial Sequence: Synthetic peptide
  Seed: DQVPFSVSV (PMEL_HUMAN)
DVVPFSVSI

SEQ ID NO: 135910 - protein, 9 aa, Artificial Sequence
  Description of Artificial Sequence: Synthetic peptide
  Seed: ILLVLMAVV (PMEL_HUMAN)
IMLVLMAVI

SEQ ID NO: 135911 - protein, 9 aa, Artificial Sequence
  Description of Artificial Sequence: Synthetic peptide
  Seed: LSIGTGRAM (PMEL_HUMAN)
LAIGTGRAF

SEQ ID NO: 135912 - protein, 9 aa, Artificial Sequence
  Description of Artificial Sequence: Synthetic peptide
  Seed: TLIGANASF (PMEL_HUMAN)
TWIGANASL

SEQ ID NO: 135913 - protein, 9 aa, Artificial Sequence
  Description of Artificial Sequence: Synthetic peptide
  Seed: ANASFSIAL (PMEL_HUMAN)
ATASFSIAL

SEQ ID NO: 135914 - protein, 10 aa, Artificial Sequence
  Description of Artificial Sequence: Synthetic peptide
  Seed: KRQVPLDCVL (PMEL_HUMAN)
KIQVPLDCVY

SEQ ID NO: 135915 - protein, 9 aa, Artificial Sequence
  Description of Artificial Sequence: Synthetic peptide
  Seed: VLGGPVSGL (PMEL_HUMAN)
VSGGPVSGL

SEQ ID NO: 135916 - protein, 9 aa, Artificial Sequence
  Description of Artificial Sequence: Synthetic peptide
  Seed: VTLDIVQGI (PMEL_HUMAN)
VTLDIVQGW

SEQ ID NO: 135917 - protein, 10 aa, Artificial Sequence
  Description of Artificial Sequence: Synthetic peptide
  Seed: HTMEVTVYHR (PMEL_HUMAN)
HTMEVTVYHK

SEQ ID NO: 135918 - protein, 10 aa, Artificial Sequence
  Description of Artificial Sequence: Synthetic peptide
  Seed: RRLMKQDFSV (PMEL_HUMAN)
RILMKQDFSI

SEQ ID NO: 135919 - protein, 10 aa, Artificial Sequence
  Description of Artificial Sequence: Synthetic peptide
  Seed: RGSRSYVPLA (PMEL_HUMAN)
RDSRSYVPLY

SEQ ID NO: 135920 - protein, 9 aa, Artificial Sequence
  Description of Artificial Sequence: Synthetic peptide
  Seed: VSEVMGTTL (PMEL_HUMAN)
VTEVMGTTW

SEQ ID NO: 135921 - protein, 9 aa, Artificial Sequence
  Description of Artificial Sequence: Synthetic peptide
  Seed: YLEPGPVTA (PMEL_HUMAN)
YFEPGPVTV

SEQ ID NO: 135922 - protein, 9 aa, Artificial Sequence
  Description of Artificial Sequence: Synthetic peptide
  Seed: LSIGTGRAM (PMEL_HUMAN)
LVIGTGRAW

SEQ ID NO: 135923 - protein, 9 aa, Artificial Sequence
  Description of Artificial Sequence: Synthetic peptide
  Seed: MPTAESTGM (PMEL_HUMAN)
MPTAESTGA

SEQ ID NO: 135924 - protein, 10 aa, Artificial Sequence
  Description of Artificial Sequence: Synthetic peptide
  Seed: KRQVPLDCVL (PMEL_HUMAN)
KDQVPLDCVY

SEQ ID NO: 135925 - protein, 9 aa, Artificial Sequence
  Description of Artificial Sequence: Synthetic peptide
  Seed: RTKAWNRQL (PMEL_HUMAN)
RIKAWNRQV

SEQ ID NO: 135926 - protein, 10 aa, Artificial Sequence
  Description of Artificial Sequence: Synthetic peptide
  Seed: MTPAEVSIVV (PMEL_HUMAN)
MQPAEVSIVV

SEQ ID NO: 135927 - protein, 10 aa, Artificial Sequence
  Description of Artificial Sequence: Synthetic peptide
  Seed: SVTLDIVQGI (PMEL_HUMAN)
SETLDIVQGV

SEQ ID NO: 135928 - protein, 10 aa, Artificial Sequence
  Description of Artificial Sequence: Synthetic peptide
  Seed: YVPLAHSSSA (PMEL_HUMAN)
YVPLAHSSSI

SEQ ID NO: 135929 - protein, 9 aa, Artificial Sequence
  Description of Artificial Sequence: Synthetic peptide
  Seed: VQVPTTEVI (PMEL_HUMAN)
VAVPTTEVF

SEQ ID NO: 135930 - protein, 10 aa, Artificial Sequence
  Description of Artificial Sequence: Synthetic peptide
  Seed: YRYGSFSVTL (PMEL_HUMAN)
YQYGSFSVTA

SEQ ID NO: 135931 - protein, 10 aa, Artificial Sequence
  Description of Artificial Sequence: Synthetic peptide
  Seed: MTPAEVSIVV (PMEL_HUMAN)
MTPAEVSIVY

SEQ ID NO: 135932 - protein, 9 aa, Artificial Sequence
  Description of Artificial Sequence: Synthetic peptide
  Seed: LYRYGSFSV (PMEL_HUMAN)
LYRYGSFSY

SEQ ID NO: 135933 - protein, 9 aa, Artificial Sequence
  Description of Artificial Sequence: Synthetic peptide
  Seed: RGSRSYVPL (PMEL_HUMAN)
RASRSYVPA

SEQ ID NO: 135934 - protein, 10 aa, Artificial Sequence
  Description of Artificial Sequence: Synthetic peptide
  Seed: ALDGGNKHFL (PMEL_HUMAN)
AADGGNKHFL

SEQ ID NO: 135935 - protein, 9 aa, Artificial Sequence
  Description of Artificial Sequence: Synthetic peptide
  Seed: ALVVTHTYL (PMEL_HUMAN)
AQVVTHTYV

SEQ ID NO: 135936 - protein, 9 aa, Artificial Sequence
  Description of Artificial Sequence: Synthetic peptide
  Seed: VLPSPACQL (PMEL_HUMAN)
VIPSPACQV

SEQ ID NO: 135937 - protein, 9 aa, Artificial Sequence
  Description of Artificial Sequence: Synthetic peptide
  Seed: LTSCGSSPV (PMEL_HUMAN)
LASCGSSPY

SEQ ID NO: 135938 - protein, 11 aa, Artificial Sequence
  Description of Artificial Sequence: Synthetic peptide
  Seed: RALDGGNKHFL (PMEL_HUMAN)
RQLDGGNKHFM

SEQ ID NO: 135939 - protein, 9 aa, Artificial Sequence
  Description of Artificial Sequence: Synthetic peptide
  Seed: LIVGILLVL (PMEL_HUMAN)
LVVGILLVV

SEQ ID NO: 135940 - protein, 9 aa, Artificial Sequence
  Description of Artificial Sequence: Synthetic peptide
  Seed: RIFCSCPIG (PMEL_HUMAN)
RFFCSCPIK

SEQ ID NO: 135941 - protein, 9 aa, Artificial Sequence
  Description of Artificial Sequence: Synthetic peptide
  Seed: LYPEWTEAQ (PMEL_HUMAN)
LYPEWTEAL

SEQ ID NO: 135942 - protein, 9 aa, Artificial Sequence
  Description of Artificial Sequence: Synthetic peptide
  Seed: YLAEADLSY (PMEL_HUMAN)
YAAEADLSL

SEQ ID NO: 135943 - protein, 10 aa, Artificial Sequence
  Description of Artificial Sequence: Synthetic peptide
  Seed: ESITGSLGPL (PMEL_HUMAN)
EVITGSLGPR

SEQ ID NO: 135944 - protein, 11 aa, Artificial Sequence
  Description of Artificial Sequence: Synthetic peptide
  Seed: KHFLRNQPLTF (PMEL_HUMAN)
KMFLRNQPLTF

SEQ ID NO: 135945 - protein, 10 aa, Artificial Sequence
  Description of Artificial Sequence: Synthetic peptide
  Seed: SRALVVTHTY (PMEL_HUMAN)
SFALVVTHTW

SEQ ID NO: 135946 - protein, 9 aa, Artificial Sequence
  Description of Artificial Sequence: Synthetic peptide
  Seed: GQVPLIVGI (PMEL_HUMAN)
GMVPLIVGL

SEQ ID NO: 135947 - protein, 9 aa, Artificial Sequence
  Description of Artificial Sequence: Synthetic peptide
  Seed: HTMEVTVYH (PMEL_HUMAN)
HPMEVTVYF

SEQ ID NO: 135948 - protein, 9 aa, Artificial Sequence
  Description of Artificial Sequence: Synthetic peptide
  Seed: TIINGSQVW (PMEL_HUMAN)
TQINGSQVF

SEQ ID NO: 135949 - protein, 11 aa, Artificial Sequence
  Description of Artificial Sequence: Synthetic peptide
  Seed: AEADLSYTWDF (PMEL_HUMAN)
AEADLSYTWDL

SEQ ID NO: 135950 - protein, 10 aa, Artificial Sequence
  Description of Artificial Sequence: Synthetic peptide
  Seed: RTKAWNRQLY (PMEL_HUMAN)
RIKAWNRQLK

SEQ ID NO: 135951 - protein, 10 aa, Artificial Sequence
  Description of Artificial Sequence: Synthetic peptide
  Seed: ALDGGNKHFL (PMEL_HUMAN)
AMDGGNKHFM

SEQ ID NO: 135952 - protein, 9 aa, Artificial Sequence
  Description of Artificial Sequence: Synthetic peptide
  Seed: SAFTITDQV (PMEL_HUMAN)
SSFTITDQL

SEQ ID NO: 135953 - protein, 9 aa, Artificial Sequence
  Description of Artificial Sequence: Synthetic peptide
  Seed: YLEPGPVTA (PMEL_HUMAN)
YQEPGPVTL

SEQ ID NO: 135954 - protein, 10 aa, Artificial Sequence
  Description of Artificial Sequence: Synthetic peptide
  Seed: SVPQLPHSSS (PMEL_HUMAN)
SYPQLPHSSF

SEQ ID NO: 135955 - protein, 10 aa, Artificial Sequence
  Description of Artificial Sequence: Synthetic peptide
  Seed: AVIGALLAVG (PMEL_HUMAN)
AIIGALLAVV

SEQ ID NO: 135956 - protein, 10 aa, Artificial Sequence
  Description of Artificial Sequence: Synthetic peptide
  Seed: MAVVLASLIY (PMEL_HUMAN)
MQVVLASLIY

SEQ ID NO: 135957 - protein, 9 aa, Artificial Sequence
  Description of Artificial Sequence: Synthetic peptide
  Seed: AEADLSYTW (PMEL_HUMAN)
ALADLSYTW

SEQ ID NO: 135958 - protein, 10 aa, Artificial Sequence
  Description of Artificial Sequence: Synthetic peptide
  Seed: MAVVLASLIY (PMEL_HUMAN)
MCVVLASLIR

SEQ ID NO: 135959 - protein, 9 aa, Artificial Sequence
  Description of Artificial Sequence: Synthetic peptide
  Seed: TPAEVSIVV (PMEL_HUMAN)
TTAEVSIVI

SEQ ID NO: 135960 - protein, 9 aa, Artificial Sequence
  Description of Artificial Sequence: Synthetic peptide
  Seed: TLISRALVV (PMEL_HUMAN)
TVISRALVL

SEQ ID NO: 135961 - protein, 10 aa, Artificial Sequence
  Description of Artificial Sequence: Synthetic peptide
  Seed: MAVVLASLIY (PMEL_HUMAN)
MTVVLASLIK

SEQ ID NO: 135962 - protein, 10 aa, Artificial Sequence
  Description of Artificial Sequence: Synthetic peptide
  Seed: LAVIGALLAV (PMEL_HUMAN)
LPVIGALLAI

SEQ ID NO: 135963 - protein, 9 aa, Artificial Sequence
  Description of Artificial Sequence: Synthetic peptide
  Seed: HTYLEPGPV (PMEL_HUMAN)
HAYLEPGPY

SEQ ID NO: 135964 - protein, 10 aa, Artificial Sequence
  Description of Artificial Sequence: Synthetic peptide
  Seed: SGTYCLNVSL (PMEL_HUMAN)
SWTYCLNVSW

SEQ ID NO: 135965 - protein, 9 aa, Artificial Sequence
  Description of Artificial Sequence: Synthetic peptide
  Seed: FLRNQPLTF (PMEL_HUMAN)
FRRNQPLTM

SEQ ID NO: 135966 - protein, 9 aa, Artificial Sequence
  Description of Artificial Sequence: Synthetic peptide
  Seed: ASFSIALNF (PMEL_HUMAN)
AQFSIALNM

SEQ ID NO: 135967 - protein, 10 aa, Artificial Sequence
  Description of Artificial Sequence: Synthetic peptide
  Seed: GALLAVGATK (PMEL_HUMAN)
GSLLAVGATK

SEQ ID NO: 135968 - protein, 9 aa, Artificial Sequence
  Description of Artificial Sequence: Synthetic peptide
  Seed: VVLASLIYR (PMEL_HUMAN)
VYLASLIYR

SEQ ID NO: 135969 - protein, 10 aa, Artificial Sequence
  Description of Artificial Sequence: Synthetic peptide
  Seed: LPHSSSHWLR (PMEL_HUMAN)
LMHSSSHWLR

SEQ ID NO: 135970 - protein, 10 aa, Artificial Sequence
  Description of Artificial Sequence: Synthetic peptide
  Seed: AVVLASLIYR (PMEL_HUMAN)
ADVLASLIYR

SEQ ID NO: 135971 - protein, 10 aa, Artificial Sequence
  Description of Artificial Sequence: Synthetic peptide
  Seed: ASFSIALNFP (PMEL_HUMAN)
ASFSIALNFW

SEQ ID NO: 135972 - protein, 11 aa, Artificial Sequence
  Description of Artificial Sequence: Synthetic peptide
  Seed: RQVPLDCVLYR (PMEL_HUMAN)
RQVPLDCVLYY

SEQ ID NO: 135973 - protein, 10 aa, Artificial Sequence
  Description of Artificial Sequence: Synthetic peptide
  Seed: GSRSYVPLAH (PMEL_HUMAN)
GTRSYVPLAV

SEQ ID NO: 135974 - protein, 11 aa, Artificial Sequence
  Description of Artificial Sequence: Synthetic peptide
  Seed: KRSFVYVWKTW (PMEL_HUMAN)
KASFVYVWKTW

SEQ ID NO: 135975 - protein, 10 aa, Artificial Sequence
  Description of Artificial Sequence: Synthetic peptide
  Seed: GEGDAFELTV (PMEL_HUMAN)
GEGDAFELTM

SEQ ID NO: 135976 - protein, 9 aa, Artificial Sequence
  Description of Artificial Sequence: Synthetic peptide
  Seed: TLISRALVV (PMEL_HUMAN)
TIISRALVL

SEQ ID NO: 135977 - protein, 10 aa, Artificial Sequence
  Description of Artificial Sequence: Synthetic peptide
  Seed: AWNRQLYPEW (PMEL_HUMAN)
AYNRQLYPEI

SEQ ID NO: 135978 - protein, 10 aa, Artificial Sequence
  Description of Artificial Sequence: Synthetic peptide
  Seed: GPLLDGTATL (PMEL_HUMAN)
GCLLDGTATM

SEQ ID NO: 135979 - protein, 9 aa, Artificial Sequence
  Description of Artificial Sequence: Synthetic peptide
  Seed: LIVGILLVL (PMEL_HUMAN)
LQVGILLVA

SEQ ID NO: 135980 - protein, 10 aa, Artificial Sequence
  Description of Artificial Sequence: Synthetic peptide
  Seed: EVSIVVLSGT (PMEL_HUMAN)
EWSIVVLSGI

SEQ ID NO: 135981 - protein, 9 aa, Artificial Sequence
  Description of Artificial Sequence: Synthetic peptide
  Seed: HTMEVTVYH (PMEL_HUMAN)
HPMEVTVYI

SEQ ID NO: 135982 - protein, 9 aa, Artificial Sequence
  Description of Artificial Sequence: Synthetic peptide
  Seed: VPLDCVLYR (PMEL_HUMAN)
VTLDCVLYR

SEQ ID NO: 135983 - protein, 9 aa, Artificial Sequence
  Description of Artificial Sequence: Synthetic peptide
  Seed: RGSRSYVPL (PMEL_HUMAN)
RTSRSYVPR

SEQ ID NO: 135984 - protein, 9 aa, Artificial Sequence
  Description of Artificial Sequence: Synthetic peptide
  Seed: FGDSSGTLI (PMEL_HUMAN)
FYDSSGTLM

SEQ ID NO: 135985 - protein, 9 aa, Artificial Sequence
  Description of Artificial Sequence: Synthetic peptide
  Seed: TPAEVSIVV (PMEL_HUMAN)
TRAEVSIVA

SEQ ID NO: 135986 - protein, 9 aa, Artificial Sequence
  Description of Artificial Sequence: Synthetic peptide
  Seed: LADTNSLAV (PMEL_HUMAN)
LWDTNSLAF

SEQ ID NO: 135987 - protein, 9 aa, Artificial Sequence
  Description of Artificial Sequence: Synthetic peptide
  Seed: ALNFPGSQK (PMEL_HUMAN)
AINFPGSQK

SEQ ID NO: 135988 - protein, 11 aa, Artificial Sequence
  Description of Artificial Sequence: Synthetic peptide
  Seed: ALDGGNKHFLR (PMEL_HUMAN)
ATDGGNKHFLY

SEQ ID NO: 135989 - protein, 11 aa, Artificial Sequence
  Description of Artificial Sequence: Synthetic peptide
  Seed: FGDSSGTLISR (PMEL_HUMAN)
FADSSGTLISV

SEQ ID NO: 135990 - protein, 10 aa, Artificial Sequence
  Description of Artificial Sequence: Synthetic peptide
  Seed: IALNFPGSQK (PMEL_HUMAN)
IFLNFPGSQK

SEQ ID NO: 135991 - protein, 10 aa, Artificial Sequence
  Description of Artificial Sequence: Synthetic peptide
  Seed: ELTVSCQGGL (PMEL_HUMAN)
ELTVSCQGGV

SEQ ID NO: 135992 - protein, 9 aa, Artificial Sequence
  Description of Artificial Sequence: Synthetic peptide
  Seed: FTITDQVPF (PMEL_HUMAN)
FRITDQVPM

SEQ ID NO: 135993 - protein, 9 aa, Artificial Sequence
  Description of Artificial Sequence: Synthetic peptide
  Seed: RNQPLTFAL (PMEL_HUMAN)
RSQPLTFAY

SEQ ID NO: 135994 - protein, 9 aa, Artificial Sequence
  Description of Artificial Sequence: Synthetic peptide
  Seed: GMTPAEVSI (PMEL_HUMAN)
GSTPAEVSL

SEQ ID NO: 135995 - protein, 11 aa, Artificial Sequence
  Description of Artificial Sequence: Synthetic peptide
  Seed: RAMLGTHTMEV (PMEL_HUMAN)
RMMLGTHTMEI

SEQ ID NO: 135996 - protein, 9 aa, Artificial Sequence
  Description of Artificial Sequence: Synthetic peptide
  Seed: TEVISTAPV (PMEL_HUMAN)
TEVISTAPI

SEQ ID NO: 135997 - protein, 10 aa, Artificial Sequence
  Description of Artificial Sequence: Synthetic peptide
  Seed: VSLADTNSLA (PMEL_HUMAN)
VMLADTNSLI

SEQ ID NO: 135998 - protein, 9 aa, Artificial Sequence
  Description of Artificial Sequence: Synthetic peptide
  Seed: LADTNSLAV (PMEL_HUMAN)
LQDTNSLAV

SEQ ID NO: 135999 - protein, 9 aa, Artificial Sequence
  Description of Artificial Sequence: Synthetic peptide
  Seed: HTMEVTVYH (PMEL_HUMAN)
HSMEVTVYW

SEQ ID NO: 136000 - protein, 9 aa, Artificial Sequence
  Description of Artificial Sequence: Synthetic peptide
  Seed: FLRNQPLTF (PMEL_HUMAN)
FVRNQPLTY

SEQ ID NO: 136001 - protein, 10 aa, Artificial Sequence
  Description of Artificial Sequence: Synthetic peptide
  Seed: KTWGQYWQVL (PMEL_HUMAN)
KYWGQYWQVL

SEQ ID NO: 136002 - protein, 9 aa, Artificial Sequence
  Description of Artificial Sequence: Synthetic peptide
  Seed: RAMLGTHTM (PMEL_HUMAN)
RQMLGTHTW

SEQ ID NO: 136003 - protein, 11 aa, Artificial Sequence
  Description of Artificial Sequence: Synthetic peptide
  Seed: RRGSRSYVPLA (PMEL_HUMAN)
RVGSRSYVPLV

SEQ ID NO: 136004 - protein, 10 aa, Artificial Sequence
  Description of Artificial Sequence: Synthetic peptide
  Seed: RGSRSYVPLA (PMEL_HUMAN)
RLSRSYVPLG

SEQ ID NO: 136005 - protein, 10 aa, Artificial Sequence
  Description of Artificial Sequence: Synthetic peptide
  Seed: SQVWGGQPVY (PMEL_HUMAN)
SGVWGGQPVY

SEQ ID NO: 136006 - protein, 9 aa, Artificial Sequence
  Description of Artificial Sequence: Synthetic peptide
  Seed: WSQKRSFVY (PMEL_HUMAN)
WSQKRSFVF

SEQ ID NO: 136007 - protein, 10 aa, Artificial Sequence
  Description of Artificial Sequence: Synthetic peptide
  Seed: YRYGSFSVTL (PMEL_HUMAN)
YHYGSFSVTF

SEQ ID NO: 136008 - protein, 9 aa, Artificial Sequence
  Description of Artificial Sequence: Synthetic peptide
  Seed: AVVSTQLIM (PMEL_HUMAN)
ASVSTQLIV

SEQ ID NO: 136009 - protein, 11 aa, Artificial Sequence
  Description of Artificial Sequence: Synthetic peptide
  Seed: SYVPLAHSSSA (PMEL_HUMAN)
SPVPLAHSSSV

SEQ ID NO: 136010 - protein, 9 aa, Artificial Sequence
  Description of Artificial Sequence: Synthetic peptide
  Seed: SSHWLRLPR (PMEL_HUMAN)
SVHWLRLPA

SEQ ID NO: 136011 - protein, 9 aa, Artificial Sequence
  Description of Artificial Sequence: Synthetic peptide
  Seed: GTYCLNVSL (PMEL_HUMAN)
GLYCLNVSF

SEQ ID NO: 136012 - protein, 9 aa, Artificial Sequence
  Description of Artificial Sequence: Synthetic peptide
  Seed: RALVVTHTY (PMEL_HUMAN)
RQLVVTHTL

SEQ ID NO: 136013 - protein, 11 aa, Artificial Sequence
  Description of Artificial Sequence: Synthetic peptide
  Seed: FTITDQVPFSV (PMEL_HUMAN)
FMITDQVPFSL

SEQ ID NO: 136014 - protein, 9 aa, Artificial Sequence
  Description of Artificial Sequence: Synthetic peptide
  Seed: LIVGILLVL (PMEL_HUMAN)
LMVGILLVA

SEQ ID NO: 136015 - protein, 9 aa, Artificial Sequence
  Description of Artificial Sequence: Synthetic peptide
  Seed: VLMAVVLAS (PMEL_HUMAN)
VMMAVVLAT

SEQ ID NO: 136016 - protein, 9 aa, Artificial Sequence
  Description of Artificial Sequence: Synthetic peptide
  Seed: LSIGTGRAM (PMEL_HUMAN)
LMIGTGRAL

SEQ ID NO: 136017 - protein, 10 aa, Artificial Sequence
  Description of Artificial Sequence: Synthetic peptide
  Seed: APNTTAGQVP (PMEL_HUMAN)
APNTTAGQVF

SEQ ID NO: 136018 - protein, 9 aa, Artificial Sequence
  Description of Artificial Sequence: Synthetic peptide
  Seed: SQKRSFVYV (PMEL_HUMAN)
SAKRSFVYY

SEQ ID NO: 136019 - protein, 10 aa, Artificial Sequence
  Description of Artificial Sequence: Synthetic peptide
  Seed: IALNFPGSQK (PMEL_HUMAN)
IALNFPGSQY

SEQ ID NO: 136020 - protein, 11 aa, Artificial Sequence
  Description of Artificial Sequence: Synthetic peptide
  Seed: RLPRIFCSCPI (PMEL_HUMAN)
RIPRIFCSCPL

SEQ ID NO: 136021 - protein, 9 aa, Artificial Sequence
  Description of Artificial Sequence: Synthetic peptide
  Seed: RALVVTHTY (PMEL_HUMAN)
RELVVTHTY

SEQ ID NO: 136022 - protein, 11 aa, Artificial Sequence
  Description of Artificial Sequence: Synthetic peptide
  Seed: CVLYRYGSFSV (PMEL_HUMAN)
CLLYRYGSFSV

SEQ ID NO: 136023 - protein, 9 aa, Artificial Sequence
  Description of Artificial Sequence: Synthetic peptide
  Seed: RQVPLDCVL (PMEL_HUMAN)
RLVPLDCVY

SEQ ID NO: 136024 - protein, 9 aa, Artificial Sequence
  Description of Artificial Sequence: Synthetic peptide
  Seed: ALDGGNKHF (PMEL_HUMAN)
ATDGGNKHY

SEQ ID NO: 136025 - protein, 9 aa, Artificial Sequence
  Description of Artificial Sequence: Synthetic peptide
  Seed: AEAPNTTAG (PMEL_HUMAN)
AEAPNTTAT

SEQ ID NO: 136026 - protein, 10 aa, Artificial Sequence
  Description of Artificial Sequence: Synthetic peptide
  Seed: LHLAVIGALL (PMEL_HUMAN)
LMLAVIGALI

SEQ ID NO: 136027 - protein, 9 aa, Artificial Sequence
  Description of Artificial Sequence: Synthetic peptide
  Seed: EKVPVSEVM (PMEL_HUMAN)
EHVPVSEVF

SEQ ID NO: 136028 - protein, 9 aa, Artificial Sequence
  Description of Artificial Sequence: Synthetic peptide
  Seed: RTKAWNRQL (PMEL_HUMAN)
RQKAWNRQF

SEQ ID NO: 136029 - protein, 9 aa, Artificial Sequence
  Description of Artificial Sequence: Synthetic peptide
  Seed: QAAIPLTSC (PMEL_HUMAN)
QPAIPLTSS

SEQ ID NO: 136030 - protein, 10 aa, Artificial Sequence
  Description of Artificial Sequence: Synthetic peptide
  Seed: SQVWGGQPVY (PMEL_HUMAN)
SPVWGGQPVM

SEQ ID NO: 136031 - protein, 10 aa, Artificial Sequence
  Description of Artificial Sequence: Synthetic peptide
  Seed: GQVPLIVGIL (PMEL_HUMAN)
GQVPLIVGIY

SEQ ID NO: 136032 - protein, 10 aa, Artificial Sequence
  Description of Artificial Sequence: Synthetic peptide
  Seed: RSFVYVWKTW (PMEL_HUMAN)
RGFVYVWKTW

SEQ ID NO: 136033 - protein, 9 aa, Artificial Sequence
  Description of Artificial Sequence: Synthetic peptide
  Seed: DSSGTLISR (PMEL_HUMAN)
DYSGTLISK

SEQ ID NO: 136034 - protein, 9 aa, Artificial Sequence
  Description of Artificial Sequence: Synthetic peptide
  Seed: KQDFSVPQL (PMEL_HUMAN)
KGDFSVPQL

SEQ ID NO: 136035 - protein, 11 aa, Artificial Sequence
  Description of Artificial Sequence: Synthetic peptide
  Seed: GIESAEILQAV (PMEL_HUMAN)
GLESAEILQAA

SEQ ID NO: 136036 - protein, 9 aa, Artificial Sequence
  Description of Artificial Sequence: Synthetic peptide
  Seed: RAMLGTHTM (PMEL_HUMAN)
RMMLGTHTL

SEQ ID NO: 136037 - protein, 10 aa, Artificial Sequence
  Description of Artificial Sequence: Synthetic peptide
  Seed: VLMAVVLASL (PMEL_HUMAN)
VTMAVVLASA

SEQ ID NO: 136038 - protein, 9 aa, Artificial Sequence
  Description of Artificial Sequence: Synthetic peptide
  Seed: VPLAHSSSA (PMEL_HUMAN)
VPLAHSSSP

SEQ ID NO: 136039 - protein, 9 aa, Artificial Sequence
  Description of Artificial Sequence: Synthetic peptide
  Seed: RLMKQDFSV (PMEL_HUMAN)
RIMKQDFSW

SEQ ID NO: 136040 - protein, 10 aa, Artificial Sequence
  Description of Artificial Sequence: Synthetic peptide
  Seed: SLADTNSLAV (PMEL_HUMAN)
SMADTNSLAW

SEQ ID NO: 136041 - protein, 9 aa, Artificial Sequence
  Description of Artificial Sequence: Synthetic peptide
  Seed: RLMKQDFSV (PMEL_HUMAN)
RRMKQDFSI

SEQ ID NO: 136042 - protein, 9 aa, Artificial Sequence
  Description of Artificial Sequence: Synthetic peptide
  Seed: LTVSCQGGL (PMEL_HUMAN)
LVVSCQGGW

SEQ ID NO: 136043 - protein, 9 aa, Artificial Sequence
  Description of Artificial Sequence: Synthetic peptide
  Seed: SQKRSFVYV (PMEL_HUMAN)
SLKRSFVYL

SEQ ID NO: 136044 - protein, 9 aa, Artificial Sequence
  Description of Artificial Sequence: Synthetic peptide
  Seed: TATLRLVKR (PMEL_HUMAN)
TITLRLVKR

SEQ ID NO: 136045 - protein, 10 aa, Artificial Sequence
  Description of Artificial Sequence: Synthetic peptide
  Seed: VLPDGQVIWV (PMEL_HUMAN)
VLPDGQVIWI

SEQ ID NO: 136046 - protein, 9 aa, Artificial Sequence
  Description of Artificial Sequence: Synthetic peptide
  Seed: ASFSIALNF (PMEL_HUMAN)
ANFSIALNW

SEQ ID NO: 136047 - protein, 9 aa, Artificial Sequence
  Description of Artificial Sequence: Synthetic peptide
  Seed: HLAVIGALL (PMEL_HUMAN)
HGAVIGALY

SEQ ID NO: 136048 - protein, 10 aa, Artificial Sequence
  Description of Artificial Sequence: Synthetic peptide
  Seed: SGTYCLNVSL (PMEL_HUMAN)
SQTYCLNVSV

SEQ ID NO: 136049 - protein, 9 aa, Artificial Sequence
  Description of Artificial Sequence: Synthetic peptide
  Seed: ALDGGNKHF (PMEL_HUMAN)
AIDGGNKHI

SEQ ID NO: 136050 - protein, 9 aa, Artificial Sequence
  Description of Artificial Sequence: Synthetic peptide
  Seed: KHFLRNQPL (PMEL_HUMAN)
KVFLRNQPM

SEQ ID NO: 136051 - protein, 9 aa, Artificial Sequence
  Description of Artificial Sequence: Synthetic peptide
  Seed: LTSCGSSPV (PMEL_HUMAN)
LVSCGSSPF

SEQ ID NO: 136052 - protein, 9 aa, Artificial Sequence
  Description of Artificial Sequence: Synthetic peptide
  Seed: HSSSHWLRL (PMEL_HUMAN)
HASSHWLRM

SEQ ID NO: 136053 - protein, 8 aa, Artificial Sequence
  Description of Artificial Sequence: Synthetic peptide
  Seed: ADTNSLAV (PMEL_HUMAN)
AETNSLAL

SEQ ID NO: 136054 - protein, 9 aa, Artificial Sequence
  Description of Artificial Sequence: Synthetic peptide
  Seed: GLGQVPLIV (PMEL_HUMAN)
GQGQVPLIV

SEQ ID NO: 136055 - protein, 10 aa, Artificial Sequence
  Description of Artificial Sequence: Synthetic peptide
  Seed: QVIWVNNTII (PMEL_HUMAN)
QTIWVNNTII

SEQ ID NO: 136056 - protein, 9 aa, Artificial Sequence
  Description of Artificial Sequence: Synthetic peptide
  Seed: KVLPDGQVI (PMEL_HUMAN)
KALPDGQVW

SEQ ID NO: 136057 - protein, 9 aa, Artificial Sequence
  Description of Artificial Sequence: Synthetic peptide
  Seed: FTITDQVPF (PMEL_HUMAN)
FPITDQVPY

SEQ ID NO: 136058 - protein, 11 aa, Artificial Sequence
  Description of Artificial Sequence: Synthetic peptide
  Seed: ITDQVPFSVSV (PMEL_HUMAN)
ILDQVPFSVSL

SEQ ID NO: 136059 - protein, 9 aa, Artificial Sequence
  Description of Artificial Sequence: Synthetic peptide
  Seed: VSNDGPTLI (PMEL_HUMAN)
VMNDGPTLA

SEQ ID NO: 136060 - protein, 10 aa, Artificial Sequence
  Description of Artificial Sequence: Synthetic peptide
  Seed: AVVLASLIYR (PMEL_HUMAN)
ATVLASLIYK

SEQ ID NO: 136061 - protein, 9 aa, Artificial Sequence
  Description of Artificial Sequence: Synthetic peptide
  Seed: GQVPLIVGI (PMEL_HUMAN)
GTVPLIVGV

SEQ ID NO: 136062 - protein, 10 aa, Artificial Sequence
  Description of Artificial Sequence: Synthetic peptide
  Seed: AVPSGEGDAF (PMEL_HUMAN)
ASPSGEGDAM

SEQ ID NO: 136063 - protein, 9 aa, Artificial Sequence
  Description of Artificial Sequence: Synthetic peptide
  Seed: EVMGTTLAE (PMEL_HUMAN)
ETMGTTLAH

SEQ ID NO: 136064 - protein, 9 aa, Artificial Sequence
  Description of Artificial Sequence: Synthetic peptide
  Seed: KAWNRQLYP (PMEL_HUMAN)
KAWNRQLYV

SEQ ID NO: 136065 - protein, 10 aa, Artificial Sequence
  Description of Artificial Sequence: Synthetic peptide
  Seed: RALVVTHTYL (PMEL_HUMAN)
RGLVVTHTYY

SEQ ID NO: 136066 - protein, 10 aa, Artificial Sequence
  Description of Artificial Sequence: Synthetic peptide
  Seed: EVMGTTLAEM (PMEL_HUMAN)
ELMGTTLAEI

SEQ ID NO: 136067 - protein, 9 aa, Artificial Sequence
  Description of Artificial Sequence: Synthetic peptide
  Seed: CWRGGQVSL (PMEL_HUMAN)
CYRGGQVSW

SEQ ID NO: 136068 - protein, 8 aa, Artificial Sequence
  Description of Artificial Sequence: Synthetic peptide
  Seed: HTMEVTVY (PMEL_HUMAN)
HTMEVTVW

SEQ ID NO: 136069 - protein, 9 aa, Artificial Sequence
  Description of Artificial Sequence: Synthetic peptide
  Seed: AGQVPTTEV (PMEL_HUMAN)
ATQVPTTEI

SEQ ID NO: 136070 - protein, 11 aa, Artificial Sequence
  Description of Artificial Sequence: Synthetic peptide
  Seed: RELPIPEPEGP (PMEL_HUMAN)
RELPIPEPEGA

SEQ ID NO: 136071 - protein, 9 aa, Artificial Sequence
  Description of Artificial Sequence: Synthetic peptide
  Seed: VSNDGPTLI (PMEL_HUMAN)
VGNDGPTLY

SEQ ID NO: 136072 - protein, 10 aa, Artificial Sequence
  Description of Artificial Sequence: Synthetic peptide
  Seed: LQLHDPSGYL (PMEL_HUMAN)
LKLHDPSGYF

SEQ ID NO: 136073 - protein, 11 aa, Artificial Sequence
  Description of Artificial Sequence: Synthetic peptide
  Seed: VVLASLIYRRR (PMEL_HUMAN)
VVLASLIYRRK

SEQ ID NO: 136074 - protein, 10 aa, Artificial Sequence
  Description of Artificial Sequence: Synthetic peptide
  Seed: RGSRSYVPLA (PMEL_HUMAN)
RASRSYVPLL

SEQ ID NO: 136075 - protein, 8 aa, Artificial Sequence
  Description of Artificial Sequence: Synthetic peptide
  Seed: ALVVTHTY (PMEL_HUMAN)
AQVVTHTF

SEQ ID NO: 136076 - protein, 9 aa, Artificial Sequence
  Description of Artificial Sequence: Synthetic peptide
  Seed: FTITDQVPF (PMEL_HUMAN)
FEITDQVPM

SEQ ID NO: 136077 - protein, 10 aa, Artificial Sequence
  Description of Artificial Sequence: Synthetic peptide
  Seed: SCPIGENSPL (PMEL_HUMAN)
SVPIGENSPM

SEQ ID NO: 136078 - protein, 9 aa, Artificial Sequence
  Description of Artificial Sequence: Synthetic peptide
  Seed: YLEPGPVTA (PMEL_HUMAN)
YQEPGPVTY

SEQ ID NO: 136079 - protein, 9 aa, Artificial Sequence
  Description of Artificial Sequence: Synthetic peptide
  Seed: AVIGALLAV (PMEL_HUMAN)
ALIGALLAW

SEQ ID NO: 136080 - protein, 11 aa, Artificial Sequence
  Description of Artificial Sequence: Synthetic peptide
  Seed: RTKAWNRQLYP (PMEL_HUMAN)
RSKAWNRQLYK

SEQ ID NO: 136081 - protein, 9 aa, Artificial Sequence
  Description of Artificial Sequence: Synthetic peptide
  Seed: TTAGQVPTT (PMEL_HUMAN)
TVAGQVPTA

SEQ ID NO: 136082 - protein, 10 aa, Artificial Sequence
  Description of Artificial Sequence: Synthetic peptide
  Seed: AEILQAVPSG (PMEL_HUMAN)
AEILQAVPSV

SEQ ID NO: 136083 - protein, 9 aa, Artificial Sequence
  Description of Artificial Sequence: Synthetic peptide
  Seed: YLAEADLSY (PMEL_HUMAN)
YWAEADLSY

SEQ ID NO: 136084 - protein, 10 aa, Artificial Sequence
  Description of Artificial Sequence: Synthetic peptide
  Seed: WKTWGQYWQV (PMEL_HUMAN)
WGTWGQYWQV

SEQ ID NO: 136085 - protein, 9 aa, Artificial Sequence
  Description of Artificial Sequence: Synthetic peptide
  Seed: KTWGQYWQV (PMEL_HUMAN)
KWWGQYWQK

SEQ ID NO: 136086 - protein, 9 aa, Artificial Sequence
  Description of Artificial Sequence: Synthetic peptide
  Seed: AVVLASLIY (PMEL_HUMAN)
APVLASLIY

SEQ ID NO: 136087 - protein, 9 aa, Artificial Sequence
  Description of Artificial Sequence: Synthetic peptide
  Seed: EAQRLDCWR (PMEL_HUMAN)
ETQRLDCWR

SEQ ID NO: 136088 - protein, 10 aa, Artificial Sequence
  Description of Artificial Sequence: Synthetic peptide
  Seed: SAEILQAVPS (PMEL_HUMAN)
SCEILQAVPA

SEQ ID NO: 136089 - protein, 9 aa, Artificial Sequence
  Description of Artificial Sequence: Synthetic peptide
  Seed: SVQVPTTEV (PMEL_HUMAN)
SRQVPTTEL

SEQ ID NO: 136090 - protein, 9 aa, Artificial Sequence
  Description of Artificial Sequence: Synthetic peptide
  Seed: RAMLGTHTM (PMEL_HUMAN)
RLMLGTHTA

SEQ ID NO: 136091 - protein, 10 aa, Artificial Sequence
  Description of Artificial Sequence: Synthetic peptide
  Seed: DSSGTLISRA (PMEL_HUMAN)
DTSGTLISRV

SEQ ID NO: 136092 - protein, 9 aa, Artificial Sequence
  Description of Artificial Sequence: Synthetic peptide
  Seed: YVWKTWGQY (PMEL_HUMAN)
YYWKTWGQF

SEQ ID NO: 136093 - protein, 10 aa, Artificial Sequence
  Description of Artificial Sequence: Synthetic peptide
  Seed: MKQDFSVPQL (PMEL_HUMAN)
MAQDFSVPQY

SEQ ID NO: 136094 - protein, 8 aa, Artificial Sequence
  Description of Artificial Sequence: Synthetic peptide
  Seed: LLDGTATL (PMEL_HUMAN)
LTDGTATM

SEQ ID NO: 136095 - protein, 10 aa, Artificial Sequence
  Description of Artificial Sequence: Synthetic peptide
  Seed: SLADTNSLAV (PMEL_HUMAN)
SMADTNSLAV

SEQ ID NO: 136096 - protein, 9 aa, Artificial Sequence
  Description of Artificial Sequence: Synthetic peptide
  Seed: EGDAFELTV (PMEL_HUMAN)
EYDAFELTM

SEQ ID NO: 136097 - protein, 9 aa, Artificial Sequence
  Description of Artificial Sequence: Synthetic peptide
  Seed: RTKAWNRQL (PMEL_HUMAN)
RAKAWNRQY

SEQ ID NO: 136098 - protein, 9 aa, Artificial Sequence
  Description of Artificial Sequence: Synthetic peptide
  Seed: RAMLGTHTM (PMEL_HUMAN)
RQMLGTHTI

SEQ ID NO: 136099 - protein, 9 aa, Artificial Sequence
  Description of Artificial Sequence: Synthetic peptide
  Seed: TIINGSQVW (PMEL_HUMAN)
TLINGSQVF

SEQ ID NO: 136100 - protein, 9 aa, Artificial Sequence
  Description of Artificial Sequence: Synthetic peptide
  Seed: VLGGPVSGL (PMEL_HUMAN)
VMGGPVSGI

SEQ ID NO: 136101 - protein, 9 aa, Artificial Sequence
  Description of Artificial Sequence: Synthetic peptide
  Seed: SQVWGGQPV (PMEL_HUMAN)
SNVWGGQPF

SEQ ID NO: 136102 - protein, 9 aa, Artificial Sequence
  Description of Artificial Sequence: Synthetic peptide
  Seed: AEPSGTTSV (PMEL_HUMAN)
AGPSGTTSM

SEQ ID NO: 136103 - protein, 9 aa, Artificial Sequence
  Description of Artificial Sequence: Synthetic peptide
  Seed: GQVPTTEVV (PMEL_HUMAN)
GGVPTTEVY

SEQ ID NO: 136104 - protein, 11 aa, Artificial Sequence
  Description of Artificial Sequence: Synthetic peptide
  Seed: FGDSSGTLISR (PMEL_HUMAN)
FIDSSGTLISI

SEQ ID NO: 136105 - protein, 10 aa, Artificial Sequence
  Description of Artificial Sequence: Synthetic peptide
  Seed: FSVSVSQLRA (PMEL_HUMAN)
FTVSVSQLRC

SEQ ID NO: 136106 - protein, 8 aa, Artificial Sequence
  Description of Artificial Sequence: Synthetic peptide
  Seed: SNDGPTLI (PMEL_HUMAN)
SCDGPTLL

SEQ ID NO: 136107 - protein, 10 aa, Artificial Sequence
  Description of Artificial Sequence: Synthetic peptide
  Seed: ESITGSLGPL (PMEL_HUMAN)
ELITGSLGPR

SEQ ID NO: 136108 - protein, 9 aa, Artificial Sequence
  Description of Artificial Sequence: Synthetic peptide
  Seed: NFPGSQKVL (PMEL_HUMAN)
NIPGSQKVL

SEQ ID NO: 136109 - protein, 10 aa, Artificial Sequence
  Description of Artificial Sequence: Synthetic peptide
  Seed: VPQLPHSSSH (PMEL_HUMAN)
VTQLPHSSSL

SEQ ID NO: 136110 - protein, 10 aa, Artificial Sequence
  Description of Artificial Sequence: Synthetic peptide
  Seed: MKQDFSVPQL (PMEL_HUMAN)
MRQDFSVPQY

SEQ ID NO: 136111 - protein, 9 aa, Artificial Sequence
  Description of Artificial Sequence: Synthetic peptide
  Seed: RTKAWNRQL (PMEL_HUMAN)
RLKAWNRQF

SEQ ID NO: 136112 - protein, 9 aa, Artificial Sequence
  Description of Artificial Sequence: Synthetic peptide
  Seed: HTMEVTVYH (PMEL_HUMAN)
HTMEVTVYE

SEQ ID NO: 136113 - protein, 11 aa, Artificial Sequence
  Description of Artificial Sequence: Synthetic peptide
  Seed: VTAQVVLQAAI (PMEL_HUMAN)
VTAQVVLQAAW

SEQ ID NO: 136114 - protein, 9 aa, Artificial Sequence
  Description of Artificial Sequence: Synthetic peptide
  Seed: MTPEKVPVS (PMEL_HUMAN)
MAPEKVPVA

SEQ ID NO: 136115 - protein, 9 aa, Artificial Sequence
  Description of Artificial Sequence: Synthetic peptide
  Seed: VVLQAAIPL (PMEL_HUMAN)
VQLQAAIPI

SEQ ID NO: 136116 - protein, 10 aa, Artificial Sequence
  Description of Artificial Sequence: Synthetic peptide
  Seed: AVIGALLAVG (PMEL_HUMAN)
AVIGALLAVD

SEQ ID NO: 136117 - protein, 10 aa, Artificial Sequence
  Description of Artificial Sequence: Synthetic peptide
  Seed: RGSRSYVPLA (PMEL_HUMAN)
RESRSYVPLR

SEQ ID NO: 136118 - protein, 10 aa, Artificial Sequence
  Description of Artificial Sequence: Synthetic peptide
  Seed: LAVVSTQLIM (PMEL_HUMAN)
LLVVSTQLIF

SEQ ID NO: 136119 - protein, 9 aa, Artificial Sequence
  Description of Artificial Sequence: Synthetic peptide
  Seed: ALVVTHTYL (PMEL_HUMAN)
AVVVTHTYV

SEQ ID NO: 136120 - protein, 9 aa, Artificial Sequence
  Description of Artificial Sequence: Synthetic peptide
  Seed: MLGTHTMEV (PMEL_HUMAN)
MLGTHTMEL

SEQ ID NO: 136121 - protein, 10 aa, Artificial Sequence
  Description of Artificial Sequence: Synthetic peptide
  Seed: MTPAEVSIVV (PMEL_HUMAN)
MWPAEVSIVV

SEQ ID NO: 136122 - protein, 11 aa, Artificial Sequence
  Description of Artificial Sequence: Synthetic peptide
  Seed: RALDGGNKHFL (PMEL_HUMAN)
RQLDGGNKHFI

SEQ ID NO: 136123 - protein, 9 aa, Artificial Sequence
  Description of Artificial Sequence: Synthetic peptide
  Seed: TAEAPNTTA (PMEL_HUMAN)
TIEAPNTTI

SEQ ID NO: 136124 - protein, 9 aa, Artificial Sequence
  Description of Artificial Sequence: Synthetic peptide
  Seed: MEVTVYHRR (PMEL_HUMAN)
MFVTVYHRR

SEQ ID NO: 136125 - protein, 11 aa, Artificial Sequence
  Description of Artificial Sequence: Synthetic peptide
  Seed: RQVPLDCVLYR (PMEL_HUMAN)
RIVPLDCVLYR

SEQ ID NO: 136126 - protein, 9 aa, Artificial Sequence
  Description of Artificial Sequence: Synthetic peptide
  Seed: GQVPLIVGI (PMEL_HUMAN)
GIVPLIVGM

SEQ ID NO: 136127 - protein, 10 aa, Artificial Sequence
  Description of Artificial Sequence: Synthetic peptide
  Seed: FPDGGPCPSG (PMEL_HUMAN)
FPDGGPCPSF

SEQ ID NO: 136128 - protein, 9 aa, Artificial Sequence
  Description of Artificial Sequence: Synthetic peptide
  Seed: HSSSHWLRL (PMEL_HUMAN)
HVSSHWLRW

SEQ ID NO: 136129 - protein, 10 aa, Artificial Sequence
  Description of Artificial Sequence: Synthetic peptide
  Seed: YRYGSFSVTL (PMEL_HUMAN)
YMYGSFSVTI

SEQ ID NO: 136130 - protein, 9 aa, Artificial Sequence
  Description of Artificial Sequence: Synthetic peptide
  Seed: RLVKRQVPL (PMEL_HUMAN)
RRVKRQVPM

SEQ ID NO: 136131 - protein, 9 aa, Artificial Sequence
  Description of Artificial Sequence: Synthetic peptide
  Seed: ESAEILQAV (PMEL_HUMAN)
EIAEILQAW

SEQ ID NO: 136132 - protein, 10 aa, Artificial Sequence
  Description of Artificial Sequence: Synthetic peptide
  Seed: YGSFSVTLDI (PMEL_HUMAN)
YKSFSVTLDF

SEQ ID NO: 136133 - protein, 9 aa, Artificial Sequence
  Description of Artificial Sequence: Synthetic peptide
  Seed: GANASFSIA (PMEL_HUMAN)
GANASFSIY

SEQ ID NO: 136134 - protein, 9 aa, Artificial Sequence
  Description of Artificial Sequence: Synthetic peptide
  Seed: TTPGQAPTA (PMEL_HUMAN)
TGPGQAPTF

SEQ ID NO: 136135 - protein, 9 aa, Artificial Sequence
  Description of Artificial Sequence: Synthetic peptide
  Seed: TTPGQAPTA (PMEL_HUMAN)
TGPGQAPTM

SEQ ID NO: 136136 - protein, 9 aa, Artificial Sequence
  Description of Artificial Sequence: Synthetic peptide
  Seed: TLISRALVV (PMEL_HUMAN)
TVISRALVM

SEQ ID NO: 136137 - protein, 8 aa, Artificial Sequence
  Description of Artificial Sequence: Synthetic peptide
  Seed: YGSFSVTL (PMEL_HUMAN)
YSSFSVTY

SEQ ID NO: 136138 - protein, 11 aa, Artificial Sequence
  Description of Artificial Sequence: Synthetic peptide
  Seed: SGLSIGTGRAM (PMEL_HUMAN)
SALSIGTGRAY

SEQ ID NO: 136139 - protein, 9 aa, Artificial Sequence
  Description of Artificial Sequence: Synthetic peptide
  Seed: FLRNQPLTF (PMEL_HUMAN)
FGRNQPLTW

SEQ ID NO: 136140 - protein, 9 aa, Artificial Sequence
  Description of Artificial Sequence: Synthetic peptide
  Seed: GMTPAEVSI (PMEL_HUMAN)
GVTPAEVSV

SEQ ID NO: 136141 - protein, 9 aa, Artificial Sequence
  Description of Artificial Sequence: Synthetic peptide
  Seed: VSNDGPTLI (PMEL_HUMAN)
VINDGPTLW

SEQ ID NO: 136142 - protein, 9 aa, Artificial Sequence
  Description of Artificial Sequence: Synthetic peptide
  Seed: AEPSGTTSV (PMEL_HUMAN)
ATPSGTTSI

SEQ ID NO: 136143 - protein, 11 aa, Artificial Sequence
  Description of Artificial Sequence: Synthetic peptide
  Seed: GYLAEADLSYT (PMEL_HUMAN)
GKLAEADLSYV

SEQ ID NO: 136144 - protein, 10 aa, Artificial Sequence
  Description of Artificial Sequence: Synthetic peptide
  Seed: TYLEPGPVTA (PMEL_HUMAN)
TWLEPGPVTF

SEQ ID NO: 136145 - protein, 11 aa, Artificial Sequence
  Description of Artificial Sequence: Synthetic peptide
  Seed: RRGSRSYVPLA (PMEL_HUMAN)
RKGSRSYVPLK

SEQ ID NO: 136146 - protein, 10 aa, Artificial Sequence
  Description of Artificial Sequence: Synthetic peptide
  Seed: TDQVPFSVSV (PMEL_HUMAN)
TCQVPFSVSV

SEQ ID NO: 136147 - protein, 8 aa, Artificial Sequence
  Description of Artificial Sequence: Synthetic peptide
  Seed: AQVVLQAA (PMEL_HUMAN)
AEVVLQAV

SEQ ID NO: 136148 - protein, 9 aa, Artificial Sequence
  Description of Artificial Sequence: Synthetic peptide
  Seed: KQDFSVPQL (PMEL_HUMAN)
KCDFSVPQL

SEQ ID NO: 136149 - protein, 11 aa, Artificial Sequence
  Description of Artificial Sequence: Synthetic peptide
  Seed: RRRLMKQDFSV (PMEL_HUMAN)
RRRLMKQDFSM

SEQ ID NO: 136150 - protein, 9 aa, Artificial Sequence
  Description of Artificial Sequence: Synthetic peptide
  Seed: FTITDQVPF (PMEL_HUMAN)
FTITDQVPY

SEQ ID NO: 136151 - protein, 10 aa, Artificial Sequence
  Description of Artificial Sequence: Synthetic peptide
  Seed: EVVGTTPGQA (PMEL_HUMAN)
ESVGTTPGQR

SEQ ID NO: 136152 - protein, 9 aa, Artificial Sequence
  Description of Artificial Sequence: Synthetic peptide
  Seed: IMPGQEAGL (PMEL_HUMAN)
IFPGQEAGY

SEQ ID NO: 136153 - protein, 10 aa, Artificial Sequence
  Description of Artificial Sequence: Synthetic peptide
  Seed: NTIINGSQVW (PMEL_HUMAN)
NSIINGSQVW

SEQ ID NO: 136154 - protein, 11 aa, Artificial Sequence
  Description of Artificial Sequence: Synthetic peptide
  Seed: AEMSTPEATGM (PMEL_HUMAN)
AMMSTPEATGY

SEQ ID NO: 136155 - protein, 9 aa, Artificial Sequence
  Description of Artificial Sequence: Synthetic peptide
  Seed: LVLMAVVLA (PMEL_HUMAN)
LLLMAVVLV

SEQ ID NO: 136156 - protein, 10 aa, Artificial Sequence
  Description of Artificial Sequence: Synthetic peptide
  Seed: KRQVPLDCVL (PMEL_HUMAN)
KMQVPLDCVF

SEQ ID NO: 136157 - protein, 10 aa, Artificial Sequence
  Description of Artificial Sequence: Synthetic peptide
  Seed: SQKRSFVYVW (PMEL_HUMAN)
SLKRSFVYVF

SEQ ID NO: 136158 - protein, 9 aa, Artificial Sequence
  Description of Artificial Sequence: Synthetic peptide
  Seed: YLAEADLSY (PMEL_HUMAN)
YKAEADLSI

SEQ ID NO: 136159 - protein, 10 aa, Artificial Sequence
  Description of Artificial Sequence: Synthetic peptide
  Seed: GALLAVGATK (PMEL_HUMAN)
GLLLAVGATK

SEQ ID NO: 136160 - protein, 9 aa, Artificial Sequence
  Description of Artificial Sequence: Synthetic peptide
  Seed: MPTAESTGM (PMEL_HUMAN)
MATAESTGM

SEQ ID NO: 136161 - protein, 9 aa, Artificial Sequence
  Description of Artificial Sequence: Synthetic peptide
  Seed: TAPVQMPTA (PMEL_HUMAN)
TVPVQMPTM

SEQ ID NO: 136162 - protein, 11 aa, Artificial Sequence
  Description of Artificial Sequence: Synthetic peptide
  Seed: FGDSSGTLISR (PMEL_HUMAN)
FLDSSGTLISL

SEQ ID NO: 136163 - protein, 9 aa, Artificial Sequence
  Description of Artificial Sequence: Synthetic peptide
  Seed: AVIGALLAV (PMEL_HUMAN)
AIIGALLAI

SEQ ID NO: 136164 - protein, 9 aa, Artificial Sequence
  Description of Artificial Sequence: Synthetic peptide
  Seed: ALDGGNKHF (PMEL_HUMAN)
AWDGGNKHL

SEQ ID NO: 136165 - protein, 10 aa, Artificial Sequence
  Description of Artificial Sequence: Synthetic peptide
  Seed: RALDGGNKHF (PMEL_HUMAN)
RLLDGGNKHV

SEQ ID NO: 136166 - protein, 9 aa, Artificial Sequence
  Description of Artificial Sequence: Synthetic peptide
  Seed: LAVVSTQLI (PMEL_HUMAN)
LSVVSTQLI

SEQ ID NO: 136167 - protein, 9 aa, Artificial Sequence
  Description of Artificial Sequence: Synthetic peptide
  Seed: YLAEADLSY (PMEL_HUMAN)
YVAEADLSI

SEQ ID NO: 136168 - protein, 9 aa, Artificial Sequence
  Description of Artificial Sequence: Synthetic peptide
  Seed: AAIPLTSCG (PMEL_HUMAN)
AAIPLTSCF

SEQ ID NO: 136169 - protein, 10 aa, Artificial Sequence
  Description of Artificial Sequence: Synthetic peptide
  Seed: RRLMKQDFSV (PMEL_HUMAN)
RKLMKQDFSL

SEQ ID NO: 136170 - protein, 9 aa, Artificial Sequence
  Description of Artificial Sequence: Synthetic peptide
  Seed: AEAPNTTAG (PMEL_HUMAN)
AEAPNTTAL

SEQ ID NO: 136171 - protein, 10 aa, Artificial Sequence
  Description of Artificial Sequence: Synthetic peptide
  Seed: DSSGTLISRA (PMEL_HUMAN)
DASGTLISRV

SEQ ID NO: 136172 - protein, 11 aa, Artificial Sequence
  Description of Artificial Sequence: Synthetic peptide
  Seed: AEMSTPEATGM (PMEL_HUMAN)
AVMSTPEATGF

SEQ ID NO: 136173 - protein, 9 aa, Artificial Sequence
  Description of Artificial Sequence: Synthetic peptide
  Seed: AQRLCQPVL (PMEL_HUMAN)
AKRLCQPVY

SEQ ID NO: 136174 - protein, 11 aa, Artificial Sequence
  Description of Artificial Sequence: Synthetic peptide
  Seed: HSSSHWLRLPR (PMEL_HUMAN)
HLSSHWLRLPR

SEQ ID NO: 136175 - protein, 10 aa, Artificial Sequence
  Description of Artificial Sequence: Synthetic peptide
  Seed: IALNFPGSQK (PMEL_HUMAN)
ILLNFPGSQK

SEQ ID NO: 136176 - protein, 9 aa, Artificial Sequence
  Description of Artificial Sequence: Synthetic peptide
  Seed: DQVPFSVSV (PMEL_HUMAN)
DTVPFSVSM

SEQ ID NO: 136177 - protein, 9 aa, Artificial Sequence
  Description of Artificial Sequence: Synthetic peptide
  Seed: VQVPTTEVI (PMEL_HUMAN)
VMVPTTEVM

SEQ ID NO: 136178 - protein, 9 aa, Artificial Sequence
  Description of Artificial Sequence: Synthetic peptide
  Seed: VTLDIVQGI (PMEL_HUMAN)
VTLDIVQGM

SEQ ID NO: 136179 - protein, 9 aa, Artificial Sequence
  Description of Artificial Sequence: Synthetic peptide
  Seed: VMGTTLAEM (PMEL_HUMAN)
VIGTTLAEY

SEQ ID NO: 136180 - protein, 10 aa, Artificial Sequence
  Description of Artificial Sequence: Synthetic peptide
  Seed: KVLPDGQVIW (PMEL_HUMAN)
KTLPDGQVIW

SEQ ID NO: 136181 - protein, 9 aa, Artificial Sequence
  Description of Artificial Sequence: Synthetic peptide
  Seed: SSIMSTESI (PMEL_HUMAN)
SCIMSTESW

SEQ ID NO: 136182 - protein, 9 aa, Artificial Sequence
  Description of Artificial Sequence: Synthetic peptide
  Seed: VQVPTTEVI (PMEL_HUMAN)
VVVPTTEVL

SEQ ID NO: 136183 - protein, 10 aa, Artificial Sequence
  Description of Artificial Sequence: Synthetic peptide
  Seed: LAEADLSYTW (PMEL_HUMAN)
LYEADLSYTW

SEQ ID NO: 136184 - protein, 10 aa, Artificial Sequence
  Description of Artificial Sequence: Synthetic peptide
  Seed: RGSRSYVPLA (PMEL_HUMAN)
RESRSYVPLY

SEQ ID NO: 136185 - protein, 9 aa, Artificial Sequence
  Description of Artificial Sequence: Synthetic peptide
  Seed: ALVVTHTYL (PMEL_HUMAN)
ATVVTHTYV

SEQ ID NO: 136186 - protein, 9 aa, Artificial Sequence
  Description of Artificial Sequence: Synthetic peptide
  Seed: VISTAPVQM (PMEL_HUMAN)
VQSTAPVQY

SEQ ID NO: 136187 - protein, 10 aa, Artificial Sequence
  Description of Artificial Sequence: Synthetic peptide
  Seed: ALDGGNKHFL (PMEL_HUMAN)
ASDGGNKHFY

SEQ ID NO: 136188 - protein, 9 aa, Artificial Sequence
  Description of Artificial Sequence: Synthetic peptide
  Seed: YLAEADLSY (PMEL_HUMAN)
YYAEADLSF

SEQ ID NO: 136189 - protein, 9 aa, Artificial Sequence
  Description of Artificial Sequence: Synthetic peptide
  Seed: FGDSSGTLI (PMEL_HUMAN)
FGDSSGTLF

SEQ ID NO: 136190 - protein, 11 aa, Artificial Sequence
  Description of Artificial Sequence: Synthetic peptide
  Seed: YVPLAHSSSAF (PMEL_HUMAN)
YEPLAHSSSAY

SEQ ID NO: 136191 - protein, 9 aa, Artificial Sequence
  Description of Artificial Sequence: Synthetic peptide
  Seed: LVLKRCLLH (PMEL_HUMAN)
LMLKRCLLK

SEQ ID NO: 136192 - protein, 9 aa, Artificial Sequence
  Description of Artificial Sequence: Synthetic peptide
  Seed: RALDGGNKH (PMEL_HUMAN)
RVLDGGNKY

SEQ ID NO: 136193 - protein, 9 aa, Artificial Sequence
  Description of Artificial Sequence: Synthetic peptide
  Seed: RSYVPLAHS (PMEL_HUMAN)
RTYVPLAHA

SEQ ID NO: 136194 - protein, 11 aa, Artificial Sequence
  Description of Artificial Sequence: Synthetic peptide
  Seed: ITDQVPFSVSV (PMEL_HUMAN)
ILDQVPFSVSV

SEQ ID NO: 136195 - protein, 9 aa, Artificial Sequence
  Description of Artificial Sequence: Synthetic peptide
  Seed: HSSSHWLRL (PMEL_HUMAN)
HISSHWLRY

SEQ ID NO: 136196 - protein, 10 aa, Artificial Sequence
  Description of Artificial Sequence: Synthetic peptide
  Seed: SRALVVTHTY (PMEL_HUMAN)
SWALVVTHTW

SEQ ID NO: 136197 - protein, 9 aa, Artificial Sequence
  Description of Artificial Sequence: Synthetic peptide
  Seed: ESAEILQAV (PMEL_HUMAN)
EIAEILQAA

SEQ ID NO: 136198 - protein, 10 aa, Artificial Sequence
  Description of Artificial Sequence: Synthetic peptide
  Seed: AVVLASLIYR (PMEL_HUMAN)
ACVLASLIYR

SEQ ID NO: 136199 - protein, 10 aa, Artificial Sequence
  Description of Artificial Sequence: Synthetic peptide
  Seed: AFTITDQVPF (PMEL_HUMAN)
AMTITDQVPY

SEQ ID NO: 136200 - protein, 10 aa, Artificial Sequence
  Description of Artificial Sequence: Synthetic peptide
  Seed: CQLVLHQILK (PMEL_HUMAN)
CTLVLHQILK

SEQ ID NO: 136201 - protein, 9 aa, Artificial Sequence
  Description of Artificial Sequence: Synthetic peptide
  Seed: LHLAVIGAL (PMEL_HUMAN)
LMLAVIGAM

SEQ ID NO: 136202 - protein, 11 aa, Artificial Sequence
  Description of Artificial Sequence: Synthetic peptide
  Seed: GYLAEADLSYT (PMEL_HUMAN)
GMLAEADLSYI

SEQ ID NO: 136203 - protein, 9 aa, Artificial Sequence
  Description of Artificial Sequence: Synthetic peptide
  Seed: LPDGQVIWV (PMEL_HUMAN)
LGDGQVIWF

SEQ ID NO: 136204 - protein, 9 aa, Artificial Sequence
  Description of Artificial Sequence: Synthetic peptide
  Seed: KQDFSVPQL (PMEL_HUMAN)
KLDFSVPQL

SEQ ID NO: 136205 - protein, 10 aa, Artificial Sequence
  Description of Artificial Sequence: Synthetic peptide
  Seed: CLLHLAVIGA (PMEL_HUMAN)
CMLHLAVIGV

SEQ ID NO: 136206 - protein, 10 aa, Artificial Sequence
  Description of Artificial Sequence: Synthetic peptide
  Seed: SRALVVTHTY (PMEL_HUMAN)
SQALVVTHTY

SEQ ID NO: 136207 - protein, 9 aa, Artificial Sequence
  Description of Artificial Sequence: Synthetic peptide
  Seed: RNQPLTFAL (PMEL_HUMAN)
RRQPLTFAI

SEQ ID NO: 136208 - protein, 9 aa, Artificial Sequence
  Description of Artificial Sequence: Synthetic peptide
  Seed: KAWNRQLYP (PMEL_HUMAN)
KTWNRQLYL

SEQ ID NO: 136209 - protein, 11 aa, Artificial Sequence
  Description of Artificial Sequence: Synthetic peptide
  Seed: LVLMAVVLASL (PMEL_HUMAN)
LQLMAVVLASV

SEQ ID NO: 136210 - protein, 9 aa, Artificial Sequence
  Description of Artificial Sequence: Synthetic peptide
  Seed: EVMGTTLAE (PMEL_HUMAN)
EQMGTTLAR

SEQ ID NO: 136211 - protein, 9 aa, Artificial Sequence
  Description of Artificial Sequence: Synthetic peptide
  Seed: LIVGILLVL (PMEL_HUMAN)
LVVGILLVF

SEQ ID NO: 136212 - protein, 9 aa, Artificial Sequence
  Description of Artificial Sequence: Synthetic peptide
  Seed: SYVPLAHSS (PMEL_HUMAN)
SFVPLAHSL

SEQ ID NO: 136213 - protein, 9 aa, Artificial Sequence
  Description of Artificial Sequence: Synthetic peptide
  Seed: LLDGTATLR (PMEL_HUMAN)
LSDGTATLF

SEQ ID NO: 136214 - protein, 9 aa, Artificial Sequence
  Description of Artificial Sequence: Synthetic peptide
  Seed: TAEAPNTTA (PMEL_HUMAN)
TSEAPNTTI

SEQ ID NO: 136215 - protein, 11 aa, Artificial Sequence
  Description of Artificial Sequence: Synthetic peptide
  Seed: FSVTLDIVQGI (PMEL_HUMAN)
FEVTLDIVQGV

SEQ ID NO: 136216 - protein, 10 aa, Artificial Sequence
  Description of Artificial Sequence: Synthetic peptide
  Seed: VVLASLIYRR (PMEL_HUMAN)
VGLASLIYRR

SEQ ID NO: 136217 - protein, 9 aa, Artificial Sequence
  Description of Artificial Sequence: Synthetic peptide
  Seed: RNQPLTFAL (PMEL_HUMAN)
RAQPLTFAW

SEQ ID NO: 136218 - protein, 9 aa, Artificial Sequence
  Description of Artificial Sequence: Synthetic peptide
  Seed: TMEVTVYHR (PMEL_HUMAN)
TIEVTVYHR

SEQ ID NO: 136219 - protein, 10 aa, Artificial Sequence
  Description of Artificial Sequence: Synthetic peptide
  Seed: VLMAVVLASL (PMEL_HUMAN)
VQMAVVLASF

SEQ ID NO: 136220 - protein, 9 aa, Artificial Sequence
  Description of Artificial Sequence: Synthetic peptide
  Seed: LIVGILLVL (PMEL_HUMAN)
LSVGILLVI

SEQ ID NO: 136221 - protein, 10 aa, Artificial Sequence
  Description of Artificial Sequence: Synthetic peptide
  Seed: DGTATLRLVK (PMEL_HUMAN)
DWTATLRLVR

SEQ ID NO: 136222 - protein, 10 aa, Artificial Sequence
  Description of Artificial Sequence: Synthetic peptide
  Seed: SVPQLPHSSS (PMEL_HUMAN)
SQPQLPHSSV

SEQ ID NO: 136223 - protein, 9 aa, Artificial Sequence
  Description of Artificial Sequence: Synthetic peptide
  Seed: MTPAEVSIV (PMEL_HUMAN)
MLPAEVSIM

SEQ ID NO: 136224 - protein, 9 aa, Artificial Sequence
  Description of Artificial Sequence: Synthetic peptide
  Seed: LQLHDPSGY (PMEL_HUMAN)
LQLHDPSGF

SEQ ID NO: 136225 - protein, 9 aa, Artificial Sequence
  Description of Artificial Sequence: Synthetic peptide
  Seed: YLEPGPVTA (PMEL_HUMAN)
YNEPGPVTM

SEQ ID NO: 136226 - protein, 9 aa, Artificial Sequence
  Description of Artificial Sequence: Synthetic peptide
  Seed: RAMLGTHTM (PMEL_HUMAN)
RPMLGTHTF

SEQ ID NO: 136227 - protein, 9 aa, Artificial Sequence
  Description of Artificial Sequence: Synthetic peptide
  Seed: KVLPDGQVI (PMEL_HUMAN)
KQLPDGQVI

SEQ ID NO: 136228 - protein, 9 aa, Artificial Sequence
  Description of Artificial Sequence: Synthetic peptide
  Seed: STAPVQMPT (PMEL_HUMAN)
SVAPVQMPA

SEQ ID NO: 136229 - protein, 10 aa, Artificial Sequence
  Description of Artificial Sequence: Synthetic peptide
  Seed: EVISTAPVQM (PMEL_HUMAN)
EVISTAPVQF

SEQ ID NO: 136230 - protein, 9 aa, Artificial Sequence
  Description of Artificial Sequence: Synthetic peptide
  Seed: SGLSIGTGR (PMEL_HUMAN)
SFLSIGTGR

SEQ ID NO: 136231 - protein, 9 aa, Artificial Sequence
  Description of Artificial Sequence: Synthetic peptide
  Seed: GTYCLNVSL (PMEL_HUMAN)
GQYCLNVSF

SEQ ID NO: 136232 - protein, 9 aa, Artificial Sequence
  Description of Artificial Sequence: Synthetic peptide
  Seed: RAMLGTHTM (PMEL_HUMAN)
RTMLGTHTR

SEQ ID NO: 136233 - protein, 9 aa, Artificial Sequence
  Description of Artificial Sequence: Synthetic peptide
  Seed: LSIGTGRAM (PMEL_HUMAN)
LMIGTGRAY

SEQ ID NO: 136234 - protein, 9 aa, Artificial Sequence
  Description of Artificial Sequence: Synthetic peptide
  Seed: QLRTKAWNR (PMEL_HUMAN)
QMRTKAWNK

SEQ ID NO: 136235 - protein, 9 aa, Artificial Sequence
  Description of Artificial Sequence: Synthetic peptide
  Seed: VLPDGQVIW (PMEL_HUMAN)
VGPDGQVIL

SEQ ID NO: 136236 - protein, 10 aa, Artificial Sequence
  Description of Artificial Sequence: Synthetic peptide
  Seed: LSIGTGRAML (PMEL_HUMAN)
LTIGTGRAMW

SEQ ID NO: 136237 - protein, 9 aa, Artificial Sequence
  Description of Artificial Sequence: Synthetic peptide
  Seed: SSIMSTESI (PMEL_HUMAN)
STIMSTESM

SEQ ID NO: 136238 - protein, 9 aa, Artificial Sequence
  Description of Artificial Sequence: Synthetic peptide
  Seed: SQVWGGQPV (PMEL_HUMAN)
SEVWGGQPI

SEQ ID NO: 136239 - protein, 9 aa, Artificial Sequence
  Description of Artificial Sequence: Synthetic peptide
  Seed: LQLHDPSGY (PMEL_HUMAN)
LKLHDPSGF

SEQ ID NO: 136240 - protein, 11 aa, Artificial Sequence
  Description of Artificial Sequence: Synthetic peptide
  Seed: AEMSTPEATGM (PMEL_HUMAN)
AAMSTPEATGF

SEQ ID NO: 136241 - protein, 9 aa, Artificial Sequence
  Description of Artificial Sequence: Synthetic peptide
  Seed: YLEPGPVTA (PMEL_HUMAN)
YAEPGPVTV

SEQ ID NO: 136242 - protein, 9 aa, Artificial Sequence
  Description of Artificial Sequence: Synthetic peptide
  Seed: LPKEACMEI (PMEL_HUMAN)
LPKEACMEL

SEQ ID NO: 136243 - protein, 9 aa, Artificial Sequence
  Description of Artificial Sequence: Synthetic peptide
  Seed: LPDGQVIWV (PMEL_HUMAN)
LPDGQVIWL

SEQ ID NO: 136244 - protein, 9 aa, Artificial Sequence
  Description of Artificial Sequence: Synthetic peptide
  Seed: KTWGQYWQV (PMEL_HUMAN)
KLWGQYWQS

SEQ ID NO: 136245 - protein, 9 aa, Artificial Sequence
  Description of Artificial Sequence: Synthetic peptide
  Seed: RQVPLDCVL (PMEL_HUMAN)
RIVPLDCVV

SEQ ID NO: 136246 - protein, 10 aa, Artificial Sequence
  Description of Artificial Sequence: Synthetic peptide
  Seed: RRGSRSYVPL (PMEL_HUMAN)
RRGSRSYVPM

SEQ ID NO: 136247 - protein, 9 aa, Artificial Sequence
  Description of Artificial Sequence: Synthetic peptide
  Seed: MAVVLASLI (PMEL_HUMAN)
MIVVLASLV

SEQ ID NO: 136248 - protein, 9 aa, Artificial Sequence
  Description of Artificial Sequence: Synthetic peptide
  Seed: VTLDIVQGI (PMEL_HUMAN)
VSLDIVQGY

SEQ ID NO: 136249 - protein, 9 aa, Artificial Sequence
  Description of Artificial Sequence: Synthetic peptide
  Seed: RQVPLDCVL (PMEL_HUMAN)
RSVPLDCVM

SEQ ID NO: 136250 - protein, 9 aa, Artificial Sequence
  Description of Artificial Sequence: Synthetic peptide
  Seed: YHRRGSRSY (PMEL_HUMAN)
YERRGSRSM

SEQ ID NO: 136251 - protein, 9 aa, Artificial Sequence
  Description of Artificial Sequence: Synthetic peptide
  Seed: LASLIYRRR (PMEL_HUMAN)
LFSLIYRRR

SEQ ID NO: 136252 - protein, 11 aa, Artificial Sequence
  Description of Artificial Sequence: Synthetic peptide
  Seed: VSLADTNSLAV (PMEL_HUMAN)
VALADTNSLAW

SEQ ID NO: 136253 - protein, 10 aa, Artificial Sequence
  Description of Artificial Sequence: Synthetic peptide
  Seed: QVLGGPVSGL (PMEL_HUMAN)
QTLGGPVSGR

SEQ ID NO: 136254 - protein, 9 aa, Artificial Sequence
  Description of Artificial Sequence: Synthetic peptide
  Seed: VSLADTNSL (PMEL_HUMAN)
VTLADTNSM

SEQ ID NO: 136255 - protein, 9 aa, Artificial Sequence
  Description of Artificial Sequence: Synthetic peptide
  Seed: YPQETDDAC (PMEL_HUMAN)
YPQETDDAV

SEQ ID NO: 136256 - protein, 9 aa, Artificial Sequence
  Description of Artificial Sequence: Synthetic peptide
  Seed: FGDSSGTLI (PMEL_HUMAN)
FWDSSGTLL

SEQ ID NO: 136257 - protein, 9 aa, Artificial Sequence
  Description of Artificial Sequence: Synthetic peptide
  Seed: TGRAMLGTH (PMEL_HUMAN)
TARAMLGTY

SEQ ID NO: 136258 - protein, 9 aa, Artificial Sequence
  Description of Artificial Sequence: Synthetic peptide
  Seed: ESAEILQAV (PMEL_HUMAN)
ETAEILQAV

SEQ ID NO: 136259 - protein, 10 aa, Artificial Sequence
  Description of Artificial Sequence: Synthetic peptide
  Seed: RTKAWNRQLY (PMEL_HUMAN)
RQKAWNRQLK

SEQ ID NO: 136260 - protein, 10 aa, Artificial Sequence
  Description of Artificial Sequence: Synthetic peptide
  Seed: SQVWGGQPVY (PMEL_HUMAN)
SYVWGGQPVY

SEQ ID NO: 136261 - protein, 10 aa, Artificial Sequence
  Description of Artificial Sequence: Synthetic peptide
  Seed: TLAEMSTPEA (PMEL_HUMAN)
TMAEMSTPEM

SEQ ID NO: 136262 - protein, 10 aa, Artificial Sequence
  Description of Artificial Sequence: Synthetic peptide
  Seed: ALDGGNKHFL (PMEL_HUMAN)
AADGGNKHFM

SEQ ID NO: 136263 - protein, 10 aa, Artificial Sequence
  Description of Artificial Sequence: Synthetic peptide
  Seed: RGSRSYVPLA (PMEL_HUMAN)
RFSRSYVPLM

SEQ ID NO: 136264 - protein, 9 aa, Artificial Sequence
  Description of Artificial Sequence: Synthetic peptide
  Seed: TTDGHRPTA (PMEL_HUMAN)
TWDGHRPTF

SEQ ID NO: 136265 - protein, 9 aa, Artificial Sequence
  Description of Artificial Sequence: Synthetic peptide
  Seed: LNFPGSQKV (PMEL_HUMAN)
LTFPGSQKM

SEQ ID NO: 136266 - protein, 9 aa, Artificial Sequence
  Description of Artificial Sequence: Synthetic peptide
  Seed: YLEPGPVTA (PMEL_HUMAN)
YAEPGPVTM

SEQ ID NO: 136267 - protein, 11 aa, Artificial Sequence
  Description of Artificial Sequence: Synthetic peptide
  Seed: YLEPGPVTAQV (PMEL_HUMAN)
YVEPGPVTAQL

SEQ ID NO: 136268 - protein, 10 aa, Artificial Sequence
  Description of Artificial Sequence: Synthetic peptide
  Seed: YRYGSFSVTL (PMEL_HUMAN)
YFYGSFSVTY

SEQ ID NO: 136269 - protein, 9 aa, Artificial Sequence
  Description of Artificial Sequence: Synthetic peptide
  Seed: VQMPTAEST (PMEL_HUMAN)
VTMPTAESL

SEQ ID NO: 136270 - protein, 9 aa, Artificial Sequence
  Description of Artificial Sequence: Synthetic peptide
  Seed: TTDGHRPTA (PMEL_HUMAN)
TFDGHRPTV

SEQ ID NO: 136271 - protein, 10 aa, Artificial Sequence
  Description of Artificial Sequence: Synthetic peptide
  Seed: KTWGQYWQVL (PMEL_HUMAN)
KQWGQYWQVY

SEQ ID NO: 136272 - protein, 9 aa, Artificial Sequence
  Description of Artificial Sequence: Synthetic peptide
  Seed: ASFSIALNF (PMEL_HUMAN)
AMFSIALNY

SEQ ID NO: 136273 - protein, 10 aa, Artificial Sequence
  Description of Artificial Sequence: Synthetic peptide
  Seed: LAVIGALLAV (PMEL_HUMAN)
LKVIGALLAA

SEQ ID NO: 136274 - protein, 10 aa, Artificial Sequence
  Description of Artificial Sequence: Synthetic peptide
  Seed: PTLIGANASF (PMEL_HUMAN)
PRLIGANASF

SEQ ID NO: 136275 - protein, 9 aa, Artificial Sequence
  Description of Artificial Sequence: Synthetic peptide
  Seed: VQMPTAEST (PMEL_HUMAN)
VQMPTAESF

SEQ ID NO: 136276 - protein, 9 aa, Artificial Sequence
  Description of Artificial Sequence: Synthetic peptide
  Seed: KTWGQYWQV (PMEL_HUMAN)
KQWGQYWQL

SEQ ID NO: 136277 - protein, 9 aa, Artificial Sequence
  Description of Artificial Sequence: Synthetic peptide
  Seed: VVLASLIYR (PMEL_HUMAN)
VYLASLIYK

SEQ ID NO: 136278 - protein, 11 aa, Artificial Sequence
  Description of Artificial Sequence: Synthetic peptide
  Seed: RRRLMKQDFSV (PMEL_HUMAN)
RCRLMKQDFSV

SEQ ID NO: 136279 - protein, 10 aa, Artificial Sequence
  Description of Artificial Sequence: Synthetic peptide
  Seed: GQVPLIVGIL (PMEL_HUMAN)
GLVPLIVGIL

SEQ ID NO: 136280 - protein, 9 aa, Artificial Sequence
  Description of Artificial Sequence: Synthetic peptide
  Seed: MTPAEVSIV (PMEL_HUMAN)
MIPAEVSIV

SEQ ID NO: 136281 - protein, 9 aa, Artificial Sequence
  Description of Artificial Sequence: Synthetic peptide
  Seed: VVLSGTTAA (PMEL_HUMAN)
VTLSGTTAM

SEQ ID NO: 136282 - protein, 9 aa, Artificial Sequence
  Description of Artificial Sequence: Synthetic peptide
  Seed: AVIGALLAV (PMEL_HUMAN)
AQIGALLAF

SEQ ID NO: 136283 - protein, 9 aa, Artificial Sequence
  Description of Artificial Sequence: Synthetic peptide
  Seed: DSSGTLISR (PMEL_HUMAN)
DLSGTLISR

SEQ ID NO: 136284 - protein, 9 aa, Artificial Sequence
  Description of Artificial Sequence: Synthetic peptide
  Seed: SQKRSFVYV (PMEL_HUMAN)
STKRSFVYL

SEQ ID NO: 136285 - protein, 9 aa, Artificial Sequence
  Description of Artificial Sequence: Synthetic peptide
  Seed: TKAWNRQLY (PMEL_HUMAN)
TMAWNRQLF

SEQ ID NO: 136286 - protein, 9 aa, Artificial Sequence
  Description of Artificial Sequence: Synthetic peptide
  Seed: LLAVGATKV (PMEL_HUMAN)
LQAVGATKI

SEQ ID NO: 136287 - protein, 9 aa, Artificial Sequence
  Description of Artificial Sequence: Synthetic peptide
  Seed: EKVPVSEVM (PMEL_HUMAN)
EHVPVSEVL

SEQ ID NO: 136288 - protein, 10 aa, Artificial Sequence
  Description of Artificial Sequence: Synthetic peptide
  Seed: MAVVLASLIY (PMEL_HUMAN)
MTVVLASLIY

SEQ ID NO: 136289 - protein, 9 aa, Artificial Sequence
  Description of Artificial Sequence: Synthetic peptide
  Seed: SLAVVSTQL (PMEL_HUMAN)
SQAVVSTQW

SEQ ID NO: 136290 - protein, 9 aa, Artificial Sequence
  Description of Artificial Sequence: Synthetic peptide
  Seed: WVETTAREL (PMEL_HUMAN)
WAETTAREF

SEQ ID NO: 136291 - protein, 10 aa, Artificial Sequence
  Description of Artificial Sequence: Synthetic peptide
  Seed: GPLLDGTATL (PMEL_HUMAN)
GDLLDGTATV

SEQ ID NO: 136292 - protein, 9 aa, Artificial Sequence
  Description of Artificial Sequence: Synthetic peptide
  Seed: AEADLSYTW (PMEL_HUMAN)
AEADLSYTM

SEQ ID NO: 136293 - protein, 10 aa, Artificial Sequence
  Description of Artificial Sequence: Synthetic peptide
  Seed: RGSRSYVPLA (PMEL_HUMAN)
RNSRSYVPLK

SEQ ID NO: 136294 - protein, 11 aa, Artificial Sequence
  Description of Artificial Sequence: Synthetic peptide
  Seed: RSYVPLAHSSS (PMEL_HUMAN)
RSYVPLAHSSK

SEQ ID NO: 136295 - protein, 9 aa, Artificial Sequence
  Description of Artificial Sequence: Synthetic peptide
  Seed: SSIMSTESI (PMEL_HUMAN)
SIIMSTESW

SEQ ID NO: 136296 - protein, 9 aa, Artificial Sequence
  Description of Artificial Sequence: Synthetic peptide
  Seed: GQVPLIVGI (PMEL_HUMAN)
GHVPLIVGA

SEQ ID NO: 136297 - protein, 9 aa, Artificial Sequence
  Description of Artificial Sequence: Synthetic peptide
  Seed: SGLSIGTGR (PMEL_HUMAN)
SALSIGTGL

SEQ ID NO: 136298 - protein, 10 aa, Artificial Sequence
  Description of Artificial Sequence: Synthetic peptide
  Seed: LVLMAVVLAS (PMEL_HUMAN)
LILMAVVLAM

SEQ ID NO: 136299 - protein, 10 aa, Artificial Sequence
  Description of Artificial Sequence: Synthetic peptide
  Seed: LPHSSSHWLR (PMEL_HUMAN)
LTHSSSHWLR

SEQ ID NO: 136300 - protein, 10 aa, Artificial Sequence
  Description of Artificial Sequence: Synthetic peptide
  Seed: LHLAVIGALL (PMEL_HUMAN)
LFLAVIGALV

SEQ ID NO: 136301 - protein, 10 aa, Artificial Sequence
  Description of Artificial Sequence: Synthetic peptide
  Seed: LQLHDPSGYL (PMEL_HUMAN)
LMLHDPSGYL

SEQ ID NO: 136302 - protein, 10 aa, Artificial Sequence
  Description of Artificial Sequence: Synthetic peptide
  Seed: YRYGSFSVTL (PMEL_HUMAN)
YPYGSFSVTM

SEQ ID NO: 136303 - protein, 10 aa, Artificial Sequence
  Description of Artificial Sequence: Synthetic peptide
  Seed: MTPAEVSIVV (PMEL_HUMAN)
MWPAEVSIVF

SEQ ID NO: 136304 - protein, 9 aa, Artificial Sequence
  Description of Artificial Sequence: Synthetic peptide
  Seed: MTPEKVPVS (PMEL_HUMAN)
MMPEKVPVF

SEQ ID NO: 136305 - protein, 9 aa, Artificial Sequence
  Description of Artificial Sequence: Synthetic peptide
  Seed: ITDQVPFSV (PMEL_HUMAN)
IADQVPFSY

SEQ ID NO: 136306 - protein, 9 aa, Artificial Sequence
  Description of Artificial Sequence: Synthetic peptide
  Seed: GQVPLIVGI (PMEL_HUMAN)
GRVPLIVGI

SEQ ID NO: 136307 - protein, 9 aa, Artificial Sequence
  Description of Artificial Sequence: Synthetic peptide
  Seed: ALLAVGATK (PMEL_HUMAN)
ALLAVGATR

SEQ ID NO: 136308 - protein, 10 aa, Artificial Sequence
  Description of Artificial Sequence: Synthetic peptide
  Seed: RALDGGNKHF (PMEL_HUMAN)
RMLDGGNKHW

SEQ ID NO: 136309 - protein, 9 aa, Artificial Sequence
  Description of Artificial Sequence: Synthetic peptide
  Seed: RALVVTHTY (PMEL_HUMAN)
RFLVVTHTM

SEQ ID NO: 136310 - protein, 9 aa, Artificial Sequence
  Description of Artificial Sequence: Synthetic peptide
  Seed: SLGPLLDGT (PMEL_HUMAN)
STGPLLDGV

SEQ ID NO: 136311 - protein, 10 aa, Artificial Sequence
  Description of Artificial Sequence: Synthetic peptide
  Seed: RGSRSYVPLA (PMEL_HUMAN)
RFSRSYVPLG

SEQ ID NO: 136312 - protein, 10 aa, Artificial Sequence
  Description of Artificial Sequence: Synthetic peptide
  Seed: AEILQAVPSG (PMEL_HUMAN)
AEILQAVPSF

SEQ ID NO: 136313 - protein, 11 aa, Artificial Sequence
  Description of Artificial Sequence: Synthetic peptide
  Seed: GPTLIGANASF (PMEL_HUMAN)
GPTLIGANASM

SEQ ID NO: 136314 - protein, 9 aa, Artificial Sequence
  Description of Artificial Sequence: Synthetic peptide
  Seed: TTAAQVTTT (PMEL_HUMAN)
TAAAQVTTV

SEQ ID NO: 136315 - protein, 9 aa, Artificial Sequence
  Description of Artificial Sequence: Synthetic peptide
  Seed: SITGSLGPL (PMEL_HUMAN)
STTGSLGPL

SEQ ID NO: 136316 - protein, 9 aa, Artificial Sequence
  Description of Artificial Sequence: Synthetic peptide
  Seed: GQVPLIVGI (PMEL_HUMAN)
GTVPLIVGL

SEQ ID NO: 136317 - protein, 9 aa, Artificial Sequence
  Description of Artificial Sequence: Synthetic peptide
  Seed: AQVVLQAAI (PMEL_HUMAN)
AIVVLQAAY

SEQ ID NO: 136318 - protein, 9 aa, Artificial Sequence
  Description of Artificial Sequence: Synthetic peptide
  Seed: ALNFPGSQK (PMEL_HUMAN)
AINFPGSQR

SEQ ID NO: 136319 - protein, 9 aa, Artificial Sequence
  Description of Artificial Sequence: Synthetic peptide
  Seed: RTKAWNRQL (PMEL_HUMAN)
RSKAWNRQS

SEQ ID NO: 136320 - protein, 9 aa, Artificial Sequence
  Description of Artificial Sequence: Synthetic peptide
  Seed: AAQVTTTEW (PMEL_HUMAN)
ALQVTTTEM

SEQ ID NO: 136321 - protein, 9 aa, Artificial Sequence
  Description of Artificial Sequence: Synthetic peptide
  Seed: SQVWGGQPV (PMEL_HUMAN)
SQVWGGQPM

SEQ ID NO: 136322 - protein, 9 aa, Artificial Sequence
  Description of Artificial Sequence: Synthetic peptide
  Seed: LPSPACQLV (PMEL_HUMAN)
LPSPACQLM

SEQ ID NO: 136323 - protein, 9 aa, Artificial Sequence
  Description of Artificial Sequence: Synthetic peptide
  Seed: VQVPTTEVI (PMEL_HUMAN)
VKVPTTEVM

SEQ ID NO: 136324 - protein, 8 aa, Artificial Sequence
  Description of Artificial Sequence: Synthetic peptide
  Seed: LHDPSGYL (PMEL_HUMAN)
LSDPSGYF

SEQ ID NO: 136325 - protein, 9 aa, Artificial Sequence
  Description of Artificial Sequence: Synthetic peptide
  Seed: EVVGTTPGQ (PMEL_HUMAN)
ETVGTTPGM

SEQ ID NO: 136326 - protein, 9 aa, Artificial Sequence
  Description of Artificial Sequence: Synthetic peptide
  Seed: NFPGSQKVL (PMEL_HUMAN)
NIPGSQKVM

SEQ ID NO: 136327 - protein, 9 aa, Artificial Sequence
  Description of Artificial Sequence: Synthetic peptide
  Seed: ESAEILQAV (PMEL_HUMAN)
ETAEILQAA

SEQ ID NO: 136328 - protein, 10 aa, Artificial Sequence
  Description of Artificial Sequence: Synthetic peptide
  Seed: RQLYPEWTEA (PMEL_HUMAN)
RDLYPEWTEI

SEQ ID NO: 136329 - protein, 11 aa, Artificial Sequence
  Description of Artificial Sequence: Synthetic peptide
  Seed: RQVPLDCVLYR (PMEL_HUMAN)
RFVPLDCVLYR

SEQ ID NO: 136330 - protein, 10 aa, Artificial Sequence
  Description of Artificial Sequence: Synthetic peptide
  Seed: VSLADTNSLA (PMEL_HUMAN)
VMLADTNSLV

SEQ ID NO: 136331 - protein, 9 aa, Artificial Sequence
  Description of Artificial Sequence: Synthetic peptide
  Seed: RELPIPEPE (PMEL_HUMAN)
RDLPIPEPA

SEQ ID NO: 136332 - protein, 9 aa, Artificial Sequence
  Description of Artificial Sequence: Synthetic peptide
  Seed: HSSSHWLRL (PMEL_HUMAN)
HFSSHWLRY

SEQ ID NO: 136333 - protein, 10 aa, Artificial Sequence
  Description of Artificial Sequence: Synthetic peptide
  Seed: DGTATLRLVK (PMEL_HUMAN)
DDTATLRLVR

SEQ ID NO: 136334 - protein, 10 aa, Artificial Sequence
  Description of Artificial Sequence: Synthetic peptide
  Seed: AMLGTHTMEV (PMEL_HUMAN)
AKLGTHTMEV

SEQ ID NO: 136335 - protein, 11 aa, Artificial Sequence
  Description of Artificial Sequence: Synthetic peptide
  Seed: RRRLMKQDFSV (PMEL_HUMAN)
RIRLMKQDFSV

SEQ ID NO: 136336 - protein, 9 aa, Artificial Sequence
  Description of Artificial Sequence: Synthetic peptide
  Seed: SQKRSFVYV (PMEL_HUMAN)
SSKRSFVYV

SEQ ID NO: 136337 - protein, 9 aa, Artificial Sequence
  Description of Artificial Sequence: Synthetic peptide
  Seed: STESITGSL (PMEL_HUMAN)
SMESITGSL

SEQ ID NO: 136338 - protein, 9 aa, Artificial Sequence
  Description of Artificial Sequence: Synthetic peptide
  Seed: VQVPTTEVI (PMEL_HUMAN)
VMVPTTEVI

SEQ ID NO: 136339 - protein, 9 aa, Artificial Sequence
  Description of Artificial Sequence: Synthetic peptide
  Seed: VTAQVVLQA (PMEL_HUMAN)
VQAQVVLQL

SEQ ID NO: 136340 - protein, 10 aa, Artificial Sequence
  Description of Artificial Sequence: Synthetic peptide
  Seed: GDSSGTLISR (PMEL_HUMAN)
GSSSGTLISR

SEQ ID NO: 136341 - protein, 9 aa, Artificial Sequence
  Description of Artificial Sequence: Synthetic peptide
  Seed: VISTAPVQM (PMEL_HUMAN)
VYSTAPVQF

SEQ ID NO: 136342 - protein, 9 aa, Artificial Sequence
  Description of Artificial Sequence: Synthetic peptide
  Seed: LNFPGSQKV (PMEL_HUMAN)
LQFPGSQKM

SEQ ID NO: 136343 - protein, 9 aa, Artificial Sequence
  Description of Artificial Sequence: Synthetic peptide
  Seed: CWRGGQVSL (PMEL_HUMAN)
CFRGGQVSY

SEQ ID NO: 136344 - protein, 11 aa, Artificial Sequence
  Description of Artificial Sequence: Synthetic peptide
  Seed: KHFLRNQPLTF (PMEL_HUMAN)
KMFLRNQPLTM

SEQ ID NO: 136345 - protein, 9 aa, Artificial Sequence
  Description of Artificial Sequence: Synthetic peptide
  Seed: LSGTTAAQV (PMEL_HUMAN)
LAGTTAAQL

SEQ ID NO: 136346 - protein, 9 aa, Artificial Sequence
  Description of Artificial Sequence: Synthetic peptide
  Seed: RQVPLDCVL (PMEL_HUMAN)
RLVPLDCVF

SEQ ID NO: 136347 - protein, 9 aa, Artificial Sequence
  Description of Artificial Sequence: Synthetic peptide
  Seed: RALVVTHTY (PMEL_HUMAN)
RHLVVTHTF

SEQ ID NO: 136348 - protein, 11 aa, Artificial Sequence
  Description of Artificial Sequence: Synthetic peptide
  Seed: MAVVLASLIYR (PMEL_HUMAN)
MRVVLASLIYR

SEQ ID NO: 136349 - protein, 10 aa, Artificial Sequence
  Description of Artificial Sequence: Synthetic peptide
  Seed: SVPQLPHSSS (PMEL_HUMAN)
SRPQLPHSSV

SEQ ID NO: 136350 - protein, 9 aa, Artificial Sequence
  Description of Artificial Sequence: Synthetic peptide
  Seed: AEVSIVVLS (PMEL_HUMAN)
AEVSIVVLF

SEQ ID NO: 136351 - protein, 10 aa, Artificial Sequence
  Description of Artificial Sequence: Synthetic peptide
  Seed: KTWGQYWQVL (PMEL_HUMAN)
KLWGQYWQVE

SEQ ID NO: 136352 - protein, 9 aa, Artificial Sequence
  Description of Artificial Sequence: Synthetic peptide
  Seed: HTMEVTVYH (PMEL_HUMAN)
HFMEVTVYR

SEQ ID NO: 136353 - protein, 10 aa, Artificial Sequence
  Description of Artificial Sequence: Synthetic peptide
  Seed: LVLMAVVLAS (PMEL_HUMAN)
LWLMAVVLAI

SEQ ID NO: 136354 - protein, 9 aa, Artificial Sequence
  Description of Artificial Sequence: Synthetic peptide
  Seed: MSTPEATGM (PMEL_HUMAN)
MATPEATGY

SEQ ID NO: 136355 - protein, 10 aa, Artificial Sequence
  Description of Artificial Sequence: Synthetic peptide
  Seed: AVPSGEGDAF (PMEL_HUMAN)
AQPSGEGDAY

SEQ ID NO: 136356 - protein, 9 aa, Artificial Sequence
  Description of Artificial Sequence: Synthetic peptide
  Seed: ADTNSLAVV (PMEL_HUMAN)
AETNSLAVV

SEQ ID NO: 136357 - protein, 10 aa, Artificial Sequence
  Description of Artificial Sequence: Synthetic peptide
  Seed: SCPIGENSPL (PMEL_HUMAN)
SQPIGENSPL

SEQ ID NO: 136358 - protein, 9 aa, Artificial Sequence
  Description of Artificial Sequence: Synthetic peptide
  Seed: YWQVLGGPV (PMEL_HUMAN)
YWQVLGGPL

SEQ ID NO: 136359 - protein, 10 aa, Artificial Sequence
  Description of Artificial Sequence: Synthetic peptide
  Seed: EVISTAPVQM (PMEL_HUMAN)
EIISTAPVQF

SEQ ID NO: 136360 - protein, 9 aa, Artificial Sequence
  Description of Artificial Sequence: Synthetic peptide
  Seed: GTYCLNVSL (PMEL_HUMAN)
GLYCLNVSA

SEQ ID NO: 136361 - protein, 10 aa, Artificial Sequence
  Description of Artificial Sequence: Synthetic peptide
  Seed: SQKRSFVYVW (PMEL_HUMAN)
SGKRSFVYVF

SEQ ID NO: 136362 - protein, 9 aa, Artificial Sequence
  Description of Artificial Sequence: Synthetic peptide
  Seed: VSVSQLRAL (PMEL_HUMAN)
VVVSQLRAW

SEQ ID NO: 136363 - protein, 9 aa, Artificial Sequence
  Description of Artificial Sequence: Synthetic peptide
  Seed: RNQPLTFAL (PMEL_HUMAN)
RVQPLTFAI

SEQ ID NO: 136364 - protein, 9 aa, Artificial Sequence
  Description of Artificial Sequence: Synthetic peptide
  Seed: GILLVLMAV (PMEL_HUMAN)
GLLLVLMAL

SEQ ID NO: 136365 - protein, 10 aa, Artificial Sequence
  Description of Artificial Sequence: Synthetic peptide
  Seed: LADTNSLAVV (PMEL_HUMAN)
LLDTNSLAVM

SEQ ID NO: 136366 - protein, 9 aa, Artificial Sequence
  Description of Artificial Sequence: Synthetic peptide
  Seed: VLPSPACQL (PMEL_HUMAN)
VRPSPACQY

SEQ ID NO: 136367 - protein, 9 aa, Artificial Sequence
  Description of Artificial Sequence: Synthetic peptide
  Seed: RAMLGTHTM (PMEL_HUMAN)
RRMLGTHTI

SEQ ID NO: 136368 - protein, 9 aa, Artificial Sequence
  Description of Artificial Sequence: Synthetic peptide
  Seed: LSIGTGRAM (PMEL_HUMAN)
LYIGTGRAV

SEQ ID NO: 136369 - protein, 9 aa, Artificial Sequence
  Description of Artificial Sequence: Synthetic peptide
  Seed: AQRLCQPVL (PMEL_HUMAN)
AARLCQPVA

SEQ ID NO: 136370 - protein, 9 aa, Artificial Sequence
  Description of Artificial Sequence: Synthetic peptide
  Seed: VLPSPACQL (PMEL_HUMAN)
VGPSPACQV

SEQ ID NO: 136371 - protein, 9 aa, Artificial Sequence
  Description of Artificial Sequence: Synthetic peptide
  Seed: AGLGQVPLI (PMEL_HUMAN)
ATLGQVPLV

SEQ ID NO: 136372 - protein, 9 aa, Artificial Sequence
  Description of Artificial Sequence: Synthetic peptide
  Seed: SVPQLPHSS (PMEL_HUMAN)
SMPQLPHSV

SEQ ID NO: 136373 - protein, 9 aa, Artificial Sequence
  Description of Artificial Sequence: Synthetic peptide
  Seed: RTKAWNRQL (PMEL_HUMAN)
RMKAWNRQL

SEQ ID NO: 136374 - protein, 9 aa, Artificial Sequence
  Description of Artificial Sequence: Synthetic peptide
  Seed: QLVLHQILK (PMEL_HUMAN)
QIVLHQILK

SEQ ID NO: 136375 - protein, 10 aa, Artificial Sequence
  Description of Artificial Sequence: Synthetic peptide
  Seed: RRLMKQDFSV (PMEL_HUMAN)
RQLMKQDFSV

SEQ ID NO: 136376 - protein, 10 aa, Artificial Sequence
  Description of Artificial Sequence: Synthetic peptide
  Seed: MEISSPGCQP (PMEL_HUMAN)
MEISSPGCQM

SEQ ID NO: 136377 - protein, 9 aa, Artificial Sequence
  Description of Artificial Sequence: Synthetic peptide
  Seed: WSQKRSFVY (PMEL_HUMAN)
WEQKRSFVF

SEQ ID NO: 136378 - protein, 9 aa, Artificial Sequence
  Description of Artificial Sequence: Synthetic peptide
  Seed: RNQPLTFAL (PMEL_HUMAN)
RVQPLTFAF

SEQ ID NO: 136379 - protein, 9 aa, Artificial Sequence
  Description of Artificial Sequence: Synthetic peptide
  Seed: AGLGQVPLI (PMEL_HUMAN)
AQLGQVPLI

SEQ ID NO: 136380 - protein, 9 aa, Artificial Sequence
  Description of Artificial Sequence: Synthetic peptide
  Seed: QVIWVNNTI (PMEL_HUMAN)
QIIWVNNTV

SEQ ID NO: 136381 - protein, 9 aa, Artificial Sequence
  Description of Artificial Sequence: Synthetic peptide
  Seed: KTWGQYWQV (PMEL_HUMAN)
KIWGQYWQK

SEQ ID NO: 136382 - protein, 9 aa, Artificial Sequence
  Description of Artificial Sequence: Synthetic peptide
  Seed: KTWGQYWQV (PMEL_HUMAN)
KLWGQYWQI

SEQ ID NO: 136383 - protein, 10 aa, Artificial Sequence
  Description of Artificial Sequence: Synthetic peptide
  Seed: RALVVTHTYL (PMEL_HUMAN)
RLLVVTHTYL

SEQ ID NO: 136384 - protein, 9 aa, Artificial Sequence
  Description of Artificial Sequence: Synthetic peptide
  Seed: SQKRSFVYV (PMEL_HUMAN)
SVKRSFVYT

SEQ ID NO: 136385 - protein, 9 aa, Artificial Sequence
  Description of Artificial Sequence: Synthetic peptide
  Seed: RQVPLDCVL (PMEL_HUMAN)
RHVPLDCVI

SEQ ID NO: 136386 - protein, 9 aa, Artificial Sequence
  Description of Artificial Sequence: Synthetic peptide
  Seed: FGDSSGTLI (PMEL_HUMAN)
FHDSSGTLL

SEQ ID NO: 136387 - protein, 10 aa, Artificial Sequence
  Description of Artificial Sequence: Synthetic peptide
  Seed: DWLGVSRQLR (PMEL_HUMAN)
DFLGVSRQLR

SEQ ID NO: 136388 - protein, 10 aa, Artificial Sequence
  Description of Artificial Sequence: Synthetic peptide
  Seed: YVPLAHSSSA (PMEL_HUMAN)
YIPLAHSSSL

SEQ ID NO: 136389 - protein, 10 aa, Artificial Sequence
  Description of Artificial Sequence: Synthetic peptide
  Seed: SAEILQAVPS (PMEL_HUMAN)
SEEILQAVPA

SEQ ID NO: 136390 - protein, 10 aa, Artificial Sequence
  Description of Artificial Sequence: Synthetic peptide
  Seed: LAEADLSYTW (PMEL_HUMAN)
LIEADLSYTW

SEQ ID NO: 136391 - protein, 10 aa, Artificial Sequence
  Description of Artificial Sequence: Synthetic peptide
  Seed: ASSIMSTESI (PMEL_HUMAN)
AISIMSTESF

SEQ ID NO: 136392 - protein, 10 aa, Artificial Sequence
  Description of Artificial Sequence: Synthetic peptide
  Seed: SVPQLPHSSS (PMEL_HUMAN)
SPPQLPHSSA

SEQ ID NO: 136393 - protein, 9 aa, Artificial Sequence
  Description of Artificial Sequence: Synthetic peptide
  Seed: TLISRALVV (PMEL_HUMAN)
TLISRALVI

SEQ ID NO: 136394 - protein, 9 aa, Artificial Sequence
  Description of Artificial Sequence: Synthetic peptide
  Seed: VVLSGTTAA (PMEL_HUMAN)
VALSGTTAI

SEQ ID NO: 136395 - protein, 10 aa, Artificial Sequence
  Description of Artificial Sequence: Synthetic peptide
  Seed: VPQLPHSSSH (PMEL_HUMAN)
VNQLPHSSSF

SEQ ID NO: 136396 - protein, 10 aa, Artificial Sequence
  Description of Artificial Sequence: Synthetic peptide
  Seed: RQVPLDCVLY (PMEL_HUMAN)
RKVPLDCVLF

SEQ ID NO: 136397 - protein, 9 aa, Artificial Sequence
  Description of Artificial Sequence: Synthetic peptide
  Seed: SAFTITDQV (PMEL_HUMAN)
SAFTITDQI

SEQ ID NO: 136398 - protein, 11 aa, Artificial Sequence
  Description of Artificial Sequence: Synthetic peptide
  Seed: FTITDQVPFSV (PMEL_HUMAN)
FLITDQVPFSI

SEQ ID NO: 136399 - protein, 10 aa, Artificial Sequence
  Description of Artificial Sequence: Synthetic peptide
  Seed: EVSIVVLSGT (PMEL_HUMAN)
EISIVVLSGV

SEQ ID NO: 136400 - protein, 11 aa, Artificial Sequence
  Description of Artificial Sequence: Synthetic peptide
  Seed: MAVVLASLIYR (PMEL_HUMAN)
MIVVLASLIYR

SEQ ID NO: 136401 - protein, 10 aa, Artificial Sequence
  Description of Artificial Sequence: Synthetic peptide
  Seed: MPTAESTGMT (PMEL_HUMAN)
MTTAESTGMV

SEQ ID NO: 136402 - protein, 9 aa, Artificial Sequence
  Description of Artificial Sequence: Synthetic peptide
  Seed: QVWGGQPVY (PMEL_HUMAN)
QTWGGQPVI

SEQ ID NO: 136403 - protein, 9 aa, Artificial Sequence
  Description of Artificial Sequence: Synthetic peptide
  Seed: GTLISRALV (PMEL_HUMAN)
GSLISRALK

SEQ ID NO: 136404 - protein, 9 aa, Artificial Sequence
  Description of Artificial Sequence: Synthetic peptide
  Seed: RQVPLDCVL (PMEL_HUMAN)
RNVPLDCVY

SEQ ID NO: 136405 - protein, 10 aa, Artificial Sequence
  Description of Artificial Sequence: Synthetic peptide
  Seed: THTMEVTVYH (PMEL_HUMAN)
TKTMEVTVYK

SEQ ID NO: 136406 - protein, 10 aa, Artificial Sequence
  Description of Artificial Sequence: Synthetic peptide
  Seed: AEMSTPEATG (PMEL_HUMAN)
AEMSTPEATP

SEQ ID NO: 136407 - protein, 9 aa, Artificial Sequence
  Description of Artificial Sequence: Synthetic peptide
  Seed: LYPEWTEAQ (PMEL_HUMAN)
LFPEWTEAF

SEQ ID NO: 136408 - protein, 11 aa, Artificial Sequence
  Description of Artificial Sequence: Synthetic peptide
  Seed: QLYPEWTEAQR (PMEL_HUMAN)
QSYPEWTEAQK

SEQ ID NO: 136409 - protein, 10 aa, Artificial Sequence
  Description of Artificial Sequence: Synthetic peptide
  Seed: MTPAEVSIVV (PMEL_HUMAN)
MIPAEVSIVW

SEQ ID NO: 136410 - protein, 9 aa, Artificial Sequence
  Description of Artificial Sequence: Synthetic peptide
  Seed: ALDGGNKHF (PMEL_HUMAN)
AADGGNKHV

SEQ ID NO: 136411 - protein, 9 aa, Artificial Sequence
  Description of Artificial Sequence: Synthetic peptide
  Seed: TPAEVSIVV (PMEL_HUMAN)
TPAEVSIVA

SEQ ID NO: 136412 - protein, 11 aa, Artificial Sequence
  Description of Artificial Sequence: Synthetic peptide
  Seed: TEVISTAPVQM (PMEL_HUMAN)
TEVISTAPVQF

SEQ ID NO: 136413 - protein, 10 aa, Artificial Sequence
  Description of Artificial Sequence: Synthetic peptide
  Seed: GQVPLIVGIL (PMEL_HUMAN)
GEVPLIVGIL

SEQ ID NO: 136414 - protein, 9 aa, Artificial Sequence
  Description of Artificial Sequence: Synthetic peptide
  Seed: SLADTNSLA (PMEL_HUMAN)
STADTNSLV

SEQ ID NO: 136415 - protein, 9 aa, Artificial Sequence
  Description of Artificial Sequence: Synthetic peptide
  Seed: SSHWLRLPR (PMEL_HUMAN)
SQHWLRLPK

SEQ ID NO: 136416 - protein, 10 aa, Artificial Sequence
  Description of Artificial Sequence: Synthetic peptide
  Seed: KRQVPLDCVL (PMEL_HUMAN)
KMQVPLDCVY

SEQ ID NO: 136417 - protein, 10 aa, Artificial Sequence
  Description of Artificial Sequence: Synthetic peptide
  Seed: SVPQLPHSSS (PMEL_HUMAN)
SGPQLPHSSA

SEQ ID NO: 136418 - protein, 9 aa, Artificial Sequence
  Description of Artificial Sequence: Synthetic peptide
  Seed: QRLCQPVLP (PMEL_HUMAN)
QHLCQPVLA

SEQ ID NO: 136419 - protein, 10 aa, Artificial Sequence
  Description of Artificial Sequence: Synthetic peptide
  Seed: RALDGGNKHF (PMEL_HUMAN)
RELDGGNKHL

SEQ ID NO: 136420 - protein, 9 aa, Artificial Sequence
  Description of Artificial Sequence: Synthetic peptide
  Seed: FTITDQVPF (PMEL_HUMAN)
FIITDQVPY

SEQ ID NO: 136421 - protein, 9 aa, Artificial Sequence
  Description of Artificial Sequence: Synthetic peptide
  Seed: KVSNDGPTL (PMEL_HUMAN)
KQSNDGPTW

SEQ ID NO: 136422 - protein, 9 aa, Artificial Sequence
  Description of Artificial Sequence: Synthetic peptide
  Seed: TKAWNRQLY (PMEL_HUMAN)
TQAWNRQLY

SEQ ID NO: 136423 - protein, 9 aa, Artificial Sequence
  Description of Artificial Sequence: Synthetic peptide
  Seed: TLIGANASF (PMEL_HUMAN)
TMIGANASW

SEQ ID NO: 136424 - protein, 9 aa, Artificial Sequence
  Description of Artificial Sequence: Synthetic peptide
  Seed: MEVTVYHRR (PMEL_HUMAN)
MVVTVYHRR

SEQ ID NO: 136425 - protein, 11 aa, Artificial Sequence
  Description of Artificial Sequence: Synthetic peptide
  Seed: TVYHRRGSRSY (PMEL_HUMAN)
TQYHRRGSRSF

SEQ ID NO: 136426 - protein, 9 aa, Artificial Sequence
  Description of Artificial Sequence: Synthetic peptide
  Seed: VVLSGTTAA (PMEL_HUMAN)
VILSGTTAA

SEQ ID NO: 136427 - protein, 9 aa, Artificial Sequence
  Description of Artificial Sequence: Synthetic peptide
  Seed: VTLDIVQGI (PMEL_HUMAN)
VNLDIVQGW

SEQ ID NO: 136428 - protein, 9 aa, Artificial Sequence
  Description of Artificial Sequence: Synthetic peptide
  Seed: STAPVQMPT (PMEL_HUMAN)
SLAPVQMPL

SEQ ID NO: 136429 - protein, 9 aa, Artificial Sequence
  Description of Artificial Sequence: Synthetic peptide
  Seed: VSNDGPTLI (PMEL_HUMAN)
VFNDGPTLF

SEQ ID NO: 136430 - protein, 9 aa, Artificial Sequence
  Description of Artificial Sequence: Synthetic peptide
  Seed: RLVKRQVPL (PMEL_HUMAN)
RLVKRQVPI

SEQ ID NO: 136431 - protein, 10 aa, Artificial Sequence
  Description of Artificial Sequence: Synthetic peptide
  Seed: RALDGGNKHF (PMEL_HUMAN)
RSLDGGNKHF

SEQ ID NO: 136432 - protein, 10 aa, Artificial Sequence
  Description of Artificial Sequence: Synthetic peptide
  Seed: LMAVVLASLI (PMEL_HUMAN)
LLAVVLASLD

SEQ ID NO: 136433 - protein, 10 aa, Artificial Sequence
  Description of Artificial Sequence: Synthetic peptide
  Seed: TLISRALVVT (PMEL_HUMAN)
TLISRALVVL

SEQ ID NO: 136434 - protein, 9 aa, Artificial Sequence
  Description of Artificial Sequence: Synthetic peptide
  Seed: YVWKTWGQY (PMEL_HUMAN)
YTWKTWGQF

SEQ ID NO: 136435 - protein, 9 aa, Artificial Sequence
  Description of Artificial Sequence: Synthetic peptide
  Seed: AVVSTQLIM (PMEL_HUMAN)
AKVSTQLIM

SEQ ID NO: 136436 - protein, 10 aa, Artificial Sequence
  Description of Artificial Sequence: Synthetic peptide
  Seed: VLYRYGSFSV (PMEL_HUMAN)
VGYRYGSFSK

SEQ ID NO: 136437 - protein, 9 aa, Artificial Sequence
  Description of Artificial Sequence: Synthetic peptide
  Seed: LAVVSTQLI (PMEL_HUMAN)
LNVVSTQLW

SEQ ID NO: 136438 - protein, 10 aa, Artificial Sequence
  Description of Artificial Sequence: Synthetic peptide
  Seed: VPLAHSSSAF (PMEL_HUMAN)
VHLAHSSSAF

SEQ ID NO: 136439 - protein, 9 aa, Artificial Sequence
  Description of Artificial Sequence: Synthetic peptide
  Seed: TESITGSLG (PMEL_HUMAN)
TESITGSLV

SEQ ID NO: 136440 - protein, 10 aa, Artificial Sequence
  Description of Artificial Sequence: Synthetic peptide
  Seed: IALNFPGSQK (PMEL_HUMAN)
IKLNFPGSQK

SEQ ID NO: 136441 - protein, 10 aa, Artificial Sequence
  Description of Artificial Sequence: Synthetic peptide
  Seed: RLMKQDFSVP (PMEL_HUMAN)
RLMKQDFSVM

SEQ ID NO: 136442 - protein, 11 aa, Artificial Sequence
  Description of Artificial Sequence: Synthetic peptide
  Seed: VQMPTAESTGM (PMEL_HUMAN)
VMMPTAESTGY

SEQ ID NO: 136443 - protein, 9 aa, Artificial Sequence
  Description of Artificial Sequence: Synthetic peptide
  Seed: GQVPLIVGI (PMEL_HUMAN)
GRVPLIVGM

SEQ ID NO: 136444 - protein, 9 aa, Artificial Sequence
  Description of Artificial Sequence: Synthetic peptide
  Seed: AVVSTQLIM (PMEL_HUMAN)
AMVSTQLIF

SEQ ID NO: 136445 - protein, 9 aa, Artificial Sequence
  Description of Artificial Sequence: Synthetic peptide
  Seed: LSIGTGRAM (PMEL_HUMAN)
LRIGTGRAF

SEQ ID NO: 136446 - protein, 11 aa, Artificial Sequence
  Description of Artificial Sequence: Synthetic peptide
  Seed: RQVPLDCVLYR (PMEL_HUMAN)
RIVPLDCVLYK

SEQ ID NO: 136447 - protein, 10 aa, Artificial Sequence
  Description of Artificial Sequence: Synthetic peptide
  Seed: LIMPGQEAGL (PMEL_HUMAN)
LLMPGQEAGV

SEQ ID NO: 136448 - protein, 9 aa, Artificial Sequence
  Description of Artificial Sequence: Synthetic peptide
  Seed: LQAAIPLTS (PMEL_HUMAN)
LQAAIPLTM

SEQ ID NO: 136449 - protein, 11 aa, Artificial Sequence
  Description of Artificial Sequence: Synthetic peptide
  Seed: RAMLGTHTMEV (PMEL_HUMAN)
RLMLGTHTMEI

SEQ ID NO: 136450 - protein, 10 aa, Artificial Sequence
  Description of Artificial Sequence: Synthetic peptide
  Seed: ELTVSCQGGL (PMEL_HUMAN)
EGTVSCQGGV

SEQ ID NO: 136451 - protein, 9 aa, Artificial Sequence
  Description of Artificial Sequence: Synthetic peptide
  Seed: QVWGGQPVY (PMEL_HUMAN)
QPWGGQPVM

SEQ ID NO: 136452 - protein, 10 aa, Artificial Sequence
  Description of Artificial Sequence: Synthetic peptide
  Seed: IESAEILQAV (PMEL_HUMAN)
IQSAEILQAV

SEQ ID NO: 136453 - protein, 9 aa, Artificial Sequence
  Description of Artificial Sequence: Synthetic peptide
  Seed: YHRRGSRSY (PMEL_HUMAN)
YARRGSRSM

SEQ ID NO: 136454 - protein, 11 aa, Artificial Sequence
  Description of Artificial Sequence: Synthetic peptide
  Seed: SYVPLAHSSSA (PMEL_HUMAN)
SGVPLAHSSSM

SEQ ID NO: 136455 - protein, 10 aa, Artificial Sequence
  Description of Artificial Sequence: Synthetic peptide
  Seed: EVVGTTPGQA (PMEL_HUMAN)
EAVGTTPGQR

SEQ ID NO: 136456 - protein, 10 aa, Artificial Sequence
  Description of Artificial Sequence: Synthetic peptide
  Seed: SGTYCLNVSL (PMEL_HUMAN)
SSTYCLNVSF

SEQ ID NO: 136457 - protein, 9 aa, Artificial Sequence
  Description of Artificial Sequence: Synthetic peptide
  Seed: ASFSIALNF (PMEL_HUMAN)
AAFSIALNR

SEQ ID NO: 136458 - protein, 9 aa, Artificial Sequence
  Description of Artificial Sequence: Synthetic peptide
  Seed: LYRYGSFSV (PMEL_HUMAN)
LYRYGSFSL

SEQ ID NO: 136459 - protein, 9 aa, Artificial Sequence
  Description of Artificial Sequence: Synthetic peptide
  Seed: GTYCLNVSL (PMEL_HUMAN)
GSYCLNVSF

SEQ ID NO: 136460 - protein, 8 aa, Artificial Sequence
  Description of Artificial Sequence: Synthetic peptide
  Seed: LADTNSLA (PMEL_HUMAN)
LIDTNSLV

SEQ ID NO: 136461 - protein, 9 aa, Artificial Sequence
  Description of Artificial Sequence: Synthetic peptide
  Seed: VLMAVVLAS (PMEL_HUMAN)
VIMAVVLAV

SEQ ID NO: 136462 - protein, 9 aa, Artificial Sequence
  Description of Artificial Sequence: Synthetic peptide
  Seed: VSNDGPTLI (PMEL_HUMAN)
VLNDGPTLV

SEQ ID NO: 136463 - protein, 8 aa, Artificial Sequence
  Description of Artificial Sequence: Synthetic peptide
  Seed: LHDPSGYL (PMEL_HUMAN)
LIDPSGYV

SEQ ID NO: 136464 - protein, 10 aa, Artificial Sequence
  Description of Artificial Sequence: Synthetic peptide
  Seed: GPLLDGTATL (PMEL_HUMAN)
GPLLDGTATV

SEQ ID NO: 136465 - protein, 9 aa, Artificial Sequence
  Description of Artificial Sequence: Synthetic peptide
  Seed: RLVKRQVPL (PMEL_HUMAN)
RLVKRQVPY

SEQ ID NO: 136466 - protein, 8 aa, Artificial Sequence
  Description of Artificial Sequence: Synthetic peptide
  Seed: LAHSSSAF (PMEL_HUMAN)
LKHSSSAF

SEQ ID NO: 136467 - protein, 10 aa, Artificial Sequence
  Description of Artificial Sequence: Synthetic peptide
  Seed: GPTLIGANAS (PMEL_HUMAN)
GPTLIGANAA

SEQ ID NO: 136468 - protein, 9 aa, Artificial Sequence
  Description of Artificial Sequence: Synthetic peptide
  Seed: SLAVVSTQL (PMEL_HUMAN)
SMAVVSTQM

SEQ ID NO: 136469 - protein, 10 aa, Artificial Sequence
  Description of Artificial Sequence: Synthetic peptide
  Seed: LGQVPLIVGI (PMEL_HUMAN)
LLQVPLIVGI

SEQ ID NO: 136470 - protein, 9 aa, Artificial Sequence
  Description of Artificial Sequence: Synthetic peptide
  Seed: SQVWGGQPV (PMEL_HUMAN)
SQVWGGQPL

SEQ ID NO: 136471 - protein, 9 aa, Artificial Sequence
  Description of Artificial Sequence: Synthetic peptide
  Seed: VVLQAAIPL (PMEL_HUMAN)
VQLQAAIPY

SEQ ID NO: 136472 - protein, 9 aa, Artificial Sequence
  Description of Artificial Sequence: Synthetic peptide
  Seed: WSQKRSFVY (PMEL_HUMAN)
WAQKRSFVM

SEQ ID NO: 136473 - protein, 9 aa, Artificial Sequence
  Description of Artificial Sequence: Synthetic peptide
  Seed: LPDGQVIWV (PMEL_HUMAN)
LGDGQVIWM

SEQ ID NO: 136474 - protein, 11 aa, Artificial Sequence
  Description of Artificial Sequence: Synthetic peptide
  Seed: RAMLGTHTMEV (PMEL_HUMAN)
RKMLGTHTMEV

SEQ ID NO: 136475 - protein, 9 aa, Artificial Sequence
  Description of Artificial Sequence: Synthetic peptide
  Seed: RIFCSCPIG (PMEL_HUMAN)
RMFCSCPIK

SEQ ID NO: 136476 - protein, 9 aa, Artificial Sequence
  Description of Artificial Sequence: Synthetic peptide
  Seed: LADTNSLAV (PMEL_HUMAN)
LPDTNSLAI

SEQ ID NO: 136477 - protein, 9 aa, Artificial Sequence
  Description of Artificial Sequence: Synthetic peptide
  Seed: RIFCSCPIG (PMEL_HUMAN)
RTFCSCPII

SEQ ID NO: 136478 - protein, 10 aa, Artificial Sequence
  Description of Artificial Sequence: Synthetic peptide
  Seed: YGSFSVTLDI (PMEL_HUMAN)
YYSFSVTLDF

SEQ ID NO: 136479 - protein, 9 aa, Artificial Sequence
  Description of Artificial Sequence: Synthetic peptide
  Seed: TTDGHRPTA (PMEL_HUMAN)
TLDGHRPTC

SEQ ID NO: 136480 - protein, 8 aa, Artificial Sequence
  Description of Artificial Sequence: Synthetic peptide
  Seed: LADTNSLA (PMEL_HUMAN)
LGDTNSLL

SEQ ID NO: 136481 - protein, 10 aa, Artificial Sequence
  Description of Artificial Sequence: Synthetic peptide
  Seed: RALDGGNKHF (PMEL_HUMAN)
RMLDGGNKHR

SEQ ID NO: 136482 - protein, 10 aa, Artificial Sequence
  Description of Artificial Sequence: Synthetic peptide
  Seed: RALDGGNKHF (PMEL_HUMAN)
RCLDGGNKHW

SEQ ID NO: 136483 - protein, 9 aa, Artificial Sequence
  Description of Artificial Sequence: Synthetic peptide
  Seed: MLGTHTMEV (PMEL_HUMAN)
MIGTHTMEL

SEQ ID NO: 136484 - protein, 9 aa, Artificial Sequence
  Description of Artificial Sequence: Synthetic peptide
  Seed: MLGTHTMEV (PMEL_HUMAN)
MFGTHTMEL

SEQ ID NO: 136485 - protein, 10 aa, Artificial Sequence
  Description of Artificial Sequence: Synthetic peptide
  Seed: FSVSVSQLRA (PMEL_HUMAN)
FTVSVSQLRI

SEQ ID NO: 136486 - protein, 9 aa, Artificial Sequence
  Description of Artificial Sequence: Synthetic peptide
  Seed: RQVPLDCVL (PMEL_HUMAN)
RRVPLDCVV

SEQ ID NO: 136487 - protein, 9 aa, Artificial Sequence
  Description of Artificial Sequence: Synthetic peptide
  Seed: MLGTHTMEV (PMEL_HUMAN)
MRGTHTMEM

SEQ ID NO: 136488 - protein, 9 aa, Artificial Sequence
  Description of Artificial Sequence: Synthetic peptide
  Seed: AQRLCQPVL (PMEL_HUMAN)
ASRLCQPVL

SEQ ID NO: 136489 - protein, 9 aa, Artificial Sequence
  Description of Artificial Sequence: Synthetic peptide
  Seed: APNTTAGQV (PMEL_HUMAN)
APNTTAGQA

SEQ ID NO: 136490 - protein, 9 aa, Artificial Sequence
  Description of Artificial Sequence: Synthetic peptide
  Seed: AEAPNTTAG (PMEL_HUMAN)
AEAPNTTAP

SEQ ID NO: 136491 - protein, 10 aa, Artificial Sequence
  Description of Artificial Sequence: Synthetic peptide
  Seed: PTLIGANASF (PMEL_HUMAN)
PKLIGANASY

SEQ ID NO: 136492 - protein, 8 aa, Artificial Sequence
  Description of Artificial Sequence: Synthetic peptide
  Seed: SIGTGRAM (PMEL_HUMAN)
SSGTGRAF

SEQ ID NO: 136493 - protein, 11 aa, Artificial Sequence
  Description of Artificial Sequence: Synthetic peptide
  Seed: KVLPDGQVIWV (PMEL_HUMAN)
KMLPDGQVIWM

SEQ ID NO: 136494 - protein, 9 aa, Artificial Sequence
  Description of Artificial Sequence: Synthetic peptide
  Seed: QAAIPLTSC (PMEL_HUMAN)
QAAIPLTSL

SEQ ID NO: 136495 - protein, 9 aa, Artificial Sequence
  Description of Artificial Sequence: Synthetic peptide
  Seed: VPLDCVLYR (PMEL_HUMAN)
VMLDCVLYV

SEQ ID NO: 136496 - protein, 10 aa, Artificial Sequence
  Description of Artificial Sequence: Synthetic peptide
  Seed: WKTWGQYWQV (PMEL_HUMAN)
WQTWGQYWQA

SEQ ID NO: 136497 - protein, 9 aa, Artificial Sequence
  Description of Artificial Sequence: Synthetic peptide
  Seed: YHRRGSRSY (PMEL_HUMAN)
YRRRGSRSF

SEQ ID NO: 136498 - protein, 11 aa, Artificial Sequence
  Description of Artificial Sequence: Synthetic peptide
  Seed: SYVPLAHSSSA (PMEL_HUMAN)
STVPLAHSSSF

SEQ ID NO: 136499 - protein, 9 aa, Artificial Sequence
  Description of Artificial Sequence: Synthetic peptide
  Seed: MSTPEATGM (PMEL_HUMAN)
MATPEATGH

SEQ ID NO: 136500 - protein, 9 aa, Artificial Sequence
  Description of Artificial Sequence: Synthetic peptide
  Seed: QDFSVPQLP (PMEL_HUMAN)
QEFSVPQLP

SEQ ID NO: 136501 - protein, 10 aa, Artificial Sequence
  Description of Artificial Sequence: Synthetic peptide
  Seed: TAEPSGTTSV (PMEL_HUMAN)
TAEPSGTTSY

SEQ ID NO: 136502 - protein, 9 aa, Artificial Sequence
  Description of Artificial Sequence: Synthetic peptide
  Seed: VPLDCVLYR (PMEL_HUMAN)
VSLDCVLYR

SEQ ID NO: 136503 - protein, 9 aa, Artificial Sequence
  Description of Artificial Sequence: Synthetic peptide
  Seed: VLKRCLLHL (PMEL_HUMAN)
VIKRCLLHY

SEQ ID NO: 136504 - protein, 9 aa, Artificial Sequence
  Description of Artificial Sequence: Synthetic peptide
  Seed: RLVKRQVPL (PMEL_HUMAN)
RVVKRQVPY

SEQ ID NO: 136505 - protein, 9 aa, Artificial Sequence
  Description of Artificial Sequence: Synthetic peptide
  Seed: RAMLGTHTM (PMEL_HUMAN)
RYMLGTHTL

SEQ ID NO: 136506 - protein, 10 aa, Artificial Sequence
  Description of Artificial Sequence: Synthetic peptide
  Seed: AVVLASLIYR (PMEL_HUMAN)
AGVLASLIYR

SEQ ID NO: 136507 - protein, 10 aa, Artificial Sequence
  Description of Artificial Sequence: Synthetic peptide
  Seed: SLADTNSLAV (PMEL_HUMAN)
SLADTNSLAI

SEQ ID NO: 136508 - protein, 9 aa, Artificial Sequence
  Description of Artificial Sequence: Synthetic peptide
  Seed: ITDQVPFSV (PMEL_HUMAN)
ILDQVPFSL

SEQ ID NO: 136509 - protein, 9 aa, Artificial Sequence
  Description of Artificial Sequence: Synthetic peptide
  Seed: YHRRGSRSY (PMEL_HUMAN)
YQRRGSRSY

SEQ ID NO: 136510 - protein, 9 aa, Artificial Sequence
  Description of Artificial Sequence: Synthetic peptide
  Seed: VLPDGQVIW (PMEL_HUMAN)
VIPDGQVIL

SEQ ID NO: 136511 - protein, 10 aa, Artificial Sequence
  Description of Artificial Sequence: Synthetic peptide
  Seed: SAEILQAVPS (PMEL_HUMAN)
SKEILQAVPA

SEQ ID NO: 136512 - protein, 9 aa, Artificial Sequence
  Description of Artificial Sequence: Synthetic peptide
  Seed: WSQKRSFVY (PMEL_HUMAN)
WKQKRSFVM

SEQ ID NO: 136513 - protein, 9 aa, Artificial Sequence
  Description of Artificial Sequence: Synthetic peptide
  Seed: AVVLASLIY (PMEL_HUMAN)
AQVLASLII

SEQ ID NO: 136514 - protein, 10 aa, Artificial Sequence
  Description of Artificial Sequence: Synthetic peptide
  Seed: YRYGSFSVTL (PMEL_HUMAN)
YRYGSFSVTI

SEQ ID NO: 136515 - protein, 10 aa, Artificial Sequence
  Description of Artificial Sequence: Synthetic peptide
  Seed: LQLHDPSGYL (PMEL_HUMAN)
LNLHDPSGYV

SEQ ID NO: 136516 - protein, 11 aa, Artificial Sequence
  Description of Artificial Sequence: Synthetic peptide
  Seed: KVLPDGQVIWV (PMEL_HUMAN)
KLLPDGQVIWL

SEQ ID NO: 136517 - protein, 9 aa, Artificial Sequence
  Description of Artificial Sequence: Synthetic peptide
  Seed: MSTPEATGM (PMEL_HUMAN)
MQTPEATGF

SEQ ID NO: 136518 - protein, 9 aa, Artificial Sequence
  Description of Artificial Sequence: Synthetic peptide
  Seed: QLRTKAWNR (PMEL_HUMAN)
QVRTKAWNK

SEQ ID NO: 136519 - protein, 9 aa, Artificial Sequence
  Description of Artificial Sequence: Synthetic peptide
  Seed: ITDQVPFSV (PMEL_HUMAN)
IFDQVPFSV

SEQ ID NO: 136520 - protein, 9 aa, Artificial Sequence
  Description of Artificial Sequence: Synthetic peptide
  Seed: ASFSIALNF (PMEL_HUMAN)
ARFSIALNL

SEQ ID NO: 136521 - protein, 9 aa, Artificial Sequence
  Description of Artificial Sequence: Synthetic peptide
  Seed: MTPAEVSIV (PMEL_HUMAN)
MSPAEVSII

SEQ ID NO: 136522 - protein, 9 aa, Artificial Sequence
  Description of Artificial Sequence: Synthetic peptide
  Seed: RAMLGTHTM (PMEL_HUMAN)
RYMLGTHTV

SEQ ID NO: 136523 - protein, 9 aa, Artificial Sequence
  Description of Artificial Sequence: Synthetic peptide
  Seed: RAMLGTHTM (PMEL_HUMAN)
RHMLGTHTI

SEQ ID NO: 136524 - protein, 9 aa, Artificial Sequence
  Description of Artificial Sequence: Synthetic peptide
  Seed: RAMLGTHTM (PMEL_HUMAN)
RMMLGTHTY

SEQ ID NO: 136525 - protein, 9 aa, Artificial Sequence
  Description of Artificial Sequence: Synthetic peptide
  Seed: IYRRRLMKQ (PMEL_HUMAN)
IMRRRLMKK

SEQ ID NO: 136526 - protein, 9 aa, Artificial Sequence
  Description of Artificial Sequence: Synthetic peptide
  Seed: VLPDGQVIW (PMEL_HUMAN)
VVPDGQVIV

SEQ ID NO: 136527 - protein, 10 aa, Artificial Sequence
  Description of Artificial Sequence: Synthetic peptide
  Seed: LQLHDPSGYL (PMEL_HUMAN)
LGLHDPSGYV

SEQ ID NO: 136528 - protein, 9 aa, Artificial Sequence
  Description of Artificial Sequence: Synthetic peptide
  Seed: SLADTNSLA (PMEL_HUMAN)
SIADTNSLL

SEQ ID NO: 136529 - protein, 9 aa, Artificial Sequence
  Description of Artificial Sequence: Synthetic peptide
  Seed: MAVVLASLI (PMEL_HUMAN)
MPVVLASLL

SEQ ID NO: 136530 - protein, 11 aa, Artificial Sequence
  Description of Artificial Sequence: Synthetic peptide
  Seed: HQILKGGSGTY (PMEL_HUMAN)
HEILKGGSGTW

SEQ ID NO: 136531 - protein, 8 aa, Artificial Sequence
  Description of Artificial Sequence: Synthetic peptide
  Seed: TLDIVQGI (PMEL_HUMAN)
TYDIVQGM

SEQ ID NO: 136532 - protein, 9 aa, Artificial Sequence
  Description of Artificial Sequence: Synthetic peptide
  Seed: VSNDGPTLI (PMEL_HUMAN)
VINDGPTLF

SEQ ID NO: 136533 - protein, 11 aa, Artificial Sequence
  Description of Artificial Sequence: Synthetic peptide
  Seed: RAMLGTHTMEV (PMEL_HUMAN)
RQMLGTHTMEI

SEQ ID NO: 136534 - protein, 11 aa, Artificial Sequence
  Description of Artificial Sequence: Synthetic peptide
  Seed: VQMPTAESTGM (PMEL_HUMAN)
VAMPTAESTGY

SEQ ID NO: 136535 - protein, 11 aa, Artificial Sequence
  Description of Artificial Sequence: Synthetic peptide
  Seed: FSVTLDIVQGI (PMEL_HUMAN)
FIVTLDIVQGV

SEQ ID NO: 136536 - protein, 10 aa, Artificial Sequence
  Description of Artificial Sequence: Synthetic peptide
  Seed: LMAVVLASLI (PMEL_HUMAN)
LMAVVLASLY

SEQ ID NO: 136537 - protein, 9 aa, Artificial Sequence
  Description of Artificial Sequence: Synthetic peptide
  Seed: YHRRGSRSY (PMEL_HUMAN)
YKRRGSRSL

SEQ ID NO: 136538 - protein, 9 aa, Artificial Sequence
  Description of Artificial Sequence: Synthetic peptide
  Seed: YLAEADLSY (PMEL_HUMAN)
YKAEADLSF

SEQ ID NO: 136539 - protein, 10 aa, Artificial Sequence
  Description of Artificial Sequence: Synthetic peptide
  Seed: SRALVVTHTY (PMEL_HUMAN)
SLALVVTHTY

SEQ ID NO: 136540 - protein, 9 aa, Artificial Sequence
  Description of Artificial Sequence: Synthetic peptide
  Seed: SSIMSTESI (PMEL_HUMAN)
SSIMSTESF

SEQ ID NO: 136541 - protein, 9 aa, Artificial Sequence
  Description of Artificial Sequence: Synthetic peptide
  Seed: KVSNDGPTL (PMEL_HUMAN)
KLSNDGPTV

SEQ ID NO: 136542 - protein, 9 aa, Artificial Sequence
  Description of Artificial Sequence: Synthetic peptide
  Seed: LLDGTATLR (PMEL_HUMAN)
LIDGTATLL

SEQ ID NO: 136543 - protein, 8 aa, Artificial Sequence
  Description of Artificial Sequence: Synthetic peptide
  Seed: SNDGPTLI (PMEL_HUMAN)
SADGPTLL

SEQ ID NO: 136544 - protein, 9 aa, Artificial Sequence
  Description of Artificial Sequence: Synthetic peptide
  Seed: SVPQLPHSS (PMEL_HUMAN)
SVPQLPHSM

SEQ ID NO: 136545 - protein, 9 aa, Artificial Sequence
  Description of Artificial Sequence: Synthetic peptide
  Seed: AGLGQVPLI (PMEL_HUMAN)
AQLGQVPLV

SEQ ID NO: 136546 - protein, 9 aa, Artificial Sequence
  Description of Artificial Sequence: Synthetic peptide
  Seed: VPFSVSVSQ (PMEL_HUMAN)
VVFSVSVSM

SEQ ID NO: 136547 - protein, 10 aa, Artificial Sequence
  Description of Artificial Sequence: Synthetic peptide
  Seed: KVLPDGQVIW (PMEL_HUMAN)
KALPDGQVIY

SEQ ID NO: 136548 - protein, 10 aa, Artificial Sequence
  Description of Artificial Sequence: Synthetic peptide
  Seed: MTPAEVSIVV (PMEL_HUMAN)
MCPAEVSIVH

SEQ ID NO: 136549 - protein, 9 aa, Artificial Sequence
  Description of Artificial Sequence: Synthetic peptide
  Seed: RTKAWNRQL (PMEL_HUMAN)
RSKAWNRQK

SEQ ID NO: 136550 - protein, 10 aa, Artificial Sequence
  Description of Artificial Sequence: Synthetic peptide
  Seed: SHWLRLPRIF (PMEL_HUMAN)
SYWLRLPRIW

SEQ ID NO: 136551 - protein, 10 aa, Artificial Sequence
  Description of Artificial Sequence: Synthetic peptide
  Seed: YRYGSFSVTL (PMEL_HUMAN)
YLYGSFSVTM

SEQ ID NO: 136552 - protein, 9 aa, Artificial Sequence
  Description of Artificial Sequence: Synthetic peptide
  Seed: LMAVVLASL (PMEL_HUMAN)
LTAVVLASR

SEQ ID NO: 136553 - protein, 8 aa, Artificial Sequence
  Description of Artificial Sequence: Synthetic peptide
  Seed: YRYGSFSV (PMEL_HUMAN)
YHYGSFSM

SEQ ID NO: 136554 - protein, 8 aa, Artificial Sequence
  Description of Artificial Sequence: Synthetic peptide
  Seed: FGDSSGTL (PMEL_HUMAN)
FIDSSGTM

SEQ ID NO: 136555 - protein, 9 aa, Artificial Sequence
  Description of Artificial Sequence: Synthetic peptide
  Seed: GQVPLIVGI (PMEL_HUMAN)
GEVPLIVGM

SEQ ID NO: 136556 - protein, 11 aa, Artificial Sequence
  Description of Artificial Sequence: Synthetic peptide
  Seed: HTMEVTVYHRR (PMEL_HUMAN)
HTMEVTVYHRT

SEQ ID NO: 136557 - protein, 9 aa, Artificial Sequence
  Description of Artificial Sequence: Synthetic peptide
  Seed: VISTAPVQM (PMEL_HUMAN)
VMSTAPVQF

SEQ ID NO: 136558 - protein, 9 aa, Artificial Sequence
  Description of Artificial Sequence: Synthetic peptide
  Seed: DSSGTLISR (PMEL_HUMAN)
DYSGTLISR

SEQ ID NO: 136559 - protein, 9 aa, Artificial Sequence
  Description of Artificial Sequence: Synthetic peptide
  Seed: VQGIESAEI (PMEL_HUMAN)
VHGIESAEL

SEQ ID NO: 136560 - protein, 10 aa, Artificial Sequence
  Description of Artificial Sequence: Synthetic peptide
  Seed: ASSIMSTESI (PMEL_HUMAN)
AISIMSTESW

SEQ ID NO: 136561 - protein, 10 aa, Artificial Sequence
  Description of Artificial Sequence: Synthetic peptide
  Seed: MSTESITGSL (PMEL_HUMAN)
MSTESITGSM

SEQ ID NO: 136562 - protein, 9 aa, Artificial Sequence
  Description of Artificial Sequence: Synthetic peptide
  Seed: GTYCLNVSL (PMEL_HUMAN)
GLYCLNVSM

SEQ ID NO: 136563 - protein, 9 aa, Artificial Sequence
  Description of Artificial Sequence: Synthetic peptide
  Seed: SPVPGTTDG (PMEL_HUMAN)
SPVPGTTDV

SEQ ID NO: 136564 - protein, 9 aa, Artificial Sequence
  Description of Artificial Sequence: Synthetic peptide
  Seed: LTVSCQGGL (PMEL_HUMAN)
LAVSCQGGW

SEQ ID NO: 136565 - protein, 11 aa, Artificial Sequence
  Description of Artificial Sequence: Synthetic peptide
  Seed: AVIGALLAVGA (PMEL_HUMAN)
AQIGALLAVGL

SEQ ID NO: 136566 - protein, 9 aa, Artificial Sequence
  Description of Artificial Sequence: Synthetic peptide
  Seed: MAVVLASLI (PMEL_HUMAN)
MLVVLASLV

SEQ ID NO: 136567 - protein, 9 aa, Artificial Sequence
  Description of Artificial Sequence: Synthetic peptide
  Seed: GLGQVPLIV (PMEL_HUMAN)
GQGQVPLII

SEQ ID NO: 136568 - protein, 9 aa, Artificial Sequence
  Description of Artificial Sequence: Synthetic peptide
  Seed: IYRRRLMKQ (PMEL_HUMAN)
IVRRRLMKK

SEQ ID NO: 136569 - protein, 9 aa, Artificial Sequence
  Description of Artificial Sequence: Synthetic peptide
  Seed: VLPDGQVIW (PMEL_HUMAN)
VLPDGQVII

SEQ ID NO: 136570 - protein, 10 aa, Artificial Sequence
  Description of Artificial Sequence: Synthetic peptide
  Seed: RYGSFSVTLD (PMEL_HUMAN)
RWGSFSVTLI

SEQ ID NO: 136571 - protein, 9 aa, Artificial Sequence
  Description of Artificial Sequence: Synthetic peptide
  Seed: AAQVTTTEW (PMEL_HUMAN)
AIQVTTTEY

SEQ ID NO: 136572 - protein, 9 aa, Artificial Sequence
  Description of Artificial Sequence: Synthetic peptide
  Seed: ANASFSIAL (PMEL_HUMAN)
ARASFSIAL

SEQ ID NO: 136573 - protein, 9 aa, Artificial Sequence
  Description of Artificial Sequence: Synthetic peptide
  Seed: SLAVVSTQL (PMEL_HUMAN)
SMAVVSTQW

SEQ ID NO: 136574 - protein, 9 aa, Artificial Sequence
  Description of Artificial Sequence: Synthetic peptide
  Seed: VVLQAAIPL (PMEL_HUMAN)
VTLQAAIPV

SEQ ID NO: 136575 - protein, 10 aa, Artificial Sequence
  Description of Artificial Sequence: Synthetic peptide
  Seed: ESITGSLGPL (PMEL_HUMAN)
EVITGSLGPL

SEQ ID NO: 136576 - protein, 10 aa, Artificial Sequence
  Description of Artificial Sequence: Synthetic peptide
  Seed: YVPLAHSSSA (PMEL_HUMAN)
YRPLAHSSSF

SEQ ID NO: 136577 - protein, 9 aa, Artificial Sequence
  Description of Artificial Sequence: Synthetic peptide
  Seed: YVWKTWGQY (PMEL_HUMAN)
YSWKTWGQY

SEQ ID NO: 136578 - protein, 8 aa, Artificial Sequence
  Description of Artificial Sequence: Synthetic peptide
  Seed: VLPDGQVI (PMEL_HUMAN)
VTPDGQVL

SEQ ID NO: 136579 - protein, 9 aa, Artificial Sequence
  Description of Artificial Sequence: Synthetic peptide
  Seed: KAWNRQLYP (PMEL_HUMAN)
KTWNRQLYI

SEQ ID NO: 136580 - protein, 9 aa, Artificial Sequence
  Description of Artificial Sequence: Synthetic peptide
  Seed: AQVVLQAAI (PMEL_HUMAN)
AHVVLQAAY

SEQ ID NO: 136581 - protein, 10 aa, Artificial Sequence
  Description of Artificial Sequence: Synthetic peptide
  Seed: ESAEILQAVP (PMEL_HUMAN)
EVAEILQAVL

SEQ ID NO: 136582 - protein, 10 aa, Artificial Sequence
  Description of Artificial Sequence: Synthetic peptide
  Seed: THTMEVTVYH (PMEL_HUMAN)
TCTMEVTVYK

SEQ ID NO: 136583 - protein, 9 aa, Artificial Sequence
  Description of Artificial Sequence: Synthetic peptide
  Seed: GPVTAQVVL (PMEL_HUMAN)
GPVTAQVVY

SEQ ID NO: 136584 - protein, 11 aa, Artificial Sequence
  Description of Artificial Sequence: Synthetic peptide
  Seed: RTKAWNRQLYP (PMEL_HUMAN)
RVKAWNRQLYA

SEQ ID NO: 136585 - protein, 10 aa, Artificial Sequence
  Description of Artificial Sequence: Synthetic peptide
  Seed: KVLPDGQVIW (PMEL_HUMAN)
KPLPDGQVIW

SEQ ID NO: 136586 - protein, 9 aa, Artificial Sequence
  Description of Artificial Sequence: Synthetic peptide
  Seed: VQMPTAEST (PMEL_HUMAN)
VLMPTAESM

SEQ ID NO: 136587 - protein, 10 aa, Artificial Sequence
  Description of Artificial Sequence: Synthetic peptide
  Seed: MTPAEVSIVV (PMEL_HUMAN)
MAPAEVSIVS

SEQ ID NO: 136588 - protein, 10 aa, Artificial Sequence
  Description of Artificial Sequence: Synthetic peptide
  Seed: AVIGALLAVG (PMEL_HUMAN)
AVIGALLAVF

SEQ ID NO: 136589 - protein, 9 aa, Artificial Sequence
  Description of Artificial Sequence: Synthetic peptide
  Seed: GQVPLIVGI (PMEL_HUMAN)
GIVPLIVGL

SEQ ID NO: 136590 - protein, 10 aa, Artificial Sequence
  Description of Artificial Sequence: Synthetic peptide
  Seed: RQLYPEWTEA (PMEL_HUMAN)
RFLYPEWTEF

SEQ ID NO: 136591 - protein, 9 aa, Artificial Sequence
  Description of Artificial Sequence: Synthetic peptide
  Seed: RIFCSCPIG (PMEL_HUMAN)
RSFCSCPIV

SEQ ID NO: 136592 - protein, 10 aa, Artificial Sequence
  Description of Artificial Sequence: Synthetic peptide
  Seed: KRQVPLDCVL (PMEL_HUMAN)
KEQVPLDCVY

SEQ ID NO: 136593 - protein, 9 aa, Artificial Sequence
  Description of Artificial Sequence: Synthetic peptide
  Seed: LQAAIPLTS (PMEL_HUMAN)
LLAAIPLTF

SEQ ID NO: 136594 - protein, 9 aa, Artificial Sequence
  Description of Artificial Sequence: Synthetic peptide
  Seed: RAMLGTHTM (PMEL_HUMAN)
RYMLGTHTM

SEQ ID NO: 136595 - protein, 10 aa, Artificial Sequence
  Description of Artificial Sequence: Synthetic peptide
  Seed: GTHTMEVTVY (PMEL_HUMAN)
GQHTMEVTVF

SEQ ID NO: 136596 - protein, 10 aa, Artificial Sequence
  Description of Artificial Sequence: Synthetic peptide
  Seed: RSFVYVWKTW (PMEL_HUMAN)
RQFVYVWKTW

SEQ ID NO: 136597 - protein, 11 aa, Artificial Sequence
  Description of Artificial Sequence: Synthetic peptide
  Seed: SGLSIGTGRAM (PMEL_HUMAN)
SALSIGTGRAF

SEQ ID NO: 136598 - protein, 9 aa, Artificial Sequence
  Description of Artificial Sequence: Synthetic peptide
  Seed: TLISRALVV (PMEL_HUMAN)
TLISRALVF

SEQ ID NO: 136599 - protein, 10 aa, Artificial Sequence
  Description of Artificial Sequence: Synthetic peptide
  Seed: SVPQLPHSSS (PMEL_HUMAN)
SMPQLPHSSL

SEQ ID NO: 136600 - protein, 9 aa, Artificial Sequence
  Description of Artificial Sequence: Synthetic peptide
  Seed: VSEVMGTTL (PMEL_HUMAN)
VAEVMGTTL

SEQ ID NO: 136601 - protein, 9 aa, Artificial Sequence
  Description of Artificial Sequence: Synthetic peptide
  Seed: VMGTTLAEM (PMEL_HUMAN)
VLGTTLAEA

SEQ ID NO: 136602 - protein, 9 aa, Artificial Sequence
  Description of Artificial Sequence: Synthetic peptide
  Seed: YLAEADLSY (PMEL_HUMAN)
YPAEADLSQ

SEQ ID NO: 136603 - protein, 11 aa, Artificial Sequence
  Description of Artificial Sequence: Synthetic peptide
  Seed: RRGSRSYVPLA (PMEL_HUMAN)
RCGSRSYVPLA

SEQ ID NO: 136604 - protein, 10 aa, Artificial Sequence
  Description of Artificial Sequence: Synthetic peptide
  Seed: SGTYCLNVSL (PMEL_HUMAN)
STTYCLNVSV

SEQ ID NO: 136605 - protein, 9 aa, Artificial Sequence
  Description of Artificial Sequence: Synthetic peptide
  Seed: EGDAFELTV (PMEL_HUMAN)
EADAFELTV

SEQ ID NO: 136606 - protein, 11 aa, Artificial Sequence
  Description of Artificial Sequence: Synthetic peptide
  Seed: RRGSRSYVPLA (PMEL_HUMAN)
RHGSRSYVPLA

SEQ ID NO: 136607 - protein, 10 aa, Artificial Sequence
  Description of Artificial Sequence: Synthetic peptide
  Seed: VVLASLIYRR (PMEL_HUMAN)
VHLASLIYRR

SEQ ID NO: 136608 - protein, 9 aa, Artificial Sequence
  Description of Artificial Sequence: Synthetic peptide
  Seed: TLIGANASF (PMEL_HUMAN)
TFIGANASF

SEQ ID NO: 136609 - protein, 9 aa, Artificial Sequence
  Description of Artificial Sequence: Synthetic peptide
  Seed: AEMSTPEAT (PMEL_HUMAN)
ADMSTPEAM

SEQ ID NO: 136610 - protein, 9 aa, Artificial Sequence
  Description of Artificial Sequence: Synthetic peptide
  Seed: VISTAPVQM (PMEL_HUMAN)
VTSTAPVQF

SEQ ID NO: 136611 - protein, 9 aa, Artificial Sequence
  Description of Artificial Sequence: Synthetic peptide
  Seed: GSFSVTLDI (PMEL_HUMAN)
GMFSVTLDA

SEQ ID NO: 136612 - protein, 9 aa, Artificial Sequence
  Description of Artificial Sequence: Synthetic peptide
  Seed: KTWGQYWQV (PMEL_HUMAN)
KTWGQYWQA

SEQ ID NO: 136613 - protein, 10 aa, Artificial Sequence
  Description of Artificial Sequence: Synthetic peptide
  Seed: LAVVSTQLIM (PMEL_HUMAN)
LQVVSTQLIF

SEQ ID NO: 136614 - protein, 9 aa, Artificial Sequence
  Description of Artificial Sequence: Synthetic peptide
  Seed: EVMGTTLAE (PMEL_HUMAN)
ECMGTTLAR

SEQ ID NO: 136615 - protein, 9 aa, Artificial Sequence
  Description of Artificial Sequence: Synthetic peptide
  Seed: VSLADTNSL (PMEL_HUMAN)
VLLADTNSW

SEQ ID NO: 136616 - protein, 11 aa, Artificial Sequence
  Description of Artificial Sequence: Synthetic peptide
  Seed: RLPRIFCSCPI (PMEL_HUMAN)
RNPRIFCSCPL

SEQ ID NO: 136617 - protein, 10 aa, Artificial Sequence
  Description of Artificial Sequence: Synthetic peptide
  Seed: THTMEVTVYH (PMEL_HUMAN)
TGTMEVTVYK

SEQ ID NO: 136618 - protein, 9 aa, Artificial Sequence
  Description of Artificial Sequence: Synthetic peptide
  Seed: YPQETDDAC (PMEL_HUMAN)
YPQETDDAF

SEQ ID NO: 136619 - protein, 9 aa, Artificial Sequence
  Description of Artificial Sequence: Synthetic peptide
  Seed: GILLVLMAV (PMEL_HUMAN)
GMLLVLMAI

SEQ ID NO: 136620 - protein, 9 aa, Artificial Sequence
  Description of Artificial Sequence: Synthetic peptide
  Seed: TLISRALVV (PMEL_HUMAN)
TSISRALVY

SEQ ID NO: 136621 - protein, 9 aa, Artificial Sequence
  Description of Artificial Sequence: Synthetic peptide
  Seed: VSNDGPTLI (PMEL_HUMAN)
VGNDGPTLM

SEQ ID NO: 136622 - protein, 9 aa, Artificial Sequence
  Description of Artificial Sequence: Synthetic peptide
  Seed: KHFLRNQPL (PMEL_HUMAN)
KFFLRNQPL

SEQ ID NO: 136623 - protein, 9 aa, Artificial Sequence
  Description of Artificial Sequence: Synthetic peptide
  Seed: MAVVLASLI (PMEL_HUMAN)
MGVVLASLY

SEQ ID NO: 136624 - protein, 11 aa, Artificial Sequence
  Description of Artificial Sequence: Synthetic peptide
  Seed: TWDFGDSSGTL (PMEL_HUMAN)
TADFGDSSGTV

SEQ ID NO: 136625 - protein, 9 aa, Artificial Sequence
  Description of Artificial Sequence: Synthetic peptide
  Seed: TLIGANASF (PMEL_HUMAN)
TLIGANASL

SEQ ID NO: 136626 - protein, 10 aa, Artificial Sequence
  Description of Artificial Sequence: Synthetic peptide
  Seed: RQLYPEWTEA (PMEL_HUMAN)
RWLYPEWTEL

SEQ ID NO: 136627 - protein, 9 aa, Artificial Sequence
  Description of Artificial Sequence: Synthetic peptide
  Seed: YRYGSFSVT (PMEL_HUMAN)
YRYGSFSVV

SEQ ID NO: 136628 - protein, 8 aa, Artificial Sequence
  Description of Artificial Sequence: Synthetic peptide
  Seed: AQVTTTEW (PMEL_HUMAN)
AMVTTTEY

SEQ ID NO: 136629 - protein, 10 aa, Artificial Sequence
  Description of Artificial Sequence: Synthetic peptide
  Seed: RGSRSYVPLA (PMEL_HUMAN)
RVSRSYVPLR

SEQ ID NO: 136630 - protein, 11 aa, Artificial Sequence
  Description of Artificial Sequence: Synthetic peptide
  Seed: LYRYGSFSVTL (PMEL_HUMAN)
LDRYGSFSVTF

SEQ ID NO: 136631 - protein, 9 aa, Artificial Sequence
  Description of Artificial Sequence: Synthetic peptide
  Seed: GPLLDGTAT (PMEL_HUMAN)
GPLLDGTAM

SEQ ID NO: 136632 - protein, 9 aa, Artificial Sequence
  Description of Artificial Sequence: Synthetic peptide
  Seed: VMGTTLAEM (PMEL_HUMAN)
VIGTTLAEL

SEQ ID NO: 136633 - protein, 9 aa, Artificial Sequence
  Description of Artificial Sequence: Synthetic peptide
  Seed: ALVVTHTYL (PMEL_HUMAN)
AVVVTHTYF

SEQ ID NO: 136634 - protein, 9 aa, Artificial Sequence
  Description of Artificial Sequence: Synthetic peptide
  Seed: ANASFSIAL (PMEL_HUMAN)
AIASFSIAF

SEQ ID NO: 136635 - protein, 10 aa, Artificial Sequence
  Description of Artificial Sequence: Synthetic peptide
  Seed: GSRSYVPLAH (PMEL_HUMAN)
GTRSYVPLAK

SEQ ID NO: 136636 - protein, 9 aa, Artificial Sequence
  Description of Artificial Sequence: Synthetic peptide
  Seed: MLGTHTMEV (PMEL_HUMAN)
MQGTHTMEY

SEQ ID NO: 136637 - protein, 10 aa, Artificial Sequence
  Description of Artificial Sequence: Synthetic peptide
  Seed: SSHWLRLPRI (PMEL_HUMAN)
SGHWLRLPRR

SEQ ID NO: 136638 - protein, 9 aa, Artificial Sequence
  Description of Artificial Sequence: Synthetic peptide
  Seed: AVIGALLAV (PMEL_HUMAN)
ATIGALLAL

SEQ ID NO: 136639 - protein, 10 aa, Artificial Sequence
  Description of Artificial Sequence: Synthetic peptide
  Seed: LAVIGALLAV (PMEL_HUMAN)
LFVIGALLAV

SEQ ID NO: 136640 - protein, 9 aa, Artificial Sequence
  Description of Artificial Sequence: Synthetic peptide
  Seed: TAEAPNTTA (PMEL_HUMAN)
TMEAPNTTL

SEQ ID NO: 136641 - protein, 10 aa, Artificial Sequence
  Description of Artificial Sequence: Synthetic peptide
  Seed: RGSRSYVPLA (PMEL_HUMAN)
RRSRSYVPLR

SEQ ID NO: 136642 - protein, 9 aa, Artificial Sequence
  Description of Artificial Sequence: Synthetic peptide
  Seed: AAIPLTSCG (PMEL_HUMAN)
AVIPLTSCY

SEQ ID NO: 136643 - protein, 10 aa, Artificial Sequence
  Description of Artificial Sequence: Synthetic peptide
  Seed: SGTYCLNVSL (PMEL_HUMAN)
SYTYCLNVSV

SEQ ID NO: 136644 - protein, 9 aa, Artificial Sequence
  Description of Artificial Sequence: Synthetic peptide
  Seed: KQDFSVPQL (PMEL_HUMAN)
KSDFSVPQV

SEQ ID NO: 136645 - protein, 9 aa, Artificial Sequence
  Description of Artificial Sequence: Synthetic peptide
  Seed: SAFTITDQV (PMEL_HUMAN)
SQFTITDQM

SEQ ID NO: 136646 - protein, 9 aa, Artificial Sequence
  Description of Artificial Sequence: Synthetic peptide
  Seed: EGDAFELTV (PMEL_HUMAN)
EFDAFELTL

SEQ ID NO: 136647 - protein, 8 aa, Artificial Sequence
  Description of Artificial Sequence: Synthetic peptide
  Seed: TLDIVQGI (PMEL_HUMAN)
TYDIVQGL

SEQ ID NO: 136648 - protein, 9 aa, Artificial Sequence
  Description of Artificial Sequence: Synthetic peptide
  Seed: RALVVTHTY (PMEL_HUMAN)
RILVVTHTY

SEQ ID NO: 136649 - protein, 10 aa, Artificial Sequence
  Description of Artificial Sequence: Synthetic peptide
  Seed: LLDGTATLRL (PMEL_HUMAN)
LSDGTATLRL

SEQ ID NO: 136650 - protein, 10 aa, Artificial Sequence
  Description of Artificial Sequence: Synthetic peptide
  Seed: MPTAESTGMT (PMEL_HUMAN)
MCTAESTGMI

SEQ ID NO: 136651 - protein, 10 aa, Artificial Sequence
  Description of Artificial Sequence: Synthetic peptide
  Seed: SSHWLRLPRI (PMEL_HUMAN)
SIHWLRLPRR

SEQ ID NO: 136652 - protein, 9 aa, Artificial Sequence
  Description of Artificial Sequence: Synthetic peptide
  Seed: AQVVLQAAI (PMEL_HUMAN)
ARVVLQAAF

SEQ ID NO: 136653 - protein, 11 aa, Artificial Sequence
  Description of Artificial Sequence: Synthetic peptide
  Seed: RQVPLDCVLYR (PMEL_HUMAN)
RLVPLDCVLYR

SEQ ID NO: 136654 - protein, 9 aa, Artificial Sequence
  Description of Artificial Sequence: Synthetic peptide
  Seed: ANASFSIAL (PMEL_HUMAN)
AQASFSIAV

SEQ ID NO: 136655 - protein, 9 aa, Artificial Sequence
  Description of Artificial Sequence: Synthetic peptide
  Seed: SVPQLPHSS (PMEL_HUMAN)
SGPQLPHSM

SEQ ID NO: 136656 - protein, 10 aa, Artificial Sequence
  Description of Artificial Sequence: Synthetic peptide
  Seed: LVLMAVVLAS (PMEL_HUMAN)
LCLMAVVLAL

SEQ ID NO: 136657 - protein, 9 aa, Artificial Sequence
  Description of Artificial Sequence: Synthetic peptide
  Seed: RAMLGTHTM (PMEL_HUMAN)
RVMLGTHTW

SEQ ID NO: 136658 - protein, 10 aa, Artificial Sequence
  Description of Artificial Sequence: Synthetic peptide
  Seed: EVMGTTLAEM (PMEL_HUMAN)
EIMGTTLAEF

SEQ ID NO: 136659 - protein, 9 aa, Artificial Sequence
  Description of Artificial Sequence: Synthetic peptide
  Seed: LNFPGSQKV (PMEL_HUMAN)
LVFPGSQKF

SEQ ID NO: 136660 - protein, 9 aa, Artificial Sequence
  Description of Artificial Sequence: Synthetic peptide
  Seed: KTWGQYWQV (PMEL_HUMAN)
KVWGQYWQA

SEQ ID NO: 136661 - protein, 9 aa, Artificial Sequence
  Description of Artificial Sequence: Synthetic peptide
  Seed: AQVTTTEWV (PMEL_HUMAN)
AMVTTTEWA

SEQ ID NO: 136662 - protein, 10 aa, Artificial Sequence
  Description of Artificial Sequence: Synthetic peptide
  Seed: SSSHWLRLPR (PMEL_HUMAN)
STSHWLRLPR

SEQ ID NO: 136663 - protein, 10 aa, Artificial Sequence
  Description of Artificial Sequence: Synthetic peptide
  Seed: RALDGGNKHF (PMEL_HUMAN)
RLLDGGNKHI

SEQ ID NO: 136664 - protein, 10 aa, Artificial Sequence
  Description of Artificial Sequence: Synthetic peptide
  Seed: SQKRSFVYVW (PMEL_HUMAN)
STKRSFVYVF

SEQ ID NO: 136665 - protein, 9 aa, Artificial Sequence
  Description of Artificial Sequence: Synthetic peptide
  Seed: AVVLASLIY (PMEL_HUMAN)
AAVLASLIM

SEQ ID NO: 136666 - protein, 11 aa, Artificial Sequence
  Description of Artificial Sequence: Synthetic peptide
  Seed: AMLGTHTMEVT (PMEL_HUMAN)
ALLGTHTMEVV

SEQ ID NO: 136667 - protein, 9 aa, Artificial Sequence
  Description of Artificial Sequence: Synthetic peptide
  Seed: MAVVLASLI (PMEL_HUMAN)
MSVVLASLM

SEQ ID NO: 136668 - protein, 9 aa, Artificial Sequence
  Description of Artificial Sequence: Synthetic peptide
  Seed: VTLDIVQGI (PMEL_HUMAN)
VMLDIVQGV

SEQ ID NO: 136669 - protein, 9 aa, Artificial Sequence
  Description of Artificial Sequence: Synthetic peptide
  Seed: AVIGALLAV (PMEL_HUMAN)
AAIGALLAV

SEQ ID NO: 136670 - protein, 10 aa, Artificial Sequence
  Description of Artificial Sequence: Synthetic peptide
  Seed: SVPQLPHSSS (PMEL_HUMAN)
SWPQLPHSSL

SEQ ID NO: 136671 - protein, 9 aa, Artificial Sequence
  Description of Artificial Sequence: Synthetic peptide
  Seed: YPQETDDAC (PMEL_HUMAN)
YPQETDDAM

SEQ ID NO: 136672 - protein, 11 aa, Artificial Sequence
  Description of Artificial Sequence: Synthetic peptide
  Seed: MAVVLASLIYR (PMEL_HUMAN)
MFVVLASLIYK

SEQ ID NO: 136673 - protein, 10 aa, Artificial Sequence
  Description of Artificial Sequence: Synthetic peptide
  Seed: AVVLASLIYR (PMEL_HUMAN)
ARVLASLIYR

SEQ ID NO: 136674 - protein, 9 aa, Artificial Sequence
  Description of Artificial Sequence: Synthetic peptide
  Seed: RTKAWNRQL (PMEL_HUMAN)
RFKAWNRQV

SEQ ID NO: 136675 - protein, 9 aa, Artificial Sequence
  Description of Artificial Sequence: Synthetic peptide
  Seed: AQVVLQAAI (PMEL_HUMAN)
AIVVLQAAV

SEQ ID NO: 136676 - protein, 10 aa, Artificial Sequence
  Description of Artificial Sequence: Synthetic peptide
  Seed: TAEPSGTTSV (PMEL_HUMAN)
TAEPSGTTSF

SEQ ID NO: 136677 - protein, 9 aa, Artificial Sequence
  Description of Artificial Sequence: Synthetic peptide
  Seed: SQKRSFVYV (PMEL_HUMAN)
SAKRSFVYM

SEQ ID NO: 136678 - protein, 10 aa, Artificial Sequence
  Description of Artificial Sequence: Synthetic peptide
  Seed: RSFVYVWKTW (PMEL_HUMAN)
RWFVYVWKTW

SEQ ID NO: 136679 - protein, 9 aa, Artificial Sequence
  Description of Artificial Sequence: Synthetic peptide
  Seed: KHFLRNQPL (PMEL_HUMAN)
KYFLRNQPM

SEQ ID NO: 136680 - protein, 10 aa, Artificial Sequence
  Description of Artificial Sequence: Synthetic peptide
  Seed: VYVWKTWGQY (PMEL_HUMAN)
VMVWKTWGQY

SEQ ID NO: 136681 - protein, 9 aa, Artificial Sequence
  Description of Artificial Sequence: Synthetic peptide
  Seed: GQVPLIVGI (PMEL_HUMAN)
GMVPLIVGM

SEQ ID NO: 136682 - protein, 9 aa, Artificial Sequence
  Description of Artificial Sequence: Synthetic peptide
  Seed: FGDSSGTLI (PMEL_HUMAN)
FLDSSGTLM

SEQ ID NO: 136683 - protein, 9 aa, Artificial Sequence
  Description of Artificial Sequence: Synthetic peptide
  Seed: TLISRALVV (PMEL_HUMAN)
TPISRALVL

SEQ ID NO: 136684 - protein, 9 aa, Artificial Sequence
  Description of Artificial Sequence: Synthetic peptide
  Seed: VLPDGQVIW (PMEL_HUMAN)
VIPDGQVIM

SEQ ID NO: 136685 - protein, 10 aa, Artificial Sequence
  Description of Artificial Sequence: Synthetic peptide
  Seed: RALVVTHTYL (PMEL_HUMAN)
RMLVVTHTYF

SEQ ID NO: 136686 - protein, 9 aa, Artificial Sequence
  Description of Artificial Sequence: Synthetic peptide
  Seed: CQLVLHQIL (PMEL_HUMAN)
CMLVLHQIF

SEQ ID NO: 136687 - protein, 10 aa, Artificial Sequence
  Description of Artificial Sequence: Synthetic peptide
  Seed: RGSRSYVPLA (PMEL_HUMAN)
RQSRSYVPLR

SEQ ID NO: 136688 - protein, 10 aa, Artificial Sequence
  Description of Artificial Sequence: Synthetic peptide
  Seed: EATGMTPAEV (PMEL_HUMAN)
ESTGMTPAEV

SEQ ID NO: 136689 - protein, 11 aa, Artificial Sequence
  Description of Artificial Sequence: Synthetic peptide
  Seed: YLAEADLSYTW (PMEL_HUMAN)
YFAEADLSYTF

SEQ ID NO: 136690 - protein, 9 aa, Artificial Sequence
  Description of Artificial Sequence: Synthetic peptide
  Seed: RTKAWNRQL (PMEL_HUMAN)
RRKAWNRQY

SEQ ID NO: 136691 - protein, 9 aa, Artificial Sequence
  Description of Artificial Sequence: Synthetic peptide
  Seed: SQVWGGQPV (PMEL_HUMAN)
SSVWGGQPV

SEQ ID NO: 136692 - protein, 9 aa, Artificial Sequence
  Description of Artificial Sequence: Synthetic peptide
  Seed: LSIGTGRAM (PMEL_HUMAN)
LRIGTGRAM

SEQ ID NO: 136693 - protein, 9 aa, Artificial Sequence
  Description of Artificial Sequence: Synthetic peptide
  Seed: HTMEVTVYH (PMEL_HUMAN)
HAMEVTVYI

SEQ ID NO: 136694 - protein, 9 aa, Artificial Sequence
  Description of Artificial Sequence: Synthetic peptide
  Seed: VSLADTNSL (PMEL_HUMAN)
VLLADTNSI

SEQ ID NO: 136695 - protein, 10 aa, Artificial Sequence
  Description of Artificial Sequence: Synthetic peptide
  Seed: RALDGGNKHF (PMEL_HUMAN)
RQLDGGNKHL

SEQ ID NO: 136696 - protein, 9 aa, Artificial Sequence
  Description of Artificial Sequence: Synthetic peptide
  Seed: YLAEADLSY (PMEL_HUMAN)
YQAEADLSW

SEQ ID NO: 136697 - protein, 10 aa, Artificial Sequence
  Description of Artificial Sequence: Synthetic peptide
  Seed: AFTITDQVPF (PMEL_HUMAN)
AYTITDQVPF

SEQ ID NO: 136698 - protein, 10 aa, Artificial Sequence
  Description of Artificial Sequence: Synthetic peptide
  Seed: RALDGGNKHF (PMEL_HUMAN)
RSLDGGNKHW

SEQ ID NO: 136699 - protein, 11 aa, Artificial Sequence
  Description of Artificial Sequence: Synthetic peptide
  Seed: RQLRTKAWNRQ (PMEL_HUMAN)
RTLRTKAWNRR

SEQ ID NO: 136700 - protein, 8 aa, Artificial Sequence
  Description of Artificial Sequence: Synthetic peptide
  Seed: LLDGTATL (PMEL_HUMAN)
LGDGTATL

SEQ ID NO: 136701 - protein, 9 aa, Artificial Sequence
  Description of Artificial Sequence: Synthetic peptide
  Seed: ALNFPGSQK (PMEL_HUMAN)
AINFPGSQF

SEQ ID NO: 136702 - protein, 9 aa, Artificial Sequence
  Description of Artificial Sequence: Synthetic peptide
  Seed: YLAEADLSY (PMEL_HUMAN)
YIAEADLSI

SEQ ID NO: 136703 - protein, 9 aa, Artificial Sequence
  Description of Artificial Sequence: Synthetic peptide
  Seed: YRYGSFSVT (PMEL_HUMAN)
YQYGSFSVF

SEQ ID NO: 136704 - protein, 9 aa, Artificial Sequence
  Description of Artificial Sequence: Synthetic peptide
  Seed: LPHSSSHWL (PMEL_HUMAN)
LVHSSSHWY

SEQ ID NO: 136705 - protein, 10 aa, Artificial Sequence
  Description of Artificial Sequence: Synthetic peptide
  Seed: SCPIGENSPL (PMEL_HUMAN)
SLPIGENSPL

SEQ ID NO: 136706 - protein, 9 aa, Artificial Sequence
  Description of Artificial Sequence: Synthetic peptide
  Seed: SSIMSTESI (PMEL_HUMAN)
SMIMSTESY

SEQ ID NO: 136707 - protein, 10 aa, Artificial Sequence
  Description of Artificial Sequence: Synthetic peptide
  Seed: MPTAESTGMT (PMEL_HUMAN)
MATAESTGML

SEQ ID NO: 136708 - protein, 9 aa, Artificial Sequence
  Description of Artificial Sequence: Synthetic peptide
  Seed: ESAEILQAV (PMEL_HUMAN)
EVAEILQAI

SEQ ID NO: 136709 - protein, 9 aa, Artificial Sequence
  Description of Artificial Sequence: Synthetic peptide
  Seed: WSQKRSFVY (PMEL_HUMAN)
WIQKRSFVF

SEQ ID NO: 136710 - protein, 9 aa, Artificial Sequence
  Description of Artificial Sequence: Synthetic peptide
  Seed: GQVPTTEVV (PMEL_HUMAN)
GIVPTTEVV

SEQ ID NO: 136711 - protein, 11 aa, Artificial Sequence
  Description of Artificial Sequence: Synthetic peptide
  Seed: GATKVPRNQDW (PMEL_HUMAN)
GTTKVPRNQDW

SEQ ID NO: 136712 - protein, 9 aa, Artificial Sequence
  Description of Artificial Sequence: Synthetic peptide
  Seed: AEADLSYTW (PMEL_HUMAN)
ATADLSYTY

SEQ ID NO: 136713 - protein, 9 aa, Artificial Sequence
  Description of Artificial Sequence: Synthetic peptide
  Seed: AQRLCQPVL (PMEL_HUMAN)
AWRLCQPVK

SEQ ID NO: 136714 - protein, 10 aa, Artificial Sequence
  Description of Artificial Sequence: Synthetic peptide
  Seed: WKTWGQYWQV (PMEL_HUMAN)
WLTWGQYWQM

SEQ ID NO: 136715 - protein, 10 aa, Artificial Sequence
  Description of Artificial Sequence: Synthetic peptide
  Seed: ESITGSLGPL (PMEL_HUMAN)
EAITGSLGPV

SEQ ID NO: 136716 - protein, 10 aa, Artificial Sequence
  Description of Artificial Sequence: Synthetic peptide
  Seed: ILKGGSGTYC (PMEL_HUMAN)
IMKGGSGTYF

SEQ ID NO: 136717 - protein, 10 aa, Artificial Sequence
  Description of Artificial Sequence: Synthetic peptide
  Seed: LAHSSSAFTI (PMEL_HUMAN)
LLHSSSAFTW

SEQ ID NO: 136718 - protein, 9 aa, Artificial Sequence
  Description of Artificial Sequence: Synthetic peptide
  Seed: AEADLSYTW (PMEL_HUMAN)
AAADLSYTW

SEQ ID NO: 136719 - protein, 9 aa, Artificial Sequence
  Description of Artificial Sequence: Synthetic peptide
  Seed: ITDQVPFSV (PMEL_HUMAN)
IIDQVPFSF

SEQ ID NO: 136720 - protein, 10 aa, Artificial Sequence
  Description of Artificial Sequence: Synthetic peptide
  Seed: YVPLAHSSSA (PMEL_HUMAN)
YFPLAHSSSF

SEQ ID NO: 136721 - protein, 10 aa, Artificial Sequence
  Description of Artificial Sequence: Synthetic peptide
  Seed: VSLADTNSLA (PMEL_HUMAN)
VYLADTNSLV

SEQ ID NO: 136722 - protein, 10 aa, Artificial Sequence
  Description of Artificial Sequence: Synthetic peptide
  Seed: RQLYPEWTEA (PMEL_HUMAN)
RLLYPEWTEL

SEQ ID NO: 136723 - protein, 10 aa, Artificial Sequence
  Description of Artificial Sequence: Synthetic peptide
  Seed: YLAEADLSYT (PMEL_HUMAN)
YLAEADLSYC

SEQ ID NO: 136724 - protein, 11 aa, Artificial Sequence
  Description of Artificial Sequence: Synthetic peptide
  Seed: CVLYRYGSFSV (PMEL_HUMAN)
CFLYRYGSFSV

SEQ ID NO: 136725 - protein, 10 aa, Artificial Sequence
  Description of Artificial Sequence: Synthetic peptide
  Seed: RRLMKQDFSV (PMEL_HUMAN)
RVLMKQDFSI

SEQ ID NO: 136726 - protein, 10 aa, Artificial Sequence
  Description of Artificial Sequence: Synthetic peptide
  Seed: RALVVTHTYL (PMEL_HUMAN)
RWLVVTHTYY

SEQ ID NO: 136727 - protein, 9 aa, Artificial Sequence
  Description of Artificial Sequence: Synthetic peptide
  Seed: DQVPFSVSV (PMEL_HUMAN)
DVVPFSVSY

SEQ ID NO: 136728 - protein, 8 aa, Artificial Sequence
  Description of Artificial Sequence: Synthetic peptide
  Seed: QDFSVPQL (PMEL_HUMAN)
QMFSVPQV

SEQ ID NO: 136729 - protein, 9 aa, Artificial Sequence
  Description of Artificial Sequence: Synthetic peptide
  Seed: RTKAWNRQL (PMEL_HUMAN)
RLKAWNRQW

SEQ ID NO: 136730 - protein, 8 aa, Artificial Sequence
  Description of Artificial Sequence: Synthetic peptide
  Seed: SNDGPTLI (PMEL_HUMAN)
SIDGPTLM

SEQ ID NO: 136731 - protein, 9 aa, Artificial Sequence
  Description of Artificial Sequence: Synthetic peptide
  Seed: AEILQAVPS (PMEL_HUMAN)
AEILQAVPL

SEQ ID NO: 136732 - protein, 11 aa, Artificial Sequence
  Description of Artificial Sequence: Synthetic peptide
  Seed: RRGSRSYVPLA (PMEL_HUMAN)
RQGSRSYVPLV

SEQ ID NO: 136733 - protein, 9 aa, Artificial Sequence
  Description of Artificial Sequence: Synthetic peptide
  Seed: YVWKTWGQY (PMEL_HUMAN)
YMWKTWGQL

SEQ ID NO: 136734 - protein, 10 aa, Artificial Sequence
  Description of Artificial Sequence: Synthetic peptide
  Seed: FLRNQPLTFA (PMEL_HUMAN)
FLRNQPLTFM

SEQ ID NO: 136735 - protein, 10 aa, Artificial Sequence
  Description of Artificial Sequence: Synthetic peptide
  Seed: DGTATLRLVK (PMEL_HUMAN)
DLTATLRLVR

SEQ ID NO: 136736 - protein, 10 aa, Artificial Sequence
  Description of Artificial Sequence: Synthetic peptide
  Seed: MAVVLASLIY (PMEL_HUMAN)
MQVVLASLIF

SEQ ID NO: 136737 - protein, 11 aa, Artificial Sequence
  Description of Artificial Sequence: Synthetic peptide
  Seed: YLEPGPVTAQV (PMEL_HUMAN)
YAEPGPVTAQI

SEQ ID NO: 136738 - protein, 11 aa, Artificial Sequence
  Description of Artificial Sequence: Synthetic peptide
  Seed: MTPAEVSIVVL (PMEL_HUMAN)
MTPAEVSIVVW

SEQ ID NO: 136739 - protein, 9 aa, Artificial Sequence
  Description of Artificial Sequence: Synthetic peptide
  Seed: VSCQGGLPK (PMEL_HUMAN)
VTCQGGLPR

SEQ ID NO: 136740 - protein, 10 aa, Artificial Sequence
  Description of Artificial Sequence: Synthetic peptide
  Seed: LKVSNDGPTL (PMEL_HUMAN)
LMVSNDGPTF

SEQ ID NO: 136741 - protein, 11 aa, Artificial Sequence
  Description of Artificial Sequence: Synthetic peptide
  Seed: HQILKGGSGTY (PMEL_HUMAN)
HAILKGGSGTY

SEQ ID NO: 136742 - protein, 9 aa, Artificial Sequence
  Description of Artificial Sequence: Synthetic peptide
  Seed: RTKAWNRQL (PMEL_HUMAN)
RAKAWNRQM

SEQ ID NO: 136743 - protein, 9 aa, Artificial Sequence
  Description of Artificial Sequence: Synthetic peptide
  Seed: AQVVLQAAI (PMEL_HUMAN)
AMVVLQAAL

SEQ ID NO: 136744 - protein, 10 aa, Artificial Sequence
  Description of Artificial Sequence: Synthetic peptide
  Seed: LIMPGQEAGL (PMEL_HUMAN)
LTMPGQEAGR

SEQ ID NO: 136745 - protein, 10 aa, Artificial Sequence
  Description of Artificial Sequence: Synthetic peptide
  Seed: LQLHDPSGYL (PMEL_HUMAN)
LMLHDPSGYV

SEQ ID NO: 136746 - protein, 9 aa, Artificial Sequence
  Description of Artificial Sequence: Synthetic peptide
  Seed: ITDQVPFSV (PMEL_HUMAN)
IFDQVPFSW

SEQ ID NO: 136747 - protein, 9 aa, Artificial Sequence
  Description of Artificial Sequence: Synthetic peptide
  Seed: SITGSLGPL (PMEL_HUMAN)
SLTGSLGPI

SEQ ID NO: 136748 - protein, 10 aa, Artificial Sequence
  Description of Artificial Sequence: Synthetic peptide
  Seed: TDQVPFSVSV (PMEL_HUMAN)
TKQVPFSVSV

SEQ ID NO: 136749 - protein, 11 aa, Artificial Sequence
  Description of Artificial Sequence: Synthetic peptide
  Seed: KVLPDGQVIWV (PMEL_HUMAN)
KQLPDGQVIWM

SEQ ID NO: 136750 - protein, 11 aa, Artificial Sequence
  Description of Artificial Sequence: Synthetic peptide
  Seed: VPSGEGDAFEL (PMEL_HUMAN)
VPSGEGDAFEF

SEQ ID NO: 136751 - protein, 10 aa, Artificial Sequence
  Description of Artificial Sequence: Synthetic peptide
  Seed: KRQVPLDCVL (PMEL_HUMAN)
KSQVPLDCVY

SEQ ID NO: 136752 - protein, 9 aa, Artificial Sequence
  Description of Artificial Sequence: Synthetic peptide
  Seed: GSSPVPGTT (PMEL_HUMAN)
GASPVPGTF

SEQ ID NO: 136753 - protein, 10 aa, Artificial Sequence
  Description of Artificial Sequence: Synthetic peptide
  Seed: KVSNDGPTLI (PMEL_HUMAN)
KVSNDGPTLW

SEQ ID NO: 136754 - protein, 9 aa, Artificial Sequence
  Description of Artificial Sequence: Synthetic peptide
  Seed: THTMEVTVY (PMEL_HUMAN)
TATMEVTVY

SEQ ID NO: 136755 - protein, 9 aa, Artificial Sequence
  Description of Artificial Sequence: Synthetic peptide
  Seed: TIINGSQVW (PMEL_HUMAN)
TQINGSQVM

SEQ ID NO: 136756 - protein, 8 aa, Artificial Sequence
  Description of Artificial Sequence: Synthetic peptide
  Seed: YGSFSVTL (PMEL_HUMAN)
YASFSVTM

SEQ ID NO: 136757 - protein, 9 aa, Artificial Sequence
  Description of Artificial Sequence: Synthetic peptide
  Seed: TAPVQMPTA (PMEL_HUMAN)
TAPVQMPTM

SEQ ID NO: 136758 - protein, 9 aa, Artificial Sequence
  Description of Artificial Sequence: Synthetic peptide
  Seed: RALVVTHTY (PMEL_HUMAN)
RALVVTHTV

SEQ ID NO: 136759 - protein, 10 aa, Artificial Sequence
  Description of Artificial Sequence: Synthetic peptide
  Seed: AVVLASLIYR (PMEL_HUMAN)
AGVLASLIYK

SEQ ID NO: 136760 - protein, 9 aa, Artificial Sequence
  Description of Artificial Sequence: Synthetic peptide
  Seed: AQRLCQPVL (PMEL_HUMAN)
AIRLCQPVF

SEQ ID NO: 136761 - protein, 10 aa, Artificial Sequence
  Description of Artificial Sequence: Synthetic peptide
  Seed: KVSNDGPTLI (PMEL_HUMAN)
KLSNDGPTLW

SEQ ID NO: 136762 - protein, 10 aa, Artificial Sequence
  Description of Artificial Sequence: Synthetic peptide
  Seed: AVIGALLAVG (PMEL_HUMAN)
AQIGALLAVA

SEQ ID NO: 136763 - protein, 11 aa, Artificial Sequence
  Description of Artificial Sequence: Synthetic peptide
  Seed: SGYLAEADLSY (PMEL_HUMAN)
SQYLAEADLSF

SEQ ID NO: 136764 - protein, 9 aa, Artificial Sequence
  Description of Artificial Sequence: Synthetic peptide
  Seed: KTWGQYWQV (PMEL_HUMAN)
KQWGQYWQI

SEQ ID NO: 136765 - protein, 9 aa, Artificial Sequence
  Description of Artificial Sequence: Synthetic peptide
  Seed: ALLAVGATK (PMEL_HUMAN)
AALAVGATI

SEQ ID NO: 136766 - protein, 11 aa, Artificial Sequence
  Description of Artificial Sequence: Synthetic peptide
  Seed: FSVTLDIVQGI (PMEL_HUMAN)
FLVTLDIVQGL

SEQ ID NO: 136767 - protein, 10 aa, Artificial Sequence
  Description of Artificial Sequence: Synthetic peptide
  Seed: LADTNSLAVV (PMEL_HUMAN)
LADTNSLAVI

SEQ ID NO: 136768 - protein, 9 aa, Artificial Sequence
  Description of Artificial Sequence: Synthetic peptide
  Seed: LADTNSLAV (PMEL_HUMAN)
LFDTNSLAV

SEQ ID NO: 136769 - protein, 9 aa, Artificial Sequence
  Description of Artificial Sequence: Synthetic peptide
  Seed: SLAVVSTQL (PMEL_HUMAN)
SVAVVSTQW

SEQ ID NO: 136770 - protein, 9 aa, Artificial Sequence
  Description of Artificial Sequence: Synthetic peptide
  Seed: VSVSQLRAL (PMEL_HUMAN)
VTVSQLRAF

SEQ ID NO: 136771 - protein, 9 aa, Artificial Sequence
  Description of Artificial Sequence: Synthetic peptide
  Seed: SVPQLPHSS (PMEL_HUMAN)
STPQLPHSL

SEQ ID NO: 136772 - protein, 9 aa, Artificial Sequence
  Description of Artificial Sequence: Synthetic peptide
  Seed: LTVSCQGGL (PMEL_HUMAN)
LSVSCQGGF

SEQ ID NO: 136773 - protein, 8 aa, Artificial Sequence
  Description of Artificial Sequence: Synthetic peptide
  Seed: FSVSVSQL (PMEL_HUMAN)
FAVSVSQF

SEQ ID NO: 136774 - protein, 9 aa, Artificial Sequence
  Description of Artificial Sequence: Synthetic peptide
  Seed: KAWNRQLYP (PMEL_HUMAN)
KAWNRQLYA

SEQ ID NO: 136775 - protein, 10 aa, Artificial Sequence
  Description of Artificial Sequence: Synthetic peptide
  Seed: RGSRSYVPLA (PMEL_HUMAN)
RPSRSYVPLR

SEQ ID NO: 136776 - protein, 10 aa, Artificial Sequence
  Description of Artificial Sequence: Synthetic peptide
  Seed: RQLYPEWTEA (PMEL_HUMAN)
RCLYPEWTEF

SEQ ID NO: 136777 - protein, 10 aa, Artificial Sequence
  Description of Artificial Sequence: Synthetic peptide
  Seed: GPLLDGTATL (PMEL_HUMAN)
GILLDGTATV

SEQ ID NO: 136778 - protein, 10 aa, Artificial Sequence
  Description of Artificial Sequence: Synthetic peptide
  Seed: SRALVVTHTY (PMEL_HUMAN)
SMALVVTHTF

SEQ ID NO: 136779 - protein, 9 aa, Artificial Sequence
  Description of Artificial Sequence: Synthetic peptide
  Seed: VTAQVVLQA (PMEL_HUMAN)
VIAQVVLQV

SEQ ID NO: 136780 - protein, 10 aa, Artificial Sequence
  Description of Artificial Sequence: Synthetic peptide
  Seed: SVTLDIVQGI (PMEL_HUMAN)
SVTLDIVQGV

SEQ ID NO: 136781 - protein, 10 aa, Artificial Sequence
  Description of Artificial Sequence: Synthetic peptide
  Seed: YVPLAHSSSA (PMEL_HUMAN)
YFPLAHSSSA

SEQ ID NO: 136782 - protein, 9 aa, Artificial Sequence
  Description of Artificial Sequence: Synthetic peptide
  Seed: AHSSSAFTI (PMEL_HUMAN)
AQSSSAFTF

SEQ ID NO: 136783 - protein, 9 aa, Artificial Sequence
  Description of Artificial Sequence: Synthetic peptide
  Seed: RAMLGTHTM (PMEL_HUMAN)
RNMLGTHTM

SEQ ID NO: 136784 - protein, 10 aa, Artificial Sequence
  Description of Artificial Sequence: Synthetic peptide
  Seed: EVSIVVLSGT (PMEL_HUMAN)
EHSIVVLSGV

SEQ ID NO: 136785 - protein, 11 aa, Artificial Sequence
  Description of Artificial Sequence: Synthetic peptide
  Seed: MPTAESTGMTP (PMEL_HUMAN)
MPTAESTGMTF

SEQ ID NO: 136786 - protein, 10 aa, Artificial Sequence
  Description of Artificial Sequence: Synthetic peptide
  Seed: LAVIGALLAV (PMEL_HUMAN)
LAVIGALLAI

SEQ ID NO: 136787 - protein, 10 aa, Artificial Sequence
  Description of Artificial Sequence: Synthetic peptide
  Seed: GSFSVTLDIV (PMEL_HUMAN)
GLFSVTLDII

SEQ ID NO: 136788 - protein, 10 aa, Artificial Sequence
  Description of Artificial Sequence: Synthetic peptide
  Seed: MAVVLASLIY (PMEL_HUMAN)
MSVVLASLIM

SEQ ID NO: 136789 - protein, 10 aa, Artificial Sequence
  Description of Artificial Sequence: Synthetic peptide
  Seed: LIMPGQEAGL (PMEL_HUMAN)
LQMPGQEAGI

SEQ ID NO: 136790 - protein, 10 aa, Artificial Sequence
  Description of Artificial Sequence: Synthetic peptide
  Seed: QILKGGSGTY (PMEL_HUMAN)
QMLKGGSGTY

SEQ ID NO: 136791 - protein, 8 aa, Artificial Sequence
  Description of Artificial Sequence: Synthetic peptide
  Seed: SNDGPTLI (PMEL_HUMAN)
SSDGPTLL

SEQ ID NO: 136792 - protein, 10 aa, Artificial Sequence
  Description of Artificial Sequence: Synthetic peptide
  Seed: MKQDFSVPQL (PMEL_HUMAN)
MLQDFSVPQY

SEQ ID NO: 136793 - protein, 9 aa, Artificial Sequence
  Description of Artificial Sequence: Synthetic peptide
  Seed: AEPSGTTSV (PMEL_HUMAN)
ATPSGTTSL

SEQ ID NO: 136794 - protein, 9 aa, Artificial Sequence
  Description of Artificial Sequence: Synthetic peptide
  Seed: TYLEPGPVT (PMEL_HUMAN)
TFLEPGPVM

SEQ ID NO: 136795 - protein, 10 aa, Artificial Sequence
  Description of Artificial Sequence: Synthetic peptide
  Seed: RQVPLDCVLY (PMEL_HUMAN)
RMVPLDCVLY

SEQ ID NO: 136796 - protein, 9 aa, Artificial Sequence
  Description of Artificial Sequence: Synthetic peptide
  Seed: KHFLRNQPL (PMEL_HUMAN)
KWFLRNQPL

SEQ ID NO: 136797 - protein, 10 aa, Artificial Sequence
  Description of Artificial Sequence: Synthetic peptide
  Seed: TAEPSGTTSV (PMEL_HUMAN)
TSEPSGTTSL

SEQ ID NO: 136798 - protein, 10 aa, Artificial Sequence
  Description of Artificial Sequence: Synthetic peptide
  Seed: EVVGTTPGQA (PMEL_HUMAN)
EIVGTTPGQR

SEQ ID NO: 136799 - protein, 10 aa, Artificial Sequence
  Description of Artificial Sequence: Synthetic peptide
  Seed: SLIYRRRLMK (PMEL_HUMAN)
SEIYRRRLMR

SEQ ID NO: 136800 - protein, 9 aa, Artificial Sequence
  Description of Artificial Sequence: Synthetic peptide
  Seed: SQKRSFVYV (PMEL_HUMAN)
SVKRSFVYY

SEQ ID NO: 136801 - protein, 10 aa, Artificial Sequence
  Description of Artificial Sequence: Synthetic peptide
  Seed: VPLAHSSSAF (PMEL_HUMAN)
VILAHSSSAF

SEQ ID NO: 136802 - protein, 9 aa, Artificial Sequence
  Description of Artificial Sequence: Synthetic peptide
  Seed: SSHWLRLPR (PMEL_HUMAN)
STHWLRLPV

SEQ ID NO: 136803 - protein, 8 aa, Artificial Sequence
  Description of Artificial Sequence: Synthetic peptide
  Seed: YGSFSVTL (PMEL_HUMAN)
YASFSVTL

SEQ ID NO: 136804 - protein, 9 aa, Artificial Sequence
  Description of Artificial Sequence: Synthetic peptide
  Seed: DQVPFSVSV (PMEL_HUMAN)
DMVPFSVSV

SEQ ID NO: 136805 - protein, 11 aa, Artificial Sequence
  Description of Artificial Sequence: Synthetic peptide
  Seed: RALDGGNKHFL (PMEL_HUMAN)
RSLDGGNKHFR

SEQ ID NO: 136806 - protein, 9 aa, Artificial Sequence
  Description of Artificial Sequence: Synthetic peptide
  Seed: AEADLSYTW (PMEL_HUMAN)
AIADLSYTW

SEQ ID NO: 136807 - protein, 8 aa, Artificial Sequence
  Description of Artificial Sequence: Synthetic peptide
  Seed: VPFSVSVS (PMEL_HUMAN)
VPFSVSVA

SEQ ID NO: 136808 - protein, 9 aa, Artificial Sequence
  Description of Artificial Sequence: Synthetic peptide
  Seed: VLASLIYRR (PMEL_HUMAN)
VMASLIYRL

SEQ ID NO: 136809 - protein, 9 aa, Artificial Sequence
  Description of Artificial Sequence: Synthetic peptide
  Seed: SQVWGGQPV (PMEL_HUMAN)
SQVWGGQPY

SEQ ID NO: 136810 - protein, 10 aa, Artificial Sequence
  Description of Artificial Sequence: Synthetic peptide
  Seed: LQLHDPSGYL (PMEL_HUMAN)
LILHDPSGYV

SEQ ID NO: 136811 - protein, 10 aa, Artificial Sequence
  Description of Artificial Sequence: Synthetic peptide
  Seed: ESITGSLGPL (PMEL_HUMAN)
EIITGSLGPK

SEQ ID NO: 136812 - protein, 9 aa, Artificial Sequence
  Description of Artificial Sequence: Synthetic peptide
  Seed: YLEPGPVTA (PMEL_HUMAN)
YQEPGPVTI

SEQ ID NO: 136813 - protein, 9 aa, Artificial Sequence
  Description of Artificial Sequence: Synthetic peptide
  Seed: LQAAIPLTS (PMEL_HUMAN)
LAAAIPLTM

SEQ ID NO: 136814 - protein, 9 aa, Artificial Sequence
  Description of Artificial Sequence: Synthetic peptide
  Seed: LQAAIPLTS (PMEL_HUMAN)
LIAAIPLTF

SEQ ID NO: 136815 - protein, 9 aa, Artificial Sequence
  Description of Artificial Sequence: Synthetic peptide
  Seed: GQVPLIVGI (PMEL_HUMAN)
GIVPLIVGI

SEQ ID NO: 136816 - protein, 9 aa, Artificial Sequence
  Description of Artificial Sequence: Synthetic peptide
  Seed: LSIGTGRAM (PMEL_HUMAN)
LQIGTGRAF

SEQ ID NO: 136817 - protein, 10 aa, Artificial Sequence
  Description of Artificial Sequence: Synthetic peptide
  Seed: GRAMLGTHTM (PMEL_HUMAN)
GQAMLGTHTF

SEQ ID NO: 136818 - protein, 10 aa, Artificial Sequence
  Description of Artificial Sequence: Synthetic peptide
  Seed: RRLMKQDFSV (PMEL_HUMAN)
RRLMKQDFSL

SEQ ID NO: 136819 - protein, 10 aa, Artificial Sequence
  Description of Artificial Sequence: Synthetic peptide
  Seed: AVVLASLIYR (PMEL_HUMAN)
AEVLASLIYR

SEQ ID NO: 136820 - protein, 10 aa, Artificial Sequence
  Description of Artificial Sequence: Synthetic peptide
  Seed: DGTATLRLVK (PMEL_HUMAN)
DVTATLRLVR

SEQ ID NO: 136821 - protein, 10 aa, Artificial Sequence
  Description of Artificial Sequence: Synthetic peptide
  Seed: VSLADTNSLA (PMEL_HUMAN)
VQLADTNSLL

SEQ ID NO: 136822 - protein, 9 aa, Artificial Sequence
  Description of Artificial Sequence: Synthetic peptide
  Seed: YRYGSFSVT (PMEL_HUMAN)
YKYGSFSVA

SEQ ID NO: 136823 - protein, 9 aa, Artificial Sequence
  Description of Artificial Sequence: Synthetic peptide
  Seed: MAVVLASLI (PMEL_HUMAN)
MPVVLASLF

SEQ ID NO: 136824 - protein, 10 aa, Artificial Sequence
  Description of Artificial Sequence: Synthetic peptide
  Seed: MAVVLASLIY (PMEL_HUMAN)
MTVVLASLIW

SEQ ID NO: 136825 - protein, 11 aa, Artificial Sequence
  Description of Artificial Sequence: Synthetic peptide
  Seed: FGDSSGTLISR (PMEL_HUMAN)
FIDSSGTLISM

SEQ ID NO: 136826 - protein, 9 aa, Artificial Sequence
  Description of Artificial Sequence: Synthetic peptide
  Seed: MAVVLASLI (PMEL_HUMAN)
MLVVLASLI

SEQ ID NO: 136827 - protein, 10 aa, Artificial Sequence
  Description of Artificial Sequence: Synthetic peptide
  Seed: FSVSVSQLRA (PMEL_HUMAN)
FEVSVSQLRR

SEQ ID NO: 136828 - protein, 9 aa, Artificial Sequence
  Description of Artificial Sequence: Synthetic peptide
  Seed: VQMPTAEST (PMEL_HUMAN)
VVMPTAESI

SEQ ID NO: 136829 - protein, 9 aa, Artificial Sequence
  Description of Artificial Sequence: Synthetic peptide
  Seed: VSLADTNSL (PMEL_HUMAN)
VQLADTNSW

SEQ ID NO: 136830 - protein, 9 aa, Artificial Sequence
  Description of Artificial Sequence: Synthetic peptide
  Seed: KTWGQYWQV (PMEL_HUMAN)
KSWGQYWQV

SEQ ID NO: 136831 - protein, 10 aa, Artificial Sequence
  Description of Artificial Sequence: Synthetic peptide
  Seed: VLSGTTAAQV (PMEL_HUMAN)
VMSGTTAAQL

SEQ ID NO: 136832 - protein, 10 aa, Artificial Sequence
  Description of Artificial Sequence: Synthetic peptide
  Seed: YVPLAHSSSA (PMEL_HUMAN)
YCPLAHSSSI

SEQ ID NO: 136833 - protein, 9 aa, Artificial Sequence
  Description of Artificial Sequence: Synthetic peptide
  Seed: ISRALVVTH (PMEL_HUMAN)
ISRALVVTY

SEQ ID NO: 136834 - protein, 10 aa, Artificial Sequence
  Description of Artificial Sequence: Synthetic peptide
  Seed: SLIYRRRLMK (PMEL_HUMAN)
SVIYRRRLMK

SEQ ID NO: 136835 - protein, 9 aa, Artificial Sequence
  Description of Artificial Sequence: Synthetic peptide
  Seed: VWKTWGQYW (PMEL_HUMAN)
VWKTWGQYF

SEQ ID NO: 136836 - protein, 10 aa, Artificial Sequence
  Description of Artificial Sequence: Synthetic peptide
  Seed: RQLYPEWTEA (PMEL_HUMAN)
RDLYPEWTEL

SEQ ID NO: 136837 - protein, 9 aa, Artificial Sequence
  Description of Artificial Sequence: Synthetic peptide
  Seed: RALVVTHTY (PMEL_HUMAN)
RTLVVTHTL

SEQ ID NO: 136838 - protein, 10 aa, Artificial Sequence
  Description of Artificial Sequence: Synthetic peptide
  Seed: YLAEADLSYT (PMEL_HUMAN)
YLAEADLSYM

SEQ ID NO: 136839 - protein, 9 aa, Artificial Sequence
  Description of Artificial Sequence: Synthetic peptide
  Seed: ILKGGSGTY (PMEL_HUMAN)
IVKGGSGTM

SEQ ID NO: 136840 - protein, 9 aa, Artificial Sequence
  Description of Artificial Sequence: Synthetic peptide
  Seed: QVWGGQPVY (PMEL_HUMAN)
QAWGGQPVK

SEQ ID NO: 136841 - protein, 9 aa, Artificial Sequence
  Description of Artificial Sequence: Synthetic peptide
  Seed: LAVVSTQLI (PMEL_HUMAN)
LSVVSTQLW

SEQ ID NO: 136842 - protein, 9 aa, Artificial Sequence
  Description of Artificial Sequence: Synthetic peptide
  Seed: ITDQVPFSV (PMEL_HUMAN)
ITDQVPFSL

SEQ ID NO: 136843 - protein, 9 aa, Artificial Sequence
  Description of Artificial Sequence: Synthetic peptide
  Seed: SSHWLRLPR (PMEL_HUMAN)
STHWLRLPI

SEQ ID NO: 136844 - protein, 10 aa, Artificial Sequence
  Description of Artificial Sequence: Synthetic peptide
  Seed: GPLLDGTATL (PMEL_HUMAN)
GSLLDGTATV

SEQ ID NO: 136845 - protein, 8 aa, Artificial Sequence
  Description of Artificial Sequence: Synthetic peptide
  Seed: LAHSSSAF (PMEL_HUMAN)
LQHSSSAL

SEQ ID NO: 136846 - protein, 9 aa, Artificial Sequence
  Description of Artificial Sequence: Synthetic peptide
  Seed: LQAAIPLTS (PMEL_HUMAN)
LMAAIPLTL

SEQ ID NO: 136847 - protein, 9 aa, Artificial Sequence
  Description of Artificial Sequence: Synthetic peptide
  Seed: VSEVMGTTL (PMEL_HUMAN)
VAEVMGTTF

SEQ ID NO: 136848 - protein, 9 aa, Artificial Sequence
  Description of Artificial Sequence: Synthetic peptide
  Seed: RNQPLTFAL (PMEL_HUMAN)
RKQPLTFAF

SEQ ID NO: 136849 - protein, 9 aa, Artificial Sequence
  Description of Artificial Sequence: Synthetic peptide
  Seed: SQKRSFVYV (PMEL_HUMAN)
STKRSFVYR

SEQ ID NO: 136850 - protein, 9 aa, Artificial Sequence
  Description of Artificial Sequence: Synthetic peptide
  Seed: GTYCLNVSL (PMEL_HUMAN)
GLYCLNVSY

SEQ ID NO: 136851 - protein, 9 aa, Artificial Sequence
  Description of Artificial Sequence: Synthetic peptide
  Seed: YLAEADLSY (PMEL_HUMAN)
YRAEADLSI

SEQ ID NO: 136852 - protein, 10 aa, Artificial Sequence
  Description of Artificial Sequence: Synthetic peptide
  Seed: MPTAESTGMT (PMEL_HUMAN)
MPTAESTGML

SEQ ID NO: 136853 - protein, 9 aa, Artificial Sequence
  Description of Artificial Sequence: Synthetic peptide
  Seed: QDFSVPQLP (PMEL_HUMAN)
QEFSVPQLI

SEQ ID NO: 136854 - protein, 10 aa, Artificial Sequence
  Description of Artificial Sequence: Synthetic peptide
  Seed: YRYGSFSVTL (PMEL_HUMAN)
YFYGSFSVTF

SEQ ID NO: 136855 - protein, 9 aa, Artificial Sequence
  Description of Artificial Sequence: Synthetic peptide
  Seed: STAPVQMPT (PMEL_HUMAN)
SAAPVQMPV

SEQ ID NO: 136856 - protein, 11 aa, Artificial Sequence
  Description of Artificial Sequence: Synthetic peptide
  Seed: YLAEADLSYTW (PMEL_HUMAN)
YVAEADLSYTL

SEQ ID NO: 136857 - protein, 10 aa, Artificial Sequence
  Description of Artificial Sequence: Synthetic peptide
  Seed: SQVWGGQPVY (PMEL_HUMAN)
SVVWGGQPVF

SEQ ID NO: 136858 - protein, 9 aa, Artificial Sequence
  Description of Artificial Sequence: Synthetic peptide
  Seed: LIVGILLVL (PMEL_HUMAN)
LVVGILLVA

SEQ ID NO: 136859 - protein, 8 aa, Artificial Sequence
  Description of Artificial Sequence: Synthetic peptide
  Seed: SNDGPTLI (PMEL_HUMAN)
SVDGPTLV

SEQ ID NO: 136860 - protein, 10 aa, Artificial Sequence
  Description of Artificial Sequence: Synthetic peptide
  Seed: KRQVPLDCVL (PMEL_HUMAN)
KYQVPLDCVF

SEQ ID NO: 136861 - protein, 10 aa, Artificial Sequence
  Description of Artificial Sequence: Synthetic peptide
  Seed: NASFSIALNF (PMEL_HUMAN)
NLSFSIALNW

SEQ ID NO: 136862 - protein, 11 aa, Artificial Sequence
  Description of Artificial Sequence: Synthetic peptide
  Seed: QAVPSGEGDAF (PMEL_HUMAN)
QLVPSGEGDAL

SEQ ID NO: 136863 - protein, 10 aa, Artificial Sequence
  Description of Artificial Sequence: Synthetic peptide
  Seed: MTPAEVSIVV (PMEL_HUMAN)
MEPAEVSIVW

SEQ ID NO: 136864 - protein, 9 aa, Artificial Sequence
  Description of Artificial Sequence: Synthetic peptide
  Seed: LSIGTGRAM (PMEL_HUMAN)
LMIGTGRAM

SEQ ID NO: 136865 - protein, 9 aa, Artificial Sequence
  Description of Artificial Sequence: Synthetic peptide
  Seed: MAVVLASLI (PMEL_HUMAN)
MLVVLASLY

SEQ ID NO: 136866 - protein, 10 aa, Artificial Sequence
  Description of Artificial Sequence: Synthetic peptide
  Seed: LMAVVLASLI (PMEL_HUMAN)
LMAVVLASLM

SEQ ID NO: 136867 - protein, 9 aa, Artificial Sequence
  Description of Artificial Sequence: Synthetic peptide
  Seed: RAMLGTHTM (PMEL_HUMAN)
RTMLGTHTI

SEQ ID NO: 136868 - protein, 9 aa, Artificial Sequence
  Description of Artificial Sequence: Synthetic peptide
  Seed: TTDGHRPTA (PMEL_HUMAN)
TGDGHRPTV

SEQ ID NO: 136869 - protein, 9 aa, Artificial Sequence
  Description of Artificial Sequence: Synthetic peptide
  Seed: DIVQGIESA (PMEL_HUMAN)
DTVQGIESA

SEQ ID NO: 136870 - protein, 9 aa, Artificial Sequence
  Description of Artificial Sequence: Synthetic peptide
  Seed: SGLSIGTGR (PMEL_HUMAN)
SMLSIGTGR

SEQ ID NO: 136871 - protein, 9 aa, Artificial Sequence
  Description of Artificial Sequence: Synthetic peptide
  Seed: TAEAPNTTA (PMEL_HUMAN)
TIEAPNTTV

SEQ ID NO: 136872 - protein, 9 aa, Artificial Sequence
  Description of Artificial Sequence: Synthetic peptide
  Seed: FGDSSGTLI (PMEL_HUMAN)
FADSSGTLF

SEQ ID NO: 136873 - protein, 9 aa, Artificial Sequence
  Description of Artificial Sequence: Synthetic peptide
  Seed: VLPSPACQL (PMEL_HUMAN)
VFPSPACQF

SEQ ID NO: 136874 - protein, 10 aa, Artificial Sequence
  Description of Artificial Sequence: Synthetic peptide
  Seed: KTWGQYWQVL (PMEL_HUMAN)
KSWGQYWQVF

SEQ ID NO: 136875 - protein, 9 aa, Artificial Sequence
  Description of Artificial Sequence: Synthetic peptide
  Seed: VSVSQLRAL (PMEL_HUMAN)
VMVSQLRAM

SEQ ID NO: 136876 - protein, 10 aa, Artificial Sequence
  Description of Artificial Sequence: Synthetic peptide
  Seed: LVLMAVVLAS (PMEL_HUMAN)
LNLMAVVLAM

SEQ ID NO: 136877 - protein, 9 aa, Artificial Sequence
  Description of Artificial Sequence: Synthetic peptide
  Seed: VTLDIVQGI (PMEL_HUMAN)
VALDIVQGV

SEQ ID NO: 136878 - protein, 9 aa, Artificial Sequence
  Description of Artificial Sequence: Synthetic peptide
  Seed: QVWGGQPVY (PMEL_HUMAN)
QMWGGQPVM

SEQ ID NO: 136879 - protein, 9 aa, Artificial Sequence
  Description of Artificial Sequence: Synthetic peptide
  Seed: AVVSTQLIM (PMEL_HUMAN)
ATVSTQLIW

SEQ ID NO: 136880 - protein, 9 aa, Artificial Sequence
  Description of Artificial Sequence: Synthetic peptide
  Seed: AEPSGTTSV (PMEL_HUMAN)
AAPSGTTSC

SEQ ID NO: 136881 - protein, 9 aa, Artificial Sequence
  Description of Artificial Sequence: Synthetic peptide
  Seed: EVVGTTPGQ (PMEL_HUMAN)
ETVGTTPGR

SEQ ID NO: 136882 - protein, 9 aa, Artificial Sequence
  Description of Artificial Sequence: Synthetic peptide
  Seed: ESAEILQAV (PMEL_HUMAN)
EEAEILQAF

SEQ ID NO: 136883 - protein, 11 aa, Artificial Sequence
  Description of Artificial Sequence: Synthetic peptide
  Seed: FGDSSGTLISR (PMEL_HUMAN)
FQDSSGTLISM

SEQ ID NO: 136884 - protein, 9 aa, Artificial Sequence
  Description of Artificial Sequence: Synthetic peptide
  Seed: ITDQVPFSV (PMEL_HUMAN)
IGDQVPFSI

SEQ ID NO: 136885 - protein, 10 aa, Artificial Sequence
  Description of Artificial Sequence: Synthetic peptide
  Seed: SQVWGGQPVY (PMEL_HUMAN)
SEVWGGQPVF

SEQ ID NO: 136886 - protein, 9 aa, Artificial Sequence
  Description of Artificial Sequence: Synthetic peptide
  Seed: YLEPGPVTA (PMEL_HUMAN)
YFEPGPVTC

SEQ ID NO: 136887 - protein, 9 aa, Artificial Sequence
  Description of Artificial Sequence: Synthetic peptide
  Seed: TLISRALVV (PMEL_HUMAN)
TSISRALVF

SEQ ID NO: 136888 - protein, 9 aa, Artificial Sequence
  Description of Artificial Sequence: Synthetic peptide
  Seed: MSTPEATGM (PMEL_HUMAN)
MTTPEATGY

SEQ ID NO: 136889 - protein, 9 aa, Artificial Sequence
  Description of Artificial Sequence: Synthetic peptide
  Seed: RNQPLTFAL (PMEL_HUMAN)
RLQPLTFAY

SEQ ID NO: 136890 - protein, 9 aa, Artificial Sequence
  Description of Artificial Sequence: Synthetic peptide
  Seed: SQKRSFVYV (PMEL_HUMAN)
STKRSFVYI

SEQ ID NO: 136891 - protein, 9 aa, Artificial Sequence
  Description of Artificial Sequence: Synthetic peptide
  Seed: VPFSVSVSQ (PMEL_HUMAN)
VTFSVSVSF

SEQ ID NO: 136892 - protein, 10 aa, Artificial Sequence
  Description of Artificial Sequence: Synthetic peptide
  Seed: YLAEADLSYT (PMEL_HUMAN)
YMAEADLSYE

SEQ ID NO: 136893 - protein, 9 aa, Artificial Sequence
  Description of Artificial Sequence: Synthetic peptide
  Seed: ALDGGNKHF (PMEL_HUMAN)
ATDGGNKHV

SEQ ID NO: 136894 - protein, 9 aa, Artificial Sequence
  Description of Artificial Sequence: Synthetic peptide
  Seed: ESAEILQAV (PMEL_HUMAN)
EQAEILQAR

SEQ ID NO: 136895 - protein, 10 aa, Artificial Sequence
  Description of Artificial Sequence: Synthetic peptide
  Seed: MTPAEVSIVV (PMEL_HUMAN)
MQPAEVSIVH

SEQ ID NO: 136896 - protein, 9 aa, Artificial Sequence
  Description of Artificial Sequence: Synthetic peptide
  Seed: KTWGQYWQV (PMEL_HUMAN)
KAWGQYWQM

SEQ ID NO: 136897 - protein, 9 aa, Artificial Sequence
  Description of Artificial Sequence: Synthetic peptide
  Seed: VQMPTAEST (PMEL_HUMAN)
VVMPTAESV

SEQ ID NO: 136898 - protein, 11 aa, Artificial Sequence
  Description of Artificial Sequence: Synthetic peptide
  Seed: LPIPEPEGPDA (PMEL_HUMAN)
LPIPEPEGPDY

SEQ ID NO: 136899 - protein, 11 aa, Artificial Sequence
  Description of Artificial Sequence: Synthetic peptide
  Seed: YLAEADLSYTW (PMEL_HUMAN)
YWAEADLSYTW

SEQ ID NO: 136900 - protein, 9 aa, Artificial Sequence
  Description of Artificial Sequence: Synthetic peptide
  Seed: VLQAAIPLT (PMEL_HUMAN)
VQQAAIPLL

SEQ ID NO: 136901 - protein, 9 aa, Artificial Sequence
  Description of Artificial Sequence: Synthetic peptide
  Seed: AESTGMTPE (PMEL_HUMAN)
AESTGMTPC

SEQ ID NO: 136902 - protein, 9 aa, Artificial Sequence
  Description of Artificial Sequence: Synthetic peptide
  Seed: TTPGQAPTA (PMEL_HUMAN)
TLPGQAPTL

SEQ ID NO: 136903 - protein, 9 aa, Artificial Sequence
  Description of Artificial Sequence: Synthetic peptide
  Seed: ASFSIALNF (PMEL_HUMAN)
AVFSIALNW

SEQ ID NO: 136904 - protein, 10 aa, Artificial Sequence
  Description of Artificial Sequence: Synthetic peptide
  Seed: YRYGSFSVTL (PMEL_HUMAN)
YNYGSFSVTW

SEQ ID NO: 136905 - protein, 9 aa, Artificial Sequence
  Description of Artificial Sequence: Synthetic peptide
  Seed: VETTARELP (PMEL_HUMAN)
VETTARELL

SEQ ID NO: 136906 - protein, 10 aa, Artificial Sequence
  Description of Artificial Sequence: Synthetic peptide
  Seed: VSLADTNSLA (PMEL_HUMAN)
VVLADTNSLV

SEQ ID NO: 136907 - protein, 9 aa, Artificial Sequence
  Description of Artificial Sequence: Synthetic peptide
  Seed: VQVPTTEVI (PMEL_HUMAN)
VPVPTTEVF

SEQ ID NO: 136908 - protein, 9 aa, Artificial Sequence
  Description of Artificial Sequence: Synthetic peptide
  Seed: LHLAVIGAL (PMEL_HUMAN)
LVLAVIGAF

SEQ ID NO: 136909 - protein, 9 aa, Artificial Sequence
  Description of Artificial Sequence: Synthetic peptide
  Seed: FGDSSGTLI (PMEL_HUMAN)
FIDSSGTLV

SEQ ID NO: 136910 - protein, 9 aa, Artificial Sequence
  Description of Artificial Sequence: Synthetic peptide
  Seed: YLAEADLSY (PMEL_HUMAN)
YMAEADLSY

SEQ ID NO: 136911 - protein, 9 aa, Artificial Sequence
  Description of Artificial Sequence: Synthetic peptide
  Seed: SITGSLGPL (PMEL_HUMAN)
SITGSLGPI

SEQ ID NO: 136912 - protein, 9 aa, Artificial Sequence
  Description of Artificial Sequence: Synthetic peptide
  Seed: RAMLGTHTM (PMEL_HUMAN)
RSMLGTHTL

SEQ ID NO: 136913 - protein, 10 aa, Artificial Sequence
  Description of Artificial Sequence: Synthetic peptide
  Seed: APTAEPSGTT (PMEL_HUMAN)
APTAEPSGTL

SEQ ID NO: 136914 - protein, 9 aa, Artificial Sequence
  Description of Artificial Sequence: Synthetic peptide
  Seed: LYRYGSFSV (PMEL_HUMAN)
LVRYGSFSA

SEQ ID NO: 136915 - protein, 10 aa, Artificial Sequence
  Description of Artificial Sequence: Synthetic peptide
  Seed: IALNFPGSQK (PMEL_HUMAN)
IYLNFPGSQK

SEQ ID NO: 136916 - protein, 9 aa, Artificial Sequence
  Description of Artificial Sequence: Synthetic peptide
  Seed: AEADLSYTW (PMEL_HUMAN)
ASADLSYTM

SEQ ID NO: 136917 - protein, 9 aa, Artificial Sequence
  Description of Artificial Sequence: Synthetic peptide
  Seed: GVSRQLRTK (PMEL_HUMAN)
GMSRQLRTK

SEQ ID NO: 136918 - protein, 9 aa, Artificial Sequence
  Description of Artificial Sequence: Synthetic peptide
  Seed: VVLQAAIPL (PMEL_HUMAN)
VNLQAAIPF

SEQ ID NO: 136919 - protein, 9 aa, Artificial Sequence
  Description of Artificial Sequence: Synthetic peptide
  Seed: SSIMSTESI (PMEL_HUMAN)
SLIMSTESY

SEQ ID NO: 136920 - protein, 11 aa, Artificial Sequence
  Description of Artificial Sequence: Synthetic peptide
  Seed: TVYHRRGSRSY (PMEL_HUMAN)
TQYHRRGSRSY

SEQ ID NO: 136921 - protein, 9 aa, Artificial Sequence
  Description of Artificial Sequence: Synthetic peptide
  Seed: GQVPLIVGI (PMEL_HUMAN)
GVVPLIVGM

SEQ ID NO: 136922 - protein, 11 aa, Artificial Sequence
  Description of Artificial Sequence: Synthetic peptide
  Seed: YVPLAHSSSAF (PMEL_HUMAN)
YYPLAHSSSAF

SEQ ID NO: 136923 - protein, 10 aa, Artificial Sequence
  Description of Artificial Sequence: Synthetic peptide
  Seed: QVLGGPVSGL (PMEL_HUMAN)
QMLGGPVSGV

SEQ ID NO: 136924 - protein, 8 aa, Artificial Sequence
  Description of Artificial Sequence: Synthetic peptide
  Seed: TLDIVQGI (PMEL_HUMAN)
TSDIVQGL

SEQ ID NO: 136925 - protein, 11 aa, Artificial Sequence
  Description of Artificial Sequence: Synthetic peptide
  Seed: YLAEADLSYTW (PMEL_HUMAN)
YIAEADLSYTV

SEQ ID NO: 136926 - protein, 9 aa, Artificial Sequence
  Description of Artificial Sequence: Synthetic peptide
  Seed: LQAAIPLTS (PMEL_HUMAN)
LAAAIPLTF

SEQ ID NO: 136927 - protein, 9 aa, Artificial Sequence
  Description of Artificial Sequence: Synthetic peptide
  Seed: AVGATKVPR (PMEL_HUMAN)
AVGATKVPK

SEQ ID NO: 136928 - protein, 8 aa, Artificial Sequence
  Description of Artificial Sequence: Synthetic peptide
  Seed: RSFVYVWK (PMEL_HUMAN)
RMFVYVWR

SEQ ID NO: 136929 - protein, 9 aa, Artificial Sequence
  Description of Artificial Sequence: Synthetic peptide
  Seed: AGQVPTTEV (PMEL_HUMAN)
ASQVPTTEM

SEQ ID NO: 136930 - protein, 9 aa, Artificial Sequence
  Description of Artificial Sequence: Synthetic peptide
  Seed: LADTNSLAV (PMEL_HUMAN)
LADTNSLAI

SEQ ID NO: 136931 - protein, 8 aa, Artificial Sequence
  Description of Artificial Sequence: Synthetic peptide
  Seed: LADTNSLA (PMEL_HUMAN)
LLDTNSLL

SEQ ID NO: 136932 - protein, 9 aa, Artificial Sequence
  Description of Artificial Sequence: Synthetic peptide
  Seed: SQVWGGQPV (PMEL_HUMAN)
SAVWGGQPI

SEQ ID NO: 136933 - protein, 10 aa, Artificial Sequence
  Description of Artificial Sequence: Synthetic peptide
  Seed: LADTNSLAVV (PMEL_HUMAN)
LMDTNSLAVM

SEQ ID NO: 136934 - protein, 9 aa, Artificial Sequence
  Description of Artificial Sequence: Synthetic peptide
  Seed: TAEAPNTTA (PMEL_HUMAN)
TIEAPNTTM

SEQ ID NO: 136935 - protein, 10 aa, Artificial Sequence
  Description of Artificial Sequence: Synthetic peptide
  Seed: SSSHWLRLPR (PMEL_HUMAN)
SRSHWLRLPK

SEQ ID NO: 136936 - protein, 9 aa, Artificial Sequence
  Description of Artificial Sequence: Synthetic peptide
  Seed: KTWGQYWQV (PMEL_HUMAN)
KWWGQYWQL

SEQ ID NO: 136937 - protein, 8 aa, Artificial Sequence
  Description of Artificial Sequence: Synthetic peptide
  Seed: LIYRRRLM (PMEL_HUMAN)
LAYRRRLL

SEQ ID NO: 136938 - protein, 10 aa, Artificial Sequence
  Description of Artificial Sequence: Synthetic peptide
  Seed: HFLRNQPLTF (PMEL_HUMAN)
HQLRNQPLTM

SEQ ID NO: 136939 - protein, 9 aa, Artificial Sequence
  Description of Artificial Sequence: Synthetic peptide
  Seed: VVLQAAIPL (PMEL_HUMAN)
VKLQAAIPL

SEQ ID NO: 136940 - protein, 10 aa, Artificial Sequence
  Description of Artificial Sequence: Synthetic peptide
  Seed: TAEPSGTTSV (PMEL_HUMAN)
TVEPSGTTSL

SEQ ID NO: 136941 - protein, 11 aa, Artificial Sequence
  Description of Artificial Sequence: Synthetic peptide
  Seed: THTMEVTVYHR (PMEL_HUMAN)
TYTMEVTVYHR

SEQ ID NO: 136942 - protein, 9 aa, Artificial Sequence
  Description of Artificial Sequence: Synthetic peptide
  Seed: QVWGGQPVY (PMEL_HUMAN)
QMWGGQPVF

SEQ ID NO: 136943 - protein, 8 aa, Artificial Sequence
  Description of Artificial Sequence: Synthetic peptide
  Seed: FGDSSGTL (PMEL_HUMAN)
FIDSSGTL

SEQ ID NO: 136944 - protein, 11 aa, Artificial Sequence
  Description of Artificial Sequence: Synthetic peptide
  Seed: RYGSFSVTLDI (PMEL_HUMAN)
RYGSFSVTLDY

SEQ ID NO: 136945 - protein, 11 aa, Artificial Sequence
  Description of Artificial Sequence: Synthetic peptide
  Seed: RRRLMKQDFSV (PMEL_HUMAN)
RGRLMKQDFSV

SEQ ID NO: 136946 - protein, 10 aa, Artificial Sequence
  Description of Artificial Sequence: Synthetic peptide
  Seed: ASSIMSTESI (PMEL_HUMAN)
AGSIMSTESF

SEQ ID NO: 136947 - protein, 10 aa, Artificial Sequence
  Description of Artificial Sequence: Synthetic peptide
  Seed: MAVVLASLIY (PMEL_HUMAN)
MQVVLASLIM

SEQ ID NO: 136948 - protein, 9 aa, Artificial Sequence
  Description of Artificial Sequence: Synthetic peptide
  Seed: KTWGQYWQV (PMEL_HUMAN)
KFWGQYWQR

SEQ ID NO: 136949 - protein, 9 aa, Artificial Sequence
  Description of Artificial Sequence: Synthetic peptide
  Seed: HTMEVTVYH (PMEL_HUMAN)
HPMEVTVYR

SEQ ID NO: 136950 - protein, 9 aa, Artificial Sequence
  Description of Artificial Sequence: Synthetic peptide
  Seed: KTWGQYWQV (PMEL_HUMAN)
KSWGQYWQF

SEQ ID NO: 136951 - protein, 9 aa, Artificial Sequence
  Description of Artificial Sequence: Synthetic peptide
  Seed: KHFLRNQPL (PMEL_HUMAN)
KYFLRNQPL

SEQ ID NO: 136952 - protein, 10 aa, Artificial Sequence
  Description of Artificial Sequence: Synthetic peptide
  Seed: LVLMAVVLAS (PMEL_HUMAN)
LGLMAVVLAA

SEQ ID NO: 136953 - protein, 10 aa, Artificial Sequence
  Description of Artificial Sequence: Synthetic peptide
  Seed: GDSSGTLISR (PMEL_HUMAN)
GTSSGTLISY

SEQ ID NO: 136954 - protein, 10 aa, Artificial Sequence
  Description of Artificial Sequence: Synthetic peptide
  Seed: RQVPLDCVLY (PMEL_HUMAN)
RVVPLDCVLY

SEQ ID NO: 136955 - protein, 9 aa, Artificial Sequence
  Description of Artificial Sequence: Synthetic peptide
  Seed: KHFLRNQPL (PMEL_HUMAN)
KQFLRNQPV

SEQ ID NO: 136956 - protein, 9 aa, Artificial Sequence
  Description of Artificial Sequence: Synthetic peptide
  Seed: YRYGSFSVT (PMEL_HUMAN)
YKYGSFSVM

SEQ ID NO: 136957 - protein, 9 aa, Artificial Sequence
  Description of Artificial Sequence: Synthetic peptide
  Seed: AEADLSYTW (PMEL_HUMAN)
AEADLSYTT

SEQ ID NO: 136958 - protein, 11 aa, Artificial Sequence
  Description of Artificial Sequence: Synthetic peptide
  Seed: NNTIINGSQVW (PMEL_HUMAN)
NSTIINGSQVW

SEQ ID NO: 136959 - protein, 9 aa, Artificial Sequence
  Description of Artificial Sequence: Synthetic peptide
  Seed: VMGTTLAEM (PMEL_HUMAN)
VYGTTLAEF

SEQ ID NO: 136960 - protein, 10 aa, Artificial Sequence
  Description of Artificial Sequence: Synthetic peptide
  Seed: GSFSVTLDIV (PMEL_HUMAN)
GMFSVTLDIM

SEQ ID NO: 136961 - protein, 10 aa, Artificial Sequence
  Description of Artificial Sequence: Synthetic peptide
  Seed: SVPQLPHSSS (PMEL_HUMAN)
SRPQLPHSSF

SEQ ID NO: 136962 - protein, 9 aa, Artificial Sequence
  Description of Artificial Sequence: Synthetic peptide
  Seed: QVWGGQPVY (PMEL_HUMAN)
QAWGGQPVW

SEQ ID NO: 136963 - protein, 9 aa, Artificial Sequence
  Description of Artificial Sequence: Synthetic peptide
  Seed: AVVLASLIY (PMEL_HUMAN)
APVLASLIM

SEQ ID NO: 136964 - protein, 10 aa, Artificial Sequence
  Description of Artificial Sequence: Synthetic peptide
  Seed: RGSRSYVPLA (PMEL_HUMAN)
RASRSYVPLI

SEQ ID NO: 136965 - protein, 9 aa, Artificial Sequence
  Description of Artificial Sequence: Synthetic peptide
  Seed: KVLPDGQVI (PMEL_HUMAN)
KQLPDGQVF

SEQ ID NO: 136966 - protein, 10 aa, Artificial Sequence
  Description of Artificial Sequence: Synthetic peptide
  Seed: SLIYRRRLMK (PMEL_HUMAN)
SSIYRRRLMK

SEQ ID NO: 136967 - protein, 10 aa, Artificial Sequence
  Description of Artificial Sequence: Synthetic peptide
  Seed: YLAEADLSYT (PMEL_HUMAN)
YQAEADLSYF

SEQ ID NO: 136968 - protein, 9 aa, Artificial Sequence
  Description of Artificial Sequence: Synthetic peptide
  Seed: VTLDIVQGI (PMEL_HUMAN)
VRLDIVQGI

SEQ ID NO: 136969 - protein, 9 aa, Artificial Sequence
  Description of Artificial Sequence: Synthetic peptide
  Seed: CPIGENSPL (PMEL_HUMAN)
CHIGENSPL

SEQ ID NO: 136970 - protein, 10 aa, Artificial Sequence
  Description of Artificial Sequence: Synthetic peptide
  Seed: RGSRSYVPLA (PMEL_HUMAN)
RFSRSYVPLA

SEQ ID NO: 136971 - protein, 10 aa, Artificial Sequence
  Description of Artificial Sequence: Synthetic peptide
  Seed: LAEADLSYTW (PMEL_HUMAN)
LSEADLSYTF

SEQ ID NO: 136972 - protein, 9 aa, Artificial Sequence
  Description of Artificial Sequence: Synthetic peptide
  Seed: SSHWLRLPR (PMEL_HUMAN)
SLHWLRLPK

SEQ ID NO: 136973 - protein, 9 aa, Artificial Sequence
  Description of Artificial Sequence: Synthetic peptide
  Seed: MTPAEVSIV (PMEL_HUMAN)
MSPAEVSIM

SEQ ID NO: 136974 - protein, 10 aa, Artificial Sequence
  Description of Artificial Sequence: Synthetic peptide
  Seed: ESAEILQAVP (PMEL_HUMAN)
EAAEILQAVL

SEQ ID NO: 136975 - protein, 9 aa, Artificial Sequence
  Description of Artificial Sequence: Synthetic peptide
  Seed: KVSNDGPTL (PMEL_HUMAN)
KVSNDGPTW

SEQ ID NO: 136976 - protein, 9 aa, Artificial Sequence
  Description of Artificial Sequence: Synthetic peptide
  Seed: VQVPTTEVI (PMEL_HUMAN)
VQVPTTEVL

SEQ ID NO: 136977 - protein, 9 aa, Artificial Sequence
  Description of Artificial Sequence: Synthetic peptide
  Seed: ALDGGNKHF (PMEL_HUMAN)
AIDGGNKHF

SEQ ID NO: 136978 - protein, 9 aa, Artificial Sequence
  Description of Artificial Sequence: Synthetic peptide
  Seed: VQMPTAEST (PMEL_HUMAN)
VQMPTAESM

SEQ ID NO: 136979 - protein, 9 aa, Artificial Sequence
  Description of Artificial Sequence: Synthetic peptide
  Seed: VMGTTLAEM (PMEL_HUMAN)
VLGTTLAEF

SEQ ID NO: 136980 - protein, 9 aa, Artificial Sequence
  Description of Artificial Sequence: Synthetic peptide
  Seed: HQILKGGSG (PMEL_HUMAN)
HQILKGGSA

SEQ ID NO: 136981 - protein, 11 aa, Artificial Sequence
  Description of Artificial Sequence: Synthetic peptide
  Seed: ASLIYRRRLMK (PMEL_HUMAN)
ALLIYRRRLMK

SEQ ID NO: 136982 - protein, 11 aa, Artificial Sequence
  Description of Artificial Sequence: Synthetic peptide
  Seed: RRRLMKQDFSV (PMEL_HUMAN)
RVRLMKQDFSV

SEQ ID NO: 136983 - protein, 9 aa, Artificial Sequence
  Description of Artificial Sequence: Synthetic peptide
  Seed: GSFSVTLDI (PMEL_HUMAN)
GIFSVTLDI

SEQ ID NO: 136984 - protein, 10 aa, Artificial Sequence
  Description of Artificial Sequence: Synthetic peptide
  Seed: TAAQVTTTEW (PMEL_HUMAN)
TQAQVTTTEW

SEQ ID NO: 136985 - protein, 9 aa, Artificial Sequence
  Description of Artificial Sequence: Synthetic peptide
  Seed: KTWGQYWQV (PMEL_HUMAN)
KQWGQYWQK

SEQ ID NO: 136986 - protein, 9 aa, Artificial Sequence
  Description of Artificial Sequence: Synthetic peptide
  Seed: CVLYRYGSF (PMEL_HUMAN)
CQLYRYGSL

SEQ ID NO: 136987 - protein, 9 aa, Artificial Sequence
  Description of Artificial Sequence: Synthetic peptide
  Seed: RLMKQDFSV (PMEL_HUMAN)
RMMKQDFSW

SEQ ID NO: 136988 - protein, 11 aa, Artificial Sequence
  Description of Artificial Sequence: Synthetic peptide
  Seed: FGDSSGTLISR (PMEL_HUMAN)
FMDSSGTLISY

SEQ ID NO: 136989 - protein, 10 aa, Artificial Sequence
  Description of Artificial Sequence: Synthetic peptide
  Seed: LVLKRCLLHL (PMEL_HUMAN)
LFLKRCLLHV

SEQ ID NO: 136990 - protein, 9 aa, Artificial Sequence
  Description of Artificial Sequence: Synthetic peptide
  Seed: RYGSFSVTL (PMEL_HUMAN)
RWGSFSVTL

SEQ ID NO: 136991 - protein, 9 aa, Artificial Sequence
  Description of Artificial Sequence: Synthetic peptide
  Seed: GQVPTTEVV (PMEL_HUMAN)
GAVPTTEVF

SEQ ID NO: 136992 - protein, 10 aa, Artificial Sequence
  Description of Artificial Sequence: Synthetic peptide
  Seed: YRYGSFSVTL (PMEL_HUMAN)
YHYGSFSVTW

SEQ ID NO: 136993 - protein, 8 aa, Artificial Sequence
  Description of Artificial Sequence: Synthetic peptide
  Seed: SNDGPTLI (PMEL_HUMAN)
SWDGPTLI

SEQ ID NO: 136994 - protein, 9 aa, Artificial Sequence
  Description of Artificial Sequence: Synthetic peptide
  Seed: YLAEADLSY (PMEL_HUMAN)
YCAEADLSM

SEQ ID NO: 136995 - protein, 9 aa, Artificial Sequence
  Description of Artificial Sequence: Synthetic peptide
  Seed: QVWGGQPVY (PMEL_HUMAN)
QVWGGQPVK

SEQ ID NO: 136996 - protein, 9 aa, Artificial Sequence
  Description of Artificial Sequence: Synthetic peptide
  Seed: AEADLSYTW (PMEL_HUMAN)
AQADLSYTY

SEQ ID NO: 136997 - protein, 10 aa, Artificial Sequence
  Description of Artificial Sequence: Synthetic peptide
  Seed: LSIGTGRAML (PMEL_HUMAN)
LAIGTGRAML

SEQ ID NO: 136998 - protein, 9 aa, Artificial Sequence
  Description of Artificial Sequence: Synthetic peptide
  Seed: SQKRSFVYV (PMEL_HUMAN)
SSKRSFVYR

SEQ ID NO: 136999 - protein, 10 aa, Artificial Sequence
  Description of Artificial Sequence: Synthetic peptide
  Seed: LVLMAVVLAS (PMEL_HUMAN)
LHLMAVVLAL

SEQ ID NO: 137000 - protein, 9 aa, Artificial Sequence
  Description of Artificial Sequence: Synthetic peptide
  Seed: GMTPAEVSI (PMEL_HUMAN)
GITPAEVSF

SEQ ID NO: 137001 - protein, 9 aa, Artificial Sequence
  Description of Artificial Sequence: Synthetic peptide
  Seed: SLAVVSTQL (PMEL_HUMAN)
SIAVVSTQW

SEQ ID NO: 137002 - protein, 9 aa, Artificial Sequence
  Description of Artificial Sequence: Synthetic peptide
  Seed: KAWNRQLYP (PMEL_HUMAN)
KVWNRQLYY

SEQ ID NO: 137003 - protein, 10 aa, Artificial Sequence
  Description of Artificial Sequence: Synthetic peptide
  Seed: YRYGSFSVTL (PMEL_HUMAN)
YQYGSFSVTF

SEQ ID NO: 137004 - protein, 10 aa, Artificial Sequence
  Description of Artificial Sequence: Synthetic peptide
  Seed: QEAGLGQVPL (PMEL_HUMAN)
QEAGLGQVPW

SEQ ID NO: 137005 - protein, 10 aa, Artificial Sequence
  Description of Artificial Sequence: Synthetic peptide
  Seed: VPQLPHSSSH (PMEL_HUMAN)
VRQLPHSSSF

SEQ ID NO: 137006 - protein, 10 aa, Artificial Sequence
  Description of Artificial Sequence: Synthetic peptide
  Seed: VPQLPHSSSH (PMEL_HUMAN)
VRQLPHSSSM

SEQ ID NO: 137007 - protein, 9 aa, Artificial Sequence
  Description of Artificial Sequence: Synthetic peptide
  Seed: AVIGALLAV (PMEL_HUMAN)
AVIGALLAR

SEQ ID NO: 137008 - protein, 9 aa, Artificial Sequence
  Description of Artificial Sequence: Synthetic peptide
  Seed: ASFSIALNF (PMEL_HUMAN)
AVFSIALNR

SEQ ID NO: 137009 - protein, 9 aa, Artificial Sequence
  Description of Artificial Sequence: Synthetic peptide
  Seed: ITDQVPFSV (PMEL_HUMAN)
IGDQVPFSM

SEQ ID NO: 137010 - protein, 9 aa, Artificial Sequence
  Description of Artificial Sequence: Synthetic peptide
  Seed: LPKEACMEI (PMEL_HUMAN)
LPKEACMEW

SEQ ID NO: 137011 - protein, 9 aa, Artificial Sequence
  Description of Artificial Sequence: Synthetic peptide
  Seed: RALDGGNKH (PMEL_HUMAN)
RMLDGGNKM

SEQ ID NO: 137012 - protein, 10 aa, Artificial Sequence
  Description of Artificial Sequence: Synthetic peptide
  Seed: RTKAWNRQLY (PMEL_HUMAN)
RMKAWNRQLF

SEQ ID NO: 137013 - protein, 9 aa, Artificial Sequence
  Description of Artificial Sequence: Synthetic peptide
  Seed: RAMLGTHTM (PMEL_HUMAN)
RTMLGTHTA

SEQ ID NO: 137014 - protein, 9 aa, Artificial Sequence
  Description of Artificial Sequence: Synthetic peptide
  Seed: AAIPLTSCG (PMEL_HUMAN)
AAIPLTSCL

SEQ ID NO: 137015 - protein, 9 aa, Artificial Sequence
  Description of Artificial Sequence: Synthetic peptide
  Seed: RGSRSYVPL (PMEL_HUMAN)
RTSRSYVPG

SEQ ID NO: 137016 - protein, 9 aa, Artificial Sequence
  Description of Artificial Sequence: Synthetic peptide
  Seed: LQLHDPSGY (PMEL_HUMAN)
LYLHDPSGY

SEQ ID NO: 137017 - protein, 10 aa, Artificial Sequence
  Description of Artificial Sequence: Synthetic peptide
  Seed: LNFPGSQKVL (PMEL_HUMAN)
LAFPGSQKVL

SEQ ID NO: 137018 - protein, 10 aa, Artificial Sequence
  Description of Artificial Sequence: Synthetic peptide
  Seed: RRLMKQDFSV (PMEL_HUMAN)
RCLMKQDFSI

SEQ ID NO: 137019 - protein, 10 aa, Artificial Sequence
  Description of Artificial Sequence: Synthetic peptide
  Seed: AEADLSYTWD (PMEL_HUMAN)
AEADLSYTWT

SEQ ID NO: 137020 - protein, 9 aa, Artificial Sequence
  Description of Artificial Sequence: Synthetic peptide
  Seed: MAVVLASLI (PMEL_HUMAN)
MVVVLASLW

SEQ ID NO: 137021 - protein, 9 aa, Artificial Sequence
  Description of Artificial Sequence: Synthetic peptide
  Seed: QVWGGQPVY (PMEL_HUMAN)
QTWGGQPVW

SEQ ID NO: 137022 - protein, 9 aa, Artificial Sequence
  Description of Artificial Sequence: Synthetic peptide
  Seed: ESAEILQAV (PMEL_HUMAN)
ECAEILQAR

SEQ ID NO: 137023 - protein, 10 aa, Artificial Sequence
  Description of Artificial Sequence: Synthetic peptide
  Seed: AMLGTHTMEV (PMEL_HUMAN)
AFLGTHTMEI

SEQ ID NO: 137024 - protein, 9 aa, Artificial Sequence
  Description of Artificial Sequence: Synthetic peptide
  Seed: AGLGQVPLI (PMEL_HUMAN)
AILGQVPLL

SEQ ID NO: 137025 - protein, 11 aa, Artificial Sequence
  Description of Artificial Sequence: Synthetic peptide
  Seed: AEADLSYTWDF (PMEL_HUMAN)
AEADLSYTWDW

SEQ ID NO: 137026 - protein, 9 aa, Artificial Sequence
  Description of Artificial Sequence: Synthetic peptide
  Seed: KTWGQYWQV (PMEL_HUMAN)
KNWGQYWQK

SEQ ID NO: 137027 - protein, 9 aa, Artificial Sequence
  Description of Artificial Sequence: Synthetic peptide
  Seed: AVGATKVPR (PMEL_HUMAN)
ATGATKVPR

SEQ ID NO: 137028 - protein, 8 aa, Artificial Sequence
  Description of Artificial Sequence: Synthetic peptide
  Seed: CQPPAQRL (PMEL_HUMAN)
CAPPAQRL

SEQ ID NO: 137029 - protein, 9 aa, Artificial Sequence
  Description of Artificial Sequence: Synthetic peptide
  Seed: SEVMGTTLA (PMEL_HUMAN)
SHVMGTTLA

SEQ ID NO: 137030 - protein, 9 aa, Artificial Sequence
  Description of Artificial Sequence: Synthetic peptide
  Seed: ASFSIALNF (PMEL_HUMAN)
AGFSIALNY

SEQ ID NO: 137031 - protein, 11 aa, Artificial Sequence
  Description of Artificial Sequence: Synthetic peptide
  Seed: LYRYGSFSVTL (PMEL_HUMAN)
LLRYGSFSVTF

SEQ ID NO: 137032 - protein, 10 aa, Artificial Sequence
  Description of Artificial Sequence: Synthetic peptide
  Seed: RALDGGNKHF (PMEL_HUMAN)
RRLDGGNKHY

SEQ ID NO: 137033 - protein, 10 aa, Artificial Sequence
  Description of Artificial Sequence: Synthetic peptide
  Seed: VLMAVVLASL (PMEL_HUMAN)
VVMAVVLASY

SEQ ID NO: 137034 - protein, 9 aa, Artificial Sequence
  Description of Artificial Sequence: Synthetic peptide
  Seed: RGSRSYVPL (PMEL_HUMAN)
RVSRSYVPM

SEQ ID NO: 137035 - protein, 10 aa, Artificial Sequence
  Description of Artificial Sequence: Synthetic peptide
  Seed: ASFSIALNFP (PMEL_HUMAN)
AAFSIALNFW

SEQ ID NO: 137036 - protein, 9 aa, Artificial Sequence
  Description of Artificial Sequence: Synthetic peptide
  Seed: AVIGALLAV (PMEL_HUMAN)
AQIGALLAL

SEQ ID NO: 137037 - protein, 10 aa, Artificial Sequence
  Description of Artificial Sequence: Synthetic peptide
  Seed: SVPQLPHSSS (PMEL_HUMAN)
SVPQLPHSSA

SEQ ID NO: 137038 - protein, 11 aa, Artificial Sequence
  Description of Artificial Sequence: Synthetic peptide
  Seed: SYVPLAHSSSA (PMEL_HUMAN)
SQVPLAHSSSM

SEQ ID NO: 137039 - protein, 9 aa, Artificial Sequence
  Description of Artificial Sequence: Synthetic peptide
  Seed: KVLPDGQVI (PMEL_HUMAN)
KTLPDGQVI

SEQ ID NO: 137040 - protein, 9 aa, Artificial Sequence
  Description of Artificial Sequence: Synthetic peptide
  Seed: GSFSVTLDI (PMEL_HUMAN)
GQFSVTLDI

SEQ ID NO: 137041 - protein, 10 aa, Artificial Sequence
  Description of Artificial Sequence: Synthetic peptide
  Seed: GSRSYVPLAH (PMEL_HUMAN)
GYRSYVPLAK

SEQ ID NO: 137042 - protein, 9 aa, Artificial Sequence
  Description of Artificial Sequence: Synthetic peptide
  Seed: RTKAWNRQL (PMEL_HUMAN)
RVKAWNRQK

SEQ ID NO: 137043 - protein, 11 aa, Artificial Sequence
  Description of Artificial Sequence: Synthetic peptide
  Seed: RYGSFSVTLDI (PMEL_HUMAN)
RKGSFSVTLDY

SEQ ID NO: 137044 - protein, 10 aa, Artificial Sequence
  Description of Artificial Sequence: Synthetic peptide
  Seed: AVIGALLAVG (PMEL_HUMAN)
AQIGALLAVK

SEQ ID NO: 137045 - protein, 9 aa, Artificial Sequence
  Description of Artificial Sequence: Synthetic peptide
  Seed: VTLDIVQGI (PMEL_HUMAN)
VLLDIVQGI

SEQ ID NO: 137046 - protein, 9 aa, Artificial Sequence
  Description of Artificial Sequence: Synthetic peptide
  Seed: GSFSVTLDI (PMEL_HUMAN)
GVFSVTLDI

SEQ ID NO: 137047 - protein, 9 aa, Artificial Sequence
  Description of Artificial Sequence: Synthetic peptide
  Seed: RNQPLTFAL (PMEL_HUMAN)
RGQPLTFAW

SEQ ID NO: 137048 - protein, 10 aa, Artificial Sequence
  Description of Artificial Sequence: Synthetic peptide
  Seed: SCPIGENSPL (PMEL_HUMAN)
SSPIGENSPM

SEQ ID NO: 137049 - protein, 9 aa, Artificial Sequence
  Description of Artificial Sequence: Synthetic peptide
  Seed: LMAVVLASL (PMEL_HUMAN)
LTAVVLASY

SEQ ID NO: 137050 - protein, 9 aa, Artificial Sequence
  Description of Artificial Sequence: Synthetic peptide
  Seed: SQVWGGQPV (PMEL_HUMAN)
SIVWGGQPY

SEQ ID NO: 137051 - protein, 9 aa, Artificial Sequence
  Description of Artificial Sequence: Synthetic peptide
  Seed: VLPSPACQL (PMEL_HUMAN)
VMPSPACQF

SEQ ID NO: 137052 - protein, 11 aa, Artificial Sequence
  Description of Artificial Sequence: Synthetic peptide
  Seed: QLYPEWTEAQR (PMEL_HUMAN)
QAYPEWTEAQK

SEQ ID NO: 137053 - protein, 9 aa, Artificial Sequence
  Description of Artificial Sequence: Synthetic peptide
  Seed: YLAEADLSY (PMEL_HUMAN)
YMAEADLSM

SEQ ID NO: 137054 - protein, 10 aa, Artificial Sequence
  Description of Artificial Sequence: Synthetic peptide
  Seed: LLHLAVIGAL (PMEL_HUMAN)
LMHLAVIGAI

SEQ ID NO: 137055 - protein, 10 aa, Artificial Sequence
  Description of Artificial Sequence: Synthetic peptide
  Seed: YGSFSVTLDI (PMEL_HUMAN)
YFSFSVTLDW

SEQ ID NO: 137056 - protein, 9 aa, Artificial Sequence
  Description of Artificial Sequence: Synthetic peptide
  Seed: RLVKRQVPL (PMEL_HUMAN)
RLVKRQVPV

SEQ ID NO: 137057 - protein, 9 aa, Artificial Sequence
  Description of Artificial Sequence: Synthetic peptide
  Seed: IMPGQEAGL (PMEL_HUMAN)
IYPGQEAGY

SEQ ID NO: 137058 - protein, 9 aa, Artificial Sequence
  Description of Artificial Sequence: Synthetic peptide
  Seed: LSIGTGRAM (PMEL_HUMAN)
LYIGTGRAM

SEQ ID NO: 137059 - protein, 10 aa, Artificial Sequence
  Description of Artificial Sequence: Synthetic peptide
  Seed: YRYGSFSVTL (PMEL_HUMAN)
YPYGSFSVTW

SEQ ID NO: 137060 - protein, 9 aa, Artificial Sequence
  Description of Artificial Sequence: Synthetic peptide
  Seed: SQKRSFVYV (PMEL_HUMAN)
SAKRSFVYG

SEQ ID NO: 137061 - protein, 9 aa, Artificial Sequence
  Description of Artificial Sequence: Synthetic peptide
  Seed: LPDGQVIWV (PMEL_HUMAN)
LADGQVIWV

SEQ ID NO: 137062 - protein, 9 aa, Artificial Sequence
  Description of Artificial Sequence: Synthetic peptide
  Seed: TAPVQMPTA (PMEL_HUMAN)
TPPVQMPTV

SEQ ID NO: 137063 - protein, 9 aa, Artificial Sequence
  Description of Artificial Sequence: Synthetic peptide
  Seed: GQVPTTEVV (PMEL_HUMAN)
GEVPTTEVL

SEQ ID NO: 137064 - protein, 9 aa, Artificial Sequence
  Description of Artificial Sequence: Synthetic peptide
  Seed: LMAVVLASL (PMEL_HUMAN)
LRAVVLASY

SEQ ID NO: 137065 - protein, 9 aa, Artificial Sequence
  Description of Artificial Sequence: Synthetic peptide
  Seed: VQMPTAEST (PMEL_HUMAN)
VQMPTAESL

SEQ ID NO: 137066 - protein, 10 aa, Artificial Sequence
  Description of Artificial Sequence: Synthetic peptide
  Seed: SPVPGTTDGH (PMEL_HUMAN)
SPVPGTTDGY

SEQ ID NO: 137067 - protein, 10 aa, Artificial Sequence
  Description of Artificial Sequence: Synthetic peptide
  Seed: RGSRSYVPLA (PMEL_HUMAN)
RFSRSYVPLF

SEQ ID NO: 137068 - protein, 10 aa, Artificial Sequence
  Description of Artificial Sequence: Synthetic peptide
  Seed: SLADTNSLAV (PMEL_HUMAN)
SQADTNSLAL

SEQ ID NO: 137069 - protein, 9 aa, Artificial Sequence
  Description of Artificial Sequence: Synthetic peptide
  Seed: VQGIESAEI (PMEL_HUMAN)
VHGIESAEI

SEQ ID NO: 137070 - protein, 10 aa, Artificial Sequence
  Description of Artificial Sequence: Synthetic peptide
  Seed: SGTYCLNVSL (PMEL_HUMAN)
SMTYCLNVSF

SEQ ID NO: 137071 - protein, 9 aa, Artificial Sequence
  Description of Artificial Sequence: Synthetic peptide
  Seed: SQKRSFVYV (PMEL_HUMAN)
SVKRSFVYA

SEQ ID NO: 137072 - protein, 9 aa, Artificial Sequence
  Description of Artificial Sequence: Synthetic peptide
  Seed: AVVLASLIY (PMEL_HUMAN)
AMVLASLIM

SEQ ID NO: 137073 - protein, 9 aa, Artificial Sequence
  Description of Artificial Sequence: Synthetic peptide
  Seed: EVVGTTPGQ (PMEL_HUMAN)
EAVGTTPGR

SEQ ID NO: 137074 - protein, 11 aa, Artificial Sequence
  Description of Artificial Sequence: Synthetic peptide
  Seed: VQMPTAESTGM (PMEL_HUMAN)
VLMPTAESTGF

SEQ ID NO: 137075 - protein, 10 aa, Artificial Sequence
  Description of Artificial Sequence: Synthetic peptide
  Seed: RSFVYVWKTW (PMEL_HUMAN)
RAFVYVWKTW

SEQ ID NO: 137076 - protein, 10 aa, Artificial Sequence
  Description of Artificial Sequence: Synthetic peptide
  Seed: YVPLAHSSSA (PMEL_HUMAN)
YYPLAHSSSI

SEQ ID NO: 137077 - protein, 8 aa, Artificial Sequence
  Description of Artificial Sequence: Synthetic peptide
  Seed: LLDGTATL (PMEL_HUMAN)
LSDGTATI

SEQ ID NO: 137078 - protein, 10 aa, Artificial Sequence
  Description of Artificial Sequence: Synthetic peptide
  Seed: NKHFLRNQPL (PMEL_HUMAN)
NHHFLRNQPL

SEQ ID NO: 137079 - protein, 10 aa, Artificial Sequence
  Description of Artificial Sequence: Synthetic peptide
  Seed: MTPAEVSIVV (PMEL_HUMAN)
MFPAEVSIVL

SEQ ID NO: 137080 - protein, 10 aa, Artificial Sequence
  Description of Artificial Sequence: Synthetic peptide
  Seed: FSVSVSQLRA (PMEL_HUMAN)
FKVSVSQLRR

SEQ ID NO: 137081 - protein, 10 aa, Artificial Sequence
  Description of Artificial Sequence: Synthetic peptide
  Seed: GPLLDGTATL (PMEL_HUMAN)
GRLLDGTATL

SEQ ID NO: 137082 - protein, 9 aa, Artificial Sequence
  Description of Artificial Sequence: Synthetic peptide
  Seed: TWGQYWQVL (PMEL_HUMAN)
TYGQYWQVL

SEQ ID NO: 137083 - protein, 9 aa, Artificial Sequence
  Description of Artificial Sequence: Synthetic peptide
  Seed: AVVSTQLIM (PMEL_HUMAN)
ALVSTQLIY

SEQ ID NO: 137084 - protein, 10 aa, Artificial Sequence
  Description of Artificial Sequence: Synthetic peptide
  Seed: LVLMAVVLAS (PMEL_HUMAN)
LRLMAVVLAL

SEQ ID NO: 137085 - protein, 9 aa, Artificial Sequence
  Description of Artificial Sequence: Synthetic peptide
  Seed: RQVPLDCVL (PMEL_HUMAN)
RMVPLDCVF

SEQ ID NO: 137086 - protein, 9 aa, Artificial Sequence
  Description of Artificial Sequence: Synthetic peptide
  Seed: EPGPVTAQV (PMEL_HUMAN)
EPGPVTAQA

SEQ ID NO: 137087 - protein, 10 aa, Artificial Sequence
  Description of Artificial Sequence: Synthetic peptide
  Seed: RSFVYVWKTW (PMEL_HUMAN)
RTFVYVWKTI

SEQ ID NO: 137088 - protein, 10 aa, Artificial Sequence
  Description of Artificial Sequence: Synthetic peptide
  Seed: ASSIMSTESI (PMEL_HUMAN)
ANSIMSTESF

SEQ ID NO: 137089 - protein, 10 aa, Artificial Sequence
  Description of Artificial Sequence: Synthetic peptide
  Seed: RQVPLDCVLY (PMEL_HUMAN)
RAVPLDCVLY

SEQ ID NO: 137090 - protein, 10 aa, Artificial Sequence
  Description of Artificial Sequence: Synthetic peptide
  Seed: RGSRSYVPLA (PMEL_HUMAN)
RPSRSYVPLL

SEQ ID NO: 137091 - protein, 8 aa, Artificial Sequence
  Description of Artificial Sequence: Synthetic peptide
  Seed: TLDIVQGI (PMEL_HUMAN)
TFDIVQGM

SEQ ID NO: 137092 - protein, 9 aa, Artificial Sequence
  Description of Artificial Sequence: Synthetic peptide
  Seed: LADTNSLAV (PMEL_HUMAN)
LMDTNSLAV

SEQ ID NO: 137093 - protein, 9 aa, Artificial Sequence
  Description of Artificial Sequence: Synthetic peptide
  Seed: LADTNSLAV (PMEL_HUMAN)
LPDTNSLAH

SEQ ID NO: 137094 - protein, 9 aa, Artificial Sequence
  Description of Artificial Sequence: Synthetic peptide
  Seed: FGDSSGTLI (PMEL_HUMAN)
FGDSSGTLL

SEQ ID NO: 137095 - protein, 9 aa, Artificial Sequence
  Description of Artificial Sequence: Synthetic peptide
  Seed: FGDSSGTLI (PMEL_HUMAN)
FADSSGTLY

SEQ ID NO: 137096 - protein, 9 aa, Artificial Sequence
  Description of Artificial Sequence: Synthetic peptide
  Seed: FPDGGPCPS (PMEL_HUMAN)
FIDGGPCPM

SEQ ID NO: 137097 - protein, 9 aa, Artificial Sequence
  Description of Artificial Sequence: Synthetic peptide
  Seed: VVLASLIYR (PMEL_HUMAN)
VMLASLIYR

SEQ ID NO: 137098 - protein, 10 aa, Artificial Sequence
  Description of Artificial Sequence: Synthetic peptide
  Seed: ALDGGNKHFL (PMEL_HUMAN)
AYDGGNKHFM

SEQ ID NO: 137099 - protein, 9 aa, Artificial Sequence
  Description of Artificial Sequence: Synthetic peptide
  Seed: YVWKTWGQY (PMEL_HUMAN)
YWWKTWGQY

SEQ ID NO: 137100 - protein, 9 aa, Artificial Sequence
  Description of Artificial Sequence: Synthetic peptide
  Seed: MTPAEVSIV (PMEL_HUMAN)
MAPAEVSIF

SEQ ID NO: 137101 - protein, 9 aa, Artificial Sequence
  Description of Artificial Sequence: Synthetic peptide
  Seed: VLPSPACQL (PMEL_HUMAN)
VYPSPACQW

SEQ ID NO: 137102 - protein, 10 aa, Artificial Sequence
  Description of Artificial Sequence: Synthetic peptide
  Seed: EVMGTTLAEM (PMEL_HUMAN)
EIMGTTLAEV

SEQ ID NO: 137103 - protein, 10 aa, Artificial Sequence
  Description of Artificial Sequence: Synthetic peptide
  Seed: SVPQLPHSSS (PMEL_HUMAN)
SEPQLPHSSL

SEQ ID NO: 137104 - protein, 9 aa, Artificial Sequence
  Description of Artificial Sequence: Synthetic peptide
  Seed: ILKGGSGTY (PMEL_HUMAN)
IQKGGSGTF

SEQ ID NO: 137105 - protein, 9 aa, Artificial Sequence
  Description of Artificial Sequence: Synthetic peptide
  Seed: VQVPTTEVI (PMEL_HUMAN)
VVVPTTEVV

SEQ ID NO: 137106 - protein, 9 aa, Artificial Sequence
  Description of Artificial Sequence: Synthetic peptide
  Seed: LTSCGSSPV (PMEL_HUMAN)
LLSCGSSPI

SEQ ID NO: 137107 - protein, 9 aa, Artificial Sequence
  Description of Artificial Sequence: Synthetic peptide
  Seed: TIINGSQVW (PMEL_HUMAN)
TTINGSQVY

SEQ ID NO: 137108 - protein, 9 aa, Artificial Sequence
  Description of Artificial Sequence: Synthetic peptide
  Seed: FSVSVSQLR (PMEL_HUMAN)
FSVSVSQLK

SEQ ID NO: 137109 - protein, 9 aa, Artificial Sequence
  Description of Artificial Sequence: Synthetic peptide
  Seed: VSNDGPTLI (PMEL_HUMAN)
VANDGPTLF

SEQ ID NO: 137110 - protein, 9 aa, Artificial Sequence
  Description of Artificial Sequence: Synthetic peptide
  Seed: SSPGCQPPA (PMEL_HUMAN)
SSPGCQPPI

SEQ ID NO: 137111 - protein, 10 aa, Artificial Sequence
  Description of Artificial Sequence: Synthetic peptide
  Seed: SCPIGENSPL (PMEL_HUMAN)
SMPIGENSPM

SEQ ID NO: 137112 - protein, 9 aa, Artificial Sequence
  Description of Artificial Sequence: Synthetic peptide
  Seed: VQMPTAEST (PMEL_HUMAN)
VLMPTAESI

SEQ ID NO: 137113 - protein, 9 aa, Artificial Sequence
  Description of Artificial Sequence: Synthetic peptide
  Seed: MEVTVYHRR (PMEL_HUMAN)
MSVTVYHRR

SEQ ID NO: 137114 - protein, 9 aa, Artificial Sequence
  Description of Artificial Sequence: Synthetic peptide
  Seed: SVPQLPHSS (PMEL_HUMAN)
SGPQLPHSV

SEQ ID NO: 137115 - protein, 9 aa, Artificial Sequence
  Description of Artificial Sequence: Synthetic peptide
  Seed: SSHWLRLPR (PMEL_HUMAN)
SMHWLRLPR

SEQ ID NO: 137116 - protein, 9 aa, Artificial Sequence
  Description of Artificial Sequence: Synthetic peptide
  Seed: AEPSGTTSV (PMEL_HUMAN)
APPSGTTSL

SEQ ID NO: 137117 - protein, 10 aa, Artificial Sequence
  Description of Artificial Sequence: Synthetic peptide
  Seed: SRALVVTHTY (PMEL_HUMAN)
SRALVVTHTF

SEQ ID NO: 137118 - protein, 9 aa, Artificial Sequence
  Description of Artificial Sequence: Synthetic peptide
  Seed: SGTLISRAL (PMEL_HUMAN)
SSTLISRAY

SEQ ID NO: 137119 - protein, 9 aa, Artificial Sequence
  Description of Artificial Sequence: Synthetic peptide
  Seed: GTHTMEVTV (PMEL_HUMAN)
GQHTMEVTL

SEQ ID NO: 137120 - protein, 9 aa, Artificial Sequence
  Description of Artificial Sequence: Synthetic peptide
  Seed: MLGTHTMEV (PMEL_HUMAN)
MLGTHTMER

SEQ ID NO: 137121 - protein, 11 aa, Artificial Sequence
  Description of Artificial Sequence: Synthetic peptide
  Seed: HTMEVTVYHRR (PMEL_HUMAN)
HTMEVTVYHRV

SEQ ID NO: 137122 - protein, 9 aa, Artificial Sequence
  Description of Artificial Sequence: Synthetic peptide
  Seed: AVIGALLAV (PMEL_HUMAN)
AIIGALLAV

SEQ ID NO: 137123 - protein, 9 aa, Artificial Sequence
  Description of Artificial Sequence: Synthetic peptide
  Seed: TTDGHRPTA (PMEL_HUMAN)
TGDGHRPTI

SEQ ID NO: 137124 - protein, 9 aa, Artificial Sequence
  Description of Artificial Sequence: Synthetic peptide
  Seed: LADTNSLAV (PMEL_HUMAN)
LLDTNSLAL

SEQ ID NO: 137125 - protein, 11 aa, Artificial Sequence
  Description of Artificial Sequence: Synthetic peptide
  Seed: QKVLPDGQVIW (PMEL_HUMAN)
QEVLPDGQVIW

SEQ ID NO: 137126 - protein, 9 aa, Artificial Sequence
  Description of Artificial Sequence: Synthetic peptide
  Seed: VSNDGPTLI (PMEL_HUMAN)
VINDGPTLL

SEQ ID NO: 137127 - protein, 9 aa, Artificial Sequence
  Description of Artificial Sequence: Synthetic peptide
  Seed: VTLDIVQGI (PMEL_HUMAN)
VTLDIVQGK

SEQ ID NO: 137128 - protein, 11 aa, Artificial Sequence
  Description of Artificial Sequence: Synthetic peptide
  Seed: RELPIPEPEGP (PMEL_HUMAN)
RELPIPEPEGM

SEQ ID NO: 137129 - protein, 10 aa, Artificial Sequence
  Description of Artificial Sequence: Synthetic peptide
  Seed: RALDGGNKHF (PMEL_HUMAN)
RLLDGGNKHW

SEQ ID NO: 137130 - protein, 9 aa, Artificial Sequence
  Description of Artificial Sequence: Synthetic peptide
  Seed: SVPQLPHSS (PMEL_HUMAN)
SLPQLPHSM

SEQ ID NO: 137131 - protein, 9 aa, Artificial Sequence
  Description of Artificial Sequence: Synthetic peptide
  Seed: KVLPDGQVI (PMEL_HUMAN)
KSLPDGQVI

SEQ ID NO: 137132 - protein, 10 aa, Artificial Sequence
  Description of Artificial Sequence: Synthetic peptide
  Seed: YRYGSFSVTL (PMEL_HUMAN)
YKYGSFSVTY

SEQ ID NO: 137133 - protein, 9 aa, Artificial Sequence
  Description of Artificial Sequence: Synthetic peptide
  Seed: GGPVSGLSI (PMEL_HUMAN)
GLPVSGLSM

SEQ ID NO: 137134 - protein, 9 aa, Artificial Sequence
  Description of Artificial Sequence: Synthetic peptide
  Seed: VQVPTTEVI (PMEL_HUMAN)
VLVPTTEVA

SEQ ID NO: 137135 - protein, 9 aa, Artificial Sequence
  Description of Artificial Sequence: Synthetic peptide
  Seed: RNQPLTFAL (PMEL_HUMAN)
RFQPLTFAF

SEQ ID NO: 137136 - protein, 9 aa, Artificial Sequence
  Description of Artificial Sequence: Synthetic peptide
  Seed: SSIMSTESI (PMEL_HUMAN)
SLIMSTESI

SEQ ID NO: 137137 - protein, 9 aa, Artificial Sequence
  Description of Artificial Sequence: Synthetic peptide
  Seed: GSSPVPGTT (PMEL_HUMAN)
GSSPVPGTF

SEQ ID NO: 137138 - protein, 9 aa, Artificial Sequence
  Description of Artificial Sequence: Synthetic peptide
  Seed: MSTPEATGM (PMEL_HUMAN)
MGTPEATGY

SEQ ID NO: 137139 - protein, 10 aa, Artificial Sequence
  Description of Artificial Sequence: Synthetic peptide
  Seed: YVPLAHSSSA (PMEL_HUMAN)
YKPLAHSSSI

SEQ ID NO: 137140 - protein, 10 aa, Artificial Sequence
  Description of Artificial Sequence: Synthetic peptide
  Seed: LSIGTGRAML (PMEL_HUMAN)
LSIGTGRAMF

SEQ ID NO: 137141 - protein, 9 aa, Artificial Sequence
  Description of Artificial Sequence: Synthetic peptide
  Seed: RALDGGNKH (PMEL_HUMAN)
RSLDGGNKF

SEQ ID NO: 137142 - protein, 10 aa, Artificial Sequence
  Description of Artificial Sequence: Synthetic peptide
  Seed: SRALVVTHTY (PMEL_HUMAN)
SGALVVTHTW

SEQ ID NO: 137143 - protein, 9 aa, Artificial Sequence
  Description of Artificial Sequence: Synthetic peptide
  Seed: SLGPLLDGT (PMEL_HUMAN)
SMGPLLDGV

SEQ ID NO: 137144 - protein, 9 aa, Artificial Sequence
  Description of Artificial Sequence: Synthetic peptide
  Seed: DGTATLRLV (PMEL_HUMAN)
DATATLRLI

SEQ ID NO: 137145 - protein, 9 aa, Artificial Sequence
  Description of Artificial Sequence: Synthetic peptide
  Seed: RNQPLTFAL (PMEL_HUMAN)
RIQPLTFAW

SEQ ID NO: 137146 - protein, 9 aa, Artificial Sequence
  Description of Artificial Sequence: Synthetic peptide
  Seed: CVLYRYGSF (PMEL_HUMAN)
CTLYRYGSF

SEQ ID NO: 137147 - protein, 9 aa, Artificial Sequence
  Description of Artificial Sequence: Synthetic peptide
  Seed: KVSNDGPTL (PMEL_HUMAN)
KLSNDGPTF

SEQ ID NO: 137148 - protein, 10 aa, Artificial Sequence
  Description of Artificial Sequence: Synthetic peptide
  Seed: LPSPACQLVL (PMEL_HUMAN)
LPSPACQLVA

SEQ ID NO: 137149 - protein, 10 aa, Artificial Sequence
  Description of Artificial Sequence: Synthetic peptide
  Seed: AEAPNTTAGQ (PMEL_HUMAN)
AEAPNTTAGL

SEQ ID NO: 137150 - protein, 9 aa, Artificial Sequence
  Description of Artificial Sequence: Synthetic peptide
  Seed: VSLADTNSL (PMEL_HUMAN)
VTLADTNSW

SEQ ID NO: 137151 - protein, 10 aa, Artificial Sequence
  Description of Artificial Sequence: Synthetic peptide
  Seed: VVLASLIYRR (PMEL_HUMAN)
VYLASLIYRK

SEQ ID NO: 137152 - protein, 9 aa, Artificial Sequence
  Description of Artificial Sequence: Synthetic peptide
  Seed: SVQVPTTEV (PMEL_HUMAN)
SAQVPTTEV

SEQ ID NO: 137153 - protein, 9 aa, Artificial Sequence
  Description of Artificial Sequence: Synthetic peptide
  Seed: FLRNQPLTF (PMEL_HUMAN)
FARNQPLTM

SEQ ID NO: 137154 - protein, 9 aa, Artificial Sequence
  Description of Artificial Sequence: Synthetic peptide
  Seed: RSFVYVWKT (PMEL_HUMAN)
RSFVYVWKK

SEQ ID NO: 137155 - protein, 9 aa, Artificial Sequence
  Description of Artificial Sequence: Synthetic peptide
  Seed: SSPGCQPPA (PMEL_HUMAN)
SCPGCQPPL

SEQ ID NO: 137156 - protein, 9 aa, Artificial Sequence
  Description of Artificial Sequence: Synthetic peptide
  Seed: ANASFSIAL (PMEL_HUMAN)
AKASFSIAM

SEQ ID NO: 137157 - protein, 10 aa, Artificial Sequence
  Description of Artificial Sequence: Synthetic peptide
  Seed: ELTVSCQGGL (PMEL_HUMAN)
EWTVSCQGGV

SEQ ID NO: 137158 - protein, 9 aa, Artificial Sequence
  Description of Artificial Sequence: Synthetic peptide
  Seed: RYGSFSVTL (PMEL_HUMAN)
RLGSFSVTY

SEQ ID NO: 137159 - protein, 9 aa, Artificial Sequence
  Description of Artificial Sequence: Synthetic peptide
  Seed: VVLQAAIPL (PMEL_HUMAN)
VILQAAIPV

SEQ ID NO: 137160 - protein, 9 aa, Artificial Sequence
  Description of Artificial Sequence: Synthetic peptide
  Seed: SAFTITDQV (PMEL_HUMAN)
SLFTITDQA

SEQ ID NO: 137161 - protein, 11 aa, Artificial Sequence
  Description of Artificial Sequence: Synthetic peptide
  Seed: RYGSFSVTLDI (PMEL_HUMAN)
RCGSFSVTLDY

SEQ ID NO: 137162 - protein, 9 aa, Artificial Sequence
  Description of Artificial Sequence: Synthetic peptide
  Seed: FLRNQPLTF (PMEL_HUMAN)
FVRNQPLTI

SEQ ID NO: 137163 - protein, 10 aa, Artificial Sequence
  Description of Artificial Sequence: Synthetic peptide
  Seed: LIMPGQEAGL (PMEL_HUMAN)
LLMPGQEAGI

SEQ ID NO: 137164 - protein, 10 aa, Artificial Sequence
  Description of Artificial Sequence: Synthetic peptide
  Seed: VLMAVVLASL (PMEL_HUMAN)
VNMAVVLASV

SEQ ID NO: 137165 - protein, 11 aa, Artificial Sequence
  Description of Artificial Sequence: Synthetic peptide
  Seed: SGYLAEADLSY (PMEL_HUMAN)
SQYLAEADLSY

SEQ ID NO: 137166 - protein, 9 aa, Artificial Sequence
  Description of Artificial Sequence: Synthetic peptide
  Seed: LSIGTGRAM (PMEL_HUMAN)
LTIGTGRAF

SEQ ID NO: 137167 - protein, 9 aa, Artificial Sequence
  Description of Artificial Sequence: Synthetic peptide
  Seed: RLVKRQVPL (PMEL_HUMAN)
RNVKRQVPF

SEQ ID NO: 137168 - protein, 10 aa, Artificial Sequence
  Description of Artificial Sequence: Synthetic peptide
  Seed: KTWGQYWQVL (PMEL_HUMAN)
KIWGQYWQVH

SEQ ID NO: 137169 - protein, 9 aa, Artificial Sequence
  Description of Artificial Sequence: Synthetic peptide
  Seed: RALVVTHTY (PMEL_HUMAN)
RVLVVTHTV

SEQ ID NO: 137170 - protein, 9 aa, Artificial Sequence
  Description of Artificial Sequence: Synthetic peptide
  Seed: SPLLSGQQV (PMEL_HUMAN)
SPLLSGQQL

SEQ ID NO: 137171 - protein, 9 aa, Artificial Sequence
  Description of Artificial Sequence: Synthetic peptide
  Seed: RQVPLDCVL (PMEL_HUMAN)
RLVPLDCVL

SEQ ID NO: 137172 - protein, 10 aa, Artificial Sequence
  Description of Artificial Sequence: Synthetic peptide
  Seed: EVMGTTLAEM (PMEL_HUMAN)
ELMGTTLAEW

SEQ ID NO: 137173 - protein, 10 aa, Artificial Sequence
  Description of Artificial Sequence: Synthetic peptide
  Seed: NSLAVVSTQL (PMEL_HUMAN)
NFLAVVSTQM

SEQ ID NO: 137174 - protein, 10 aa, Artificial Sequence
  Description of Artificial Sequence: Synthetic peptide
  Seed: YRYGSFSVTL (PMEL_HUMAN)
YGYGSFSVTF

SEQ ID NO: 137175 - protein, 8 aa, Artificial Sequence
  Description of Artificial Sequence: Synthetic peptide
  Seed: HTMEVTVY (PMEL_HUMAN)
HAMEVTVL

SEQ ID NO: 137176 - protein, 9 aa, Artificial Sequence
  Description of Artificial Sequence: Synthetic peptide
  Seed: FTITDQVPF (PMEL_HUMAN)
FLITDQVPL

SEQ ID NO: 137177 - protein, 10 aa, Artificial Sequence
  Description of Artificial Sequence: Synthetic peptide
  Seed: ASSIMSTESI (PMEL_HUMAN)
AYSIMSTESW

SEQ ID NO: 137178 - protein, 9 aa, Artificial Sequence
  Description of Artificial Sequence: Synthetic peptide
  Seed: TLISRALVV (PMEL_HUMAN)
TMISRALVA

SEQ ID NO: 137179 - protein, 10 aa, Artificial Sequence
  Description of Artificial Sequence: Synthetic peptide
  Seed: LMAVVLASLI (PMEL_HUMAN)
LIAVVLASLV

SEQ ID NO: 137180 - protein, 10 aa, Artificial Sequence
  Description of Artificial Sequence: Synthetic peptide
  Seed: RALVVTHTYL (PMEL_HUMAN)
RFLVVTHTYV

SEQ ID NO: 137181 - protein, 11 aa, Artificial Sequence
  Description of Artificial Sequence: Synthetic peptide
  Seed: RLPRIFCSCPI (PMEL_HUMAN)
RYPRIFCSCPL

SEQ ID NO: 137182 - protein, 10 aa, Artificial Sequence
  Description of Artificial Sequence: Synthetic peptide
  Seed: MKQDFSVPQL (PMEL_HUMAN)
MMQDFSVPQY

SEQ ID NO: 137183 - protein, 11 aa, Artificial Sequence
  Description of Artificial Sequence: Synthetic peptide
  Seed: KVLPDGQVIWV (PMEL_HUMAN)
KALPDGQVIWY

SEQ ID NO: 137184 - protein, 9 aa, Artificial Sequence
  Description of Artificial Sequence: Synthetic peptide
  Seed: MTPEKVPVS (PMEL_HUMAN)
MVPEKVPVL

SEQ ID NO: 137185 - protein, 10 aa, Artificial Sequence
  Description of Artificial Sequence: Synthetic peptide
  Seed: MPTAESTGMT (PMEL_HUMAN)
MQTAESTGMA

SEQ ID NO: 137186 - protein, 11 aa, Artificial Sequence
  Description of Artificial Sequence: Synthetic peptide
  Seed: VPSGEGDAFEL (PMEL_HUMAN)
VPSGEGDAFEY

SEQ ID NO: 137187 - protein, 8 aa, Artificial Sequence
  Description of Artificial Sequence: Synthetic peptide
  Seed: HTMEVTVY (PMEL_HUMAN)
HQMEVTVM

SEQ ID NO: 137188 - protein, 10 aa, Artificial Sequence
  Description of Artificial Sequence: Synthetic peptide
  Seed: MTPAEVSIVV (PMEL_HUMAN)
MKPAEVSIVA

SEQ ID NO: 137189 - protein, 9 aa, Artificial Sequence
  Description of Artificial Sequence: Synthetic peptide
  Seed: MSTPEATGM (PMEL_HUMAN)
MSTPEATGY

SEQ ID NO: 137190 - protein, 9 aa, Artificial Sequence
  Description of Artificial Sequence: Synthetic peptide
  Seed: RALVVTHTY (PMEL_HUMAN)
RQLVVTHTF

SEQ ID NO: 137191 - protein, 11 aa, Artificial Sequence
  Description of Artificial Sequence: Synthetic peptide
  Seed: SYVPLAHSSSA (PMEL_HUMAN)
SFVPLAHSSSL

SEQ ID NO: 137192 - protein, 10 aa, Artificial Sequence
  Description of Artificial Sequence: Synthetic peptide
  Seed: VLYRYGSFSV (PMEL_HUMAN)
VYYRYGSFSK

SEQ ID NO: 137193 - protein, 9 aa, Artificial Sequence
  Description of Artificial Sequence: Synthetic peptide
  Seed: WQVLGGPVS (PMEL_HUMAN)
WGVLGGPVY

SEQ ID NO: 137194 - protein, 9 aa, Artificial Sequence
  Description of Artificial Sequence: Synthetic peptide
  Seed: VSEVMGTTL (PMEL_HUMAN)
VSEVMGTTM

SEQ ID NO: 137195 - protein, 9 aa, Artificial Sequence
  Description of Artificial Sequence: Synthetic peptide
  Seed: YLEPGPVTA (PMEL_HUMAN)
YCEPGPVTL

SEQ ID NO: 137196 - protein, 9 aa, Artificial Sequence
  Description of Artificial Sequence: Synthetic peptide
  Seed: VQVPTTEVI (PMEL_HUMAN)
VEVPTTEVM

SEQ ID NO: 137197 - protein, 9 aa, Artificial Sequence
  Description of Artificial Sequence: Synthetic peptide
  Seed: DSSGTLISR (PMEL_HUMAN)
DVSGTLISR

SEQ ID NO: 137198 - protein, 11 aa, Artificial Sequence
  Description of Artificial Sequence: Synthetic peptide
  Seed: QLYPEWTEAQR (PMEL_HUMAN)
QTYPEWTEAQK

SEQ ID NO: 137199 - protein, 8 aa, Artificial Sequence
  Description of Artificial Sequence: Synthetic peptide
  Seed: KAWNRQLY (PMEL_HUMAN)
KQWNRQLM

SEQ ID NO: 137200 - protein, 10 aa, Artificial Sequence
  Description of Artificial Sequence: Synthetic peptide
  Seed: RQLYPEWTEA (PMEL_HUMAN)
RRLYPEWTEY

SEQ ID NO: 137201 - protein, 9 aa, Artificial Sequence
  Description of Artificial Sequence: Synthetic peptide
  Seed: YRYGSFSVT (PMEL_HUMAN)
YRYGSFSVA

SEQ ID NO: 137202 - protein, 10 aa, Artificial Sequence
  Description of Artificial Sequence: Synthetic peptide
  Seed: SLAVVSTQLI (PMEL_HUMAN)
SLAVVSTQLV

SEQ ID NO: 137203 - protein, 9 aa, Artificial Sequence
  Description of Artificial Sequence: Synthetic peptide
  Seed: ILKGGSGTY (PMEL_HUMAN)
IVKGGSGTL

SEQ ID NO: 137204 - protein, 9 aa, Artificial Sequence
  Description of Artificial Sequence: Synthetic peptide
  Seed: ILKGGSGTY (PMEL_HUMAN)
IYKGGSGTL

SEQ ID NO: 137205 - protein, 9 aa, Artificial Sequence
  Description of Artificial Sequence: Synthetic peptide
  Seed: SSIMSTESI (PMEL_HUMAN)
SAIMSTESW

SEQ ID NO: 137206 - protein, 9 aa, Artificial Sequence
  Description of Artificial Sequence: Synthetic peptide
  Seed: FLRNQPLTF (PMEL_HUMAN)
FQRNQPLTV

SEQ ID NO: 137207 - protein, 9 aa, Artificial Sequence
  Description of Artificial Sequence: Synthetic peptide
  Seed: TLIGANASF (PMEL_HUMAN)
TAIGANASV

SEQ ID NO: 137208 - protein, 9 aa, Artificial Sequence
  Description of Artificial Sequence: Synthetic peptide
  Seed: MPTAESTGM (PMEL_HUMAN)
MQTAESTGY

SEQ ID NO: 137209 - protein, 10 aa, Artificial Sequence
  Description of Artificial Sequence: Synthetic peptide
  Seed: MTPAEVSIVV (PMEL_HUMAN)
MWPAEVSIVS

SEQ ID NO: 137210 - protein, 9 aa, Artificial Sequence
  Description of Artificial Sequence: Synthetic peptide
  Seed: YLEPGPVTA (PMEL_HUMAN)
YGEPGPVTV

SEQ ID NO: 137211 - protein, 10 aa, Artificial Sequence
  Description of Artificial Sequence: Synthetic peptide
  Seed: YRYGSFSVTL (PMEL_HUMAN)
YEYGSFSVTM

SEQ ID NO: 137212 - protein, 10 aa, Artificial Sequence
  Description of Artificial Sequence: Synthetic peptide
  Seed: SVPQLPHSSS (PMEL_HUMAN)
SIPQLPHSSF

SEQ ID NO: 137213 - protein, 11 aa, Artificial Sequence
  Description of Artificial Sequence: Synthetic peptide
  Seed: HQILKGGSGTY (PMEL_HUMAN)
HQILKGGSGTW

SEQ ID NO: 137214 - protein, 9 aa, Artificial Sequence
  Description of Artificial Sequence: Synthetic peptide
  Seed: RSYVPLAHS (PMEL_HUMAN)
RGYVPLAHK

SEQ ID NO: 137215 - protein, 9 aa, Artificial Sequence
  Description of Artificial Sequence: Synthetic peptide
  Seed: SLAVVSTQL (PMEL_HUMAN)
SLAVVSTQM

SEQ ID NO: 137216 - protein, 11 aa, Artificial Sequence
  Description of Artificial Sequence: Synthetic peptide
  Seed: VPTTEVVGTTP (PMEL_HUMAN)
VPTTEVVGTTA

SEQ ID NO: 137217 - protein, 10 aa, Artificial Sequence
  Description of Artificial Sequence: Synthetic peptide
  Seed: SGTYCLNVSL (PMEL_HUMAN)
SNTYCLNVSF

SEQ ID NO: 137218 - protein, 9 aa, Artificial Sequence
  Description of Artificial Sequence: Synthetic peptide
  Seed: LIYRRRLMK (PMEL_HUMAN)
LQYRRRLMK

SEQ ID NO: 137219 - protein, 10 aa, Artificial Sequence
  Description of Artificial Sequence: Synthetic peptide
  Seed: YVWKTWGQYW (PMEL_HUMAN)
YWWKTWGQYF

SEQ ID NO: 137220 - protein, 9 aa, Artificial Sequence
  Description of Artificial Sequence: Synthetic peptide
  Seed: VVLSGTTAA (PMEL_HUMAN)
VPLSGTTAM

SEQ ID NO: 137221 - protein, 9 aa, Artificial Sequence
  Description of Artificial Sequence: Synthetic peptide
  Seed: TEWVETTAR (PMEL_HUMAN)
TEWVETTAT

SEQ ID NO: 137222 - protein, 10 aa, Artificial Sequence
  Description of Artificial Sequence: Synthetic peptide
  Seed: YGSFSVTLDI (PMEL_HUMAN)
YYSFSVTLDW

SEQ ID NO: 137223 - protein, 11 aa, Artificial Sequence
  Description of Artificial Sequence: Synthetic peptide
  Seed: TEVISTAPVQM (PMEL_HUMAN)
TEVISTAPVQY

SEQ ID NO: 137224 - protein, 10 aa, Artificial Sequence
  Description of Artificial Sequence: Synthetic peptide
  Seed: AWNRQLYPEW (PMEL_HUMAN)
AYNRQLYPEW

SEQ ID NO: 137225 - protein, 9 aa, Artificial Sequence
  Description of Artificial Sequence: Synthetic peptide
  Seed: LTSCGSSPV (PMEL_HUMAN)
LTSCGSSPI

SEQ ID NO: 137226 - protein, 10 aa, Artificial Sequence
  Description of Artificial Sequence: Synthetic peptide
  Seed: RQLYPEWTEA (PMEL_HUMAN)
RHLYPEWTEF

SEQ ID NO: 137227 - protein, 10 aa, Artificial Sequence
  Description of Artificial Sequence: Synthetic peptide
  Seed: RQLYPEWTEA (PMEL_HUMAN)
RYLYPEWTEL

SEQ ID NO: 137228 - protein, 10 aa, Artificial Sequence
  Description of Artificial Sequence: Synthetic peptide
  Seed: RGSRSYVPLA (PMEL_HUMAN)
RCSRSYVPLY

SEQ ID NO: 137229 - protein, 9 aa, Artificial Sequence
  Description of Artificial Sequence: Synthetic peptide
  Seed: SSHWLRLPR (PMEL_HUMAN)
SGHWLRLPR

SEQ ID NO: 137230 - protein, 10 aa, Artificial Sequence
  Description of Artificial Sequence: Synthetic peptide
  Seed: SQKRSFVYVW (PMEL_HUMAN)
SPKRSFVYVF

SEQ ID NO: 137231 - protein, 9 aa, Artificial Sequence
  Description of Artificial Sequence: Synthetic peptide
  Seed: VSNDGPTLI (PMEL_HUMAN)
VTNDGPTLF

SEQ ID NO: 137232 - protein, 9 aa, Artificial Sequence
  Description of Artificial Sequence: Synthetic peptide
  Seed: IPLTSCGSS (PMEL_HUMAN)
IPLTSCGSA

SEQ ID NO: 137233 - protein, 9 aa, Artificial Sequence
  Description of Artificial Sequence: Synthetic peptide
  Seed: AQVVLQAAI (PMEL_HUMAN)
AAVVLQAAY

SEQ ID NO: 137234 - protein, 10 aa, Artificial Sequence
  Description of Artificial Sequence: Synthetic peptide
  Seed: AVVLASLIYR (PMEL_HUMAN)
AAVLASLIYR

SEQ ID NO: 137235 - protein, 9 aa, Artificial Sequence
  Description of Artificial Sequence: Synthetic peptide
  Seed: LTSCGSSPV (PMEL_HUMAN)
LQSCGSSPV

SEQ ID NO: 137236 - protein, 11 aa, Artificial Sequence
  Description of Artificial Sequence: Synthetic peptide
  Seed: HQILKGGSGTY (PMEL_HUMAN)
HTILKGGSGTY

SEQ ID NO: 137237 - protein, 10 aa, Artificial Sequence
  Description of Artificial Sequence: Synthetic peptide
  Seed: RSFVYVWKTW (PMEL_HUMAN)
RGFVYVWKTF

SEQ ID NO: 137238 - protein, 10 aa, Artificial Sequence
  Description of Artificial Sequence: Synthetic peptide
  Seed: RQLYPEWTEA (PMEL_HUMAN)
RLLYPEWTEF

SEQ ID NO: 137239 - protein, 9 aa, Artificial Sequence
  Description of Artificial Sequence: Synthetic peptide
  Seed: AGQVPTTEV (PMEL_HUMAN)
ATQVPTTEY

SEQ ID NO: 137240 - protein, 10 aa, Artificial Sequence
  Description of Artificial Sequence: Synthetic peptide
  Seed: IFPDGGPCPS (PMEL_HUMAN)
IYPDGGPCPY

SEQ ID NO: 137241 - protein, 10 aa, Artificial Sequence
  Description of Artificial Sequence: Synthetic peptide
  Seed: SVPQLPHSSS (PMEL_HUMAN)
STPQLPHSSI

SEQ ID NO: 137242 - protein, 9 aa, Artificial Sequence
  Description of Artificial Sequence: Synthetic peptide
  Seed: RAMLGTHTM (PMEL_HUMAN)
RSMLGTHTY

SEQ ID NO: 137243 - protein, 9 aa, Artificial Sequence
  Description of Artificial Sequence: Synthetic peptide
  Seed: DSSGTLISR (PMEL_HUMAN)
DVSGTLISK

SEQ ID NO: 137244 - protein, 10 aa, Artificial Sequence
  Description of Artificial Sequence: Synthetic peptide
  Seed: ASSIMSTESI (PMEL_HUMAN)
AHSIMSTESF

SEQ ID NO: 137245 - protein, 11 aa, Artificial Sequence
  Description of Artificial Sequence: Synthetic peptide
  Seed: RALDGGNKHFL (PMEL_HUMAN)
RLLDGGNKHFW

SEQ ID NO: 137246 - protein, 10 aa, Artificial Sequence
  Description of Artificial Sequence: Synthetic peptide
  Seed: EVMGTTLAEM (PMEL_HUMAN)
EAMGTTLAEM

SEQ ID NO: 137247 - protein, 8 aa, Artificial Sequence
  Description of Artificial Sequence: Synthetic peptide
  Seed: SNDGPTLI (PMEL_HUMAN)
SADGPTLI

SEQ ID NO: 137248 - protein, 9 aa, Artificial Sequence
  Description of Artificial Sequence: Synthetic peptide
  Seed: FGDSSGTLI (PMEL_HUMAN)
FIDSSGTLC

SEQ ID NO: 137249 - protein, 9 aa, Artificial Sequence
  Description of Artificial Sequence: Synthetic peptide
  Seed: LMAVVLASL (PMEL_HUMAN)
LIAVVLASA

SEQ ID NO: 137250 - protein, 9 aa, Artificial Sequence
  Description of Artificial Sequence: Synthetic peptide
  Seed: GENSPLLSG (PMEL_HUMAN)
GENSPLLST

SEQ ID NO: 137251 - protein, 10 aa, Artificial Sequence
  Description of Artificial Sequence: Synthetic peptide
  Seed: KRQVPLDCVL (PMEL_HUMAN)
KDQVPLDCVM

SEQ ID NO: 137252 - protein, 10 aa, Artificial Sequence
  Description of Artificial Sequence: Synthetic peptide
  Seed: GTYCLNVSLA (PMEL_HUMAN)
GQYCLNVSLV

SEQ ID NO: 137253 - protein, 10 aa, Artificial Sequence
  Description of Artificial Sequence: Synthetic peptide
  Seed: LHLAVIGALL (PMEL_HUMAN)
LQLAVIGALV

SEQ ID NO: 137254 - protein, 10 aa, Artificial Sequence
  Description of Artificial Sequence: Synthetic peptide
  Seed: VSLADTNSLA (PMEL_HUMAN)
VLLADTNSLI

SEQ ID NO: 137255 - protein, 9 aa, Artificial Sequence
  Description of Artificial Sequence: Synthetic peptide
  Seed: ALVVTHTYL (PMEL_HUMAN)
ATVVTHTYR

SEQ ID NO: 137256 - protein, 11 aa, Artificial Sequence
  Description of Artificial Sequence: Synthetic peptide
  Seed: KVLPDGQVIWV (PMEL_HUMAN)
KALPDGQVIWM

SEQ ID NO: 137257 - protein, 9 aa, Artificial Sequence
  Description of Artificial Sequence: Synthetic peptide
  Seed: AQRLCQPVL (PMEL_HUMAN)
AIRLCQPVY

SEQ ID NO: 137258 - protein, 9 aa, Artificial Sequence
  Description of Artificial Sequence: Synthetic peptide
  Seed: RAMLGTHTM (PMEL_HUMAN)
RKMLGTHTY

SEQ ID NO: 137259 - protein, 10 aa, Artificial Sequence
  Description of Artificial Sequence: Synthetic peptide
  Seed: RQLYPEWTEA (PMEL_HUMAN)
RPLYPEWTEV

SEQ ID NO: 137260 - protein, 9 aa, Artificial Sequence
  Description of Artificial Sequence: Synthetic peptide
  Seed: RGSRSYVPL (PMEL_HUMAN)
RVSRSYVPA

SEQ ID NO: 137261 - protein, 11 aa, Artificial Sequence
  Description of Artificial Sequence: Synthetic peptide
  Seed: QAVPSGEGDAF (PMEL_HUMAN)
QMVPSGEGDAL

SEQ ID NO: 137262 - protein, 9 aa, Artificial Sequence
  Description of Artificial Sequence: Synthetic peptide
  Seed: TIINGSQVW (PMEL_HUMAN)
TSINGSQVF

SEQ ID NO: 137263 - protein, 10 aa, Artificial Sequence
  Description of Artificial Sequence: Synthetic peptide
  Seed: YVPLAHSSSA (PMEL_HUMAN)
YIPLAHSSSM

SEQ ID NO: 137264 - protein, 9 aa, Artificial Sequence
  Description of Artificial Sequence: Synthetic peptide
  Seed: TLIGANASF (PMEL_HUMAN)
TTIGANASW

SEQ ID NO: 137265 - protein, 10 aa, Artificial Sequence
  Description of Artificial Sequence: Synthetic peptide
  Seed: GPLLDGTATL (PMEL_HUMAN)
GYLLDGTATM

SEQ ID NO: 137266 - protein, 9 aa, Artificial Sequence
  Description of Artificial Sequence: Synthetic peptide
  Seed: QVWGGQPVY (PMEL_HUMAN)
QMWGGQPVY

SEQ ID NO: 137267 - protein, 11 aa, Artificial Sequence
  Description of Artificial Sequence: Synthetic peptide
  Seed: ALDGGNKHFLR (PMEL_HUMAN)
ASDGGNKHFLY

SEQ ID NO: 137268 - protein, 10 aa, Artificial Sequence
  Description of Artificial Sequence: Synthetic peptide
  Seed: LAVIGALLAV (PMEL_HUMAN)
LSVIGALLAV

SEQ ID NO: 137269 - protein, 9 aa, Artificial Sequence
  Description of Artificial Sequence: Synthetic peptide
  Seed: GTYCLNVSL (PMEL_HUMAN)
GMYCLNVSY

SEQ ID NO: 137270 - protein, 11 aa, Artificial Sequence
  Description of Artificial Sequence: Synthetic peptide
  Seed: THTMEVTVYHR (PMEL_HUMAN)
TNTMEVTVYHR

SEQ ID NO: 137271 - protein, 11 aa, Artificial Sequence
  Description of Artificial Sequence: Synthetic peptide
  Seed: RAMLGTHTMEV (PMEL_HUMAN)
RRMLGTHTMEV

SEQ ID NO: 137272 - protein, 10 aa, Artificial Sequence
  Description of Artificial Sequence: Synthetic peptide
  Seed: TVSCQGGLPK (PMEL_HUMAN)
TSSCQGGLPK

SEQ ID NO: 137273 - protein, 9 aa, Artificial Sequence
  Description of Artificial Sequence: Synthetic peptide
  Seed: SSIMSTESI (PMEL_HUMAN)
SFIMSTESY

SEQ ID NO: 137274 - protein, 11 aa, Artificial Sequence
  Description of Artificial Sequence: Synthetic peptide
  Seed: LGPLLDGTATL (PMEL_HUMAN)
LWPLLDGTATL

SEQ ID NO: 137275 - protein, 9 aa, Artificial Sequence
  Description of Artificial Sequence: Synthetic peptide
  Seed: QPVLPSPAC (PMEL_HUMAN)
QAVLPSPAI

SEQ ID NO: 137276 - protein, 9 aa, Artificial Sequence
  Description of Artificial Sequence: Synthetic peptide
  Seed: TLIGANASF (PMEL_HUMAN)
TEIGANASY

SEQ ID NO: 137277 - protein, 9 aa, Artificial Sequence
  Description of Artificial Sequence: Synthetic peptide
  Seed: FLRNQPLTF (PMEL_HUMAN)
FFRNQPLTF

SEQ ID NO: 137278 - protein, 9 aa, Artificial Sequence
  Description of Artificial Sequence: Synthetic peptide
  Seed: FPDGGPCPS (PMEL_HUMAN)
FADGGPCPM

SEQ ID NO: 137279 - protein, 10 aa, Artificial Sequence
  Description of Artificial Sequence: Synthetic peptide
  Seed: SSAFTITDQV (PMEL_HUMAN)
SAAFTITDQV

SEQ ID NO: 137280 - protein, 10 aa, Artificial Sequence
  Description of Artificial Sequence: Synthetic peptide
  Seed: MEISSPGCQP (PMEL_HUMAN)
MEISSPGCQL

SEQ ID NO: 137281 - protein, 9 aa, Artificial Sequence
  Description of Artificial Sequence: Synthetic peptide
  Seed: QVIWVNNTI (PMEL_HUMAN)
QIIWVNNTR

SEQ ID NO: 137282 - protein, 9 aa, Artificial Sequence
  Description of Artificial Sequence: Synthetic peptide
  Seed: YLEPGPVTA (PMEL_HUMAN)
YKEPGPVTL

SEQ ID NO: 137283 - protein, 11 aa, Artificial Sequence
  Description of Artificial Sequence: Synthetic peptide
  Seed: KAWNRQLYPEW (PMEL_HUMAN)
KTWNRQLYPEF

SEQ ID NO: 137284 - protein, 9 aa, Artificial Sequence
  Description of Artificial Sequence: Synthetic peptide
  Seed: VQMPTAEST (PMEL_HUMAN)
VHMPTAESF

SEQ ID NO: 137285 - protein, 9 aa, Artificial Sequence
  Description of Artificial Sequence: Synthetic peptide
  Seed: FSVSVSQLR (PMEL_HUMAN)
FAVSVSQLY

SEQ ID NO: 137286 - protein, 10 aa, Artificial Sequence
  Description of Artificial Sequence: Synthetic peptide
  Seed: YRYGSFSVTL (PMEL_HUMAN)
YVYGSFSVTY

SEQ ID NO: 137287 - protein, 10 aa, Artificial Sequence
  Description of Artificial Sequence: Synthetic peptide
  Seed: VPQLPHSSSH (PMEL_HUMAN)
VCQLPHSSSM

SEQ ID NO: 137288 - protein, 10 aa, Artificial Sequence
  Description of Artificial Sequence: Synthetic peptide
  Seed: YRYGSFSVTL (PMEL_HUMAN)
YSYGSFSVTM

SEQ ID NO: 137289 - protein, 10 aa, Artificial Sequence
  Description of Artificial Sequence: Synthetic peptide
  Seed: VPQLPHSSSH (PMEL_HUMAN)
VLQLPHSSSY

SEQ ID NO: 137290 - protein, 9 aa, Artificial Sequence
  Description of Artificial Sequence: Synthetic peptide
  Seed: GSRSYVPLA (PMEL_HUMAN)
GARSYVPLK

SEQ ID NO: 137291 - protein, 9 aa, Artificial Sequence
  Description of Artificial Sequence: Synthetic peptide
  Seed: YPQETDDAC (PMEL_HUMAN)
YMQETDDAY

SEQ ID NO: 137292 - protein, 10 aa, Artificial Sequence
  Description of Artificial Sequence: Synthetic peptide
  Seed: SRALVVTHTY (PMEL_HUMAN)
SRALVVTHTW

SEQ ID NO: 137293 - protein, 10 aa, Artificial Sequence
  Description of Artificial Sequence: Synthetic peptide
  Seed: TMEVTVYHRR (PMEL_HUMAN)
TVEVTVYHRR

SEQ ID NO: 137294 - protein, 9 aa, Artificial Sequence
  Description of Artificial Sequence: Synthetic peptide
  Seed: MTPEKVPVS (PMEL_HUMAN)
MFPEKVPVM

SEQ ID NO: 137295 - protein, 11 aa, Artificial Sequence
  Description of Artificial Sequence: Synthetic peptide
  Seed: AVIGALLAVGA (PMEL_HUMAN)
ALIGALLAVGV

SEQ ID NO: 137296 - protein, 9 aa, Artificial Sequence
  Description of Artificial Sequence: Synthetic peptide
  Seed: LHLAVIGAL (PMEL_HUMAN)
LKLAVIGAY

SEQ ID NO: 137297 - protein, 10 aa, Artificial Sequence
  Description of Artificial Sequence: Synthetic peptide
  Seed: MAVVLASLIY (PMEL_HUMAN)
MVVVLASLIY

SEQ ID NO: 137298 - protein, 9 aa, Artificial Sequence
  Description of Artificial Sequence: Synthetic peptide
  Seed: ILKGGSGTY (PMEL_HUMAN)
IQKGGSGTY

SEQ ID NO: 137299 - protein, 9 aa, Artificial Sequence
  Description of Artificial Sequence: Synthetic peptide
  Seed: VSNDGPTLI (PMEL_HUMAN)
VMNDGPTLY

SEQ ID NO: 137300 - protein, 9 aa, Artificial Sequence
  Description of Artificial Sequence: Synthetic peptide
  Seed: CPIGENSPL (PMEL_HUMAN)
CPIGENSPA

SEQ ID NO: 137301 - protein, 9 aa, Artificial Sequence
  Description of Artificial Sequence: Synthetic peptide
  Seed: STESITGSL (PMEL_HUMAN)
SLESITGSY

SEQ ID NO: 137302 - protein, 10 aa, Artificial Sequence
  Description of Artificial Sequence: Synthetic peptide
  Seed: THTMEVTVYH (PMEL_HUMAN)
TFTMEVTVYY

SEQ ID NO: 137303 - protein, 9 aa, Artificial Sequence
  Description of Artificial Sequence: Synthetic peptide
  Seed: LMAVVLASL (PMEL_HUMAN)
LMAVVLAST

SEQ ID NO: 137304 - protein, 9 aa, Artificial Sequence
  Description of Artificial Sequence: Synthetic peptide
  Seed: YPQETDDAC (PMEL_HUMAN)
YIQETDDAM

SEQ ID NO: 137305 - protein, 10 aa, Artificial Sequence
  Description of Artificial Sequence: Synthetic peptide
  Seed: ESITGSLGPL (PMEL_HUMAN)
ESITGSLGPV

SEQ ID NO: 137306 - protein, 10 aa, Artificial Sequence
  Description of Artificial Sequence: Synthetic peptide
  Seed: SCPIGENSPL (PMEL_HUMAN)
SIPIGENSPL

SEQ ID NO: 137307 - protein, 9 aa, Artificial Sequence
  Description of Artificial Sequence: Synthetic peptide
  Seed: GLSIGTGRA (PMEL_HUMAN)
GMSIGTGRV

SEQ ID NO: 137308 - protein, 9 aa, Artificial Sequence
  Description of Artificial Sequence: Synthetic peptide
  Seed: RSYVPLAHS (PMEL_HUMAN)
RTYVPLAHK

SEQ ID NO: 137309 - protein, 10 aa, Artificial Sequence
  Description of Artificial Sequence: Synthetic peptide
  Seed: HTMEVTVYHR (PMEL_HUMAN)
HLMEVTVYHK

SEQ ID NO: 137310 - protein, 9 aa, Artificial Sequence
  Description of Artificial Sequence: Synthetic peptide
  Seed: RGGQVSLKV (PMEL_HUMAN)
RAGQVSLKV

SEQ ID NO: 137311 - protein, 10 aa, Artificial Sequence
  Description of Artificial Sequence: Synthetic peptide
  Seed: AVIGALLAVG (PMEL_HUMAN)
AQIGALLAVW

SEQ ID NO: 137312 - protein, 10 aa, Artificial Sequence
  Description of Artificial Sequence: Synthetic peptide
  Seed: IESAEILQAV (PMEL_HUMAN)
IMSAEILQAI

SEQ ID NO: 137313 - protein, 9 aa, Artificial Sequence
  Description of Artificial Sequence: Synthetic peptide
  Seed: YHRRGSRSY (PMEL_HUMAN)
YWRRGSRSM

SEQ ID NO: 137314 - protein, 9 aa, Artificial Sequence
  Description of Artificial Sequence: Synthetic peptide
  Seed: GQVPLIVGI (PMEL_HUMAN)
GLVPLIVGL

SEQ ID NO: 137315 - protein, 10 aa, Artificial Sequence
  Description of Artificial Sequence: Synthetic peptide
  Seed: VPFSVSVSQL (PMEL_HUMAN)
VPFSVSVSQY

SEQ ID NO: 137316 - protein, 9 aa, Artificial Sequence
  Description of Artificial Sequence: Synthetic peptide
  Seed: LIVGILLVL (PMEL_HUMAN)
LAVGILLVV

SEQ ID NO: 137317 - protein, 9 aa, Artificial Sequence
  Description of Artificial Sequence: Synthetic peptide
  Seed: LMAVVLASL (PMEL_HUMAN)
LPAVVLASY

SEQ ID NO: 137318 - protein, 10 aa, Artificial Sequence
  Description of Artificial Sequence: Synthetic peptide
  Seed: SLADTNSLAV (PMEL_HUMAN)
SLADTNSLAW

SEQ ID NO: 137319 - protein, 10 aa, Artificial Sequence
  Description of Artificial Sequence: Synthetic peptide
  Seed: MSTESITGSL (PMEL_HUMAN)
MTTESITGSM

SEQ ID NO: 137320 - protein, 9 aa, Artificial Sequence
  Description of Artificial Sequence: Synthetic peptide
  Seed: LVLMAVVLA (PMEL_HUMAN)
LQLMAVVLI

SEQ ID NO: 137321 - protein, 10 aa, Artificial Sequence
  Description of Artificial Sequence: Synthetic peptide
  Seed: ESAEILQAVP (PMEL_HUMAN)
EVAEILQAVF

SEQ ID NO: 137322 - protein, 10 aa, Artificial Sequence
  Description of Artificial Sequence: Synthetic peptide
  Seed: SRALVVTHTY (PMEL_HUMAN)
SHALVVTHTW

SEQ ID NO: 137323 - protein, 11 aa, Artificial Sequence
  Description of Artificial Sequence: Synthetic peptide
  Seed: FGDSSGTLISR (PMEL_HUMAN)
FFDSSGTLISI

SEQ ID NO: 137324 - protein, 10 aa, Artificial Sequence
  Description of Artificial Sequence: Synthetic peptide
  Seed: THTMEVTVYH (PMEL_HUMAN)
TVTMEVTVYK

SEQ ID NO: 137325 - protein, 9 aa, Artificial Sequence
  Description of Artificial Sequence: Synthetic peptide
  Seed: KTWGQYWQV (PMEL_HUMAN)
KNWGQYWQW

SEQ ID NO: 137326 - protein, 11 aa, Artificial Sequence
  Description of Artificial Sequence: Synthetic peptide
  Seed: MAVVLASLIYR (PMEL_HUMAN)
MIVVLASLIYK

SEQ ID NO: 137327 - protein, 9 aa, Artificial Sequence
  Description of Artificial Sequence: Synthetic peptide
  Seed: LTVSCQGGL (PMEL_HUMAN)
LIVSCQGGV

SEQ ID NO: 137328 - protein, 10 aa, Artificial Sequence
  Description of Artificial Sequence: Synthetic peptide
  Seed: KVLPDGQVIW (PMEL_HUMAN)
KLLPDGQVIY

SEQ ID NO: 137329 - protein, 9 aa, Artificial Sequence
  Description of Artificial Sequence: Synthetic peptide
  Seed: VLGGPVSGL (PMEL_HUMAN)
VVGGPVSGF

SEQ ID NO: 137330 - protein, 9 aa, Artificial Sequence
  Description of Artificial Sequence: Synthetic peptide
  Seed: MLGTHTMEV (PMEL_HUMAN)
MLGTHTMEF

SEQ ID NO: 137331 - protein, 9 aa, Artificial Sequence
  Description of Artificial Sequence: Synthetic peptide
  Seed: VQMPTAEST (PMEL_HUMAN)
VQMPTAESH

SEQ ID NO: 137332 - protein, 9 aa, Artificial Sequence
  Description of Artificial Sequence: Synthetic peptide
  Seed: HTYLEPGPV (PMEL_HUMAN)
HIYLEPGPV

SEQ ID NO: 137333 - protein, 10 aa, Artificial Sequence
  Description of Artificial Sequence: Synthetic peptide
  Seed: LVLKRCLLHL (PMEL_HUMAN)
LSLKRCLLHV

SEQ ID NO: 137334 - protein, 9 aa, Artificial Sequence
  Description of Artificial Sequence: Synthetic peptide
  Seed: GQVPLIVGI (PMEL_HUMAN)
GVVPLIVGY

SEQ ID NO: 137335 - protein, 10 aa, Artificial Sequence
  Description of Artificial Sequence: Synthetic peptide
  Seed: FSVSVSQLRA (PMEL_HUMAN)
FVVSVSQLRV

SEQ ID NO: 137336 - protein, 9 aa, Artificial Sequence
  Description of Artificial Sequence: Synthetic peptide
  Seed: ITDQVPFSV (PMEL_HUMAN)
IVDQVPFSI

SEQ ID NO: 137337 - protein, 8 aa, Artificial Sequence
  Description of Artificial Sequence: Synthetic peptide
  Seed: AEVSIVVL (PMEL_HUMAN)
AEVSIVVV

SEQ ID NO: 137338 - protein, 9 aa, Artificial Sequence
  Description of Artificial Sequence: Synthetic peptide
  Seed: LIVGILLVL (PMEL_HUMAN)
LQVGILLVI

SEQ ID NO: 137339 - protein, 9 aa, Artificial Sequence
  Description of Artificial Sequence: Synthetic peptide
  Seed: SLIYRRRLM (PMEL_HUMAN)
SYIYRRRLY

SEQ ID NO: 137340 - protein, 9 aa, Artificial Sequence
  Description of Artificial Sequence: Synthetic peptide
  Seed: SQKRSFVYV (PMEL_HUMAN)
SGKRSFVYV

SEQ ID NO: 137341 - protein, 9 aa, Artificial Sequence
  Description of Artificial Sequence: Synthetic peptide
  Seed: ALDGGNKHF (PMEL_HUMAN)
AVDGGNKHF

SEQ ID NO: 137342 - protein, 9 aa, Artificial Sequence
  Description of Artificial Sequence: Synthetic peptide
  Seed: VISTAPVQM (PMEL_HUMAN)
VISTAPVQV

SEQ ID NO: 137343 - protein, 9 aa, Artificial Sequence
  Description of Artificial Sequence: Synthetic peptide
  Seed: LADTNSLAV (PMEL_HUMAN)
LCDTNSLAL

SEQ ID NO: 137344 - protein, 11 aa, Artificial Sequence
  Description of Artificial Sequence: Synthetic peptide
  Seed: KVLPDGQVIWV (PMEL_HUMAN)
KSLPDGQVIWF

SEQ ID NO: 137345 - protein, 9 aa, Artificial Sequence
  Description of Artificial Sequence: Synthetic peptide
  Seed: GTATLRLVK (PMEL_HUMAN)
GLATLRLVR

SEQ ID NO: 137346 - protein, 10 aa, Artificial Sequence
  Description of Artificial Sequence: Synthetic peptide
  Seed: LQLHDPSGYL (PMEL_HUMAN)
LCLHDPSGYV

SEQ ID NO: 137347 - protein, 10 aa, Artificial Sequence
  Description of Artificial Sequence: Synthetic peptide
  Seed: RQLYPEWTEA (PMEL_HUMAN)
RTLYPEWTEV

SEQ ID NO: 137348 - protein, 10 aa, Artificial Sequence
  Description of Artificial Sequence: Synthetic peptide
  Seed: YVPLAHSSSA (PMEL_HUMAN)
YMPLAHSSSV

SEQ ID NO: 137349 - protein, 10 aa, Artificial Sequence
  Description of Artificial Sequence: Synthetic peptide
  Seed: KTWGQYWQVL (PMEL_HUMAN)
KTWGQYWQVF

SEQ ID NO: 137350 - protein, 10 aa, Artificial Sequence
  Description of Artificial Sequence: Synthetic peptide
  Seed: CPIGENSPLL (PMEL_HUMAN)
CPIGENSPLY

SEQ ID NO: 137351 - protein, 10 aa, Artificial Sequence
  Description of Artificial Sequence: Synthetic peptide
  Seed: MSTESITGSL (PMEL_HUMAN)
MSTESITGSF

SEQ ID NO: 137352 - protein, 11 aa, Artificial Sequence
  Description of Artificial Sequence: Synthetic peptide
  Seed: AESTGMTPEKV (PMEL_HUMAN)
AESTGMTPEKF

SEQ ID NO: 137353 - protein, 9 aa, Artificial Sequence
  Description of Artificial Sequence: Synthetic peptide
  Seed: RIFCSCPIG (PMEL_HUMAN)
RSFCSCPIA

SEQ ID NO: 137354 - protein, 10 aa, Artificial Sequence
  Description of Artificial Sequence: Synthetic peptide
  Seed: SGTYCLNVSL (PMEL_HUMAN)
STTYCLNVSY

SEQ ID NO: 137355 - protein, 9 aa, Artificial Sequence
  Description of Artificial Sequence: Synthetic peptide
  Seed: HSSSHWLRL (PMEL_HUMAN)
HRSSHWLRY

SEQ ID NO: 137356 - protein, 9 aa, Artificial Sequence
  Description of Artificial Sequence: Synthetic peptide
  Seed: GQVPLIVGI (PMEL_HUMAN)
GIVPLIVGY

SEQ ID NO: 137357 - protein, 9 aa, Artificial Sequence
  Description of Artificial Sequence: Synthetic peptide
  Seed: FPDGGPCPS (PMEL_HUMAN)
FIDGGPCPY

SEQ ID NO: 137358 - protein, 11 aa, Artificial Sequence
  Description of Artificial Sequence: Synthetic peptide
  Seed: KHFLRNQPLTF (PMEL_HUMAN)
KWFLRNQPLTF

SEQ ID NO: 137359 - protein, 8 aa, Artificial Sequence
  Description of Artificial Sequence: Synthetic peptide
  Seed: LAHSSSAF (PMEL_HUMAN)
LMHSSSAM

SEQ ID NO: 137360 - protein, 9 aa, Artificial Sequence
  Description of Artificial Sequence: Synthetic peptide
  Seed: ALVVTHTYL (PMEL_HUMAN)
AQVVTHTYF

SEQ ID NO: 137361 - protein, 9 aa, Artificial Sequence
  Description of Artificial Sequence: Synthetic peptide
  Seed: GQVPTTEVV (PMEL_HUMAN)
GLVPTTEVL

SEQ ID NO: 137362 - protein, 9 aa, Artificial Sequence
  Description of Artificial Sequence: Synthetic peptide
  Seed: LADTNSLAV (PMEL_HUMAN)
LFDTNSLAI

SEQ ID NO: 137363 - protein, 9 aa, Artificial Sequence
  Description of Artificial Sequence: Synthetic peptide
  Seed: SQKRSFVYV (PMEL_HUMAN)
SLKRSFVYA

SEQ ID NO: 137364 - protein, 9 aa, Artificial Sequence
  Description of Artificial Sequence: Synthetic peptide
  Seed: SSIMSTESI (PMEL_HUMAN)
SQIMSTESM

SEQ ID NO: 137365 - protein, 9 aa, Artificial Sequence
  Description of Artificial Sequence: Synthetic peptide
  Seed: VLYRYGSFS (PMEL_HUMAN)
VLYRYGSFM

SEQ ID NO: 137366 - protein, 9 aa, Artificial Sequence
  Description of Artificial Sequence: Synthetic peptide
  Seed: TLIGANASF (PMEL_HUMAN)
TYIGANASF

SEQ ID NO: 137367 - protein, 9 aa, Artificial Sequence
  Description of Artificial Sequence: Synthetic peptide
  Seed: SVPQLPHSS (PMEL_HUMAN)
SFPQLPHSM

SEQ ID NO: 137368 - protein, 9 aa, Artificial Sequence
  Description of Artificial Sequence: Synthetic peptide
  Seed: VTAQVVLQA (PMEL_HUMAN)
VLAQVVLQA

SEQ ID NO: 137369 - protein, 11 aa, Artificial Sequence
  Description of Artificial Sequence: Synthetic peptide
  Seed: KVLPDGQVIWV (PMEL_HUMAN)
KTLPDGQVIWY

SEQ ID NO: 137370 - protein, 9 aa, Artificial Sequence
  Description of Artificial Sequence: Synthetic peptide
  Seed: LMAVVLASL (PMEL_HUMAN)
LMAVVLASF

SEQ ID NO: 137371 - protein, 10 aa, Artificial Sequence
  Description of Artificial Sequence: Synthetic peptide
  Seed: KRQVPLDCVL (PMEL_HUMAN)
KGQVPLDCVY

SEQ ID NO: 137372 - protein, 9 aa, Artificial Sequence
  Description of Artificial Sequence: Synthetic peptide
  Seed: MAVVLASLI (PMEL_HUMAN)
MNVVLASLY

SEQ ID NO: 137373 - protein, 11 aa, Artificial Sequence
  Description of Artificial Sequence: Synthetic peptide
  Seed: RRGSRSYVPLA (PMEL_HUMAN)
RTGSRSYVPLM

SEQ ID NO: 137374 - protein, 11 aa, Artificial Sequence
  Description of Artificial Sequence: Synthetic peptide
  Seed: AQVVLQAAIPL (PMEL_HUMAN)
AQVVLQAAIPY

SEQ ID NO: 137375 - protein, 10 aa, Artificial Sequence
  Description of Artificial Sequence: Synthetic peptide
  Seed: QVLGGPVSGL (PMEL_HUMAN)
QTLGGPVSGF

SEQ ID NO: 137376 - protein, 9 aa, Artificial Sequence
  Description of Artificial Sequence: Synthetic peptide
  Seed: AVVSTQLIM (PMEL_HUMAN)
ASVSTQLIM

SEQ ID NO: 137377 - protein, 9 aa, Artificial Sequence
  Description of Artificial Sequence: Synthetic peptide
  Seed: EVMGTTLAE (PMEL_HUMAN)
ELMGTTLAK

SEQ ID NO: 137378 - protein, 11 aa, Artificial Sequence
  Description of Artificial Sequence: Synthetic peptide
  Seed: GQYWQVLGGPV (PMEL_HUMAN)
GMYWQVLGGPV

SEQ ID NO: 137379 - protein, 9 aa, Artificial Sequence
  Description of Artificial Sequence: Synthetic peptide
  Seed: VLPDGQVIW (PMEL_HUMAN)
VMPDGQVIV

SEQ ID NO: 137380 - protein, 9 aa, Artificial Sequence
  Description of Artificial Sequence: Synthetic peptide
  Seed: MPTAESTGM (PMEL_HUMAN)
MPTAESTGL

SEQ ID NO: 137381 - protein, 11 aa, Artificial Sequence
  Description of Artificial Sequence: Synthetic peptide
  Seed: LGPLLDGTATL (PMEL_HUMAN)
LEPLLDGTATL

SEQ ID NO: 137382 - protein, 11 aa, Artificial Sequence
  Description of Artificial Sequence: Synthetic peptide
  Seed: RLPRIFCSCPI (PMEL_HUMAN)
RQPRIFCSCPL

SEQ ID NO: 137383 - protein, 9 aa, Artificial Sequence
  Description of Artificial Sequence: Synthetic peptide
  Seed: SEVMGTTLA (PMEL_HUMAN)
SDVMGTTLM

SEQ ID NO: 137384 - protein, 9 aa, Artificial Sequence
  Description of Artificial Sequence: Synthetic peptide
  Seed: SQKRSFVYV (PMEL_HUMAN)
SVKRSFVYN

SEQ ID NO: 137385 - protein, 9 aa, Artificial Sequence
  Description of Artificial Sequence: Synthetic peptide
  Seed: SQKRSFVYV (PMEL_HUMAN)
SIKRSFVYK

SEQ ID NO: 137386 - protein, 9 aa, Artificial Sequence
  Description of Artificial Sequence: Synthetic peptide
  Seed: VTLDIVQGI (PMEL_HUMAN)
VVLDIVQGW

SEQ ID NO: 137387 - protein, 10 aa, Artificial Sequence
  Description of Artificial Sequence: Synthetic peptide
  Seed: VPQLPHSSSH (PMEL_HUMAN)
VVQLPHSSSL

SEQ ID NO: 137388 - protein, 9 aa, Artificial Sequence
  Description of Artificial Sequence: Synthetic peptide
  Seed: SYVPLAHSS (PMEL_HUMAN)
SYVPLAHSF

SEQ ID NO: 137389 - protein, 10 aa, Artificial Sequence
  Description of Artificial Sequence: Synthetic peptide
  Seed: WKTWGQYWQV (PMEL_HUMAN)
WMTWGQYWQI

SEQ ID NO: 137390 - protein, 10 aa, Artificial Sequence
  Description of Artificial Sequence: Synthetic peptide
  Seed: YVPLAHSSSA (PMEL_HUMAN)
YAPLAHSSSM

SEQ ID NO: 137391 - protein, 9 aa, Artificial Sequence
  Description of Artificial Sequence: Synthetic peptide
  Seed: VVLQAAIPL (PMEL_HUMAN)
VMLQAAIPW

SEQ ID NO: 137392 - protein, 10 aa, Artificial Sequence
  Description of Artificial Sequence: Synthetic peptide
  Seed: THTMEVTVYH (PMEL_HUMAN)
TQTMEVTVYY

SEQ ID NO: 137393 - protein, 9 aa, Artificial Sequence
  Description of Artificial Sequence: Synthetic peptide
  Seed: VLMAVVLAS (PMEL_HUMAN)
VVMAVVLAV

SEQ ID NO: 137394 - protein, 9 aa, Artificial Sequence
  Description of Artificial Sequence: Synthetic peptide
  Seed: VTLDIVQGI (PMEL_HUMAN)
VMLDIVQGW

SEQ ID NO: 137395 - protein, 10 aa, Artificial Sequence
  Description of Artificial Sequence: Synthetic peptide
  Seed: RGSRSYVPLA (PMEL_HUMAN)
RSSRSYVPLS

SEQ ID NO: 137396 - protein, 11 aa, Artificial Sequence
  Description of Artificial Sequence: Synthetic peptide
  Seed: KRSFVYVWKTW (PMEL_HUMAN)
KSSFVYVWKTW

SEQ ID NO: 137397 - protein, 9 aa, Artificial Sequence
  Description of Artificial Sequence: Synthetic peptide
  Seed: CVLYRYGSF (PMEL_HUMAN)
CQLYRYGSF

SEQ ID NO: 137398 - protein, 9 aa, Artificial Sequence
  Description of Artificial Sequence: Synthetic peptide
  Seed: RTKAWNRQL (PMEL_HUMAN)
RQKAWNRQM

SEQ ID NO: 137399 - protein, 9 aa, Artificial Sequence
  Description of Artificial Sequence: Synthetic peptide
  Seed: HTMEVTVYH (PMEL_HUMAN)
HYMEVTVYY

SEQ ID NO: 137400 - protein, 9 aa, Artificial Sequence
  Description of Artificial Sequence: Synthetic peptide
  Seed: VLMAVVLAS (PMEL_HUMAN)
VVMAVVLAI

SEQ ID NO: 137401 - protein, 8 aa, Artificial Sequence
  Description of Artificial Sequence: Synthetic peptide
  Seed: QDFSVPQL (PMEL_HUMAN)
QEFSVPQY

SEQ ID NO: 137402 - protein, 9 aa, Artificial Sequence
  Description of Artificial Sequence: Synthetic peptide
  Seed: AEADLSYTW (PMEL_HUMAN)
AVADLSYTW

SEQ ID NO: 137403 - protein, 8 aa, Artificial Sequence
  Description of Artificial Sequence: Synthetic peptide
  Seed: MTPEKVPV (PMEL_HUMAN)
MAPEKVPL

SEQ ID NO: 137404 - protein, 9 aa, Artificial Sequence
  Description of Artificial Sequence: Synthetic peptide
  Seed: TTTEWVETT (PMEL_HUMAN)
TTTEWVETI

SEQ ID NO: 137405 - protein, 9 aa, Artificial Sequence
  Description of Artificial Sequence: Synthetic peptide
  Seed: TLISRALVV (PMEL_HUMAN)
TMISRALVL

SEQ ID NO: 137406 - protein, 10 aa, Artificial Sequence
  Description of Artificial Sequence: Synthetic peptide
  Seed: GRAMLGTHTM (PMEL_HUMAN)
GYAMLGTHTM

SEQ ID NO: 137407 - protein, 10 aa, Artificial Sequence
  Description of Artificial Sequence: Synthetic peptide
  Seed: KTWGQYWQVL (PMEL_HUMAN)
KQWGQYWQVF

SEQ ID NO: 137408 - protein, 9 aa, Artificial Sequence
  Description of Artificial Sequence: Synthetic peptide
  Seed: RYGSFSVTL (PMEL_HUMAN)
RQGSFSVTL

SEQ ID NO: 137409 - protein, 9 aa, Artificial Sequence
  Description of Artificial Sequence: Synthetic peptide
  Seed: ALVVTHTYL (PMEL_HUMAN)
AAVVTHTYL

SEQ ID NO: 137410 - protein, 9 aa, Artificial Sequence
  Description of Artificial Sequence: Synthetic peptide
  Seed: FLRNQPLTF (PMEL_HUMAN)
FHRNQPLTM

SEQ ID NO: 137411 - protein, 11 aa, Artificial Sequence
  Description of Artificial Sequence: Synthetic peptide
  Seed: RALDGGNKHFL (PMEL_HUMAN)
RELDGGNKHFL

SEQ ID NO: 137412 - protein, 9 aa, Artificial Sequence
  Description of Artificial Sequence: Synthetic peptide
  Seed: SPVPGTTDG (PMEL_HUMAN)
SPVPGTTDA

SEQ ID NO: 137413 - protein, 11 aa, Artificial Sequence
  Description of Artificial Sequence: Synthetic peptide
  Seed: ISRALVVTHTY (PMEL_HUMAN)
ITRALVVTHTF

SEQ ID NO: 137414 - protein, 9 aa, Artificial Sequence
  Description of Artificial Sequence: Synthetic peptide
  Seed: QVIWVNNTI (PMEL_HUMAN)
QAIWVNNTF

SEQ ID NO: 137415 - protein, 9 aa, Artificial Sequence
  Description of Artificial Sequence: Synthetic peptide
  Seed: VSNDGPTLI (PMEL_HUMAN)
VMNDGPTLM

SEQ ID NO: 137416 - protein, 9 aa, Artificial Sequence
  Description of Artificial Sequence: Synthetic peptide
  Seed: AQVVLQAAI (PMEL_HUMAN)
AQVVLQAAM

SEQ ID NO: 137417 - protein, 11 aa, Artificial Sequence
  Description of Artificial Sequence: Synthetic peptide
  Seed: RYGSFSVTLDI (PMEL_HUMAN)
RHGSFSVTLDW

SEQ ID NO: 137418 - protein, 10 aa, Artificial Sequence
  Description of Artificial Sequence: Synthetic peptide
  Seed: STAPVQMPTA (PMEL_HUMAN)
SMAPVQMPTV

SEQ ID NO: 137419 - protein, 10 aa, Artificial Sequence
  Description of Artificial Sequence: Synthetic peptide
  Seed: SSAFTITDQV (PMEL_HUMAN)
SMAFTITDQA

SEQ ID NO: 137420 - protein, 10 aa, Artificial Sequence
  Description of Artificial Sequence: Synthetic peptide
  Seed: SGTYCLNVSL (PMEL_HUMAN)
SRTYCLNVSW

SEQ ID NO: 137421 - protein, 9 aa, Artificial Sequence
  Description of Artificial Sequence: Synthetic peptide
  Seed: ANASFSIAL (PMEL_HUMAN)
AQASFSIAA

SEQ ID NO: 137422 - protein, 10 aa, Artificial Sequence
  Description of Artificial Sequence: Synthetic peptide
  Seed: RGSRSYVPLA (PMEL_HUMAN)
RTSRSYVPLK

SEQ ID NO: 137423 - protein, 9 aa, Artificial Sequence
  Description of Artificial Sequence: Synthetic peptide
  Seed: FTITDQVPF (PMEL_HUMAN)
FIITDQVPA

SEQ ID NO: 137424 - protein, 9 aa, Artificial Sequence
  Description of Artificial Sequence: Synthetic peptide
  Seed: SLAVVSTQL (PMEL_HUMAN)
SSAVVSTQF

SEQ ID NO: 137425 - protein, 9 aa, Artificial Sequence
  Description of Artificial Sequence: Synthetic peptide
  Seed: FLRNQPLTF (PMEL_HUMAN)
FMRNQPLTY

SEQ ID NO: 137426 - protein, 10 aa, Artificial Sequence
  Description of Artificial Sequence: Synthetic peptide
  Seed: VLPDGQVIWV (PMEL_HUMAN)
VAPDGQVIWL

SEQ ID NO: 137427 - protein, 9 aa, Artificial Sequence
  Description of Artificial Sequence: Synthetic peptide
  Seed: VVLSGTTAA (PMEL_HUMAN)
VPLSGTTAP

SEQ ID NO: 137428 - protein, 11 aa, Artificial Sequence
  Description of Artificial Sequence: Synthetic peptide
  Seed: GYLAEADLSYT (PMEL_HUMAN)
GVLAEADLSYV

SEQ ID NO: 137429 - protein, 9 aa, Artificial Sequence
  Description of Artificial Sequence: Synthetic peptide
  Seed: SQVWGGQPV (PMEL_HUMAN)
SVVWGGQPM

SEQ ID NO: 137430 - protein, 9 aa, Artificial Sequence
  Description of Artificial Sequence: Synthetic peptide
  Seed: VVLSGTTAA (PMEL_HUMAN)
VTLSGTTAY

SEQ ID NO: 137431 - protein, 10 aa, Artificial Sequence
  Description of Artificial Sequence: Synthetic peptide
  Seed: LQLHDPSGYL (PMEL_HUMAN)
LLLHDPSGYV

SEQ ID NO: 137432 - protein, 9 aa, Artificial Sequence
  Description of Artificial Sequence: Synthetic peptide
  Seed: WVETTAREL (PMEL_HUMAN)
WAETTAREY

SEQ ID NO: 137433 - protein, 10 aa, Artificial Sequence
  Description of Artificial Sequence: Synthetic peptide
  Seed: YLAEADLSYT (PMEL_HUMAN)
YVAEADLSYF

SEQ ID NO: 137434 - protein, 9 aa, Artificial Sequence
  Description of Artificial Sequence: Synthetic peptide
  Seed: SLGPLLDGT (PMEL_HUMAN)
SVGPLLDGM

SEQ ID NO: 137435 - protein, 9 aa, Artificial Sequence
  Description of Artificial Sequence: Synthetic peptide
  Seed: KVSNDGPTL (PMEL_HUMAN)
KSSNDGPTF

SEQ ID NO: 137436 - protein, 9 aa, Artificial Sequence
  Description of Artificial Sequence: Synthetic peptide
  Seed: TTAAQVTTT (PMEL_HUMAN)
TVAAQVTTI

SEQ ID NO: 137437 - protein, 9 aa, Artificial Sequence
  Description of Artificial Sequence: Synthetic peptide
  Seed: TIINGSQVW (PMEL_HUMAN)
TQINGSQVV

SEQ ID NO: 137438 - protein, 8 aa, Artificial Sequence
  Description of Artificial Sequence: Synthetic peptide
  Seed: LADTNSLA (PMEL_HUMAN)
LTDTNSLV

SEQ ID NO: 137439 - protein, 11 aa, Artificial Sequence
  Description of Artificial Sequence: Synthetic peptide
  Seed: GYLAEADLSYT (PMEL_HUMAN)
GLLAEADLSYI

SEQ ID NO: 137440 - protein, 9 aa, Artificial Sequence
  Description of Artificial Sequence: Synthetic peptide
  Seed: LPDGQVIWV (PMEL_HUMAN)
LFDGQVIWM

SEQ ID NO: 137441 - protein, 8 aa, Artificial Sequence
  Description of Artificial Sequence: Synthetic peptide
  Seed: VLYRYGSF (PMEL_HUMAN)
VQYRYGSY

SEQ ID NO: 137442 - protein, 9 aa, Artificial Sequence
  Description of Artificial Sequence: Synthetic peptide
  Seed: TPAEVSIVV (PMEL_HUMAN)
TVAEVSIVL

SEQ ID NO: 137443 - protein, 9 aa, Artificial Sequence
  Description of Artificial Sequence: Synthetic peptide
  Seed: LAVVSTQLI (PMEL_HUMAN)
LSVVSTQLM

SEQ ID NO: 137444 - protein, 9 aa, Artificial Sequence
  Description of Artificial Sequence: Synthetic peptide
  Seed: RLVKRQVPL (PMEL_HUMAN)
REVKRQVPY

SEQ ID NO: 137445 - protein, 9 aa, Artificial Sequence
  Description of Artificial Sequence: Synthetic peptide
  Seed: LPSPACQLV (PMEL_HUMAN)
LPSPACQLY

SEQ ID NO: 137446 - protein, 9 aa, Artificial Sequence
  Description of Artificial Sequence: Synthetic peptide
  Seed: FGDSSGTLI (PMEL_HUMAN)
FMDSSGTLV

SEQ ID NO: 137447 - protein, 10 aa, Artificial Sequence
  Description of Artificial Sequence: Synthetic peptide
  Seed: KTWGQYWQVL (PMEL_HUMAN)
KTWGQYWQVW

SEQ ID NO: 137448 - protein, 9 aa, Artificial Sequence
  Description of Artificial Sequence: Synthetic peptide
  Seed: DGGNKHFLR (PMEL_HUMAN)
DYGNKHFLR

SEQ ID NO: 137449 - protein, 9 aa, Artificial Sequence
  Description of Artificial Sequence: Synthetic peptide
  Seed: MAVVLASLI (PMEL_HUMAN)
MPVVLASLH

SEQ ID NO: 137450 - protein, 9 aa, Artificial Sequence
  Description of Artificial Sequence: Synthetic peptide
  Seed: DIVQGIESA (PMEL_HUMAN)
DSVQGIESV

SEQ ID NO: 137451 - protein, 10 aa, Artificial Sequence
  Description of Artificial Sequence: Synthetic peptide
  Seed: NSLAVVSTQL (PMEL_HUMAN)
NQLAVVSTQV

SEQ ID NO: 137452 - protein, 9 aa, Artificial Sequence
  Description of Artificial Sequence: Synthetic peptide
  Seed: LQAAIPLTS (PMEL_HUMAN)
LQAAIPLTL

SEQ ID NO: 137453 - protein, 10 aa, Artificial Sequence
  Description of Artificial Sequence: Synthetic peptide
  Seed: LSIGTGRAML (PMEL_HUMAN)
LAIGTGRAMF

SEQ ID NO: 137454 - protein, 10 aa, Artificial Sequence
  Description of Artificial Sequence: Synthetic peptide
  Seed: MTPAEVSIVV (PMEL_HUMAN)
MFPAEVSIVS

SEQ ID NO: 137455 - protein, 9 aa, Artificial Sequence
  Description of Artificial Sequence: Synthetic peptide
  Seed: RAMLGTHTM (PMEL_HUMAN)
RWMLGTHTW

SEQ ID NO: 137456 - protein, 10 aa, Artificial Sequence
  Description of Artificial Sequence: Synthetic peptide
  Seed: THTMEVTVYH (PMEL_HUMAN)
TMTMEVTVYR

SEQ ID NO: 137457 - protein, 9 aa, Artificial Sequence
  Description of Artificial Sequence: Synthetic peptide
  Seed: GILLVLMAV (PMEL_HUMAN)
GQLLVLMAI

SEQ ID NO: 137458 - protein, 10 aa, Artificial Sequence
  Description of Artificial Sequence: Synthetic peptide
  Seed: SGTYCLNVSL (PMEL_HUMAN)
SFTYCLNVSF

SEQ ID NO: 137459 - protein, 9 aa, Artificial Sequence
  Description of Artificial Sequence: Synthetic peptide
  Seed: LQAAIPLTS (PMEL_HUMAN)
LQAAIPLTV

SEQ ID NO: 137460 - protein, 8 aa, Artificial Sequence
  Description of Artificial Sequence: Synthetic peptide
  Seed: FGDSSGTL (PMEL_HUMAN)
FWDSSGTI

SEQ ID NO: 137461 - protein, 9 aa, Artificial Sequence
  Description of Artificial Sequence: Synthetic peptide
  Seed: FTITDQVPF (PMEL_HUMAN)
FWITDQVPM

SEQ ID NO: 137462 - protein, 10 aa, Artificial Sequence
  Description of Artificial Sequence: Synthetic peptide
  Seed: RGSRSYVPLA (PMEL_HUMAN)
RYSRSYVPLR

SEQ ID NO: 137463 - protein, 9 aa, Artificial Sequence
  Description of Artificial Sequence: Synthetic peptide
  Seed: GSWSQKRSF (PMEL_HUMAN)
GKWSQKRSY

SEQ ID NO: 137464 - protein, 10 aa, Artificial Sequence
  Description of Artificial Sequence: Synthetic peptide
  Seed: RRLMKQDFSV (PMEL_HUMAN)
RFLMKQDFSA

SEQ ID NO: 137465 - protein, 9 aa, Artificial Sequence
  Description of Artificial Sequence: Synthetic peptide
  Seed: SQVWGGQPV (PMEL_HUMAN)
SQVWGGQPW

SEQ ID NO: 137466 - protein, 10 aa, Artificial Sequence
  Description of Artificial Sequence: Synthetic peptide
  Seed: VVLASLIYRR (PMEL_HUMAN)
VILASLIYRR

SEQ ID NO: 137467 - protein, 9 aa, Artificial Sequence
  Description of Artificial Sequence: Synthetic peptide
  Seed: VQMPTAEST (PMEL_HUMAN)
VQMPTAESY

SEQ ID NO: 137468 - protein, 9 aa, Artificial Sequence
  Description of Artificial Sequence: Synthetic peptide
  Seed: FGDSSGTLI (PMEL_HUMAN)
FADSSGTLC

SEQ ID NO: 137469 - protein, 9 aa, Artificial Sequence
  Description of Artificial Sequence: Synthetic peptide
  Seed: FGDSSGTLI (PMEL_HUMAN)
FYDSSGTLA

SEQ ID NO: 137470 - protein, 9 aa, Artificial Sequence
  Description of Artificial Sequence: Synthetic peptide
  Seed: GQVPTTEVV (PMEL_HUMAN)
GHVPTTEVF

SEQ ID NO: 137471 - protein, 11 aa, Artificial Sequence
  Description of Artificial Sequence: Synthetic peptide
  Seed: LGPLLDGTATL (PMEL_HUMAN)
LGPLLDGTATV

SEQ ID NO: 137472 - protein, 9 aa, Artificial Sequence
  Description of Artificial Sequence: Synthetic peptide
  Seed: MAVVLASLI (PMEL_HUMAN)
MVVVLASLA

SEQ ID NO: 137473 - protein, 10 aa, Artificial Sequence
  Description of Artificial Sequence: Synthetic peptide
  Seed: RQLRTKAWNR (PMEL_HUMAN)
RYLRTKAWNR

SEQ ID NO: 137474 - protein, 9 aa, Artificial Sequence
  Description of Artificial Sequence: Synthetic peptide
  Seed: VSNDGPTLI (PMEL_HUMAN)
VANDGPTLY

SEQ ID NO: 137475 - protein, 9 aa, Artificial Sequence
  Description of Artificial Sequence: Synthetic peptide
  Seed: YRYGSFSVT (PMEL_HUMAN)
YRYGSFSVR

SEQ ID NO: 137476 - protein, 9 aa, Artificial Sequence
  Description of Artificial Sequence: Synthetic peptide
  Seed: RLVKRQVPL (PMEL_HUMAN)
RQVKRQVPI

SEQ ID NO: 137477 - protein, 10 aa, Artificial Sequence
  Description of Artificial Sequence: Synthetic peptide
  Seed: LQLHDPSGYL (PMEL_HUMAN)
LQLHDPSGYV

SEQ ID NO: 137478 - protein, 9 aa, Artificial Sequence
  Description of Artificial Sequence: Synthetic peptide
  Seed: SYVPLAHSS (PMEL_HUMAN)
SYVPLAHSI

SEQ ID NO: 137479 - protein, 10 aa, Artificial Sequence
  Description of Artificial Sequence: Synthetic peptide
  Seed: TMEVTVYHRR (PMEL_HUMAN)
TIEVTVYHRR

SEQ ID NO: 137480 - protein, 9 aa, Artificial Sequence
  Description of Artificial Sequence: Synthetic peptide
  Seed: AVGATKVPR (PMEL_HUMAN)
ASGATKVPK

SEQ ID NO: 137481 - protein, 10 aa, Artificial Sequence
  Description of Artificial Sequence: Synthetic peptide
  Seed: RSFVYVWKTW (PMEL_HUMAN)
RNFVYVWKTF

SEQ ID NO: 137482 - protein, 8 aa, Artificial Sequence
  Description of Artificial Sequence: Synthetic peptide
  Seed: SNDGPTLI (PMEL_HUMAN)
SYDGPTLV

SEQ ID NO: 137483 - protein, 11 aa, Artificial Sequence
  Description of Artificial Sequence: Synthetic peptide
  Seed: KAWNRQLYPEW (PMEL_HUMAN)
KTWNRQLYPEY

SEQ ID NO: 137484 - protein, 10 aa, Artificial Sequence
  Description of Artificial Sequence: Synthetic peptide
  Seed: RQLRTKAWNR (PMEL_HUMAN)
RSLRTKAWNK

SEQ ID NO: 137485 - protein, 10 aa, Artificial Sequence
  Description of Artificial Sequence: Synthetic peptide
  Seed: MTPAEVSIVV (PMEL_HUMAN)
MVPAEVSIVL

SEQ ID NO: 137486 - protein, 9 aa, Artificial Sequence
  Description of Artificial Sequence: Synthetic peptide
  Seed: FTITDQVPF (PMEL_HUMAN)
FQITDQVPY

SEQ ID NO: 137487 - protein, 10 aa, Artificial Sequence
  Description of Artificial Sequence: Synthetic peptide
  Seed: KVSNDGPTLI (PMEL_HUMAN)
KVSNDGPTLF

SEQ ID NO: 137488 - protein, 10 aa, Artificial Sequence
  Description of Artificial Sequence: Synthetic peptide
  Seed: YVPLAHSSSA (PMEL_HUMAN)
YMPLAHSSSA

SEQ ID NO: 137489 - protein, 9 aa, Artificial Sequence
  Description of Artificial Sequence: Synthetic peptide
  Seed: VQVPTTEVI (PMEL_HUMAN)
VHVPTTEVV

SEQ ID NO: 137490 - protein, 11 aa, Artificial Sequence
  Description of Artificial Sequence: Synthetic peptide
  Seed: YVPLAHSSSAF (PMEL_HUMAN)
YAPLAHSSSAY

SEQ ID NO: 137491 - protein, 9 aa, Artificial Sequence
  Description of Artificial Sequence: Synthetic peptide
  Seed: RNQPLTFAL (PMEL_HUMAN)
RRQPLTFAF

SEQ ID NO: 137492 - protein, 9 aa, Artificial Sequence
  Description of Artificial Sequence: Synthetic peptide
  Seed: EVVGTTPGQ (PMEL_HUMAN)
EIVGTTPGK

SEQ ID NO: 137493 - protein, 9 aa, Artificial Sequence
  Description of Artificial Sequence: Synthetic peptide
  Seed: GSWSQKRSF (PMEL_HUMAN)
GEWSQKRSY

SEQ ID NO: 137494 - protein, 10 aa, Artificial Sequence
  Description of Artificial Sequence: Synthetic peptide
  Seed: VLMAVVLASL (PMEL_HUMAN)
VEMAVVLASL

SEQ ID NO: 137495 - protein, 10 aa, Artificial Sequence
  Description of Artificial Sequence: Synthetic peptide
  Seed: RSFVYVWKTW (PMEL_HUMAN)
RRFVYVWKTF

SEQ ID NO: 137496 - protein, 9 aa, Artificial Sequence
  Description of Artificial Sequence: Synthetic peptide
  Seed: VVLQAAIPL (PMEL_HUMAN)
VKLQAAIPM

SEQ ID NO: 137497 - protein, 9 aa, Artificial Sequence
  Description of Artificial Sequence: Synthetic peptide
  Seed: SLAVVSTQL (PMEL_HUMAN)
STAVVSTQM

SEQ ID NO: 137498 - protein, 11 aa, Artificial Sequence
  Description of Artificial Sequence: Synthetic peptide
  Seed: RNQPLTFALQL (PMEL_HUMAN)
RPQPLTFALQL

SEQ ID NO: 137499 - protein, 10 aa, Artificial Sequence
  Description of Artificial Sequence: Synthetic peptide
  Seed: QVPLDCVLYR (PMEL_HUMAN)
QMPLDCVLYR

SEQ ID NO: 137500 - protein, 11 aa, Artificial Sequence
  Description of Artificial Sequence: Synthetic peptide
  Seed: QAVPSGEGDAF (PMEL_HUMAN)
QMVPSGEGDAI

SEQ ID NO: 137501 - protein, 10 aa, Artificial Sequence
  Description of Artificial Sequence: Synthetic peptide
  Seed: FPDGGPCPSG (PMEL_HUMAN)
FVDGGPCPSY

SEQ ID NO: 137502 - protein, 9 aa, Artificial Sequence
  Description of Artificial Sequence: Synthetic peptide
  Seed: VLKRCLLHL (PMEL_HUMAN)
VLKRCLLHI

SEQ ID NO: 137503 - protein, 9 aa, Artificial Sequence
  Description of Artificial Sequence: Synthetic peptide
  Seed: ITDQVPFSV (PMEL_HUMAN)
IMDQVPFSI

SEQ ID NO: 137504 - protein, 9 aa, Artificial Sequence
  Description of Artificial Sequence: Synthetic peptide
  Seed: LQAAIPLTS (PMEL_HUMAN)
LMAAIPLTF

SEQ ID NO: 137505 - protein, 9 aa, Artificial Sequence
  Description of Artificial Sequence: Synthetic peptide
  Seed: TTAAQVTTT (PMEL_HUMAN)
TTAAQVTTL

SEQ ID NO: 137506 - protein, 9 aa, Artificial Sequence
  Description of Artificial Sequence: Synthetic peptide
  Seed: SITGSLGPL (PMEL_HUMAN)
SITGSLGPF

SEQ ID NO: 137507 - protein, 10 aa, Artificial Sequence
  Description of Artificial Sequence: Synthetic peptide
  Seed: MPTAESTGMT (PMEL_HUMAN)
MMTAESTGML

SEQ ID NO: 137508 - protein, 8 aa, Artificial Sequence
  Description of Artificial Sequence: Synthetic peptide
  Seed: LHDPSGYL (PMEL_HUMAN)
LFDPSGYL

SEQ ID NO: 137509 - protein, 9 aa, Artificial Sequence
  Description of Artificial Sequence: Synthetic peptide
  Seed: VQVPTTEVI (PMEL_HUMAN)
VRVPTTEVV

SEQ ID NO: 137510 - protein, 9 aa, Artificial Sequence
  Description of Artificial Sequence: Synthetic peptide
  Seed: LMAVVLASL (PMEL_HUMAN)
LKAVVLASF

SEQ ID NO: 137511 - protein, 9 aa, Artificial Sequence
  Description of Artificial Sequence: Synthetic peptide
  Seed: GSFSVTLDI (PMEL_HUMAN)
GTFSVTLDM

SEQ ID NO: 137512 - protein, 10 aa, Artificial Sequence
  Description of Artificial Sequence: Synthetic peptide
  Seed: FSVSVSQLRA (PMEL_HUMAN)
FVVSVSQLRK

SEQ ID NO: 137513 - protein, 9 aa, Artificial Sequence
  Description of Artificial Sequence: Synthetic peptide
  Seed: TIINGSQVW (PMEL_HUMAN)
TAINGSQVM

SEQ ID NO: 137514 - protein, 10 aa, Artificial Sequence
  Description of Artificial Sequence: Synthetic peptide
  Seed: KRQVPLDCVL (PMEL_HUMAN)
KKQVPLDCVF

SEQ ID NO: 137515 - protein, 9 aa, Artificial Sequence
  Description of Artificial Sequence: Synthetic peptide
  Seed: DSSGTLISR (PMEL_HUMAN)
DTSGTLISR

SEQ ID NO: 137516 - protein, 9 aa, Artificial Sequence
  Description of Artificial Sequence: Synthetic peptide
  Seed: SQKRSFVYV (PMEL_HUMAN)
SLKRSFVYI

SEQ ID NO: 137517 - protein, 11 aa, Artificial Sequence
  Description of Artificial Sequence: Synthetic peptide
  Seed: FSVSVSQLRAL (PMEL_HUMAN)
FSVSVSQLRAY

SEQ ID NO: 137518 - protein, 11 aa, Artificial Sequence
  Description of Artificial Sequence: Synthetic peptide
  Seed: YLAEADLSYTW (PMEL_HUMAN)
YQAEADLSYTW

SEQ ID NO: 137519 - protein, 9 aa, Artificial Sequence
  Description of Artificial Sequence: Synthetic peptide
  Seed: GSWSQKRSF (PMEL_HUMAN)
GTWSQKRSY

SEQ ID NO: 137520 - protein, 10 aa, Artificial Sequence
  Description of Artificial Sequence: Synthetic peptide
  Seed: IFPDGGPCPS (PMEL_HUMAN)
IWPDGGPCPM

SEQ ID NO: 137521 - protein, 11 aa, Artificial Sequence
  Description of Artificial Sequence: Synthetic peptide
  Seed: AEMSTPEATGM (PMEL_HUMAN)
AEMSTPEATGC

SEQ ID NO: 137522 - protein, 10 aa, Artificial Sequence
  Description of Artificial Sequence: Synthetic peptide
  Seed: TTEWVETTAR (PMEL_HUMAN)
TSEWVETTAR

SEQ ID NO: 137523 - protein, 10 aa, Artificial Sequence
  Description of Artificial Sequence: Synthetic peptide
  Seed: RQLYPEWTEA (PMEL_HUMAN)
RILYPEWTEY

SEQ ID NO: 137524 - protein, 9 aa, Artificial Sequence
  Description of Artificial Sequence: Synthetic peptide
  Seed: YLAEADLSY (PMEL_HUMAN)
YMAEADLSL

SEQ ID NO: 137525 - protein, 9 aa, Artificial Sequence
  Description of Artificial Sequence: Synthetic peptide
  Seed: IMPGQEAGL (PMEL_HUMAN)
IFPGQEAGF

SEQ ID NO: 137526 - protein, 11 aa, Artificial Sequence
  Description of Artificial Sequence: Synthetic peptide
  Seed: VVLSGTTAAQV (PMEL_HUMAN)
VFLSGTTAAQV

SEQ ID NO: 137527 - protein, 9 aa, Artificial Sequence
  Description of Artificial Sequence: Synthetic peptide
  Seed: RNQPLTFAL (PMEL_HUMAN)
RRQPLTFAM

SEQ ID NO: 137528 - protein, 10 aa, Artificial Sequence
  Description of Artificial Sequence: Synthetic peptide
  Seed: VPQLPHSSSH (PMEL_HUMAN)
VKQLPHSSSL

SEQ ID NO: 137529 - protein, 9 aa, Artificial Sequence
  Description of Artificial Sequence: Synthetic peptide
  Seed: VVLASLIYR (PMEL_HUMAN)
VWLASLIYK

SEQ ID NO: 137530 - protein, 10 aa, Artificial Sequence
  Description of Artificial Sequence: Synthetic peptide
  Seed: MDLVLKRCLL (PMEL_HUMAN)
MLLVLKRCLL

SEQ ID NO: 137531 - protein, 9 aa, Artificial Sequence
  Description of Artificial Sequence: Synthetic peptide
  Seed: VVLSGTTAA (PMEL_HUMAN)
VILSGTTAM

SEQ ID NO: 137532 - protein, 9 aa, Artificial Sequence
  Description of Artificial Sequence: Synthetic peptide
  Seed: KAWNRQLYP (PMEL_HUMAN)
KAWNRQLYI

SEQ ID NO: 137533 - protein, 9 aa, Artificial Sequence
  Description of Artificial Sequence: Synthetic peptide
  Seed: ALDGGNKHF (PMEL_HUMAN)
AQDGGNKHI

SEQ ID NO: 137534 - protein, 10 aa, Artificial Sequence
  Description of Artificial Sequence: Synthetic peptide
  Seed: SQKRSFVYVW (PMEL_HUMAN)
SKKRSFVYVY

SEQ ID NO: 137535 - protein, 10 aa, Artificial Sequence
  Description of Artificial Sequence: Synthetic peptide
  Seed: VSLADTNSLA (PMEL_HUMAN)
VKLADTNSLI

SEQ ID NO: 137536 - protein, 9 aa, Artificial Sequence
  Description of Artificial Sequence: Synthetic peptide
  Seed: SQVWGGQPV (PMEL_HUMAN)
SIVWGGQPV

SEQ ID NO: 137537 - protein, 10 aa, Artificial Sequence
  Description of Artificial Sequence: Synthetic peptide
  Seed: YLAEADLSYT (PMEL_HUMAN)
YVAEADLSYV

SEQ ID NO: 137538 - protein, 10 aa, Artificial Sequence
  Description of Artificial Sequence: Synthetic peptide
  Seed: VYHRRGSRSY (PMEL_HUMAN)
VYHRRGSRSM

SEQ ID NO: 137539 - protein, 10 aa, Artificial Sequence
  Description of Artificial Sequence: Synthetic peptide
  Seed: SVPQLPHSSS (PMEL_HUMAN)
SDPQLPHSSF

SEQ ID NO: 137540 - protein, 10 aa, Artificial Sequence
  Description of Artificial Sequence: Synthetic peptide
  Seed: KRQVPLDCVL (PMEL_HUMAN)
KNQVPLDCVF

SEQ ID NO: 137541 - protein, 9 aa, Artificial Sequence
  Description of Artificial Sequence: Synthetic peptide
  Seed: LPHSSSHWL (PMEL_HUMAN)
LPHSSSHWF

SEQ ID NO: 137542 - protein, 9 aa, Artificial Sequence
  Description of Artificial Sequence: Synthetic peptide
  Seed: TYLEPGPVT (PMEL_HUMAN)
TFLEPGPVL

SEQ ID NO: 137543 - protein, 8 aa, Artificial Sequence
  Description of Artificial Sequence: Synthetic peptide
  Seed: LAVVSTQL (PMEL_HUMAN)
LQVVSTQI

SEQ ID NO: 137544 - protein, 9 aa, Artificial Sequence
  Description of Artificial Sequence: Synthetic peptide
  Seed: RALDGGNKH (PMEL_HUMAN)
RLLDGGNKM

SEQ ID NO: 137545 - protein, 11 aa, Artificial Sequence
  Description of Artificial Sequence: Synthetic peptide
  Seed: SQKRSFVYVWK (PMEL_HUMAN)
SSKRSFVYVWR

SEQ ID NO: 137546 - protein, 9 aa, Artificial Sequence
  Description of Artificial Sequence: Synthetic peptide
  Seed: VVLQAAIPL (PMEL_HUMAN)
VPLQAAIPL

SEQ ID NO: 137547 - protein, 11 aa, Artificial Sequence
  Description of Artificial Sequence: Synthetic peptide
  Seed: RYGSFSVTLDI (PMEL_HUMAN)
RVGSFSVTLDY

SEQ ID NO: 137548 - protein, 8 aa, Artificial Sequence
  Description of Artificial Sequence: Synthetic peptide
  Seed: STPEATGM (PMEL_HUMAN)
SSPEATGL

SEQ ID NO: 137549 - protein, 10 aa, Artificial Sequence
  Description of Artificial Sequence: Synthetic peptide
  Seed: VLMAVVLASL (PMEL_HUMAN)
VGMAVVLASA

SEQ ID NO: 137550 - protein, 9 aa, Artificial Sequence
  Description of Artificial Sequence: Synthetic peptide
  Seed: RLMKQDFSV (PMEL_HUMAN)
RLMKQDFSK

SEQ ID NO: 137551 - protein, 9 aa, Artificial Sequence
  Description of Artificial Sequence: Synthetic peptide
  Seed: ASFSIALNF (PMEL_HUMAN)
ATFSIALNM

SEQ ID NO: 137552 - protein, 9 aa, Artificial Sequence
  Description of Artificial Sequence: Synthetic peptide
  Seed: RGSRSYVPL (PMEL_HUMAN)
RVSRSYVPS

SEQ ID NO: 137553 - protein, 9 aa, Artificial Sequence
  Description of Artificial Sequence: Synthetic peptide
  Seed: LAVGATKVP (PMEL_HUMAN)
LAVGATKVF

SEQ ID NO: 137554 - protein, 9 aa, Artificial Sequence
  Description of Artificial Sequence: Synthetic peptide
  Seed: SITGSLGPL (PMEL_HUMAN)
SMTGSLGPI

SEQ ID NO: 137555 - protein, 9 aa, Artificial Sequence
  Description of Artificial Sequence: Synthetic peptide
  Seed: TTDGHRPTA (PMEL_HUMAN)
TLDGHRPTL

SEQ ID NO: 137556 - protein, 11 aa, Artificial Sequence
  Description of Artificial Sequence: Synthetic peptide
  Seed: SYVPLAHSSSA (PMEL_HUMAN)
SSVPLAHSSSF

SEQ ID NO: 137557 - protein, 9 aa, Artificial Sequence
  Description of Artificial Sequence: Synthetic peptide
  Seed: YLAEADLSY (PMEL_HUMAN)
YVAEADLSW

SEQ ID NO: 137558 - protein, 9 aa, Artificial Sequence
  Description of Artificial Sequence: Synthetic peptide
  Seed: LTVSCQGGL (PMEL_HUMAN)
LQVSCQGGV

SEQ ID NO: 137559 - protein, 10 aa, Artificial Sequence
  Description of Artificial Sequence: Synthetic peptide
  Seed: ESAEILQAVP (PMEL_HUMAN)
ETAEILQAVQ

SEQ ID NO: 137560 - protein, 9 aa, Artificial Sequence
  Description of Artificial Sequence: Synthetic peptide
  Seed: FTITDQVPF (PMEL_HUMAN)
FTITDQVPM

SEQ ID NO: 137561 - protein, 9 aa, Artificial Sequence
  Description of Artificial Sequence: Synthetic peptide
  Seed: EGDAFELTV (PMEL_HUMAN)
EYDAFELTL

SEQ ID NO: 137562 - protein, 11 aa, Artificial Sequence
  Description of Artificial Sequence: Synthetic peptide
  Seed: RALDGGNKHFL (PMEL_HUMAN)
RGLDGGNKHFY

SEQ ID NO: 137563 - protein, 11 aa, Artificial Sequence
  Description of Artificial Sequence: Synthetic peptide
  Seed: RRLMKQDFSVP (PMEL_HUMAN)
RYLMKQDFSVV

SEQ ID NO: 137564 - protein, 9 aa, Artificial Sequence
  Description of Artificial Sequence: Synthetic peptide
  Seed: WQVLGGPVS (PMEL_HUMAN)
WRVLGGPVY

SEQ ID NO: 137565 - protein, 10 aa, Artificial Sequence
  Description of Artificial Sequence: Synthetic peptide
  Seed: SVPQLPHSSS (PMEL_HUMAN)
SWPQLPHSSM

SEQ ID NO: 137566 - protein, 9 aa, Artificial Sequence
  Description of Artificial Sequence: Synthetic peptide
  Seed: VLPDGQVIW (PMEL_HUMAN)
VMPDGQVII

SEQ ID NO: 137567 - protein, 10 aa, Artificial Sequence
  Description of Artificial Sequence: Synthetic peptide
  Seed: MLGTHTMEVT (PMEL_HUMAN)
MMGTHTMEVA

SEQ ID NO: 137568 - protein, 9 aa, Artificial Sequence
  Description of Artificial Sequence: Synthetic peptide
  Seed: QAAIPLTSC (PMEL_HUMAN)
QPAIPLTSI

SEQ ID NO: 137569 - protein, 10 aa, Artificial Sequence
  Description of Artificial Sequence: Synthetic peptide
  Seed: FSVSVSQLRA (PMEL_HUMAN)
FTVSVSQLRK

SEQ ID NO: 137570 - protein, 9 aa, Artificial Sequence
  Description of Artificial Sequence: Synthetic peptide
  Seed: GSRSYVPLA (PMEL_HUMAN)
GSRSYVPLM

SEQ ID NO: 137571 - protein, 9 aa, Artificial Sequence
  Description of Artificial Sequence: Synthetic peptide
  Seed: SVQVPTTEV (PMEL_HUMAN)
SPQVPTTEL

SEQ ID NO: 137572 - protein, 9 aa, Artificial Sequence
  Description of Artificial Sequence: Synthetic peptide
  Seed: MTPEKVPVS (PMEL_HUMAN)
MMPEKVPVM

SEQ ID NO: 137573 - protein, 9 aa, Artificial Sequence
  Description of Artificial Sequence: Synthetic peptide
  Seed: TAEAPNTTA (PMEL_HUMAN)
TLEAPNTTV

SEQ ID NO: 137574 - protein, 10 aa, Artificial Sequence
  Description of Artificial Sequence: Synthetic peptide
  Seed: LVLKRCLLHL (PMEL_HUMAN)
LVLKRCLLHV

SEQ ID NO: 137575 - protein, 10 aa, Artificial Sequence
  Description of Artificial Sequence: Synthetic peptide
  Seed: RGSRSYVPLA (PMEL_HUMAN)
RKSRSYVPLL

SEQ ID NO: 137576 - protein, 11 aa, Artificial Sequence
  Description of Artificial Sequence: Synthetic peptide
  Seed: VPVSEVMGTTL (PMEL_HUMAN)
VPVSEVMGTTF

SEQ ID NO: 137577 - protein, 10 aa, Artificial Sequence
  Description of Artificial Sequence: Synthetic peptide
  Seed: LAEADLSYTW (PMEL_HUMAN)
LFEADLSYTW

SEQ ID NO: 137578 - protein, 9 aa, Artificial Sequence
  Description of Artificial Sequence: Synthetic peptide
  Seed: LMAVVLASL (PMEL_HUMAN)
LIAVVLASV

SEQ ID NO: 137579 - protein, 9 aa, Artificial Sequence
  Description of Artificial Sequence: Synthetic peptide
  Seed: SQKRSFVYV (PMEL_HUMAN)
SIKRSFVYY

SEQ ID NO: 137580 - protein, 11 aa, Artificial Sequence
  Description of Artificial Sequence: Synthetic peptide
  Seed: CVLYRYGSFSV (PMEL_HUMAN)
CYLYRYGSFSL

SEQ ID NO: 137581 - protein, 10 aa, Artificial Sequence
  Description of Artificial Sequence: Synthetic peptide
  Seed: GPLLDGTATL (PMEL_HUMAN)
GQLLDGTATM

SEQ ID NO: 137582 - protein, 9 aa, Artificial Sequence
  Description of Artificial Sequence: Synthetic peptide
  Seed: RALVVTHTY (PMEL_HUMAN)
RQLVVTHTY

SEQ ID NO: 137583 - protein, 10 aa, Artificial Sequence
  Description of Artificial Sequence: Synthetic peptide
  Seed: HTMEVTVYHR (PMEL_HUMAN)
HQMEVTVYHR

SEQ ID NO: 137584 - protein, 10 aa, Artificial Sequence
  Description of Artificial Sequence: Synthetic peptide
  Seed: RALVVTHTYL (PMEL_HUMAN)
RVLVVTHTYV

SEQ ID NO: 137585 - protein, 9 aa, Artificial Sequence
  Description of Artificial Sequence: Synthetic peptide
  Seed: FPDGGPCPS (PMEL_HUMAN)
FSDGGPCPY

SEQ ID NO: 137586 - protein, 9 aa, Artificial Sequence
  Description of Artificial Sequence: Synthetic peptide
  Seed: RYGSFSVTL (PMEL_HUMAN)
RMGSFSVTL

SEQ ID NO: 137587 - protein, 8 aa, Artificial Sequence
  Description of Artificial Sequence: Synthetic peptide
  Seed: TLDIVQGI (PMEL_HUMAN)
TFDIVQGL

SEQ ID NO: 137588 - protein, 9 aa, Artificial Sequence
  Description of Artificial Sequence: Synthetic peptide
  Seed: AEAPNTTAG (PMEL_HUMAN)
ADAPNTTAA

SEQ ID NO: 137589 - protein, 10 aa, Artificial Sequence
  Description of Artificial Sequence: Synthetic peptide
  Seed: RALVVTHTYL (PMEL_HUMAN)
RILVVTHTYV

SEQ ID NO: 137590 - protein, 9 aa, Artificial Sequence
  Description of Artificial Sequence: Synthetic peptide
  Seed: AVIGALLAV (PMEL_HUMAN)
ATIGALLAF

SEQ ID NO: 137591 - protein, 9 aa, Artificial Sequence
  Description of Artificial Sequence: Synthetic peptide
  Seed: RYGSFSVTL (PMEL_HUMAN)
RTGSFSVTL

SEQ ID NO: 137592 - protein, 9 aa, Artificial Sequence
  Description of Artificial Sequence: Synthetic peptide
  Seed: RAMLGTHTM (PMEL_HUMAN)
REMLGTHTF

SEQ ID NO: 137593 - protein, 9 aa, Artificial Sequence
  Description of Artificial Sequence: Synthetic peptide
  Seed: QKRSFVYVW (PMEL_HUMAN)
QQRSFVYVM

SEQ ID NO: 137594 - protein, 10 aa, Artificial Sequence
  Description of Artificial Sequence: Synthetic peptide
  Seed: SGTYCLNVSL (PMEL_HUMAN)
SFTYCLNVSW

SEQ ID NO: 137595 - protein, 10 aa, Artificial Sequence
  Description of Artificial Sequence: Synthetic peptide
  Seed: IALNFPGSQK (PMEL_HUMAN)
IHLNFPGSQK

SEQ ID NO: 137596 - protein, 10 aa, Artificial Sequence
  Description of Artificial Sequence: Synthetic peptide
  Seed: LPSPACQLVL (PMEL_HUMAN)
LPSPACQLVF

SEQ ID NO: 137597 - protein, 9 aa, Artificial Sequence
  Description of Artificial Sequence: Synthetic peptide
  Seed: QLRTKAWNR (PMEL_HUMAN)
QIRTKAWNR

SEQ ID NO: 137598 - protein, 8 aa, Artificial Sequence
  Description of Artificial Sequence: Synthetic peptide
  Seed: HTMEVTVY (PMEL_HUMAN)
HQMEVTVF

SEQ ID NO: 137599 - protein, 8 aa, Artificial Sequence
  Description of Artificial Sequence: Synthetic peptide
  Seed: LAVGATKV (PMEL_HUMAN)
LQVGATKV

SEQ ID NO: 137600 - protein, 9 aa, Artificial Sequence
  Description of Artificial Sequence: Synthetic peptide
  Seed: QDFSVPQLP (PMEL_HUMAN)
QEFSVPQLM

SEQ ID NO: 137601 - protein, 9 aa, Artificial Sequence
  Description of Artificial Sequence: Synthetic peptide
  Seed: AHSSSAFTI (PMEL_HUMAN)
AESSSAFTY

SEQ ID NO: 137602 - protein, 9 aa, Artificial Sequence
  Description of Artificial Sequence: Synthetic peptide
  Seed: RNQPLTFAL (PMEL_HUMAN)
RQQPLTFAI

SEQ ID NO: 137603 - protein, 10 aa, Artificial Sequence
  Description of Artificial Sequence: Synthetic peptide
  Seed: AMLGTHTMEV (PMEL_HUMAN)
AYLGTHTMEL

SEQ ID NO: 137604 - protein, 11 aa, Artificial Sequence
  Description of Artificial Sequence: Synthetic peptide
  Seed: ISRALVVTHTY (PMEL_HUMAN)
IGRALVVTHTW

SEQ ID NO: 137605 - protein, 9 aa, Artificial Sequence
  Description of Artificial Sequence: Synthetic peptide
  Seed: HLAVIGALL (PMEL_HUMAN)
HTAVIGALV

SEQ ID NO: 137606 - protein, 9 aa, Artificial Sequence
  Description of Artificial Sequence: Synthetic peptide
  Seed: KTWGQYWQV (PMEL_HUMAN)
KTWGQYWQH

SEQ ID NO: 137607 - protein, 10 aa, Artificial Sequence
  Description of Artificial Sequence: Synthetic peptide
  Seed: AVIGALLAVG (PMEL_HUMAN)
AVIGALLAVS

SEQ ID NO: 137608 - protein, 9 aa, Artificial Sequence
  Description of Artificial Sequence: Synthetic peptide
  Seed: AEADLSYTW (PMEL_HUMAN)
AQADLSYTV

SEQ ID NO: 137609 - protein, 9 aa, Artificial Sequence
  Description of Artificial Sequence: Synthetic peptide
  Seed: RLMKQDFSV (PMEL_HUMAN)
RYMKQDFSY

SEQ ID NO: 137610 - protein, 9 aa, Artificial Sequence
  Description of Artificial Sequence: Synthetic peptide
  Seed: SQKRSFVYV (PMEL_HUMAN)
STKRSFVYK

SEQ ID NO: 137611 - protein, 9 aa, Artificial Sequence
  Description of Artificial Sequence: Synthetic peptide
  Seed: VMGTTLAEM (PMEL_HUMAN)
VFGTTLAEF

SEQ ID NO: 137612 - protein, 9 aa, Artificial Sequence
  Description of Artificial Sequence: Synthetic peptide
  Seed: SQKRSFVYV (PMEL_HUMAN)
STKRSFVYG

SEQ ID NO: 137613 - protein, 11 aa, Artificial Sequence
  Description of Artificial Sequence: Synthetic peptide
  Seed: FGDSSGTLISR (PMEL_HUMAN)
FWDSSGTLISM

SEQ ID NO: 137614 - protein, 9 aa, Artificial Sequence
  Description of Artificial Sequence: Synthetic peptide
  Seed: ISRALVVTH (PMEL_HUMAN)
IMRALVVTM

SEQ ID NO: 137615 - protein, 10 aa, Artificial Sequence
  Description of Artificial Sequence: Synthetic peptide
  Seed: VVLASLIYRR (PMEL_HUMAN)
VNLASLIYRR

SEQ ID NO: 137616 - protein, 10 aa, Artificial Sequence
  Description of Artificial Sequence: Synthetic peptide
  Seed: RRLMKQDFSV (PMEL_HUMAN)
RPLMKQDFSL

SEQ ID NO: 137617 - protein, 9 aa, Artificial Sequence
  Description of Artificial Sequence: Synthetic peptide
  Seed: YLAEADLSY (PMEL_HUMAN)
YMAEADLSH

SEQ ID NO: 137618 - protein, 10 aa, Artificial Sequence
  Description of Artificial Sequence: Synthetic peptide
  Seed: EATGMTPAEV (PMEL_HUMAN)
ETTGMTPAEV

SEQ ID NO: 137619 - protein, 11 aa, Artificial Sequence
  Description of Artificial Sequence: Synthetic peptide
  Seed: RPTAEAPNTTA (PMEL_HUMAN)
RPTAEAPNTTM

SEQ ID NO: 137620 - protein, 10 aa, Artificial Sequence
  Description of Artificial Sequence: Synthetic peptide
  Seed: EVSIVVLSGT (PMEL_HUMAN)
EASIVVLSGL

SEQ ID NO: 137621 - protein, 9 aa, Artificial Sequence
  Description of Artificial Sequence: Synthetic peptide
  Seed: RGSRSYVPL (PMEL_HUMAN)
RGSRSYVPK

SEQ ID NO: 137622 - protein, 8 aa, Artificial Sequence
  Description of Artificial Sequence: Synthetic peptide
  Seed: YGSFSVTL (PMEL_HUMAN)
YASFSVTF

SEQ ID NO: 137623 - protein, 8 aa, Artificial Sequence
  Description of Artificial Sequence: Synthetic peptide
  Seed: SIGTGRAM (PMEL_HUMAN)
SAGTGRAL

SEQ ID NO: 137624 - protein, 10 aa, Artificial Sequence
  Description of Artificial Sequence: Synthetic peptide
  Seed: YGSFSVTLDI (PMEL_HUMAN)
YNSFSVTLDF

SEQ ID NO: 137625 - protein, 11 aa, Artificial Sequence
  Description of Artificial Sequence: Synthetic peptide
  Seed: AQVVLQAAIPL (PMEL_HUMAN)
AQVVLQAAIPF

SEQ ID NO: 137626 - protein, 9 aa, Artificial Sequence
  Description of Artificial Sequence: Synthetic peptide
  Seed: VLASLIYRR (PMEL_HUMAN)
VSASLIYRK

SEQ ID NO: 137627 - protein, 9 aa, Artificial Sequence
  Description of Artificial Sequence: Synthetic peptide
  Seed: VVLASLIYR (PMEL_HUMAN)
VTLASLIYK

SEQ ID NO: 137628 - protein, 10 aa, Artificial Sequence
  Description of Artificial Sequence: Synthetic peptide
  Seed: RNQDWLGVSR (PMEL_HUMAN)
RLQDWLGVSK

SEQ ID NO: 137629 - protein, 9 aa, Artificial Sequence
  Description of Artificial Sequence: Synthetic peptide
  Seed: QKRSFVYVW (PMEL_HUMAN)
QHRSFVYVY

SEQ ID NO: 137630 - protein, 9 aa, Artificial Sequence
  Description of Artificial Sequence: Synthetic peptide
  Seed: SGLSIGTGR (PMEL_HUMAN)
SLLSIGTGR

SEQ ID NO: 137631 - protein, 9 aa, Artificial Sequence
  Description of Artificial Sequence: Synthetic peptide
  Seed: LADTNSLAV (PMEL_HUMAN)
LSDTNSLAI

SEQ ID NO: 137632 - protein, 9 aa, Artificial Sequence
  Description of Artificial Sequence: Synthetic peptide
  Seed: GPVSGLSIG (PMEL_HUMAN)
GPVSGLSIA

SEQ ID NO: 137633 - protein, 10 aa, Artificial Sequence
  Description of Artificial Sequence: Synthetic peptide
  Seed: EVMGTTLAEM (PMEL_HUMAN)
ESMGTTLAEV

SEQ ID NO: 137634 - protein, 10 aa, Artificial Sequence
  Description of Artificial Sequence: Synthetic peptide
  Seed: GPLLDGTATL (PMEL_HUMAN)
GVLLDGTATV

SEQ ID NO: 137635 - protein, 10 aa, Artificial Sequence
  Description of Artificial Sequence: Synthetic peptide
  Seed: AVVLASLIYR (PMEL_HUMAN)
ASVLASLIYK

SEQ ID NO: 137636 - protein, 11 aa, Artificial Sequence
  Description of Artificial Sequence: Synthetic peptide
  Seed: MPTAESTGMTP (PMEL_HUMAN)
MPTAESTGMTI

SEQ ID NO: 137637 - protein, 9 aa, Artificial Sequence
  Description of Artificial Sequence: Synthetic peptide
  Seed: VLASLIYRR (PMEL_HUMAN)
VVASLIYRR

SEQ ID NO: 137638 - protein, 9 aa, Artificial Sequence
  Description of Artificial Sequence: Synthetic peptide
  Seed: LSGTTAAQV (PMEL_HUMAN)
LIGTTAAQV

SEQ ID NO: 137639 - protein, 9 aa, Artificial Sequence
  Description of Artificial Sequence: Synthetic peptide
  Seed: GSSPVPGTT (PMEL_HUMAN)
GASPVPGTM

SEQ ID NO: 137640 - protein, 10 aa, Artificial Sequence
  Description of Artificial Sequence: Synthetic peptide
  Seed: ASSIMSTESI (PMEL_HUMAN)
ARSIMSTESW

SEQ ID NO: 137641 - protein, 10 aa, Artificial Sequence
  Description of Artificial Sequence: Synthetic peptide
  Seed: VLMAVVLASL (PMEL_HUMAN)
VFMAVVLASA

SEQ ID NO: 137642 - protein, 9 aa, Artificial Sequence
  Description of Artificial Sequence: Synthetic peptide
  Seed: WQVLGGPVS (PMEL_HUMAN)
WQVLGGPVY

SEQ ID NO: 137643 - protein, 9 aa, Artificial Sequence
  Description of Artificial Sequence: Synthetic peptide
  Seed: SQKRSFVYV (PMEL_HUMAN)
SHKRSFVYK

SEQ ID NO: 137644 - protein, 9 aa, Artificial Sequence
  Description of Artificial Sequence: Synthetic peptide
  Seed: SGTLISRAL (PMEL_HUMAN)
SQTLISRAI

SEQ ID NO: 137645 - protein, 11 aa, Artificial Sequence
  Description of Artificial Sequence: Synthetic peptide
  Seed: FTITDQVPFSV (PMEL_HUMAN)
FAITDQVPFSW

SEQ ID NO: 137646 - protein, 11 aa, Artificial Sequence
  Description of Artificial Sequence: Synthetic peptide
  Seed: TLIGANASFSI (PMEL_HUMAN)
TLIGANASFSV

SEQ ID NO: 137647 - protein, 11 aa, Artificial Sequence
  Description of Artificial Sequence: Synthetic peptide
  Seed: YLAEADLSYTW (PMEL_HUMAN)
YIAEADLSYTI

SEQ ID NO: 137648 - protein, 9 aa, Artificial Sequence
  Description of Artificial Sequence: Synthetic peptide
  Seed: HSSSHWLRL (PMEL_HUMAN)
HQSSHWLRK

SEQ ID NO: 137649 - protein, 10 aa, Artificial Sequence
  Description of Artificial Sequence: Synthetic peptide
  Seed: VLMAVVLASL (PMEL_HUMAN)
VSMAVVLASA

SEQ ID NO: 137650 - protein, 10 aa, Artificial Sequence
  Description of Artificial Sequence: Synthetic peptide
  Seed: LGQVPLIVGI (PMEL_HUMAN)
LLQVPLIVGA

SEQ ID NO: 137651 - protein, 10 aa, Artificial Sequence
  Description of Artificial Sequence: Synthetic peptide
  Seed: ALDGGNKHFL (PMEL_HUMAN)
AIDGGNKHFL

SEQ ID NO: 137652 - protein, 10 aa, Artificial Sequence
  Description of Artificial Sequence: Synthetic peptide
  Seed: ELTVSCQGGL (PMEL_HUMAN)
ENTVSCQGGV

SEQ ID NO: 137653 - protein, 9 aa, Artificial Sequence
  Description of Artificial Sequence: Synthetic peptide
  Seed: YHRRGSRSY (PMEL_HUMAN)
YIRRGSRSM

SEQ ID NO: 137654 - protein, 10 aa, Artificial Sequence
  Description of Artificial Sequence: Synthetic peptide
  Seed: SSSHWLRLPR (PMEL_HUMAN)
SQSHWLRLPR

SEQ ID NO: 137655 - protein, 9 aa, Artificial Sequence
  Description of Artificial Sequence: Synthetic peptide
  Seed: YLEPGPVTA (PMEL_HUMAN)
YMEPGPVTR

SEQ ID NO: 137656 - protein, 9 aa, Artificial Sequence
  Description of Artificial Sequence: Synthetic peptide
  Seed: SVQVPTTEV (PMEL_HUMAN)
SSQVPTTEM

SEQ ID NO: 137657 - protein, 10 aa, Artificial Sequence
  Description of Artificial Sequence: Synthetic peptide
  Seed: RGSRSYVPLA (PMEL_HUMAN)
RTSRSYVPLR

SEQ ID NO: 137658 - protein, 9 aa, Artificial Sequence
  Description of Artificial Sequence: Synthetic peptide
  Seed: AEADLSYTW (PMEL_HUMAN)
APADLSYTW

SEQ ID NO: 137659 - protein, 10 aa, Artificial Sequence
  Description of Artificial Sequence: Synthetic peptide
  Seed: MKQDFSVPQL (PMEL_HUMAN)
MHQDFSVPQY

SEQ ID NO: 137660 - protein, 9 aa, Artificial Sequence
  Description of Artificial Sequence: Synthetic peptide
  Seed: VVLQAAIPL (PMEL_HUMAN)
VELQAAIPF

SEQ ID NO: 137661 - protein, 11 aa, Artificial Sequence
  Description of Artificial Sequence: Synthetic peptide
  Seed: NQDWLGVSRQL (PMEL_HUMAN)
NHDWLGVSRQL

SEQ ID NO: 137662 - protein, 9 aa, Artificial Sequence
  Description of Artificial Sequence: Synthetic peptide
  Seed: MPTAESTGM (PMEL_HUMAN)
MATAESTGF

SEQ ID NO: 137663 - protein, 10 aa, Artificial Sequence
  Description of Artificial Sequence: Synthetic peptide
  Seed: LVLMAVVLAS (PMEL_HUMAN)
LVLMAVVLAI

SEQ ID NO: 137664 - protein, 10 aa, Artificial Sequence
  Description of Artificial Sequence: Synthetic peptide
  Seed: KRQVPLDCVL (PMEL_HUMAN)
KMQVPLDCVM

SEQ ID NO: 137665 - protein, 11 aa, Artificial Sequence
  Description of Artificial Sequence: Synthetic peptide
  Seed: ITDQVPFSVSV (PMEL_HUMAN)
ISDQVPFSVSL

SEQ ID NO: 137666 - protein, 9 aa, Artificial Sequence
  Description of Artificial Sequence: Synthetic peptide
  Seed: RQVPLDCVL (PMEL_HUMAN)
RKVPLDCVM

SEQ ID NO: 137667 - protein, 10 aa, Artificial Sequence
  Description of Artificial Sequence: Synthetic peptide
  Seed: TDQVPFSVSV (PMEL_HUMAN)
TGQVPFSVSV

SEQ ID NO: 137668 - protein, 9 aa, Artificial Sequence
  Description of Artificial Sequence: Synthetic peptide
  Seed: RQVPLDCVL (PMEL_HUMAN)
RIVPLDCVY

SEQ ID NO: 137669 - protein, 10 aa, Artificial Sequence
  Description of Artificial Sequence: Synthetic peptide
  Seed: ALDGGNKHFL (PMEL_HUMAN)
AGDGGNKHFY

SEQ ID NO: 137670 - protein, 10 aa, Artificial Sequence
  Description of Artificial Sequence: Synthetic peptide
  Seed: YGSFSVTLDI (PMEL_HUMAN)
YCSFSVTLDW

SEQ ID NO: 137671 - protein, 8 aa, Artificial Sequence
  Description of Artificial Sequence: Synthetic peptide
  Seed: TLDIVQGI (PMEL_HUMAN)
TVDIVQGI

SEQ ID NO: 137672 - protein, 9 aa, Artificial Sequence
  Description of Artificial Sequence: Synthetic peptide
  Seed: RLMKQDFSV (PMEL_HUMAN)
RAMKQDFSF

SEQ ID NO: 137673 - protein, 9 aa, Artificial Sequence
  Description of Artificial Sequence: Synthetic peptide
  Seed: RALVVTHTY (PMEL_HUMAN)
RNLVVTHTF

SEQ ID NO: 137674 - protein, 9 aa, Artificial Sequence
  Description of Artificial Sequence: Synthetic peptide
  Seed: TLIGANASF (PMEL_HUMAN)
TIIGANASM

SEQ ID NO: 137675 - protein, 9 aa, Artificial Sequence
  Description of Artificial Sequence: Synthetic peptide
  Seed: QVIWVNNTI (PMEL_HUMAN)
QMIWVNNTF

SEQ ID NO: 137676 - protein, 9 aa, Artificial Sequence
  Description of Artificial Sequence: Synthetic peptide
  Seed: AEMSTPEAT (PMEL_HUMAN)
AEMSTPEAS

SEQ ID NO: 137677 - protein, 10 aa, Artificial Sequence
  Description of Artificial Sequence: Synthetic peptide
  Seed: RQLYPEWTEA (PMEL_HUMAN)
RWLYPEWTEI

SEQ ID NO: 137678 - protein, 9 aa, Artificial Sequence
  Description of Artificial Sequence: Synthetic peptide
  Seed: SQVWGGQPV (PMEL_HUMAN)
SQVWGGQPH

SEQ ID NO: 137679 - protein, 10 aa, Artificial Sequence
  Description of Artificial Sequence: Synthetic peptide
  Seed: VSLADTNSLA (PMEL_HUMAN)
VRLADTNSLL

SEQ ID NO: 137680 - protein, 9 aa, Artificial Sequence
  Description of Artificial Sequence: Synthetic peptide
  Seed: VSNDGPTLI (PMEL_HUMAN)
VVNDGPTLV

SEQ ID NO: 137681 - protein, 9 aa, Artificial Sequence
  Description of Artificial Sequence: Synthetic peptide
  Seed: SQKRSFVYV (PMEL_HUMAN)
SLKRSFVYY

SEQ ID NO: 137682 - protein, 11 aa, Artificial Sequence
  Description of Artificial Sequence: Synthetic peptide
  Seed: CVLYRYGSFSV (PMEL_HUMAN)
CMLYRYGSFSI

SEQ ID NO: 137683 - protein, 10 aa, Artificial Sequence
  Description of Artificial Sequence: Synthetic peptide
  Seed: KVLPDGQVIW (PMEL_HUMAN)
KSLPDGQVIY

SEQ ID NO: 137684 - protein, 11 aa, Artificial Sequence
  Description of Artificial Sequence: Synthetic peptide
  Seed: SSPGCQPPAQR (PMEL_HUMAN)
SVPGCQPPAQK

SEQ ID NO: 137685 - protein, 10 aa, Artificial Sequence
  Description of Artificial Sequence: Synthetic peptide
  Seed: EVMGTTLAEM (PMEL_HUMAN)
EMMGTTLAER

SEQ ID NO: 137686 - protein, 10 aa, Artificial Sequence
  Description of Artificial Sequence: Synthetic peptide
  Seed: RTKAWNRQLY (PMEL_HUMAN)
RVKAWNRQLK

SEQ ID NO: 137687 - protein, 10 aa, Artificial Sequence
  Description of Artificial Sequence: Synthetic peptide
  Seed: THTMEVTVYH (PMEL_HUMAN)
TCTMEVTVYY

SEQ ID NO: 137688 - protein, 9 aa, Artificial Sequence
  Description of Artificial Sequence: Synthetic peptide
  Seed: RTKAWNRQL (PMEL_HUMAN)
RVKAWNRQF

SEQ ID NO: 137689 - protein, 9 aa, Artificial Sequence
  Description of Artificial Sequence: Synthetic peptide
  Seed: ITDQVPFSV (PMEL_HUMAN)
ILDQVPFSC

SEQ ID NO: 137690 - protein, 9 aa, Artificial Sequence
  Description of Artificial Sequence: Synthetic peptide
  Seed: VPSGEGDAF (PMEL_HUMAN)
VPSGEGDAY

SEQ ID NO: 137691 - protein, 9 aa, Artificial Sequence
  Description of Artificial Sequence: Synthetic peptide
  Seed: GGPVSGLSI (PMEL_HUMAN)
GRPVSGLSM

SEQ ID NO: 137692 - protein, 9 aa, Artificial Sequence
  Description of Artificial Sequence: Synthetic peptide
  Seed: ALDGGNKHF (PMEL_HUMAN)
AIDGGNKHY

SEQ ID NO: 137693 - protein, 10 aa, Artificial Sequence
  Description of Artificial Sequence: Synthetic peptide
  Seed: RGSRSYVPLA (PMEL_HUMAN)
RDSRSYVPLS

SEQ ID NO: 137694 - protein, 9 aa, Artificial Sequence
  Description of Artificial Sequence: Synthetic peptide
  Seed: YVWKTWGQY (PMEL_HUMAN)
YTWKTWGQM

SEQ ID NO: 137695 - protein, 10 aa, Artificial Sequence
  Description of Artificial Sequence: Synthetic peptide
  Seed: MTPAEVSIVV (PMEL_HUMAN)
MKPAEVSIVW

SEQ ID NO: 137696 - protein, 9 aa, Artificial Sequence
  Description of Artificial Sequence: Synthetic peptide
  Seed: RLPRIFCSC (PMEL_HUMAN)
RLPRIFCSM

SEQ ID NO: 137697 - protein, 9 aa, Artificial Sequence
  Description of Artificial Sequence: Synthetic peptide
  Seed: RQVPLDCVL (PMEL_HUMAN)
RMVPLDCVL

SEQ ID NO: 137698 - protein, 9 aa, Artificial Sequence
  Description of Artificial Sequence: Synthetic peptide
  Seed: YLAEADLSY (PMEL_HUMAN)
YGAEADLSM

SEQ ID NO: 137699 - protein, 10 aa, Artificial Sequence
  Description of Artificial Sequence: Synthetic peptide
  Seed: TYLEPGPVTA (PMEL_HUMAN)
THLEPGPVTA

SEQ ID NO: 137700 - protein, 10 aa, Artificial Sequence
  Description of Artificial Sequence: Synthetic peptide
  Seed: ASSIMSTESI (PMEL_HUMAN)
AQSIMSTESF

SEQ ID NO: 137701 - protein, 9 aa, Artificial Sequence
  Description of Artificial Sequence: Synthetic peptide
  Seed: CVLYRYGSF (PMEL_HUMAN)
CLLYRYGSM

SEQ ID NO: 137702 - protein, 9 aa, Artificial Sequence
  Description of Artificial Sequence: Synthetic peptide
  Seed: EAQRLDCWR (PMEL_HUMAN)
ETQRLDCWK

SEQ ID NO: 137703 - protein, 9 aa, Artificial Sequence
  Description of Artificial Sequence: Synthetic peptide
  Seed: KAWNRQLYP (PMEL_HUMAN)
KYWNRQLYI

SEQ ID NO: 137704 - protein, 11 aa, Artificial Sequence
  Description of Artificial Sequence: Synthetic peptide
  Seed: THTMEVTVYHR (PMEL_HUMAN)
TMTMEVTVYHK

SEQ ID NO: 137705 - protein, 9 aa, Artificial Sequence
  Description of Artificial Sequence: Synthetic peptide
  Seed: YLAEADLSY (PMEL_HUMAN)
YTAEADLSR

SEQ ID NO: 137706 - protein, 9 aa, Artificial Sequence
  Description of Artificial Sequence: Synthetic peptide
  Seed: THTMEVTVY (PMEL_HUMAN)
THTMEVTVI

SEQ ID NO: 137707 - protein, 10 aa, Artificial Sequence
  Description of Artificial Sequence: Synthetic peptide
  Seed: KTWGQYWQVL (PMEL_HUMAN)
KIWGQYWQVM

SEQ ID NO: 137708 - protein, 9 aa, Artificial Sequence
  Description of Artificial Sequence: Synthetic peptide
  Seed: ESAEILQAV (PMEL_HUMAN)
EVAEILQAT

SEQ ID NO: 137709 - protein, 10 aa, Artificial Sequence
  Description of Artificial Sequence: Synthetic peptide
  Seed: GTHTMEVTVY (PMEL_HUMAN)
GKHTMEVTVF

SEQ ID NO: 137710 - protein, 9 aa, Artificial Sequence
  Description of Artificial Sequence: Synthetic peptide
  Seed: QPVLPSPAC (PMEL_HUMAN)
QPVLPSPAM

SEQ ID NO: 137711 - protein, 9 aa, Artificial Sequence
  Description of Artificial Sequence: Synthetic peptide
  Seed: TAPVQMPTA (PMEL_HUMAN)
TQPVQMPTV

SEQ ID NO: 137712 - protein, 9 aa, Artificial Sequence
  Description of Artificial Sequence: Synthetic peptide
  Seed: RNQPLTFAL (PMEL_HUMAN)
RLQPLTFAM

SEQ ID NO: 137713 - protein, 10 aa, Artificial Sequence
  Description of Artificial Sequence: Synthetic peptide
  Seed: YLAEADLSYT (PMEL_HUMAN)
YMAEADLSYR

SEQ ID NO: 137714 - protein, 9 aa, Artificial Sequence
  Description of Artificial Sequence: Synthetic peptide
  Seed: LLAVGATKV (PMEL_HUMAN)
LVAVGATKV

SEQ ID NO: 137715 - protein, 9 aa, Artificial Sequence
  Description of Artificial Sequence: Synthetic peptide
  Seed: VQVPTTEVI (PMEL_HUMAN)
VVVPTTEVF

SEQ ID NO: 137716 - protein, 8 aa, Artificial Sequence
  Description of Artificial Sequence: Synthetic peptide
  Seed: KAWNRQLY (PMEL_HUMAN)
KSWNRQLW

SEQ ID NO: 137717 - protein, 9 aa, Artificial Sequence
  Description of Artificial Sequence: Synthetic peptide
  Seed: RAMLGTHTM (PMEL_HUMAN)
RIMLGTHTR

SEQ ID NO: 137718 - protein, 9 aa, Artificial Sequence
  Description of Artificial Sequence: Synthetic peptide
  Seed: VLPSPACQL (PMEL_HUMAN)
VIPSPACQY

SEQ ID NO: 137719 - protein, 9 aa, Artificial Sequence
  Description of Artificial Sequence: Synthetic peptide
  Seed: AAQVTTTEW (PMEL_HUMAN)
AQQVTTTEL

SEQ ID NO: 137720 - protein, 10 aa, Artificial Sequence
  Description of Artificial Sequence: Synthetic peptide
  Seed: RQLRTKAWNR (PMEL_HUMAN)
RRLRTKAWNI

SEQ ID NO: 137721 - protein, 11 aa, Artificial Sequence
  Description of Artificial Sequence: Synthetic peptide
  Seed: RRGSRSYVPLA (PMEL_HUMAN)
RCGSRSYVPLK

SEQ ID NO: 137722 - protein, 10 aa, Artificial Sequence
  Description of Artificial Sequence: Synthetic peptide
  Seed: YVPLAHSSSA (PMEL_HUMAN)
YTPLAHSSSF

SEQ ID NO: 137723 - protein, 9 aa, Artificial Sequence
  Description of Artificial Sequence: Synthetic peptide
  Seed: RLVKRQVPL (PMEL_HUMAN)
RKVKRQVPM

SEQ ID NO: 137724 - protein, 9 aa, Artificial Sequence
  Description of Artificial Sequence: Synthetic peptide
  Seed: LSIGTGRAM (PMEL_HUMAN)
LTIGTGRAV

SEQ ID NO: 137725 - protein, 9 aa, Artificial Sequence
  Description of Artificial Sequence: Synthetic peptide
  Seed: RALVVTHTY (PMEL_HUMAN)
RQLVVTHTW

SEQ ID NO: 137726 - protein, 11 aa, Artificial Sequence
  Description of Artificial Sequence: Synthetic peptide
  Seed: YVPLAHSSSAF (PMEL_HUMAN)
YSPLAHSSSAY

SEQ ID NO: 137727 - protein, 9 aa, Artificial Sequence
  Description of Artificial Sequence: Synthetic peptide
  Seed: RLVKRQVPL (PMEL_HUMAN)
RWVKRQVPY

SEQ ID NO: 137728 - protein, 10 aa, Artificial Sequence
  Description of Artificial Sequence: Synthetic peptide
  Seed: SGTYCLNVSL (PMEL_HUMAN)
SETYCLNVSY

SEQ ID NO: 137729 - protein, 10 aa, Artificial Sequence
  Description of Artificial Sequence: Synthetic peptide
  Seed: RSYVPLAHSS (PMEL_HUMAN)
RAYVPLAHSK

SEQ ID NO: 137730 - protein, 10 aa, Artificial Sequence
  Description of Artificial Sequence: Synthetic peptide
  Seed: RSFVYVWKTW (PMEL_HUMAN)
RYFVYVWKTL

SEQ ID NO: 137731 - protein, 10 aa, Artificial Sequence
  Description of Artificial Sequence: Synthetic peptide
  Seed: FLRNQPLTFA (PMEL_HUMAN)
FMRNQPLTFT

SEQ ID NO: 137732 - protein, 10 aa, Artificial Sequence
  Description of Artificial Sequence: Synthetic peptide
  Seed: YRYGSFSVTL (PMEL_HUMAN)
YYYGSFSVTV

SEQ ID NO: 137733 - protein, 10 aa, Artificial Sequence
  Description of Artificial Sequence: Synthetic peptide
  Seed: VPLAHSSSAF (PMEL_HUMAN)
VRLAHSSSAF

SEQ ID NO: 137734 - protein, 9 aa, Artificial Sequence
  Description of Artificial Sequence: Synthetic peptide
  Seed: GMTPAEVSI (PMEL_HUMAN)
GLTPAEVSF

SEQ ID NO: 137735 - protein, 11 aa, Artificial Sequence
  Description of Artificial Sequence: Synthetic peptide
  Seed: THTMEVTVYHR (PMEL_HUMAN)
TTTMEVTVYHR

SEQ ID NO: 137736 - protein, 9 aa, Artificial Sequence
  Description of Artificial Sequence: Synthetic peptide
  Seed: AGLGQVPLI (PMEL_HUMAN)
AVLGQVPLL

SEQ ID NO: 137737 - protein, 10 aa, Artificial Sequence
  Description of Artificial Sequence: Synthetic peptide
  Seed: MTPAEVSIVV (PMEL_HUMAN)
MNPAEVSIVW

SEQ ID NO: 137738 - protein, 9 aa, Artificial Sequence
  Description of Artificial Sequence: Synthetic peptide
  Seed: FTITDQVPF (PMEL_HUMAN)
FKITDQVPL

SEQ ID NO: 137739 - protein, 10 aa, Artificial Sequence
  Description of Artificial Sequence: Synthetic peptide
  Seed: RGSRSYVPLA (PMEL_HUMAN)
RKSRSYVPLA

SEQ ID NO: 137740 - protein, 10 aa, Artificial Sequence
  Description of Artificial Sequence: Synthetic peptide
  Seed: TVSCQGGLPK (PMEL_HUMAN)
TTSCQGGLPK

SEQ ID NO: 137741 - protein, 10 aa, Artificial Sequence
  Description of Artificial Sequence: Synthetic peptide
  Seed: YGSFSVTLDI (PMEL_HUMAN)
YMSFSVTLDF

SEQ ID NO: 137742 - protein, 9 aa, Artificial Sequence
  Description of Artificial Sequence: Synthetic peptide
  Seed: EVVGTTPGQ (PMEL_HUMAN)
EQVGTTPGR

SEQ ID NO: 137743 - protein, 9 aa, Artificial Sequence
  Description of Artificial Sequence: Synthetic peptide
  Seed: ANASFSIAL (PMEL_HUMAN)
AKASFSIAY

SEQ ID NO: 137744 - protein, 10 aa, Artificial Sequence
  Description of Artificial Sequence: Synthetic peptide
  Seed: MAVVLASLIY (PMEL_HUMAN)
MYVVLASLIR

SEQ ID NO: 137745 - protein, 8 aa, Artificial Sequence
  Description of Artificial Sequence: Synthetic peptide
  Seed: LVKRQVPL (PMEL_HUMAN)
LPKRQVPL

SEQ ID NO: 137746 - protein, 9 aa, Artificial Sequence
  Description of Artificial Sequence: Synthetic peptide
  Seed: ESAEILQAV (PMEL_HUMAN)
EAAEILQAK

SEQ ID NO: 137747 - protein, 9 aa, Artificial Sequence
  Description of Artificial Sequence: Synthetic peptide
  Seed: SLADTNSLA (PMEL_HUMAN)
SVADTNSLL

SEQ ID NO: 137748 - protein, 9 aa, Artificial Sequence
  Description of Artificial Sequence: Synthetic peptide
  Seed: RALVVTHTY (PMEL_HUMAN)
RMLVVTHTL

SEQ ID NO: 137749 - protein, 9 aa, Artificial Sequence
  Description of Artificial Sequence: Synthetic peptide
  Seed: LADTNSLAV (PMEL_HUMAN)
LLDTNSLAV

SEQ ID NO: 137750 - protein, 9 aa, Artificial Sequence
  Description of Artificial Sequence: Synthetic peptide
  Seed: GQVPLIVGI (PMEL_HUMAN)
GHVPLIVGV

SEQ ID NO: 137751 - protein, 9 aa, Artificial Sequence
  Description of Artificial Sequence: Synthetic peptide
  Seed: GMTPAEVSI (PMEL_HUMAN)
GVTPAEVSY

SEQ ID NO: 137752 - protein, 9 aa, Artificial Sequence
  Description of Artificial Sequence: Synthetic peptide
  Seed: HLAVIGALL (PMEL_HUMAN)
HLAVIGALY

SEQ ID NO: 137753 - protein, 9 aa, Artificial Sequence
  Description of Artificial Sequence: Synthetic peptide
  Seed: SQVWGGQPV (PMEL_HUMAN)
SLVWGGQPF

SEQ ID NO: 137754 - protein, 9 aa, Artificial Sequence
  Description of Artificial Sequence: Synthetic peptide
  Seed: QVWGGQPVY (PMEL_HUMAN)
QHWGGQPVY

SEQ ID NO: 137755 - protein, 9 aa, Artificial Sequence
  Description of Artificial Sequence: Synthetic peptide
  Seed: LIYRRRLMK (PMEL_HUMAN)
LGYRRRLMR

SEQ ID NO: 137756 - protein, 10 aa, Artificial Sequence
  Description of Artificial Sequence: Synthetic peptide
  Seed: AVIGALLAVG (PMEL_HUMAN)
ALIGALLAVF

SEQ ID NO: 137757 - protein, 10 aa, Artificial Sequence
  Description of Artificial Sequence: Synthetic peptide
  Seed: ALDGGNKHFL (PMEL_HUMAN)
AYDGGNKHFF

SEQ ID NO: 137758 - protein, 9 aa, Artificial Sequence
  Description of Artificial Sequence: Synthetic peptide
  Seed: FGDSSGTLI (PMEL_HUMAN)
FFDSSGTLM

SEQ ID NO: 137759 - protein, 10 aa, Artificial Sequence
  Description of Artificial Sequence: Synthetic peptide
  Seed: RQLRTKAWNR (PMEL_HUMAN)
RVLRTKAWNK

SEQ ID NO: 137760 - protein, 10 aa, Artificial Sequence
  Description of Artificial Sequence: Synthetic peptide
  Seed: MTPAEVSIVV (PMEL_HUMAN)
MTPAEVSIVL

SEQ ID NO: 137761 - protein, 9 aa, Artificial Sequence
  Description of Artificial Sequence: Synthetic peptide
  Seed: VQMPTAEST (PMEL_HUMAN)
VFMPTAESY

SEQ ID NO: 137762 - protein, 10 aa, Artificial Sequence
  Description of Artificial Sequence: Synthetic peptide
  Seed: VSLADTNSLA (PMEL_HUMAN)
VELADTNSLL

SEQ ID NO: 137763 - protein, 9 aa, Artificial Sequence
  Description of Artificial Sequence: Synthetic peptide
  Seed: SGTLISRAL (PMEL_HUMAN)
STTLISRAM

SEQ ID NO: 137764 - protein, 9 aa, Artificial Sequence
  Description of Artificial Sequence: Synthetic peptide
  Seed: QVWGGQPVY (PMEL_HUMAN)
QSWGGQPVW

SEQ ID NO: 137765 - protein, 10 aa, Artificial Sequence
  Description of Artificial Sequence: Synthetic peptide
  Seed: VPLAHSSSAF (PMEL_HUMAN)
VHLAHSSSAY

SEQ ID NO: 137766 - protein, 8 aa, Artificial Sequence
  Description of Artificial Sequence: Synthetic peptide
  Seed: HTMEVTVY (PMEL_HUMAN)
HPMEVTVY

SEQ ID NO: 137767 - protein, 9 aa, Artificial Sequence
  Description of Artificial Sequence: Synthetic peptide
  Seed: AVIGALLAV (PMEL_HUMAN)
AVIGALLAM

SEQ ID NO: 137768 - protein, 9 aa, Artificial Sequence
  Description of Artificial Sequence: Synthetic peptide
  Seed: QEAGLGQVP (PMEL_HUMAN)
QEAGLGQVV

SEQ ID NO: 137769 - protein, 9 aa, Artificial Sequence
  Description of Artificial Sequence: Synthetic peptide
  Seed: VSLADTNSL (PMEL_HUMAN)
VQLADTNSL

SEQ ID NO: 137770 - protein, 9 aa, Artificial Sequence
  Description of Artificial Sequence: Synthetic peptide
  Seed: GSRSYVPLA (PMEL_HUMAN)
GIRSYVPLI

SEQ ID NO: 137771 - protein, 10 aa, Artificial Sequence
  Description of Artificial Sequence: Synthetic peptide
  Seed: GPLLDGTATL (PMEL_HUMAN)
GFLLDGTATA

SEQ ID NO: 137772 - protein, 9 aa, Artificial Sequence
  Description of Artificial Sequence: Synthetic peptide
  Seed: HLAVIGALL (PMEL_HUMAN)
HAAVIGALA

SEQ ID NO: 137773 - protein, 9 aa, Artificial Sequence
  Description of Artificial Sequence: Synthetic peptide
  Seed: TAQVVLQAA (PMEL_HUMAN)
TAQVVLQAM

SEQ ID NO: 137774 - protein, 9 aa, Artificial Sequence
  Description of Artificial Sequence: Synthetic peptide
  Seed: SQVWGGQPV (PMEL_HUMAN)
SRVWGGQPY

SEQ ID NO: 137775 - protein, 10 aa, Artificial Sequence
  Description of Artificial Sequence: Synthetic peptide
  Seed: AVPSGEGDAF (PMEL_HUMAN)
AYPSGEGDAF

SEQ ID NO: 137776 - protein, 9 aa, Artificial Sequence
  Description of Artificial Sequence: Synthetic peptide
  Seed: YLEPGPVTA (PMEL_HUMAN)
YLEPGPVTI

SEQ ID NO: 137777 - protein, 9 aa, Artificial Sequence
  Description of Artificial Sequence: Synthetic peptide
  Seed: ALDGGNKHF (PMEL_HUMAN)
AWDGGNKHF

SEQ ID NO: 137778 - protein, 9 aa, Artificial Sequence
  Description of Artificial Sequence: Synthetic peptide
  Seed: LPDGQVIWV (PMEL_HUMAN)
LLDGQVIWI

SEQ ID NO: 137779 - protein, 9 aa, Artificial Sequence
  Description of Artificial Sequence: Synthetic peptide
  Seed: SLAVVSTQL (PMEL_HUMAN)
SMAVVSTQI

SEQ ID NO: 137780 - protein, 10 aa, Artificial Sequence
  Description of Artificial Sequence: Synthetic peptide
  Seed: RQLRTKAWNR (PMEL_HUMAN)
RILRTKAWNK

SEQ ID NO: 137781 - protein, 11 aa, Artificial Sequence
  Description of Artificial Sequence: Synthetic peptide
  Seed: MAVVLASLIYR (PMEL_HUMAN)
MEVVLASLIYR

SEQ ID NO: 137782 - protein, 11 aa, Artificial Sequence
  Description of Artificial Sequence: Synthetic peptide
  Seed: LVLMAVVLASL (PMEL_HUMAN)
LRLMAVVLASL

SEQ ID NO: 137783 - protein, 9 aa, Artificial Sequence
  Description of Artificial Sequence: Synthetic peptide
  Seed: AVVSTQLIM (PMEL_HUMAN)
ARVSTQLIY

SEQ ID NO: 137784 - protein, 10 aa, Artificial Sequence
  Description of Artificial Sequence: Synthetic peptide
  Seed: RQVPLDCVLY (PMEL_HUMAN)
RMVPLDCVLF

SEQ ID NO: 137785 - protein, 9 aa, Artificial Sequence
  Description of Artificial Sequence: Synthetic peptide
  Seed: VQVPTTEVI (PMEL_HUMAN)
VTVPTTEVL

SEQ ID NO: 137786 - protein, 9 aa, Artificial Sequence
  Description of Artificial Sequence: Synthetic peptide
  Seed: RLMKQDFSV (PMEL_HUMAN)
RIMKQDFSM

SEQ ID NO: 137787 - protein, 9 aa, Artificial Sequence
  Description of Artificial Sequence: Synthetic peptide
  Seed: SRSYVPLAH (PMEL_HUMAN)
SYSYVPLAM

SEQ ID NO: 137788 - protein, 10 aa, Artificial Sequence
  Description of Artificial Sequence: Synthetic peptide
  Seed: RGSRSYVPLA (PMEL_HUMAN)
RLSRSYVPLA

SEQ ID NO: 137789 - protein, 9 aa, Artificial Sequence
  Description of Artificial Sequence: Synthetic peptide
  Seed: MTPEKVPVS (PMEL_HUMAN)
MQPEKVPVI

SEQ ID NO: 137790 - protein, 9 aa, Artificial Sequence
  Description of Artificial Sequence: Synthetic peptide
  Seed: VISTAPVQM (PMEL_HUMAN)
VLSTAPVQW

SEQ ID NO: 137791 - protein, 9 aa, Artificial Sequence
  Description of Artificial Sequence: Synthetic peptide
  Seed: GSWSQKRSF (PMEL_HUMAN)
GKWSQKRSF

SEQ ID NO: 137792 - protein, 9 aa, Artificial Sequence
  Description of Artificial Sequence: Synthetic peptide
  Seed: LPDGQVIWV (PMEL_HUMAN)
LVDGQVIWL

SEQ ID NO: 137793 - protein, 10 aa, Artificial Sequence
  Description of Artificial Sequence: Synthetic peptide
  Seed: RTKAWNRQLY (PMEL_HUMAN)
RTKAWNRQLI

SEQ ID NO: 137794 - protein, 9 aa, Artificial Sequence
  Description of Artificial Sequence: Synthetic peptide
  Seed: VTLDIVQGI (PMEL_HUMAN)
VVLDIVQGR

SEQ ID NO: 137795 - protein, 9 aa, Artificial Sequence
  Description of Artificial Sequence: Synthetic peptide
  Seed: VSNDGPTLI (PMEL_HUMAN)
VLNDGPTLL

SEQ ID NO: 137796 - protein, 8 aa, Artificial Sequence
  Description of Artificial Sequence: Synthetic peptide
  Seed: RSFVYVWK (PMEL_HUMAN)
RQFVYVWR

SEQ ID NO: 137797 - protein, 9 aa, Artificial Sequence
  Description of Artificial Sequence: Synthetic peptide
  Seed: GCQPPAQRL (PMEL_HUMAN)
GAQPPAQRL

SEQ ID NO: 137798 - protein, 9 aa, Artificial Sequence
  Description of Artificial Sequence: Synthetic peptide
  Seed: VLQAAIPLT (PMEL_HUMAN)
VLQAAIPLI

SEQ ID NO: 137799 - protein, 9 aa, Artificial Sequence
  Description of Artificial Sequence: Synthetic peptide
  Seed: LNFPGSQKV (PMEL_HUMAN)
LSFPGSQKY

SEQ ID NO: 137800 - protein, 11 aa, Artificial Sequence
  Description of Artificial Sequence: Synthetic peptide
  Seed: GSQVWGGQPVY (PMEL_HUMAN)
GQQVWGGQPVY

SEQ ID NO: 137801 - protein, 9 aa, Artificial Sequence
  Description of Artificial Sequence: Synthetic peptide
  Seed: AVIGALLAV (PMEL_HUMAN)
AMIGALLAK

SEQ ID NO: 137802 - protein, 10 aa, Artificial Sequence
  Description of Artificial Sequence: Synthetic peptide
  Seed: LQLHDPSGYL (PMEL_HUMAN)
LQLHDPSGYM

SEQ ID NO: 137803 - protein, 11 aa, Artificial Sequence
  Description of Artificial Sequence: Synthetic peptide
  Seed: QEAGLGQVPLI (PMEL_HUMAN)
QEAGLGQVPLF

SEQ ID NO: 137804 - protein, 9 aa, Artificial Sequence
  Description of Artificial Sequence: Synthetic peptide
  Seed: KAWNRQLYP (PMEL_HUMAN)
KWWNRQLYK

SEQ ID NO: 137805 - protein, 10 aa, Artificial Sequence
  Description of Artificial Sequence: Synthetic peptide
  Seed: AEVSIVVLSG (PMEL_HUMAN)
AEVSIVVLSI

SEQ ID NO: 137806 - protein, 10 aa, Artificial Sequence
  Description of Artificial Sequence: Synthetic peptide
  Seed: SRALVVTHTY (PMEL_HUMAN)
SSALVVTHTY

SEQ ID NO: 137807 - protein, 9 aa, Artificial Sequence
  Description of Artificial Sequence: Synthetic peptide
  Seed: GSSPVPGTT (PMEL_HUMAN)
GISPVPGTF

SEQ ID NO: 137808 - protein, 9 aa, Artificial Sequence
  Description of Artificial Sequence: Synthetic peptide
  Seed: VQVPTTEVI (PMEL_HUMAN)
VIVPTTEVV

SEQ ID NO: 137809 - protein, 10 aa, Artificial Sequence
  Description of Artificial Sequence: Synthetic peptide
  Seed: ALDGGNKHFL (PMEL_HUMAN)
AMDGGNKHFY

SEQ ID NO: 137810 - protein, 9 aa, Artificial Sequence
  Description of Artificial Sequence: Synthetic peptide
  Seed: HLAVIGALL (PMEL_HUMAN)
HQAVIGALI

SEQ ID NO: 137811 - protein, 9 aa, Artificial Sequence
  Description of Artificial Sequence: Synthetic peptide
  Seed: RYGSFSVTL (PMEL_HUMAN)
RAGSFSVTY

SEQ ID NO: 137812 - protein, 9 aa, Artificial Sequence
  Description of Artificial Sequence: Synthetic peptide
  Seed: RAMLGTHTM (PMEL_HUMAN)
RIMLGTHTM

SEQ ID NO: 137813 - protein, 9 aa, Artificial Sequence
  Description of Artificial Sequence: Synthetic peptide
  Seed: LPHSSSHWL (PMEL_HUMAN)
LAHSSSHWY

SEQ ID NO: 137814 - protein, 11 aa, Artificial Sequence
  Description of Artificial Sequence: Synthetic peptide
  Seed: FGDSSGTLISR (PMEL_HUMAN)
FVDSSGTLISV

SEQ ID NO: 137815 - protein, 9 aa, Artificial Sequence
  Description of Artificial Sequence: Synthetic peptide
  Seed: KVSNDGPTL (PMEL_HUMAN)
KLSNDGPTI

SEQ ID NO: 137816 - protein, 10 aa, Artificial Sequence
  Description of Artificial Sequence: Synthetic peptide
  Seed: EVSIVVLSGT (PMEL_HUMAN)
EISIVVLSGI

SEQ ID NO: 137817 - protein, 11 aa, Artificial Sequence
  Description of Artificial Sequence: Synthetic peptide
  Seed: RRGSRSYVPLA (PMEL_HUMAN)
RMGSRSYVPLA

SEQ ID NO: 137818 - protein, 9 aa, Artificial Sequence
  Description of Artificial Sequence: Synthetic peptide
  Seed: VISTAPVQM (PMEL_HUMAN)
VWSTAPVQF

SEQ ID NO: 137819 - protein, 9 aa, Artificial Sequence
  Description of Artificial Sequence: Synthetic peptide
  Seed: TTPGQAPTA (PMEL_HUMAN)
TQPGQAPTM

SEQ ID NO: 137820 - protein, 9 aa, Artificial Sequence
  Description of Artificial Sequence: Synthetic peptide
  Seed: RALDGGNKH (PMEL_HUMAN)
RTLDGGNKY

SEQ ID NO: 137821 - protein, 9 aa, Artificial Sequence
  Description of Artificial Sequence: Synthetic peptide
  Seed: AQVVLQAAI (PMEL_HUMAN)
AEVVLQAAT

SEQ ID NO: 137822 - protein, 9 aa, Artificial Sequence
  Description of Artificial Sequence: Synthetic peptide
  Seed: ALLAVGATK (PMEL_HUMAN)
ASLAVGATK

SEQ ID NO: 137823 - protein, 10 aa, Artificial Sequence
  Description of Artificial Sequence: Synthetic peptide
  Seed: RALDGGNKHF (PMEL_HUMAN)
RLLDGGNKHR

SEQ ID NO: 137824 - protein, 9 aa, Artificial Sequence
  Description of Artificial Sequence: Synthetic peptide
  Seed: AVVLASLIY (PMEL_HUMAN)
AAVLASLIY

SEQ ID NO: 137825 - protein, 9 aa, Artificial Sequence
  Description of Artificial Sequence: Synthetic peptide
  Seed: WQVLGGPVS (PMEL_HUMAN)
WLVLGGPVM

SEQ ID NO: 137826 - protein, 9 aa, Artificial Sequence
  Description of Artificial Sequence: Synthetic peptide
  Seed: VWKTWGQYW (PMEL_HUMAN)
VYKTWGQYW

SEQ ID NO: 137827 - protein, 9 aa, Artificial Sequence
  Description of Artificial Sequence: Synthetic peptide
  Seed: FTITDQVPF (PMEL_HUMAN)
FIITDQVPL

SEQ ID NO: 137828 - protein, 9 aa, Artificial Sequence
  Description of Artificial Sequence: Synthetic peptide
  Seed: SRSYVPLAH (PMEL_HUMAN)
SRSYVPLAF

SEQ ID NO: 137829 - protein, 10 aa, Artificial Sequence
  Description of Artificial Sequence: Synthetic peptide
  Seed: RYGSFSVTLD (PMEL_HUMAN)
RYGSFSVTLV

SEQ ID NO: 137830 - protein, 11 aa, Artificial Sequence
  Description of Artificial Sequence: Synthetic peptide
  Seed: ISRALVVTHTY (PMEL_HUMAN)
ITRALVVTHTW

SEQ ID NO: 137831 - protein, 9 aa, Artificial Sequence
  Description of Artificial Sequence: Synthetic peptide
  Seed: SVQVPTTEV (PMEL_HUMAN)
SPQVPTTEM

SEQ ID NO: 137832 - protein, 10 aa, Artificial Sequence
  Description of Artificial Sequence: Synthetic peptide
  Seed: RTKAWNRQLY (PMEL_HUMAN)
RFKAWNRQLY

SEQ ID NO: 137833 - protein, 9 aa, Artificial Sequence
  Description of Artificial Sequence: Synthetic peptide
  Seed: HSSSHWLRL (PMEL_HUMAN)
HASSHWLRK

SEQ ID NO: 137834 - protein, 9 aa, Artificial Sequence
  Description of Artificial Sequence: Synthetic peptide
  Seed: KHFLRNQPL (PMEL_HUMAN)
KQFLRNQPL

SEQ ID NO: 137835 - protein, 10 aa, Artificial Sequence
  Description of Artificial Sequence: Synthetic peptide
  Seed: VPQLPHSSSH (PMEL_HUMAN)
VCQLPHSSSY

SEQ ID NO: 137836 - protein, 10 aa, Artificial Sequence
  Description of Artificial Sequence: Synthetic peptide
  Seed: GPLLDGTATL (PMEL_HUMAN)
GCLLDGTATA

SEQ ID NO: 137837 - protein, 9 aa, Artificial Sequence
  Description of Artificial Sequence: Synthetic peptide
  Seed: YPQETDDAC (PMEL_HUMAN)
YAQETDDAM

SEQ ID NO: 137838 - protein, 9 aa, Artificial Sequence
  Description of Artificial Sequence: Synthetic peptide
  Seed: RTKAWNRQL (PMEL_HUMAN)
RAKAWNRQF

SEQ ID NO: 137839 - protein, 9 aa, Artificial Sequence
  Description of Artificial Sequence: Synthetic peptide
  Seed: SSIMSTESI (PMEL_HUMAN)
SVIMSTESV

SEQ ID NO: 137840 - protein, 9 aa, Artificial Sequence
  Description of Artificial Sequence: Synthetic peptide
  Seed: AVIGALLAV (PMEL_HUMAN)
ALIGALLAR

SEQ ID NO: 137841 - protein, 10 aa, Artificial Sequence
  Description of Artificial Sequence: Synthetic peptide
  Seed: LVLKRCLLHL (PMEL_HUMAN)
LMLKRCLLHV

SEQ ID NO: 137842 - protein, 10 aa, Artificial Sequence
  Description of Artificial Sequence: Synthetic peptide
  Seed: RTKAWNRQLY (PMEL_HUMAN)
RSKAWNRQLF

SEQ ID NO: 137843 - protein, 11 aa, Artificial Sequence
  Description of Artificial Sequence: Synthetic peptide
  Seed: FSVTLDIVQGI (PMEL_HUMAN)
FQVTLDIVQGV

SEQ ID NO: 137844 - protein, 9 aa, Artificial Sequence
  Description of Artificial Sequence: Synthetic peptide
  Seed: RGGQVSLKV (PMEL_HUMAN)
RIGQVSLKI

SEQ ID NO: 137845 - protein, 11 aa, Artificial Sequence
  Description of Artificial Sequence: Synthetic peptide
  Seed: VSLADTNSLAV (PMEL_HUMAN)
VGLADTNSLAW

SEQ ID NO: 137846 - protein, 9 aa, Artificial Sequence
  Description of Artificial Sequence: Synthetic peptide
  Seed: ALVVTHTYL (PMEL_HUMAN)
AIVVTHTYY

SEQ ID NO: 137847 - protein, 11 aa, Artificial Sequence
  Description of Artificial Sequence: Synthetic peptide
  Seed: MAVVLASLIYR (PMEL_HUMAN)
MPVVLASLIYR

SEQ ID NO: 137848 - protein, 9 aa, Artificial Sequence
  Description of Artificial Sequence: Synthetic peptide
  Seed: MTPEKVPVS (PMEL_HUMAN)
MVPEKVPVF

SEQ ID NO: 137849 - protein, 9 aa, Artificial Sequence
  Description of Artificial Sequence: Synthetic peptide
  Seed: AVVSTQLIM (PMEL_HUMAN)
AIVSTQLIY

SEQ ID NO: 137850 - protein, 9 aa, Artificial Sequence
  Description of Artificial Sequence: Synthetic peptide
  Seed: QVIWVNNTI (PMEL_HUMAN)
QAIWVNNTI

SEQ ID NO: 137851 - protein, 9 aa, Artificial Sequence
  Description of Artificial Sequence: Synthetic peptide
  Seed: ITDQVPFSV (PMEL_HUMAN)
IQDQVPFSF

SEQ ID NO: 137852 - protein, 9 aa, Artificial Sequence
  Description of Artificial Sequence: Synthetic peptide
  Seed: SITGSLGPL (PMEL_HUMAN)
SQTGSLGPF

SEQ ID NO: 137853 - protein, 9 aa, Artificial Sequence
  Description of Artificial Sequence: Synthetic peptide
  Seed: FLRNQPLTF (PMEL_HUMAN)
FVRNQPLTH

SEQ ID NO: 137854 - protein, 11 aa, Artificial Sequence
  Description of Artificial Sequence: Synthetic peptide
  Seed: LVLMAVVLASL (PMEL_HUMAN)
LCLMAVVLASV

SEQ ID NO: 137855 - protein, 9 aa, Artificial Sequence
  Description of Artificial Sequence: Synthetic peptide
  Seed: TESITGSLG (PMEL_HUMAN)
TESITGSLP

SEQ ID NO: 137856 - protein, 11 aa, Artificial Sequence
  Description of Artificial Sequence: Synthetic peptide
  Seed: THTMEVTVYHR (PMEL_HUMAN)
TRTMEVTVYHR

SEQ ID NO: 137857 - protein, 9 aa, Artificial Sequence
  Description of Artificial Sequence: Synthetic peptide
  Seed: HSSSHWLRL (PMEL_HUMAN)
HGSSHWLRW

SEQ ID NO: 137858 - protein, 9 aa, Artificial Sequence
  Description of Artificial Sequence: Synthetic peptide
  Seed: FLRNQPLTF (PMEL_HUMAN)
FLRNQPLTI

SEQ ID NO: 137859 - protein, 8 aa, Artificial Sequence
  Description of Artificial Sequence: Synthetic peptide
  Seed: VQVPTTEV (PMEL_HUMAN)
VQVPTTEY

SEQ ID NO: 137860 - protein, 8 aa, Artificial Sequence
  Description of Artificial Sequence: Synthetic peptide
  Seed: FGDSSGTL (PMEL_HUMAN)
FTDSSGTI

SEQ ID NO: 137861 - protein, 10 aa, Artificial Sequence
  Description of Artificial Sequence: Synthetic peptide
  Seed: SLIYRRRLMK (PMEL_HUMAN)
SNIYRRRLMK

SEQ ID NO: 137862 - protein, 9 aa, Artificial Sequence
  Description of Artificial Sequence: Synthetic peptide
  Seed: TLIGANASF (PMEL_HUMAN)
TRIGANASF

SEQ ID NO: 137863 - protein, 9 aa, Artificial Sequence
  Description of Artificial Sequence: Synthetic peptide
  Seed: QDFSVPQLP (PMEL_HUMAN)
QEFSVPQLS

SEQ ID NO: 137864 - protein, 10 aa, Artificial Sequence
  Description of Artificial Sequence: Synthetic peptide
  Seed: LIGANASFSI (PMEL_HUMAN)
LQGANASFSV

SEQ ID NO: 137865 - protein, 8 aa, Artificial Sequence
  Description of Artificial Sequence: Synthetic peptide
  Seed: SNDGPTLI (PMEL_HUMAN)
SNDGPTLL

SEQ ID NO: 137866 - protein, 10 aa, Artificial Sequence
  Description of Artificial Sequence: Synthetic peptide
  Seed: LAVIGALLAV (PMEL_HUMAN)
LLVIGALLAV

SEQ ID NO: 137867 - protein, 9 aa, Artificial Sequence
  Description of Artificial Sequence: Synthetic peptide
  Seed: MTPAEVSIV (PMEL_HUMAN)
MIPAEVSIM

SEQ ID NO: 137868 - protein, 9 aa, Artificial Sequence
  Description of Artificial Sequence: Synthetic peptide
  Seed: LIVGILLVL (PMEL_HUMAN)
LVVGILLVW

SEQ ID NO: 137869 - protein, 9 aa, Artificial Sequence
  Description of Artificial Sequence: Synthetic peptide
  Seed: GTATLRLVK (PMEL_HUMAN)
GFATLRLVR

SEQ ID NO: 137870 - protein, 9 aa, Artificial Sequence
  Description of Artificial Sequence: Synthetic peptide
  Seed: SSPGCQPPA (PMEL_HUMAN)
SAPGCQPPI

SEQ ID NO: 137871 - protein, 11 aa, Artificial Sequence
  Description of Artificial Sequence: Synthetic peptide
  Seed: RRGSRSYVPLA (PMEL_HUMAN)
RSGSRSYVPLV

SEQ ID NO: 137872 - protein, 9 aa, Artificial Sequence
  Description of Artificial Sequence: Synthetic peptide
  Seed: QVWGGQPVY (PMEL_HUMAN)
QPWGGQPVF

SEQ ID NO: 137873 - protein, 9 aa, Artificial Sequence
  Description of Artificial Sequence: Synthetic peptide
  Seed: LAVVSTQLI (PMEL_HUMAN)
LTVVSTQLF

SEQ ID NO: 137874 - protein, 9 aa, Artificial Sequence
  Description of Artificial Sequence: Synthetic peptide
  Seed: LPDGQVIWV (PMEL_HUMAN)
LTDGQVIWV

SEQ ID NO: 137875 - protein, 8 aa, Artificial Sequence
  Description of Artificial Sequence: Synthetic peptide
  Seed: SQKRSFVY (PMEL_HUMAN)
SMKRSFVY

SEQ ID NO: 137876 - protein, 9 aa, Artificial Sequence
  Description of Artificial Sequence: Synthetic peptide
  Seed: MSTPEATGM (PMEL_HUMAN)
MTTPEATGM

SEQ ID NO: 137877 - protein, 9 aa, Artificial Sequence
  Description of Artificial Sequence: Synthetic peptide
  Seed: AEMSTPEAT (PMEL_HUMAN)
AEMSTPEAI

SEQ ID NO: 137878 - protein, 9 aa, Artificial Sequence
  Description of Artificial Sequence: Synthetic peptide
  Seed: QVWGGQPVY (PMEL_HUMAN)
QKWGGQPVF

SEQ ID NO: 137879 - protein, 9 aa, Artificial Sequence
  Description of Artificial Sequence: Synthetic peptide
  Seed: VTAQVVLQA (PMEL_HUMAN)
VQAQVVLQI

SEQ ID NO: 137880 - protein, 9 aa, Artificial Sequence
  Description of Artificial Sequence: Synthetic peptide
  Seed: SAFTITDQV (PMEL_HUMAN)
SQFTITDQV

SEQ ID NO: 137881 - protein, 11 aa, Artificial Sequence
  Description of Artificial Sequence: Synthetic peptide
  Seed: HSSSHWLRLPR (PMEL_HUMAN)
HNSSHWLRLPR

SEQ ID NO: 137882 - protein, 10 aa, Artificial Sequence
  Description of Artificial Sequence: Synthetic peptide
  Seed: VLMAVVLASL (PMEL_HUMAN)
VCMAVVLASY

SEQ ID NO: 137883 - protein, 9 aa, Artificial Sequence
  Description of Artificial Sequence: Synthetic peptide
  Seed: GSFSVTLDI (PMEL_HUMAN)
GMFSVTLDV

SEQ ID NO: 137884 - protein, 9 aa, Artificial Sequence
  Description of Artificial Sequence: Synthetic peptide
  Seed: ASFSIALNF (PMEL_HUMAN)
AMFSIALNR

SEQ ID NO: 137885 - protein, 9 aa, Artificial Sequence
  Description of Artificial Sequence: Synthetic peptide
  Seed: AEPSGTTSV (PMEL_HUMAN)
AIPSGTTSL

SEQ ID NO: 137886 - protein, 9 aa, Artificial Sequence
  Description of Artificial Sequence: Synthetic peptide
  Seed: ISRALVVTH (PMEL_HUMAN)
ISRALVVTK

SEQ ID NO: 137887 - protein, 9 aa, Artificial Sequence
  Description of Artificial Sequence: Synthetic peptide
  Seed: DAFELTVSC (PMEL_HUMAN)
DGFELTVSF

SEQ ID NO: 137888 - protein, 9 aa, Artificial Sequence
  Description of Artificial Sequence: Synthetic peptide
  Seed: LIYRRRLMK (PMEL_HUMAN)
LIYRRRLMR

SEQ ID NO: 137889 - protein, 9 aa, Artificial Sequence
  Description of Artificial Sequence: Synthetic peptide
  Seed: TIINGSQVW (PMEL_HUMAN)
TVINGSQVF

SEQ ID NO: 137890 - protein, 10 aa, Artificial Sequence
  Description of Artificial Sequence: Synthetic peptide
  Seed: SVPQLPHSSS (PMEL_HUMAN)
SPPQLPHSSV

SEQ ID NO: 137891 - protein, 11 aa, Artificial Sequence
  Description of Artificial Sequence: Synthetic peptide
  Seed: RRGSRSYVPLA (PMEL_HUMAN)
RIGSRSYVPLK

SEQ ID NO: 137892 - protein, 11 aa, Artificial Sequence
  Description of Artificial Sequence: Synthetic peptide
  Seed: YLEPGPVTAQV (PMEL_HUMAN)
YMEPGPVTAQI

SEQ ID NO: 137893 - protein, 9 aa, Artificial Sequence
  Description of Artificial Sequence: Synthetic peptide
  Seed: GSRSYVPLA (PMEL_HUMAN)
GIRSYVPLK

SEQ ID NO: 137894 - protein, 9 aa, Artificial Sequence
  Description of Artificial Sequence: Synthetic peptide
  Seed: YHRRGSRSY (PMEL_HUMAN)
YVRRGSRSY

SEQ ID NO: 137895 - protein, 10 aa, Artificial Sequence
  Description of Artificial Sequence: Synthetic peptide
  Seed: ASSIMSTESI (PMEL_HUMAN)
ANSIMSTESW

SEQ ID NO: 137896 - protein, 9 aa, Artificial Sequence
  Description of Artificial Sequence: Synthetic peptide
  Seed: ALLAVGATK (PMEL_HUMAN)
AMLAVGATK

SEQ ID NO: 137897 - protein, 9 aa, Artificial Sequence
  Description of Artificial Sequence: Synthetic peptide
  Seed: TTDGHRPTA (PMEL_HUMAN)
TGDGHRPTF

SEQ ID NO: 137898 - protein, 9 aa, Artificial Sequence
  Description of Artificial Sequence: Synthetic peptide
  Seed: VVLQAAIPL (PMEL_HUMAN)
VTLQAAIPY

SEQ ID NO: 137899 - protein, 11 aa, Artificial Sequence
  Description of Artificial Sequence: Synthetic peptide
  Seed: RYGSFSVTLDI (PMEL_HUMAN)
RIGSFSVTLDY

SEQ ID NO: 137900 - protein, 9 aa, Artificial Sequence
  Description of Artificial Sequence: Synthetic peptide
  Seed: KHFLRNQPL (PMEL_HUMAN)
KKFLRNQPI

SEQ ID NO: 137901 - protein, 9 aa, Artificial Sequence
  Description of Artificial Sequence: Synthetic peptide
  Seed: AVVSTQLIM (PMEL_HUMAN)
ASVSTQLIF

SEQ ID NO: 137902 - protein, 9 aa, Artificial Sequence
  Description of Artificial Sequence: Synthetic peptide
  Seed: HTMEVTVYH (PMEL_HUMAN)
HPMEVTVYS

SEQ ID NO: 137903 - protein, 9 aa, Artificial Sequence
  Description of Artificial Sequence: Synthetic peptide
  Seed: FLRNQPLTF (PMEL_HUMAN)
FVRNQPLTF

SEQ ID NO: 137904 - protein, 9 aa, Artificial Sequence
  Description of Artificial Sequence: Synthetic peptide
  Seed: SLADTNSLA (PMEL_HUMAN)
SSADTNSLV

SEQ ID NO: 137905 - protein, 10 aa, Artificial Sequence
  Description of Artificial Sequence: Synthetic peptide
  Seed: LVLMAVVLAS (PMEL_HUMAN)
LGLMAVVLAM

SEQ ID NO: 137906 - protein, 9 aa, Artificial Sequence
  Description of Artificial Sequence: Synthetic peptide
  Seed: RALVVTHTY (PMEL_HUMAN)
RLLVVTHTF

SEQ ID NO: 137907 - protein, 11 aa, Artificial Sequence
  Description of Artificial Sequence: Synthetic peptide
  Seed: YLAEADLSYTW (PMEL_HUMAN)
YWAEADLSYTF

SEQ ID NO: 137908 - protein, 9 aa, Artificial Sequence
  Description of Artificial Sequence: Synthetic peptide
  Seed: RNQPLTFAL (PMEL_HUMAN)
RLQPLTFAW

SEQ ID NO: 137909 - protein, 11 aa, Artificial Sequence
  Description of Artificial Sequence: Synthetic peptide
  Seed: FGDSSGTLISR (PMEL_HUMAN)
FNDSSGTLISF

SEQ ID NO: 137910 - protein, 11 aa, Artificial Sequence
  Description of Artificial Sequence: Synthetic peptide
  Seed: CVLYRYGSFSV (PMEL_HUMAN)
CYLYRYGSFSV

SEQ ID NO: 137911 - protein, 9 aa, Artificial Sequence
  Description of Artificial Sequence: Synthetic peptide
  Seed: SQVWGGQPV (PMEL_HUMAN)
SRVWGGQPL

SEQ ID NO: 137912 - protein, 10 aa, Artificial Sequence
  Description of Artificial Sequence: Synthetic peptide
  Seed: SVTLDIVQGI (PMEL_HUMAN)
SWTLDIVQGV

SEQ ID NO: 137913 - protein, 10 aa, Artificial Sequence
  Description of Artificial Sequence: Synthetic peptide
  Seed: EVSIVVLSGT (PMEL_HUMAN)
ESSIVVLSGV

SEQ ID NO: 137914 - protein, 9 aa, Artificial Sequence
  Description of Artificial Sequence: Synthetic peptide
  Seed: ALDGGNKHF (PMEL_HUMAN)
ATDGGNKHF

SEQ ID NO: 137915 - protein, 9 aa, Artificial Sequence
  Description of Artificial Sequence: Synthetic peptide
  Seed: SAFTITDQV (PMEL_HUMAN)
SLFTITDQW

SEQ ID NO: 137916 - protein, 9 aa, Artificial Sequence
  Description of Artificial Sequence: Synthetic peptide
  Seed: GEGDAFELT (PMEL_HUMAN)
GEGDAFELL

SEQ ID NO: 137917 - protein, 9 aa, Artificial Sequence
  Description of Artificial Sequence: Synthetic peptide
  Seed: ITDQVPFSV (PMEL_HUMAN)
IIDQVPFSY

SEQ ID NO: 137918 - protein, 9 aa, Artificial Sequence
  Description of Artificial Sequence: Synthetic peptide
  Seed: RYGSFSVTL (PMEL_HUMAN)
RWGSFSVTF

SEQ ID NO: 137919 - protein, 9 aa, Artificial Sequence
  Description of Artificial Sequence: Synthetic peptide
  Seed: VISTAPVQM (PMEL_HUMAN)
VISTAPVQF

SEQ ID NO: 137920 - protein, 10 aa, Artificial Sequence
  Description of Artificial Sequence: Synthetic peptide
  Seed: SSAFTITDQV (PMEL_HUMAN)
SIAFTITDQV

SEQ ID NO: 137921 - protein, 9 aa, Artificial Sequence
  Description of Artificial Sequence: Synthetic peptide
  Seed: QPLTFALQL (PMEL_HUMAN)
QALTFALQY

SEQ ID NO: 137922 - protein, 9 aa, Artificial Sequence
  Description of Artificial Sequence: Synthetic peptide
  Seed: ALDGGNKHF (PMEL_HUMAN)
AIDGGNKHL

SEQ ID NO: 137923 - protein, 9 aa, Artificial Sequence
  Description of Artificial Sequence: Synthetic peptide
  Seed: FTITDQVPF (PMEL_HUMAN)
FAITDQVPI

SEQ ID NO: 137924 - protein, 10 aa, Artificial Sequence
  Description of Artificial Sequence: Synthetic peptide
  Seed: KVLPDGQVIW (PMEL_HUMAN)
KILPDGQVIY

SEQ ID NO: 137925 - protein, 10 aa, Artificial Sequence
  Description of Artificial Sequence: Synthetic peptide
  Seed: RQVPLDCVLY (PMEL_HUMAN)
RQVPLDCVLI

SEQ ID NO: 137926 - protein, 9 aa, Artificial Sequence
  Description of Artificial Sequence: Synthetic peptide
  Seed: VSLADTNSL (PMEL_HUMAN)
VLLADTNSV

SEQ ID NO: 137927 - protein, 11 aa, Artificial Sequence
  Description of Artificial Sequence: Synthetic peptide
  Seed: LGPLLDGTATL (PMEL_HUMAN)
LNPLLDGTATL

SEQ ID NO: 137928 - protein, 10 aa, Artificial Sequence
  Description of Artificial Sequence: Synthetic peptide
  Seed: SSSHWLRLPR (PMEL_HUMAN)
SHSHWLRLPK

SEQ ID NO: 137929 - protein, 10 aa, Artificial Sequence
  Description of Artificial Sequence: Synthetic peptide
  Seed: HFLRNQPLTF (PMEL_HUMAN)
HYLRNQPLTY

SEQ ID NO: 137930 - protein, 11 aa, Artificial Sequence
  Description of Artificial Sequence: Synthetic peptide
  Seed: MAVVLASLIYR (PMEL_HUMAN)
MFVVLASLIYR

SEQ ID NO: 137931 - protein, 9 aa, Artificial Sequence
  Description of Artificial Sequence: Synthetic peptide
  Seed: VLASLIYRR (PMEL_HUMAN)
VIASLIYRR

SEQ ID NO: 137932 - protein, 10 aa, Artificial Sequence
  Description of Artificial Sequence: Synthetic peptide
  Seed: ESITGSLGPL (PMEL_HUMAN)
ESITGSLGPI

SEQ ID NO: 137933 - protein, 9 aa, Artificial Sequence
  Description of Artificial Sequence: Synthetic peptide
  Seed: FLRNQPLTF (PMEL_HUMAN)
FQRNQPLTF

SEQ ID NO: 137934 - protein, 9 aa, Artificial Sequence
  Description of Artificial Sequence: Synthetic peptide
  Seed: MTPEKVPVS (PMEL_HUMAN)
MSPEKVPVL

SEQ ID NO: 137935 - protein, 10 aa, Artificial Sequence
  Description of Artificial Sequence: Synthetic peptide
  Seed: YRYGSFSVTL (PMEL_HUMAN)
YIYGSFSVTW

SEQ ID NO: 137936 - protein, 9 aa, Artificial Sequence
  Description of Artificial Sequence: Synthetic peptide
  Seed: FLRNQPLTF (PMEL_HUMAN)
FYRNQPLTL

SEQ ID NO: 137937 - protein, 10 aa, Artificial Sequence
  Description of Artificial Sequence: Synthetic peptide
  Seed: GSFSVTLDIV (PMEL_HUMAN)
GVFSVTLDIL

SEQ ID NO: 137938 - protein, 9 aa, Artificial Sequence
  Description of Artificial Sequence: Synthetic peptide
  Seed: VPLDCVLYR (PMEL_HUMAN)
VLLDCVLYR

SEQ ID NO: 137939 - protein, 10 aa, Artificial Sequence
  Description of Artificial Sequence: Synthetic peptide
  Seed: THTMEVTVYH (PMEL_HUMAN)
THTMEVTVYR

SEQ ID NO: 137940 - protein, 9 aa, Artificial Sequence
  Description of Artificial Sequence: Synthetic peptide
  Seed: YVWKTWGQY (PMEL_HUMAN)
YMWKTWGQW

SEQ ID NO: 137941 - protein, 9 aa, Artificial Sequence
  Description of Artificial Sequence: Synthetic peptide
  Seed: HTYLEPGPV (PMEL_HUMAN)
HTYLEPGPF

SEQ ID NO: 137942 - protein, 9 aa, Artificial Sequence
  Description of Artificial Sequence: Synthetic peptide
  Seed: QVIWVNNTI (PMEL_HUMAN)
QSIWVNNTI

SEQ ID NO: 137943 - protein, 11 aa, Artificial Sequence
  Description of Artificial Sequence: Synthetic peptide
  Seed: LVLMAVVLASL (PMEL_HUMAN)
LTLMAVVLASV

SEQ ID NO: 137944 - protein, 9 aa, Artificial Sequence
  Description of Artificial Sequence: Synthetic peptide
  Seed: GTYCLNVSL (PMEL_HUMAN)
GTYCLNVSR

SEQ ID NO: 137945 - protein, 9 aa, Artificial Sequence
  Description of Artificial Sequence: Synthetic peptide
  Seed: YRYGSFSVT (PMEL_HUMAN)
YRYGSFSVY

SEQ ID NO: 137946 - protein, 10 aa, Artificial Sequence
  Description of Artificial Sequence: Synthetic peptide
  Seed: AVIGALLAVG (PMEL_HUMAN)
ALIGALLAVP

SEQ ID NO: 137947 - protein, 9 aa, Artificial Sequence
  Description of Artificial Sequence: Synthetic peptide
  Seed: RLVKRQVPL (PMEL_HUMAN)
RMVKRQVPV

SEQ ID NO: 137948 - protein, 8 aa, Artificial Sequence
  Description of Artificial Sequence: Synthetic peptide
  Seed: AQVVLQAA (PMEL_HUMAN)
AQVVLQAV

SEQ ID NO: 137949 - protein, 9 aa, Artificial Sequence
  Description of Artificial Sequence: Synthetic peptide
  Seed: FGDSSGTLI (PMEL_HUMAN)
FIDSSGTLF

SEQ ID NO: 137950 - protein, 9 aa, Artificial Sequence
  Description of Artificial Sequence: Synthetic peptide
  Seed: IMPGQEAGL (PMEL_HUMAN)
IVPGQEAGL

SEQ ID NO: 137951 - protein, 10 aa, Artificial Sequence
  Description of Artificial Sequence: Synthetic peptide
  Seed: YRYGSFSVTL (PMEL_HUMAN)
YRYGSFSVTK

SEQ ID NO: 137952 - protein, 9 aa, Artificial Sequence
  Description of Artificial Sequence: Synthetic peptide
  Seed: WSQKRSFVY (PMEL_HUMAN)
WAQKRSFVF

SEQ ID NO: 137953 - protein, 9 aa, Artificial Sequence
  Description of Artificial Sequence: Synthetic peptide
  Seed: TTAGQVPTT (PMEL_HUMAN)
TTAGQVPTI

SEQ ID NO: 137954 - protein, 9 aa, Artificial Sequence
  Description of Artificial Sequence: Synthetic peptide
  Seed: GSSPVPGTT (PMEL_HUMAN)
GASPVPGTV

SEQ ID NO: 137955 - protein, 9 aa, Artificial Sequence
  Description of Artificial Sequence: Synthetic peptide
  Seed: SVPQLPHSS (PMEL_HUMAN)
SVPQLPHSL

SEQ ID NO: 137956 - protein, 9 aa, Artificial Sequence
  Description of Artificial Sequence: Synthetic peptide
  Seed: TTDGHRPTA (PMEL_HUMAN)
TADGHRPTA

SEQ ID NO: 137957 - protein, 9 aa, Artificial Sequence
  Description of Artificial Sequence: Synthetic peptide
  Seed: YWQVLGGPV (PMEL_HUMAN)
YYQVLGGPM

SEQ ID NO: 137958 - protein, 10 aa, Artificial Sequence
  Description of Artificial Sequence: Synthetic peptide
  Seed: YLAEADLSYT (PMEL_HUMAN)
YQAEADLSYA

SEQ ID NO: 137959 - protein, 9 aa, Artificial Sequence
  Description of Artificial Sequence: Synthetic peptide
  Seed: VLPSPACQL (PMEL_HUMAN)
VWPSPACQM

SEQ ID NO: 137960 - protein, 9 aa, Artificial Sequence
  Description of Artificial Sequence: Synthetic peptide
  Seed: LADTNSLAV (PMEL_HUMAN)
LGDTNSLAF

SEQ ID NO: 137961 - protein, 11 aa, Artificial Sequence
  Description of Artificial Sequence: Synthetic peptide
  Seed: HSSSHWLRLPR (PMEL_HUMAN)
HKSSHWLRLPR

SEQ ID NO: 137962 - protein, 9 aa, Artificial Sequence
  Description of Artificial Sequence: Synthetic peptide
  Seed: RLVKRQVPL (PMEL_HUMAN)
RHVKRQVPF

SEQ ID NO: 137963 - protein, 10 aa, Artificial Sequence
  Description of Artificial Sequence: Synthetic peptide
  Seed: VPFSVSVSQL (PMEL_HUMAN)
VPFSVSVSQM

SEQ ID NO: 137964 - protein, 9 aa, Artificial Sequence
  Description of Artificial Sequence: Synthetic peptide
  Seed: WVETTAREL (PMEL_HUMAN)
WAETTAREM

SEQ ID NO: 137965 - protein, 10 aa, Artificial Sequence
  Description of Artificial Sequence: Synthetic peptide
  Seed: MTPAEVSIVV (PMEL_HUMAN)
MVPAEVSIVM

SEQ ID NO: 137966 - protein, 9 aa, Artificial Sequence
  Description of Artificial Sequence: Synthetic peptide
  Seed: FTITDQVPF (PMEL_HUMAN)
FPITDQVPF

SEQ ID NO: 137967 - protein, 8 aa, Artificial Sequence
  Description of Artificial Sequence: Synthetic peptide
  Seed: YRYGSFSV (PMEL_HUMAN)
YRYGSFSM

SEQ ID NO: 137968 - protein, 9 aa, Artificial Sequence
  Description of Artificial Sequence: Synthetic peptide
  Seed: GQVPTTEVV (PMEL_HUMAN)
GNVPTTEVY

SEQ ID NO: 137969 - protein, 9 aa, Artificial Sequence
  Description of Artificial Sequence: Synthetic peptide
  Seed: SQKRSFVYV (PMEL_HUMAN)
SKKRSFVYM

SEQ ID NO: 137970 - protein, 9 aa, Artificial Sequence
  Description of Artificial Sequence: Synthetic peptide
  Seed: SGTLISRAL (PMEL_HUMAN)
STTLISRAL

SEQ ID NO: 137971 - protein, 11 aa, Artificial Sequence
  Description of Artificial Sequence: Synthetic peptide
  Seed: QAVPSGEGDAF (PMEL_HUMAN)
QIVPSGEGDAY

SEQ ID NO: 137972 - protein, 9 aa, Artificial Sequence
  Description of Artificial Sequence: Synthetic peptide
  Seed: VQVPTTEVI (PMEL_HUMAN)
VGVPTTEVF

SEQ ID NO: 137973 - protein, 9 aa, Artificial Sequence
  Description of Artificial Sequence: Synthetic peptide
  Seed: TTDGHRPTA (PMEL_HUMAN)
TLDGHRPTF

SEQ ID NO: 137974 - protein, 11 aa, Artificial Sequence
  Description of Artificial Sequence: Synthetic peptide
  Seed: MAVVLASLIYR (PMEL_HUMAN)
MRVVLASLIYK

SEQ ID NO: 137975 - protein, 9 aa, Artificial Sequence
  Description of Artificial Sequence: Synthetic peptide
  Seed: TPAEVSIVV (PMEL_HUMAN)
TQAEVSIVL

SEQ ID NO: 137976 - protein, 9 aa, Artificial Sequence
  Description of Artificial Sequence: Synthetic peptide
  Seed: FPDGGPCPS (PMEL_HUMAN)
FPDGGPCPH

SEQ ID NO: 137977 - protein, 9 aa, Artificial Sequence
  Description of Artificial Sequence: Synthetic peptide
  Seed: RTKAWNRQL (PMEL_HUMAN)
RTKAWNRQC

SEQ ID NO: 137978 - protein, 9 aa, Artificial Sequence
  Description of Artificial Sequence: Synthetic peptide
  Seed: DQVPFSVSV (PMEL_HUMAN)
DQVPFSVSI

SEQ ID NO: 137979 - protein, 8 aa, Artificial Sequence
  Description of Artificial Sequence: Synthetic peptide
  Seed: LADTNSLA (PMEL_HUMAN)
LMDTNSLL

SEQ ID NO: 137980 - protein, 9 aa, Artificial Sequence
  Description of Artificial Sequence: Synthetic peptide
  Seed: YLEPGPVTA (PMEL_HUMAN)
YYEPGPVTV

SEQ ID NO: 137981 - protein, 9 aa, Artificial Sequence
  Description of Artificial Sequence: Synthetic peptide
  Seed: DAFELTVSC (PMEL_HUMAN)
DAFELTVSI

SEQ ID NO: 137982 - protein, 10 aa, Artificial Sequence
  Description of Artificial Sequence: Synthetic peptide
  Seed: LAVIGALLAV (PMEL_HUMAN)
LGVIGALLAV

SEQ ID NO: 137983 - protein, 10 aa, Artificial Sequence
  Description of Artificial Sequence: Synthetic peptide
  Seed: VLMAVVLASL (PMEL_HUMAN)
VWMAVVLASI

SEQ ID NO: 137984 - protein, 8 aa, Artificial Sequence
  Description of Artificial Sequence: Synthetic peptide
  Seed: SNDGPTLI (PMEL_HUMAN)
STDGPTLF

SEQ ID NO: 137985 - protein, 9 aa, Artificial Sequence
  Description of Artificial Sequence: Synthetic peptide
  Seed: DIVQGIESA (PMEL_HUMAN)
DTVQGIESV

SEQ ID NO: 137986 - protein, 11 aa, Artificial Sequence
  Description of Artificial Sequence: Synthetic peptide
  Seed: RRRLMKQDFSV (PMEL_HUMAN)
RRRLMKQDFSF

SEQ ID NO: 137987 - protein, 10 aa, Artificial Sequence
  Description of Artificial Sequence: Synthetic peptide
  Seed: AVIGALLAVG (PMEL_HUMAN)
ATIGALLAVI

SEQ ID NO: 137988 - protein, 9 aa, Artificial Sequence
  Description of Artificial Sequence: Synthetic peptide
  Seed: QVIWVNNTI (PMEL_HUMAN)
QTIWVNNTA

SEQ ID NO: 137989 - protein, 10 aa, Artificial Sequence
  Description of Artificial Sequence: Synthetic peptide
  Seed: AVPSGEGDAF (PMEL_HUMAN)
AIPSGEGDAM

SEQ ID NO: 137990 - protein, 9 aa, Artificial Sequence
  Description of Artificial Sequence: Synthetic peptide
  Seed: SLAVVSTQL (PMEL_HUMAN)
SRAVVSTQL

SEQ ID NO: 137991 - protein, 9 aa, Artificial Sequence
  Description of Artificial Sequence: Synthetic peptide
  Seed: LIYRRRLMK (PMEL_HUMAN)
LSYRRRLMK

SEQ ID NO: 137992 - protein, 9 aa, Artificial Sequence
  Description of Artificial Sequence: Synthetic peptide
  Seed: RLVKRQVPL (PMEL_HUMAN)
RKVKRQVPF

SEQ ID NO: 137993 - protein, 10 aa, Artificial Sequence
  Description of Artificial Sequence: Synthetic peptide
  Seed: LAVIGALLAV (PMEL_HUMAN)
LDVIGALLAA

SEQ ID NO: 137994 - protein, 9 aa, Artificial Sequence
  Description of Artificial Sequence: Synthetic peptide
  Seed: YLEPGPVTA (PMEL_HUMAN)
YMEPGPVTM

SEQ ID NO: 137995 - protein, 11 aa, Artificial Sequence
  Description of Artificial Sequence: Synthetic peptide
  Seed: RALDGGNKHFL (PMEL_HUMAN)
RMLDGGNKHFR

SEQ ID NO: 137996 - protein, 9 aa, Artificial Sequence
  Description of Artificial Sequence: Synthetic peptide
  Seed: TAEAPNTTA (PMEL_HUMAN)
TTEAPNTTI

SEQ ID NO: 137997 - protein, 9 aa, Artificial Sequence
  Description of Artificial Sequence: Synthetic peptide
  Seed: AVVLASLIY (PMEL_HUMAN)
AEVLASLIF

SEQ ID NO: 137998 - protein, 10 aa, Artificial Sequence
  Description of Artificial Sequence: Synthetic peptide
  Seed: MAVVLASLIY (PMEL_HUMAN)
MCVVLASLIY

SEQ ID NO: 137999 - protein, 9 aa, Artificial Sequence
  Description of Artificial Sequence: Synthetic peptide
  Seed: MEVTVYHRR (PMEL_HUMAN)
MLVTVYHRR

SEQ ID NO: 138000 - protein, 9 aa, Artificial Sequence
  Description of Artificial Sequence: Synthetic peptide
  Seed: TLIGANASF (PMEL_HUMAN)
TFIGANASI

SEQ ID NO: 138001 - protein, 9 aa, Artificial Sequence
  Description of Artificial Sequence: Synthetic peptide
  Seed: TTAAQVTTT (PMEL_HUMAN)
TSAAQVTTV

SEQ ID NO: 138002 - protein, 9 aa, Artificial Sequence
  Description of Artificial Sequence: Synthetic peptide
  Seed: DAFELTVSC (PMEL_HUMAN)
DAFELTVSF

SEQ ID NO: 138003 - protein, 10 aa, Artificial Sequence
  Description of Artificial Sequence: Synthetic peptide
  Seed: TLAEMSTPEA (PMEL_HUMAN)
TMAEMSTPEL

SEQ ID NO: 138004 - protein, 8 aa, Artificial Sequence
  Description of Artificial Sequence: Synthetic peptide
  Seed: SEVMGTTL (PMEL_HUMAN)
SEVMGTTW

SEQ ID NO: 138005 - protein, 9 aa, Artificial Sequence
  Description of Artificial Sequence: Synthetic peptide
  Seed: RLVKRQVPL (PMEL_HUMAN)
RQVKRQVPF

SEQ ID NO: 138006 - protein, 9 aa, Artificial Sequence
  Description of Artificial Sequence: Synthetic peptide
  Seed: SQVWGGQPV (PMEL_HUMAN)
SAVWGGQPF

SEQ ID NO: 138007 - protein, 9 aa, Artificial Sequence
  Description of Artificial Sequence: Synthetic peptide
  Seed: ALDGGNKHF (PMEL_HUMAN)
AYDGGNKHM

SEQ ID NO: 138008 - protein, 8 aa, Artificial Sequence
  Description of Artificial Sequence: Synthetic peptide
  Seed: TLDIVQGI (PMEL_HUMAN)
TSDIVQGM

SEQ ID NO: 138009 - protein, 10 aa, Artificial Sequence
  Description of Artificial Sequence: Synthetic peptide
  Seed: RGSRSYVPLA (PMEL_HUMAN)
RNSRSYVPLI

SEQ ID NO: 138010 - protein, 9 aa, Artificial Sequence
  Description of Artificial Sequence: Synthetic peptide
  Seed: TEWVETTAR (PMEL_HUMAN)
TEWVETTAL

SEQ ID NO: 138011 - protein, 9 aa, Artificial Sequence
  Description of Artificial Sequence: Synthetic peptide
  Seed: PLLDGTATL (PMEL_HUMAN)
PMLDGTATV

SEQ ID NO: 138012 - protein, 9 aa, Artificial Sequence
  Description of Artificial Sequence: Synthetic peptide
  Seed: TPAEVSIVV (PMEL_HUMAN)
TPAEVSIVF

SEQ ID NO: 138013 - protein, 9 aa, Artificial Sequence
  Description of Artificial Sequence: Synthetic peptide
  Seed: KAWNRQLYP (PMEL_HUMAN)
KYWNRQLYK

SEQ ID NO: 138014 - protein, 9 aa, Artificial Sequence
  Description of Artificial Sequence: Synthetic peptide
  Seed: MSTPEATGM (PMEL_HUMAN)
MVTPEATGF

SEQ ID NO: 138015 - protein, 10 aa, Artificial Sequence
  Description of Artificial Sequence: Synthetic peptide
  Seed: ASFSIALNFP (PMEL_HUMAN)
AAFSIALNFF

SEQ ID NO: 138016 - protein, 9 aa, Artificial Sequence
  Description of Artificial Sequence: Synthetic peptide
  Seed: VQMPTAEST (PMEL_HUMAN)
VMMPTAESL

SEQ ID NO: 138017 - protein, 9 aa, Artificial Sequence
  Description of Artificial Sequence: Synthetic peptide
  Seed: KVLPDGQVI (PMEL_HUMAN)
KMLPDGQVV

SEQ ID NO: 138018 - protein, 9 aa, Artificial Sequence
  Description of Artificial Sequence: Synthetic peptide
  Seed: STAPVQMPT (PMEL_HUMAN)
SQAPVQMPV

SEQ ID NO: 138019 - protein, 9 aa, Artificial Sequence
  Description of Artificial Sequence: Synthetic peptide
  Seed: FLRNQPLTF (PMEL_HUMAN)
FTRNQPLTM

SEQ ID NO: 138020 - protein, 9 aa, Artificial Sequence
  Description of Artificial Sequence: Synthetic peptide
  Seed: VVLQAAIPL (PMEL_HUMAN)
VMLQAAIPV

SEQ ID NO: 138021 - protein, 10 aa, Artificial Sequence
  Description of Artificial Sequence: Synthetic peptide
  Seed: ALLAVGATKV (PMEL_HUMAN)
AQLAVGATKV

SEQ ID NO: 138022 - protein, 9 aa, Artificial Sequence
  Description of Artificial Sequence: Synthetic peptide
  Seed: LYRYGSFSV (PMEL_HUMAN)
LYRYGSFSW

SEQ ID NO: 138023 - protein, 10 aa, Artificial Sequence
  Description of Artificial Sequence: Synthetic peptide
  Seed: VVLASLIYRR (PMEL_HUMAN)
VMLASLIYRG

SEQ ID NO: 138024 - protein, 11 aa, Artificial Sequence
  Description of Artificial Sequence: Synthetic peptide
  Seed: GSQVWGGQPVY (PMEL_HUMAN)
GRQVWGGQPVF

SEQ ID NO: 138025 - protein, 9 aa, Artificial Sequence
  Description of Artificial Sequence: Synthetic peptide
  Seed: QAAIPLTSC (PMEL_HUMAN)
QSAIPLTSL

SEQ ID NO: 138026 - protein, 9 aa, Artificial Sequence
  Description of Artificial Sequence: Synthetic peptide
  Seed: AQRLCQPVL (PMEL_HUMAN)
ASRLCQPVA

SEQ ID NO: 138027 - protein, 9 aa, Artificial Sequence
  Description of Artificial Sequence: Synthetic peptide
  Seed: GQVPTTEVV (PMEL_HUMAN)
GTVPTTEVY

SEQ ID NO: 138028 - protein, 9 aa, Artificial Sequence
  Description of Artificial Sequence: Synthetic peptide
  Seed: SFVYVWKTW (PMEL_HUMAN)
STVYVWKTF

SEQ ID NO: 138029 - protein, 9 aa, Artificial Sequence
  Description of Artificial Sequence: Synthetic peptide
  Seed: SQKRSFVYV (PMEL_HUMAN)
SFKRSFVYV

SEQ ID NO: 138030 - protein, 8 aa, Artificial Sequence
  Description of Artificial Sequence: Synthetic peptide
  Seed: LAHSSSAF (PMEL_HUMAN)
LMHSSSAF

SEQ ID NO: 138031 - protein, 9 aa, Artificial Sequence
  Description of Artificial Sequence: Synthetic peptide
  Seed: AGQVPTTEV (PMEL_HUMAN)
AAQVPTTEV

SEQ ID NO: 138032 - protein, 9 aa, Artificial Sequence
  Description of Artificial Sequence: Synthetic peptide
  Seed: RALVVTHTY (PMEL_HUMAN)
RNLVVTHTY

SEQ ID NO: 138033 - protein, 10 aa, Artificial Sequence
  Description of Artificial Sequence: Synthetic peptide
  Seed: YLAEADLSYT (PMEL_HUMAN)
YIAEADLSYF

SEQ ID NO: 138034 - protein, 11 aa, Artificial Sequence
  Description of Artificial Sequence: Synthetic peptide
  Seed: ISRALVVTHTY (PMEL_HUMAN)
IWRALVVTHTW

SEQ ID NO: 138035 - protein, 9 aa, Artificial Sequence
  Description of Artificial Sequence: Synthetic peptide
  Seed: GILLVLMAV (PMEL_HUMAN)
GQLLVLMAV

SEQ ID NO: 138036 - protein, 9 aa, Artificial Sequence
  Description of Artificial Sequence: Synthetic peptide
  Seed: MAVVLASLI (PMEL_HUMAN)
MAVVLASLY

SEQ ID NO: 138037 - protein, 11 aa, Artificial Sequence
  Description of Artificial Sequence: Synthetic peptide
  Seed: VSLADTNSLAV (PMEL_HUMAN)
VVLADTNSLAW

SEQ ID NO: 138038 - protein, 8 aa, Artificial Sequence
  Description of Artificial Sequence: Synthetic peptide
  Seed: LLDGTATL (PMEL_HUMAN)
LFDGTATI

SEQ ID NO: 138039 - protein, 9 aa, Artificial Sequence
  Description of Artificial Sequence: Synthetic peptide
  Seed: SSHWLRLPR (PMEL_HUMAN)
SVHWLRLPK

SEQ ID NO: 138040 - protein, 9 aa, Artificial Sequence
  Description of Artificial Sequence: Synthetic peptide
  Seed: TLISRALVV (PMEL_HUMAN)
TMISRALVR

SEQ ID NO: 138041 - protein, 9 aa, Artificial Sequence
  Description of Artificial Sequence: Synthetic peptide
  Seed: AQVVLQAAI (PMEL_HUMAN)
AQVVLQAAV

SEQ ID NO: 138042 - protein, 10 aa, Artificial Sequence
  Description of Artificial Sequence: Synthetic peptide
  Seed: VLMAVVLASL (PMEL_HUMAN)
VLMAVVLASA

SEQ ID NO: 138043 - protein, 10 aa, Artificial Sequence
  Description of Artificial Sequence: Synthetic peptide
  Seed: FSVSVSQLRA (PMEL_HUMAN)
FNVSVSQLRR

SEQ ID NO: 138044 - protein, 9 aa, Artificial Sequence
  Description of Artificial Sequence: Synthetic peptide
  Seed: RAMLGTHTM (PMEL_HUMAN)
RQMLGTHTG

SEQ ID NO: 138045 - protein, 9 aa, Artificial Sequence
  Description of Artificial Sequence: Synthetic peptide
  Seed: GSFSVTLDI (PMEL_HUMAN)
GTFSVTLDW

SEQ ID NO: 138046 - protein, 9 aa, Artificial Sequence
  Description of Artificial Sequence: Synthetic peptide
  Seed: VVLQAAIPL (PMEL_HUMAN)
VSLQAAIPY

SEQ ID NO: 138047 - protein, 9 aa, Artificial Sequence
  Description of Artificial Sequence: Synthetic peptide
  Seed: QVWGGQPVY (PMEL_HUMAN)
QTWGGQPVM

SEQ ID NO: 138048 - protein, 9 aa, Artificial Sequence
  Description of Artificial Sequence: Synthetic peptide
  Seed: RGGQVSLKV (PMEL_HUMAN)
RMGQVSLKL

SEQ ID NO: 138049 - protein, 9 aa, Artificial Sequence
  Description of Artificial Sequence: Synthetic peptide
  Seed: YLEPGPVTA (PMEL_HUMAN)
YSEPGPVTV

SEQ ID NO: 138050 - protein, 10 aa, Artificial Sequence
  Description of Artificial Sequence: Synthetic peptide
  Seed: MTPAEVSIVV (PMEL_HUMAN)
MIPAEVSIVV

SEQ ID NO: 138051 - protein, 10 aa, Artificial Sequence
  Description of Artificial Sequence: Synthetic peptide
  Seed: TGMTPAEVSI (PMEL_HUMAN)
TMMTPAEVSL

SEQ ID NO: 138052 - protein, 8 aa, Artificial Sequence
  Description of Artificial Sequence: Synthetic peptide
  Seed: AQVVLQAA (PMEL_HUMAN)
AEVVLQAI

SEQ ID NO: 138053 - protein, 10 aa, Artificial Sequence
  Description of Artificial Sequence: Synthetic peptide
  Seed: RQLYPEWTEA (PMEL_HUMAN)
RPLYPEWTEF

SEQ ID NO: 138054 - protein, 9 aa, Artificial Sequence
  Description of Artificial Sequence: Synthetic peptide
  Seed: QKRSFVYVW (PMEL_HUMAN)
QARSFVYVY

SEQ ID NO: 138055 - protein, 9 aa, Artificial Sequence
  Description of Artificial Sequence: Synthetic peptide
  Seed: TTPGQAPTA (PMEL_HUMAN)
TFPGQAPTL

SEQ ID NO: 138056 - protein, 11 aa, Artificial Sequence
  Description of Artificial Sequence: Synthetic peptide
  Seed: RRGSRSYVPLA (PMEL_HUMAN)
RGGSRSYVPLA

SEQ ID NO: 138057 - protein, 9 aa, Artificial Sequence
  Description of Artificial Sequence: Synthetic peptide
  Seed: VPLAHSSSA (PMEL_HUMAN)
VPLAHSSSM

SEQ ID NO: 138058 - protein, 11 aa, Artificial Sequence
  Description of Artificial Sequence: Synthetic peptide
  Seed: RQVPLDCVLYR (PMEL_HUMAN)
RSVPLDCVLYK

SEQ ID NO: 138059 - protein, 9 aa, Artificial Sequence
  Description of Artificial Sequence: Synthetic peptide
  Seed: QVIWVNNTI (PMEL_HUMAN)
QLIWVNNTV

SEQ ID NO: 138060 - protein, 9 aa, Artificial Sequence
  Description of Artificial Sequence: Synthetic peptide
  Seed: CVLYRYGSF (PMEL_HUMAN)
CMLYRYGSM

SEQ ID NO: 138061 - protein, 9 aa, Artificial Sequence
  Description of Artificial Sequence: Synthetic peptide
  Seed: LTSCGSSPV (PMEL_HUMAN)
LISCGSSPF

SEQ ID NO: 138062 - protein, 9 aa, Artificial Sequence
  Description of Artificial Sequence: Synthetic peptide
  Seed: RYGSFSVTL (PMEL_HUMAN)
RFGSFSVTF

SEQ ID NO: 138063 - protein, 10 aa, Artificial Sequence
  Description of Artificial Sequence: Synthetic peptide
  Seed: AVVLASLIYR (PMEL_HUMAN)
ANVLASLIYR

SEQ ID NO: 138064 - protein, 10 aa, Artificial Sequence
  Description of Artificial Sequence: Synthetic peptide
  Seed: QVLGGPVSGL (PMEL_HUMAN)
QTLGGPVSGV

SEQ ID NO: 138065 - protein, 9 aa, Artificial Sequence
  Description of Artificial Sequence: Synthetic peptide
  Seed: HTMEVTVYH (PMEL_HUMAN)
HGMEVTVYM

SEQ ID NO: 138066 - protein, 10 aa, Artificial Sequence
  Description of Artificial Sequence: Synthetic peptide
  Seed: DGTATLRLVK (PMEL_HUMAN)
DGTATLRLVR

SEQ ID NO: 138067 - protein, 9 aa, Artificial Sequence
  Description of Artificial Sequence: Synthetic peptide
  Seed: RQVPLDCVL (PMEL_HUMAN)
RHVPLDCVY

SEQ ID NO: 138068 - protein, 9 aa, Artificial Sequence
  Description of Artificial Sequence: Synthetic peptide
  Seed: ALDGGNKHF (PMEL_HUMAN)
AWDGGNKHV

SEQ ID NO: 138069 - protein, 10 aa, Artificial Sequence
  Description of Artificial Sequence: Synthetic peptide
  Seed: KRQVPLDCVL (PMEL_HUMAN)
KFQVPLDCVY

SEQ ID NO: 138070 - protein, 9 aa, Artificial Sequence
  Description of Artificial Sequence: Synthetic peptide
  Seed: LTSCGSSPV (PMEL_HUMAN)
LMSCGSSPF

SEQ ID NO: 138071 - protein, 9 aa, Artificial Sequence
  Description of Artificial Sequence: Synthetic peptide
  Seed: FGDSSGTLI (PMEL_HUMAN)
FCDSSGTLV

SEQ ID NO: 138072 - protein, 9 aa, Artificial Sequence
  Description of Artificial Sequence: Synthetic peptide
  Seed: AEAPNTTAG (PMEL_HUMAN)
ADAPNTTAF

SEQ ID NO: 138073 - protein, 11 aa, Artificial Sequence
  Description of Artificial Sequence: Synthetic peptide
  Seed: FTITDQVPFSV (PMEL_HUMAN)
FVITDQVPFSV

SEQ ID NO: 138074 - protein, 9 aa, Artificial Sequence
  Description of Artificial Sequence: Synthetic peptide
  Seed: VISTAPVQM (PMEL_HUMAN)
VLSTAPVQR

SEQ ID NO: 138075 - protein, 10 aa, Artificial Sequence
  Description of Artificial Sequence: Synthetic peptide
  Seed: SIVVLSGTTA (PMEL_HUMAN)
SVVVLSGTTV

SEQ ID NO: 138076 - protein, 9 aa, Artificial Sequence
  Description of Artificial Sequence: Synthetic peptide
  Seed: AQVVLQAAI (PMEL_HUMAN)
AEVVLQAAA

SEQ ID NO: 138077 - protein, 10 aa, Artificial Sequence
  Description of Artificial Sequence: Synthetic peptide
  Seed: STAPVQMPTA (PMEL_HUMAN)
SLAPVQMPTA

SEQ ID NO: 138078 - protein, 9 aa, Artificial Sequence
  Description of Artificial Sequence: Synthetic peptide
  Seed: KVLPDGQVI (PMEL_HUMAN)
KVLPDGQVF

SEQ ID NO: 138079 - protein, 9 aa, Artificial Sequence
  Description of Artificial Sequence: Synthetic peptide
  Seed: KQDFSVPQL (PMEL_HUMAN)
KWDFSVPQV

SEQ ID NO: 138080 - protein, 9 aa, Artificial Sequence
  Description of Artificial Sequence: Synthetic peptide
  Seed: KAWNRQLYP (PMEL_HUMAN)
KVWNRQLYL

SEQ ID NO: 138081 - protein, 9 aa, Artificial Sequence
  Description of Artificial Sequence: Synthetic peptide
  Seed: RGSRSYVPL (PMEL_HUMAN)
RTSRSYVPV

SEQ ID NO: 138082 - protein, 11 aa, Artificial Sequence
  Description of Artificial Sequence: Synthetic peptide
  Seed: GMTPAEVSIVV (PMEL_HUMAN)
GLTPAEVSIVV

SEQ ID NO: 138083 - protein, 9 aa, Artificial Sequence
  Description of Artificial Sequence: Synthetic peptide
  Seed: AEPSGTTSV (PMEL_HUMAN)
ALPSGTTSI

SEQ ID NO: 138084 - protein, 9 aa, Artificial Sequence
  Description of Artificial Sequence: Synthetic peptide
  Seed: GSWSQKRSF (PMEL_HUMAN)
GAWSQKRSW

SEQ ID NO: 138085 - protein, 10 aa, Artificial Sequence
  Description of Artificial Sequence: Synthetic peptide
  Seed: KTWGQYWQVL (PMEL_HUMAN)
KFWGQYWQVF

SEQ ID NO: 138086 - protein, 10 aa, Artificial Sequence
  Description of Artificial Sequence: Synthetic peptide
  Seed: MTPAEVSIVV (PMEL_HUMAN)
MTPAEVSIVW

SEQ ID NO: 138087 - protein, 10 aa, Artificial Sequence
  Description of Artificial Sequence: Synthetic peptide
  Seed: ALDGGNKHFL (PMEL_HUMAN)
ATDGGNKHFW

SEQ ID NO: 138088 - protein, 9 aa, Artificial Sequence
  Description of Artificial Sequence: Synthetic peptide
  Seed: VLMAVVLAS (PMEL_HUMAN)
VLMAVVLAL

SEQ ID NO: 138089 - protein, 9 aa, Artificial Sequence
  Description of Artificial Sequence: Synthetic peptide
  Seed: KQDFSVPQL (PMEL_HUMAN)
KSDFSVPQL

SEQ ID NO: 138090 - protein, 9 aa, Artificial Sequence
  Description of Artificial Sequence: Synthetic peptide
  Seed: YLAEADLSY (PMEL_HUMAN)
YRAEADLSL

SEQ ID NO: 138091 - protein, 10 aa, Artificial Sequence
  Description of Artificial Sequence: Synthetic peptide
  Seed: SSAFTITDQV (PMEL_HUMAN)
STAFTITDQL

SEQ ID NO: 138092 - protein, 9 aa, Artificial Sequence
  Description of Artificial Sequence: Synthetic peptide
  Seed: MAVVLASLI (PMEL_HUMAN)
MQVVLASLM

SEQ ID NO: 138093 - protein, 10 aa, Artificial Sequence
  Description of Artificial Sequence: Synthetic peptide
  Seed: MTPAEVSIVV (PMEL_HUMAN)
MQPAEVSIVL

SEQ ID NO: 138094 - protein, 10 aa, Artificial Sequence
  Description of Artificial Sequence: Synthetic peptide
  Seed: MKQDFSVPQL (PMEL_HUMAN)
MHQDFSVPQF

SEQ ID NO: 138095 - protein, 8 aa, Artificial Sequence
  Description of Artificial Sequence: Synthetic peptide
  Seed: TLDIVQGI (PMEL_HUMAN)
TLDIVQGM

SEQ ID NO: 138096 - protein, 10 aa, Artificial Sequence
  Description of Artificial Sequence: Synthetic peptide
  Seed: SGTYCLNVSL (PMEL_HUMAN)
SWTYCLNVSY

SEQ ID NO: 138097 - protein, 10 aa, Artificial Sequence
  Description of Artificial Sequence: Synthetic peptide
  Seed: VTAQVVLQAA (PMEL_HUMAN)
VMAQVVLQAV

SEQ ID NO: 138098 - protein, 9 aa, Artificial Sequence
  Description of Artificial Sequence: Synthetic peptide
  Seed: AVIGALLAV (PMEL_HUMAN)
AQIGALLAY

SEQ ID NO: 138099 - protein, 11 aa, Artificial Sequence
  Description of Artificial Sequence: Synthetic peptide
  Seed: RALDGGNKHFL (PMEL_HUMAN)
RTLDGGNKHFR

SEQ ID NO: 138100 - protein, 11 aa, Artificial Sequence
  Description of Artificial Sequence: Synthetic peptide
  Seed: RALDGGNKHFL (PMEL_HUMAN)
RVLDGGNKHFF

SEQ ID NO: 138101 - protein, 9 aa, Artificial Sequence
  Description of Artificial Sequence: Synthetic peptide
  Seed: DSSGTLISR (PMEL_HUMAN)
DLSGTLISK

SEQ ID NO: 138102 - protein, 9 aa, Artificial Sequence
  Description of Artificial Sequence: Synthetic peptide
  Seed: FTITDQVPF (PMEL_HUMAN)
FSITDQVPL

SEQ ID NO: 138103 - protein, 10 aa, Artificial Sequence
  Description of Artificial Sequence: Synthetic peptide
  Seed: TPEATGMTPA (PMEL_HUMAN)
TPEATGMTPL

SEQ ID NO: 138104 - protein, 9 aa, Artificial Sequence
  Description of Artificial Sequence: Synthetic peptide
  Seed: SGLSIGTGR (PMEL_HUMAN)
SSLSIGTGF

SEQ ID NO: 138105 - protein, 11 aa, Artificial Sequence
  Description of Artificial Sequence: Synthetic peptide
  Seed: SYVPLAHSSSA (PMEL_HUMAN)
SVVPLAHSSSL

SEQ ID NO: 138106 - protein, 9 aa, Artificial Sequence
  Description of Artificial Sequence: Synthetic peptide
  Seed: LADTNSLAV (PMEL_HUMAN)
LWDTNSLAL

SEQ ID NO: 138107 - protein, 9 aa, Artificial Sequence
  Description of Artificial Sequence: Synthetic peptide
  Seed: TWGQYWQVL (PMEL_HUMAN)
TFGQYWQVF

SEQ ID NO: 138108 - protein, 9 aa, Artificial Sequence
  Description of Artificial Sequence: Synthetic peptide
  Seed: TPAEVSIVV (PMEL_HUMAN)
TTAEVSIVY

SEQ ID NO: 138109 - protein, 10 aa, Artificial Sequence
  Description of Artificial Sequence: Synthetic peptide
  Seed: QVLGGPVSGL (PMEL_HUMAN)
QMLGGPVSGA

SEQ ID NO: 138110 - protein, 9 aa, Artificial Sequence
  Description of Artificial Sequence: Synthetic peptide
  Seed: VLQAAIPLT (PMEL_HUMAN)
VQQAAIPLI

SEQ ID NO: 138111 - protein, 10 aa, Artificial Sequence
  Description of Artificial Sequence: Synthetic peptide
  Seed: THTMEVTVYH (PMEL_HUMAN)
TWTMEVTVYK

SEQ ID NO: 138112 - protein, 9 aa, Artificial Sequence
  Description of Artificial Sequence: Synthetic peptide
  Seed: SIGTGRAML (PMEL_HUMAN)
SAGTGRAMY

SEQ ID NO: 138113 - protein, 9 aa, Artificial Sequence
  Description of Artificial Sequence: Synthetic peptide
  Seed: VVLQAAIPL (PMEL_HUMAN)
VLLQAAIPA

SEQ ID NO: 138114 - protein, 10 aa, Artificial Sequence
  Description of Artificial Sequence: Synthetic peptide
  Seed: LAVIGALLAV (PMEL_HUMAN)
LWVIGALLAV

SEQ ID NO: 138115 - protein, 9 aa, Artificial Sequence
  Description of Artificial Sequence: Synthetic peptide
  Seed: VTAQVVLQA (PMEL_HUMAN)
VTAQVVLQV

SEQ ID NO: 138116 - protein, 9 aa, Artificial Sequence
  Description of Artificial Sequence: Synthetic peptide
  Seed: EVMGTTLAE (PMEL_HUMAN)
EMMGTTLAK

SEQ ID NO: 138117 - protein, 9 aa, Artificial Sequence
  Description of Artificial Sequence: Synthetic peptide
  Seed: HTMEVTVYH (PMEL_HUMAN)
HAMEVTVYF

SEQ ID NO: 138118 - protein, 9 aa, Artificial Sequence
  Description of Artificial Sequence: Synthetic peptide
  Seed: EKVPVSEVM (PMEL_HUMAN)
ESVPVSEVY

SEQ ID NO: 138119 - protein, 9 aa, Artificial Sequence
  Description of Artificial Sequence: Synthetic peptide
  Seed: VTAQVVLQA (PMEL_HUMAN)
VVAQVVLQI

SEQ ID NO: 138120 - protein, 10 aa, Artificial Sequence
  Description of Artificial Sequence: Synthetic peptide
  Seed: GPLLDGTATL (PMEL_HUMAN)
GWLLDGTATL

SEQ ID NO: 138121 - protein, 10 aa, Artificial Sequence
  Description of Artificial Sequence: Synthetic peptide
  Seed: KRCLLHLAVI (PMEL_HUMAN)
KRCLLHLAVL

SEQ ID NO: 138122 - protein, 11 aa, Artificial Sequence
  Description of Artificial Sequence: Synthetic peptide
  Seed: LVLMAVVLASL (PMEL_HUMAN)
LFLMAVVLASI

SEQ ID NO: 138123 - protein, 10 aa, Artificial Sequence
  Description of Artificial Sequence: Synthetic peptide
  Seed: MTPAEVSIVV (PMEL_HUMAN)
MPPAEVSIVS

SEQ ID NO: 138124 - protein, 9 aa, Artificial Sequence
  Description of Artificial Sequence: Synthetic peptide
  Seed: SLAVVSTQL (PMEL_HUMAN)
SAAVVSTQM

SEQ ID NO: 138125 - protein, 9 aa, Artificial Sequence
  Description of Artificial Sequence: Synthetic peptide
  Seed: TTPGQAPTA (PMEL_HUMAN)
TCPGQAPTM

SEQ ID NO: 138126 - protein, 9 aa, Artificial Sequence
  Description of Artificial Sequence: Synthetic peptide
  Seed: FPDGGPCPS (PMEL_HUMAN)
FMDGGPCPF

SEQ ID NO: 138127 - protein, 10 aa, Artificial Sequence
  Description of Artificial Sequence: Synthetic peptide
  Seed: SLIYRRRLMK (PMEL_HUMAN)
SRIYRRRLMR

SEQ ID NO: 138128 - protein, 9 aa, Artificial Sequence
  Description of Artificial Sequence: Synthetic peptide
  Seed: YRYGSFSVT (PMEL_HUMAN)
YHYGSFSVI

SEQ ID NO: 138129 - protein, 10 aa, Artificial Sequence
  Description of Artificial Sequence: Synthetic peptide
  Seed: YRYGSFSVTL (PMEL_HUMAN)
YNYGSFSVTY

SEQ ID NO: 138130 - protein, 11 aa, Artificial Sequence
  Description of Artificial Sequence: Synthetic peptide
  Seed: SYVPLAHSSSA (PMEL_HUMAN)
SMVPLAHSSSM

SEQ ID NO: 138131 - protein, 9 aa, Artificial Sequence
  Description of Artificial Sequence: Synthetic peptide
  Seed: LADTNSLAV (PMEL_HUMAN)
LDDTNSLAL

SEQ ID NO: 138132 - protein, 9 aa, Artificial Sequence
  Description of Artificial Sequence: Synthetic peptide
  Seed: GENSPLLSG (PMEL_HUMAN)
GENSPLLSP

SEQ ID NO: 138133 - protein, 10 aa, Artificial Sequence
  Description of Artificial Sequence: Synthetic peptide
  Seed: SGTYCLNVSL (PMEL_HUMAN)
SYTYCLNVSF

SEQ ID NO: 138134 - protein, 10 aa, Artificial Sequence
  Description of Artificial Sequence: Synthetic peptide
  Seed: KRQVPLDCVL (PMEL_HUMAN)
KIQVPLDCVM

SEQ ID NO: 138135 - protein, 10 aa, Artificial Sequence
  Description of Artificial Sequence: Synthetic peptide
  Seed: MPTAESTGMT (PMEL_HUMAN)
MDTAESTGMV

SEQ ID NO: 138136 - protein, 9 aa, Artificial Sequence
  Description of Artificial Sequence: Synthetic peptide
  Seed: GSFSVTLDI (PMEL_HUMAN)
GLFSVTLDL

SEQ ID NO: 138137 - protein, 9 aa, Artificial Sequence
  Description of Artificial Sequence: Synthetic peptide
  Seed: VLPSPACQL (PMEL_HUMAN)
VIPSPACQI

SEQ ID NO: 138138 - protein, 10 aa, Artificial Sequence
  Description of Artificial Sequence: Synthetic peptide
  Seed: YRYGSFSVTL (PMEL_HUMAN)
YIYGSFSVTM

SEQ ID NO: 138139 - protein, 9 aa, Artificial Sequence
  Description of Artificial Sequence: Synthetic peptide
  Seed: VTLDIVQGI (PMEL_HUMAN)
VMLDIVQGI

SEQ ID NO: 138140 - protein, 9 aa, Artificial Sequence
  Description of Artificial Sequence: Synthetic peptide
  Seed: DQVPFSVSV (PMEL_HUMAN)
DQVPFSVSM

SEQ ID NO: 138141 - protein, 10 aa, Artificial Sequence
  Description of Artificial Sequence: Synthetic peptide
  Seed: LPHSSSHWLR (PMEL_HUMAN)
LTHSSSHWLK

SEQ ID NO: 138142 - protein, 10 aa, Artificial Sequence
  Description of Artificial Sequence: Synthetic peptide
  Seed: SVPQLPHSSS (PMEL_HUMAN)
SDPQLPHSSL

SEQ ID NO: 138143 - protein, 10 aa, Artificial Sequence
  Description of Artificial Sequence: Synthetic peptide
  Seed: AVIGALLAVG (PMEL_HUMAN)
AIIGALLAVT

SEQ ID NO: 138144 - protein, 10 aa, Artificial Sequence
  Description of Artificial Sequence: Synthetic peptide
  Seed: LPHSSSHWLR (PMEL_HUMAN)
LQHSSSHWLR

SEQ ID NO: 138145 - protein, 9 aa, Artificial Sequence
  Description of Artificial Sequence: Synthetic peptide
  Seed: TAEAPNTTA (PMEL_HUMAN)
TLEAPNTTM

SEQ ID NO: 138146 - protein, 10 aa, Artificial Sequence
  Description of Artificial Sequence: Synthetic peptide
  Seed: RQLRTKAWNR (PMEL_HUMAN)
RQLRTKAWNK

SEQ ID NO: 138147 - protein, 9 aa, Artificial Sequence
  Description of Artificial Sequence: Synthetic peptide
  Seed: VLKRCLLHL (PMEL_HUMAN)
VMKRCLLHL

SEQ ID NO: 138148 - protein, 11 aa, Artificial Sequence
  Description of Artificial Sequence: Synthetic peptide
  Seed: FALQLHDPSGY (PMEL_HUMAN)
FQLQLHDPSGY

SEQ ID NO: 138149 - protein, 10 aa, Artificial Sequence
  Description of Artificial Sequence: Synthetic peptide
  Seed: RALVVTHTYL (PMEL_HUMAN)
RILVVTHTYF

SEQ ID NO: 138150 - protein, 10 aa, Artificial Sequence
  Description of Artificial Sequence: Synthetic peptide
  Seed: LGQVPLIVGI (PMEL_HUMAN)
LTQVPLIVGV

SEQ ID NO: 138151 - protein, 9 aa, Artificial Sequence
  Description of Artificial Sequence: Synthetic peptide
  Seed: RTKAWNRQL (PMEL_HUMAN)
RVKAWNRQI

SEQ ID NO: 138152 - protein, 11 aa, Artificial Sequence
  Description of Artificial Sequence: Synthetic peptide
  Seed: QAVPSGEGDAF (PMEL_HUMAN)
QPVPSGEGDAL

SEQ ID NO: 138153 - protein, 9 aa, Artificial Sequence
  Description of Artificial Sequence: Synthetic peptide
  Seed: VSNDGPTLI (PMEL_HUMAN)
VINDGPTLM

SEQ ID NO: 138154 - protein, 10 aa, Artificial Sequence
  Description of Artificial Sequence: Synthetic peptide
  Seed: SRALVVTHTY (PMEL_HUMAN)
SQALVVTHTF

SEQ ID NO: 138155 - protein, 10 aa, Artificial Sequence
  Description of Artificial Sequence: Synthetic peptide
  Seed: RTKAWNRQLY (PMEL_HUMAN)
RLKAWNRQLR

SEQ ID NO: 138156 - protein, 9 aa, Artificial Sequence
  Description of Artificial Sequence: Synthetic peptide
  Seed: SVPQLPHSS (PMEL_HUMAN)
STPQLPHSI

SEQ ID NO: 138157 - protein, 9 aa, Artificial Sequence
  Description of Artificial Sequence: Synthetic peptide
  Seed: TIINGSQVW (PMEL_HUMAN)
TQINGSQVI

SEQ ID NO: 138158 - protein, 9 aa, Artificial Sequence
  Description of Artificial Sequence: Synthetic peptide
  Seed: LMAVVLASL (PMEL_HUMAN)
LVAVVLASL

SEQ ID NO: 138159 - protein, 9 aa, Artificial Sequence
  Description of Artificial Sequence: Synthetic peptide
  Seed: LNFPGSQKV (PMEL_HUMAN)
LTFPGSQKI

SEQ ID NO: 138160 - protein, 10 aa, Artificial Sequence
  Description of Artificial Sequence: Synthetic peptide
  Seed: TTEVISTAPV (PMEL_HUMAN)
TTEVISTAPI

SEQ ID NO: 138161 - protein, 9 aa, Artificial Sequence
  Description of Artificial Sequence: Synthetic peptide
  Seed: AEPSGTTSV (PMEL_HUMAN)
AAPSGTTSI

SEQ ID NO: 138162 - protein, 9 aa, Artificial Sequence
  Description of Artificial Sequence: Synthetic peptide
  Seed: GENSPLLSG (PMEL_HUMAN)
GENSPLLSC

SEQ ID NO: 138163 - protein, 9 aa, Artificial Sequence
  Description of Artificial Sequence: Synthetic peptide
  Seed: ALNFPGSQK (PMEL_HUMAN)
AANFPGSQH

SEQ ID NO: 138164 - protein, 9 aa, Artificial Sequence
  Description of Artificial Sequence: Synthetic peptide
  Seed: AVIGALLAV (PMEL_HUMAN)
AQIGALLAI

SEQ ID NO: 138165 - protein, 9 aa, Artificial Sequence
  Description of Artificial Sequence: Synthetic peptide
  Seed: FSIALNFPG (PMEL_HUMAN)
FSIALNFPF

SEQ ID NO: 138166 - protein, 9 aa, Artificial Sequence
  Description of Artificial Sequence: Synthetic peptide
  Seed: LMAVVLASL (PMEL_HUMAN)
LSAVVLASM

SEQ ID NO: 138167 - protein, 11 aa, Artificial Sequence
  Description of Artificial Sequence: Synthetic peptide
  Seed: AEAPNTTAGQV (PMEL_HUMAN)
AEAPNTTAGQF

SEQ ID NO: 138168 - protein, 9 aa, Artificial Sequence
  Description of Artificial Sequence: Synthetic peptide
  Seed: KRCLLHLAV (PMEL_HUMAN)
KRCLLHLAF

SEQ ID NO: 138169 - protein, 9 aa, Artificial Sequence
  Description of Artificial Sequence: Synthetic peptide
  Seed: VVLSGTTAA (PMEL_HUMAN)
VSLSGTTAM

SEQ ID NO: 138170 - protein, 9 aa, Artificial Sequence
  Description of Artificial Sequence: Synthetic peptide
  Seed: YLEPGPVTA (PMEL_HUMAN)
YHEPGPVTL

SEQ ID NO: 138171 - protein, 10 aa, Artificial Sequence
  Description of Artificial Sequence: Synthetic peptide
  Seed: SLAVVSTQLI (PMEL_HUMAN)
SMAVVSTQLI

SEQ ID NO: 138172 - protein, 10 aa, Artificial Sequence
  Description of Artificial Sequence: Synthetic peptide
  Seed: RQLRTKAWNR (PMEL_HUMAN)
RWLRTKAWNK

SEQ ID NO: 138173 - protein, 10 aa, Artificial Sequence
  Description of Artificial Sequence: Synthetic peptide
  Seed: EVMGTTLAEM (PMEL_HUMAN)
EAMGTTLAEW

SEQ ID NO: 138174 - protein, 10 aa, Artificial Sequence
  Description of Artificial Sequence: Synthetic peptide
  Seed: VLASLIYRRR (PMEL_HUMAN)
VVASLIYRRR

SEQ ID NO: 138175 - protein, 9 aa, Artificial Sequence
  Description of Artificial Sequence: Synthetic peptide
  Seed: HTMEVTVYH (PMEL_HUMAN)
HYMEVTVYK

SEQ ID NO: 138176 - protein, 9 aa, Artificial Sequence
  Description of Artificial Sequence: Synthetic peptide
  Seed: AEPSGTTSV (PMEL_HUMAN)
ACPSGTTSM

SEQ ID NO: 138177 - protein, 9 aa, Artificial Sequence
  Description of Artificial Sequence: Synthetic peptide
  Seed: RLMKQDFSV (PMEL_HUMAN)
RQMKQDFSF

SEQ ID NO: 138178 - protein, 9 aa, Artificial Sequence
  Description of Artificial Sequence: Synthetic peptide
  Seed: MLGTHTMEV (PMEL_HUMAN)
MVGTHTMEF

SEQ ID NO: 138179 - protein, 10 aa, Artificial Sequence
  Description of Artificial Sequence: Synthetic peptide
  Seed: YVPLAHSSSA (PMEL_HUMAN)
YNPLAHSSSF

SEQ ID NO: 138180 - protein, 9 aa, Artificial Sequence
  Description of Artificial Sequence: Synthetic peptide
  Seed: RQVPLDCVL (PMEL_HUMAN)
RVVPLDCVV

SEQ ID NO: 138181 - protein, 10 aa, Artificial Sequence
  Description of Artificial Sequence: Synthetic peptide
  Seed: VTAQVVLQAA (PMEL_HUMAN)
VAAQVVLQAV

SEQ ID NO: 138182 - protein, 10 aa, Artificial Sequence
  Description of Artificial Sequence: Synthetic peptide
  Seed: GPLLDGTATL (PMEL_HUMAN)
GDLLDGTATM

SEQ ID NO: 138183 - protein, 9 aa, Artificial Sequence
  Description of Artificial Sequence: Synthetic peptide
  Seed: YHRRGSRSY (PMEL_HUMAN)
YMRRGSRSW

SEQ ID NO: 138184 - protein, 9 aa, Artificial Sequence
  Description of Artificial Sequence: Synthetic peptide
  Seed: AQVVLQAAI (PMEL_HUMAN)
ALVVLQAAF

SEQ ID NO: 138185 - protein, 9 aa, Artificial Sequence
  Description of Artificial Sequence: Synthetic peptide
  Seed: AGQVPTTEV (PMEL_HUMAN)
ASQVPTTEI

SEQ ID NO: 138186 - protein, 10 aa, Artificial Sequence
  Description of Artificial Sequence: Synthetic peptide
  Seed: HTMEVTVYHR (PMEL_HUMAN)
HVMEVTVYHY

SEQ ID NO: 138187 - protein, 9 aa, Artificial Sequence
  Description of Artificial Sequence: Synthetic peptide
  Seed: FSVSVSQLR (PMEL_HUMAN)
FVVSVSQLY

SEQ ID NO: 138188 - protein, 9 aa, Artificial Sequence
  Description of Artificial Sequence: Synthetic peptide
  Seed: KAWNRQLYP (PMEL_HUMAN)
KSWNRQLYM

SEQ ID NO: 138189 - protein, 9 aa, Artificial Sequence
  Description of Artificial Sequence: Synthetic peptide
  Seed: AVGATKVPR (PMEL_HUMAN)
AFGATKVPR

SEQ ID NO: 138190 - protein, 9 aa, Artificial Sequence
  Description of Artificial Sequence: Synthetic peptide
  Seed: YLAEADLSY (PMEL_HUMAN)
YSAEADLSW

SEQ ID NO: 138191 - protein, 11 aa, Artificial Sequence
  Description of Artificial Sequence: Synthetic peptide
  Seed: GPTLIGANASF (PMEL_HUMAN)
GPTLIGANASL

SEQ ID NO: 138192 - protein, 9 aa, Artificial Sequence
  Description of Artificial Sequence: Synthetic peptide
  Seed: VWKTWGQYW (PMEL_HUMAN)
VTKTWGQYW

SEQ ID NO: 138193 - protein, 10 aa, Artificial Sequence
  Description of Artificial Sequence: Synthetic peptide
  Seed: THTMEVTVYH (PMEL_HUMAN)
TRTMEVTVYK

SEQ ID NO: 138194 - protein, 10 aa, Artificial Sequence
  Description of Artificial Sequence: Synthetic peptide
  Seed: SVPQLPHSSS (PMEL_HUMAN)
SLPQLPHSSV

SEQ ID NO: 138195 - protein, 9 aa, Artificial Sequence
  Description of Artificial Sequence: Synthetic peptide
  Seed: GSRSYVPLA (PMEL_HUMAN)
GWRSYVPLK

SEQ ID NO: 138196 - protein, 10 aa, Artificial Sequence
  Description of Artificial Sequence: Synthetic peptide
  Seed: FPDGGPCPSG (PMEL_HUMAN)
FPDGGPCPSL

SEQ ID NO: 138197 - protein, 10 aa, Artificial Sequence
  Description of Artificial Sequence: Synthetic peptide
  Seed: RRLMKQDFSV (PMEL_HUMAN)
RTLMKQDFSV

SEQ ID NO: 138198 - protein, 9 aa, Artificial Sequence
  Description of Artificial Sequence: Synthetic peptide
  Seed: AAQVTTTEW (PMEL_HUMAN)
ATQVTTTEW

SEQ ID NO: 138199 - protein, 9 aa, Artificial Sequence
  Description of Artificial Sequence: Synthetic peptide
  Seed: YHRRGSRSY (PMEL_HUMAN)
YERRGSRSY

SEQ ID NO: 138200 - protein, 8 aa, Artificial Sequence
  Description of Artificial Sequence: Synthetic peptide
  Seed: AEMSTPEA (PMEL_HUMAN)
ADMSTPEL

SEQ ID NO: 138201 - protein, 9 aa, Artificial Sequence
  Description of Artificial Sequence: Synthetic peptide
  Seed: KVSNDGPTL (PMEL_HUMAN)
KMSNDGPTI

SEQ ID NO: 138202 - protein, 10 aa, Artificial Sequence
  Description of Artificial Sequence: Synthetic peptide
  Seed: VLYRYGSFSV (PMEL_HUMAN)
VMYRYGSFSL

SEQ ID NO: 138203 - protein, 10 aa, Artificial Sequence
  Description of Artificial Sequence: Synthetic peptide
  Seed: SLIYRRRLMK (PMEL_HUMAN)
SPIYRRRLMK

SEQ ID NO: 138204 - protein, 10 aa, Artificial Sequence
  Description of Artificial Sequence: Synthetic peptide
  Seed: MAVVLASLIY (PMEL_HUMAN)
MQVVLASLIL

SEQ ID NO: 138205 - protein, 9 aa, Artificial Sequence
  Description of Artificial Sequence: Synthetic peptide
  Seed: KVSNDGPTL (PMEL_HUMAN)
KLSNDGPTL

SEQ ID NO: 138206 - protein, 9 aa, Artificial Sequence
  Description of Artificial Sequence: Synthetic peptide
  Seed: YLEPGPVTA (PMEL_HUMAN)
YVEPGPVTM

SEQ ID NO: 138207 - protein, 9 aa, Artificial Sequence
  Description of Artificial Sequence: Synthetic peptide
  Seed: MTPAEVSIV (PMEL_HUMAN)
MAPAEVSII

SEQ ID NO: 138208 - protein, 10 aa, Artificial Sequence
  Description of Artificial Sequence: Synthetic peptide
  Seed: GPLLDGTATL (PMEL_HUMAN)
GELLDGTATM

SEQ ID NO: 138209 - protein, 9 aa, Artificial Sequence
  Description of Artificial Sequence: Synthetic peptide
  Seed: VSLADTNSL (PMEL_HUMAN)
VQLADTNSF

SEQ ID NO: 138210 - protein, 9 aa, Artificial Sequence
  Description of Artificial Sequence: Synthetic peptide
  Seed: LNFPGSQKV (PMEL_HUMAN)
LAFPGSQKL

SEQ ID NO: 138211 - protein, 9 aa, Artificial Sequence
  Description of Artificial Sequence: Synthetic peptide
  Seed: LPDGQVIWV (PMEL_HUMAN)
LLDGQVIWF

SEQ ID NO: 138212 - protein, 9 aa, Artificial Sequence
  Description of Artificial Sequence: Synthetic peptide
  Seed: VSNDGPTLI (PMEL_HUMAN)
VWNDGPTLV

SEQ ID NO: 138213 - protein, 10 aa, Artificial Sequence
  Description of Artificial Sequence: Synthetic peptide
  Seed: FSVSVSQLRA (PMEL_HUMAN)
FIVSVSQLRK

SEQ ID NO: 138214 - protein, 9 aa, Artificial Sequence
  Description of Artificial Sequence: Synthetic peptide
  Seed: DQVPFSVSV (PMEL_HUMAN)
DHVPFSVSA

SEQ ID NO: 138215 - protein, 10 aa, Artificial Sequence
  Description of Artificial Sequence: Synthetic peptide
  Seed: RELPIPEPEG (PMEL_HUMAN)
RELPIPEPEF

SEQ ID NO: 138216 - protein, 10 aa, Artificial Sequence
  Description of Artificial Sequence: Synthetic peptide
  Seed: TLISRALVVT (PMEL_HUMAN)
TLISRALVVI

SEQ ID NO: 138217 - protein, 9 aa, Artificial Sequence
  Description of Artificial Sequence: Synthetic peptide
  Seed: EKVPVSEVM (PMEL_HUMAN)
EHVPVSEVV

SEQ ID NO: 138218 - protein, 10 aa, Artificial Sequence
  Description of Artificial Sequence: Synthetic peptide
  Seed: MTPAEVSIVV (PMEL_HUMAN)
MMPAEVSIVW

SEQ ID NO: 138219 - protein, 9 aa, Artificial Sequence
  Description of Artificial Sequence: Synthetic peptide
  Seed: VQMPTAEST (PMEL_HUMAN)
VSMPTAESV

SEQ ID NO: 138220 - protein, 9 aa, Artificial Sequence
  Description of Artificial Sequence: Synthetic peptide
  Seed: LIVGILLVL (PMEL_HUMAN)
LQVGILLVM

SEQ ID NO: 138221 - protein, 10 aa, Artificial Sequence
  Description of Artificial Sequence: Synthetic peptide
  Seed: SGTYCLNVSL (PMEL_HUMAN)
SVTYCLNVSY

SEQ ID NO: 138222 - protein, 9 aa, Artificial Sequence
  Description of Artificial Sequence: Synthetic peptide
  Seed: RYGSFSVTL (PMEL_HUMAN)
RYGSFSVTV

SEQ ID NO: 138223 - protein, 10 aa, Artificial Sequence
  Description of Artificial Sequence: Synthetic peptide
  Seed: EVISTAPVQM (PMEL_HUMAN)
EVISTAPVQK

SEQ ID NO: 138224 - protein, 10 aa, Artificial Sequence
  Description of Artificial Sequence: Synthetic peptide
  Seed: LGQVPLIVGI (PMEL_HUMAN)
LEQVPLIVGV

SEQ ID NO: 138225 - protein, 10 aa, Artificial Sequence
  Description of Artificial Sequence: Synthetic peptide
  Seed: LMAVVLASLI (PMEL_HUMAN)
LMAVVLASLH

SEQ ID NO: 138226 - protein, 9 aa, Artificial Sequence
  Description of Artificial Sequence: Synthetic peptide
  Seed: ASFSIALNF (PMEL_HUMAN)
AYFSIALNL

SEQ ID NO: 138227 - protein, 9 aa, Artificial Sequence
  Description of Artificial Sequence: Synthetic peptide
  Seed: TTDGHRPTA (PMEL_HUMAN)
TTDGHRPTI

SEQ ID NO: 138228 - protein, 9 aa, Artificial Sequence
  Description of Artificial Sequence: Synthetic peptide
  Seed: DQVPFSVSV (PMEL_HUMAN)
DTVPFSVSL

SEQ ID NO: 138229 - protein, 11 aa, Artificial Sequence
  Description of Artificial Sequence: Synthetic peptide
  Seed: FTITDQVPFSV (PMEL_HUMAN)
FMITDQVPFSM

SEQ ID NO: 138230 - protein, 10 aa, Artificial Sequence
  Description of Artificial Sequence: Synthetic peptide
  Seed: LRLVKRQVPL (PMEL_HUMAN)
LYLVKRQVPV

SEQ ID NO: 138231 - protein, 10 aa, Artificial Sequence
  Description of Artificial Sequence: Synthetic peptide
  Seed: YVPLAHSSSA (PMEL_HUMAN)
YLPLAHSSSM

SEQ ID NO: 138232 - protein, 9 aa, Artificial Sequence
  Description of Artificial Sequence: Synthetic peptide
  Seed: FTITDQVPF (PMEL_HUMAN)
FSITDQVPM

SEQ ID NO: 138233 - protein, 9 aa, Artificial Sequence
  Description of Artificial Sequence: Synthetic peptide
  Seed: CPIGENSPL (PMEL_HUMAN)
CSIGENSPY

SEQ ID NO: 138234 - protein, 9 aa, Artificial Sequence
  Description of Artificial Sequence: Synthetic peptide
  Seed: QLYPEWTEA (PMEL_HUMAN)
QQYPEWTEI

SEQ ID NO: 138235 - protein, 9 aa, Artificial Sequence
  Description of Artificial Sequence: Synthetic peptide
  Seed: LTSCGSSPV (PMEL_HUMAN)
LTSCGSSPM

SEQ ID NO: 138236 - protein, 9 aa, Artificial Sequence
  Description of Artificial Sequence: Synthetic peptide
  Seed: QVIWVNNTI (PMEL_HUMAN)
QQIWVNNTV

SEQ ID NO: 138237 - protein, 9 aa, Artificial Sequence
  Description of Artificial Sequence: Synthetic peptide
  Seed: VLQAAIPLT (PMEL_HUMAN)
VTQAAIPLV

SEQ ID NO: 138238 - protein, 9 aa, Artificial Sequence
  Description of Artificial Sequence: Synthetic peptide
  Seed: CPIGENSPL (PMEL_HUMAN)
CIIGENSPY

SEQ ID NO: 138239 - protein, 10 aa, Artificial Sequence
  Description of Artificial Sequence: Synthetic peptide
  Seed: YGSFSVTLDI (PMEL_HUMAN)
YDSFSVTLDY

SEQ ID NO: 138240 - protein, 9 aa, Artificial Sequence
  Description of Artificial Sequence: Synthetic peptide
  Seed: HTMEVTVYH (PMEL_HUMAN)
HLMEVTVYI

SEQ ID NO: 138241 - protein, 9 aa, Artificial Sequence
  Description of Artificial Sequence: Synthetic peptide
  Seed: LPDGQVIWV (PMEL_HUMAN)
LMDGQVIWM

SEQ ID NO: 138242 - protein, 9 aa, Artificial Sequence
  Description of Artificial Sequence: Synthetic peptide
  Seed: SLAVVSTQL (PMEL_HUMAN)
SIAVVSTQV

SEQ ID NO: 138243 - protein, 10 aa, Artificial Sequence
  Description of Artificial Sequence: Synthetic peptide
  Seed: YRYGSFSVTL (PMEL_HUMAN)
YKYGSFSVTF

SEQ ID NO: 138244 - protein, 9 aa, Artificial Sequence
  Description of Artificial Sequence: Synthetic peptide
  Seed: MTPAEVSIV (PMEL_HUMAN)
MAPAEVSIV

SEQ ID NO: 138245 - protein, 9 aa, Artificial Sequence
  Description of Artificial Sequence: Synthetic peptide
  Seed: SLADTNSLA (PMEL_HUMAN)
STADTNSLA

SEQ ID NO: 138246 - protein, 10 aa, Artificial Sequence
  Description of Artificial Sequence: Synthetic peptide
  Seed: ESAEILQAVP (PMEL_HUMAN)
ETAEILQAVF

SEQ ID NO: 138247 - protein, 10 aa, Artificial Sequence
  Description of Artificial Sequence: Synthetic peptide
  Seed: FSVSVSQLRA (PMEL_HUMAN)
FTVSVSQLRS

SEQ ID NO: 138248 - protein, 9 aa, Artificial Sequence
  Description of Artificial Sequence: Synthetic peptide
  Seed: DQVPFSVSV (PMEL_HUMAN)
DQVPFSVSF

SEQ ID NO: 138249 - protein, 9 aa, Artificial Sequence
  Description of Artificial Sequence: Synthetic peptide
  Seed: MSTPEATGM (PMEL_HUMAN)
MQTPEATGL

SEQ ID NO: 138250 - protein, 10 aa, Artificial Sequence
  Description of Artificial Sequence: Synthetic peptide
  Seed: AVVLASLIYR (PMEL_HUMAN)
ANVLASLIYK

SEQ ID NO: 138251 - protein, 10 aa, Artificial Sequence
  Description of Artificial Sequence: Synthetic peptide
  Seed: LHLAVIGALL (PMEL_HUMAN)
LRLAVIGALV

SEQ ID NO: 138252 - protein, 10 aa, Artificial Sequence
  Description of Artificial Sequence: Synthetic peptide
  Seed: SLIYRRRLMK (PMEL_HUMAN)
SGIYRRRLMR

SEQ ID NO: 138253 - protein, 9 aa, Artificial Sequence
  Description of Artificial Sequence: Synthetic peptide
  Seed: CPIGENSPL (PMEL_HUMAN)
CPIGENSPH

SEQ ID NO: 138254 - protein, 9 aa, Artificial Sequence
  Description of Artificial Sequence: Synthetic peptide
  Seed: YRYGSFSVT (PMEL_HUMAN)
YHYGSFSVV

SEQ ID NO: 138255 - protein, 9 aa, Artificial Sequence
  Description of Artificial Sequence: Synthetic peptide
  Seed: SGEGDAFEL (PMEL_HUMAN)
SYEGDAFEL

SEQ ID NO: 138256 - protein, 9 aa, Artificial Sequence
  Description of Artificial Sequence: Synthetic peptide
  Seed: VSNDGPTLI (PMEL_HUMAN)
VINDGPTLV

SEQ ID NO: 138257 - protein, 9 aa, Artificial Sequence
  Description of Artificial Sequence: Synthetic peptide
  Seed: AEADLSYTW (PMEL_HUMAN)
AMADLSYTF

SEQ ID NO: 138258 - protein, 9 aa, Artificial Sequence
  Description of Artificial Sequence: Synthetic peptide
  Seed: FGDSSGTLI (PMEL_HUMAN)
FADSSGTLV

SEQ ID NO: 138259 - protein, 9 aa, Artificial Sequence
  Description of Artificial Sequence: Synthetic peptide
  Seed: ASFSIALNF (PMEL_HUMAN)
AWFSIALNY

SEQ ID NO: 138260 - protein, 9 aa, Artificial Sequence
  Description of Artificial Sequence: Synthetic peptide
  Seed: RTKAWNRQL (PMEL_HUMAN)
RTKAWNRQK

SEQ ID NO: 138261 - protein, 9 aa, Artificial Sequence
  Description of Artificial Sequence: Synthetic peptide
  Seed: VSCQGGLPK (PMEL_HUMAN)
VACQGGLPR

SEQ ID NO: 138262 - protein, 8 aa, Artificial Sequence
  Description of Artificial Sequence: Synthetic peptide
  Seed: AEVSIVVL (PMEL_HUMAN)
AEVSIVVA

SEQ ID NO: 138263 - protein, 9 aa, Artificial Sequence
  Description of Artificial Sequence: Synthetic peptide
  Seed: VSEVMGTTL (PMEL_HUMAN)
VWEVMGTTL

SEQ ID NO: 138264 - protein, 9 aa, Artificial Sequence
  Description of Artificial Sequence: Synthetic peptide
  Seed: ITDQVPFSV (PMEL_HUMAN)
IQDQVPFSL

SEQ ID NO: 138265 - protein, 9 aa, Artificial Sequence
  Description of Artificial Sequence: Synthetic peptide
  Seed: KQDFSVPQL (PMEL_HUMAN)
KLDFSVPQA

SEQ ID NO: 138266 - protein, 9 aa, Artificial Sequence
  Description of Artificial Sequence: Synthetic peptide
  Seed: STAPVQMPT (PMEL_HUMAN)
SMAPVQMPI

SEQ ID NO: 138267 - protein, 10 aa, Artificial Sequence
  Description of Artificial Sequence: Synthetic peptide
  Seed: VPQLPHSSSH (PMEL_HUMAN)
VRQLPHSSSL

SEQ ID NO: 138268 - protein, 9 aa, Artificial Sequence
  Description of Artificial Sequence: Synthetic peptide
  Seed: YHRRGSRSY (PMEL_HUMAN)
YARRGSRSY

SEQ ID NO: 138269 - protein, 10 aa, Artificial Sequence
  Description of Artificial Sequence: Synthetic peptide
  Seed: MAVVLASLIY (PMEL_HUMAN)
MVVVLASLIR

SEQ ID NO: 138270 - protein, 11 aa, Artificial Sequence
  Description of Artificial Sequence: Synthetic peptide
  Seed: FSVTLDIVQGI (PMEL_HUMAN)
FGVTLDIVQGV

SEQ ID NO: 138271 - protein, 9 aa, Artificial Sequence
  Description of Artificial Sequence: Synthetic peptide
  Seed: FLRNQPLTF (PMEL_HUMAN)
FNRNQPLTY

SEQ ID NO: 138272 - protein, 9 aa, Artificial Sequence
  Description of Artificial Sequence: Synthetic peptide
  Seed: RLVKRQVPL (PMEL_HUMAN)
RAVKRQVPF

SEQ ID NO: 138273 - protein, 10 aa, Artificial Sequence
  Description of Artificial Sequence: Synthetic peptide
  Seed: VVLASLIYRR (PMEL_HUMAN)
VWLASLIYRR

SEQ ID NO: 138274 - protein, 9 aa, Artificial Sequence
  Description of Artificial Sequence: Synthetic peptide
  Seed: LIYRRRLMK (PMEL_HUMAN)
LTYRRRLMK

SEQ ID NO: 138275 - protein, 10 aa, Artificial Sequence
  Description of Artificial Sequence: Synthetic peptide
  Seed: RALVVTHTYL (PMEL_HUMAN)
RALVVTHTYY

SEQ ID NO: 138276 - protein, 10 aa, Artificial Sequence
  Description of Artificial Sequence: Synthetic peptide
  Seed: SRALVVTHTY (PMEL_HUMAN)
SPALVVTHTW

SEQ ID NO: 138277 - protein, 11 aa, Artificial Sequence
  Description of Artificial Sequence: Synthetic peptide
  Seed: TWDFGDSSGTL (PMEL_HUMAN)
TSDFGDSSGTF

SEQ ID NO: 138278 - protein, 10 aa, Artificial Sequence
  Description of Artificial Sequence: Synthetic peptide
  Seed: NSLAVVSTQL (PMEL_HUMAN)
NNLAVVSTQV

SEQ ID NO: 138279 - protein, 10 aa, Artificial Sequence
  Description of Artificial Sequence: Synthetic peptide
  Seed: KTWGQYWQVL (PMEL_HUMAN)
KMWGQYWQVP

SEQ ID NO: 138280 - protein, 11 aa, Artificial Sequence
  Description of Artificial Sequence: Synthetic peptide
  Seed: LYPEWTEAQRL (PMEL_HUMAN)
LYPEWTEAQRW

SEQ ID NO: 138281 - protein, 10 aa, Artificial Sequence
  Description of Artificial Sequence: Synthetic peptide
  Seed: VVLASLIYRR (PMEL_HUMAN)
VMLASLIYRH

SEQ ID NO: 138282 - protein, 9 aa, Artificial Sequence
  Description of Artificial Sequence: Synthetic peptide
  Seed: ALLAVGATK (PMEL_HUMAN)
ASLAVGATL

SEQ ID NO: 138283 - protein, 9 aa, Artificial Sequence
  Description of Artificial Sequence: Synthetic peptide
  Seed: RGSRSYVPL (PMEL_HUMAN)
RTSRSYVPS

SEQ ID NO: 138284 - protein, 9 aa, Artificial Sequence
  Description of Artificial Sequence: Synthetic peptide
  Seed: VSCQGGLPK (PMEL_HUMAN)
VSCQGGLPR

SEQ ID NO: 138285 - protein, 9 aa, Artificial Sequence
  Description of Artificial Sequence: Synthetic peptide
  Seed: FLRNQPLTF (PMEL_HUMAN)
FKRNQPLTY

SEQ ID NO: 138286 - protein, 9 aa, Artificial Sequence
  Description of Artificial Sequence: Synthetic peptide
  Seed: ESTGMTPEK (PMEL_HUMAN)
EMTGMTPER

SEQ ID NO: 138287 - protein, 10 aa, Artificial Sequence
  Description of Artificial Sequence: Synthetic peptide
  Seed: LVLMAVVLAS (PMEL_HUMAN)
LNLMAVVLAL

SEQ ID NO: 138288 - protein, 10 aa, Artificial Sequence
  Description of Artificial Sequence: Synthetic peptide
  Seed: LAVIGALLAV (PMEL_HUMAN)
LQVIGALLAV

SEQ ID NO: 138289 - protein, 9 aa, Artificial Sequence
  Description of Artificial Sequence: Synthetic peptide
  Seed: VLQAAIPLT (PMEL_HUMAN)
VMQAAIPLI

SEQ ID NO: 138290 - protein, 9 aa, Artificial Sequence
  Description of Artificial Sequence: Synthetic peptide
  Seed: ANASFSIAL (PMEL_HUMAN)
AYASFSIAF

SEQ ID NO: 138291 - protein, 11 aa, Artificial Sequence
  Description of Artificial Sequence: Synthetic peptide
  Seed: KHFLRNQPLTF (PMEL_HUMAN)
KQFLRNQPLTM

SEQ ID NO: 138292 - protein, 10 aa, Artificial Sequence
  Description of Artificial Sequence: Synthetic peptide
  Seed: VLMAVVLASL (PMEL_HUMAN)
VDMAVVLASV

SEQ ID NO: 138293 - protein, 9 aa, Artificial Sequence
  Description of Artificial Sequence: Synthetic peptide
  Seed: TTAGQVPTT (PMEL_HUMAN)
TTAGQVPTV

SEQ ID NO: 138294 - protein, 10 aa, Artificial Sequence
  Description of Artificial Sequence: Synthetic peptide
  Seed: MSTESITGSL (PMEL_HUMAN)
MGTESITGSW

SEQ ID NO: 138295 - protein, 11 aa, Artificial Sequence
  Description of Artificial Sequence: Synthetic peptide
  Seed: ISRALVVTHTY (PMEL_HUMAN)
ISRALVVTHTW

SEQ ID NO: 138296 - protein, 9 aa, Artificial Sequence
  Description of Artificial Sequence: Synthetic peptide
  Seed: LADTNSLAV (PMEL_HUMAN)
LMDTNSLAL

SEQ ID NO: 138297 - protein, 9 aa, Artificial Sequence
  Description of Artificial Sequence: Synthetic peptide
  Seed: APVQMPTAE (PMEL_HUMAN)
APVQMPTAT

SEQ ID NO: 138298 - protein, 9 aa, Artificial Sequence
  Description of Artificial Sequence: Synthetic peptide
  Seed: SLADTNSLA (PMEL_HUMAN)
SVADTNSLI

SEQ ID NO: 138299 - protein, 9 aa, Artificial Sequence
  Description of Artificial Sequence: Synthetic peptide
  Seed: ITDQVPFSV (PMEL_HUMAN)
IQDQVPFSW

SEQ ID NO: 138300 - protein, 8 aa, Artificial Sequence
  Description of Artificial Sequence: Synthetic peptide
  Seed: LVKRQVPL (PMEL_HUMAN)
LLKRQVPL

SEQ ID NO: 138301 - protein, 9 aa, Artificial Sequence
  Description of Artificial Sequence: Synthetic peptide
  Seed: ASFSIALNF (PMEL_HUMAN)
ASFSIALNM

SEQ ID NO: 138302 - protein, 10 aa, Artificial Sequence
  Description of Artificial Sequence: Synthetic peptide
  Seed: AVIGALLAVG (PMEL_HUMAN)
AVIGALLAVP

SEQ ID NO: 138303 - protein, 9 aa, Artificial Sequence
  Description of Artificial Sequence: Synthetic peptide
  Seed: ITDQVPFSV (PMEL_HUMAN)
IMDQVPFSA

SEQ ID NO: 138304 - protein, 11 aa, Artificial Sequence
  Description of Artificial Sequence: Synthetic peptide
  Seed: FTITDQVPFSV (PMEL_HUMAN)
FQITDQVPFSV

SEQ ID NO: 138305 - protein, 9 aa, Artificial Sequence
  Description of Artificial Sequence: Synthetic peptide
  Seed: APVQMPTAE (PMEL_HUMAN)
APVQMPTAS

SEQ ID NO: 138306 - protein, 10 aa, Artificial Sequence
  Description of Artificial Sequence: Synthetic peptide
  Seed: RALDGGNKHF (PMEL_HUMAN)
RILDGGNKHY

SEQ ID NO: 138307 - protein, 10 aa, Artificial Sequence
  Description of Artificial Sequence: Synthetic peptide
  Seed: LMAVVLASLI (PMEL_HUMAN)
LMAVVLASLV

SEQ ID NO: 138308 - protein, 9 aa, Artificial Sequence
  Description of Artificial Sequence: Synthetic peptide
  Seed: AEADLSYTW (PMEL_HUMAN)
AIADLSYTV

SEQ ID NO: 138309 - protein, 10 aa, Artificial Sequence
  Description of Artificial Sequence: Synthetic peptide
  Seed: KVLPDGQVIW (PMEL_HUMAN)
KMLPDGQVII

SEQ ID NO: 138310 - protein, 11 aa, Artificial Sequence
  Description of Artificial Sequence: Synthetic peptide
  Seed: RALDGGNKHFL (PMEL_HUMAN)
RMLDGGNKHFF

SEQ ID NO: 138311 - protein, 10 aa, Artificial Sequence
  Description of Artificial Sequence: Synthetic peptide
  Seed: MEISSPGCQP (PMEL_HUMAN)
MEISSPGCQI

SEQ ID NO: 138312 - protein, 10 aa, Artificial Sequence
  Description of Artificial Sequence: Synthetic peptide
  Seed: RQVPLDCVLY (PMEL_HUMAN)
RLVPLDCVLY

SEQ ID NO: 138313 - protein, 10 aa, Artificial Sequence
  Description of Artificial Sequence: Synthetic peptide
  Seed: YGSFSVTLDI (PMEL_HUMAN)
YWSFSVTLDF

SEQ ID NO: 138314 - protein, 10 aa, Artificial Sequence
  Description of Artificial Sequence: Synthetic peptide
  Seed: YVWKTWGQYW (PMEL_HUMAN)
YYWKTWGQYW

SEQ ID NO: 138315 - protein, 9 aa, Artificial Sequence
  Description of Artificial Sequence: Synthetic peptide
  Seed: LADTNSLAV (PMEL_HUMAN)
LIDTNSLAF

SEQ ID NO: 138316 - protein, 11 aa, Artificial Sequence
  Description of Artificial Sequence: Synthetic peptide
  Seed: HTMEVTVYHRR (PMEL_HUMAN)
HTMEVTVYHRH

SEQ ID NO: 138317 - protein, 9 aa, Artificial Sequence
  Description of Artificial Sequence: Synthetic peptide
  Seed: FTITDQVPF (PMEL_HUMAN)
FVITDQVPA

SEQ ID NO: 138318 - protein, 10 aa, Artificial Sequence
  Description of Artificial Sequence: Synthetic peptide
  Seed: QVLGGPVSGL (PMEL_HUMAN)
QALGGPVSGY

SEQ ID NO: 138319 - protein, 9 aa, Artificial Sequence
  Description of Artificial Sequence: Synthetic peptide
  Seed: KAWNRQLYP (PMEL_HUMAN)
KVWNRQLYS

SEQ ID NO: 138320 - protein, 10 aa, Artificial Sequence
  Description of Artificial Sequence: Synthetic peptide
  Seed: RQLYPEWTEA (PMEL_HUMAN)
RMLYPEWTEI

SEQ ID NO: 138321 - protein, 9 aa, Artificial Sequence
  Description of Artificial Sequence: Synthetic peptide
  Seed: ALDGGNKHF (PMEL_HUMAN)
AWDGGNKHM

SEQ ID NO: 138322 - protein, 9 aa, Artificial Sequence
  Description of Artificial Sequence: Synthetic peptide
  Seed: LIYRRRLMK (PMEL_HUMAN)
LVYRRRLMR

SEQ ID NO: 138323 - protein, 8 aa, Artificial Sequence
  Description of Artificial Sequence: Synthetic peptide
  Seed: SEVMGTTL (PMEL_HUMAN)
SRVMGTTL

SEQ ID NO: 138324 - protein, 10 aa, Artificial Sequence
  Description of Artificial Sequence: Synthetic peptide
  Seed: YRYGSFSVTL (PMEL_HUMAN)
YYYGSFSVTW

SEQ ID NO: 138325 - protein, 8 aa, Artificial Sequence
  Description of Artificial Sequence: Synthetic peptide
  Seed: SFSIALNF (PMEL_HUMAN)
SYSIALNF

SEQ ID NO: 138326 - protein, 10 aa, Artificial Sequence
  Description of Artificial Sequence: Synthetic peptide
  Seed: EVISTAPVQM (PMEL_HUMAN)
ETISTAPVQY

SEQ ID NO: 138327 - protein, 11 aa, Artificial Sequence
  Description of Artificial Sequence: Synthetic peptide
  Seed: LVLMAVVLASL (PMEL_HUMAN)
LILMAVVLASV

SEQ ID NO: 138328 - protein, 9 aa, Artificial Sequence
  Description of Artificial Sequence: Synthetic peptide
  Seed: VSCQGGLPK (PMEL_HUMAN)
VACQGGLPI

SEQ ID NO: 138329 - protein, 9 aa, Artificial Sequence
  Description of Artificial Sequence: Synthetic peptide
  Seed: RGSRSYVPL (PMEL_HUMAN)
RASRSYVPV

SEQ ID NO: 138330 - protein, 9 aa, Artificial Sequence
  Description of Artificial Sequence: Synthetic peptide
  Seed: VMGTTLAEM (PMEL_HUMAN)
VTGTTLAEL

SEQ ID NO: 138331 - protein, 9 aa, Artificial Sequence
  Description of Artificial Sequence: Synthetic peptide
  Seed: RTKAWNRQL (PMEL_HUMAN)
RIKAWNRQK

SEQ ID NO: 138332 - protein, 9 aa, Artificial Sequence
  Description of Artificial Sequence: Synthetic peptide
  Seed: ALDGGNKHF (PMEL_HUMAN)
ALDGGNKHM

SEQ ID NO: 138333 - protein, 9 aa, Artificial Sequence
  Description of Artificial Sequence: Synthetic peptide
  Seed: MSTPEATGM (PMEL_HUMAN)
MQTPEATGM

SEQ ID NO: 138334 - protein, 11 aa, Artificial Sequence
  Description of Artificial Sequence: Synthetic peptide
  Seed: GYLAEADLSYT (PMEL_HUMAN)
GKLAEADLSYL

SEQ ID NO: 138335 - protein, 9 aa, Artificial Sequence
  Description of Artificial Sequence: Synthetic peptide
  Seed: RALVVTHTY (PMEL_HUMAN)
RVLVVTHTW

SEQ ID NO: 138336 - protein, 9 aa, Artificial Sequence
  Description of Artificial Sequence: Synthetic peptide
  Seed: VLQAAIPLT (PMEL_HUMAN)
VIQAAIPLV

SEQ ID NO: 138337 - protein, 8 aa, Artificial Sequence
  Description of Artificial Sequence: Synthetic peptide
  Seed: LHDPSGYL (PMEL_HUMAN)
LTDPSGYL

SEQ ID NO: 138338 - protein, 9 aa, Artificial Sequence
  Description of Artificial Sequence: Synthetic peptide
  Seed: VSNDGPTLI (PMEL_HUMAN)
VVNDGPTLM

SEQ ID NO: 138339 - protein, 11 aa, Artificial Sequence
  Description of Artificial Sequence: Synthetic peptide
  Seed: RALDGGNKHFL (PMEL_HUMAN)
RTLDGGNKHFM

SEQ ID NO: 138340 - protein, 9 aa, Artificial Sequence
  Description of Artificial Sequence: Synthetic peptide
  Seed: RALVVTHTY (PMEL_HUMAN)
RLLVVTHTK

SEQ ID NO: 138341 - protein, 8 aa, Artificial Sequence
  Description of Artificial Sequence: Synthetic peptide
  Seed: LLDGTATL (PMEL_HUMAN)
LFDGTATF

SEQ ID NO: 138342 - protein, 11 aa, Artificial Sequence
  Description of Artificial Sequence: Synthetic peptide
  Seed: YLEPGPVTAQV (PMEL_HUMAN)
YLEPGPVTAQI

SEQ ID NO: 138343 - protein, 9 aa, Artificial Sequence
  Description of Artificial Sequence: Synthetic peptide
  Seed: AEPSGTTSV (PMEL_HUMAN)
ATPSGTTSF

SEQ ID NO: 138344 - protein, 9 aa, Artificial Sequence
  Description of Artificial Sequence: Synthetic peptide
  Seed: FLRNQPLTF (PMEL_HUMAN)
FERNQPLTM

SEQ ID NO: 138345 - protein, 11 aa, Artificial Sequence
  Description of Artificial Sequence: Synthetic peptide
  Seed: KHFLRNQPLTF (PMEL_HUMAN)
KWFLRNQPLTW

SEQ ID NO: 138346 - protein, 9 aa, Artificial Sequence
  Description of Artificial Sequence: Synthetic peptide
  Seed: AVVSTQLIM (PMEL_HUMAN)
AAVSTQLIV

SEQ ID NO: 138347 - protein, 10 aa, Artificial Sequence
  Description of Artificial Sequence: Synthetic peptide
  Seed: VLMAVVLASL (PMEL_HUMAN)
VIMAVVLASY

SEQ ID NO: 138348 - protein, 9 aa, Artificial Sequence
  Description of Artificial Sequence: Synthetic peptide
  Seed: LADTNSLAV (PMEL_HUMAN)
LSDTNSLAL

SEQ ID NO: 138349 - protein, 9 aa, Artificial Sequence
  Description of Artificial Sequence: Synthetic peptide
  Seed: MAVVLASLI (PMEL_HUMAN)
MTVVLASLT

SEQ ID NO: 138350 - protein, 10 aa, Artificial Sequence
  Description of Artificial Sequence: Synthetic peptide
  Seed: RGSRSYVPLA (PMEL_HUMAN)
RYSRSYVPLT

SEQ ID NO: 138351 - protein, 11 aa, Artificial Sequence
  Description of Artificial Sequence: Synthetic peptide
  Seed: GIESAEILQAV (PMEL_HUMAN)
GMESAEILQAL

SEQ ID NO: 138352 - protein, 10 aa, Artificial Sequence
  Description of Artificial Sequence: Synthetic peptide
  Seed: VLYRYGSFSV (PMEL_HUMAN)
VMYRYGSFSM

SEQ ID NO: 138353 - protein, 9 aa, Artificial Sequence
  Description of Artificial Sequence: Synthetic peptide
  Seed: RLVKRQVPL (PMEL_HUMAN)
RAVKRQVPL

SEQ ID NO: 138354 - protein, 9 aa, Artificial Sequence
  Description of Artificial Sequence: Synthetic peptide
  Seed: VLMAVVLAS (PMEL_HUMAN)
VIMAVVLAA

SEQ ID NO: 138355 - protein, 9 aa, Artificial Sequence
  Description of Artificial Sequence: Synthetic peptide
  Seed: RALVVTHTY (PMEL_HUMAN)
RNLVVTHTR

SEQ ID NO: 138356 - protein, 9 aa, Artificial Sequence
  Description of Artificial Sequence: Synthetic peptide
  Seed: YLAEADLSY (PMEL_HUMAN)
YHAEADLSF

SEQ ID NO: 138357 - protein, 9 aa, Artificial Sequence
  Description of Artificial Sequence: Synthetic peptide
  Seed: SLADTNSLA (PMEL_HUMAN)
SLADTNSLI

SEQ ID NO: 138358 - protein, 11 aa, Artificial Sequence
  Description of Artificial Sequence: Synthetic peptide
  Seed: FSVSVSQLRAL (PMEL_HUMAN)
FAVSVSQLRAM

SEQ ID NO: 138359 - protein, 9 aa, Artificial Sequence
  Description of Artificial Sequence: Synthetic peptide
  Seed: LSIGTGRAM (PMEL_HUMAN)
LIIGTGRAM

SEQ ID NO: 138360 - protein, 10 aa, Artificial Sequence
  Description of Artificial Sequence: Synthetic peptide
  Seed: YVPLAHSSSA (PMEL_HUMAN)
YMPLAHSSSI

SEQ ID NO: 138361 - protein, 8 aa, Artificial Sequence
  Description of Artificial Sequence: Synthetic peptide
  Seed: SNDGPTLI (PMEL_HUMAN)
SGDGPTLL

SEQ ID NO: 138362 - protein, 11 aa, Artificial Sequence
  Description of Artificial Sequence: Synthetic peptide
  Seed: MAVVLASLIYR (PMEL_HUMAN)
MWVVLASLIYK

SEQ ID NO: 138363 - protein, 10 aa, Artificial Sequence
  Description of Artificial Sequence: Synthetic peptide
  Seed: SQVWGGQPVY (PMEL_HUMAN)
SKVWGGQPVY

SEQ ID NO: 138364 - protein, 10 aa, Artificial Sequence
  Description of Artificial Sequence: Synthetic peptide
  Seed: LQLHDPSGYL (PMEL_HUMAN)
LSLHDPSGYY

SEQ ID NO: 138365 - protein, 9 aa, Artificial Sequence
  Description of Artificial Sequence: Synthetic peptide
  Seed: YRYGSFSVT (PMEL_HUMAN)
YRYGSFSVM

SEQ ID NO: 138366 - protein, 9 aa, Artificial Sequence
  Description of Artificial Sequence: Synthetic peptide
  Seed: AEPSGTTSV (PMEL_HUMAN)
AWPSGTTSL

SEQ ID NO: 138367 - protein, 9 aa, Artificial Sequence
  Description of Artificial Sequence: Synthetic peptide
  Seed: SEVMGTTLA (PMEL_HUMAN)
SEVMGTTLP

SEQ ID NO: 138368 - protein, 9 aa, Artificial Sequence
  Description of Artificial Sequence: Synthetic peptide
  Seed: ASFSIALNF (PMEL_HUMAN)
AQFSIALNF

SEQ ID NO: 138369 - protein, 9 aa, Artificial Sequence
  Description of Artificial Sequence: Synthetic peptide
  Seed: EKVPVSEVM (PMEL_HUMAN)
EVVPVSEVY

SEQ ID NO: 138370 - protein, 10 aa, Artificial Sequence
  Description of Artificial Sequence: Synthetic peptide
  Seed: MKQDFSVPQL (PMEL_HUMAN)
MQQDFSVPQM

SEQ ID NO: 138371 - protein, 9 aa, Artificial Sequence
  Description of Artificial Sequence: Synthetic peptide
  Seed: RTKAWNRQL (PMEL_HUMAN)
RVKAWNRQV

SEQ ID NO: 138372 - protein, 10 aa, Artificial Sequence
  Description of Artificial Sequence: Synthetic peptide
  Seed: RRLMKQDFSV (PMEL_HUMAN)
RPLMKQDFSV

SEQ ID NO: 138373 - protein, 9 aa, Artificial Sequence
  Description of Artificial Sequence: Synthetic peptide
  Seed: ESAEILQAV (PMEL_HUMAN)
EVAEILQAY

SEQ ID NO: 138374 - protein, 10 aa, Artificial Sequence
  Description of Artificial Sequence: Synthetic peptide
  Seed: LKVSNDGPTL (PMEL_HUMAN)
LQVSNDGPTY

SEQ ID NO: 138375 - protein, 11 aa, Artificial Sequence
  Description of Artificial Sequence: Synthetic peptide
  Seed: SQVWGGQPVYP (PMEL_HUMAN)
SQVWGGQPVYY

SEQ ID NO: 138376 - protein, 10 aa, Artificial Sequence
  Description of Artificial Sequence: Synthetic peptide
  Seed: YLAEADLSYT (PMEL_HUMAN)
YQAEADLSYM

SEQ ID NO: 138377 - protein, 9 aa, Artificial Sequence
  Description of Artificial Sequence: Synthetic peptide
  Seed: MEVTVYHRR (PMEL_HUMAN)
MLVTVYHRK

SEQ ID NO: 138378 - protein, 10 aa, Artificial Sequence
  Description of Artificial Sequence: Synthetic peptide
  Seed: FPDGGPCPSG (PMEL_HUMAN)
FPDGGPCPSA

SEQ ID NO: 138379 - protein, 10 aa, Artificial Sequence
  Description of Artificial Sequence: Synthetic peptide
  Seed: GPLLDGTATL (PMEL_HUMAN)
GKLLDGTATM

SEQ ID NO: 138380 - protein, 9 aa, Artificial Sequence
  Description of Artificial Sequence: Synthetic peptide
  Seed: LQAAIPLTS (PMEL_HUMAN)
LTAAIPLTF

SEQ ID NO: 138381 - protein, 11 aa, Artificial Sequence
  Description of Artificial Sequence: Synthetic peptide
  Seed: KVLPDGQVIWV (PMEL_HUMAN)
KLLPDGQVIWW

SEQ ID NO: 138382 - protein, 8 aa, Artificial Sequence
  Description of Artificial Sequence: Synthetic peptide
  Seed: AQVTTTEW (PMEL_HUMAN)
AQVTTTEY

SEQ ID NO: 138383 - protein, 10 aa, Artificial Sequence
  Description of Artificial Sequence: Synthetic peptide
  Seed: RELPIPEPEG (PMEL_HUMAN)
RELPIPEPEA

SEQ ID NO: 138384 - protein, 9 aa, Artificial Sequence
  Description of Artificial Sequence: Synthetic peptide
  Seed: STAPVQMPT (PMEL_HUMAN)
SMAPVQMPT

SEQ ID NO: 138385 - protein, 9 aa, Artificial Sequence
  Description of Artificial Sequence: Synthetic peptide
  Seed: RAMLGTHTM (PMEL_HUMAN)
RYMLGTHTF

SEQ ID NO: 138386 - protein, 9 aa, Artificial Sequence
  Description of Artificial Sequence: Synthetic peptide
  Seed: AGLGQVPLI (PMEL_HUMAN)
AQLGQVPLM

SEQ ID NO: 138387 - protein, 9 aa, Artificial Sequence
  Description of Artificial Sequence: Synthetic peptide
  Seed: LSGTTAAQV (PMEL_HUMAN)
LAGTTAAQW

SEQ ID NO: 138388 - protein, 10 aa, Artificial Sequence
  Description of Artificial Sequence: Synthetic peptide
  Seed: IESAEILQAV (PMEL_HUMAN)
IISAEILQAL

SEQ ID NO: 138389 - protein, 10 aa, Artificial Sequence
  Description of Artificial Sequence: Synthetic peptide
  Seed: AVIGALLAVG (PMEL_HUMAN)
ALIGALLAVL

SEQ ID NO: 138390 - protein, 9 aa, Artificial Sequence
  Description of Artificial Sequence: Synthetic peptide
  Seed: YLAEADLSY (PMEL_HUMAN)
YLAEADLSR

SEQ ID NO: 138391 - protein, 10 aa, Artificial Sequence
  Description of Artificial Sequence: Synthetic peptide
  Seed: EVMGTTLAEM (PMEL_HUMAN)
ESMGTTLAEY

SEQ ID NO: 138392 - protein, 9 aa, Artificial Sequence
  Description of Artificial Sequence: Synthetic peptide
  Seed: RQVPLDCVL (PMEL_HUMAN)
RRVPLDCVY

SEQ ID NO: 138393 - protein, 9 aa, Artificial Sequence
  Description of Artificial Sequence: Synthetic peptide
  Seed: VSVSQLRAL (PMEL_HUMAN)
VQVSQLRAV

SEQ ID NO: 138394 - protein, 9 aa, Artificial Sequence
  Description of Artificial Sequence: Synthetic peptide
  Seed: KAWNRQLYP (PMEL_HUMAN)
KTWNRQLYV

SEQ ID NO: 138395 - protein, 10 aa, Artificial Sequence
  Description of Artificial Sequence: Synthetic peptide
  Seed: RGSRSYVPLA (PMEL_HUMAN)
RRSRSYVPLS

SEQ ID NO: 138396 - protein, 9 aa, Artificial Sequence
  Description of Artificial Sequence: Synthetic peptide
  Seed: AGLGQVPLI (PMEL_HUMAN)
AALGQVPLV

SEQ ID NO: 138397 - protein, 9 aa, Artificial Sequence
  Description of Artificial Sequence: Synthetic peptide
  Seed: RNQPLTFAL (PMEL_HUMAN)
RSQPLTFAV

SEQ ID NO: 138398 - protein, 9 aa, Artificial Sequence
  Description of Artificial Sequence: Synthetic peptide
  Seed: LPDGQVIWV (PMEL_HUMAN)
LFDGQVIWF

SEQ ID NO: 138399 - protein, 8 aa, Artificial Sequence
  Description of Artificial Sequence: Synthetic peptide
  Seed: RSFVYVWK (PMEL_HUMAN)
RFFVYVWR

SEQ ID NO: 138400 - protein, 9 aa, Artificial Sequence
  Description of Artificial Sequence: Synthetic peptide
  Seed: AVIGALLAV (PMEL_HUMAN)
AVIGALLAW

SEQ ID NO: 138401 - protein, 9 aa, Artificial Sequence
  Description of Artificial Sequence: Synthetic peptide
  Seed: VVLQAAIPL (PMEL_HUMAN)
VMLQAAIPI

SEQ ID NO: 138402 - protein, 10 aa, Artificial Sequence
  Description of Artificial Sequence: Synthetic peptide
  Seed: LAHSSSAFTI (PMEL_HUMAN)
LQHSSSAFTW

SEQ ID NO: 138403 - protein, 11 aa, Artificial Sequence
  Description of Artificial Sequence: Synthetic peptide
  Seed: TYLEPGPVTAQ (PMEL_HUMAN)
TYLEPGPVTAL

SEQ ID NO: 138404 - protein, 11 aa, Artificial Sequence
  Description of Artificial Sequence: Synthetic peptide
  Seed: KVLPDGQVIWV (PMEL_HUMAN)
KSLPDGQVIWI

SEQ ID NO: 138405 - protein, 9 aa, Artificial Sequence
  Description of Artificial Sequence: Synthetic peptide
  Seed: EGDAFELTV (PMEL_HUMAN)
EVDAFELTM

SEQ ID NO: 138406 - protein, 9 aa, Artificial Sequence
  Description of Artificial Sequence: Synthetic peptide
  Seed: ESAEILQAV (PMEL_HUMAN)
ELAEILQAI

SEQ ID NO: 138407 - protein, 9 aa, Artificial Sequence
  Description of Artificial Sequence: Synthetic peptide
  Seed: VQMPTAEST (PMEL_HUMAN)
VHMPTAESA

SEQ ID NO: 138408 - protein, 9 aa, Artificial Sequence
  Description of Artificial Sequence: Synthetic peptide
  Seed: ITDQVPFSV (PMEL_HUMAN)
IMDQVPFSL

SEQ ID NO: 138409 - protein, 9 aa, Artificial Sequence
  Description of Artificial Sequence: Synthetic peptide
  Seed: MTPAEVSIV (PMEL_HUMAN)
MVPAEVSII

SEQ ID NO: 138410 - protein, 9 aa, Artificial Sequence
  Description of Artificial Sequence: Synthetic peptide
  Seed: ASFSIALNF (PMEL_HUMAN)
AAFSIALNI

SEQ ID NO: 138411 - protein, 10 aa, Artificial Sequence
  Description of Artificial Sequence: Synthetic peptide
  Seed: APVQMPTAES (PMEL_HUMAN)
APVQMPTAEV

SEQ ID NO: 138412 - protein, 9 aa, Artificial Sequence
  Description of Artificial Sequence: Synthetic peptide
  Seed: SQVWGGQPV (PMEL_HUMAN)
SVVWGGQPI

SEQ ID NO: 138413 - protein, 8 aa, Artificial Sequence
  Description of Artificial Sequence: Synthetic peptide
  Seed: TLDIVQGI (PMEL_HUMAN)
TTDIVQGI

SEQ ID NO: 138414 - protein, 8 aa, Artificial Sequence
  Description of Artificial Sequence: Synthetic peptide
  Seed: SNDGPTLI (PMEL_HUMAN)
SWDGPTLL

SEQ ID NO: 138415 - protein, 9 aa, Artificial Sequence
  Description of Artificial Sequence: Synthetic peptide
  Seed: TAPVQMPTA (PMEL_HUMAN)
TGPVQMPTL

SEQ ID NO: 138416 - protein, 9 aa, Artificial Sequence
  Description of Artificial Sequence: Synthetic peptide
  Seed: TTDGHRPTA (PMEL_HUMAN)
TVDGHRPTI

SEQ ID NO: 138417 - protein, 10 aa, Artificial Sequence
  Description of Artificial Sequence: Synthetic peptide
  Seed: MTPAEVSIVV (PMEL_HUMAN)
MDPAEVSIVT

SEQ ID NO: 138418 - protein, 9 aa, Artificial Sequence
  Description of Artificial Sequence: Synthetic peptide
  Seed: WQVLGGPVS (PMEL_HUMAN)
WHVLGGPVM

SEQ ID NO: 138419 - protein, 11 aa, Artificial Sequence
  Description of Artificial Sequence: Synthetic peptide
  Seed: GYLAEADLSYT (PMEL_HUMAN)
GALAEADLSYI

SEQ ID NO: 138420 - protein, 9 aa, Artificial Sequence
  Description of Artificial Sequence: Synthetic peptide
  Seed: ITDQVPFSV (PMEL_HUMAN)
ISDQVPFSL

SEQ ID NO: 138421 - protein, 11 aa, Artificial Sequence
  Description of Artificial Sequence: Synthetic peptide
  Seed: SYVPLAHSSSA (PMEL_HUMAN)
SCVPLAHSSSM

SEQ ID NO: 138422 - protein, 11 aa, Artificial Sequence
  Description of Artificial Sequence: Synthetic peptide
  Seed: RALDGGNKHFL (PMEL_HUMAN)
RMLDGGNKHFW

SEQ ID NO: 138423 - protein, 9 aa, Artificial Sequence
  Description of Artificial Sequence: Synthetic peptide
  Seed: VSLADTNSL (PMEL_HUMAN)
VMLADTNSF

SEQ ID NO: 138424 - protein, 10 aa, Artificial Sequence
  Description of Artificial Sequence: Synthetic peptide
  Seed: EVSIVVLSGT (PMEL_HUMAN)
EQSIVVLSGI

SEQ ID NO: 138425 - protein, 9 aa, Artificial Sequence
  Description of Artificial Sequence: Synthetic peptide
  Seed: ESAEILQAV (PMEL_HUMAN)
EQAEILQAI

SEQ ID NO: 138426 - protein, 9 aa, Artificial Sequence
  Description of Artificial Sequence: Synthetic peptide
  Seed: RLVKRQVPL (PMEL_HUMAN)
RMVKRQVPY

SEQ ID NO: 138427 - protein, 10 aa, Artificial Sequence
  Description of Artificial Sequence: Synthetic peptide
  Seed: LPSPACQLVL (PMEL_HUMAN)
LPSPACQLVY

SEQ ID NO: 138428 - protein, 10 aa, Artificial Sequence
  Description of Artificial Sequence: Synthetic peptide
  Seed: RGSRSYVPLA (PMEL_HUMAN)
RDSRSYVPLR

SEQ ID NO: 138429 - protein, 10 aa, Artificial Sequence
  Description of Artificial Sequence: Synthetic peptide
  Seed: AVVLASLIYR (PMEL_HUMAN)
ASVLASLIYR

SEQ ID NO: 138430 - protein, 10 aa, Artificial Sequence
  Description of Artificial Sequence: Synthetic peptide
  Seed: RALVVTHTYL (PMEL_HUMAN)
RSLVVTHTYF

SEQ ID NO: 138431 - protein, 9 aa, Artificial Sequence
  Description of Artificial Sequence: Synthetic peptide
  Seed: SSPGCQPPA (PMEL_HUMAN)
SGPGCQPPL

SEQ ID NO: 138432 - protein, 10 aa, Artificial Sequence
  Description of Artificial Sequence: Synthetic peptide
  Seed: QILKGGSGTY (PMEL_HUMAN)
QQLKGGSGTF

SEQ ID NO: 138433 - protein, 10 aa, Artificial Sequence
  Description of Artificial Sequence: Synthetic peptide
  Seed: SLAVVSTQLI (PMEL_HUMAN)
SVAVVSTQLV

SEQ ID NO: 138434 - protein, 11 aa, Artificial Sequence
  Description of Artificial Sequence: Synthetic peptide
  Seed: LVLMAVVLASL (PMEL_HUMAN)
LSLMAVVLASI

SEQ ID NO: 138435 - protein, 9 aa, Artificial Sequence
  Description of Artificial Sequence: Synthetic peptide
  Seed: RYGSFSVTL (PMEL_HUMAN)
RIGSFSVTM

SEQ ID NO: 138436 - protein, 9 aa, Artificial Sequence
  Description of Artificial Sequence: Synthetic peptide
  Seed: LYRYGSFSV (PMEL_HUMAN)
LFRYGSFSL

SEQ ID NO: 138437 - protein, 9 aa, Artificial Sequence
  Description of Artificial Sequence: Synthetic peptide
  Seed: APVQMPTAE (PMEL_HUMAN)
APVQMPTAL

SEQ ID NO: 138438 - protein, 9 aa, Artificial Sequence
  Description of Artificial Sequence: Synthetic peptide
  Seed: SSIMSTESI (PMEL_HUMAN)
SIIMSTESI

SEQ ID NO: 138439 - protein, 9 aa, Artificial Sequence
  Description of Artificial Sequence: Synthetic peptide
  Seed: LSIGTGRAM (PMEL_HUMAN)
LYIGTGRAL

SEQ ID NO: 138440 - protein, 9 aa, Artificial Sequence
  Description of Artificial Sequence: Synthetic peptide
  Seed: VTAQVVLQA (PMEL_HUMAN)
VQAQVVLQA

SEQ ID NO: 138441 - protein, 10 aa, Artificial Sequence
  Description of Artificial Sequence: Synthetic peptide
  Seed: MPTAESTGMT (PMEL_HUMAN)
MKTAESTGMA

SEQ ID NO: 138442 - protein, 9 aa, Artificial Sequence
  Description of Artificial Sequence: Synthetic peptide
  Seed: IVVLSGTTA (PMEL_HUMAN)
IPVLSGTTI

SEQ ID NO: 138443 - protein, 10 aa, Artificial Sequence
  Description of Artificial Sequence: Synthetic peptide
  Seed: LHLAVIGALL (PMEL_HUMAN)
LPLAVIGALL

SEQ ID NO: 138444 - protein, 9 aa, Artificial Sequence
  Description of Artificial Sequence: Synthetic peptide
  Seed: YLEPGPVTA (PMEL_HUMAN)
YTEPGPVTL

SEQ ID NO: 138445 - protein, 9 aa, Artificial Sequence
  Description of Artificial Sequence: Synthetic peptide
  Seed: YVWKTWGQY (PMEL_HUMAN)
YPWKTWGQM

SEQ ID NO: 138446 - protein, 10 aa, Artificial Sequence
  Description of Artificial Sequence: Synthetic peptide
  Seed: ASSIMSTESI (PMEL_HUMAN)
AQSIMSTESW

SEQ ID NO: 138447 - protein, 9 aa, Artificial Sequence
  Description of Artificial Sequence: Synthetic peptide
  Seed: LTSCGSSPV (PMEL_HUMAN)
LISCGSSPL

SEQ ID NO: 138448 - protein, 9 aa, Artificial Sequence
  Description of Artificial Sequence: Synthetic peptide
  Seed: ANASFSIAL (PMEL_HUMAN)
AMASFSIAI

SEQ ID NO: 138449 - protein, 9 aa, Artificial Sequence
  Description of Artificial Sequence: Synthetic peptide
  Seed: FSVSVSQLR (PMEL_HUMAN)
FVVSVSQLL

SEQ ID NO: 138450 - protein, 10 aa, Artificial Sequence
  Description of Artificial Sequence: Synthetic peptide
  Seed: YVPLAHSSSA (PMEL_HUMAN)
YDPLAHSSSV

SEQ ID NO: 138451 - protein, 11 aa, Artificial Sequence
  Description of Artificial Sequence: Synthetic peptide
  Seed: KHFLRNQPLTF (PMEL_HUMAN)
KYFLRNQPLTF

SEQ ID NO: 138452 - protein, 9 aa, Artificial Sequence
  Description of Artificial Sequence: Synthetic peptide
  Seed: GQVPTTEVV (PMEL_HUMAN)
GMVPTTEVV

SEQ ID NO: 138453 - protein, 10 aa, Artificial Sequence
  Description of Artificial Sequence: Synthetic peptide
  Seed: KRSFVYVWKT (PMEL_HUMAN)
KRSFVYVWKR

SEQ ID NO: 138454 - protein, 9 aa, Artificial Sequence
  Description of Artificial Sequence: Synthetic peptide
  Seed: RAMLGTHTM (PMEL_HUMAN)
RQMLGTHTL

SEQ ID NO: 138455 - protein, 10 aa, Artificial Sequence
  Description of Artificial Sequence: Synthetic peptide
  Seed: AEVSIVVLSG (PMEL_HUMAN)
AEVSIVVLSM

SEQ ID NO: 138456 - protein, 9 aa, Artificial Sequence
  Description of Artificial Sequence: Synthetic peptide
  Seed: QVIWVNNTI (PMEL_HUMAN)
QQIWVNNTI

SEQ ID NO: 138457 - protein, 10 aa, Artificial Sequence
  Description of Artificial Sequence: Synthetic peptide
  Seed: SGTYCLNVSL (PMEL_HUMAN)
SMTYCLNVSW

SEQ ID NO: 138458 - protein, 10 aa, Artificial Sequence
  Description of Artificial Sequence: Synthetic peptide
  Seed: YLAEADLSYT (PMEL_HUMAN)
YSAEADLSYI

SEQ ID NO: 138459 - protein, 10 aa, Artificial Sequence
  Description of Artificial Sequence: Synthetic peptide
  Seed: MAVVLASLIY (PMEL_HUMAN)
MAVVLASLIR

SEQ ID NO: 138460 - protein, 10 aa, Artificial Sequence
  Description of Artificial Sequence: Synthetic peptide
  Seed: GQEAGLGQVP (PMEL_HUMAN)
GEEAGLGQVL

SEQ ID NO: 138461 - protein, 9 aa, Artificial Sequence
  Description of Artificial Sequence: Synthetic peptide
  Seed: LPHSSSHWL (PMEL_HUMAN)
LPHSSSHWV

SEQ ID NO: 138462 - protein, 9 aa, Artificial Sequence
  Description of Artificial Sequence: Synthetic peptide
  Seed: YLEPGPVTA (PMEL_HUMAN)
YVEPGPVTL

SEQ ID NO: 138463 - protein, 11 aa, Artificial Sequence
  Description of Artificial Sequence: Synthetic peptide
  Seed: SEVMGTTLAEM (PMEL_HUMAN)
SEVMGTTLAEL

SEQ ID NO: 138464 - protein, 9 aa, Artificial Sequence
  Description of Artificial Sequence: Synthetic peptide
  Seed: TTDGHRPTA (PMEL_HUMAN)
TSDGHRPTA

SEQ ID NO: 138465 - protein, 10 aa, Artificial Sequence
  Description of Artificial Sequence: Synthetic peptide
  Seed: RALVVTHTYL (PMEL_HUMAN)
RCLVVTHTYW

SEQ ID NO: 138466 - protein, 9 aa, Artificial Sequence
  Description of Artificial Sequence: Synthetic peptide
  Seed: TAPVQMPTA (PMEL_HUMAN)
TVPVQMPTL

SEQ ID NO: 138467 - protein, 9 aa, Artificial Sequence
  Description of Artificial Sequence: Synthetic peptide
  Seed: RNQPLTFAL (PMEL_HUMAN)
RMQPLTFAH

SEQ ID NO: 138468 - protein, 9 aa, Artificial Sequence
  Description of Artificial Sequence: Synthetic peptide
  Seed: ITDQVPFSV (PMEL_HUMAN)
IRDQVPFSL

SEQ ID NO: 138469 - protein, 10 aa, Artificial Sequence
  Description of Artificial Sequence: Synthetic peptide
  Seed: VPLAHSSSAF (PMEL_HUMAN)
VPLAHSSSAL

SEQ ID NO: 138470 - protein, 9 aa, Artificial Sequence
  Description of Artificial Sequence: Synthetic peptide
  Seed: YLAEADLSY (PMEL_HUMAN)
YIAEADLSL

SEQ ID NO: 138471 - protein, 11 aa, Artificial Sequence
  Description of Artificial Sequence: Synthetic peptide
  Seed: MEISSPGCQPP (PMEL_HUMAN)
MEISSPGCQPA

SEQ ID NO: 138472 - protein, 10 aa, Artificial Sequence
  Description of Artificial Sequence: Synthetic peptide
  Seed: LVLMAVVLAS (PMEL_HUMAN)
LKLMAVVLAM

SEQ ID NO: 138473 - protein, 10 aa, Artificial Sequence
  Description of Artificial Sequence: Synthetic peptide
  Seed: GDSSGTLISR (PMEL_HUMAN)
GASSGTLISL

SEQ ID NO: 138474 - protein, 9 aa, Artificial Sequence
  Description of Artificial Sequence: Synthetic peptide
  Seed: VLQAAIPLT (PMEL_HUMAN)
VLQAAIPLV

SEQ ID NO: 138475 - protein, 10 aa, Artificial Sequence
  Description of Artificial Sequence: Synthetic peptide
  Seed: RNQDWLGVSR (PMEL_HUMAN)
RMQDWLGVSR

SEQ ID NO: 138476 - protein, 9 aa, Artificial Sequence
  Description of Artificial Sequence: Synthetic peptide
  Seed: TVYHRRGSR (PMEL_HUMAN)
TIYHRRGSK

SEQ ID NO: 138477 - protein, 10 aa, Artificial Sequence
  Description of Artificial Sequence: Synthetic peptide
  Seed: LRNQPLTFAL (PMEL_HUMAN)
LRNQPLTFAF

SEQ ID NO: 138478 - protein, 10 aa, Artificial Sequence
  Description of Artificial Sequence: Synthetic peptide
  Seed: NSLAVVSTQL (PMEL_HUMAN)
NSLAVVSTQV

SEQ ID NO: 138479 - protein, 9 aa, Artificial Sequence
  Description of Artificial Sequence: Synthetic peptide
  Seed: WSQKRSFVY (PMEL_HUMAN)
WVQKRSFVF

SEQ ID NO: 138480 - protein, 9 aa, Artificial Sequence
  Description of Artificial Sequence: Synthetic peptide
  Seed: GQVPLIVGI (PMEL_HUMAN)
GSVPLIVGY

SEQ ID NO: 138481 - protein, 9 aa, Artificial Sequence
  Description of Artificial Sequence: Synthetic peptide
  Seed: LNFPGSQKV (PMEL_HUMAN)
LLFPGSQKL

SEQ ID NO: 138482 - protein, 10 aa, Artificial Sequence
  Description of Artificial Sequence: Synthetic peptide
  Seed: ALDGGNKHFL (PMEL_HUMAN)
ANDGGNKHFY

SEQ ID NO: 138483 - protein, 9 aa, Artificial Sequence
  Description of Artificial Sequence: Synthetic peptide
  Seed: VVLQAAIPL (PMEL_HUMAN)
VLLQAAIPM

SEQ ID NO: 138484 - protein, 10 aa, Artificial Sequence
  Description of Artificial Sequence: Synthetic peptide
  Seed: LMAVVLASLI (PMEL_HUMAN)
LQAVVLASLV

SEQ ID NO: 138485 - protein, 11 aa, Artificial Sequence
  Description of Artificial Sequence: Synthetic peptide
  Seed: RTKAWNRQLYP (PMEL_HUMAN)
RSKAWNRQLYV

SEQ ID NO: 138486 - protein, 11 aa, Artificial Sequence
  Description of Artificial Sequence: Synthetic peptide
  Seed: SYVPLAHSSSA (PMEL_HUMAN)
SWVPLAHSSSF

SEQ ID NO: 138487 - protein, 9 aa, Artificial Sequence
  Description of Artificial Sequence: Synthetic peptide
  Seed: SFVYVWKTW (PMEL_HUMAN)
SWVYVWKTL

SEQ ID NO: 138488 - protein, 10 aa, Artificial Sequence
  Description of Artificial Sequence: Synthetic peptide
  Seed: KTWGQYWQVL (PMEL_HUMAN)
KKWGQYWQVF

SEQ ID NO: 138489 - protein, 9 aa, Artificial Sequence
  Description of Artificial Sequence: Synthetic peptide
  Seed: VLPDGQVIW (PMEL_HUMAN)
VYPDGQVIW

SEQ ID NO: 138490 - protein, 9 aa, Artificial Sequence
  Description of Artificial Sequence: Synthetic peptide
  Seed: AEPSGTTSV (PMEL_HUMAN)
AVPSGTTSF

SEQ ID NO: 138491 - protein, 9 aa, Artificial Sequence
  Description of Artificial Sequence: Synthetic peptide
  Seed: DSSGTLISR (PMEL_HUMAN)
DVSGTLISF

SEQ ID NO: 138492 - protein, 9 aa, Artificial Sequence
  Description of Artificial Sequence: Synthetic peptide
  Seed: EGDAFELTV (PMEL_HUMAN)
EADAFELTL

SEQ ID NO: 138493 - protein, 9 aa, Artificial Sequence
  Description of Artificial Sequence: Synthetic peptide
  Seed: HLAVIGALL (PMEL_HUMAN)
HSAVIGALF

SEQ ID NO: 138494 - protein, 10 aa, Artificial Sequence
  Description of Artificial Sequence: Synthetic peptide
  Seed: RGSRSYVPLA (PMEL_HUMAN)
RGSRSYVPLT

SEQ ID NO: 138495 - protein, 9 aa, Artificial Sequence
  Description of Artificial Sequence: Synthetic peptide
  Seed: ILKGGSGTY (PMEL_HUMAN)
IAKGGSGTI

SEQ ID NO: 138496 - protein, 10 aa, Artificial Sequence
  Description of Artificial Sequence: Synthetic peptide
  Seed: AMLGTHTMEV (PMEL_HUMAN)
AFLGTHTMEL

SEQ ID NO: 138497 - protein, 11 aa, Artificial Sequence
  Description of Artificial Sequence: Synthetic peptide
  Seed: YLAEADLSYTW (PMEL_HUMAN)
YYAEADLSYTM

SEQ ID NO: 138498 - protein, 10 aa, Artificial Sequence
  Description of Artificial Sequence: Synthetic peptide
  Seed: CLLHLAVIGA (PMEL_HUMAN)
CLLHLAVIGV

SEQ ID NO: 138499 - protein, 9 aa, Artificial Sequence
  Description of Artificial Sequence: Synthetic peptide
  Seed: LMAVVLASL (PMEL_HUMAN)
LVAVVLASI

SEQ ID NO: 138500 - protein, 9 aa, Artificial Sequence
  Description of Artificial Sequence: Synthetic peptide
  Seed: AEAPNTTAG (PMEL_HUMAN)
AEAPNTTAS

SEQ ID NO: 138501 - protein, 9 aa, Artificial Sequence
  Description of Artificial Sequence: Synthetic peptide
  Seed: DAFELTVSC (PMEL_HUMAN)
DRFELTVSA

SEQ ID NO: 138502 - protein, 9 aa, Artificial Sequence
  Description of Artificial Sequence: Synthetic peptide
  Seed: SGEGDAFEL (PMEL_HUMAN)
SLEGDAFEL

SEQ ID NO: 138503 - protein, 10 aa, Artificial Sequence
  Description of Artificial Sequence: Synthetic peptide
  Seed: LAVIGALLAV (PMEL_HUMAN)
LRVIGALLAV

SEQ ID NO: 138504 - protein, 8 aa, Artificial Sequence
  Description of Artificial Sequence: Synthetic peptide
  Seed: LHDPSGYL (PMEL_HUMAN)
LADPSGYF

SEQ ID NO: 138505 - protein, 9 aa, Artificial Sequence
  Description of Artificial Sequence: Synthetic peptide
  Seed: QKRSFVYVW (PMEL_HUMAN)
QQRSFVYVH

SEQ ID NO: 138506 - protein, 10 aa, Artificial Sequence
  Description of Artificial Sequence: Synthetic peptide
  Seed: RGSRSYVPLA (PMEL_HUMAN)
RKSRSYVPLM

SEQ ID NO: 138507 - protein, 9 aa, Artificial Sequence
  Description of Artificial Sequence: Synthetic peptide
  Seed: SGLSIGTGR (PMEL_HUMAN)
STLSIGTGY

SEQ ID NO: 138508 - protein, 10 aa, Artificial Sequence
  Description of Artificial Sequence: Synthetic peptide
  Seed: YVWKTWGQYW (PMEL_HUMAN)
YPWKTWGQYY

SEQ ID NO: 138509 - protein, 9 aa, Artificial Sequence
  Description of Artificial Sequence: Synthetic peptide
  Seed: SAFTITDQV (PMEL_HUMAN)
SSFTITDQV

SEQ ID NO: 138510 - protein, 9 aa, Artificial Sequence
  Description of Artificial Sequence: Synthetic peptide
  Seed: VLPSPACQL (PMEL_HUMAN)
VFPSPACQY

SEQ ID NO: 138511 - protein, 9 aa, Artificial Sequence
  Description of Artificial Sequence: Synthetic peptide
  Seed: FLRNQPLTF (PMEL_HUMAN)
FRRNQPLTY

SEQ ID NO: 138512 - protein, 10 aa, Artificial Sequence
  Description of Artificial Sequence: Synthetic peptide
  Seed: YVPLAHSSSA (PMEL_HUMAN)
YHPLAHSSSI

SEQ ID NO: 138513 - protein, 11 aa, Artificial Sequence
  Description of Artificial Sequence: Synthetic peptide
  Seed: YLAEADLSYTW (PMEL_HUMAN)
YIAEADLSYTL

SEQ ID NO: 138514 - protein, 9 aa, Artificial Sequence
  Description of Artificial Sequence: Synthetic peptide
  Seed: YLEPGPVTA (PMEL_HUMAN)
YFEPGPVTY

SEQ ID NO: 138515 - protein, 9 aa, Artificial Sequence
  Description of Artificial Sequence: Synthetic peptide
  Seed: QLYPEWTEA (PMEL_HUMAN)
QMYPEWTEM

SEQ ID NO: 138516 - protein, 10 aa, Artificial Sequence
  Description of Artificial Sequence: Synthetic peptide
  Seed: MTPAEVSIVV (PMEL_HUMAN)
MTPAEVSIVI

SEQ ID NO: 138517 - protein, 11 aa, Artificial Sequence
  Description of Artificial Sequence: Synthetic peptide
  Seed: RRGSRSYVPLA (PMEL_HUMAN)
RNGSRSYVPLV

SEQ ID NO: 138518 - protein, 9 aa, Artificial Sequence
  Description of Artificial Sequence: Synthetic peptide
  Seed: FTITDQVPF (PMEL_HUMAN)
FIITDQVPI

SEQ ID NO: 138519 - protein, 9 aa, Artificial Sequence
  Description of Artificial Sequence: Synthetic peptide
  Seed: LMAVVLASL (PMEL_HUMAN)
LVAVVLASY

SEQ ID NO: 138520 - protein, 10 aa, Artificial Sequence
  Description of Artificial Sequence: Synthetic peptide
  Seed: VTAQVVLQAA (PMEL_HUMAN)
VLAQVVLQAI

SEQ ID NO: 138521 - protein, 10 aa, Artificial Sequence
  Description of Artificial Sequence: Synthetic peptide
  Seed: MTPAEVSIVV (PMEL_HUMAN)
MRPAEVSIVW

SEQ ID NO: 138522 - protein, 11 aa, Artificial Sequence
  Description of Artificial Sequence: Synthetic peptide
  Seed: GYLAEADLSYT (PMEL_HUMAN)
GALAEADLSYL

SEQ ID NO: 138523 - protein, 9 aa, Artificial Sequence
  Description of Artificial Sequence: Synthetic peptide
  Seed: TPAEVSIVV (PMEL_HUMAN)
TIAEVSIVI

SEQ ID NO: 138524 - protein, 8 aa, Artificial Sequence
  Description of Artificial Sequence: Synthetic peptide
  Seed: LLDGTATL (PMEL_HUMAN)
LTDGTATV

SEQ ID NO: 138525 - protein, 10 aa, Artificial Sequence
  Description of Artificial Sequence: Synthetic peptide
  Seed: SAEILQAVPS (PMEL_HUMAN)
SNEILQAVPA

SEQ ID NO: 138526 - protein, 9 aa, Artificial Sequence
  Description of Artificial Sequence: Synthetic peptide
  Seed: QAAIPLTSC (PMEL_HUMAN)
QAAIPLTSY

SEQ ID NO: 138527 - protein, 8 aa, Artificial Sequence
  Description of Artificial Sequence: Synthetic peptide
  Seed: STPEATGM (PMEL_HUMAN)
SIPEATGL

SEQ ID NO: 138528 - protein, 9 aa, Artificial Sequence
  Description of Artificial Sequence: Synthetic peptide
  Seed: APTAEPSGT (PMEL_HUMAN)
APTAEPSGA

SEQ ID NO: 138529 - protein, 10 aa, Artificial Sequence
  Description of Artificial Sequence: Synthetic peptide
  Seed: AEADLSYTWD (PMEL_HUMAN)
AEADLSYTWC

SEQ ID NO: 138530 - protein, 9 aa, Artificial Sequence
  Description of Artificial Sequence: Synthetic peptide
  Seed: SSIMSTESI (PMEL_HUMAN)
SQIMSTESV

SEQ ID NO: 138531 - protein, 10 aa, Artificial Sequence
  Description of Artificial Sequence: Synthetic peptide
  Seed: GPLLDGTATL (PMEL_HUMAN)
GCLLDGTATL

SEQ ID NO: 138532 - protein, 10 aa, Artificial Sequence
  Description of Artificial Sequence: Synthetic peptide
  Seed: ALDGGNKHFL (PMEL_HUMAN)
ASDGGNKHFI

SEQ ID NO: 138533 - protein, 10 aa, Artificial Sequence
  Description of Artificial Sequence: Synthetic peptide
  Seed: SLADTNSLAV (PMEL_HUMAN)
SAADTNSLAM

SEQ ID NO: 138534 - protein, 9 aa, Artificial Sequence
  Description of Artificial Sequence: Synthetic peptide
  Seed: VLYRYGSFS (PMEL_HUMAN)
VLYRYGSFI

SEQ ID NO: 138535 - protein, 10 aa, Artificial Sequence
  Description of Artificial Sequence: Synthetic peptide
  Seed: AMLGTHTMEV (PMEL_HUMAN)
AVLGTHTMEV

SEQ ID NO: 138536 - protein, 9 aa, Artificial Sequence
  Description of Artificial Sequence: Synthetic peptide
  Seed: KVLPDGQVI (PMEL_HUMAN)
KLLPDGQVI

SEQ ID NO: 138537 - protein, 10 aa, Artificial Sequence
  Description of Artificial Sequence: Synthetic peptide
  Seed: QVIWVNNTII (PMEL_HUMAN)
QTIWVNNTIA

SEQ ID NO: 138538 - protein, 9 aa, Artificial Sequence
  Description of Artificial Sequence: Synthetic peptide
  Seed: AVVLASLIY (PMEL_HUMAN)
ASVLASLIM

SEQ ID NO: 138539 - protein, 10 aa, Artificial Sequence
  Description of Artificial Sequence: Synthetic peptide
  Seed: AVIGALLAVG (PMEL_HUMAN)
AVIGALLAVQ

SEQ ID NO: 138540 - protein, 10 aa, Artificial Sequence
  Description of Artificial Sequence: Synthetic peptide
  Seed: SVPQLPHSSS (PMEL_HUMAN)
SPPQLPHSSL

SEQ ID NO: 138541 - protein, 10 aa, Artificial Sequence
  Description of Artificial Sequence: Synthetic peptide
  Seed: KTWGQYWQVL (PMEL_HUMAN)
KSWGQYWQVW

SEQ ID NO: 138542 - protein, 10 aa, Artificial Sequence
  Description of Artificial Sequence: Synthetic peptide
  Seed: RQLYPEWTEA (PMEL_HUMAN)
RNLYPEWTEI

SEQ ID NO: 138543 - protein, 10 aa, Artificial Sequence
  Description of Artificial Sequence: Synthetic peptide
  Seed: FSVSVSQLRA (PMEL_HUMAN)
FMVSVSQLRR

SEQ ID NO: 138544 - protein, 9 aa, Artificial Sequence
  Description of Artificial Sequence: Synthetic peptide
  Seed: YHRRGSRSY (PMEL_HUMAN)
YHRRGSRSM

SEQ ID NO: 138545 - protein, 11 aa, Artificial Sequence
  Description of Artificial Sequence: Synthetic peptide
  Seed: QAVPSGEGDAF (PMEL_HUMAN)
QPVPSGEGDAF

SEQ ID NO: 138546 - protein, 9 aa, Artificial Sequence
  Description of Artificial Sequence: Synthetic peptide
  Seed: VLMAVVLAS (PMEL_HUMAN)
VTMAVVLAV

SEQ ID NO: 138547 - protein, 9 aa, Artificial Sequence
  Description of Artificial Sequence: Synthetic peptide
  Seed: VSLADTNSL (PMEL_HUMAN)
VTLADTNSI

SEQ ID NO: 138548 - protein, 10 aa, Artificial Sequence
  Description of Artificial Sequence: Synthetic peptide
  Seed: EVMGTTLAEM (PMEL_HUMAN)
ELMGTTLAEL

SEQ ID NO: 138549 - protein, 10 aa, Artificial Sequence
  Description of Artificial Sequence: Synthetic peptide
  Seed: RYGSFSVTLD (PMEL_HUMAN)
RWGSFSVTLL

SEQ ID NO: 138550 - protein, 9 aa, Artificial Sequence
  Description of Artificial Sequence: Synthetic peptide
  Seed: KQDFSVPQL (PMEL_HUMAN)
KVDFSVPQF

SEQ ID NO: 138551 - protein, 9 aa, Artificial Sequence
  Description of Artificial Sequence: Synthetic peptide
  Seed: VLGGPVSGL (PMEL_HUMAN)
VLGGPVSGV

SEQ ID NO: 138552 - protein, 9 aa, Artificial Sequence
  Description of Artificial Sequence: Synthetic peptide
  Seed: GGPVSGLSI (PMEL_HUMAN)
GCPVSGLSL

SEQ ID NO: 138553 - protein, 9 aa, Artificial Sequence
  Description of Artificial Sequence: Synthetic peptide
  Seed: LSIGTGRAM (PMEL_HUMAN)
LGIGTGRAF

SEQ ID NO: 138554 - protein, 11 aa, Artificial Sequence
  Description of Artificial Sequence: Synthetic peptide
  Seed: YLAEADLSYTW (PMEL_HUMAN)
YRAEADLSYTW

SEQ ID NO: 138555 - protein, 9 aa, Artificial Sequence
  Description of Artificial Sequence: Synthetic peptide
  Seed: SITGSLGPL (PMEL_HUMAN)
SMTGSLGPA

SEQ ID NO: 138556 - protein, 9 aa, Artificial Sequence
  Description of Artificial Sequence: Synthetic peptide
  Seed: LSIGTGRAM (PMEL_HUMAN)
LTIGTGRAW

SEQ ID NO: 138557 - protein, 9 aa, Artificial Sequence
  Description of Artificial Sequence: Synthetic peptide
  Seed: YLEPGPVTA (PMEL_HUMAN)
YYEPGPVTF

SEQ ID NO: 138558 - protein, 10 aa, Artificial Sequence
  Description of Artificial Sequence: Synthetic peptide
  Seed: SCPIGENSPL (PMEL_HUMAN)
SIPIGENSPM

SEQ ID NO: 138559 - protein, 10 aa, Artificial Sequence
  Description of Artificial Sequence: Synthetic peptide
  Seed: VSLADTNSLA (PMEL_HUMAN)
VNLADTNSLI

SEQ ID NO: 138560 - protein, 10 aa, Artificial Sequence
  Description of Artificial Sequence: Synthetic peptide
  Seed: VLMAVVLASL (PMEL_HUMAN)
VSMAVVLASY

SEQ ID NO: 138561 - protein, 9 aa, Artificial Sequence
  Description of Artificial Sequence: Synthetic peptide
  Seed: EVVGTTPGQ (PMEL_HUMAN)
EIVGTTPGY

SEQ ID NO: 138562 - protein, 10 aa, Artificial Sequence
  Description of Artificial Sequence: Synthetic peptide
  Seed: TLISRALVVT (PMEL_HUMAN)
TMISRALVVV

SEQ ID NO: 138563 - protein, 9 aa, Artificial Sequence
  Description of Artificial Sequence: Synthetic peptide
  Seed: HSSSHWLRL (PMEL_HUMAN)
HASSHWLRI

SEQ ID NO: 138564 - protein, 11 aa, Artificial Sequence
  Description of Artificial Sequence: Synthetic peptide
  Seed: RRGSRSYVPLA (PMEL_HUMAN)
RVGSRSYVPLA

SEQ ID NO: 138565 - protein, 11 aa, Artificial Sequence
  Description of Artificial Sequence: Synthetic peptide
  Seed: SYVPLAHSSSA (PMEL_HUMAN)
SFVPLAHSSSF

SEQ ID NO: 138566 - protein, 9 aa, Artificial Sequence
  Description of Artificial Sequence: Synthetic peptide
  Seed: AGLGQVPLI (PMEL_HUMAN)
ASLGQVPLM

SEQ ID NO: 138567 - protein, 10 aa, Artificial Sequence
  Description of Artificial Sequence: Synthetic peptide
  Seed: LIGANASFSI (PMEL_HUMAN)
LLGANASFSI

SEQ ID NO: 138568 - protein, 10 aa, Artificial Sequence
  Description of Artificial Sequence: Synthetic peptide
  Seed: LVLMAVVLAS (PMEL_HUMAN)
LQLMAVVLAI

SEQ ID NO: 138569 - protein, 10 aa, Artificial Sequence
  Description of Artificial Sequence: Synthetic peptide
  Seed: RALDGGNKHF (PMEL_HUMAN)
RQLDGGNKHM

SEQ ID NO: 138570 - protein, 9 aa, Artificial Sequence
  Description of Artificial Sequence: Synthetic peptide
  Seed: KTWGQYWQV (PMEL_HUMAN)
KTWGQYWQF

SEQ ID NO: 138571 - protein, 11 aa, Artificial Sequence
  Description of Artificial Sequence: Synthetic peptide
  Seed: RTKAWNRQLYP (PMEL_HUMAN)
RVKAWNRQLYK

SEQ ID NO: 138572 - protein, 10 aa, Artificial Sequence
  Description of Artificial Sequence: Synthetic peptide
  Seed: VLYRYGSFSV (PMEL_HUMAN)
VQYRYGSFSV

SEQ ID NO: 138573 - protein, 10 aa, Artificial Sequence
  Description of Artificial Sequence: Synthetic peptide
  Seed: LMAVVLASLI (PMEL_HUMAN)
LLAVVLASLR

SEQ ID NO: 138574 - protein, 11 aa, Artificial Sequence
  Description of Artificial Sequence: Synthetic peptide
  Seed: AVIGALLAVGA (PMEL_HUMAN)
AVIGALLAVGV

SEQ ID NO: 138575 - protein, 10 aa, Artificial Sequence
  Description of Artificial Sequence: Synthetic peptide
  Seed: IESAEILQAV (PMEL_HUMAN)
IMSAEILQAM

SEQ ID NO: 138576 - protein, 9 aa, Artificial Sequence
  Description of Artificial Sequence: Synthetic peptide
  Seed: HTMEVTVYH (PMEL_HUMAN)
HIMEVTVYR

SEQ ID NO: 138577 - protein, 9 aa, Artificial Sequence
  Description of Artificial Sequence: Synthetic peptide
  Seed: RYGSFSVTL (PMEL_HUMAN)
RFGSFSVTL

SEQ ID NO: 138578 - protein, 9 aa, Artificial Sequence
  Description of Artificial Sequence: Synthetic peptide
  Seed: RALVVTHTY (PMEL_HUMAN)
RYLVVTHTY

SEQ ID NO: 138579 - protein, 9 aa, Artificial Sequence
  Description of Artificial Sequence: Synthetic peptide
  Seed: DAFELTVSC (PMEL_HUMAN)
DHFELTVSP

SEQ ID NO: 138580 - protein, 9 aa, Artificial Sequence
  Description of Artificial Sequence: Synthetic peptide
  Seed: GSSPVPGTT (PMEL_HUMAN)
GASPVPGTY

SEQ ID NO: 138581 - protein, 9 aa, Artificial Sequence
  Description of Artificial Sequence: Synthetic peptide
  Seed: KQDFSVPQL (PMEL_HUMAN)
KEDFSVPQI

SEQ ID NO: 138582 - protein, 9 aa, Artificial Sequence
  Description of Artificial Sequence: Synthetic peptide
  Seed: VSVSQLRAL (PMEL_HUMAN)
VRVSQLRAI

SEQ ID NO: 138583 - protein, 9 aa, Artificial Sequence
  Description of Artificial Sequence: Synthetic peptide
  Seed: LSIGTGRAM (PMEL_HUMAN)
LAIGTGRAW

SEQ ID NO: 138584 - protein, 9 aa, Artificial Sequence
  Description of Artificial Sequence: Synthetic peptide
  Seed: ITDQVPFSV (PMEL_HUMAN)
INDQVPFSL

SEQ ID NO: 138585 - protein, 9 aa, Artificial Sequence
  Description of Artificial Sequence: Synthetic peptide
  Seed: LMAVVLASL (PMEL_HUMAN)
LTAVVLASV

SEQ ID NO: 138586 - protein, 10 aa, Artificial Sequence
  Description of Artificial Sequence: Synthetic peptide
  Seed: EVMGTTLAEM (PMEL_HUMAN)
ETMGTTLAEM

SEQ ID NO: 138587 - protein, 9 aa, Artificial Sequence
  Description of Artificial Sequence: Synthetic peptide
  Seed: VMGTTLAEM (PMEL_HUMAN)
VFGTTLAEY

SEQ ID NO: 138588 - protein, 9 aa, Artificial Sequence
  Description of Artificial Sequence: Synthetic peptide
  Seed: HLAVIGALL (PMEL_HUMAN)
HTAVIGALI

SEQ ID NO: 138589 - protein, 9 aa, Artificial Sequence
  Description of Artificial Sequence: Synthetic peptide
  Seed: RLMKQDFSV (PMEL_HUMAN)
RKMKQDFSI

SEQ ID NO: 138590 - protein, 9 aa, Artificial Sequence
  Description of Artificial Sequence: Synthetic peptide
  Seed: NQDWLGVSR (PMEL_HUMAN)
NTDWLGVSR

SEQ ID NO: 138591 - protein, 11 aa, Artificial Sequence
  Description of Artificial Sequence: Synthetic peptide
  Seed: LYRYGSFSVTL (PMEL_HUMAN)
LYRYGSFSVTF

SEQ ID NO: 138592 - protein, 10 aa, Artificial Sequence
  Description of Artificial Sequence: Synthetic peptide
  Seed: SQKRSFVYVW (PMEL_HUMAN)
SKKRSFVYVF

SEQ ID NO: 138593 - protein, 10 aa, Artificial Sequence
  Description of Artificial Sequence: Synthetic peptide
  Seed: AEADLSYTWD (PMEL_HUMAN)
AEADLSYTWW

SEQ ID NO: 138594 - protein, 10 aa, Artificial Sequence
  Description of Artificial Sequence: Synthetic peptide
  Seed: WSQKRSFVYV (PMEL_HUMAN)
WRQKRSFVYK

SEQ ID NO: 138595 - protein, 9 aa, Artificial Sequence
  Description of Artificial Sequence: Synthetic peptide
  Seed: FGDSSGTLI (PMEL_HUMAN)
FTDSSGTLM

SEQ ID NO: 138596 - protein, 9 aa, Artificial Sequence
  Description of Artificial Sequence: Synthetic peptide
  Seed: VVLQAAIPL (PMEL_HUMAN)
VHLQAAIPM

SEQ ID NO: 138597 - protein, 10 aa, Artificial Sequence
  Description of Artificial Sequence: Synthetic peptide
  Seed: ALDGGNKHFL (PMEL_HUMAN)
AQDGGNKHFI

SEQ ID NO: 138598 - protein, 11 aa, Artificial Sequence
  Description of Artificial Sequence: Synthetic peptide
  Seed: LVLMAVVLASL (PMEL_HUMAN)
LNLMAVVLASV

SEQ ID NO: 138599 - protein, 9 aa, Artificial Sequence
  Description of Artificial Sequence: Synthetic peptide
  Seed: SQVWGGQPV (PMEL_HUMAN)
SEVWGGQPL

SEQ ID NO: 138600 - protein, 10 aa, Artificial Sequence
  Description of Artificial Sequence: Synthetic peptide
  Seed: EVVGTTPGQA (PMEL_HUMAN)
EVVGTTPGQL

SEQ ID NO: 138601 - protein, 9 aa, Artificial Sequence
  Description of Artificial Sequence: Synthetic peptide
  Seed: KTWGQYWQV (PMEL_HUMAN)
KMWGQYWQI

SEQ ID NO: 138602 - protein, 9 aa, Artificial Sequence
  Description of Artificial Sequence: Synthetic peptide
  Seed: VLMAVVLAS (PMEL_HUMAN)
VMMAVVLAI

SEQ ID NO: 138603 - protein, 9 aa, Artificial Sequence
  Description of Artificial Sequence: Synthetic peptide
  Seed: VPQLPHSSS (PMEL_HUMAN)
VPQLPHSSI

SEQ ID NO: 138604 - protein, 9 aa, Artificial Sequence
  Description of Artificial Sequence: Synthetic peptide
  Seed: KVSNDGPTL (PMEL_HUMAN)
KVSNDGPTF

SEQ ID NO: 138605 - protein, 11 aa, Artificial Sequence
  Description of Artificial Sequence: Synthetic peptide
  Seed: KVLPDGQVIWV (PMEL_HUMAN)
KQLPDGQVIWF

SEQ ID NO: 138606 - protein, 9 aa, Artificial Sequence
  Description of Artificial Sequence: Synthetic peptide
  Seed: TTPGQAPTA (PMEL_HUMAN)
TTPGQAPTY

SEQ ID NO: 138607 - protein, 9 aa, Artificial Sequence
  Description of Artificial Sequence: Synthetic peptide
  Seed: YRYGSFSVT (PMEL_HUMAN)
YYYGSFSVF

SEQ ID NO: 138608 - protein, 9 aa, Artificial Sequence
  Description of Artificial Sequence: Synthetic peptide
  Seed: IYRRRLMKQ (PMEL_HUMAN)
ILRRRLMKK

SEQ ID NO: 138609 - protein, 10 aa, Artificial Sequence
  Description of Artificial Sequence: Synthetic peptide
  Seed: GYLAEADLSY (PMEL_HUMAN)
GMLAEADLSM

SEQ ID NO: 138610 - protein, 9 aa, Artificial Sequence
  Description of Artificial Sequence: Synthetic peptide
  Seed: VSEVMGTTL (PMEL_HUMAN)
VTEVMGTTF

SEQ ID NO: 138611 - protein, 9 aa, Artificial Sequence
  Description of Artificial Sequence: Synthetic peptide
  Seed: ESAEILQAV (PMEL_HUMAN)
EIAEILQAK

SEQ ID NO: 138612 - protein, 11 aa, Artificial Sequence
  Description of Artificial Sequence: Synthetic peptide
  Seed: SLADTNSLAVV (PMEL_HUMAN)
SIADTNSLAVV

SEQ ID NO: 138613 - protein, 9 aa, Artificial Sequence
  Description of Artificial Sequence: Synthetic peptide
  Seed: AQVVLQAAI (PMEL_HUMAN)
ALVVLQAAL

SEQ ID NO: 138614 - protein, 9 aa, Artificial Sequence
  Description of Artificial Sequence: Synthetic peptide
  Seed: STAPVQMPT (PMEL_HUMAN)
STAPVQMPA

SEQ ID NO: 138615 - protein, 9 aa, Artificial Sequence
  Description of Artificial Sequence: Synthetic peptide
  Seed: VQVPTTEVI (PMEL_HUMAN)
VRVPTTEVY

SEQ ID NO: 138616 - protein, 9 aa, Artificial Sequence
  Description of Artificial Sequence: Synthetic peptide
  Seed: VLGGPVSGL (PMEL_HUMAN)
VVGGPVSGV

SEQ ID NO: 138617 - protein, 8 aa, Artificial Sequence
  Description of Artificial Sequence: Synthetic peptide
  Seed: YRYGSFSV (PMEL_HUMAN)
YQYGSFSL

SEQ ID NO: 138618 - protein, 10 aa, Artificial Sequence
  Description of Artificial Sequence: Synthetic peptide
  Seed: RGSRSYVPLA (PMEL_HUMAN)
RHSRSYVPLK

SEQ ID NO: 138619 - protein, 10 aa, Artificial Sequence
  Description of Artificial Sequence: Synthetic peptide
  Seed: GPLLDGTATL (PMEL_HUMAN)
GGLLDGTATM

SEQ ID NO: 138620 - protein, 10 aa, Artificial Sequence
  Description of Artificial Sequence: Synthetic peptide
  Seed: MAVVLASLIY (PMEL_HUMAN)
MEVVLASLIF

SEQ ID NO: 138621 - protein, 10 aa, Artificial Sequence
  Description of Artificial Sequence: Synthetic peptide
  Seed: SVPQLPHSSS (PMEL_HUMAN)
SFPQLPHSSA

SEQ ID NO: 138622 - protein, 9 aa, Artificial Sequence
  Description of Artificial Sequence: Synthetic peptide
  Seed: LADTNSLAV (PMEL_HUMAN)
LPDTNSLAV

SEQ ID NO: 138623 - protein, 9 aa, Artificial Sequence
  Description of Artificial Sequence: Synthetic peptide
  Seed: GTYCLNVSL (PMEL_HUMAN)
GGYCLNVSY

SEQ ID NO: 138624 - protein, 9 aa, Artificial Sequence
  Description of Artificial Sequence: Synthetic peptide
  Seed: LLAVGATKV (PMEL_HUMAN)
LQAVGATKV

SEQ ID NO: 138625 - protein, 10 aa, Artificial Sequence
  Description of Artificial Sequence: Synthetic peptide
  Seed: GDSSGTLISR (PMEL_HUMAN)
GESSGTLISK

SEQ ID NO: 138626 - protein, 9 aa, Artificial Sequence
  Description of Artificial Sequence: Synthetic peptide
  Seed: KVSNDGPTL (PMEL_HUMAN)
KTSNDGPTM

SEQ ID NO: 138627 - protein, 10 aa, Artificial Sequence
  Description of Artificial Sequence: Synthetic peptide
  Seed: RLMKQDFSVP (PMEL_HUMAN)
RMMKQDFSVV

SEQ ID NO: 138628 - protein, 9 aa, Artificial Sequence
  Description of Artificial Sequence: Synthetic peptide
  Seed: VLPDGQVIW (PMEL_HUMAN)
VWPDGQVIW

SEQ ID NO: 138629 - protein, 9 aa, Artificial Sequence
  Description of Artificial Sequence: Synthetic peptide
  Seed: DSSGTLISR (PMEL_HUMAN)
DFSGTLISR

SEQ ID NO: 138630 - protein, 10 aa, Artificial Sequence
  Description of Artificial Sequence: Synthetic peptide
  Seed: MSTESITGSL (PMEL_HUMAN)
MTTESITGSF

SEQ ID NO: 138631 - protein, 9 aa, Artificial Sequence
  Description of Artificial Sequence: Synthetic peptide
  Seed: GMTPAEVSI (PMEL_HUMAN)
GQTPAEVSV

SEQ ID NO: 138632 - protein, 10 aa, Artificial Sequence
  Description of Artificial Sequence: Synthetic peptide
  Seed: LAVVSTQLIM (PMEL_HUMAN)
LSVVSTQLIY

SEQ ID NO: 138633 - protein, 10 aa, Artificial Sequence
  Description of Artificial Sequence: Synthetic peptide
  Seed: YPQETDDACI (PMEL_HUMAN)
YPQETDDACW

SEQ ID NO: 138634 - protein, 11 aa, Artificial Sequence
  Description of Artificial Sequence: Synthetic peptide
  Seed: RLPRIFCSCPI (PMEL_HUMAN)
RLPRIFCSCPV

SEQ ID NO: 138635 - protein, 9 aa, Artificial Sequence
  Description of Artificial Sequence: Synthetic peptide
  Seed: GSRSYVPLA (PMEL_HUMAN)
GYRSYVPLA

SEQ ID NO: 138636 - protein, 9 aa, Artificial Sequence
  Description of Artificial Sequence: Synthetic peptide
  Seed: VVLQAAIPL (PMEL_HUMAN)
VVLQAAIPW

SEQ ID NO: 138637 - protein, 10 aa, Artificial Sequence
  Description of Artificial Sequence: Synthetic peptide
  Seed: LVLMAVVLAS (PMEL_HUMAN)
LLLMAVVLAV

SEQ ID NO: 138638 - protein, 9 aa, Artificial Sequence
  Description of Artificial Sequence: Synthetic peptide
  Seed: LSIGTGRAM (PMEL_HUMAN)
LQIGTGRAW

SEQ ID NO: 138639 - protein, 9 aa, Artificial Sequence
  Description of Artificial Sequence: Synthetic peptide
  Seed: RALVVTHTY (PMEL_HUMAN)
RILVVTHTL

SEQ ID NO: 138640 - protein, 9 aa, Artificial Sequence
  Description of Artificial Sequence: Synthetic peptide
  Seed: VTAQVVLQA (PMEL_HUMAN)
VVAQVVLQF

SEQ ID NO: 138641 - protein, 9 aa, Artificial Sequence
  Description of Artificial Sequence: Synthetic peptide
  Seed: VVLSGTTAA (PMEL_HUMAN)
VALSGTTAH

SEQ ID NO: 138642 - protein, 9 aa, Artificial Sequence
  Description of Artificial Sequence: Synthetic peptide
  Seed: VTAQVVLQA (PMEL_HUMAN)
VGAQVVLQL

SEQ ID NO: 138643 - protein, 9 aa, Artificial Sequence
  Description of Artificial Sequence: Synthetic peptide
  Seed: GQVPTTEVV (PMEL_HUMAN)
GQVPTTEVL

SEQ ID NO: 138644 - protein, 10 aa, Artificial Sequence
  Description of Artificial Sequence: Synthetic peptide
  Seed: VPQLPHSSSH (PMEL_HUMAN)
VGQLPHSSSM

SEQ ID NO: 138645 - protein, 10 aa, Artificial Sequence
  Description of Artificial Sequence: Synthetic peptide
  Seed: YGSFSVTLDI (PMEL_HUMAN)
YVSFSVTLDW

SEQ ID NO: 138646 - protein, 9 aa, Artificial Sequence
  Description of Artificial Sequence: Synthetic peptide
  Seed: KQDFSVPQL (PMEL_HUMAN)
KIDFSVPQI

SEQ ID NO: 138647 - protein, 10 aa, Artificial Sequence
  Description of Artificial Sequence: Synthetic peptide
  Seed: SSAFTITDQV (PMEL_HUMAN)
SVAFTITDQI

SEQ ID NO: 138648 - protein, 9 aa, Artificial Sequence
  Description of Artificial Sequence: Synthetic peptide
  Seed: TPAEVSIVV (PMEL_HUMAN)
TPAEVSIVP

SEQ ID NO: 138649 - protein, 10 aa, Artificial Sequence
  Description of Artificial Sequence: Synthetic peptide
  Seed: HDPSGYLAEA (PMEL_HUMAN)
HEPSGYLAEA

SEQ ID NO: 138650 - protein, 9 aa, Artificial Sequence
  Description of Artificial Sequence: Synthetic peptide
  Seed: LHLAVIGAL (PMEL_HUMAN)
LRLAVIGAY

SEQ ID NO: 138651 - protein, 9 aa, Artificial Sequence
  Description of Artificial Sequence: Synthetic peptide
  Seed: LIYRRRLMK (PMEL_HUMAN)
LWYRRRLMK

SEQ ID NO: 138652 - protein, 11 aa, Artificial Sequence
  Description of Artificial Sequence: Synthetic peptide
  Seed: MAVVLASLIYR (PMEL_HUMAN)
MGVVLASLIYR

SEQ ID NO: 138653 - protein, 9 aa, Artificial Sequence
  Description of Artificial Sequence: Synthetic peptide
  Seed: YVWKTWGQY (PMEL_HUMAN)
YIWKTWGQF

SEQ ID NO: 138654 - protein, 11 aa, Artificial Sequence
  Description of Artificial Sequence: Synthetic peptide
  Seed: QLYPEWTEAQR (PMEL_HUMAN)
QVYPEWTEAQK

SEQ ID NO: 138655 - protein, 9 aa, Artificial Sequence
  Description of Artificial Sequence: Synthetic peptide
  Seed: THTMEVTVY (PMEL_HUMAN)
THTMEVTVM

SEQ ID NO: 138656 - protein, 9 aa, Artificial Sequence
  Description of Artificial Sequence: Synthetic peptide
  Seed: ASFSIALNF (PMEL_HUMAN)
AFFSIALNF

SEQ ID NO: 138657 - protein, 9 aa, Artificial Sequence
  Description of Artificial Sequence: Synthetic peptide
  Seed: GLGQVPLIV (PMEL_HUMAN)
GQGQVPLIL

SEQ ID NO: 138658 - protein, 9 aa, Artificial Sequence
  Description of Artificial Sequence: Synthetic peptide
  Seed: STESITGSL (PMEL_HUMAN)
SAESITGSF

SEQ ID NO: 138659 - protein, 11 aa, Artificial Sequence
  Description of Artificial Sequence: Synthetic peptide
  Seed: ITDQVPFSVSV (PMEL_HUMAN)
ITDQVPFSVSM

SEQ ID NO: 138660 - protein, 9 aa, Artificial Sequence
  Description of Artificial Sequence: Synthetic peptide
  Seed: LQAAIPLTS (PMEL_HUMAN)
LKAAIPLTI

SEQ ID NO: 138661 - protein, 9 aa, Artificial Sequence
  Description of Artificial Sequence: Synthetic peptide
  Seed: VLPSPACQL (PMEL_HUMAN)
VIPSPACQF

SEQ ID NO: 138662 - protein, 9 aa, Artificial Sequence
  Description of Artificial Sequence: Synthetic peptide
  Seed: GENSPLLSG (PMEL_HUMAN)
GENSPLLSL

SEQ ID NO: 138663 - protein, 9 aa, Artificial Sequence
  Description of Artificial Sequence: Synthetic peptide
  Seed: LIVGILLVL (PMEL_HUMAN)
LAVGILLVL

SEQ ID NO: 138664 - protein, 8 aa, Artificial Sequence
  Description of Artificial Sequence: Synthetic peptide
  Seed: CQLVLHQI (PMEL_HUMAN)
CQLVLHQL

SEQ ID NO: 138665 - protein, 9 aa, Artificial Sequence
  Description of Artificial Sequence: Synthetic peptide
  Seed: KVLPDGQVI (PMEL_HUMAN)
KQLPDGQVY

SEQ ID NO: 138666 - protein, 9 aa, Artificial Sequence
  Description of Artificial Sequence: Synthetic peptide
  Seed: TAPVQMPTA (PMEL_HUMAN)
TSPVQMPTL

SEQ ID NO: 138667 - protein, 10 aa, Artificial Sequence
  Description of Artificial Sequence: Synthetic peptide
  Seed: EVSIVVLSGT (PMEL_HUMAN)
ERSIVVLSGV

SEQ ID NO: 138668 - protein, 10 aa, Artificial Sequence
  Description of Artificial Sequence: Synthetic peptide
  Seed: AMLGTHTMEV (PMEL_HUMAN)
ADLGTHTMEV

SEQ ID NO: 138669 - protein, 9 aa, Artificial Sequence
  Description of Artificial Sequence: Synthetic peptide
  Seed: RNQPLTFAL (PMEL_HUMAN)
RKQPLTFAM

SEQ ID NO: 138670 - protein, 10 aa, Artificial Sequence
  Description of Artificial Sequence: Synthetic peptide
  Seed: SAEILQAVPS (PMEL_HUMAN)
SMEILQAVPA

SEQ ID NO: 138671 - protein, 9 aa, Artificial Sequence
  Description of Artificial Sequence: Synthetic peptide
  Seed: VSCQGGLPK (PMEL_HUMAN)
VMCQGGLPK

SEQ ID NO: 138672 - protein, 10 aa, Artificial Sequence
  Description of Artificial Sequence: Synthetic peptide
  Seed: SCPIGENSPL (PMEL_HUMAN)
SRPIGENSPM

SEQ ID NO: 138673 - protein, 9 aa, Artificial Sequence
  Description of Artificial Sequence: Synthetic peptide
  Seed: VISTAPVQM (PMEL_HUMAN)
VYSTAPVQV

SEQ ID NO: 138674 - protein, 9 aa, Artificial Sequence
  Description of Artificial Sequence: Synthetic peptide
  Seed: FTITDQVPF (PMEL_HUMAN)
FVITDQVPF

SEQ ID NO: 138675 - protein, 11 aa, Artificial Sequence
  Description of Artificial Sequence: Synthetic peptide
  Seed: RLPRIFCSCPI (PMEL_HUMAN)
RFPRIFCSCPL

SEQ ID NO: 138676 - protein, 9 aa, Artificial Sequence
  Description of Artificial Sequence: Synthetic peptide
  Seed: VMGTTLAEM (PMEL_HUMAN)
VKGTTLAEY

SEQ ID NO: 138677 - protein, 9 aa, Artificial Sequence
  Description of Artificial Sequence: Synthetic peptide
  Seed: NQDWLGVSR (PMEL_HUMAN)
NSDWLGVSY

SEQ ID NO: 138678 - protein, 10 aa, Artificial Sequence
  Description of Artificial Sequence: Synthetic peptide
  Seed: AVIGALLAVG (PMEL_HUMAN)
AQIGALLAVF

SEQ ID NO: 138679 - protein, 9 aa, Artificial Sequence
  Description of Artificial Sequence: Synthetic peptide
  Seed: SVPQLPHSS (PMEL_HUMAN)
SIPQLPHSM

SEQ ID NO: 138680 - protein, 10 aa, Artificial Sequence
  Description of Artificial Sequence: Synthetic peptide
  Seed: KRQVPLDCVL (PMEL_HUMAN)
KEQVPLDCVM

SEQ ID NO: 138681 - protein, 10 aa, Artificial Sequence
  Description of Artificial Sequence: Synthetic peptide
  Seed: RGSRSYVPLA (PMEL_HUMAN)
RLSRSYVPLL

SEQ ID NO: 138682 - protein, 10 aa, Artificial Sequence
  Description of Artificial Sequence: Synthetic peptide
  Seed: YVPLAHSSSA (PMEL_HUMAN)
YVPLAHSSSF

SEQ ID NO: 138683 - protein, 10 aa, Artificial Sequence
  Description of Artificial Sequence: Synthetic peptide
  Seed: ALDGGNKHFL (PMEL_HUMAN)
ASDGGNKHFV

SEQ ID NO: 138684 - protein, 9 aa, Artificial Sequence
  Description of Artificial Sequence: Synthetic peptide
  Seed: AEADLSYTW (PMEL_HUMAN)
AEADLSYTL

SEQ ID NO: 138685 - protein, 10 aa, Artificial Sequence
  Description of Artificial Sequence: Synthetic peptide
  Seed: AEMSTPEATG (PMEL_HUMAN)
AEMSTPEATW

SEQ ID NO: 138686 - protein, 11 aa, Artificial Sequence
  Description of Artificial Sequence: Synthetic peptide
  Seed: RYGSFSVTLDI (PMEL_HUMAN)
RQGSFSVTLDF

SEQ ID NO: 138687 - protein, 10 aa, Artificial Sequence
  Description of Artificial Sequence: Synthetic peptide
  Seed: YVPLAHSSSA (PMEL_HUMAN)
YIPLAHSSSI

SEQ ID NO: 138688 - protein, 9 aa, Artificial Sequence
  Description of Artificial Sequence: Synthetic peptide
  Seed: MEVTVYHRR (PMEL_HUMAN)
MVVTVYHRY

SEQ ID NO: 138689 - protein, 9 aa, Artificial Sequence
  Description of Artificial Sequence: Synthetic peptide
  Seed: SEVMGTTLA (PMEL_HUMAN)
SEVMGTTLC

SEQ ID NO: 138690 - protein, 11 aa, Artificial Sequence
  Description of Artificial Sequence: Synthetic peptide
  Seed: LGPLLDGTATL (PMEL_HUMAN)
LPPLLDGTATV

SEQ ID NO: 138691 - protein, 10 aa, Artificial Sequence
  Description of Artificial Sequence: Synthetic peptide
  Seed: ESAEILQAVP (PMEL_HUMAN)
EVAEILQAVI

SEQ ID NO: 138692 - protein, 9 aa, Artificial Sequence
  Description of Artificial Sequence: Synthetic peptide
  Seed: FTITDQVPF (PMEL_HUMAN)
FFITDQVPW

SEQ ID NO: 138693 - protein, 10 aa, Artificial Sequence
  Description of Artificial Sequence: Synthetic peptide
  Seed: SVPQLPHSSS (PMEL_HUMAN)
SCPQLPHSSM

SEQ ID NO: 138694 - protein, 10 aa, Artificial Sequence
  Description of Artificial Sequence: Synthetic peptide
  Seed: MTPAEVSIVV (PMEL_HUMAN)
MQPAEVSIVM

SEQ ID NO: 138695 - protein, 10 aa, Artificial Sequence
  Description of Artificial Sequence: Synthetic peptide
  Seed: SSHWLRLPRI (PMEL_HUMAN)
SMHWLRLPRR

SEQ ID NO: 138696 - protein, 10 aa, Artificial Sequence
  Description of Artificial Sequence: Synthetic peptide
  Seed: SVPQLPHSSS (PMEL_HUMAN)
SVPQLPHSSV

SEQ ID NO: 138697 - protein, 9 aa, Artificial Sequence
  Description of Artificial Sequence: Synthetic peptide
  Seed: FLRNQPLTF (PMEL_HUMAN)
FRRNQPLTV

SEQ ID NO: 138698 - protein, 9 aa, Artificial Sequence
  Description of Artificial Sequence: Synthetic peptide
  Seed: VSVSQLRAL (PMEL_HUMAN)
VAVSQLRAI

SEQ ID NO: 138699 - protein, 9 aa, Artificial Sequence
  Description of Artificial Sequence: Synthetic peptide
  Seed: RGGQVSLKV (PMEL_HUMAN)
RLGQVSLKL

SEQ ID NO: 138700 - protein, 9 aa, Artificial Sequence
  Description of Artificial Sequence: Synthetic peptide
  Seed: HTMEVTVYH (PMEL_HUMAN)
HPMEVTVYM

SEQ ID NO: 138701 - protein, 10 aa, Artificial Sequence
  Description of Artificial Sequence: Synthetic peptide
  Seed: WSQKRSFVYV (PMEL_HUMAN)
WMQKRSFVYK

SEQ ID NO: 138702 - protein, 9 aa, Artificial Sequence
  Description of Artificial Sequence: Synthetic peptide
  Seed: SLGPLLDGT (PMEL_HUMAN)
SIGPLLDGI

SEQ ID NO: 138703 - protein, 10 aa, Artificial Sequence
  Description of Artificial Sequence: Synthetic peptide
  Seed: ASSIMSTESI (PMEL_HUMAN)
AFSIMSTESF

SEQ ID NO: 138704 - protein, 9 aa, Artificial Sequence
  Description of Artificial Sequence: Synthetic peptide
  Seed: ITDQVPFSV (PMEL_HUMAN)
ISDQVPFSM

SEQ ID NO: 138705 - protein, 10 aa, Artificial Sequence
  Description of Artificial Sequence: Synthetic peptide
  Seed: RQLYPEWTEA (PMEL_HUMAN)
RHLYPEWTEI

SEQ ID NO: 138706 - protein, 10 aa, Artificial Sequence
  Description of Artificial Sequence: Synthetic peptide
  Seed: SVPQLPHSSS (PMEL_HUMAN)
SGPQLPHSSF

SEQ ID NO: 138707 - protein, 9 aa, Artificial Sequence
  Description of Artificial Sequence: Synthetic peptide
  Seed: TLIGANASF (PMEL_HUMAN)
TLIGANASY

SEQ ID NO: 138708 - protein, 9 aa, Artificial Sequence
  Description of Artificial Sequence: Synthetic peptide
  Seed: KQDFSVPQL (PMEL_HUMAN)
KNDFSVPQM

SEQ ID NO: 138709 - protein, 9 aa, Artificial Sequence
  Description of Artificial Sequence: Synthetic peptide
  Seed: YLEPGPVTA (PMEL_HUMAN)
YGEPGPVTY

SEQ ID NO: 138710 - protein, 9 aa, Artificial Sequence
  Description of Artificial Sequence: Synthetic peptide
  Seed: DQVPFSVSV (PMEL_HUMAN)
DEVPFSVSY

SEQ ID NO: 138711 - protein, 9 aa, Artificial Sequence
  Description of Artificial Sequence: Synthetic peptide
  Seed: ASFSIALNF (PMEL_HUMAN)
AIFSIALNY

SEQ ID NO: 138712 - protein, 10 aa, Artificial Sequence
  Description of Artificial Sequence: Synthetic peptide
  Seed: EVISTAPVQM (PMEL_HUMAN)
ETISTAPVQW

SEQ ID NO: 138713 - protein, 11 aa, Artificial Sequence
  Description of Artificial Sequence: Synthetic peptide
  Seed: FGDSSGTLISR (PMEL_HUMAN)
FGDSSGTLISV

SEQ ID NO: 138714 - protein, 10 aa, Artificial Sequence
  Description of Artificial Sequence: Synthetic peptide
  Seed: RGSRSYVPLA (PMEL_HUMAN)
RRSRSYVPLL

SEQ ID NO: 138715 - protein, 10 aa, Artificial Sequence
  Description of Artificial Sequence: Synthetic peptide
  Seed: IESAEILQAV (PMEL_HUMAN)
ILSAEILQAT

SEQ ID NO: 138716 - protein, 11 aa, Artificial Sequence
  Description of Artificial Sequence: Synthetic peptide
  Seed: RALDGGNKHFL (PMEL_HUMAN)
RELDGGNKHFF

SEQ ID NO: 138717 - protein, 10 aa, Artificial Sequence
  Description of Artificial Sequence: Synthetic peptide
  Seed: LIVGILLVLM (PMEL_HUMAN)
LLVGILLVLV

SEQ ID NO: 138718 - protein, 10 aa, Artificial Sequence
  Description of Artificial Sequence: Synthetic peptide
  Seed: KRQVPLDCVL (PMEL_HUMAN)
KNQVPLDCVM

SEQ ID NO: 138719 - protein, 9 aa, Artificial Sequence
  Description of Artificial Sequence: Synthetic peptide
  Seed: TMEVTVYHR (PMEL_HUMAN)
TVEVTVYHY

SEQ ID NO: 138720 - protein, 10 aa, Artificial Sequence
  Description of Artificial Sequence: Synthetic peptide
  Seed: THTMEVTVYH (PMEL_HUMAN)
TFTMEVTVYR

SEQ ID NO: 138721 - protein, 9 aa, Artificial Sequence
  Description of Artificial Sequence: Synthetic peptide
  Seed: VLMAVVLAS (PMEL_HUMAN)
VSMAVVLAI

SEQ ID NO: 138722 - protein, 9 aa, Artificial Sequence
  Description of Artificial Sequence: Synthetic peptide
  Seed: VVLQAAIPL (PMEL_HUMAN)
VELQAAIPM

SEQ ID NO: 138723 - protein, 9 aa, Artificial Sequence
  Description of Artificial Sequence: Synthetic peptide
  Seed: SQKRSFVYV (PMEL_HUMAN)
SQKRSFVYL

SEQ ID NO: 138724 - protein, 9 aa, Artificial Sequence
  Description of Artificial Sequence: Synthetic peptide
  Seed: LHDPSGYLA (PMEL_HUMAN)
LHDPSGYLF

SEQ ID NO: 138725 - protein, 9 aa, Artificial Sequence
  Description of Artificial Sequence: Synthetic peptide
  Seed: QVIWVNNTI (PMEL_HUMAN)
QQIWVNNTL

SEQ ID NO: 138726 - protein, 9 aa, Artificial Sequence
  Description of Artificial Sequence: Synthetic peptide
  Seed: WQVLGGPVS (PMEL_HUMAN)
WAVLGGPVM

SEQ ID NO: 138727 - protein, 10 aa, Artificial Sequence
  Description of Artificial Sequence: Synthetic peptide
  Seed: RSFVYVWKTW (PMEL_HUMAN)
RPFVYVWKTF

SEQ ID NO: 138728 - protein, 9 aa, Artificial Sequence
  Description of Artificial Sequence: Synthetic peptide
  Seed: VSLADTNSL (PMEL_HUMAN)
VQLADTNSV

SEQ ID NO: 138729 - protein, 9 aa, Artificial Sequence
  Description of Artificial Sequence: Synthetic peptide
  Seed: TLIGANASF (PMEL_HUMAN)
TIIGANASL

SEQ ID NO: 138730 - protein, 9 aa, Artificial Sequence
  Description of Artificial Sequence: Synthetic peptide
  Seed: FGDSSGTLI (PMEL_HUMAN)
FADSSGTLI

SEQ ID NO: 138731 - protein, 11 aa, Artificial Sequence
  Description of Artificial Sequence: Synthetic peptide
  Seed: LGPLLDGTATL (PMEL_HUMAN)
LLPLLDGTATI

SEQ ID NO: 138732 - protein, 9 aa, Artificial Sequence
  Description of Artificial Sequence: Synthetic peptide
  Seed: SGLSIGTGR (PMEL_HUMAN)
SALSIGTGY

SEQ ID NO: 138733 - protein, 9 aa, Artificial Sequence
  Description of Artificial Sequence: Synthetic peptide
  Seed: ESTGMTPEK (PMEL_HUMAN)
ELTGMTPEK

SEQ ID NO: 138734 - protein, 9 aa, Artificial Sequence
  Description of Artificial Sequence: Synthetic peptide
  Seed: VLASLIYRR (PMEL_HUMAN)
VVASLIYRK

SEQ ID NO: 138735 - protein, 10 aa, Artificial Sequence
  Description of Artificial Sequence: Synthetic peptide
  Seed: YRYGSFSVTL (PMEL_HUMAN)
YLYGSFSVTI

SEQ ID NO: 138736 - protein, 9 aa, Artificial Sequence
  Description of Artificial Sequence: Synthetic peptide
  Seed: YLEPGPVTA (PMEL_HUMAN)
YPEPGPVTT

SEQ ID NO: 138737 - protein, 10 aa, Artificial Sequence
  Description of Artificial Sequence: Synthetic peptide
  Seed: HFLRNQPLTF (PMEL_HUMAN)
HYLRNQPLTW

SEQ ID NO: 138738 - protein, 9 aa, Artificial Sequence
  Description of Artificial Sequence: Synthetic peptide
  Seed: LYRYGSFSV (PMEL_HUMAN)
LYRYGSFSK

SEQ ID NO: 138739 - protein, 10 aa, Artificial Sequence
  Description of Artificial Sequence: Synthetic peptide
  Seed: GPLLDGTATL (PMEL_HUMAN)
GSLLDGTATM

SEQ ID NO: 138740 - protein, 9 aa, Artificial Sequence
  Description of Artificial Sequence: Synthetic peptide
  Seed: TTAAQVTTT (PMEL_HUMAN)
TTAAQVTTA

SEQ ID NO: 138741 - protein, 9 aa, Artificial Sequence
  Description of Artificial Sequence: Synthetic peptide
  Seed: HTMEVTVYH (PMEL_HUMAN)
HVMEVTVYK

SEQ ID NO: 138742 - protein, 10 aa, Artificial Sequence
  Description of Artificial Sequence: Synthetic peptide
  Seed: RALVVTHTYL (PMEL_HUMAN)
RFLVVTHTYY

SEQ ID NO: 138743 - protein, 10 aa, Artificial Sequence
  Description of Artificial Sequence: Synthetic peptide
  Seed: LVLMAVVLAS (PMEL_HUMAN)
LLLMAVVLAL

SEQ ID NO: 138744 - protein, 9 aa, Artificial Sequence
  Description of Artificial Sequence: Synthetic peptide
  Seed: MTPAEVSIV (PMEL_HUMAN)
MMPAEVSIA

SEQ ID NO: 138745 - protein, 9 aa, Artificial Sequence
  Description of Artificial Sequence: Synthetic peptide
  Seed: VPLIVGILL (PMEL_HUMAN)
VPLIVGILW

SEQ ID NO: 138746 - protein, 9 aa, Artificial Sequence
  Description of Artificial Sequence: Synthetic peptide
  Seed: KHFLRNQPL (PMEL_HUMAN)
KGFLRNQPY

SEQ ID NO: 138747 - protein, 9 aa, Artificial Sequence
  Description of Artificial Sequence: Synthetic peptide
  Seed: FPDGGPCPS (PMEL_HUMAN)
FSDGGPCPF

SEQ ID NO: 138748 - protein, 9 aa, Artificial Sequence
  Description of Artificial Sequence: Synthetic peptide
  Seed: LPDGQVIWV (PMEL_HUMAN)
LIDGQVIWF

SEQ ID NO: 138749 - protein, 9 aa, Artificial Sequence
  Description of Artificial Sequence: Synthetic peptide
  Seed: AVVSTQLIM (PMEL_HUMAN)
ARVSTQLIF

SEQ ID NO: 138750 - protein, 9 aa, Artificial Sequence
  Description of Artificial Sequence: Synthetic peptide
  Seed: YHRRGSRSY (PMEL_HUMAN)
YYRRGSRSL

SEQ ID NO: 138751 - protein, 9 aa, Artificial Sequence
  Description of Artificial Sequence: Synthetic peptide
  Seed: TTDGHRPTA (PMEL_HUMAN)
TMDGHRPTL

SEQ ID NO: 138752 - protein, 9 aa, Artificial Sequence
  Description of Artificial Sequence: Synthetic peptide
  Seed: RLVKRQVPL (PMEL_HUMAN)
RPVKRQVPA

SEQ ID NO: 138753 - protein, 9 aa, Artificial Sequence
  Description of Artificial Sequence: Synthetic peptide
  Seed: KTWGQYWQV (PMEL_HUMAN)
KGWGQYWQF

SEQ ID NO: 138754 - protein, 9 aa, Artificial Sequence
  Description of Artificial Sequence: Synthetic peptide
  Seed: VVLQAAIPL (PMEL_HUMAN)
VPLQAAIPM

SEQ ID NO: 138755 - protein, 10 aa, Artificial Sequence
  Description of Artificial Sequence: Synthetic peptide
  Seed: VPQLPHSSSH (PMEL_HUMAN)
VHQLPHSSSM

SEQ ID NO: 138756 - protein, 10 aa, Artificial Sequence
  Description of Artificial Sequence: Synthetic peptide
  Seed: ALLAVGATKV (PMEL_HUMAN)
ALLAVGATKI

SEQ ID NO: 138757 - protein, 9 aa, Artificial Sequence
  Description of Artificial Sequence: Synthetic peptide
  Seed: SVPQLPHSS (PMEL_HUMAN)
SGPQLPHSI

SEQ ID NO: 138758 - protein, 10 aa, Artificial Sequence
  Description of Artificial Sequence: Synthetic peptide
  Seed: RQLRTKAWNR (PMEL_HUMAN)
RRLRTKAWNR

SEQ ID NO: 138759 - protein, 10 aa, Artificial Sequence
  Description of Artificial Sequence: Synthetic peptide
  Seed: IESAEILQAV (PMEL_HUMAN)
IESAEILQAM

SEQ ID NO: 138760 - protein, 10 aa, Artificial Sequence
  Description of Artificial Sequence: Synthetic peptide
  Seed: SSAFTITDQV (PMEL_HUMAN)
SLAFTITDQA

SEQ ID NO: 138761 - protein, 9 aa, Artificial Sequence
  Description of Artificial Sequence: Synthetic peptide
  Seed: SQKRSFVYV (PMEL_HUMAN)
SLKRSFVYK

SEQ ID NO: 138762 - protein, 9 aa, Artificial Sequence
  Description of Artificial Sequence: Synthetic peptide
  Seed: LNFPGSQKV (PMEL_HUMAN)
LRFPGSQKL

SEQ ID NO: 138763 - protein, 9 aa, Artificial Sequence
  Description of Artificial Sequence: Synthetic peptide
  Seed: RALVVTHTY (PMEL_HUMAN)
RVLVVTHTI

SEQ ID NO: 138764 - protein, 9 aa, Artificial Sequence
  Description of Artificial Sequence: Synthetic peptide
  Seed: ILKGGSGTY (PMEL_HUMAN)
ITKGGSGTY

SEQ ID NO: 138765 - protein, 9 aa, Artificial Sequence
  Description of Artificial Sequence: Synthetic peptide
  Seed: MAVVLASLI (PMEL_HUMAN)
MTVVLASLY

SEQ ID NO: 138766 - protein, 9 aa, Artificial Sequence
  Description of Artificial Sequence: Synthetic peptide
  Seed: WQVLGGPVS (PMEL_HUMAN)
WKVLGGPVL

SEQ ID NO: 138767 - protein, 9 aa, Artificial Sequence
  Description of Artificial Sequence: Synthetic peptide
  Seed: VISTAPVQM (PMEL_HUMAN)
VQSTAPVQW

SEQ ID NO: 138768 - protein, 9 aa, Artificial Sequence
  Description of Artificial Sequence: Synthetic peptide
  Seed: FPDGGPCPS (PMEL_HUMAN)
FPDGGPCPM

SEQ ID NO: 138769 - protein, 10 aa, Artificial Sequence
  Description of Artificial Sequence: Synthetic peptide
  Seed: SSSHWLRLPR (PMEL_HUMAN)
SWSHWLRLPK

SEQ ID NO: 138770 - protein, 8 aa, Artificial Sequence
  Description of Artificial Sequence: Synthetic peptide
  Seed: RELPIPEP (PMEL_HUMAN)
RELPIPEI

SEQ ID NO: 138771 - protein, 9 aa, Artificial Sequence
  Description of Artificial Sequence: Synthetic peptide
  Seed: HTMEVTVYH (PMEL_HUMAN)
HHMEVTVYY

SEQ ID NO: 138772 - protein, 9 aa, Artificial Sequence
  Description of Artificial Sequence: Synthetic peptide
  Seed: KTWGQYWQV (PMEL_HUMAN)
KLWGQYWQM

SEQ ID NO: 138773 - protein, 9 aa, Artificial Sequence
  Description of Artificial Sequence: Synthetic peptide
  Seed: ESAEILQAV (PMEL_HUMAN)
EVAEILQAV

SEQ ID NO: 138774 - protein, 9 aa, Artificial Sequence
  Description of Artificial Sequence: Synthetic peptide
  Seed: FGDSSGTLI (PMEL_HUMAN)
FIDSSGTLM

SEQ ID NO: 138775 - protein, 11 aa, Artificial Sequence
  Description of Artificial Sequence: Synthetic peptide
  Seed: RRRLMKQDFSV (PMEL_HUMAN)
RRRLMKQDFSK

SEQ ID NO: 138776 - protein, 9 aa, Artificial Sequence
  Description of Artificial Sequence: Synthetic peptide
  Seed: IMPGQEAGL (PMEL_HUMAN)
ITPGQEAGL

SEQ ID NO: 138777 - protein, 9 aa, Artificial Sequence
  Description of Artificial Sequence: Synthetic peptide
  Seed: SVQVPTTEV (PMEL_HUMAN)
SMQVPTTEV

SEQ ID NO: 138778 - protein, 10 aa, Artificial Sequence
  Description of Artificial Sequence: Synthetic peptide
  Seed: TSVQVPTTEV (PMEL_HUMAN)
TVVQVPTTEV

SEQ ID NO: 138779 - protein, 9 aa, Artificial Sequence
  Description of Artificial Sequence: Synthetic peptide
  Seed: YLAEADLSY (PMEL_HUMAN)
YAAEADLSY

SEQ ID NO: 138780 - protein, 10 aa, Artificial Sequence
  Description of Artificial Sequence: Synthetic peptide
  Seed: SLIYRRRLMK (PMEL_HUMAN)
SWIYRRRLMR

SEQ ID NO: 138781 - protein, 10 aa, Artificial Sequence
  Description of Artificial Sequence: Synthetic peptide
  Seed: GSFSVTLDIV (PMEL_HUMAN)
GMFSVTLDIV

SEQ ID NO: 138782 - protein, 9 aa, Artificial Sequence
  Description of Artificial Sequence: Synthetic peptide
  Seed: FGDSSGTLI (PMEL_HUMAN)
FSDSSGTLC

SEQ ID NO: 138783 - protein, 11 aa, Artificial Sequence
  Description of Artificial Sequence: Synthetic peptide
  Seed: AEMSTPEATGM (PMEL_HUMAN)
AEMSTPEATGW

SEQ ID NO: 138784 - protein, 10 aa, Artificial Sequence
  Description of Artificial Sequence: Synthetic peptide
  Seed: RALVVTHTYL (PMEL_HUMAN)
RMLVVTHTYW

SEQ ID NO: 138785 - protein, 10 aa, Artificial Sequence
  Description of Artificial Sequence: Synthetic peptide
  Seed: LSIGTGRAML (PMEL_HUMAN)
LAIGTGRAMM

SEQ ID NO: 138786 - protein, 11 aa, Artificial Sequence
  Description of Artificial Sequence: Synthetic peptide
  Seed: YLAEADLSYTW (PMEL_HUMAN)
YMAEADLSYTL

SEQ ID NO: 138787 - protein, 9 aa, Artificial Sequence
  Description of Artificial Sequence: Synthetic peptide
  Seed: YLAEADLSY (PMEL_HUMAN)
YGAEADLSL

SEQ ID NO: 138788 - protein, 9 aa, Artificial Sequence
  Description of Artificial Sequence: Synthetic peptide
  Seed: STAPVQMPT (PMEL_HUMAN)
SAAPVQMPA

SEQ ID NO: 138789 - protein, 9 aa, Artificial Sequence
  Description of Artificial Sequence: Synthetic peptide
  Seed: GGPVSGLSI (PMEL_HUMAN)
GAPVSGLSL

SEQ ID NO: 138790 - protein, 9 aa, Artificial Sequence
  Description of Artificial Sequence: Synthetic peptide
  Seed: RAMLGTHTM (PMEL_HUMAN)
RKMLGTHTH

SEQ ID NO: 138791 - protein, 9 aa, Artificial Sequence
  Description of Artificial Sequence: Synthetic peptide
  Seed: AEPSGTTSV (PMEL_HUMAN)
AVPSGTTSY

SEQ ID NO: 138792 - protein, 9 aa, Artificial Sequence
  Description of Artificial Sequence: Synthetic peptide
  Seed: VLPSPACQL (PMEL_HUMAN)
VSPSPACQI

SEQ ID NO: 138793 - protein, 9 aa, Artificial Sequence
  Description of Artificial Sequence: Synthetic peptide
  Seed: RALDGGNKH (PMEL_HUMAN)
RQLDGGNKM

SEQ ID NO: 138794 - protein, 9 aa, Artificial Sequence
  Description of Artificial Sequence: Synthetic peptide
  Seed: VSVSQLRAL (PMEL_HUMAN)
VMVSQLRAY

SEQ ID NO: 138795 - protein, 8 aa, Artificial Sequence
  Description of Artificial Sequence: Synthetic peptide
  Seed: HTMEVTVY (PMEL_HUMAN)
HAMEVTVY

SEQ ID NO: 138796 - protein, 9 aa, Artificial Sequence
  Description of Artificial Sequence: Synthetic peptide
  Seed: LHLAVIGAL (PMEL_HUMAN)
LQLAVIGAL

SEQ ID NO: 138797 - protein, 9 aa, Artificial Sequence
  Description of Artificial Sequence: Synthetic peptide
  Seed: LIYRRRLMK (PMEL_HUMAN)
LGYRRRLMK

SEQ ID NO: 138798 - protein, 9 aa, Artificial Sequence
  Description of Artificial Sequence: Synthetic peptide
  Seed: VLYRYGSFS (PMEL_HUMAN)
VMYRYGSFA

SEQ ID NO: 138799 - protein, 9 aa, Artificial Sequence
  Description of Artificial Sequence: Synthetic peptide
  Seed: FGDSSGTLI (PMEL_HUMAN)
FGDSSGTLV

SEQ ID NO: 138800 - protein, 10 aa, Artificial Sequence
  Description of Artificial Sequence: Synthetic peptide
  Seed: VPQLPHSSSH (PMEL_HUMAN)
VLQLPHSSSL

SEQ ID NO: 138801 - protein, 10 aa, Artificial Sequence
  Description of Artificial Sequence: Synthetic peptide
  Seed: TYLEPGPVTA (PMEL_HUMAN)
TRLEPGPVTA

SEQ ID NO: 138802 - protein, 10 aa, Artificial Sequence
  Description of Artificial Sequence: Synthetic peptide
  Seed: SSHWLRLPRI (PMEL_HUMAN)
SFHWLRLPRR

SEQ ID NO: 138803 - protein, 9 aa, Artificial Sequence
  Description of Artificial Sequence: Synthetic peptide
  Seed: YHRRGSRSY (PMEL_HUMAN)
YKRRGSRSY

SEQ ID NO: 138804 - protein, 9 aa, Artificial Sequence
  Description of Artificial Sequence: Synthetic peptide
  Seed: KTWGQYWQV (PMEL_HUMAN)
KYWGQYWQY

SEQ ID NO: 138805 - protein, 9 aa, Artificial Sequence
  Description of Artificial Sequence: Synthetic peptide
  Seed: VTAQVVLQA (PMEL_HUMAN)
VMAQVVLQA

SEQ ID NO: 138806 - protein, 9 aa, Artificial Sequence
  Description of Artificial Sequence: Synthetic peptide
  Seed: AVIGALLAV (PMEL_HUMAN)
AQIGALLAT

SEQ ID NO: 138807 - protein, 9 aa, Artificial Sequence
  Description of Artificial Sequence: Synthetic peptide
  Seed: VLPSPACQL (PMEL_HUMAN)
VSPSPACQV

SEQ ID NO: 138808 - protein, 9 aa, Artificial Sequence
  Description of Artificial Sequence: Synthetic peptide
  Seed: LMAVVLASL (PMEL_HUMAN)
LPAVVLASM

SEQ ID NO: 138809 - protein, 10 aa, Artificial Sequence
  Description of Artificial Sequence: Synthetic peptide
  Seed: VLASLIYRRR (PMEL_HUMAN)
VAASLIYRRR

SEQ ID NO: 138810 - protein, 10 aa, Artificial Sequence
  Description of Artificial Sequence: Synthetic peptide
  Seed: IFPDGGPCPS (PMEL_HUMAN)
IYPDGGPCPM

SEQ ID NO: 138811 - protein, 11 aa, Artificial Sequence
  Description of Artificial Sequence: Synthetic peptide
  Seed: FSVTLDIVQGI (PMEL_HUMAN)
FPVTLDIVQGV

SEQ ID NO: 138812 - protein, 11 aa, Artificial Sequence
  Description of Artificial Sequence: Synthetic peptide
  Seed: RQVPLDCVLYR (PMEL_HUMAN)
RKVPLDCVLYY

SEQ ID NO: 138813 - protein, 9 aa, Artificial Sequence
  Description of Artificial Sequence: Synthetic peptide
  Seed: TIINGSQVW (PMEL_HUMAN)
TTINGSQVW

SEQ ID NO: 138814 - protein, 10 aa, Artificial Sequence
  Description of Artificial Sequence: Synthetic peptide
  Seed: LNFPGSQKVL (PMEL_HUMAN)
LAFPGSQKVY

SEQ ID NO: 138815 - protein, 9 aa, Artificial Sequence
  Description of Artificial Sequence: Synthetic peptide
  Seed: DQVPFSVSV (PMEL_HUMAN)
DVVPFSVSV

SEQ ID NO: 138816 - protein, 10 aa, Artificial Sequence
  Description of Artificial Sequence: Synthetic peptide
  Seed: RTKAWNRQLY (PMEL_HUMAN)
RTKAWNRQLV

SEQ ID NO: 138817 - protein, 9 aa, Artificial Sequence
  Description of Artificial Sequence: Synthetic peptide
  Seed: GGPVSGLSI (PMEL_HUMAN)
GSPVSGLSI

SEQ ID NO: 138818 - protein, 9 aa, Artificial Sequence
  Description of Artificial Sequence: Synthetic peptide
  Seed: LNFPGSQKV (PMEL_HUMAN)
LIFPGSQKY

SEQ ID NO: 138819 - protein, 9 aa, Artificial Sequence
  Description of Artificial Sequence: Synthetic peptide
  Seed: LADTNSLAV (PMEL_HUMAN)
LVDTNSLAI

SEQ ID NO: 138820 - protein, 8 aa, Artificial Sequence
  Description of Artificial Sequence: Synthetic peptide
  Seed: FGDSSGTL (PMEL_HUMAN)
FLDSSGTM

SEQ ID NO: 138821 - protein, 9 aa, Artificial Sequence
  Description of Artificial Sequence: Synthetic peptide
  Seed: RTKAWNRQL (PMEL_HUMAN)
RVKAWNRQR

SEQ ID NO: 138822 - protein, 10 aa, Artificial Sequence
  Description of Artificial Sequence: Synthetic peptide
  Seed: FLRNQPLTFA (PMEL_HUMAN)
FLRNQPLTFI

SEQ ID NO: 138823 - protein, 10 aa, Artificial Sequence
  Description of Artificial Sequence: Synthetic peptide
  Seed: SLIYRRRLMK (PMEL_HUMAN)
SKIYRRRLMR

SEQ ID NO: 138824 - protein, 10 aa, Artificial Sequence
  Description of Artificial Sequence: Synthetic peptide
  Seed: VYHRRGSRSY (PMEL_HUMAN)
VQHRRGSRSF

SEQ ID NO: 138825 - protein, 9 aa, Artificial Sequence
  Description of Artificial Sequence: Synthetic peptide
  Seed: DSSGTLISR (PMEL_HUMAN)
DISGTLISR

SEQ ID NO: 138826 - protein, 11 aa, Artificial Sequence
  Description of Artificial Sequence: Synthetic peptide
  Seed: DCWRGGQVSLK (PMEL_HUMAN)
DSWRGGQVSLK

SEQ ID NO: 138827 - protein, 9 aa, Artificial Sequence
  Description of Artificial Sequence: Synthetic peptide
  Seed: MAVVLASLI (PMEL_HUMAN)
MSVVLASLF

SEQ ID NO: 138828 - protein, 9 aa, Artificial Sequence
  Description of Artificial Sequence: Synthetic peptide
  Seed: RYGSFSVTL (PMEL_HUMAN)
RRGSFSVTI

SEQ ID NO: 138829 - protein, 9 aa, Artificial Sequence
  Description of Artificial Sequence: Synthetic peptide
  Seed: HTMEVTVYH (PMEL_HUMAN)
HAMEVTVYL

SEQ ID NO: 138830 - protein, 10 aa, Artificial Sequence
  Description of Artificial Sequence: Synthetic peptide
  Seed: LMAVVLASLI (PMEL_HUMAN)
LMAVVLASLA

SEQ ID NO: 138831 - protein, 10 aa, Artificial Sequence
  Description of Artificial Sequence: Synthetic peptide
  Seed: LVLMAVVLAS (PMEL_HUMAN)
LPLMAVVLAI

SEQ ID NO: 138832 - protein, 10 aa, Artificial Sequence
  Description of Artificial Sequence: Synthetic peptide
  Seed: LLDGTATLRL (PMEL_HUMAN)
LIDGTATLRL

SEQ ID NO: 138833 - protein, 9 aa, Artificial Sequence
  Description of Artificial Sequence: Synthetic peptide
  Seed: SSIMSTESI (PMEL_HUMAN)
SKIMSTESF

SEQ ID NO: 138834 - protein, 10 aa, Artificial Sequence
  Description of Artificial Sequence: Synthetic peptide
  Seed: EVMGTTLAEM (PMEL_HUMAN)
EQMGTTLAEK

SEQ ID NO: 138835 - protein, 11 aa, Artificial Sequence
  Description of Artificial Sequence: Synthetic peptide
  Seed: YVPLAHSSSAF (PMEL_HUMAN)
YQPLAHSSSAM

SEQ ID NO: 138836 - protein, 9 aa, Artificial Sequence
  Description of Artificial Sequence: Synthetic peptide
  Seed: SQKRSFVYV (PMEL_HUMAN)
SVKRSFVYG

SEQ ID NO: 138837 - protein, 9 aa, Artificial Sequence
  Description of Artificial Sequence: Synthetic peptide
  Seed: YLAEADLSY (PMEL_HUMAN)
YCAEADLSF

SEQ ID NO: 138838 - protein, 9 aa, Artificial Sequence
  Description of Artificial Sequence: Synthetic peptide
  Seed: ITDQVPFSV (PMEL_HUMAN)
ILDQVPFSI

SEQ ID NO: 138839 - protein, 11 aa, Artificial Sequence
  Description of Artificial Sequence: Synthetic peptide
  Seed: YLAEADLSYTW (PMEL_HUMAN)
YLAEADLSYTM

SEQ ID NO: 138840 - protein, 10 aa, Artificial Sequence
  Description of Artificial Sequence: Synthetic peptide
  Seed: IALNFPGSQK (PMEL_HUMAN)
IALNFPGSQR

SEQ ID NO: 138841 - protein, 8 aa, Artificial Sequence
  Description of Artificial Sequence: Synthetic peptide
  Seed: RSFVYVWK (PMEL_HUMAN)
RTFVYVWR

SEQ ID NO: 138842 - protein, 9 aa, Artificial Sequence
  Description of Artificial Sequence: Synthetic peptide
  Seed: SLAVVSTQL (PMEL_HUMAN)
SQAVVSTQF

SEQ ID NO: 138843 - protein, 9 aa, Artificial Sequence
  Description of Artificial Sequence: Synthetic peptide
  Seed: TLISRALVV (PMEL_HUMAN)
TQISRALVF

SEQ ID NO: 138844 - protein, 10 aa, Artificial Sequence
  Description of Artificial Sequence: Synthetic peptide
  Seed: LAVIGALLAV (PMEL_HUMAN)
LKVIGALLAI

SEQ ID NO: 138845 - protein, 10 aa, Artificial Sequence
  Description of Artificial Sequence: Synthetic peptide
  Seed: IALNFPGSQK (PMEL_HUMAN)
IFLNFPGSQR

SEQ ID NO: 138846 - protein, 9 aa, Artificial Sequence
  Description of Artificial Sequence: Synthetic peptide
  Seed: SITGSLGPL (PMEL_HUMAN)
SVTGSLGPV

SEQ ID NO: 138847 - protein, 9 aa, Artificial Sequence
  Description of Artificial Sequence: Synthetic peptide
  Seed: LTSCGSSPV (PMEL_HUMAN)
LSSCGSSPM

SEQ ID NO: 138848 - protein, 9 aa, Artificial Sequence
  Description of Artificial Sequence: Synthetic peptide
  Seed: ESAEILQAV (PMEL_HUMAN)
ELAEILQAM

SEQ ID NO: 138849 - protein, 10 aa, Artificial Sequence
  Description of Artificial Sequence: Synthetic peptide
  Seed: LIMPGQEAGL (PMEL_HUMAN)
LQMPGQEAGW

SEQ ID NO: 138850 - protein, 9 aa, Artificial Sequence
  Description of Artificial Sequence: Synthetic peptide
  Seed: AQVTTTEWV (PMEL_HUMAN)
ALVTTTEWV

SEQ ID NO: 138851 - protein, 11 aa, Artificial Sequence
  Description of Artificial Sequence: Synthetic peptide
  Seed: RRGSRSYVPLA (PMEL_HUMAN)
RLGSRSYVPLA

SEQ ID NO: 138852 - protein, 10 aa, Artificial Sequence
  Description of Artificial Sequence: Synthetic peptide
  Seed: RSFVYVWKTW (PMEL_HUMAN)
RKFVYVWKTF

SEQ ID NO: 138853 - protein, 9 aa, Artificial Sequence
  Description of Artificial Sequence: Synthetic peptide
  Seed: SSIMSTESI (PMEL_HUMAN)
SLIMSTESF

SEQ ID NO: 138854 - protein, 9 aa, Artificial Sequence
  Description of Artificial Sequence: Synthetic peptide
  Seed: ALLAVGATK (PMEL_HUMAN)
AFLAVGATR

SEQ ID NO: 138855 - protein, 10 aa, Artificial Sequence
  Description of Artificial Sequence: Synthetic peptide
  Seed: YVPLAHSSSA (PMEL_HUMAN)
YLPLAHSSSI

SEQ ID NO: 138856 - protein, 10 aa, Artificial Sequence
  Description of Artificial Sequence: Synthetic peptide
  Seed: VLMAVVLASL (PMEL_HUMAN)
VKMAVVLASL

SEQ ID NO: 138857 - protein, 10 aa, Artificial Sequence
  Description of Artificial Sequence: Synthetic peptide
  Seed: SIVVLSGTTA (PMEL_HUMAN)
SLVVLSGTTV

SEQ ID NO: 138858 - protein, 9 aa, Artificial Sequence
  Description of Artificial Sequence: Synthetic peptide
  Seed: AHSSSAFTI (PMEL_HUMAN)
AHSSSAFTM

SEQ ID NO: 138859 - protein, 11 aa, Artificial Sequence
  Description of Artificial Sequence: Synthetic peptide
  Seed: CVLYRYGSFSV (PMEL_HUMAN)
CSLYRYGSFSV

SEQ ID NO: 138860 - protein, 9 aa, Artificial Sequence
  Description of Artificial Sequence: Synthetic peptide
  Seed: DAFELTVSC (PMEL_HUMAN)
DVFELTVSY

SEQ ID NO: 138861 - protein, 9 aa, Artificial Sequence
  Description of Artificial Sequence: Synthetic peptide
  Seed: LLAVGATKV (PMEL_HUMAN)
LVAVGATKI

SEQ ID NO: 138862 - protein, 9 aa, Artificial Sequence
  Description of Artificial Sequence: Synthetic peptide
  Seed: VISTAPVQM (PMEL_HUMAN)
VMSTAPVQL

SEQ ID NO: 138863 - protein, 9 aa, Artificial Sequence
  Description of Artificial Sequence: Synthetic peptide
  Seed: GSWSQKRSF (PMEL_HUMAN)
GMWSQKRSF

SEQ ID NO: 138864 - protein, 9 aa, Artificial Sequence
  Description of Artificial Sequence: Synthetic peptide
  Seed: SGEGDAFEL (PMEL_HUMAN)
SSEGDAFEL

SEQ ID NO: 138865 - protein, 10 aa, Artificial Sequence
  Description of Artificial Sequence: Synthetic peptide
  Seed: MTPAEVSIVV (PMEL_HUMAN)
MGPAEVSIVV

SEQ ID NO: 138866 - protein, 10 aa, Artificial Sequence
  Description of Artificial Sequence: Synthetic peptide
  Seed: LAEADLSYTW (PMEL_HUMAN)
LLEADLSYTW

SEQ ID NO: 138867 - protein, 8 aa, Artificial Sequence
  Description of Artificial Sequence: Synthetic peptide
  Seed: FGDSSGTL (PMEL_HUMAN)
FIDSSGTI

SEQ ID NO: 138868 - protein, 9 aa, Artificial Sequence
  Description of Artificial Sequence: Synthetic peptide
  Seed: SVQVPTTEV (PMEL_HUMAN)
SLQVPTTEV

SEQ ID NO: 138869 - protein, 10 aa, Artificial Sequence
  Description of Artificial Sequence: Synthetic peptide
  Seed: YRYGSFSVTL (PMEL_HUMAN)
YLYGSFSVTY

SEQ ID NO: 138870 - protein, 10 aa, Artificial Sequence
  Description of Artificial Sequence: Synthetic peptide
  Seed: MPTAESTGMT (PMEL_HUMAN)
METAESTGML

SEQ ID NO: 138871 - protein, 10 aa, Artificial Sequence
  Description of Artificial Sequence: Synthetic peptide
  Seed: MPTAESTGMT (PMEL_HUMAN)
MFTAESTGMA

SEQ ID NO: 138872 - protein, 11 aa, Artificial Sequence
  Description of Artificial Sequence: Synthetic peptide
  Seed: CVLYRYGSFSV (PMEL_HUMAN)
CTLYRYGSFSV

SEQ ID NO: 138873 - protein, 9 aa, Artificial Sequence
  Description of Artificial Sequence: Synthetic peptide
  Seed: VSLADTNSL (PMEL_HUMAN)
VALADTNSL

SEQ ID NO: 138874 - protein, 9 aa, Artificial Sequence
  Description of Artificial Sequence: Synthetic peptide
  Seed: VSLADTNSL (PMEL_HUMAN)
VSLADTNSM

SEQ ID NO: 138875 - protein, 10 aa, Artificial Sequence
  Description of Artificial Sequence: Synthetic peptide
  Seed: ALDGGNKHFL (PMEL_HUMAN)
AADGGNKHFY

SEQ ID NO: 138876 - protein, 11 aa, Artificial Sequence
  Description of Artificial Sequence: Synthetic peptide
  Seed: YLEPGPVTAQV (PMEL_HUMAN)
YAEPGPVTAQL

SEQ ID NO: 138877 - protein, 11 aa, Artificial Sequence
  Description of Artificial Sequence: Synthetic peptide
  Seed: MTPEKVPVSEV (PMEL_HUMAN)
MLPEKVPVSEI

SEQ ID NO: 138878 - protein, 9 aa, Artificial Sequence
  Description of Artificial Sequence: Synthetic peptide
  Seed: SLGPLLDGT (PMEL_HUMAN)
SVGPLLDGA

SEQ ID NO: 138879 - protein, 11 aa, Artificial Sequence
  Description of Artificial Sequence: Synthetic peptide
  Seed: LVLMAVVLASL (PMEL_HUMAN)
LMLMAVVLASL

SEQ ID NO: 138880 - protein, 10 aa, Artificial Sequence
  Description of Artificial Sequence: Synthetic peptide
  Seed: YRYGSFSVTL (PMEL_HUMAN)
YRYGSFSVTV

SEQ ID NO: 138881 - protein, 9 aa, Artificial Sequence
  Description of Artificial Sequence: Synthetic peptide
  Seed: CPIGENSPL (PMEL_HUMAN)
CPIGENSPF

SEQ ID NO: 138882 - protein, 9 aa, Artificial Sequence
  Description of Artificial Sequence: Synthetic peptide
  Seed: VISTAPVQM (PMEL_HUMAN)
VSSTAPVQV

SEQ ID NO: 138883 - protein, 11 aa, Artificial Sequence
  Description of Artificial Sequence: Synthetic peptide
  Seed: LGPLLDGTATL (PMEL_HUMAN)
LPPLLDGTATI

SEQ ID NO: 138884 - protein, 9 aa, Artificial Sequence
  Description of Artificial Sequence: Synthetic peptide
  Seed: STESITGSL (PMEL_HUMAN)
SLESITGSV

SEQ ID NO: 138885 - protein, 11 aa, Artificial Sequence
  Description of Artificial Sequence: Synthetic peptide
  Seed: RSFVYVWKTWG (PMEL_HUMAN)
RAFVYVWKTWW

SEQ ID NO: 138886 - protein, 9 aa, Artificial Sequence
  Description of Artificial Sequence: Synthetic peptide
  Seed: HTMEVTVYH (PMEL_HUMAN)
HVMEVTVYR

SEQ ID NO: 138887 - protein, 9 aa, Artificial Sequence
  Description of Artificial Sequence: Synthetic peptide
  Seed: RNQPLTFAL (PMEL_HUMAN)
RCQPLTFAY

SEQ ID NO: 138888 - protein, 9 aa, Artificial Sequence
  Description of Artificial Sequence: Synthetic peptide
  Seed: VSLADTNSL (PMEL_HUMAN)
VVLADTNSI

SEQ ID NO: 138889 - protein, 10 aa, Artificial Sequence
  Description of Artificial Sequence: Synthetic peptide
  Seed: GPLLDGTATL (PMEL_HUMAN)
GHLLDGTATV

SEQ ID NO: 138890 - protein, 10 aa, Artificial Sequence
  Description of Artificial Sequence: Synthetic peptide
  Seed: KRSFVYVWKT (PMEL_HUMAN)
KRSFVYVWKF

SEQ ID NO: 138891 - protein, 11 aa, Artificial Sequence
  Description of Artificial Sequence: Synthetic peptide
  Seed: QKVLPDGQVIW (PMEL_HUMAN)
QSVLPDGQVIW

SEQ ID NO: 138892 - protein, 10 aa, Artificial Sequence
  Description of Artificial Sequence: Synthetic peptide
  Seed: KTWGQYWQVL (PMEL_HUMAN)
KIWGQYWQVQ

SEQ ID NO: 138893 - protein, 9 aa, Artificial Sequence
  Description of Artificial Sequence: Synthetic peptide
  Seed: VQVPTTEVI (PMEL_HUMAN)
VTVPTTEVY

SEQ ID NO: 138894 - protein, 9 aa, Artificial Sequence
  Description of Artificial Sequence: Synthetic peptide
  Seed: STAPVQMPT (PMEL_HUMAN)
SIAPVQMPM

SEQ ID NO: 138895 - protein, 9 aa, Artificial Sequence
  Description of Artificial Sequence: Synthetic peptide
  Seed: TTTEWVETT (PMEL_HUMAN)
TVTEWVETL

SEQ ID NO: 138896 - protein, 9 aa, Artificial Sequence
  Description of Artificial Sequence: Synthetic peptide
  Seed: FGDSSGTLI (PMEL_HUMAN)
FFDSSGTLW

SEQ ID NO: 138897 - protein, 10 aa, Artificial Sequence
  Description of Artificial Sequence: Synthetic peptide
  Seed: RGSRSYVPLA (PMEL_HUMAN)
RQSRSYVPLV

SEQ ID NO: 138898 - protein, 9 aa, Artificial Sequence
  Description of Artificial Sequence: Synthetic peptide
  Seed: LSIGTGRAM (PMEL_HUMAN)
LWIGTGRAY

SEQ ID NO: 138899 - protein, 10 aa, Artificial Sequence
  Description of Artificial Sequence: Synthetic peptide
  Seed: RALDGGNKHF (PMEL_HUMAN)
RELDGGNKHY

SEQ ID NO: 138900 - protein, 9 aa, Artificial Sequence
  Description of Artificial Sequence: Synthetic peptide
  Seed: FGDSSGTLI (PMEL_HUMAN)
FCDSSGTLF

SEQ ID NO: 138901 - protein, 9 aa, Artificial Sequence
  Description of Artificial Sequence: Synthetic peptide
  Seed: RLVKRQVPL (PMEL_HUMAN)
RMVKRQVPF

SEQ ID NO: 138902 - protein, 9 aa, Artificial Sequence
  Description of Artificial Sequence: Synthetic peptide
  Seed: RQVPLDCVL (PMEL_HUMAN)
RLVPLDCVM

SEQ ID NO: 138903 - protein, 9 aa, Artificial Sequence
  Description of Artificial Sequence: Synthetic peptide
  Seed: HTMEVTVYH (PMEL_HUMAN)
HFMEVTVYY

SEQ ID NO: 138904 - protein, 11 aa, Artificial Sequence
  Description of Artificial Sequence: Synthetic peptide
  Seed: MAVVLASLIYR (PMEL_HUMAN)
MNVVLASLIYR

SEQ ID NO: 138905 - protein, 9 aa, Artificial Sequence
  Description of Artificial Sequence: Synthetic peptide
  Seed: GSWSQKRSF (PMEL_HUMAN)
GRWSQKRSL

SEQ ID NO: 138906 - protein, 9 aa, Artificial Sequence
  Description of Artificial Sequence: Synthetic peptide
  Seed: SPLLSGQQV (PMEL_HUMAN)
SPLLSGQQI

SEQ ID NO: 138907 - protein, 10 aa, Artificial Sequence
  Description of Artificial Sequence: Synthetic peptide
  Seed: TYLEPGPVTA (PMEL_HUMAN)
TFLEPGPVTM

SEQ ID NO: 138908 - protein, 9 aa, Artificial Sequence
  Description of Artificial Sequence: Synthetic peptide
  Seed: LIVGILLVL (PMEL_HUMAN)
LIVGILLVV

SEQ ID NO: 138909 - protein, 9 aa, Artificial Sequence
  Description of Artificial Sequence: Synthetic peptide
  Seed: HTMEVTVYH (PMEL_HUMAN)
HIMEVTVYW

SEQ ID NO: 138910 - protein, 9 aa, Artificial Sequence
  Description of Artificial Sequence: Synthetic peptide
  Seed: SGLSIGTGR (PMEL_HUMAN)
SQLSIGTGR

SEQ ID NO: 138911 - protein, 11 aa, Artificial Sequence
  Description of Artificial Sequence: Synthetic peptide
  Seed: RRGSRSYVPLA (PMEL_HUMAN)
RTGSRSYVPLL

SEQ ID NO: 138912 - protein, 9 aa, Artificial Sequence
  Description of Artificial Sequence: Synthetic peptide
  Seed: ESAEILQAV (PMEL_HUMAN)
EGAEILQAY

SEQ ID NO: 138913 - protein, 10 aa, Artificial Sequence
  Description of Artificial Sequence: Synthetic peptide
  Seed: YGSFSVTLDI (PMEL_HUMAN)
YWSFSVTLDY

SEQ ID NO: 138914 - protein, 9 aa, Artificial Sequence
  Description of Artificial Sequence: Synthetic peptide
  Seed: KQDFSVPQL (PMEL_HUMAN)
KYDFSVPQL

SEQ ID NO: 138915 - protein, 9 aa, Artificial Sequence
  Description of Artificial Sequence: Synthetic peptide
  Seed: DAFELTVSC (PMEL_HUMAN)
DAFELTVSV

SEQ ID NO: 138916 - protein, 9 aa, Artificial Sequence
  Description of Artificial Sequence: Synthetic peptide
  Seed: SQKRSFVYV (PMEL_HUMAN)
SVKRSFVYL

SEQ ID NO: 138917 - protein, 10 aa, Artificial Sequence
  Description of Artificial Sequence: Synthetic peptide
  Seed: QVLGGPVSGL (PMEL_HUMAN)
QLLGGPVSGV

SEQ ID NO: 138918 - protein, 9 aa, Artificial Sequence
  Description of Artificial Sequence: Synthetic peptide
  Seed: RGGQVSLKV (PMEL_HUMAN)
RTGQVSLKL

SEQ ID NO: 138919 - protein, 10 aa, Artificial Sequence
  Description of Artificial Sequence: Synthetic peptide
  Seed: MAVVLASLIY (PMEL_HUMAN)
MKVVLASLIY

SEQ ID NO: 138920 - protein, 10 aa, Artificial Sequence
  Description of Artificial Sequence: Synthetic peptide
  Seed: MTPAEVSIVV (PMEL_HUMAN)
MDPAEVSIVA

SEQ ID NO: 138921 - protein, 10 aa, Artificial Sequence
  Description of Artificial Sequence: Synthetic peptide
  Seed: VLSGTTAAQV (PMEL_HUMAN)
VLSGTTAAQL

SEQ ID NO: 138922 - protein, 9 aa, Artificial Sequence
  Description of Artificial Sequence: Synthetic peptide
  Seed: TLIGANASF (PMEL_HUMAN)
TYIGANASM

SEQ ID NO: 138923 - protein, 10 aa, Artificial Sequence
  Description of Artificial Sequence: Synthetic peptide
  Seed: ALDGGNKHFL (PMEL_HUMAN)
AIDGGNKHFI

SEQ ID NO: 138924 - protein, 9 aa, Artificial Sequence
  Description of Artificial Sequence: Synthetic peptide
  Seed: VTAQVVLQA (PMEL_HUMAN)
VLAQVVLQV

SEQ ID NO: 138925 - protein, 9 aa, Artificial Sequence
  Description of Artificial Sequence: Synthetic peptide
  Seed: YPQETDDAC (PMEL_HUMAN)
YPQETDDAY

SEQ ID NO: 138926 - protein, 9 aa, Artificial Sequence
  Description of Artificial Sequence: Synthetic peptide
  Seed: RNQPLTFAL (PMEL_HUMAN)
RQQPLTFAM

SEQ ID NO: 138927 - protein, 9 aa, Artificial Sequence
  Description of Artificial Sequence: Synthetic peptide
  Seed: VVLSGTTAA (PMEL_HUMAN)
VILSGTTAF

SEQ ID NO: 138928 - protein, 10 aa, Artificial Sequence
  Description of Artificial Sequence: Synthetic peptide
  Seed: EVISTAPVQM (PMEL_HUMAN)
ETISTAPVQK

SEQ ID NO: 138929 - protein, 11 aa, Artificial Sequence
  Description of Artificial Sequence: Synthetic peptide
  Seed: VLGGPVSGLSI (PMEL_HUMAN)
VSGGPVSGLSL

SEQ ID NO: 138930 - protein, 9 aa, Artificial Sequence
  Description of Artificial Sequence: Synthetic peptide
  Seed: MTPEKVPVS (PMEL_HUMAN)
MAPEKVPVM

SEQ ID NO: 138931 - protein, 11 aa, Artificial Sequence
  Description of Artificial Sequence: Synthetic peptide
  Seed: HSSSHWLRLPR (PMEL_HUMAN)
HYSSHWLRLPR

SEQ ID NO: 138932 - protein, 10 aa, Artificial Sequence
  Description of Artificial Sequence: Synthetic peptide
  Seed: FSVSVSQLRA (PMEL_HUMAN)
FTVSVSQLRR

SEQ ID NO: 138933 - protein, 9 aa, Artificial Sequence
  Description of Artificial Sequence: Synthetic peptide
  Seed: HTMEVTVYH (PMEL_HUMAN)
HMMEVTVYR

SEQ ID NO: 138934 - protein, 9 aa, Artificial Sequence
  Description of Artificial Sequence: Synthetic peptide
  Seed: VQMPTAEST (PMEL_HUMAN)
VQMPTAESV

SEQ ID NO: 138935 - protein, 10 aa, Artificial Sequence
  Description of Artificial Sequence: Synthetic peptide
  Seed: LAVIGALLAV (PMEL_HUMAN)
LCVIGALLAI

SEQ ID NO: 138936 - protein, 9 aa, Artificial Sequence
  Description of Artificial Sequence: Synthetic peptide
  Seed: SIGTGRAML (PMEL_HUMAN)
SAGTGRAML

SEQ ID NO: 138937 - protein, 9 aa, Artificial Sequence
  Description of Artificial Sequence: Synthetic peptide
  Seed: RLMKQDFSV (PMEL_HUMAN)
RTMKQDFSI

SEQ ID NO: 138938 - protein, 9 aa, Artificial Sequence
  Description of Artificial Sequence: Synthetic peptide
  Seed: KTWGQYWQV (PMEL_HUMAN)
KGWGQYWQK

SEQ ID NO: 138939 - protein, 10 aa, Artificial Sequence
  Description of Artificial Sequence: Synthetic peptide
  Seed: ALLAVGATKV (PMEL_HUMAN)
AFLAVGATKV

SEQ ID NO: 138940 - protein, 10 aa, Artificial Sequence
  Description of Artificial Sequence: Synthetic peptide
  Seed: RGSRSYVPLA (PMEL_HUMAN)
RGSRSYVPLL

SEQ ID NO: 138941 - protein, 11 aa, Artificial Sequence
  Description of Artificial Sequence: Synthetic peptide
  Seed: SQKRSFVYVWK (PMEL_HUMAN)
STKRSFVYVWR

SEQ ID NO: 138942 - protein, 10 aa, Artificial Sequence
  Description of Artificial Sequence: Synthetic peptide
  Seed: MPTAESTGMT (PMEL_HUMAN)
MDTAESTGMA

SEQ ID NO: 138943 - protein, 9 aa, Artificial Sequence
  Description of Artificial Sequence: Synthetic peptide
  Seed: TVYHRRGSR (PMEL_HUMAN)
TMYHRRGSR

SEQ ID NO: 138944 - protein, 10 aa, Artificial Sequence
  Description of Artificial Sequence: Synthetic peptide
  Seed: ESAEILQAVP (PMEL_HUMAN)
EVAEILQAVV

SEQ ID NO: 138945 - protein, 10 aa, Artificial Sequence
  Description of Artificial Sequence: Synthetic peptide
  Seed: LMAVVLASLI (PMEL_HUMAN)
LLAVVLASLS

SEQ ID NO: 138946 - protein, 10 aa, Artificial Sequence
  Description of Artificial Sequence: Synthetic peptide
  Seed: YRYGSFSVTL (PMEL_HUMAN)
YWYGSFSVTY

SEQ ID NO: 138947 - protein, 9 aa, Artificial Sequence
  Description of Artificial Sequence: Synthetic peptide
  Seed: TLIGANASF (PMEL_HUMAN)
TYIGANASW

SEQ ID NO: 138948 - protein, 10 aa, Artificial Sequence
  Description of Artificial Sequence: Synthetic peptide
  Seed: ASSIMSTESI (PMEL_HUMAN)
AESIMSTESW

SEQ ID NO: 138949 - protein, 9 aa, Artificial Sequence
  Description of Artificial Sequence: Synthetic peptide
  Seed: KTWGQYWQV (PMEL_HUMAN)
KWWGQYWQM

SEQ ID NO: 138950 - protein, 10 aa, Artificial Sequence
  Description of Artificial Sequence: Synthetic peptide
  Seed: MAVVLASLIY (PMEL_HUMAN)
MKVVLASLIR

SEQ ID NO: 138951 - protein, 9 aa, Artificial Sequence
  Description of Artificial Sequence: Synthetic peptide
  Seed: EKVPVSEVM (PMEL_HUMAN)
EHVPVSEVY

SEQ ID NO: 138952 - protein, 9 aa, Artificial Sequence
  Description of Artificial Sequence: Synthetic peptide
  Seed: FTITDQVPF (PMEL_HUMAN)
FPITDQVPC

SEQ ID NO: 138953 - protein, 9 aa, Artificial Sequence
  Description of Artificial Sequence: Synthetic peptide
  Seed: AQVVLQAAI (PMEL_HUMAN)
AQVVLQAAW

SEQ ID NO: 138954 - protein, 9 aa, Artificial Sequence
  Description of Artificial Sequence: Synthetic peptide
  Seed: LNFPGSQKV (PMEL_HUMAN)
LTFPGSQKY

SEQ ID NO: 138955 - protein, 10 aa, Artificial Sequence
  Description of Artificial Sequence: Synthetic peptide
  Seed: TAAQVTTTEW (PMEL_HUMAN)
TAAQVTTTEY

SEQ ID NO: 138956 - protein, 9 aa, Artificial Sequence
  Description of Artificial Sequence: Synthetic peptide
  Seed: AVIGALLAV (PMEL_HUMAN)
ASIGALLAV

SEQ ID NO: 138957 - protein, 9 aa, Artificial Sequence
  Description of Artificial Sequence: Synthetic peptide
  Seed: RALVVTHTY (PMEL_HUMAN)
RVLVVTHTM

SEQ ID NO: 138958 - protein, 9 aa, Artificial Sequence
  Description of Artificial Sequence: Synthetic peptide
  Seed: EVVGTTPGQ (PMEL_HUMAN)
ETVGTTPGK

SEQ ID NO: 138959 - protein, 9 aa, Artificial Sequence
  Description of Artificial Sequence: Synthetic peptide
  Seed: MLGTHTMEV (PMEL_HUMAN)
MGGTHTMEL

SEQ ID NO: 138960 - protein, 9 aa, Artificial Sequence
  Description of Artificial Sequence: Synthetic peptide
  Seed: VQMPTAEST (PMEL_HUMAN)
VLMPTAESL

SEQ ID NO: 138961 - protein, 11 aa, Artificial Sequence
  Description of Artificial Sequence: Synthetic peptide
  Seed: SPVPGTTDGHR (PMEL_HUMAN)
STVPGTTDGHR

SEQ ID NO: 138962 - protein, 10 aa, Artificial Sequence
  Description of Artificial Sequence: Synthetic peptide
  Seed: YGSFSVTLDI (PMEL_HUMAN)
YMSFSVTLDM

SEQ ID NO: 138963 - protein, 9 aa, Artificial Sequence
  Description of Artificial Sequence: Synthetic peptide
  Seed: FLRNQPLTF (PMEL_HUMAN)
FQRNQPLTW

SEQ ID NO: 138964 - protein, 10 aa, Artificial Sequence
  Description of Artificial Sequence: Synthetic peptide
  Seed: PFSVSVSQLR (PMEL_HUMAN)
PMSVSVSQLR

SEQ ID NO: 138965 - protein, 8 aa, Artificial Sequence
  Description of Artificial Sequence: Synthetic peptide
  Seed: YGSFSVTL (PMEL_HUMAN)
YSSFSVTM

SEQ ID NO: 138966 - protein, 11 aa, Artificial Sequence
  Description of Artificial Sequence: Synthetic peptide
  Seed: FGDSSGTLISR (PMEL_HUMAN)
FADSSGTLISA

SEQ ID NO: 138967 - protein, 9 aa, Artificial Sequence
  Description of Artificial Sequence: Synthetic peptide
  Seed: DSSGTLISR (PMEL_HUMAN)
DSSGTLISY

SEQ ID NO: 138968 - protein, 10 aa, Artificial Sequence
  Description of Artificial Sequence: Synthetic peptide
  Seed: QEAGLGQVPL (PMEL_HUMAN)
QEAGLGQVPV

SEQ ID NO: 138969 - protein, 9 aa, Artificial Sequence
  Description of Artificial Sequence: Synthetic peptide
  Seed: RLVKRQVPL (PMEL_HUMAN)
RIVKRQVPK

SEQ ID NO: 138970 - protein, 11 aa, Artificial Sequence
  Description of Artificial Sequence: Synthetic peptide
  Seed: TWDFGDSSGTL (PMEL_HUMAN)
TMDFGDSSGTL

SEQ ID NO: 138971 - protein, 9 aa, Artificial Sequence
  Description of Artificial Sequence: Synthetic peptide
  Seed: SVPQLPHSS (PMEL_HUMAN)
SQPQLPHSM

SEQ ID NO: 138972 - protein, 9 aa, Artificial Sequence
  Description of Artificial Sequence: Synthetic peptide
  Seed: QVWGGQPVY (PMEL_HUMAN)
QIWGGQPVY

SEQ ID NO: 138973 - protein, 8 aa, Artificial Sequence
  Description of Artificial Sequence: Synthetic peptide
  Seed: LADTNSLA (PMEL_HUMAN)
LSDTNSLF

SEQ ID NO: 138974 - protein, 9 aa, Artificial Sequence
  Description of Artificial Sequence: Synthetic peptide
  Seed: LMAVVLASL (PMEL_HUMAN)
LAAVVLASM

SEQ ID NO: 138975 - protein, 9 aa, Artificial Sequence
  Description of Artificial Sequence: Synthetic peptide
  Seed: ITDQVPFSV (PMEL_HUMAN)
IQDQVPFSV

SEQ ID NO: 138976 - protein, 9 aa, Artificial Sequence
  Description of Artificial Sequence: Synthetic peptide
  Seed: CVLYRYGSF (PMEL_HUMAN)
CMLYRYGSL

SEQ ID NO: 138977 - protein, 10 aa, Artificial Sequence
  Description of Artificial Sequence: Synthetic peptide
  Seed: LAVVSTQLIM (PMEL_HUMAN)
LAVVSTQLIW

SEQ ID NO: 138978 - protein, 9 aa, Artificial Sequence
  Description of Artificial Sequence: Synthetic peptide
  Seed: FLRNQPLTF (PMEL_HUMAN)
FMRNQPLTV

SEQ ID NO: 138979 - protein, 10 aa, Artificial Sequence
  Description of Artificial Sequence: Synthetic peptide
  Seed: SQKRSFVYVW (PMEL_HUMAN)
SCKRSFVYVY

SEQ ID NO: 138980 - protein, 9 aa, Artificial Sequence
  Description of Artificial Sequence: Synthetic peptide
  Seed: WSQKRSFVY (PMEL_HUMAN)
WIQKRSFVY

SEQ ID NO: 138981 - protein, 11 aa, Artificial Sequence
  Description of Artificial Sequence: Synthetic peptide
  Seed: FGDSSGTLISR (PMEL_HUMAN)
FADSSGTLISI

SEQ ID NO: 138982 - protein, 10 aa, Artificial Sequence
  Description of Artificial Sequence: Synthetic peptide
  Seed: MAVVLASLIY (PMEL_HUMAN)
MKVVLASLIM

SEQ ID NO: 138983 - protein, 10 aa, Artificial Sequence
  Description of Artificial Sequence: Synthetic peptide
  Seed: SGTYCLNVSL (PMEL_HUMAN)
SLTYCLNVSW

SEQ ID NO: 138984 - protein, 11 aa, Artificial Sequence
  Description of Artificial Sequence: Synthetic peptide
  Seed: SYVPLAHSSSA (PMEL_HUMAN)
SSVPLAHSSSM

SEQ ID NO: 138985 - protein, 9 aa, Artificial Sequence
  Description of Artificial Sequence: Synthetic peptide
  Seed: QLHDPSGYL (PMEL_HUMAN)
QLHDPSGYF

SEQ ID NO: 138986 - protein, 10 aa, Artificial Sequence
  Description of Artificial Sequence: Synthetic peptide
  Seed: LVLMAVVLAS (PMEL_HUMAN)
LPLMAVVLAL

SEQ ID NO: 138987 - protein, 11 aa, Artificial Sequence
  Description of Artificial Sequence: Synthetic peptide
  Seed: RLPRIFCSCPI (PMEL_HUMAN)
RAPRIFCSCPL

SEQ ID NO: 138988 - protein, 9 aa, Artificial Sequence
  Description of Artificial Sequence: Synthetic peptide
  Seed: VTLDIVQGI (PMEL_HUMAN)
VALDIVQGW

SEQ ID NO: 138989 - protein, 9 aa, Artificial Sequence
  Description of Artificial Sequence: Synthetic peptide
  Seed: YPQETDDAC (PMEL_HUMAN)
YMQETDDAF

SEQ ID NO: 138990 - protein, 9 aa, Artificial Sequence
  Description of Artificial Sequence: Synthetic peptide
  Seed: LQAAIPLTS (PMEL_HUMAN)
LVAAIPLTF

SEQ ID NO: 138991 - protein, 9 aa, Artificial Sequence
  Description of Artificial Sequence: Synthetic peptide
  Seed: TPAEVSIVV (PMEL_HUMAN)
TTAEVSIVA

SEQ ID NO: 138992 - protein, 9 aa, Artificial Sequence
  Description of Artificial Sequence: Synthetic peptide
  Seed: SVQVPTTEV (PMEL_HUMAN)
SGQVPTTEM

SEQ ID NO: 138993 - protein, 10 aa, Artificial Sequence
  Description of Artificial Sequence: Synthetic peptide
  Seed: YPEWTEAQRL (PMEL_HUMAN)
YPEWTEAQRF

SEQ ID NO: 138994 - protein, 9 aa, Artificial Sequence
  Description of Artificial Sequence: Synthetic peptide
  Seed: HSSSHWLRL (PMEL_HUMAN)
HQSSHWLRW

SEQ ID NO: 138995 - protein, 9 aa, Artificial Sequence
  Description of Artificial Sequence: Synthetic peptide
  Seed: ESAEILQAV (PMEL_HUMAN)
ELAEILQAR

SEQ ID NO: 138996 - protein, 9 aa, Artificial Sequence
  Description of Artificial Sequence: Synthetic peptide
  Seed: LYPEWTEAQ (PMEL_HUMAN)
LYPEWTEAI

SEQ ID NO: 138997 - protein, 9 aa, Artificial Sequence
  Description of Artificial Sequence: Synthetic peptide
  Seed: ANASFSIAL (PMEL_HUMAN)
AQASFSIAY

SEQ ID NO: 138998 - protein, 11 aa, Artificial Sequence
  Description of Artificial Sequence: Synthetic peptide
  Seed: HTMEVTVYHRR (PMEL_HUMAN)
HSMEVTVYHRR

SEQ ID NO: 138999 - protein, 9 aa, Artificial Sequence
  Description of Artificial Sequence: Synthetic peptide
  Seed: FTITDQVPF (PMEL_HUMAN)
FLITDQVPF

SEQ ID NO: 139000 - protein, 9 aa, Artificial Sequence
  Description of Artificial Sequence: Synthetic peptide
  Seed: KTWGQYWQV (PMEL_HUMAN)
KIWGQYWQL

SEQ ID NO: 139001 - protein, 10 aa, Artificial Sequence
  Description of Artificial Sequence: Synthetic peptide
  Seed: KTWGQYWQVL (PMEL_HUMAN)
KMWGQYWQVC

SEQ ID NO: 139002 - protein, 10 aa, Artificial Sequence
  Description of Artificial Sequence: Synthetic peptide
  Seed: VLKRCLLHLA (PMEL_HUMAN)
VMKRCLLHLV

SEQ ID NO: 139003 - protein, 9 aa, Artificial Sequence
  Description of Artificial Sequence: Synthetic peptide
  Seed: FTITDQVPF (PMEL_HUMAN)
FGITDQVPY

SEQ ID NO: 139004 - protein, 10 aa, Artificial Sequence
  Description of Artificial Sequence: Synthetic peptide
  Seed: KTWGQYWQVL (PMEL_HUMAN)
KLWGQYWQVN

SEQ ID NO: 139005 - protein, 10 aa, Artificial Sequence
  Description of Artificial Sequence: Synthetic peptide
  Seed: VPLAHSSSAF (PMEL_HUMAN)
VDLAHSSSAF

SEQ ID NO: 139006 - protein, 9 aa, Artificial Sequence
  Description of Artificial Sequence: Synthetic peptide
  Seed: VLQAAIPLT (PMEL_HUMAN)
VVQAAIPLV

SEQ ID NO: 139007 - protein, 9 aa, Artificial Sequence
  Description of Artificial Sequence: Synthetic peptide
  Seed: VISTAPVQM (PMEL_HUMAN)
VYSTAPVQY

SEQ ID NO: 139008 - protein, 9 aa, Artificial Sequence
  Description of Artificial Sequence: Synthetic peptide
  Seed: VSLADTNSL (PMEL_HUMAN)
VMLADTNSI

SEQ ID NO: 139009 - protein, 9 aa, Artificial Sequence
  Description of Artificial Sequence: Synthetic peptide
  Seed: KAWNRQLYP (PMEL_HUMAN)
KMWNRQLYM

SEQ ID NO: 139010 - protein, 9 aa, Artificial Sequence
  Description of Artificial Sequence: Synthetic peptide
  Seed: YLAEADLSY (PMEL_HUMAN)
YQAEADLSM

SEQ ID NO: 139011 - protein, 9 aa, Artificial Sequence
  Description of Artificial Sequence: Synthetic peptide
  Seed: GTYCLNVSL (PMEL_HUMAN)
GMYCLNVSF

SEQ ID NO: 139012 - protein, 9 aa, Artificial Sequence
  Description of Artificial Sequence: Synthetic peptide
  Seed: SQKRSFVYV (PMEL_HUMAN)
SIKRSFVYT

SEQ ID NO: 139013 - protein, 10 aa, Artificial Sequence
  Description of Artificial Sequence: Synthetic peptide
  Seed: HTMEVTVYHR (PMEL_HUMAN)
HCMEVTVYHR

SEQ ID NO: 139014 - protein, 9 aa, Artificial Sequence
  Description of Artificial Sequence: Synthetic peptide
  Seed: RGSRSYVPL (PMEL_HUMAN)
RSSRSYVPI

SEQ ID NO: 139015 - protein, 10 aa, Artificial Sequence
  Description of Artificial Sequence: Synthetic peptide
  Seed: SVPQLPHSSS (PMEL_HUMAN)
SGPQLPHSSL

SEQ ID NO: 139016 - protein, 11 aa, Artificial Sequence
  Description of Artificial Sequence: Synthetic peptide
  Seed: SYVPLAHSSSA (PMEL_HUMAN)
SQVPLAHSSSL

SEQ ID NO: 139017 - protein, 9 aa, Artificial Sequence
  Description of Artificial Sequence: Synthetic peptide
  Seed: VSLADTNSL (PMEL_HUMAN)
VILADTNSI

SEQ ID NO: 139018 - protein, 10 aa, Artificial Sequence
  Description of Artificial Sequence: Synthetic peptide
  Seed: YVPLAHSSSA (PMEL_HUMAN)
YAPLAHSSSV

SEQ ID NO: 139019 - protein, 9 aa, Artificial Sequence
  Description of Artificial Sequence: Synthetic peptide
  Seed: RQVPLDCVL (PMEL_HUMAN)
RVVPLDCVY

SEQ ID NO: 139020 - protein, 10 aa, Artificial Sequence
  Description of Artificial Sequence: Synthetic peptide
  Seed: KVSNDGPTLI (PMEL_HUMAN)
KSSNDGPTLF

SEQ ID NO: 139021 - protein, 11 aa, Artificial Sequence
  Description of Artificial Sequence: Synthetic peptide
  Seed: SLADTNSLAVV (PMEL_HUMAN)
SVADTNSLAVL

SEQ ID NO: 139022 - protein, 9 aa, Artificial Sequence
  Description of Artificial Sequence: Synthetic peptide
  Seed: LHDPSGYLA (PMEL_HUMAN)
LRDPSGYLL

SEQ ID NO: 139023 - protein, 10 aa, Artificial Sequence
  Description of Artificial Sequence: Synthetic peptide
  Seed: SRALVVTHTY (PMEL_HUMAN)
SVALVVTHTY

SEQ ID NO: 139024 - protein, 10 aa, Artificial Sequence
  Description of Artificial Sequence: Synthetic peptide
  Seed: SLIYRRRLMK (PMEL_HUMAN)
SDIYRRRLMR

SEQ ID NO: 139025 - protein, 10 aa, Artificial Sequence
  Description of Artificial Sequence: Synthetic peptide
  Seed: RTKAWNRQLY (PMEL_HUMAN)
RTKAWNRQLA

SEQ ID NO: 139026 - protein, 10 aa, Artificial Sequence
  Description of Artificial Sequence: Synthetic peptide
  Seed: YRYGSFSVTL (PMEL_HUMAN)
YRYGSFSVTA

SEQ ID NO: 139027 - protein, 11 aa, Artificial Sequence
  Description of Artificial Sequence: Synthetic peptide
  Seed: HTMEVTVYHRR (PMEL_HUMAN)
HTMEVTVYHRF

SEQ ID NO: 139028 - protein, 9 aa, Artificial Sequence
  Description of Artificial Sequence: Synthetic peptide
  Seed: SQVWGGQPV (PMEL_HUMAN)
SAVWGGQPL

SEQ ID NO: 139029 - protein, 11 aa, Artificial Sequence
  Description of Artificial Sequence: Synthetic peptide
  Seed: CSCPIGENSPL (PMEL_HUMAN)
CTCPIGENSPW

SEQ ID NO: 139030 - protein, 9 aa, Artificial Sequence
  Description of Artificial Sequence: Synthetic peptide
  Seed: RAMLGTHTM (PMEL_HUMAN)
RQMLGTHTR

SEQ ID NO: 139031 - protein, 10 aa, Artificial Sequence
  Description of Artificial Sequence: Synthetic peptide
  Seed: SRALVVTHTY (PMEL_HUMAN)
SSALVVTHTF

SEQ ID NO: 139032 - protein, 9 aa, Artificial Sequence
  Description of Artificial Sequence: Synthetic peptide
  Seed: TLIGANASF (PMEL_HUMAN)
TAIGANASH

SEQ ID NO: 139033 - protein, 9 aa, Artificial Sequence
  Description of Artificial Sequence: Synthetic peptide
  Seed: FLRNQPLTF (PMEL_HUMAN)
FPRNQPLTA

SEQ ID NO: 139034 - protein, 9 aa, Artificial Sequence
  Description of Artificial Sequence: Synthetic peptide
  Seed: SFVYVWKTW (PMEL_HUMAN)
SYVYVWKTF

SEQ ID NO: 139035 - protein, 10 aa, Artificial Sequence
  Description of Artificial Sequence: Synthetic peptide
  Seed: RQVPLDCVLY (PMEL_HUMAN)
RTVPLDCVLF

SEQ ID NO: 139036 - protein, 10 aa, Artificial Sequence
  Description of Artificial Sequence: Synthetic peptide
  Seed: LQLHDPSGYL (PMEL_HUMAN)
LRLHDPSGYV

SEQ ID NO: 139037 - protein, 10 aa, Artificial Sequence
  Description of Artificial Sequence: Synthetic peptide
  Seed: SCPIGENSPL (PMEL_HUMAN)
SGPIGENSPL

SEQ ID NO: 139038 - protein, 10 aa, Artificial Sequence
  Description of Artificial Sequence: Synthetic peptide
  Seed: SSSHWLRLPR (PMEL_HUMAN)
SVSHWLRLPR

SEQ ID NO: 139039 - protein, 9 aa, Artificial Sequence
  Description of Artificial Sequence: Synthetic peptide
  Seed: VSLADTNSL (PMEL_HUMAN)
VMLADTNSA

SEQ ID NO: 139040 - protein, 9 aa, Artificial Sequence
  Description of Artificial Sequence: Synthetic peptide
  Seed: KAWNRQLYP (PMEL_HUMAN)
KYWNRQLYV

SEQ ID NO: 139041 - protein, 9 aa, Artificial Sequence
  Description of Artificial Sequence: Synthetic peptide
  Seed: SLGPLLDGT (PMEL_HUMAN)
SSGPLLDGV

SEQ ID NO: 139042 - protein, 9 aa, Artificial Sequence
  Description of Artificial Sequence: Synthetic peptide
  Seed: FGDSSGTLI (PMEL_HUMAN)
FFDSSGTLY

SEQ ID NO: 139043 - protein, 9 aa, Artificial Sequence
  Description of Artificial Sequence: Synthetic peptide
  Seed: TLISRALVV (PMEL_HUMAN)
TTISRALVV

SEQ ID NO: 139044 - protein, 10 aa, Artificial Sequence
  Description of Artificial Sequence: Synthetic peptide
  Seed: GYLAEADLSY (PMEL_HUMAN)
GMLAEADLSF

SEQ ID NO: 139045 - protein, 10 aa, Artificial Sequence
  Description of Artificial Sequence: Synthetic peptide
  Seed: ALNFPGSQKV (PMEL_HUMAN)
AMNFPGSQKK

SEQ ID NO: 139046 - protein, 10 aa, Artificial Sequence
  Description of Artificial Sequence: Synthetic peptide
  Seed: VPLAHSSSAF (PMEL_HUMAN)
VILAHSSSAY

SEQ ID NO: 139047 - protein, 8 aa, Artificial Sequence
  Description of Artificial Sequence: Synthetic peptide
  Seed: LAVGATKV (PMEL_HUMAN)
LQVGATKI

SEQ ID NO: 139048 - protein, 11 aa, Artificial Sequence
  Description of Artificial Sequence: Synthetic peptide
  Seed: RALDGGNKHFL (PMEL_HUMAN)
RLLDGGNKHFL

SEQ ID NO: 139049 - protein, 9 aa, Artificial Sequence
  Description of Artificial Sequence: Synthetic peptide
  Seed: YRYGSFSVT (PMEL_HUMAN)
YPYGSFSVL

SEQ ID NO: 139050 - protein, 9 aa, Artificial Sequence
  Description of Artificial Sequence: Synthetic peptide
  Seed: KVSNDGPTL (PMEL_HUMAN)
KQSNDGPTF

SEQ ID NO: 139051 - protein, 10 aa, Artificial Sequence
  Description of Artificial Sequence: Synthetic peptide
  Seed: SLIYRRRLMK (PMEL_HUMAN)
SYIYRRRLMR

SEQ ID NO: 139052 - protein, 8 aa, Artificial Sequence
  Description of Artificial Sequence: Synthetic peptide
  Seed: LLDGTATL (PMEL_HUMAN)
LTDGTATF

SEQ ID NO: 139053 - protein, 9 aa, Artificial Sequence
  Description of Artificial Sequence: Synthetic peptide
  Seed: VQMPTAEST (PMEL_HUMAN)
VTMPTAESI

SEQ ID NO: 139054 - protein, 9 aa, Artificial Sequence
  Description of Artificial Sequence: Synthetic peptide
  Seed: MAVVLASLI (PMEL_HUMAN)
MLVVLASLL

SEQ ID NO: 139055 - protein, 10 aa, Artificial Sequence
  Description of Artificial Sequence: Synthetic peptide
  Seed: ASSIMSTESI (PMEL_HUMAN)
ADSIMSTESF

SEQ ID NO: 139056 - protein, 9 aa, Artificial Sequence
  Description of Artificial Sequence: Synthetic peptide
  Seed: HTMEVTVYH (PMEL_HUMAN)
HAMEVTVYM

SEQ ID NO: 139057 - protein, 8 aa, Artificial Sequence
  Description of Artificial Sequence: Synthetic peptide
  Seed: LHDPSGYL (PMEL_HUMAN)
LSDPSGYV

SEQ ID NO: 139058 - protein, 9 aa, Artificial Sequence
  Description of Artificial Sequence: Synthetic peptide
  Seed: VLKRCLLHL (PMEL_HUMAN)
VQKRCLLHK

SEQ ID NO: 139059 - protein, 9 aa, Artificial Sequence
  Description of Artificial Sequence: Synthetic peptide
  Seed: YLAEADLSY (PMEL_HUMAN)
YYAEADLSM

SEQ ID NO: 139060 - protein, 10 aa, Artificial Sequence
  Description of Artificial Sequence: Synthetic peptide
  Seed: MAVVLASLIY (PMEL_HUMAN)
MGVVLASLIW

SEQ ID NO: 139061 - protein, 10 aa, Artificial Sequence
  Description of Artificial Sequence: Synthetic peptide
  Seed: AESTGMTPEK (PMEL_HUMAN)
ASSTGMTPEK

SEQ ID NO: 139062 - protein, 10 aa, Artificial Sequence
  Description of Artificial Sequence: Synthetic peptide
  Seed: ILKGGSGTYC (PMEL_HUMAN)
IQKGGSGTYY

SEQ ID NO: 139063 - protein, 9 aa, Artificial Sequence
  Description of Artificial Sequence: Synthetic peptide
  Seed: AVVLASLIY (PMEL_HUMAN)
AKVLASLIY

SEQ ID NO: 139064 - protein, 10 aa, Artificial Sequence
  Description of Artificial Sequence: Synthetic peptide
  Seed: RALVVTHTYL (PMEL_HUMAN)
RLLVVTHTYW

SEQ ID NO: 139065 - protein, 9 aa, Artificial Sequence
  Description of Artificial Sequence: Synthetic peptide
  Seed: GTYCLNVSL (PMEL_HUMAN)
GQYCLNVSY

SEQ ID NO: 139066 - protein, 9 aa, Artificial Sequence
  Description of Artificial Sequence: Synthetic peptide
  Seed: TMEVTVYHR (PMEL_HUMAN)
TLEVTVYHY

SEQ ID NO: 139067 - protein, 9 aa, Artificial Sequence
  Description of Artificial Sequence: Synthetic peptide
  Seed: LADTNSLAV (PMEL_HUMAN)
LLDTNSLAM

SEQ ID NO: 139068 - protein, 9 aa, Artificial Sequence
  Description of Artificial Sequence: Synthetic peptide
  Seed: YPQETDDAC (PMEL_HUMAN)
YTQETDDAM

SEQ ID NO: 139069 - protein, 9 aa, Artificial Sequence
  Description of Artificial Sequence: Synthetic peptide
  Seed: NFPGSQKVL (PMEL_HUMAN)
NMPGSQKVM

SEQ ID NO: 139070 - protein, 11 aa, Artificial Sequence
  Description of Artificial Sequence: Synthetic peptide
  Seed: RYGSFSVTLDI (PMEL_HUMAN)
RIGSFSVTLDF

SEQ ID NO: 139071 - protein, 9 aa, Artificial Sequence
  Description of Artificial Sequence: Synthetic peptide
  Seed: AAIPLTSCG (PMEL_HUMAN)
AAIPLTSCY

SEQ ID NO: 139072 - protein, 9 aa, Artificial Sequence
  Description of Artificial Sequence: Synthetic peptide
  Seed: SLGPLLDGT (PMEL_HUMAN)
SAGPLLDGL

SEQ ID NO: 139073 - protein, 9 aa, Artificial Sequence
  Description of Artificial Sequence: Synthetic peptide
  Seed: LMAVVLASL (PMEL_HUMAN)
LVAVVLASF

SEQ ID NO: 139074 - protein, 9 aa, Artificial Sequence
  Description of Artificial Sequence: Synthetic peptide
  Seed: TLIGANASF (PMEL_HUMAN)
TLIGANASI

SEQ ID NO: 139075 - protein, 9 aa, Artificial Sequence
  Description of Artificial Sequence: Synthetic peptide
  Seed: VLPSPACQL (PMEL_HUMAN)
VYPSPACQF

SEQ ID NO: 139076 - protein, 9 aa, Artificial Sequence
  Description of Artificial Sequence: Synthetic peptide
  Seed: ANASFSIAL (PMEL_HUMAN)
AKASFSIAL

SEQ ID NO: 139077 - protein, 9 aa, Artificial Sequence
  Description of Artificial Sequence: Synthetic peptide
  Seed: LPDGQVIWV (PMEL_HUMAN)
LSDGQVIWF

SEQ ID NO: 139078 - protein, 9 aa, Artificial Sequence
  Description of Artificial Sequence: Synthetic peptide
  Seed: AVVLASLIY (PMEL_HUMAN)
ATVLASLIW

SEQ ID NO: 139079 - protein, 10 aa, Artificial Sequence
  Description of Artificial Sequence: Synthetic peptide
  Seed: VPLAHSSSAF (PMEL_HUMAN)
VFLAHSSSAF

SEQ ID NO: 139080 - protein, 10 aa, Artificial Sequence
  Description of Artificial Sequence: Synthetic peptide
  Seed: YLAEADLSYT (PMEL_HUMAN)
YMAEADLSYM

SEQ ID NO: 139081 - protein, 10 aa, Artificial Sequence
  Description of Artificial Sequence: Synthetic peptide
  Seed: YLAEADLSYT (PMEL_HUMAN)
YQAEADLSYC

SEQ ID NO: 139082 - protein, 9 aa, Artificial Sequence
  Description of Artificial Sequence: Synthetic peptide
  Seed: TTTEWVETT (PMEL_HUMAN)
TVTEWVETA

SEQ ID NO: 139083 - protein, 10 aa, Artificial Sequence
  Description of Artificial Sequence: Synthetic peptide
  Seed: RYGSFSVTLD (PMEL_HUMAN)
RYGSFSVTLY

SEQ ID NO: 139084 - protein, 9 aa, Artificial Sequence
  Description of Artificial Sequence: Synthetic peptide
  Seed: SQKRSFVYV (PMEL_HUMAN)
STKRSFVYN

SEQ ID NO: 139085 - protein, 9 aa, Artificial Sequence
  Description of Artificial Sequence: Synthetic peptide
  Seed: SLGPLLDGT (PMEL_HUMAN)
SMGPLLDGA

SEQ ID NO: 139086 - protein, 9 aa, Artificial Sequence
  Description of Artificial Sequence: Synthetic peptide
  Seed: SQVWGGQPV (PMEL_HUMAN)
STVWGGQPM

SEQ ID NO: 139087 - protein, 10 aa, Artificial Sequence
  Description of Artificial Sequence: Synthetic peptide
  Seed: MPTAESTGMT (PMEL_HUMAN)
METAESTGMI

SEQ ID NO: 139088 - protein, 9 aa, Artificial Sequence
  Description of Artificial Sequence: Synthetic peptide
  Seed: TPAEVSIVV (PMEL_HUMAN)
TTAEVSIVM

SEQ ID NO: 139089 - protein, 9 aa, Artificial Sequence
  Description of Artificial Sequence: Synthetic peptide
  Seed: FTITDQVPF (PMEL_HUMAN)
FVITDQVPM

SEQ ID NO: 139090 - protein, 10 aa, Artificial Sequence
  Description of Artificial Sequence: Synthetic peptide
  Seed: QILKGGSGTY (PMEL_HUMAN)
QVLKGGSGTW

SEQ ID NO: 139091 - protein, 9 aa, Artificial Sequence
  Description of Artificial Sequence: Synthetic peptide
  Seed: SLAVVSTQL (PMEL_HUMAN)
SMAVVSTQK

SEQ ID NO: 139092 - protein, 9 aa, Artificial Sequence
  Description of Artificial Sequence: Synthetic peptide
  Seed: YLEPGPVTA (PMEL_HUMAN)
YVEPGPVTV

SEQ ID NO: 139093 - protein, 9 aa, Artificial Sequence
  Description of Artificial Sequence: Synthetic peptide
  Seed: TTDGHRPTA (PMEL_HUMAN)
TMDGHRPTV

SEQ ID NO: 139094 - protein, 9 aa, Artificial Sequence
  Description of Artificial Sequence: Synthetic peptide
  Seed: ALLAVGATK (PMEL_HUMAN)
ATLAVGATR

SEQ ID NO: 139095 - protein, 9 aa, Artificial Sequence
  Description of Artificial Sequence: Synthetic peptide
  Seed: SSHWLRLPR (PMEL_HUMAN)
SAHWLRLPK

SEQ ID NO: 139096 - protein, 10 aa, Artificial Sequence
  Description of Artificial Sequence: Synthetic peptide
  Seed: LHLAVIGALL (PMEL_HUMAN)
LTLAVIGALV

SEQ ID NO: 139097 - protein, 10 aa, Artificial Sequence
  Description of Artificial Sequence: Synthetic peptide
  Seed: SRALVVTHTY (PMEL_HUMAN)
SYALVVTHTW

SEQ ID NO: 139098 - protein, 9 aa, Artificial Sequence
  Description of Artificial Sequence: Synthetic peptide
  Seed: LSIGTGRAM (PMEL_HUMAN)
LKIGTGRAI

SEQ ID NO: 139099 - protein, 10 aa, Artificial Sequence
  Description of Artificial Sequence: Synthetic peptide
  Seed: RSFVYVWKTW (PMEL_HUMAN)
REFVYVWKTF

SEQ ID NO: 139100 - protein, 10 aa, Artificial Sequence
  Description of Artificial Sequence: Synthetic peptide
  Seed: VPQLPHSSSH (PMEL_HUMAN)
VQQLPHSSSM

SEQ ID NO: 139101 - protein, 9 aa, Artificial Sequence
  Description of Artificial Sequence: Synthetic peptide
  Seed: EKVPVSEVM (PMEL_HUMAN)
ELVPVSEVF

SEQ ID NO: 139102 - protein, 10 aa, Artificial Sequence
  Description of Artificial Sequence: Synthetic peptide
  Seed: VTAQVVLQAA (PMEL_HUMAN)
VLAQVVLQAL

SEQ ID NO: 139103 - protein, 9 aa, Artificial Sequence
  Description of Artificial Sequence: Synthetic peptide
  Seed: FTITDQVPF (PMEL_HUMAN)
FPITDQVPN

SEQ ID NO: 139104 - protein, 10 aa, Artificial Sequence
  Description of Artificial Sequence: Synthetic peptide
  Seed: LVLMAVVLAS (PMEL_HUMAN)
LTLMAVVLAI

SEQ ID NO: 139105 - protein, 9 aa, Artificial Sequence
  Description of Artificial Sequence: Synthetic peptide
  Seed: VQVPTTEVI (PMEL_HUMAN)
VLVPTTEVM

SEQ ID NO: 139106 - protein, 9 aa, Artificial Sequence
  Description of Artificial Sequence: Synthetic peptide
  Seed: SQKRSFVYV (PMEL_HUMAN)
SMKRSFVYL

SEQ ID NO: 139107 - protein, 9 aa, Artificial Sequence
  Description of Artificial Sequence: Synthetic peptide
  Seed: VSLADTNSL (PMEL_HUMAN)
VLLADTNSM

SEQ ID NO: 139108 - protein, 9 aa, Artificial Sequence
  Description of Artificial Sequence: Synthetic peptide
  Seed: AEMSTPEAT (PMEL_HUMAN)
ADMSTPEAW

SEQ ID NO: 139109 - protein, 9 aa, Artificial Sequence
  Description of Artificial Sequence: Synthetic peptide
  Seed: ALDGGNKHF (PMEL_HUMAN)
AMDGGNKHY

SEQ ID NO: 139110 - protein, 10 aa, Artificial Sequence
  Description of Artificial Sequence: Synthetic peptide
  Seed: RQVPLDCVLY (PMEL_HUMAN)
RMVPLDCVLW

SEQ ID NO: 139111 - protein, 9 aa, Artificial Sequence
  Description of Artificial Sequence: Synthetic peptide
  Seed: GTYCLNVSL (PMEL_HUMAN)
GAYCLNVSF

SEQ ID NO: 139112 - protein, 9 aa, Artificial Sequence
  Description of Artificial Sequence: Synthetic peptide
  Seed: TTDGHRPTA (PMEL_HUMAN)
TSDGHRPTY

SEQ ID NO: 139113 - protein, 10 aa, Artificial Sequence
  Description of Artificial Sequence: Synthetic peptide
  Seed: AEILQAVPSG (PMEL_HUMAN)
AEILQAVPST

SEQ ID NO: 139114 - protein, 9 aa, Artificial Sequence
  Description of Artificial Sequence: Synthetic peptide
  Seed: RYGSFSVTL (PMEL_HUMAN)
RAGSFSVTF

SEQ ID NO: 139115 - protein, 9 aa, Artificial Sequence
  Description of Artificial Sequence: Synthetic peptide
  Seed: RAMLGTHTM (PMEL_HUMAN)
RTMLGTHTL

SEQ ID NO: 139116 - protein, 9 aa, Artificial Sequence
  Description of Artificial Sequence: Synthetic peptide
  Seed: EKVPVSEVM (PMEL_HUMAN)
ERVPVSEVL

SEQ ID NO: 139117 - protein, 10 aa, Artificial Sequence
  Description of Artificial Sequence: Synthetic peptide
  Seed: LIMPGQEAGL (PMEL_HUMAN)
LAMPGQEAGV

SEQ ID NO: 139118 - protein, 10 aa, Artificial Sequence
  Description of Artificial Sequence: Synthetic peptide
  Seed: EVSIVVLSGT (PMEL_HUMAN)
EKSIVVLSGV

SEQ ID NO: 139119 - protein, 9 aa, Artificial Sequence
  Description of Artificial Sequence: Synthetic peptide
  Seed: LPSPACQLV (PMEL_HUMAN)
LASPACQLY

SEQ ID NO: 139120 - protein, 9 aa, Artificial Sequence
  Description of Artificial Sequence: Synthetic peptide
  Seed: YLAEADLSY (PMEL_HUMAN)
YLAEADLSM

SEQ ID NO: 139121 - protein, 9 aa, Artificial Sequence
  Description of Artificial Sequence: Synthetic peptide
  Seed: ITGSLGPLL (PMEL_HUMAN)
IMGSLGPLL

SEQ ID NO: 139122 - protein, 10 aa, Artificial Sequence
  Description of Artificial Sequence: Synthetic peptide
  Seed: KTWGQYWQVL (PMEL_HUMAN)
KIWGQYWQVE

SEQ ID NO: 139123 - protein, 9 aa, Artificial Sequence
  Description of Artificial Sequence: Synthetic peptide
  Seed: VTAQVVLQA (PMEL_HUMAN)
VLAQVVLQM

SEQ ID NO: 139124 - protein, 9 aa, Artificial Sequence
  Description of Artificial Sequence: Synthetic peptide
  Seed: VSEVMGTTL (PMEL_HUMAN)
VSEVMGTTW

SEQ ID NO: 139125 - protein, 10 aa, Artificial Sequence
  Description of Artificial Sequence: Synthetic peptide
  Seed: LADTNSLAVV (PMEL_HUMAN)
LVDTNSLAVM

SEQ ID NO: 139126 - protein, 10 aa, Artificial Sequence
  Description of Artificial Sequence: Synthetic peptide
  Seed: KTWGQYWQVL (PMEL_HUMAN)
KWWGQYWQVI

SEQ ID NO: 139127 - protein, 9 aa, Artificial Sequence
  Description of Artificial Sequence: Synthetic peptide
  Seed: SLAVVSTQL (PMEL_HUMAN)
SLAVVSTQI

SEQ ID NO: 139128 - protein, 9 aa, Artificial Sequence
  Description of Artificial Sequence: Synthetic peptide
  Seed: LQAAIPLTS (PMEL_HUMAN)
LRAAIPLTM

SEQ ID NO: 139129 - protein, 10 aa, Artificial Sequence
  Description of Artificial Sequence: Synthetic peptide
  Seed: EVISTAPVQM (PMEL_HUMAN)
EIISTAPVQR

SEQ ID NO: 139130 - protein, 10 aa, Artificial Sequence
  Description of Artificial Sequence: Synthetic peptide
  Seed: ASSIMSTESI (PMEL_HUMAN)
ARSIMSTESF

SEQ ID NO: 139131 - protein, 10 aa, Artificial Sequence
  Description of Artificial Sequence: Synthetic peptide
  Seed: RALVVTHTYL (PMEL_HUMAN)
RTLVVTHTYL

SEQ ID NO: 139132 - protein, 9 aa, Artificial Sequence
  Description of Artificial Sequence: Synthetic peptide
  Seed: FGDSSGTLI (PMEL_HUMAN)
FWDSSGTLF

SEQ ID NO: 139133 - protein, 11 aa, Artificial Sequence
  Description of Artificial Sequence: Synthetic peptide
  Seed: SYVPLAHSSSA (PMEL_HUMAN)
SCVPLAHSSSL

SEQ ID NO: 139134 - protein, 10 aa, Artificial Sequence
  Description of Artificial Sequence: Synthetic peptide
  Seed: VYHRRGSRSY (PMEL_HUMAN)
VYHRRGSRSF

SEQ ID NO: 139135 - protein, 9 aa, Artificial Sequence
  Description of Artificial Sequence: Synthetic peptide
  Seed: TIINGSQVW (PMEL_HUMAN)
TMINGSQVL

SEQ ID NO: 139136 - protein, 10 aa, Artificial Sequence
  Description of Artificial Sequence: Synthetic peptide
  Seed: RALVVTHTYL (PMEL_HUMAN)
RMLVVTHTYL

SEQ ID NO: 139137 - protein, 11 aa, Artificial Sequence
  Description of Artificial Sequence: Synthetic peptide
  Seed: FSVTLDIVQGI (PMEL_HUMAN)
FKVTLDIVQGV

SEQ ID NO: 139138 - protein, 10 aa, Artificial Sequence
  Description of Artificial Sequence: Synthetic peptide
  Seed: AVIGALLAVG (PMEL_HUMAN)
AMIGALLAVD

SEQ ID NO: 139139 - protein, 10 aa, Artificial Sequence
  Description of Artificial Sequence: Synthetic peptide
  Seed: LVLKRCLLHL (PMEL_HUMAN)
LILKRCLLHV

SEQ ID NO: 139140 - protein, 9 aa, Artificial Sequence
  Description of Artificial Sequence: Synthetic peptide
  Seed: STAPVQMPT (PMEL_HUMAN)
SAAPVQMPL

SEQ ID NO: 139141 - protein, 9 aa, Artificial Sequence
  Description of Artificial Sequence: Synthetic peptide
  Seed: LAVVSTQLI (PMEL_HUMAN)
LAVVSTQLM

SEQ ID NO: 139142 - protein, 9 aa, Artificial Sequence
  Description of Artificial Sequence: Synthetic peptide
  Seed: STESITGSL (PMEL_HUMAN)
SAESITGSY

SEQ ID NO: 139143 - protein, 9 aa, Artificial Sequence
  Description of Artificial Sequence: Synthetic peptide
  Seed: HTMEVTVYH (PMEL_HUMAN)
HPMEVTVYW

SEQ ID NO: 139144 - protein, 9 aa, Artificial Sequence
  Description of Artificial Sequence: Synthetic peptide
  Seed: KTWGQYWQV (PMEL_HUMAN)
KQWGQYWQV

SEQ ID NO: 139145 - protein, 8 aa, Artificial Sequence
  Description of Artificial Sequence: Synthetic peptide
  Seed: EVISTAPV (PMEL_HUMAN)
ETISTAPV

SEQ ID NO: 139146 - protein, 9 aa, Artificial Sequence
  Description of Artificial Sequence: Synthetic peptide
  Seed: RNQPLTFAL (PMEL_HUMAN)
RIQPLTFAI

SEQ ID NO: 139147 - protein, 10 aa, Artificial Sequence
  Description of Artificial Sequence: Synthetic peptide
  Seed: RRLMKQDFSV (PMEL_HUMAN)
RKLMKQDFSV

SEQ ID NO: 139148 - protein, 9 aa, Artificial Sequence
  Description of Artificial Sequence: Synthetic peptide
  Seed: LAVVSTQLI (PMEL_HUMAN)
LQVVSTQLW

SEQ ID NO: 139149 - protein, 10 aa, Artificial Sequence
  Description of Artificial Sequence: Synthetic peptide
  Seed: RSYVPLAHSS (PMEL_HUMAN)
RMYVPLAHSK

SEQ ID NO: 139150 - protein, 10 aa, Artificial Sequence
  Description of Artificial Sequence: Synthetic peptide
  Seed: SGTYCLNVSL (PMEL_HUMAN)
SHTYCLNVSF

SEQ ID NO: 139151 - protein, 9 aa, Artificial Sequence
  Description of Artificial Sequence: Synthetic peptide
  Seed: LVLKRCLLH (PMEL_HUMAN)
LVLKRCLLR

SEQ ID NO: 139152 - protein, 9 aa, Artificial Sequence
  Description of Artificial Sequence: Synthetic peptide
  Seed: MTPEKVPVS (PMEL_HUMAN)
MQPEKVPVM

SEQ ID NO: 139153 - protein, 11 aa, Artificial Sequence
  Description of Artificial Sequence: Synthetic peptide
  Seed: RRGSRSYVPLA (PMEL_HUMAN)
RGGSRSYVPLK

SEQ ID NO: 139154 - protein, 9 aa, Artificial Sequence
  Description of Artificial Sequence: Synthetic peptide
  Seed: HTMEVTVYH (PMEL_HUMAN)
HWMEVTVYR

SEQ ID NO: 139155 - protein, 10 aa, Artificial Sequence
  Description of Artificial Sequence: Synthetic peptide
  Seed: RGSRSYVPLA (PMEL_HUMAN)
RVSRSYVPLM

SEQ ID NO: 139156 - protein, 10 aa, Artificial Sequence
  Description of Artificial Sequence: Synthetic peptide
  Seed: SQVWGGQPVY (PMEL_HUMAN)
SMVWGGQPVM

SEQ ID NO: 139157 - protein, 9 aa, Artificial Sequence
  Description of Artificial Sequence: Synthetic peptide
  Seed: LMAVVLASL (PMEL_HUMAN)
LIAVVLASF

SEQ ID NO: 139158 - protein, 9 aa, Artificial Sequence
  Description of Artificial Sequence: Synthetic peptide
  Seed: RNQPLTFAL (PMEL_HUMAN)
RCQPLTFAW

SEQ ID NO: 139159 - protein, 9 aa, Artificial Sequence
  Description of Artificial Sequence: Synthetic peptide
  Seed: KTWGQYWQV (PMEL_HUMAN)
KMWGQYWQW

SEQ ID NO: 139160 - protein, 10 aa, Artificial Sequence
  Description of Artificial Sequence: Synthetic peptide
  Seed: MTPAEVSIVV (PMEL_HUMAN)
MGPAEVSIVA

SEQ ID NO: 139161 - protein, 9 aa, Artificial Sequence
  Description of Artificial Sequence: Synthetic peptide
  Seed: VMGTTLAEM (PMEL_HUMAN)
VMGTTLAEA

SEQ ID NO: 139162 - protein, 10 aa, Artificial Sequence
  Description of Artificial Sequence: Synthetic peptide
  Seed: RALVVTHTYL (PMEL_HUMAN)
RGLVVTHTYW

SEQ ID NO: 139163 - protein, 10 aa, Artificial Sequence
  Description of Artificial Sequence: Synthetic peptide
  Seed: VLMAVVLASL (PMEL_HUMAN)
VEMAVVLASY

SEQ ID NO: 139164 - protein, 10 aa, Artificial Sequence
  Description of Artificial Sequence: Synthetic peptide
  Seed: YGSFSVTLDI (PMEL_HUMAN)
YVSFSVTLDF

SEQ ID NO: 139165 - protein, 9 aa, Artificial Sequence
  Description of Artificial Sequence: Synthetic peptide
  Seed: RNQPLTFAL (PMEL_HUMAN)
RQQPLTFAL

SEQ ID NO: 139166 - protein, 9 aa, Artificial Sequence
  Description of Artificial Sequence: Synthetic peptide
  Seed: DGGNKHFLR (PMEL_HUMAN)
DTGNKHFLK

SEQ ID NO: 139167 - protein, 9 aa, Artificial Sequence
  Description of Artificial Sequence: Synthetic peptide
  Seed: RLPRIFCSC (PMEL_HUMAN)
RMPRIFCSL

SEQ ID NO: 139168 - protein, 9 aa, Artificial Sequence
  Description of Artificial Sequence: Synthetic peptide
  Seed: RYGSFSVTL (PMEL_HUMAN)
RYGSFSVTY

SEQ ID NO: 139169 - protein, 9 aa, Artificial Sequence
  Description of Artificial Sequence: Synthetic peptide
  Seed: VPFSVSVSQ (PMEL_HUMAN)
VPFSVSVSP

SEQ ID NO: 139170 - protein, 10 aa, Artificial Sequence
  Description of Artificial Sequence: Synthetic peptide
  Seed: ALDGGNKHFL (PMEL_HUMAN)
AQDGGNKHFM

SEQ ID NO: 139171 - protein, 9 aa, Artificial Sequence
  Description of Artificial Sequence: Synthetic peptide
  Seed: QLRTKAWNR (PMEL_HUMAN)
QTRTKAWNR

SEQ ID NO: 139172 - protein, 11 aa, Artificial Sequence
  Description of Artificial Sequence: Synthetic peptide
  Seed: KVLPDGQVIWV (PMEL_HUMAN)
KCLPDGQVIWF

SEQ ID NO: 139173 - protein, 9 aa, Artificial Sequence
  Description of Artificial Sequence: Synthetic peptide
  Seed: RALDGGNKH (PMEL_HUMAN)
RALDGGNKL

SEQ ID NO: 139174 - protein, 9 aa, Artificial Sequence
  Description of Artificial Sequence: Synthetic peptide
  Seed: ANASFSIAL (PMEL_HUMAN)
AMASFSIAL

SEQ ID NO: 139175 - protein, 10 aa, Artificial Sequence
  Description of Artificial Sequence: Synthetic peptide
  Seed: RQLYPEWTEA (PMEL_HUMAN)
RVLYPEWTEV

SEQ ID NO: 139176 - protein, 9 aa, Artificial Sequence
  Description of Artificial Sequence: Synthetic peptide
  Seed: VPSGEGDAF (PMEL_HUMAN)
VVSGEGDAF

SEQ ID NO: 139177 - protein, 10 aa, Artificial Sequence
  Description of Artificial Sequence: Synthetic peptide
  Seed: LAVIGALLAV (PMEL_HUMAN)
LEVIGALLAI

SEQ ID NO: 139178 - protein, 8 aa, Artificial Sequence
  Description of Artificial Sequence: Synthetic peptide
  Seed: LIYRRRLM (PMEL_HUMAN)
LLYRRRLM

SEQ ID NO: 139179 - protein, 11 aa, Artificial Sequence
  Description of Artificial Sequence: Synthetic peptide
  Seed: SSPGCQPPAQR (PMEL_HUMAN)
SVPGCQPPAQR

SEQ ID NO: 139180 - protein, 10 aa, Artificial Sequence
  Description of Artificial Sequence: Synthetic peptide
  Seed: LAVVSTQLIM (PMEL_HUMAN)
LTVVSTQLIY

SEQ ID NO: 139181 - protein, 9 aa, Artificial Sequence
  Description of Artificial Sequence: Synthetic peptide
  Seed: VSLADTNSL (PMEL_HUMAN)
VTLADTNSL

SEQ ID NO: 139182 - protein, 10 aa, Artificial Sequence
  Description of Artificial Sequence: Synthetic peptide
  Seed: LHLAVIGALL (PMEL_HUMAN)
LPLAVIGALV

SEQ ID NO: 139183 - protein, 9 aa, Artificial Sequence
  Description of Artificial Sequence: Synthetic peptide
  Seed: FTITDQVPF (PMEL_HUMAN)
FMITDQVPW

SEQ ID NO: 139184 - protein, 10 aa, Artificial Sequence
  Description of Artificial Sequence: Synthetic peptide
  Seed: LQLHDPSGYL (PMEL_HUMAN)
LYLHDPSGYI

SEQ ID NO: 139185 - protein, 9 aa, Artificial Sequence
  Description of Artificial Sequence: Synthetic peptide
  Seed: RALVVTHTY (PMEL_HUMAN)
RYLVVTHTK

SEQ ID NO: 139186 - protein, 9 aa, Artificial Sequence
  Description of Artificial Sequence: Synthetic peptide
  Seed: VQVPTTEVI (PMEL_HUMAN)
VSVPTTEVL

SEQ ID NO: 139187 - protein, 10 aa, Artificial Sequence
  Description of Artificial Sequence: Synthetic peptide
  Seed: VSLADTNSLA (PMEL_HUMAN)
VILADTNSLL

SEQ ID NO: 139188 - protein, 11 aa, Artificial Sequence
  Description of Artificial Sequence: Synthetic peptide
  Seed: RRRLMKQDFSV (PMEL_HUMAN)
RNRLMKQDFSV

SEQ ID NO: 139189 - protein, 9 aa, Artificial Sequence
  Description of Artificial Sequence: Synthetic peptide
  Seed: YVWKTWGQY (PMEL_HUMAN)
YTWKTWGQR

SEQ ID NO: 139190 - protein, 10 aa, Artificial Sequence
  Description of Artificial Sequence: Synthetic peptide
  Seed: SCPIGENSPL (PMEL_HUMAN)
SNPIGENSPM

SEQ ID NO: 139191 - protein, 9 aa, Artificial Sequence
  Description of Artificial Sequence: Synthetic peptide
  Seed: LMAVVLASL (PMEL_HUMAN)
LTAVVLASF

SEQ ID NO: 139192 - protein, 9 aa, Artificial Sequence
  Description of Artificial Sequence: Synthetic peptide
  Seed: GSRSYVPLA (PMEL_HUMAN)
GSRSYVPLS

SEQ ID NO: 139193 - protein, 9 aa, Artificial Sequence
  Description of Artificial Sequence: Synthetic peptide
  Seed: MAVVLASLI (PMEL_HUMAN)
MSVVLASLL

SEQ ID NO: 139194 - protein, 9 aa, Artificial Sequence
  Description of Artificial Sequence: Synthetic peptide
  Seed: KTWGQYWQV (PMEL_HUMAN)
KIWGQYWQC

SEQ ID NO: 139195 - protein, 9 aa, Artificial Sequence
  Description of Artificial Sequence: Synthetic peptide
  Seed: FLRNQPLTF (PMEL_HUMAN)
FIRNQPLTL

SEQ ID NO: 139196 - protein, 9 aa, Artificial Sequence
  Description of Artificial Sequence: Synthetic peptide
  Seed: RLMKQDFSV (PMEL_HUMAN)
RTMKQDFSR

SEQ ID NO: 139197 - protein, 9 aa, Artificial Sequence
  Description of Artificial Sequence: Synthetic peptide
  Seed: RLMKQDFSV (PMEL_HUMAN)
RLMKQDFSR

SEQ ID NO: 139198 - protein, 10 aa, Artificial Sequence
  Description of Artificial Sequence: Synthetic peptide
  Seed: RQLRTKAWNR (PMEL_HUMAN)
RRLRTKAWNY

SEQ ID NO: 139199 - protein, 8 aa, Artificial Sequence
  Description of Artificial Sequence: Synthetic peptide
  Seed: AESTGMTP (PMEL_HUMAN)
AESTGMTL

SEQ ID NO: 139200 - protein, 9 aa, Artificial Sequence
  Description of Artificial Sequence: Synthetic peptide
  Seed: VSNDGPTLI (PMEL_HUMAN)
VWNDGPTLI

SEQ ID NO: 139201 - protein, 10 aa, Artificial Sequence
  Description of Artificial Sequence: Synthetic peptide
  Seed: LAVVSTQLIM (PMEL_HUMAN)
LTVVSTQLIW

SEQ ID NO: 139202 - protein, 10 aa, Artificial Sequence
  Description of Artificial Sequence: Synthetic peptide
  Seed: LAHSSSAFTI (PMEL_HUMAN)
LIHSSSAFTW

SEQ ID NO: 139203 - protein, 9 aa, Artificial Sequence
  Description of Artificial Sequence: Synthetic peptide
  Seed: VQMPTAEST (PMEL_HUMAN)
VHMPTAESL

SEQ ID NO: 139204 - protein, 8 aa, Artificial Sequence
  Description of Artificial Sequence: Synthetic peptide
  Seed: AEMSTPEA (PMEL_HUMAN)
AEMSTPEL

SEQ ID NO: 139205 - protein, 10 aa, Artificial Sequence
  Description of Artificial Sequence: Synthetic peptide
  Seed: MTPAEVSIVV (PMEL_HUMAN)
MQPAEVSIVA

SEQ ID NO: 139206 - protein, 9 aa, Artificial Sequence
  Description of Artificial Sequence: Synthetic peptide
  Seed: SQVWGGQPV (PMEL_HUMAN)
SEVWGGQPF

SEQ ID NO: 139207 - protein, 9 aa, Artificial Sequence
  Description of Artificial Sequence: Synthetic peptide
  Seed: RNQPLTFAL (PMEL_HUMAN)
RGQPLTFAY

SEQ ID NO: 139208 - protein, 9 aa, Artificial Sequence
  Description of Artificial Sequence: Synthetic peptide
  Seed: AQRLCQPVL (PMEL_HUMAN)
ASRLCQPVK

SEQ ID NO: 139209 - protein, 10 aa, Artificial Sequence
  Description of Artificial Sequence: Synthetic peptide
  Seed: ALNFPGSQKV (PMEL_HUMAN)
AVNFPGSQKK

SEQ ID NO: 139210 - protein, 9 aa, Artificial Sequence
  Description of Artificial Sequence: Synthetic peptide
  Seed: VMGTTLAEM (PMEL_HUMAN)
VAGTTLAEM

SEQ ID NO: 139211 - protein, 9 aa, Artificial Sequence
  Description of Artificial Sequence: Synthetic peptide
  Seed: FLRNQPLTF (PMEL_HUMAN)
FGRNQPLTM

SEQ ID NO: 139212 - protein, 10 aa, Artificial Sequence
  Description of Artificial Sequence: Synthetic peptide
  Seed: VPLDCVLYRY (PMEL_HUMAN)
VSLDCVLYRY

SEQ ID NO: 139213 - protein, 9 aa, Artificial Sequence
  Description of Artificial Sequence: Synthetic peptide
  Seed: KQDFSVPQL (PMEL_HUMAN)
KHDFSVPQL

SEQ ID NO: 139214 - protein, 9 aa, Artificial Sequence
  Description of Artificial Sequence: Synthetic peptide
  Seed: GQVPLIVGI (PMEL_HUMAN)
GSVPLIVGV

SEQ ID NO: 139215 - protein, 9 aa, Artificial Sequence
  Description of Artificial Sequence: Synthetic peptide
  Seed: TLISRALVV (PMEL_HUMAN)
TSISRALVM

SEQ ID NO: 139216 - protein, 10 aa, Artificial Sequence
  Description of Artificial Sequence: Synthetic peptide
  Seed: MAVVLASLIY (PMEL_HUMAN)
MNVVLASLIR

SEQ ID NO: 139217 - protein, 10 aa, Artificial Sequence
  Description of Artificial Sequence: Synthetic peptide
  Seed: SGTYCLNVSL (PMEL_HUMAN)
SQTYCLNVSY

SEQ ID NO: 139218 - protein, 10 aa, Artificial Sequence
  Description of Artificial Sequence: Synthetic peptide
  Seed: YLAEADLSYT (PMEL_HUMAN)
YQAEADLSYI

SEQ ID NO: 139219 - protein, 9 aa, Artificial Sequence
  Description of Artificial Sequence: Synthetic peptide
  Seed: RALDGGNKH (PMEL_HUMAN)
RMLDGGNKF

SEQ ID NO: 139220 - protein, 9 aa, Artificial Sequence
  Description of Artificial Sequence: Synthetic peptide
  Seed: MLGTHTMEV (PMEL_HUMAN)
MMGTHTMEI

SEQ ID NO: 139221 - protein, 9 aa, Artificial Sequence
  Description of Artificial Sequence: Synthetic peptide
  Seed: FSVSVSQLR (PMEL_HUMAN)
FMVSVSQLK

SEQ ID NO: 139222 - protein, 9 aa, Artificial Sequence
  Description of Artificial Sequence: Synthetic peptide
  Seed: TTDGHRPTA (PMEL_HUMAN)
TCDGHRPTF

SEQ ID NO: 139223 - protein, 11 aa, Artificial Sequence
  Description of Artificial Sequence: Synthetic peptide
  Seed: GYLAEADLSYT (PMEL_HUMAN)
GYLAEADLSYM

SEQ ID NO: 139224 - protein, 9 aa, Artificial Sequence
  Description of Artificial Sequence: Synthetic peptide
  Seed: RQVPLDCVL (PMEL_HUMAN)
RTVPLDCVV

SEQ ID NO: 139225 - protein, 9 aa, Artificial Sequence
  Description of Artificial Sequence: Synthetic peptide
  Seed: RYGSFSVTL (PMEL_HUMAN)
RLGSFSVTV

SEQ ID NO: 139226 - protein, 9 aa, Artificial Sequence
  Description of Artificial Sequence: Synthetic peptide
  Seed: AVIGALLAV (PMEL_HUMAN)
AMIGALLAF

SEQ ID NO: 139227 - protein, 10 aa, Artificial Sequence
  Description of Artificial Sequence: Synthetic peptide
  Seed: AVIGALLAVG (PMEL_HUMAN)
AQIGALLAVP

SEQ ID NO: 139228 - protein, 9 aa, Artificial Sequence
  Description of Artificial Sequence: Synthetic peptide
  Seed: RSYVPLAHS (PMEL_HUMAN)
RSYVPLAHA

SEQ ID NO: 139229 - protein, 10 aa, Artificial Sequence
  Description of Artificial Sequence: Synthetic peptide
  Seed: HFLRNQPLTF (PMEL_HUMAN)
HQLRNQPLTY

SEQ ID NO: 139230 - protein, 9 aa, Artificial Sequence
  Description of Artificial Sequence: Synthetic peptide
  Seed: ITDQVPFSV (PMEL_HUMAN)
IMDQVPFSF

SEQ ID NO: 139231 - protein, 11 aa, Artificial Sequence
  Description of Artificial Sequence: Synthetic peptide
  Seed: QKVLPDGQVIW (PMEL_HUMAN)
QEVLPDGQVIY

SEQ ID NO: 139232 - protein, 10 aa, Artificial Sequence
  Description of Artificial Sequence: Synthetic peptide
  Seed: RGSRSYVPLA (PMEL_HUMAN)
RYSRSYVPLK

SEQ ID NO: 139233 - protein, 10 aa, Artificial Sequence
  Description of Artificial Sequence: Synthetic peptide
  Seed: WKTWGQYWQV (PMEL_HUMAN)
WATWGQYWQV

SEQ ID NO: 139234 - protein, 10 aa, Artificial Sequence
  Description of Artificial Sequence: Synthetic peptide
  Seed: MTPAEVSIVV (PMEL_HUMAN)
MAPAEVSIVI

SEQ ID NO: 139235 - protein, 10 aa, Artificial Sequence
  Description of Artificial Sequence: Synthetic peptide
  Seed: RGSRSYVPLA (PMEL_HUMAN)
RISRSYVPLT

SEQ ID NO: 139236 - protein, 10 aa, Artificial Sequence
  Description of Artificial Sequence: Synthetic peptide
  Seed: QVLGGPVSGL (PMEL_HUMAN)
QVLGGPVSGI

SEQ ID NO: 139237 - protein, 9 aa, Artificial Sequence
  Description of Artificial Sequence: Synthetic peptide
  Seed: LNFPGSQKV (PMEL_HUMAN)
LMFPGSQKA

SEQ ID NO: 139238 - protein, 9 aa, Artificial Sequence
  Description of Artificial Sequence: Synthetic peptide
  Seed: RLVKRQVPL (PMEL_HUMAN)
RPVKRQVPF

SEQ ID NO: 139239 - protein, 10 aa, Artificial Sequence
  Description of Artificial Sequence: Synthetic peptide
  Seed: LIMPGQEAGL (PMEL_HUMAN)
LLMPGQEAGM

SEQ ID NO: 139240 - protein, 9 aa, Artificial Sequence
  Description of Artificial Sequence: Synthetic peptide
  Seed: FTITDQVPF (PMEL_HUMAN)
FFITDQVPL

SEQ ID NO: 139241 - protein, 8 aa, Artificial Sequence
  Description of Artificial Sequence: Synthetic peptide
  Seed: LNFPGSQK (PMEL_HUMAN)
LTFPGSQL

SEQ ID NO: 139242 - protein, 9 aa, Artificial Sequence
  Description of Artificial Sequence: Synthetic peptide
  Seed: RNQPLTFAL (PMEL_HUMAN)
RGQPLTFAF

SEQ ID NO: 139243 - protein, 10 aa, Artificial Sequence
  Description of Artificial Sequence: Synthetic peptide
  Seed: QVIWVNNTII (PMEL_HUMAN)
QSIWVNNTIV

SEQ ID NO: 139244 - protein, 10 aa, Artificial Sequence
  Description of Artificial Sequence: Synthetic peptide
  Seed: YVPLAHSSSA (PMEL_HUMAN)
YKPLAHSSSL

SEQ ID NO: 139245 - protein, 10 aa, Artificial Sequence
  Description of Artificial Sequence: Synthetic peptide
  Seed: SVPQLPHSSS (PMEL_HUMAN)
SPPQLPHSSM

SEQ ID NO: 139246 - protein, 9 aa, Artificial Sequence
  Description of Artificial Sequence: Synthetic peptide
  Seed: RLMKQDFSV (PMEL_HUMAN)
RLMKQDFSM

SEQ ID NO: 139247 - protein, 8 aa, Artificial Sequence
  Description of Artificial Sequence: Synthetic peptide
  Seed: VLMAVVLA (PMEL_HUMAN)
VLMAVVLV

SEQ ID NO: 139248 - protein, 10 aa, Artificial Sequence
  Description of Artificial Sequence: Synthetic peptide
  Seed: MTPAEVSIVV (PMEL_HUMAN)
MAPAEVSIVT

SEQ ID NO: 139249 - protein, 9 aa, Artificial Sequence
  Description of Artificial Sequence: Synthetic peptide
  Seed: HLAVIGALL (PMEL_HUMAN)
HSAVIGALV

SEQ ID NO: 139250 - protein, 10 aa, Artificial Sequence
  Description of Artificial Sequence: Synthetic peptide
  Seed: MSTESITGSL (PMEL_HUMAN)
MKTESITGSV

SEQ ID NO: 139251 - protein, 9 aa, Artificial Sequence
  Description of Artificial Sequence: Synthetic peptide
  Seed: RTKAWNRQL (PMEL_HUMAN)
RVKAWNRQA

SEQ ID NO: 139252 - protein, 9 aa, Artificial Sequence
  Description of Artificial Sequence: Synthetic peptide
  Seed: SQVWGGQPV (PMEL_HUMAN)
SKVWGGQPY

SEQ ID NO: 139253 - protein, 9 aa, Artificial Sequence
  Description of Artificial Sequence: Synthetic peptide
  Seed: YHRRGSRSY (PMEL_HUMAN)
YKRRGSRSF

SEQ ID NO: 139254 - protein, 10 aa, Artificial Sequence
  Description of Artificial Sequence: Synthetic peptide
  Seed: TYLEPGPVTA (PMEL_HUMAN)
TFLEPGPVTF

SEQ ID NO: 139255 - protein, 10 aa, Artificial Sequence
  Description of Artificial Sequence: Synthetic peptide
  Seed: VPQLPHSSSH (PMEL_HUMAN)
VPQLPHSSSF

SEQ ID NO: 139256 - protein, 9 aa, Artificial Sequence
  Description of Artificial Sequence: Synthetic peptide
  Seed: AVVSTQLIM (PMEL_HUMAN)
AKVSTQLIY

SEQ ID NO: 139257 - protein, 9 aa, Artificial Sequence
  Description of Artificial Sequence: Synthetic peptide
  Seed: EAQRLDCWR (PMEL_HUMAN)
EYQRLDCWR

SEQ ID NO: 139258 - protein, 9 aa, Artificial Sequence
  Description of Artificial Sequence: Synthetic peptide
  Seed: KTWGQYWQV (PMEL_HUMAN)
KVWGQYWQY

SEQ ID NO: 139259 - protein, 10 aa, Artificial Sequence
  Description of Artificial Sequence: Synthetic peptide
  Seed: ESAEILQAVP (PMEL_HUMAN)
EVAEILQAVA

SEQ ID NO: 139260 - protein, 10 aa, Artificial Sequence
  Description of Artificial Sequence: Synthetic peptide
  Seed: MTPAEVSIVV (PMEL_HUMAN)
MVPAEVSIVV

SEQ ID NO: 139261 - protein, 10 aa, Artificial Sequence
  Description of Artificial Sequence: Synthetic peptide
  Seed: VLYRYGSFSV (PMEL_HUMAN)
VLYRYGSFSL

SEQ ID NO: 139262 - protein, 10 aa, Artificial Sequence
  Description of Artificial Sequence: Synthetic peptide
  Seed: MAVVLASLIY (PMEL_HUMAN)
MFVVLASLIR

SEQ ID NO: 139263 - protein, 9 aa, Artificial Sequence
  Description of Artificial Sequence: Synthetic peptide
  Seed: RYGSFSVTL (PMEL_HUMAN)
RVGSFSVTM

SEQ ID NO: 139264 - protein, 8 aa, Artificial Sequence
  Description of Artificial Sequence: Synthetic peptide
  Seed: RSFVYVWK (PMEL_HUMAN)
RAFVYVWR

SEQ ID NO: 139265 - protein, 9 aa, Artificial Sequence
  Description of Artificial Sequence: Synthetic peptide
  Seed: RNQPLTFAL (PMEL_HUMAN)
RTQPLTFAL

SEQ ID NO: 139266 - protein, 9 aa, Artificial Sequence
  Description of Artificial Sequence: Synthetic peptide
  Seed: LQAAIPLTS (PMEL_HUMAN)
LMAAIPLTM

SEQ ID NO: 139267 - protein, 10 aa, Artificial Sequence
  Description of Artificial Sequence: Synthetic peptide
  Seed: THTMEVTVYH (PMEL_HUMAN)
TLTMEVTVYR

SEQ ID NO: 139268 - protein, 8 aa, Artificial Sequence
  Description of Artificial Sequence: Synthetic peptide
  Seed: LLDGTATL (PMEL_HUMAN)
LTDGTATI

SEQ ID NO: 139269 - protein, 9 aa, Artificial Sequence
  Description of Artificial Sequence: Synthetic peptide
  Seed: KTWGQYWQV (PMEL_HUMAN)
KMWGQYWQC

SEQ ID NO: 139270 - protein, 8 aa, Artificial Sequence
  Description of Artificial Sequence: Synthetic peptide
  Seed: VQVPTTEV (PMEL_HUMAN)
VQVPTTEL

SEQ ID NO: 139271 - protein, 9 aa, Artificial Sequence
  Description of Artificial Sequence: Synthetic peptide
  Seed: RGSRSYVPL (PMEL_HUMAN)
RTSRSYVPL

SEQ ID NO: 139272 - protein, 9 aa, Artificial Sequence
  Description of Artificial Sequence: Synthetic peptide
  Seed: TAEAPNTTA (PMEL_HUMAN)
TGEAPNTTL

SEQ ID NO: 139273 - protein, 9 aa, Artificial Sequence
  Description of Artificial Sequence: Synthetic peptide
  Seed: VSCQGGLPK (PMEL_HUMAN)
VACQGGLPK

SEQ ID NO: 139274 - protein, 9 aa, Artificial Sequence
  Description of Artificial Sequence: Synthetic peptide
  Seed: VPLDCVLYR (PMEL_HUMAN)
VQLDCVLYR

SEQ ID NO: 139275 - protein, 11 aa, Artificial Sequence
  Description of Artificial Sequence: Synthetic peptide
  Seed: RQLRTKAWNRQ (PMEL_HUMAN)
RILRTKAWNRR

SEQ ID NO: 139276 - protein, 10 aa, Artificial Sequence
  Description of Artificial Sequence: Synthetic peptide
  Seed: SLIYRRRLMK (PMEL_HUMAN)
SHIYRRRLMR

SEQ ID NO: 139277 - protein, 9 aa, Artificial Sequence
  Description of Artificial Sequence: Synthetic peptide
  Seed: SLADTNSLA (PMEL_HUMAN)
STADTNSLM

SEQ ID NO: 139278 - protein, 10 aa, Artificial Sequence
  Description of Artificial Sequence: Synthetic peptide
  Seed: QVLGGPVSGL (PMEL_HUMAN)
QTLGGPVSGY

SEQ ID NO: 139279 - protein, 11 aa, Artificial Sequence
  Description of Artificial Sequence: Synthetic peptide
  Seed: ISRALVVTHTY (PMEL_HUMAN)
ISRALVVTHTF

SEQ ID NO: 139280 - protein, 9 aa, Artificial Sequence
  Description of Artificial Sequence: Synthetic peptide
  Seed: ILKGGSGTY (PMEL_HUMAN)
ISKGGSGTL

SEQ ID NO: 139281 - protein, 10 aa, Artificial Sequence
  Description of Artificial Sequence: Synthetic peptide
  Seed: GDSSGTLISR (PMEL_HUMAN)
GRSSGTLISK

SEQ ID NO: 139282 - protein, 11 aa, Artificial Sequence
  Description of Artificial Sequence: Synthetic peptide
  Seed: CVLYRYGSFSV (PMEL_HUMAN)
CWLYRYGSFSV

SEQ ID NO: 139283 - protein, 9 aa, Artificial Sequence
  Description of Artificial Sequence: Synthetic peptide
  Seed: LHLAVIGAL (PMEL_HUMAN)
LALAVIGAM

SEQ ID NO: 139284 - protein, 9 aa, Artificial Sequence
  Description of Artificial Sequence: Synthetic peptide
  Seed: FLRNQPLTF (PMEL_HUMAN)
FRRNQPLTI

SEQ ID NO: 139285 - protein, 9 aa, Artificial Sequence
  Description of Artificial Sequence: Synthetic peptide
  Seed: LIVGILLVL (PMEL_HUMAN)
LTVGILLVM

SEQ ID NO: 139286 - protein, 9 aa, Artificial Sequence
  Description of Artificial Sequence: Synthetic peptide
  Seed: LPDGQVIWV (PMEL_HUMAN)
LNDGQVIWM

SEQ ID NO: 139287 - protein, 9 aa, Artificial Sequence
  Description of Artificial Sequence: Synthetic peptide
  Seed: KTWGQYWQV (PMEL_HUMAN)
KIWGQYWQM

SEQ ID NO: 139288 - protein, 9 aa, Artificial Sequence
  Description of Artificial Sequence: Synthetic peptide
  Seed: RTKAWNRQL (PMEL_HUMAN)
RTKAWNRQT

SEQ ID NO: 139289 - protein, 9 aa, Artificial Sequence
  Description of Artificial Sequence: Synthetic peptide
  Seed: ITDQVPFSV (PMEL_HUMAN)
INDQVPFSM

SEQ ID NO: 139290 - protein, 10 aa, Artificial Sequence
  Description of Artificial Sequence: Synthetic peptide
  Seed: YGSFSVTLDI (PMEL_HUMAN)
YQSFSVTLDW

SEQ ID NO: 139291 - protein, 9 aa, Artificial Sequence
  Description of Artificial Sequence: Synthetic peptide
  Seed: FGDSSGTLI (PMEL_HUMAN)
FQDSSGTLM

SEQ ID NO: 139292 - protein, 8 aa, Artificial Sequence
  Description of Artificial Sequence: Synthetic peptide
  Seed: SHWLRLPR (PMEL_HUMAN)
SVWLRLPR

SEQ ID NO: 139293 - protein, 9 aa, Artificial Sequence
  Description of Artificial Sequence: Synthetic peptide
  Seed: LIVGILLVL (PMEL_HUMAN)
LGVGILLVW

SEQ ID NO: 139294 - protein, 9 aa, Artificial Sequence
  Description of Artificial Sequence: Synthetic peptide
  Seed: EGDAFELTV (PMEL_HUMAN)
EADAFELTM

SEQ ID NO: 139295 - protein, 9 aa, Artificial Sequence
  Description of Artificial Sequence: Synthetic peptide
  Seed: AVIGALLAV (PMEL_HUMAN)
AMIGALLAI

SEQ ID NO: 139296 - protein, 9 aa, Artificial Sequence
  Description of Artificial Sequence: Synthetic peptide
  Seed: KTWGQYWQV (PMEL_HUMAN)
KTWGQYWQM

SEQ ID NO: 139297 - protein, 10 aa, Artificial Sequence
  Description of Artificial Sequence: Synthetic peptide
  Seed: LVLKRCLLHL (PMEL_HUMAN)
LWLKRCLLHV

SEQ ID NO: 139298 - protein, 10 aa, Artificial Sequence
  Description of Artificial Sequence: Synthetic peptide
  Seed: RQLYPEWTEA (PMEL_HUMAN)
RGLYPEWTEV

SEQ ID NO: 139299 - protein, 10 aa, Artificial Sequence
  Description of Artificial Sequence: Synthetic peptide
  Seed: GPLLDGTATL (PMEL_HUMAN)
GVLLDGTATL

SEQ ID NO: 139300 - protein, 9 aa, Artificial Sequence
  Description of Artificial Sequence: Synthetic peptide
  Seed: NFPGSQKVL (PMEL_HUMAN)
NYPGSQKVM

SEQ ID NO: 139301 - protein, 9 aa, Artificial Sequence
  Description of Artificial Sequence: Synthetic peptide
  Seed: VVLQAAIPL (PMEL_HUMAN)
VTLQAAIPF

SEQ ID NO: 139302 - protein, 9 aa, Artificial Sequence
  Description of Artificial Sequence: Synthetic peptide
  Seed: ESTGMTPEK (PMEL_HUMAN)
EATGMTPER

SEQ ID NO: 139303 - protein, 11 aa, Artificial Sequence
  Description of Artificial Sequence: Synthetic peptide
  Seed: ITDQVPFSVSV (PMEL_HUMAN)
IADQVPFSVSM

SEQ ID NO: 139304 - protein, 9 aa, Artificial Sequence
  Description of Artificial Sequence: Synthetic peptide
  Seed: GQVPTTEVV (PMEL_HUMAN)
GLVPTTEVI

SEQ ID NO: 139305 - protein, 9 aa, Artificial Sequence
  Description of Artificial Sequence: Synthetic peptide
  Seed: QLHDPSGYL (PMEL_HUMAN)
QIHDPSGYV

SEQ ID NO: 139306 - protein, 10 aa, Artificial Sequence
  Description of Artificial Sequence: Synthetic peptide
  Seed: YVWKTWGQYW (PMEL_HUMAN)
YSWKTWGQYW

SEQ ID NO: 139307 - protein, 9 aa, Artificial Sequence
  Description of Artificial Sequence: Synthetic peptide
  Seed: VSNDGPTLI (PMEL_HUMAN)
VPNDGPTLV

SEQ ID NO: 139308 - protein, 10 aa, Artificial Sequence
  Description of Artificial Sequence: Synthetic peptide
  Seed: RRLMKQDFSV (PMEL_HUMAN)
RRLMKQDFSK

SEQ ID NO: 139309 - protein, 9 aa, Artificial Sequence
  Description of Artificial Sequence: Synthetic peptide
  Seed: HTMEVTVYH (PMEL_HUMAN)
HPMEVTVYQ

SEQ ID NO: 139310 - protein, 9 aa, Artificial Sequence
  Description of Artificial Sequence: Synthetic peptide
  Seed: RAMLGTHTM (PMEL_HUMAN)
RPMLGTHTA

SEQ ID NO: 139311 - protein, 9 aa, Artificial Sequence
  Description of Artificial Sequence: Synthetic peptide
  Seed: LSIGTGRAM (PMEL_HUMAN)
LLIGTGRAF

SEQ ID NO: 139312 - protein, 9 aa, Artificial Sequence
  Description of Artificial Sequence: Synthetic peptide
  Seed: AEPSGTTSV (PMEL_HUMAN)
AAPSGTTSL

SEQ ID NO: 139313 - protein, 9 aa, Artificial Sequence
  Description of Artificial Sequence: Synthetic peptide
  Seed: ESAEILQAV (PMEL_HUMAN)
EIAEILQAL

SEQ ID NO: 139314 - protein, 9 aa, Artificial Sequence
  Description of Artificial Sequence: Synthetic peptide
  Seed: YWQVLGGPV (PMEL_HUMAN)
YWQVLGGPF

SEQ ID NO: 139315 - protein, 9 aa, Artificial Sequence
  Description of Artificial Sequence: Synthetic peptide
  Seed: TTDGHRPTA (PMEL_HUMAN)
TLDGHRPTV

SEQ ID NO: 139316 - protein, 10 aa, Artificial Sequence
  Description of Artificial Sequence: Synthetic peptide
  Seed: TYLEPGPVTA (PMEL_HUMAN)
TRLEPGPVTM

SEQ ID NO: 139317 - protein, 9 aa, Artificial Sequence
  Description of Artificial Sequence: Synthetic peptide
  Seed: RAMLGTHTM (PMEL_HUMAN)
RCMLGTHTY

SEQ ID NO: 139318 - protein, 10 aa, Artificial Sequence
  Description of Artificial Sequence: Synthetic peptide
  Seed: SHWLRLPRIF (PMEL_HUMAN)
SQWLRLPRIY

SEQ ID NO: 139319 - protein, 9 aa, Artificial Sequence
  Description of Artificial Sequence: Synthetic peptide
  Seed: GQVPTTEVV (PMEL_HUMAN)
GTVPTTEVF

SEQ ID NO: 139320 - protein, 10 aa, Artificial Sequence
  Description of Artificial Sequence: Synthetic peptide
  Seed: TVSCQGGLPK (PMEL_HUMAN)
TVSCQGGLPR

SEQ ID NO: 139321 - protein, 10 aa, Artificial Sequence
  Description of Artificial Sequence: Synthetic peptide
  Seed: MKQDFSVPQL (PMEL_HUMAN)
MAQDFSVPQV

SEQ ID NO: 139322 - protein, 10 aa, Artificial Sequence
  Description of Artificial Sequence: Synthetic peptide
  Seed: TDQVPFSVSV (PMEL_HUMAN)
TLQVPFSVSV

SEQ ID NO: 139323 - protein, 9 aa, Artificial Sequence
  Description of Artificial Sequence: Synthetic peptide
  Seed: TWGQYWQVL (PMEL_HUMAN)
TYGQYWQVV

SEQ ID NO: 139324 - protein, 9 aa, Artificial Sequence
  Description of Artificial Sequence: Synthetic peptide
  Seed: KAWNRQLYP (PMEL_HUMAN)
KVWNRQLYI

SEQ ID NO: 139325 - protein, 10 aa, Artificial Sequence
  Description of Artificial Sequence: Synthetic peptide
  Seed: VPQLPHSSSH (PMEL_HUMAN)
VDQLPHSSSY

SEQ ID NO: 139326 - protein, 10 aa, Artificial Sequence
  Description of Artificial Sequence: Synthetic peptide
  Seed: EVMGTTLAEM (PMEL_HUMAN)
EVMGTTLAEK

SEQ ID NO: 139327 - protein, 10 aa, Artificial Sequence
  Description of Artificial Sequence: Synthetic peptide
  Seed: EVMGTTLAEM (PMEL_HUMAN)
EAMGTTLAEV

SEQ ID NO: 139328 - protein, 9 aa, Artificial Sequence
  Description of Artificial Sequence: Synthetic peptide
  Seed: YRYGSFSVT (PMEL_HUMAN)
YQYGSFSVL

SEQ ID NO: 139329 - protein, 9 aa, Artificial Sequence
  Description of Artificial Sequence: Synthetic peptide
  Seed: DQVPFSVSV (PMEL_HUMAN)
DMVPFSVSF

SEQ ID NO: 139330 - protein, 10 aa, Artificial Sequence
  Description of Artificial Sequence: Synthetic peptide
  Seed: SAEILQAVPS (PMEL_HUMAN)
SHEILQAVPA

SEQ ID NO: 139331 - protein, 10 aa, Artificial Sequence
  Description of Artificial Sequence: Synthetic peptide
  Seed: LVLMAVVLAS (PMEL_HUMAN)
LTLMAVVLAM

SEQ ID NO: 139332 - protein, 9 aa, Artificial Sequence
  Description of Artificial Sequence: Synthetic peptide
  Seed: FTITDQVPF (PMEL_HUMAN)
FVITDQVPW

SEQ ID NO: 139333 - protein, 10 aa, Artificial Sequence
  Description of Artificial Sequence: Synthetic peptide
  Seed: WKTWGQYWQV (PMEL_HUMAN)
WLTWGQYWQV

SEQ ID NO: 139334 - protein, 9 aa, Artificial Sequence
  Description of Artificial Sequence: Synthetic peptide
  Seed: LMAVVLASL (PMEL_HUMAN)
LPAVVLASI

SEQ ID NO: 139335 - protein, 9 aa, Artificial Sequence
  Description of Artificial Sequence: Synthetic peptide
  Seed: RSYVPLAHS (PMEL_HUMAN)
RTYVPLAHG

SEQ ID NO: 139336 - protein, 11 aa, Artificial Sequence
  Description of Artificial Sequence: Synthetic peptide
  Seed: SYVPLAHSSSA (PMEL_HUMAN)
SKVPLAHSSSF

SEQ ID NO: 139337 - protein, 8 aa, Artificial Sequence
  Description of Artificial Sequence: Synthetic peptide
  Seed: AEILQAVP (PMEL_HUMAN)
AEILQAVV

SEQ ID NO: 139338 - protein, 10 aa, Artificial Sequence
  Description of Artificial Sequence: Synthetic peptide
  Seed: AVIGALLAVG (PMEL_HUMAN)
ALIGALLAVC

SEQ ID NO: 139339 - protein, 8 aa, Artificial Sequence
  Description of Artificial Sequence: Synthetic peptide
  Seed: SIGTGRAM (PMEL_HUMAN)
SAGTGRAF

SEQ ID NO: 139340 - protein, 10 aa, Artificial Sequence
  Description of Artificial Sequence: Synthetic peptide
  Seed: LAVIGALLAV (PMEL_HUMAN)
LAVIGALLAA

SEQ ID NO: 139341 - protein, 9 aa, Artificial Sequence
  Description of Artificial Sequence: Synthetic peptide
  Seed: VLPSPACQL (PMEL_HUMAN)
VSPSPACQM

SEQ ID NO: 139342 - protein, 10 aa, Artificial Sequence
  Description of Artificial Sequence: Synthetic peptide
  Seed: VLMAVVLASL (PMEL_HUMAN)
VFMAVVLASI

SEQ ID NO: 139343 - protein, 11 aa, Artificial Sequence
  Description of Artificial Sequence: Synthetic peptide
  Seed: GYLAEADLSYT (PMEL_HUMAN)
GRLAEADLSYL

SEQ ID NO: 139344 - protein, 9 aa, Artificial Sequence
  Description of Artificial Sequence: Synthetic peptide
  Seed: GQVPLIVGI (PMEL_HUMAN)
GAVPLIVGA

SEQ ID NO: 139345 - protein, 10 aa, Artificial Sequence
  Description of Artificial Sequence: Synthetic peptide
  Seed: SSSHWLRLPR (PMEL_HUMAN)
STSHWLRLPK

SEQ ID NO: 139346 - protein, 10 aa, Artificial Sequence
  Description of Artificial Sequence: Synthetic peptide
  Seed: SRALVVTHTY (PMEL_HUMAN)
SYALVVTHTY

SEQ ID NO: 139347 - protein, 10 aa, Artificial Sequence
  Description of Artificial Sequence: Synthetic peptide
  Seed: NSLAVVSTQL (PMEL_HUMAN)
NLLAVVSTQI

SEQ ID NO: 139348 - protein, 9 aa, Artificial Sequence
  Description of Artificial Sequence: Synthetic peptide
  Seed: SPLLSGQQV (PMEL_HUMAN)
SHLLSGQQA

SEQ ID NO: 139349 - protein, 10 aa, Artificial Sequence
  Description of Artificial Sequence: Synthetic peptide
  Seed: GSFSVTLDIV (PMEL_HUMAN)
GMFSVTLDIL

SEQ ID NO: 139350 - protein, 11 aa, Artificial Sequence
  Description of Artificial Sequence: Synthetic peptide
  Seed: YLAEADLSYTW (PMEL_HUMAN)
YQAEADLSYTM

SEQ ID NO: 139351 - protein, 10 aa, Artificial Sequence
  Description of Artificial Sequence: Synthetic peptide
  Seed: GDSSGTLISR (PMEL_HUMAN)
GHSSGTLISK

SEQ ID NO: 139352 - protein, 10 aa, Artificial Sequence
  Description of Artificial Sequence: Synthetic peptide
  Seed: MTPAEVSIVV (PMEL_HUMAN)
MCPAEVSIVF

SEQ ID NO: 139353 - protein, 9 aa, Artificial Sequence
  Description of Artificial Sequence: Synthetic peptide
  Seed: FSIALNFPG (PMEL_HUMAN)
FLIALNFPW

SEQ ID NO: 139354 - protein, 9 aa, Artificial Sequence
  Description of Artificial Sequence: Synthetic peptide
  Seed: SQKRSFVYV (PMEL_HUMAN)
STKRSFVYV

SEQ ID NO: 139355 - protein, 9 aa, Artificial Sequence
  Description of Artificial Sequence: Synthetic peptide
  Seed: VWKTWGQYW (PMEL_HUMAN)
VYKTWGQYV

SEQ ID NO: 139356 - protein, 9 aa, Artificial Sequence
  Description of Artificial Sequence: Synthetic peptide
  Seed: VTLDIVQGI (PMEL_HUMAN)
VVLDIVQGA

SEQ ID NO: 139357 - protein, 8 aa, Artificial Sequence
  Description of Artificial Sequence: Synthetic peptide
  Seed: LIYRRRLM (PMEL_HUMAN)
LMYRRRLL

SEQ ID NO: 139358 - protein, 9 aa, Artificial Sequence
  Description of Artificial Sequence: Synthetic peptide
  Seed: HSSSHWLRL (PMEL_HUMAN)
HQSSHWLRI

SEQ ID NO: 139359 - protein, 9 aa, Artificial Sequence
  Description of Artificial Sequence: Synthetic peptide
  Seed: VWKTWGQYW (PMEL_HUMAN)
VIKTWGQYW

SEQ ID NO: 139360 - protein, 10 aa, Artificial Sequence
  Description of Artificial Sequence: Synthetic peptide
  Seed: KTWGQYWQVL (PMEL_HUMAN)
KQWGQYWQVV

SEQ ID NO: 139361 - protein, 10 aa, Artificial Sequence
  Description of Artificial Sequence: Synthetic peptide
  Seed: VVLASLIYRR (PMEL_HUMAN)
VMLASLIYRC

SEQ ID NO: 139362 - protein, 9 aa, Artificial Sequence
  Description of Artificial Sequence: Synthetic peptide
  Seed: TLIGANASF (PMEL_HUMAN)
TAIGANASW

SEQ ID NO: 139363 - protein, 9 aa, Artificial Sequence
  Description of Artificial Sequence: Synthetic peptide
  Seed: VQMPTAEST (PMEL_HUMAN)
VHMPTAESI

SEQ ID NO: 139364 - protein, 9 aa, Artificial Sequence
  Description of Artificial Sequence: Synthetic peptide
  Seed: AVVSTQLIM (PMEL_HUMAN)
AKVSTQLIF

SEQ ID NO: 139365 - protein, 9 aa, Artificial Sequence
  Description of Artificial Sequence: Synthetic peptide
  Seed: KTWGQYWQV (PMEL_HUMAN)
KYWGQYWQK

SEQ ID NO: 139366 - protein, 10 aa, Artificial Sequence
  Description of Artificial Sequence: Synthetic peptide
  Seed: GSFSVTLDIV (PMEL_HUMAN)
GVFSVTLDII

SEQ ID NO: 139367 - protein, 11 aa, Artificial Sequence
  Description of Artificial Sequence: Synthetic peptide
  Seed: RLPRIFCSCPI (PMEL_HUMAN)
RLPRIFCSCPL

SEQ ID NO: 139368 - protein, 10 aa, Artificial Sequence
  Description of Artificial Sequence: Synthetic peptide
  Seed: EVMGTTLAEM (PMEL_HUMAN)
EMMGTTLAEK

SEQ ID NO: 139369 - protein, 9 aa, Artificial Sequence
  Description of Artificial Sequence: Synthetic peptide
  Seed: LNFPGSQKV (PMEL_HUMAN)
LVFPGSQKM

SEQ ID NO: 139370 - protein, 9 aa, Artificial Sequence
  Description of Artificial Sequence: Synthetic peptide
  Seed: LHLAVIGAL (PMEL_HUMAN)
LMLAVIGAY

SEQ ID NO: 139371 - protein, 9 aa, Artificial Sequence
  Description of Artificial Sequence: Synthetic peptide
  Seed: KQDFSVPQL (PMEL_HUMAN)
KQDFSVPQV

SEQ ID NO: 139372 - protein, 10 aa, Artificial Sequence
  Description of Artificial Sequence: Synthetic peptide
  Seed: IFPDGGPCPS (PMEL_HUMAN)
IYPDGGPCPV

SEQ ID NO: 139373 - protein, 9 aa, Artificial Sequence
  Description of Artificial Sequence: Synthetic peptide
  Seed: LSIGTGRAM (PMEL_HUMAN)
LTIGTGRAM

SEQ ID NO: 139374 - protein, 11 aa, Artificial Sequence
  Description of Artificial Sequence: Synthetic peptide
  Seed: KVLPDGQVIWV (PMEL_HUMAN)
KVLPDGQVIWL

SEQ ID NO: 139375 - protein, 9 aa, Artificial Sequence
  Description of Artificial Sequence: Synthetic peptide
  Seed: ANASFSIAL (PMEL_HUMAN)
AVASFSIAL

SEQ ID NO: 139376 - protein, 9 aa, Artificial Sequence
  Description of Artificial Sequence: Synthetic peptide
  Seed: QEAGLGQVP (PMEL_HUMAN)
QEAGLGQVL

SEQ ID NO: 139377 - protein, 10 aa, Artificial Sequence
  Description of Artificial Sequence: Synthetic peptide
  Seed: VYHRRGSRSY (PMEL_HUMAN)
VQHRRGSRSY

SEQ ID NO: 139378 - protein, 11 aa, Artificial Sequence
  Description of Artificial Sequence: Synthetic peptide
  Seed: YVPLAHSSSAF (PMEL_HUMAN)
YPPLAHSSSAY

SEQ ID NO: 139379 - protein, 11 aa, Artificial Sequence
  Description of Artificial Sequence: Synthetic peptide
  Seed: KVLPDGQVIWV (PMEL_HUMAN)
KTLPDGQVIWL

SEQ ID NO: 139380 - protein, 9 aa, Artificial Sequence
  Description of Artificial Sequence: Synthetic peptide
  Seed: YLAEADLSY (PMEL_HUMAN)
YTAEADLSF

SEQ ID NO: 139381 - protein, 9 aa, Artificial Sequence
  Description of Artificial Sequence: Synthetic peptide
  Seed: AGQVPTTEV (PMEL_HUMAN)
AQQVPTTEI

SEQ ID NO: 139382 - protein, 8 aa, Artificial Sequence
  Description of Artificial Sequence: Synthetic peptide
  Seed: VLYRYGSF (PMEL_HUMAN)
VMYRYGSY

SEQ ID NO: 139383 - protein, 10 aa, Artificial Sequence
  Description of Artificial Sequence: Synthetic peptide
  Seed: RQVPLDCVLY (PMEL_HUMAN)
RIVPLDCVLY

SEQ ID NO: 139384 - protein, 9 aa, Artificial Sequence
  Description of Artificial Sequence: Synthetic peptide
  Seed: GSRSYVPLA (PMEL_HUMAN)
GSRSYVPLL

SEQ ID NO: 139385 - protein, 9 aa, Artificial Sequence
  Description of Artificial Sequence: Synthetic peptide
  Seed: RLMKQDFSV (PMEL_HUMAN)
RQMKQDFSL

SEQ ID NO: 139386 - protein, 10 aa, Artificial Sequence
  Description of Artificial Sequence: Synthetic peptide
  Seed: LRNQPLTFAL (PMEL_HUMAN)
LRNQPLTFAV

SEQ ID NO: 139387 - protein, 10 aa, Artificial Sequence
  Description of Artificial Sequence: Synthetic peptide
  Seed: KTWGQYWQVL (PMEL_HUMAN)
KMWGQYWQVK

SEQ ID NO: 139388 - protein, 11 aa, Artificial Sequence
  Description of Artificial Sequence: Synthetic peptide
  Seed: RRGSRSYVPLA (PMEL_HUMAN)
RQGSRSYVPLA

SEQ ID NO: 139389 - protein, 10 aa, Artificial Sequence
  Description of Artificial Sequence: Synthetic peptide
  Seed: SRALVVTHTY (PMEL_HUMAN)
SKALVVTHTF

SEQ ID NO: 139390 - protein, 9 aa, Artificial Sequence
  Description of Artificial Sequence: Synthetic peptide
  Seed: WSQKRSFVY (PMEL_HUMAN)
WMQKRSFVM

SEQ ID NO: 139391 - protein, 10 aa, Artificial Sequence
  Description of Artificial Sequence: Synthetic peptide
  Seed: ESITGSLGPL (PMEL_HUMAN)
EIITGSLGPF

SEQ ID NO: 139392 - protein, 10 aa, Artificial Sequence
  Description of Artificial Sequence: Synthetic peptide
  Seed: AVPSGEGDAF (PMEL_HUMAN)
ALPSGEGDAM

SEQ ID NO: 139393 - protein, 9 aa, Artificial Sequence
  Description of Artificial Sequence: Synthetic peptide
  Seed: IMPGQEAGL (PMEL_HUMAN)
IYPGQEAGM

SEQ ID NO: 139394 - protein, 11 aa, Artificial Sequence
  Description of Artificial Sequence: Synthetic peptide
  Seed: RALDGGNKHFL (PMEL_HUMAN)
RYLDGGNKHFY

SEQ ID NO: 139395 - protein, 10 aa, Artificial Sequence
  Description of Artificial Sequence: Synthetic peptide
  Seed: LIMPGQEAGL (PMEL_HUMAN)
LVMPGQEAGI

SEQ ID NO: 139396 - protein, 10 aa, Artificial Sequence
  Description of Artificial Sequence: Synthetic peptide
  Seed: AEMSTPEATG (PMEL_HUMAN)
AEMSTPEATL

SEQ ID NO: 139397 - protein, 9 aa, Artificial Sequence
  Description of Artificial Sequence: Synthetic peptide
  Seed: RLMKQDFSV (PMEL_HUMAN)
RVMKQDFSR

SEQ ID NO: 139398 - protein, 9 aa, Artificial Sequence
  Description of Artificial Sequence: Synthetic peptide
  Seed: AEADLSYTW (PMEL_HUMAN)
AMADLSYTW

SEQ ID NO: 139399 - protein, 9 aa, Artificial Sequence
  Description of Artificial Sequence: Synthetic peptide
  Seed: AVIGALLAV (PMEL_HUMAN)
AQIGALLAW

SEQ ID NO: 139400 - protein, 9 aa, Artificial Sequence
  Description of Artificial Sequence: Synthetic peptide
  Seed: THTMEVTVY (PMEL_HUMAN)
TLTMEVTVF

SEQ ID NO: 139401 - protein, 10 aa, Artificial Sequence
  Description of Artificial Sequence: Synthetic peptide
  Seed: EVMGTTLAEM (PMEL_HUMAN)
ESMGTTLAEI

SEQ ID NO: 139402 - protein, 9 aa, Artificial Sequence
  Description of Artificial Sequence: Synthetic peptide
  Seed: RQVPLDCVL (PMEL_HUMAN)
RFVPLDCVF

SEQ ID NO: 139403 - protein, 8 aa, Artificial Sequence
  Description of Artificial Sequence: Synthetic peptide
  Seed: LHDPSGYL (PMEL_HUMAN)
LTDPSGYI

SEQ ID NO: 139404 - protein, 9 aa, Artificial Sequence
  Description of Artificial Sequence: Synthetic peptide
  Seed: FLRNQPLTF (PMEL_HUMAN)
FLRNQPLTW

SEQ ID NO: 139405 - protein, 10 aa, Artificial Sequence
  Description of Artificial Sequence: Synthetic peptide
  Seed: LQLHDPSGYL (PMEL_HUMAN)
LHLHDPSGYV

SEQ ID NO: 139406 - protein, 10 aa, Artificial Sequence
  Description of Artificial Sequence: Synthetic peptide
  Seed: GPLLDGTATL (PMEL_HUMAN)
GKLLDGTATL

SEQ ID NO: 139407 - protein, 11 aa, Artificial Sequence
  Description of Artificial Sequence: Synthetic peptide
  Seed: RYGSFSVTLDI (PMEL_HUMAN)
RPGSFSVTLDW

SEQ ID NO: 139408 - protein, 10 aa, Artificial Sequence
  Description of Artificial Sequence: Synthetic peptide
  Seed: LAHSSSAFTI (PMEL_HUMAN)
LAHSSSAFTF

SEQ ID NO: 139409 - protein, 11 aa, Artificial Sequence
  Description of Artificial Sequence: Synthetic peptide
  Seed: LGPLLDGTATL (PMEL_HUMAN)
LWPLLDGTATI

SEQ ID NO: 139410 - protein, 9 aa, Artificial Sequence
  Description of Artificial Sequence: Synthetic peptide
  Seed: VLMAVVLAS (PMEL_HUMAN)
VIMAVVLAM

SEQ ID NO: 139411 - protein, 9 aa, Artificial Sequence
  Description of Artificial Sequence: Synthetic peptide
  Seed: VSCQGGLPK (PMEL_HUMAN)
VLCQGGLPK

SEQ ID NO: 139412 - protein, 9 aa, Artificial Sequence
  Description of Artificial Sequence: Synthetic peptide
  Seed: YLEPGPVTA (PMEL_HUMAN)
YDEPGPVTL

SEQ ID NO: 139413 - protein, 9 aa, Artificial Sequence
  Description of Artificial Sequence: Synthetic peptide
  Seed: SSIMSTESI (PMEL_HUMAN)
SGIMSTESW

SEQ ID NO: 139414 - protein, 9 aa, Artificial Sequence
  Description of Artificial Sequence: Synthetic peptide
  Seed: SQKRSFVYV (PMEL_HUMAN)
SAKRSFVYL

SEQ ID NO: 139415 - protein, 9 aa, Artificial Sequence
  Description of Artificial Sequence: Synthetic peptide
  Seed: WSQKRSFVY (PMEL_HUMAN)
WFQKRSFVM

SEQ ID NO: 139416 - protein, 9 aa, Artificial Sequence
  Description of Artificial Sequence: Synthetic peptide
  Seed: HTYLEPGPV (PMEL_HUMAN)
HAYLEPGPL

SEQ ID NO: 139417 - protein, 9 aa, Artificial Sequence
  Description of Artificial Sequence: Synthetic peptide
  Seed: DAFELTVSC (PMEL_HUMAN)
DSFELTVSF

SEQ ID NO: 139418 - protein, 9 aa, Artificial Sequence
  Description of Artificial Sequence: Synthetic peptide
  Seed: LEPGPVTAQ (PMEL_HUMAN)
LEPGPVTAA

SEQ ID NO: 139419 - protein, 10 aa, Artificial Sequence
  Description of Artificial Sequence: Synthetic peptide
  Seed: YRYGSFSVTL (PMEL_HUMAN)
YNYGSFSVTL

SEQ ID NO: 139420 - protein, 9 aa, Artificial Sequence
  Description of Artificial Sequence: Synthetic peptide
  Seed: SLAVVSTQL (PMEL_HUMAN)
SVAVVSTQF

SEQ ID NO: 139421 - protein, 10 aa, Artificial Sequence
  Description of Artificial Sequence: Synthetic peptide
  Seed: LNFPGSQKVL (PMEL_HUMAN)
LIFPGSQKVY

SEQ ID NO: 139422 - protein, 9 aa, Artificial Sequence
  Description of Artificial Sequence: Synthetic peptide
  Seed: VLKRCLLHL (PMEL_HUMAN)
VLKRCLLHF

SEQ ID NO: 139423 - protein, 9 aa, Artificial Sequence
  Description of Artificial Sequence: Synthetic peptide
  Seed: GILLVLMAV (PMEL_HUMAN)
GQLLVLMAL

SEQ ID NO: 139424 - protein, 10 aa, Artificial Sequence
  Description of Artificial Sequence: Synthetic peptide
  Seed: QLHDPSGYLA (PMEL_HUMAN)
QMHDPSGYLV

SEQ ID NO: 139425 - protein, 10 aa, Artificial Sequence
  Description of Artificial Sequence: Synthetic peptide
  Seed: FSVSVSQLRA (PMEL_HUMAN)
FCVSVSQLRR

SEQ ID NO: 139426 - protein, 11 aa, Artificial Sequence
  Description of Artificial Sequence: Synthetic peptide
  Seed: SQVWGGQPVYP (PMEL_HUMAN)
SQVWGGQPVYF

SEQ ID NO: 139427 - protein, 11 aa, Artificial Sequence
  Description of Artificial Sequence: Synthetic peptide
  Seed: VQMPTAESTGM (PMEL_HUMAN)
VHMPTAESTGF

SEQ ID NO: 139428 - protein, 9 aa, Artificial Sequence
  Description of Artificial Sequence: Synthetic peptide
  Seed: YVWKTWGQY (PMEL_HUMAN)
YEWKTWGQY

SEQ ID NO: 139429 - protein, 11 aa, Artificial Sequence
  Description of Artificial Sequence: Synthetic peptide
  Seed: GYLAEADLSYT (PMEL_HUMAN)
GLLAEADLSYL

SEQ ID NO: 139430 - protein, 11 aa, Artificial Sequence
  Description of Artificial Sequence: Synthetic peptide
  Seed: LGPLLDGTATL (PMEL_HUMAN)
LPPLLDGTATL

SEQ ID NO: 139431 - protein, 10 aa, Artificial Sequence
  Description of Artificial Sequence: Synthetic peptide
  Seed: KTWGQYWQVL (PMEL_HUMAN)
KQWGQYWQVA

SEQ ID NO: 139432 - protein, 9 aa, Artificial Sequence
  Description of Artificial Sequence: Synthetic peptide
  Seed: GANASFSIA (PMEL_HUMAN)
GTNASFSIK

SEQ ID NO: 139433 - protein, 10 aa, Artificial Sequence
  Description of Artificial Sequence: Synthetic peptide
  Seed: SCPIGENSPL (PMEL_HUMAN)
SPPIGENSPL

SEQ ID NO: 139434 - protein, 9 aa, Artificial Sequence
  Description of Artificial Sequence: Synthetic peptide
  Seed: SITGSLGPL (PMEL_HUMAN)
SATGSLGPY

SEQ ID NO: 139435 - protein, 9 aa, Artificial Sequence
  Description of Artificial Sequence: Synthetic peptide
  Seed: TTDGHRPTA (PMEL_HUMAN)
TYDGHRPTV

SEQ ID NO: 139436 - protein, 9 aa, Artificial Sequence
  Description of Artificial Sequence: Synthetic peptide
  Seed: KTWGQYWQV (PMEL_HUMAN)
KLWGQYWQY

SEQ ID NO: 139437 - protein, 10 aa, Artificial Sequence
  Description of Artificial Sequence: Synthetic peptide
  Seed: MPTAESTGMT (PMEL_HUMAN)
MFTAESTGMV

SEQ ID NO: 139438 - protein, 9 aa, Artificial Sequence
  Description of Artificial Sequence: Synthetic peptide
  Seed: AHSSSAFTI (PMEL_HUMAN)
AASSSAFTM

SEQ ID NO: 139439 - protein, 9 aa, Artificial Sequence
  Description of Artificial Sequence: Synthetic peptide
  Seed: LIVGILLVL (PMEL_HUMAN)
LRVGILLVL

SEQ ID NO: 139440 - protein, 9 aa, Artificial Sequence
  Description of Artificial Sequence: Synthetic peptide
  Seed: NFPGSQKVL (PMEL_HUMAN)
NAPGSQKVV

SEQ ID NO: 139441 - protein, 9 aa, Artificial Sequence
  Description of Artificial Sequence: Synthetic peptide
  Seed: ITDQVPFSV (PMEL_HUMAN)
IYDQVPFSI

SEQ ID NO: 139442 - protein, 10 aa, Artificial Sequence
  Description of Artificial Sequence: Synthetic peptide
  Seed: RQLYPEWTEA (PMEL_HUMAN)
RYLYPEWTEA

SEQ ID NO: 139443 - protein, 8 aa, Artificial Sequence
  Description of Artificial Sequence: Synthetic peptide
  Seed: YRYGSFSV (PMEL_HUMAN)
YHYGSFSL

SEQ ID NO: 139444 - protein, 10 aa, Artificial Sequence
  Description of Artificial Sequence: Synthetic peptide
  Seed: IFPDGGPCPS (PMEL_HUMAN)
IFPDGGPCPM

SEQ ID NO: 139445 - protein, 9 aa, Artificial Sequence
  Description of Artificial Sequence: Synthetic peptide
  Seed: SITGSLGPL (PMEL_HUMAN)
SATGSLGPF

SEQ ID NO: 139446 - protein, 9 aa, Artificial Sequence
  Description of Artificial Sequence: Synthetic peptide
  Seed: GSFSVTLDI (PMEL_HUMAN)
GSFSVTLDW

SEQ ID NO: 139447 - protein, 11 aa, Artificial Sequence
  Description of Artificial Sequence: Synthetic peptide
  Seed: ITDQVPFSVSV (PMEL_HUMAN)
IADQVPFSVSL

SEQ ID NO: 139448 - protein, 9 aa, Artificial Sequence
  Description of Artificial Sequence: Synthetic peptide
  Seed: KQDFSVPQL (PMEL_HUMAN)
KEDFSVPQV

SEQ ID NO: 139449 - protein, 9 aa, Artificial Sequence
  Description of Artificial Sequence: Synthetic peptide
  Seed: GQVPTTEVV (PMEL_HUMAN)
GQVPTTEVF

SEQ ID NO: 139450 - protein, 9 aa, Artificial Sequence
  Description of Artificial Sequence: Synthetic peptide
  Seed: AQVVLQAAI (PMEL_HUMAN)
ASVVLQAAF

SEQ ID NO: 139451 - protein, 10 aa, Artificial Sequence
  Description of Artificial Sequence: Synthetic peptide
  Seed: GPLLDGTATL (PMEL_HUMAN)
GALLDGTATV

SEQ ID NO: 139452 - protein, 10 aa, Artificial Sequence
  Description of Artificial Sequence: Synthetic peptide
  Seed: SLIYRRRLMK (PMEL_HUMAN)
SPIYRRRLMR

SEQ ID NO: 139453 - protein, 9 aa, Artificial Sequence
  Description of Artificial Sequence: Synthetic peptide
  Seed: VQVPTTEVI (PMEL_HUMAN)
VEVPTTEVL

SEQ ID NO: 139454 - protein, 8 aa, Artificial Sequence
  Description of Artificial Sequence: Synthetic peptide
  Seed: LHDPSGYL (PMEL_HUMAN)
LVDPSGYF

SEQ ID NO: 139455 - protein, 9 aa, Artificial Sequence
  Description of Artificial Sequence: Synthetic peptide
  Seed: AAIPLTSCG (PMEL_HUMAN)
ASIPLTSCF

SEQ ID NO: 139456 - protein, 9 aa, Artificial Sequence
  Description of Artificial Sequence: Synthetic peptide
  Seed: RLMKQDFSV (PMEL_HUMAN)
RTMKQDFSM

SEQ ID NO: 139457 - protein, 8 aa, Artificial Sequence
  Description of Artificial Sequence: Synthetic peptide
  Seed: LNFPGSQK (PMEL_HUMAN)
LGFPGSQL

SEQ ID NO: 139458 - protein, 10 aa, Artificial Sequence
  Description of Artificial Sequence: Synthetic peptide
  Seed: HFLRNQPLTF (PMEL_HUMAN)
HKLRNQPLTY

SEQ ID NO: 139459 - protein, 10 aa, Artificial Sequence
  Description of Artificial Sequence: Synthetic peptide
  Seed: VSLADTNSLA (PMEL_HUMAN)
VKLADTNSLV

SEQ ID NO: 139460 - protein, 10 aa, Artificial Sequence
  Description of Artificial Sequence: Synthetic peptide
  Seed: MKQDFSVPQL (PMEL_HUMAN)
MLQDFSVPQI

SEQ ID NO: 139461 - protein, 9 aa, Artificial Sequence
  Description of Artificial Sequence: Synthetic peptide
  Seed: RSYVPLAHS (PMEL_HUMAN)
RVYVPLAHA

SEQ ID NO: 139462 - protein, 10 aa, Artificial Sequence
  Description of Artificial Sequence: Synthetic peptide
  Seed: DGTATLRLVK (PMEL_HUMAN)
DTTATLRLVR

SEQ ID NO: 139463 - protein, 9 aa, Artificial Sequence
  Description of Artificial Sequence: Synthetic peptide
  Seed: KVLPDGQVI (PMEL_HUMAN)
KLLPDGQVM

SEQ ID NO: 139464 - protein, 11 aa, Artificial Sequence
  Description of Artificial Sequence: Synthetic peptide
  Seed: LGPLLDGTATL (PMEL_HUMAN)
LDPLLDGTATI

SEQ ID NO: 139465 - protein, 9 aa, Artificial Sequence
  Description of Artificial Sequence: Synthetic peptide
  Seed: KTWGQYWQV (PMEL_HUMAN)
KAWGQYWQK

SEQ ID NO: 139466 - protein, 9 aa, Artificial Sequence
  Description of Artificial Sequence: Synthetic peptide
  Seed: RLMKQDFSV (PMEL_HUMAN)
RLMKQDFSW

SEQ ID NO: 139467 - protein, 8 aa, Artificial Sequence
  Description of Artificial Sequence: Synthetic peptide
  Seed: LLDGTATL (PMEL_HUMAN)
LVDGTATI

SEQ ID NO: 139468 - protein, 10 aa, Artificial Sequence
  Description of Artificial Sequence: Synthetic peptide
  Seed: EVSIVVLSGT (PMEL_HUMAN)
EYSIVVLSGV

SEQ ID NO: 139469 - protein, 9 aa, Artificial Sequence
  Description of Artificial Sequence: Synthetic peptide
  Seed: VMGTTLAEM (PMEL_HUMAN)
VMGTTLAEY

SEQ ID NO: 139470 - protein, 10 aa, Artificial Sequence
  Description of Artificial Sequence: Synthetic peptide
  Seed: STAPVQMPTA (PMEL_HUMAN)
SIAPVQMPTV

SEQ ID NO: 139471 - protein, 11 aa, Artificial Sequence
  Description of Artificial Sequence: Synthetic peptide
  Seed: QLYPEWTEAQR (PMEL_HUMAN)
QYYPEWTEAQR

SEQ ID NO: 139472 - protein, 11 aa, Artificial Sequence
  Description of Artificial Sequence: Synthetic peptide
  Seed: KHFLRNQPLTF (PMEL_HUMAN)
KWFLRNQPLTL

SEQ ID NO: 139473 - protein, 9 aa, Artificial Sequence
  Description of Artificial Sequence: Synthetic peptide
  Seed: RGSRSYVPL (PMEL_HUMAN)
RTSRSYVPM

SEQ ID NO: 139474 - protein, 10 aa, Artificial Sequence
  Description of Artificial Sequence: Synthetic peptide
  Seed: RQLYPEWTEA (PMEL_HUMAN)
RVLYPEWTEL

SEQ ID NO: 139475 - protein, 8 aa, Artificial Sequence
  Description of Artificial Sequence: Synthetic peptide
  Seed: RSFVYVWK (PMEL_HUMAN)
RVFVYVWR

SEQ ID NO: 139476 - protein, 9 aa, Artificial Sequence
  Description of Artificial Sequence: Synthetic peptide
  Seed: FTITDQVPF (PMEL_HUMAN)
FCITDQVPY

SEQ ID NO: 139477 - protein, 9 aa, Artificial Sequence
  Description of Artificial Sequence: Synthetic peptide
  Seed: RAMLGTHTM (PMEL_HUMAN)
RAMLGTHTI

SEQ ID NO: 139478 - protein, 9 aa, Artificial Sequence
  Description of Artificial Sequence: Synthetic peptide
  Seed: DGGNKHFLR (PMEL_HUMAN)
DFGNKHFLR

SEQ ID NO: 139479 - protein, 9 aa, Artificial Sequence
  Description of Artificial Sequence: Synthetic peptide
  Seed: TPAEVSIVV (PMEL_HUMAN)
TAAEVSIVV

SEQ ID NO: 139480 - protein, 8 aa, Artificial Sequence
  Description of Artificial Sequence: Synthetic peptide
  Seed: AEMSTPEA (PMEL_HUMAN)
AEMSTPEI

SEQ ID NO: 139481 - protein, 9 aa, Artificial Sequence
  Description of Artificial Sequence: Synthetic peptide
  Seed: LPDGQVIWV (PMEL_HUMAN)
LTDGQVIWI

SEQ ID NO: 139482 - protein, 9 aa, Artificial Sequence
  Description of Artificial Sequence: Synthetic peptide
  Seed: SSPGCQPPA (PMEL_HUMAN)
SIPGCQPPL

SEQ ID NO: 139483 - protein, 10 aa, Artificial Sequence
  Description of Artificial Sequence: Synthetic peptide
  Seed: KTWGQYWQVL (PMEL_HUMAN)
KIWGQYWQVG

SEQ ID NO: 139484 - protein, 10 aa, Artificial Sequence
  Description of Artificial Sequence: Synthetic peptide
  Seed: RRGSRSYVPL (PMEL_HUMAN)
RRGSRSYVPK

SEQ ID NO: 139485 - protein, 9 aa, Artificial Sequence
  Description of Artificial Sequence: Synthetic peptide
  Seed: LSIGTGRAM (PMEL_HUMAN)
LAIGTGRAL

SEQ ID NO: 139486 - protein, 9 aa, Artificial Sequence
  Description of Artificial Sequence: Synthetic peptide
  Seed: WSQKRSFVY (PMEL_HUMAN)
WYQKRSFVF

SEQ ID NO: 139487 - protein, 10 aa, Artificial Sequence
  Description of Artificial Sequence: Synthetic peptide
  Seed: MTPAEVSIVV (PMEL_HUMAN)
MSPAEVSIVM

SEQ ID NO: 139488 - protein, 10 aa, Artificial Sequence
  Description of Artificial Sequence: Synthetic peptide
  Seed: RTKAWNRQLY (PMEL_HUMAN)
RTKAWNRQLR

SEQ ID NO: 139489 - protein, 9 aa, Artificial Sequence
  Description of Artificial Sequence: Synthetic peptide
  Seed: ANASFSIAL (PMEL_HUMAN)
ASASFSIAV

SEQ ID NO: 139490 - protein, 9 aa, Artificial Sequence
  Description of Artificial Sequence: Synthetic peptide
  Seed: RAMLGTHTM (PMEL_HUMAN)
RYMLGTHTY

SEQ ID NO: 139491 - protein, 9 aa, Artificial Sequence
  Description of Artificial Sequence: Synthetic peptide
  Seed: LPDGQVIWV (PMEL_HUMAN)
LQDGQVIWL

SEQ ID NO: 139492 - protein, 11 aa, Artificial Sequence
  Description of Artificial Sequence: Synthetic peptide
  Seed: LGPLLDGTATL (PMEL_HUMAN)
LQPLLDGTATV

SEQ ID NO: 139493 - protein, 9 aa, Artificial Sequence
  Description of Artificial Sequence: Synthetic peptide
  Seed: EGDAFELTV (PMEL_HUMAN)
ESDAFELTM

SEQ ID NO: 139494 - protein, 11 aa, Artificial Sequence
  Description of Artificial Sequence: Synthetic peptide
  Seed: HQILKGGSGTY (PMEL_HUMAN)
HAILKGGSGTF

SEQ ID NO: 139495 - protein, 9 aa, Artificial Sequence
  Description of Artificial Sequence: Synthetic peptide
  Seed: QEAGLGQVP (PMEL_HUMAN)
QEAGLGQVT

SEQ ID NO: 139496 - protein, 9 aa, Artificial Sequence
  Description of Artificial Sequence: Synthetic peptide
  Seed: LIVGILLVL (PMEL_HUMAN)
LQVGILLVL

SEQ ID NO: 139497 - protein, 10 aa, Artificial Sequence
  Description of Artificial Sequence: Synthetic peptide
  Seed: RYGSFSVTLD (PMEL_HUMAN)
RYGSFSVTLL

SEQ ID NO: 139498 - protein, 8 aa, Artificial Sequence
  Description of Artificial Sequence: Synthetic peptide
  Seed: SEVMGTTL (PMEL_HUMAN)
SEVMGTTI

SEQ ID NO: 139499 - protein, 9 aa, Artificial Sequence
  Description of Artificial Sequence: Synthetic peptide
  Seed: MLGTHTMEV (PMEL_HUMAN)
MIGTHTMEI

SEQ ID NO: 139500 - protein, 10 aa, Artificial Sequence
  Description of Artificial Sequence: Synthetic peptide
  Seed: YLAEADLSYT (PMEL_HUMAN)
YMAEADLSYI

SEQ ID NO: 139501 - protein, 9 aa, Artificial Sequence
  Description of Artificial Sequence: Synthetic peptide
  Seed: AAQVTTTEW (PMEL_HUMAN)
ALQVTTTEW

SEQ ID NO: 139502 - protein, 9 aa, Artificial Sequence
  Description of Artificial Sequence: Synthetic peptide
  Seed: VQVPTTEVI (PMEL_HUMAN)
VLVPTTEVV

SEQ ID NO: 139503 - protein, 10 aa, Artificial Sequence
  Description of Artificial Sequence: Synthetic peptide
  Seed: WDFGDSSGTL (PMEL_HUMAN)
WEFGDSSGTA

SEQ ID NO: 139504 - protein, 10 aa, Artificial Sequence
  Description of Artificial Sequence: Synthetic peptide
  Seed: RQLYPEWTEA (PMEL_HUMAN)
RGLYPEWTEF

SEQ ID NO: 139505 - protein, 9 aa, Artificial Sequence
  Description of Artificial Sequence: Synthetic peptide
  Seed: VQVPTTEVI (PMEL_HUMAN)
VEVPTTEVI

SEQ ID NO: 139506 - protein, 9 aa, Artificial Sequence
  Description of Artificial Sequence: Synthetic peptide
  Seed: HTYLEPGPV (PMEL_HUMAN)
HMYLEPGPV

SEQ ID NO: 139507 - protein, 9 aa, Artificial Sequence
  Description of Artificial Sequence: Synthetic peptide
  Seed: LSIGTGRAM (PMEL_HUMAN)
LWIGTGRAF

SEQ ID NO: 139508 - protein, 10 aa, Artificial Sequence
  Description of Artificial Sequence: Synthetic peptide
  Seed: AVPSGEGDAF (PMEL_HUMAN)
AAPSGEGDAM

SEQ ID NO: 139509 - protein, 9 aa, Artificial Sequence
  Description of Artificial Sequence: Synthetic peptide
  Seed: TLIGANASF (PMEL_HUMAN)
TKIGANASY

SEQ ID NO: 139510 - protein, 10 aa, Artificial Sequence
  Description of Artificial Sequence: Synthetic peptide
  Seed: QVLGGPVSGL (PMEL_HUMAN)
QVLGGPVSGK

SEQ ID NO: 139511 - protein, 11 aa, Artificial Sequence
  Description of Artificial Sequence: Synthetic peptide
  Seed: DCWRGGQVSLK (PMEL_HUMAN)
DTWRGGQVSLR

SEQ ID NO: 139512 - protein, 11 aa, Artificial Sequence
  Description of Artificial Sequence: Synthetic peptide
  Seed: MPTAESTGMTP (PMEL_HUMAN)
MPTAESTGMTM

SEQ ID NO: 139513 - protein, 9 aa, Artificial Sequence
  Description of Artificial Sequence: Synthetic peptide
  Seed: EVVGTTPGQ (PMEL_HUMAN)
EVVGTTPGM

SEQ ID NO: 139514 - protein, 9 aa, Artificial Sequence
  Description of Artificial Sequence: Synthetic peptide
  Seed: KHFLRNQPL (PMEL_HUMAN)
KIFLRNQPM

SEQ ID NO: 139515 - protein, 8 aa, Artificial Sequence
  Description of Artificial Sequence: Synthetic peptide
  Seed: HTMEVTVY (PMEL_HUMAN)
HKMEVTVY

SEQ ID NO: 139516 - protein, 10 aa, Artificial Sequence
  Description of Artificial Sequence: Synthetic peptide
  Seed: SQVWGGQPVY (PMEL_HUMAN)
SHVWGGQPVF

SEQ ID NO: 139517 - protein, 9 aa, Artificial Sequence
  Description of Artificial Sequence: Synthetic peptide
  Seed: SLADTNSLA (PMEL_HUMAN)
SQADTNSLV

SEQ ID NO: 139518 - protein, 11 aa, Artificial Sequence
  Description of Artificial Sequence: Synthetic peptide
  Seed: RELPIPEPEGP (PMEL_HUMAN)
RELPIPEPEGF

SEQ ID NO: 139519 - protein, 9 aa, Artificial Sequence
  Description of Artificial Sequence: Synthetic peptide
  Seed: TIINGSQVW (PMEL_HUMAN)
TMINGSQVY

SEQ ID NO: 139520 - protein, 9 aa, Artificial Sequence
  Description of Artificial Sequence: Synthetic peptide
  Seed: VSNDGPTLI (PMEL_HUMAN)
VQNDGPTLF

SEQ ID NO: 139521 - protein, 9 aa, Artificial Sequence
  Description of Artificial Sequence: Synthetic peptide
  Seed: VTLDIVQGI (PMEL_HUMAN)
VILDIVQGM

SEQ ID NO: 139522 - protein, 9 aa, Artificial Sequence
  Description of Artificial Sequence: Synthetic peptide
  Seed: ESAEILQAV (PMEL_HUMAN)
ENAEILQAV

SEQ ID NO: 139523 - protein, 9 aa, Artificial Sequence
  Description of Artificial Sequence: Synthetic peptide
  Seed: KHFLRNQPL (PMEL_HUMAN)
KKFLRNQPF

SEQ ID NO: 139524 - protein, 10 aa, Artificial Sequence
  Description of Artificial Sequence: Synthetic peptide
  Seed: EVMGTTLAEM (PMEL_HUMAN)
EMMGTTLAEA

SEQ ID NO: 139525 - protein, 11 aa, Artificial Sequence
  Description of Artificial Sequence: Synthetic peptide
  Seed: KVLPDGQVIWV (PMEL_HUMAN)
KMLPDGQVIWF

SEQ ID NO: 139526 - protein, 8 aa, Artificial Sequence
  Description of Artificial Sequence: Synthetic peptide
  Seed: YGSFSVTL (PMEL_HUMAN)
YSSFSVTF

SEQ ID NO: 139527 - protein, 10 aa, Artificial Sequence
  Description of Artificial Sequence: Synthetic peptide
  Seed: VVLASLIYRR (PMEL_HUMAN)
VMLASLIYRA

SEQ ID NO: 139528 - protein, 9 aa, Artificial Sequence
  Description of Artificial Sequence: Synthetic peptide
  Seed: SAFTITDQV (PMEL_HUMAN)
SLFTITDQM

SEQ ID NO: 139529 - protein, 9 aa, Artificial Sequence
  Description of Artificial Sequence: Synthetic peptide
  Seed: TTPGQAPTA (PMEL_HUMAN)
TAPGQAPTI

SEQ ID NO: 139530 - protein, 10 aa, Artificial Sequence
  Description of Artificial Sequence: Synthetic peptide
  Seed: EVVGTTPGQA (PMEL_HUMAN)
ESVGTTPGQV

SEQ ID NO: 139531 - protein, 10 aa, Artificial Sequence
  Description of Artificial Sequence: Synthetic peptide
  Seed: ALDGGNKHFL (PMEL_HUMAN)
AVDGGNKHFL

SEQ ID NO: 139532 - protein, 11 aa, Artificial Sequence
  Description of Artificial Sequence: Synthetic peptide
  Seed: ITDQVPFSVSV (PMEL_HUMAN)
ITDQVPFSVSL

SEQ ID NO: 139533 - protein, 9 aa, Artificial Sequence
  Description of Artificial Sequence: Synthetic peptide
  Seed: LADTNSLAV (PMEL_HUMAN)
LPDTNSLAW

SEQ ID NO: 139534 - protein, 11 aa, Artificial Sequence
  Description of Artificial Sequence: Synthetic peptide
  Seed: GYLAEADLSYT (PMEL_HUMAN)
GILAEADLSYL

SEQ ID NO: 139535 - protein, 9 aa, Artificial Sequence
  Description of Artificial Sequence: Synthetic peptide
  Seed: VQMPTAEST (PMEL_HUMAN)
VLMPTAESV

SEQ ID NO: 139536 - protein, 9 aa, Artificial Sequence
  Description of Artificial Sequence: Synthetic peptide
  Seed: HSSSHWLRL (PMEL_HUMAN)
HTSSHWLRF

SEQ ID NO: 139537 - protein, 8 aa, Artificial Sequence
  Description of Artificial Sequence: Synthetic peptide
  Seed: TGSLGPLL (PMEL_HUMAN)
TASLGPLL

SEQ ID NO: 139538 - protein, 10 aa, Artificial Sequence
  Description of Artificial Sequence: Synthetic peptide
  Seed: SRALVVTHTY (PMEL_HUMAN)
SIALVVTHTW

SEQ ID NO: 139539 - protein, 9 aa, Artificial Sequence
  Description of Artificial Sequence: Synthetic peptide
  Seed: VTAQVVLQA (PMEL_HUMAN)
VTAQVVLQI

SEQ ID NO: 139540 - protein, 9 aa, Artificial Sequence
  Description of Artificial Sequence: Synthetic peptide
  Seed: YLAEADLSY (PMEL_HUMAN)
YCAEADLSY

SEQ ID NO: 139541 - protein, 9 aa, Artificial Sequence
  Description of Artificial Sequence: Synthetic peptide
  Seed: RGGQVSLKV (PMEL_HUMAN)
RSGQVSLKL

SEQ ID NO: 139542 - protein, 9 aa, Artificial Sequence
  Description of Artificial Sequence: Synthetic peptide
  Seed: AVVSTQLIM (PMEL_HUMAN)
ASVSTQLII

SEQ ID NO: 139543 - protein, 10 aa, Artificial Sequence
  Description of Artificial Sequence: Synthetic peptide
  Seed: NSLAVVSTQL (PMEL_HUMAN)
NHLAVVSTQV

SEQ ID NO: 139544 - protein, 11 aa, Artificial Sequence
  Description of Artificial Sequence: Synthetic peptide
  Seed: FTITDQVPFSV (PMEL_HUMAN)
FLITDQVPFSV

SEQ ID NO: 139545 - protein, 9 aa, Artificial Sequence
  Description of Artificial Sequence: Synthetic peptide
  Seed: SSHWLRLPR (PMEL_HUMAN)
SIHWLRLPK

SEQ ID NO: 139546 - protein, 10 aa, Artificial Sequence
  Description of Artificial Sequence: Synthetic peptide
  Seed: GQEAGLGQVP (PMEL_HUMAN)
GEEAGLGQVP

SEQ ID NO: 139547 - protein, 9 aa, Artificial Sequence
  Description of Artificial Sequence: Synthetic peptide
  Seed: HLAVIGALL (PMEL_HUMAN)
HQAVIGALF

SEQ ID NO: 139548 - protein, 10 aa, Artificial Sequence
  Description of Artificial Sequence: Synthetic peptide
  Seed: SQVWGGQPVY (PMEL_HUMAN)
STVWGGQPVW

SEQ ID NO: 139549 - protein, 9 aa, Artificial Sequence
  Description of Artificial Sequence: Synthetic peptide
  Seed: LMAVVLASL (PMEL_HUMAN)
LMAVVLASR

SEQ ID NO: 139550 - protein, 9 aa, Artificial Sequence
  Description of Artificial Sequence: Synthetic peptide
  Seed: RAMLGTHTM (PMEL_HUMAN)
RPMLGTHTI

SEQ ID NO: 139551 - protein, 11 aa, Artificial Sequence
  Description of Artificial Sequence: Synthetic peptide
  Seed: SYVPLAHSSSA (PMEL_HUMAN)
SEVPLAHSSSF

SEQ ID NO: 139552 - protein, 10 aa, Artificial Sequence
  Description of Artificial Sequence: Synthetic peptide
  Seed: VLMAVVLASL (PMEL_HUMAN)
VIMAVVLASL

SEQ ID NO: 139553 - protein, 9 aa, Artificial Sequence
  Description of Artificial Sequence: Synthetic peptide
  Seed: VISTAPVQM (PMEL_HUMAN)
VSSTAPVQY

SEQ ID NO: 139554 - protein, 8 aa, Artificial Sequence
  Description of Artificial Sequence: Synthetic peptide
  Seed: LNFPGSQK (PMEL_HUMAN)
LSFPGSQM

SEQ ID NO: 139555 - protein, 9 aa, Artificial Sequence
  Description of Artificial Sequence: Synthetic peptide
  Seed: FLRNQPLTF (PMEL_HUMAN)
FYRNQPLTI

SEQ ID NO: 139556 - protein, 9 aa, Artificial Sequence
  Description of Artificial Sequence: Synthetic peptide
  Seed: ASFSIALNF (PMEL_HUMAN)
ATFSIALNV

SEQ ID NO: 139557 - protein, 9 aa, Artificial Sequence
  Description of Artificial Sequence: Synthetic peptide
  Seed: SITGSLGPL (PMEL_HUMAN)
SITGSLGPR

SEQ ID NO: 139558 - protein, 9 aa, Artificial Sequence
  Description of Artificial Sequence: Synthetic peptide
  Seed: SQKRSFVYV (PMEL_HUMAN)
SMKRSFVYT

SEQ ID NO: 139559 - protein, 9 aa, Artificial Sequence
  Description of Artificial Sequence: Synthetic peptide
  Seed: QDFSVPQLP (PMEL_HUMAN)
QEFSVPQLL

SEQ ID NO: 139560 - protein, 9 aa, Artificial Sequence
  Description of Artificial Sequence: Synthetic peptide
  Seed: HWLRLPRIF (PMEL_HUMAN)
HYLRLPRIW

SEQ ID NO: 139561 - protein, 9 aa, Artificial Sequence
  Description of Artificial Sequence: Synthetic peptide
  Seed: YWQVLGGPV (PMEL_HUMAN)
YFQVLGGPM

SEQ ID NO: 139562 - protein, 9 aa, Artificial Sequence
  Description of Artificial Sequence: Synthetic peptide
  Seed: ITDQVPFSV (PMEL_HUMAN)
IWDQVPFSM

SEQ ID NO: 139563 - protein, 10 aa, Artificial Sequence
  Description of Artificial Sequence: Synthetic peptide
  Seed: VPLAHSSSAF (PMEL_HUMAN)
VSLAHSSSAY

SEQ ID NO: 139564 - protein, 9 aa, Artificial Sequence
  Description of Artificial Sequence: Synthetic peptide
  Seed: HLAVIGALL (PMEL_HUMAN)
HVAVIGALL

SEQ ID NO: 139565 - protein, 10 aa, Artificial Sequence
  Description of Artificial Sequence: Synthetic peptide
  Seed: TGMTPAEVSI (PMEL_HUMAN)
TYMTPAEVSL

SEQ ID NO: 139566 - protein, 9 aa, Artificial Sequence
  Description of Artificial Sequence: Synthetic peptide
  Seed: QVIWVNNTI (PMEL_HUMAN)
QVIWVNNTK

SEQ ID NO: 139567 - protein, 10 aa, Artificial Sequence
  Description of Artificial Sequence: Synthetic peptide
  Seed: LAHSSSAFTI (PMEL_HUMAN)
LNHSSSAFTW

SEQ ID NO: 139568 - protein, 9 aa, Artificial Sequence
  Description of Artificial Sequence: Synthetic peptide
  Seed: TVYHRRGSR (PMEL_HUMAN)
TMYHRRGSK

SEQ ID NO: 139569 - protein, 10 aa, Artificial Sequence
  Description of Artificial Sequence: Synthetic peptide
  Seed: MSTESITGSL (PMEL_HUMAN)
MYTESITGSV

SEQ ID NO: 139570 - protein, 9 aa, Artificial Sequence
  Description of Artificial Sequence: Synthetic peptide
  Seed: HTMEVTVYH (PMEL_HUMAN)
HYMEVTVYR

SEQ ID NO: 139571 - protein, 9 aa, Artificial Sequence
  Description of Artificial Sequence: Synthetic peptide
  Seed: ISRALVVTH (PMEL_HUMAN)
IMRALVVTK

SEQ ID NO: 139572 - protein, 10 aa, Artificial Sequence
  Description of Artificial Sequence: Synthetic peptide
  Seed: VLASLIYRRR (PMEL_HUMAN)
VTASLIYRRR

SEQ ID NO: 139573 - protein, 11 aa, Artificial Sequence
  Description of Artificial Sequence: Synthetic peptide
  Seed: FGDSSGTLISR (PMEL_HUMAN)
FTDSSGTLISY

SEQ ID NO: 139574 - protein, 9 aa, Artificial Sequence
  Description of Artificial Sequence: Synthetic peptide
  Seed: GMTPAEVSI (PMEL_HUMAN)
GATPAEVSL

SEQ ID NO: 139575 - protein, 9 aa, Artificial Sequence
  Description of Artificial Sequence: Synthetic peptide
  Seed: TLIGANASF (PMEL_HUMAN)
TSIGANASW

SEQ ID NO: 139576 - protein, 10 aa, Artificial Sequence
  Description of Artificial Sequence: Synthetic peptide
  Seed: RALDGGNKHF (PMEL_HUMAN)
RALDGGNKHY

SEQ ID NO: 139577 - protein, 9 aa, Artificial Sequence
  Description of Artificial Sequence: Synthetic peptide
  Seed: RAMLGTHTM (PMEL_HUMAN)
RFMLGTHTF

SEQ ID NO: 139578 - protein, 9 aa, Artificial Sequence
  Description of Artificial Sequence: Synthetic peptide
  Seed: RAMLGTHTM (PMEL_HUMAN)
RFMLGTHTR

SEQ ID NO: 139579 - protein, 8 aa, Artificial Sequence
  Description of Artificial Sequence: Synthetic peptide
  Seed: SNDGPTLI (PMEL_HUMAN)
SMDGPTLV

SEQ ID NO: 139580 - protein, 9 aa, Artificial Sequence
  Description of Artificial Sequence: Synthetic peptide
  Seed: STESITGSL (PMEL_HUMAN)
SYESITGSM

SEQ ID NO: 139581 - protein, 10 aa, Artificial Sequence
  Description of Artificial Sequence: Synthetic peptide
  Seed: RELPIPEPEG (PMEL_HUMAN)
RELPIPEPEP

SEQ ID NO: 139582 - protein, 9 aa, Artificial Sequence
  Description of Artificial Sequence: Synthetic peptide
  Seed: AQVVLQAAI (PMEL_HUMAN)
AMVVLQAAM

SEQ ID NO: 139583 - protein, 10 aa, Artificial Sequence
  Description of Artificial Sequence: Synthetic peptide
  Seed: YGSFSVTLDI (PMEL_HUMAN)
YGSFSVTLDY

SEQ ID NO: 139584 - protein, 9 aa, Artificial Sequence
  Description of Artificial Sequence: Synthetic peptide
  Seed: QVPLIVGIL (PMEL_HUMAN)
QTPLIVGIV

SEQ ID NO: 139585 - protein, 9 aa, Artificial Sequence
  Description of Artificial Sequence: Synthetic peptide
  Seed: QLRTKAWNR (PMEL_HUMAN)
QARTKAWNR

SEQ ID NO: 139586 - protein, 9 aa, Artificial Sequence
  Description of Artificial Sequence: Synthetic peptide
  Seed: QLYPEWTEA (PMEL_HUMAN)
QMYPEWTEL

SEQ ID NO: 139587 - protein, 9 aa, Artificial Sequence
  Description of Artificial Sequence: Synthetic peptide
  Seed: AHSSSAFTI (PMEL_HUMAN)
ALSSSAFTF

SEQ ID NO: 139588 - protein, 9 aa, Artificial Sequence
  Description of Artificial Sequence: Synthetic peptide
  Seed: TPAEVSIVV (PMEL_HUMAN)
TAAEVSIVW

SEQ ID NO: 139589 - protein, 10 aa, Artificial Sequence
  Description of Artificial Sequence: Synthetic peptide
  Seed: VPQLPHSSSH (PMEL_HUMAN)
VPQLPHSSSM

SEQ ID NO: 139590 - protein, 9 aa, Artificial Sequence
  Description of Artificial Sequence: Synthetic peptide
  Seed: KTWGQYWQV (PMEL_HUMAN)
KIWGQYWQT

SEQ ID NO: 139591 - protein, 10 aa, Artificial Sequence
  Description of Artificial Sequence: Synthetic peptide
  Seed: RTKAWNRQLY (PMEL_HUMAN)
RTKAWNRQLM

SEQ ID NO: 139592 - protein, 9 aa, Artificial Sequence
  Description of Artificial Sequence: Synthetic peptide
  Seed: RQVPLDCVL (PMEL_HUMAN)
RIVPLDCVL

SEQ ID NO: 139593 - protein, 11 aa, Artificial Sequence
  Description of Artificial Sequence: Synthetic peptide
  Seed: FTITDQVPFSV (PMEL_HUMAN)
FTITDQVPFSF

SEQ ID NO: 139594 - protein, 10 aa, Artificial Sequence
  Description of Artificial Sequence: Synthetic peptide
  Seed: VSLADTNSLA (PMEL_HUMAN)
VFLADTNSLA

SEQ ID NO: 139595 - protein, 9 aa, Artificial Sequence
  Description of Artificial Sequence: Synthetic peptide
  Seed: FTITDQVPF (PMEL_HUMAN)
FIITDQVPW

SEQ ID NO: 139596 - protein, 10 aa, Artificial Sequence
  Description of Artificial Sequence: Synthetic peptide
  Seed: CPIGENSPLL (PMEL_HUMAN)
CPIGENSPLM

SEQ ID NO: 139597 - protein, 10 aa, Artificial Sequence
  Description of Artificial Sequence: Synthetic peptide
  Seed: LRLVKRQVPL (PMEL_HUMAN)
LMLVKRQVPM

SEQ ID NO: 139598 - protein, 10 aa, Artificial Sequence
  Description of Artificial Sequence: Synthetic peptide
  Seed: MTPAEVSIVV (PMEL_HUMAN)
MRPAEVSIVA

SEQ ID NO: 139599 - protein, 9 aa, Artificial Sequence
  Description of Artificial Sequence: Synthetic peptide
  Seed: SQVWGGQPV (PMEL_HUMAN)
SSVWGGQPL

SEQ ID NO: 139600 - protein, 10 aa, Artificial Sequence
  Description of Artificial Sequence: Synthetic peptide
  Seed: FSVSVSQLRA (PMEL_HUMAN)
FDVSVSQLRR

SEQ ID NO: 139601 - protein, 11 aa, Artificial Sequence
  Description of Artificial Sequence: Synthetic peptide
  Seed: SPVPGTTDGHR (PMEL_HUMAN)
SIVPGTTDGHK

SEQ ID NO: 139602 - protein, 9 aa, Artificial Sequence
  Description of Artificial Sequence: Synthetic peptide
  Seed: ASFSIALNF (PMEL_HUMAN)
ATFSIALNW

SEQ ID NO: 139603 - protein, 9 aa, Artificial Sequence
  Description of Artificial Sequence: Synthetic peptide
  Seed: LIVGILLVL (PMEL_HUMAN)
LTVGILLVR

SEQ ID NO: 139604 - protein, 10 aa, Artificial Sequence
  Description of Artificial Sequence: Synthetic peptide
  Seed: SVPQLPHSSS (PMEL_HUMAN)
SQPQLPHSSI

SEQ ID NO: 139605 - protein, 9 aa, Artificial Sequence
  Description of Artificial Sequence: Synthetic peptide
  Seed: SQVWGGQPV (PMEL_HUMAN)
SEVWGGQPT

SEQ ID NO: 139606 - protein, 9 aa, Artificial Sequence
  Description of Artificial Sequence: Synthetic peptide
  Seed: GSWSQKRSF (PMEL_HUMAN)
GRWSQKRSY

SEQ ID NO: 139607 - protein, 9 aa, Artificial Sequence
  Description of Artificial Sequence: Synthetic peptide
  Seed: VQVPTTEVI (PMEL_HUMAN)
VQVPTTEVM

SEQ ID NO: 139608 - protein, 9 aa, Artificial Sequence
  Description of Artificial Sequence: Synthetic peptide
  Seed: TAQVVLQAA (PMEL_HUMAN)
TRQVVLQAA

SEQ ID NO: 139609 - protein, 9 aa, Artificial Sequence
  Description of Artificial Sequence: Synthetic peptide
  Seed: VLPDGQVIW (PMEL_HUMAN)
VMPDGQVIM

SEQ ID NO: 139610 - protein, 10 aa, Artificial Sequence
  Description of Artificial Sequence: Synthetic peptide
  Seed: VLYRYGSFSV (PMEL_HUMAN)
VLYRYGSFSI

SEQ ID NO: 139611 - protein, 11 aa, Artificial Sequence
  Description of Artificial Sequence: Synthetic peptide
  Seed: MLGTHTMEVTV (PMEL_HUMAN)
MMGTHTMEVTV

SEQ ID NO: 139612 - protein, 11 aa, Artificial Sequence
  Description of Artificial Sequence: Synthetic peptide
  Seed: VPTTEVISTAP (PMEL_HUMAN)
VPTTEVISTAA

SEQ ID NO: 139613 - protein, 10 aa, Artificial Sequence
  Description of Artificial Sequence: Synthetic peptide
  Seed: YVPLAHSSSA (PMEL_HUMAN)
YFPLAHSSSL

SEQ ID NO: 139614 - protein, 9 aa, Artificial Sequence
  Description of Artificial Sequence: Synthetic peptide
  Seed: CWRGGQVSL (PMEL_HUMAN)
CFRGGQVSM

SEQ ID NO: 139615 - protein, 10 aa, Artificial Sequence
  Description of Artificial Sequence: Synthetic peptide
  Seed: IALNFPGSQK (PMEL_HUMAN)
IILNFPGSQK

SEQ ID NO: 139616 - protein, 11 aa, Artificial Sequence
  Description of Artificial Sequence: Synthetic peptide
  Seed: QAVPSGEGDAF (PMEL_HUMAN)
QTVPSGEGDAW

SEQ ID NO: 139617 - protein, 10 aa, Artificial Sequence
  Description of Artificial Sequence: Synthetic peptide
  Seed: EVMGTTLAEM (PMEL_HUMAN)
EAMGTTLAEF

SEQ ID NO: 139618 - protein, 9 aa, Artificial Sequence
  Description of Artificial Sequence: Synthetic peptide
  Seed: TTDGHRPTA (PMEL_HUMAN)
TMDGHRPTM

SEQ ID NO: 139619 - protein, 10 aa, Artificial Sequence
  Description of Artificial Sequence: Synthetic peptide
  Seed: QILKGGSGTY (PMEL_HUMAN)
QALKGGSGTR

SEQ ID NO: 139620 - protein, 9 aa, Artificial Sequence
  Description of Artificial Sequence: Synthetic peptide
  Seed: HLAVIGALL (PMEL_HUMAN)
HIAVIGALL

SEQ ID NO: 139621 - protein, 9 aa, Artificial Sequence
  Description of Artificial Sequence: Synthetic peptide
  Seed: ALNFPGSQK (PMEL_HUMAN)
ASNFPGSQY

SEQ ID NO: 139622 - protein, 9 aa, Artificial Sequence
  Description of Artificial Sequence: Synthetic peptide
  Seed: YLEPGPVTA (PMEL_HUMAN)
YEEPGPVTL

SEQ ID NO: 139623 - protein, 9 aa, Artificial Sequence
  Description of Artificial Sequence: Synthetic peptide
  Seed: AEPSGTTSV (PMEL_HUMAN)
AEPSGTTSF

SEQ ID NO: 139624 - protein, 9 aa, Artificial Sequence
  Description of Artificial Sequence: Synthetic peptide
  Seed: AGQVPTTEV (PMEL_HUMAN)
AIQVPTTEF

SEQ ID NO: 139625 - protein, 9 aa, Artificial Sequence
  Description of Artificial Sequence: Synthetic peptide
  Seed: QLHDPSGYL (PMEL_HUMAN)
QQHDPSGYF

SEQ ID NO: 139626 - protein, 10 aa, Artificial Sequence
  Description of Artificial Sequence: Synthetic peptide
  Seed: NASFSIALNF (PMEL_HUMAN)
NASFSIALNW

SEQ ID NO: 139627 - protein, 9 aa, Artificial Sequence
  Description of Artificial Sequence: Synthetic peptide
  Seed: LNFPGSQKV (PMEL_HUMAN)
LSFPGSQKI

SEQ ID NO: 139628 - protein, 9 aa, Artificial Sequence
  Description of Artificial Sequence: Synthetic peptide
  Seed: ANASFSIAL (PMEL_HUMAN)
AHASFSIAF

SEQ ID NO: 139629 - protein, 9 aa, Artificial Sequence
  Description of Artificial Sequence: Synthetic peptide
  Seed: FSIALNFPG (PMEL_HUMAN)
FVIALNFPW

SEQ ID NO: 139630 - protein, 10 aa, Artificial Sequence
  Description of Artificial Sequence: Synthetic peptide
  Seed: VSLADTNSLA (PMEL_HUMAN)
VYLADTNSLM

SEQ ID NO: 139631 - protein, 9 aa, Artificial Sequence
  Description of Artificial Sequence: Synthetic peptide
  Seed: TTDGHRPTA (PMEL_HUMAN)
TCDGHRPTI

SEQ ID NO: 139632 - protein, 10 aa, Artificial Sequence
  Description of Artificial Sequence: Synthetic peptide
  Seed: AVIGALLAVG (PMEL_HUMAN)
AQIGALLAVR

SEQ ID NO: 139633 - protein, 10 aa, Artificial Sequence
  Description of Artificial Sequence: Synthetic peptide
  Seed: YVPLAHSSSA (PMEL_HUMAN)
YRPLAHSSSV

SEQ ID NO: 139634 - protein, 9 aa, Artificial Sequence
  Description of Artificial Sequence: Synthetic peptide
  Seed: FLRNQPLTF (PMEL_HUMAN)
FQRNQPLTI

SEQ ID NO: 139635 - protein, 9 aa, Artificial Sequence
  Description of Artificial Sequence: Synthetic peptide
  Seed: LAVVSTQLI (PMEL_HUMAN)
LQVVSTQLL

SEQ ID NO: 139636 - protein, 11 aa, Artificial Sequence
  Description of Artificial Sequence: Synthetic peptide
  Seed: RYGSFSVTLDI (PMEL_HUMAN)
RGGSFSVTLDY

SEQ ID NO: 139637 - protein, 9 aa, Artificial Sequence
  Description of Artificial Sequence: Synthetic peptide
  Seed: GSFSVTLDI (PMEL_HUMAN)
GQFSVTLDW

SEQ ID NO: 139638 - protein, 9 aa, Artificial Sequence
  Description of Artificial Sequence: Synthetic peptide
  Seed: LNFPGSQKV (PMEL_HUMAN)
LRFPGSQKV

SEQ ID NO: 139639 - protein, 9 aa, Artificial Sequence
  Description of Artificial Sequence: Synthetic peptide
  Seed: AVVLASLIY (PMEL_HUMAN)
ALVLASLIY

SEQ ID NO: 139640 - protein, 9 aa, Artificial Sequence
  Description of Artificial Sequence: Synthetic peptide
  Seed: ANASFSIAL (PMEL_HUMAN)
AAASFSIAI

SEQ ID NO: 139641 - protein, 10 aa, Artificial Sequence
  Description of Artificial Sequence: Synthetic peptide
  Seed: APNTTAGQVP (PMEL_HUMAN)
APNTTAGQVM

SEQ ID NO: 139642 - protein, 11 aa, Artificial Sequence
  Description of Artificial Sequence: Synthetic peptide
  Seed: HTMEVTVYHRR (PMEL_HUMAN)
HIMEVTVYHRK

SEQ ID NO: 139643 - protein, 10 aa, Artificial Sequence
  Description of Artificial Sequence: Synthetic peptide
  Seed: GRAMLGTHTM (PMEL_HUMAN)
GKAMLGTHTY

SEQ ID NO: 139644 - protein, 9 aa, Artificial Sequence
  Description of Artificial Sequence: Synthetic peptide
  Seed: TPAEVSIVV (PMEL_HUMAN)
TVAEVSIVA

SEQ ID NO: 139645 - protein, 9 aa, Artificial Sequence
  Description of Artificial Sequence: Synthetic peptide
  Seed: GGPVSGLSI (PMEL_HUMAN)
GVPVSGLSL

SEQ ID NO: 139646 - protein, 9 aa, Artificial Sequence
  Description of Artificial Sequence: Synthetic peptide
  Seed: VISTAPVQM (PMEL_HUMAN)
VVSTAPVQL

SEQ ID NO: 139647 - protein, 9 aa, Artificial Sequence
  Description of Artificial Sequence: Synthetic peptide
  Seed: SQKRSFVYV (PMEL_HUMAN)
SSKRSFVYA

SEQ ID NO: 139648 - protein, 9 aa, Artificial Sequence
  Description of Artificial Sequence: Synthetic peptide
  Seed: VVLSGTTAA (PMEL_HUMAN)
VQLSGTTAA

SEQ ID NO: 139649 - protein, 9 aa, Artificial Sequence
  Description of Artificial Sequence: Synthetic peptide
  Seed: ALNFPGSQK (PMEL_HUMAN)
AANFPGSQV

SEQ ID NO: 139650 - protein, 10 aa, Artificial Sequence
  Description of Artificial Sequence: Synthetic peptide
  Seed: AVVLASLIYR (PMEL_HUMAN)
AIVLASLIYK

SEQ ID NO: 139651 - protein, 9 aa, Artificial Sequence
  Description of Artificial Sequence: Synthetic peptide
  Seed: ANASFSIAL (PMEL_HUMAN)
AKASFSIAI

SEQ ID NO: 139652 - protein, 10 aa, Artificial Sequence
  Description of Artificial Sequence: Synthetic peptide
  Seed: LAVIGALLAV (PMEL_HUMAN)
LTVIGALLAA

SEQ ID NO: 139653 - protein, 9 aa, Artificial Sequence
  Description of Artificial Sequence: Synthetic peptide
  Seed: VLPDGQVIW (PMEL_HUMAN)
VFPDGQVIF

SEQ ID NO: 139654 - protein, 10 aa, Artificial Sequence
  Description of Artificial Sequence: Synthetic peptide
  Seed: MAVVLASLIY (PMEL_HUMAN)
MSVVLASLIF

SEQ ID NO: 139655 - protein, 9 aa, Artificial Sequence
  Description of Artificial Sequence: Synthetic peptide
  Seed: RNQPLTFAL (PMEL_HUMAN)
REQPLTFAF

SEQ ID NO: 139656 - protein, 9 aa, Artificial Sequence
  Description of Artificial Sequence: Synthetic peptide
  Seed: EGDAFELTV (PMEL_HUMAN)
EADAFELTF

SEQ ID NO: 139657 - protein, 10 aa, Artificial Sequence
  Description of Artificial Sequence: Synthetic peptide
  Seed: KVSNDGPTLI (PMEL_HUMAN)
KMSNDGPTLV

SEQ ID NO: 139658 - protein, 8 aa, Artificial Sequence
  Description of Artificial Sequence: Synthetic peptide
  Seed: LLDGTATL (PMEL_HUMAN)
LMDGTATL

SEQ ID NO: 139659 - protein, 10 aa, Artificial Sequence
  Description of Artificial Sequence: Synthetic peptide
  Seed: MTPAEVSIVV (PMEL_HUMAN)
MSPAEVSIVH

SEQ ID NO: 139660 - protein, 9 aa, Artificial Sequence
  Description of Artificial Sequence: Synthetic peptide
  Seed: VTLDIVQGI (PMEL_HUMAN)
VALDIVQGR

SEQ ID NO: 139661 - protein, 11 aa, Artificial Sequence
  Description of Artificial Sequence: Synthetic peptide
  Seed: ISRALVVTHTY (PMEL_HUMAN)
IKRALVVTHTW

SEQ ID NO: 139662 - protein, 9 aa, Artificial Sequence
  Description of Artificial Sequence: Synthetic peptide
  Seed: SQVWGGQPV (PMEL_HUMAN)
SVVWGGQPY

SEQ ID NO: 139663 - protein, 9 aa, Artificial Sequence
  Description of Artificial Sequence: Synthetic peptide
  Seed: QVIWVNNTI (PMEL_HUMAN)
QTIWVNNTI

SEQ ID NO: 139664 - protein, 11 aa, Artificial Sequence
  Description of Artificial Sequence: Synthetic peptide
  Seed: CSCPIGENSPL (PMEL_HUMAN)
CACPIGENSPW

SEQ ID NO: 139665 - protein, 8 aa, Artificial Sequence
  Description of Artificial Sequence: Synthetic peptide
  Seed: MTPEKVPV (PMEL_HUMAN)
MSPEKVPL

SEQ ID NO: 139666 - protein, 9 aa, Artificial Sequence
  Description of Artificial Sequence: Synthetic peptide
  Seed: NFPGSQKVL (PMEL_HUMAN)
NSPGSQKVL

SEQ ID NO: 139667 - protein, 9 aa, Artificial Sequence
  Description of Artificial Sequence: Synthetic peptide
  Seed: VISTAPVQM (PMEL_HUMAN)
VRSTAPVQM

SEQ ID NO: 139668 - protein, 10 aa, Artificial Sequence
  Description of Artificial Sequence: Synthetic peptide
  Seed: RLMKQDFSVP (PMEL_HUMAN)
RMMKQDFSVI

SEQ ID NO: 139669 - protein, 9 aa, Artificial Sequence
  Description of Artificial Sequence: Synthetic peptide
  Seed: FLRNQPLTF (PMEL_HUMAN)
FARNQPLTV

SEQ ID NO: 139670 - protein, 9 aa, Artificial Sequence
  Description of Artificial Sequence: Synthetic peptide
  Seed: AQRLCQPVL (PMEL_HUMAN)
AGRLCQPVK

SEQ ID NO: 139671 - protein, 11 aa, Artificial Sequence
  Description of Artificial Sequence: Synthetic peptide
  Seed: LGPLLDGTATL (PMEL_HUMAN)
LEPLLDGTATV

SEQ ID NO: 139672 - protein, 10 aa, Artificial Sequence
  Description of Artificial Sequence: Synthetic peptide
  Seed: RSFVYVWKTW (PMEL_HUMAN)
RSFVYVWKTM

SEQ ID NO: 139673 - protein, 9 aa, Artificial Sequence
  Description of Artificial Sequence: Synthetic peptide
  Seed: AQRLCQPVL (PMEL_HUMAN)
ATRLCQPVM

SEQ ID NO: 139674 - protein, 9 aa, Artificial Sequence
  Description of Artificial Sequence: Synthetic peptide
  Seed: AEPSGTTSV (PMEL_HUMAN)
ALPSGTTSY

SEQ ID NO: 139675 - protein, 9 aa, Artificial Sequence
  Description of Artificial Sequence: Synthetic peptide
  Seed: LSIGTGRAM (PMEL_HUMAN)
LIIGTGRAF

SEQ ID NO: 139676 - protein, 10 aa, Artificial Sequence
  Description of Artificial Sequence: Synthetic peptide
  Seed: GPLLDGTATL (PMEL_HUMAN)
GFLLDGTATL

SEQ ID NO: 139677 - protein, 9 aa, Artificial Sequence
  Description of Artificial Sequence: Synthetic peptide
  Seed: NFPGSQKVL (PMEL_HUMAN)
NLPGSQKVM

SEQ ID NO: 139678 - protein, 11 aa, Artificial Sequence
  Description of Artificial Sequence: Synthetic peptide
  Seed: ASLIYRRRLMK (PMEL_HUMAN)
AMLIYRRRLMR

SEQ ID NO: 139679 - protein, 10 aa, Artificial Sequence
  Description of Artificial Sequence: Synthetic peptide
  Seed: YVWKTWGQYW (PMEL_HUMAN)
YWWKTWGQYW

SEQ ID NO: 139680 - protein, 9 aa, Artificial Sequence
  Description of Artificial Sequence: Synthetic peptide
  Seed: RALVVTHTY (PMEL_HUMAN)
RMLVVTHTR

SEQ ID NO: 139681 - protein, 10 aa, Artificial Sequence
  Description of Artificial Sequence: Synthetic peptide
  Seed: ALDGGNKHFL (PMEL_HUMAN)
ALDGGNKHFW

SEQ ID NO: 139682 - protein, 11 aa, Artificial Sequence
  Description of Artificial Sequence: Synthetic peptide
  Seed: RYGSFSVTLDI (PMEL_HUMAN)
RHGSFSVTLDF

SEQ ID NO: 139683 - protein, 10 aa, Artificial Sequence
  Description of Artificial Sequence: Synthetic peptide
  Seed: SLADTNSLAV (PMEL_HUMAN)
SLADTNSLAL

SEQ ID NO: 139684 - protein, 9 aa, Artificial Sequence
  Description of Artificial Sequence: Synthetic peptide
  Seed: SSPGCQPPA (PMEL_HUMAN)
SIPGCQPPF

SEQ ID NO: 139685 - protein, 9 aa, Artificial Sequence
  Description of Artificial Sequence: Synthetic peptide
  Seed: VSNDGPTLI (PMEL_HUMAN)
VTNDGPTLL

SEQ ID NO: 139686 - protein, 10 aa, Artificial Sequence
  Description of Artificial Sequence: Synthetic peptide
  Seed: VLMAVVLASL (PMEL_HUMAN)
VMMAVVLASY

SEQ ID NO: 139687 - protein, 10 aa, Artificial Sequence
  Description of Artificial Sequence: Synthetic peptide
  Seed: RPTAEAPNTT (PMEL_HUMAN)
RPTAEAPNTL

SEQ ID NO: 139688 - protein, 9 aa, Artificial Sequence
  Description of Artificial Sequence: Synthetic peptide
  Seed: AGLGQVPLI (PMEL_HUMAN)
AQLGQVPLL

SEQ ID NO: 139689 - protein, 9 aa, Artificial Sequence
  Description of Artificial Sequence: Synthetic peptide
  Seed: ANASFSIAL (PMEL_HUMAN)
ARASFSIAV

SEQ ID NO: 139690 - protein, 9 aa, Artificial Sequence
  Description of Artificial Sequence: Synthetic peptide
  Seed: TEWVETTAR (PMEL_HUMAN)
TEWVETTAM

SEQ ID NO: 139691 - protein, 9 aa, Artificial Sequence
  Description of Artificial Sequence: Synthetic peptide
  Seed: YLEPGPVTA (PMEL_HUMAN)
YREPGPVTI

SEQ ID NO: 139692 - protein, 9 aa, Artificial Sequence
  Description of Artificial Sequence: Synthetic peptide
  Seed: LAVVSTQLI (PMEL_HUMAN)
LLVVSTQLW

SEQ ID NO: 139693 - protein, 9 aa, Artificial Sequence
  Description of Artificial Sequence: Synthetic peptide
  Seed: KTWGQYWQV (PMEL_HUMAN)
KGWGQYWQY

SEQ ID NO: 139694 - protein, 9 aa, Artificial Sequence
  Description of Artificial Sequence: Synthetic peptide
  Seed: RYGSFSVTL (PMEL_HUMAN)
RWGSFSVTM

SEQ ID NO: 139695 - protein, 11 aa, Artificial Sequence
  Description of Artificial Sequence: Synthetic peptide
  Seed: RYGSFSVTLDI (PMEL_HUMAN)
RWGSFSVTLDY

SEQ ID NO: 139696 - protein, 9 aa, Artificial Sequence
  Description of Artificial Sequence: Synthetic peptide
  Seed: AQVVLQAAI (PMEL_HUMAN)
AQVVLQAAY

SEQ ID NO: 139697 - protein, 11 aa, Artificial Sequence
  Description of Artificial Sequence: Synthetic peptide
  Seed: RTKAWNRQLYP (PMEL_HUMAN)
RTKAWNRQLYA

SEQ ID NO: 139698 - protein, 10 aa, Artificial Sequence
  Description of Artificial Sequence: Synthetic peptide
  Seed: ALDGGNKHFL (PMEL_HUMAN)
AVDGGNKHFF

SEQ ID NO: 139699 - protein, 9 aa, Artificial Sequence
  Description of Artificial Sequence: Synthetic peptide
  Seed: RLMKQDFSV (PMEL_HUMAN)
RAMKQDFSV

SEQ ID NO: 139700 - protein, 9 aa, Artificial Sequence
  Description of Artificial Sequence: Synthetic peptide
  Seed: RTKAWNRQL (PMEL_HUMAN)
RRKAWNRQF

SEQ ID NO: 139701 - protein, 10 aa, Artificial Sequence
  Description of Artificial Sequence: Synthetic peptide
  Seed: LSIGTGRAML (PMEL_HUMAN)
LAIGTGRAMY

SEQ ID NO: 139702 - protein, 9 aa, Artificial Sequence
  Description of Artificial Sequence: Synthetic peptide
  Seed: YLAEADLSY (PMEL_HUMAN)
YYAEADLSY

SEQ ID NO: 139703 - protein, 9 aa, Artificial Sequence
  Description of Artificial Sequence: Synthetic peptide
  Seed: LYRYGSFSV (PMEL_HUMAN)
LTRYGSFSL

SEQ ID NO: 139704 - protein, 9 aa, Artificial Sequence
  Description of Artificial Sequence: Synthetic peptide
  Seed: ALDGGNKHF (PMEL_HUMAN)
ANDGGNKHL

SEQ ID NO: 139705 - protein, 9 aa, Artificial Sequence
  Description of Artificial Sequence: Synthetic peptide
  Seed: VSNDGPTLI (PMEL_HUMAN)
VQNDGPTLI

SEQ ID NO: 139706 - protein, 10 aa, Artificial Sequence
  Description of Artificial Sequence: Synthetic peptide
  Seed: RRLMKQDFSV (PMEL_HUMAN)
RGLMKQDFSV

SEQ ID NO: 139707 - protein, 9 aa, Artificial Sequence
  Description of Artificial Sequence: Synthetic peptide
  Seed: RIFCSCPIG (PMEL_HUMAN)
RVFCSCPIV

SEQ ID NO: 139708 - protein, 10 aa, Artificial Sequence
  Description of Artificial Sequence: Synthetic peptide
  Seed: SVPQLPHSSS (PMEL_HUMAN)
SSPQLPHSSV

SEQ ID NO: 139709 - protein, 9 aa, Artificial Sequence
  Description of Artificial Sequence: Synthetic peptide
  Seed: DQVPFSVSV (PMEL_HUMAN)
DAVPFSVSF

SEQ ID NO: 139710 - protein, 9 aa, Artificial Sequence
  Description of Artificial Sequence: Synthetic peptide
  Seed: AEADLSYTW (PMEL_HUMAN)
ALADLSYTI

SEQ ID NO: 139711 - protein, 10 aa, Artificial Sequence
  Description of Artificial Sequence: Synthetic peptide
  Seed: LHLAVIGALL (PMEL_HUMAN)
LCLAVIGALL

SEQ ID NO: 139712 - protein, 9 aa, Artificial Sequence
  Description of Artificial Sequence: Synthetic peptide
  Seed: SSPGCQPPA (PMEL_HUMAN)
SSPGCQPPM

SEQ ID NO: 139713 - protein, 9 aa, Artificial Sequence
  Description of Artificial Sequence: Synthetic peptide
  Seed: DSSGTLISR (PMEL_HUMAN)
DVSGTLISM

SEQ ID NO: 139714 - protein, 10 aa, Artificial Sequence
  Description of Artificial Sequence: Synthetic peptide
  Seed: RGSRSYVPLA (PMEL_HUMAN)
RSSRSYVPLL

SEQ ID NO: 139715 - protein, 9 aa, Artificial Sequence
  Description of Artificial Sequence: Synthetic peptide
  Seed: FSVSVSQLR (PMEL_HUMAN)
FSVSVSQLF

SEQ ID NO: 139716 - protein, 9 aa, Artificial Sequence
  Description of Artificial Sequence: Synthetic peptide
  Seed: ITGSLGPLL (PMEL_HUMAN)
ILGSLGPLI

SEQ ID NO: 139717 - protein, 8 aa, Artificial Sequence
  Description of Artificial Sequence: Synthetic peptide
  Seed: SNDGPTLI (PMEL_HUMAN)
SSDGPTLF

SEQ ID NO: 139718 - protein, 9 aa, Artificial Sequence
  Description of Artificial Sequence: Synthetic peptide
  Seed: SVQVPTTEV (PMEL_HUMAN)
SLQVPTTEL

SEQ ID NO: 139719 - protein, 9 aa, Artificial Sequence
  Description of Artificial Sequence: Synthetic peptide
  Seed: HLAVIGALL (PMEL_HUMAN)
HMAVIGALV

SEQ ID NO: 139720 - protein, 9 aa, Artificial Sequence
  Description of Artificial Sequence: Synthetic peptide
  Seed: VSNDGPTLI (PMEL_HUMAN)
VGNDGPTLF

SEQ ID NO: 139721 - protein, 9 aa, Artificial Sequence
  Description of Artificial Sequence: Synthetic peptide
  Seed: YRYGSFSVT (PMEL_HUMAN)
YFYGSFSVF

SEQ ID NO: 139722 - protein, 9 aa, Artificial Sequence
  Description of Artificial Sequence: Synthetic peptide
  Seed: TAPVQMPTA (PMEL_HUMAN)
TAPVQMPTY

SEQ ID NO: 139723 - protein, 9 aa, Artificial Sequence
  Description of Artificial Sequence: Synthetic peptide
  Seed: RSYVPLAHS (PMEL_HUMAN)
RTYVPLAHS

SEQ ID NO: 139724 - protein, 11 aa, Artificial Sequence
  Description of Artificial Sequence: Synthetic peptide
  Seed: MAVVLASLIYR (PMEL_HUMAN)
MVVVLASLIYK

SEQ ID NO: 139725 - protein, 10 aa, Artificial Sequence
  Description of Artificial Sequence: Synthetic peptide
  Seed: SVPQLPHSSS (PMEL_HUMAN)
SEPQLPHSSI

SEQ ID NO: 139726 - protein, 10 aa, Artificial Sequence
  Description of Artificial Sequence: Synthetic peptide
  Seed: EVMGTTLAEM (PMEL_HUMAN)
EIMGTTLAER

SEQ ID NO: 139727 - protein, 10 aa, Artificial Sequence
  Description of Artificial Sequence: Synthetic peptide
  Seed: YRYGSFSVTL (PMEL_HUMAN)
YWYGSFSVTL

SEQ ID NO: 139728 - protein, 10 aa, Artificial Sequence
  Description of Artificial Sequence: Synthetic peptide
  Seed: STAPVQMPTA (PMEL_HUMAN)
SIAPVQMPTA

SEQ ID NO: 139729 - protein, 9 aa, Artificial Sequence
  Description of Artificial Sequence: Synthetic peptide
  Seed: AQRLCQPVL (PMEL_HUMAN)
ATRLCQPVI

SEQ ID NO: 139730 - protein, 10 aa, Artificial Sequence
  Description of Artificial Sequence: Synthetic peptide
  Seed: KRQVPLDCVL (PMEL_HUMAN)
KEQVPLDCVF

SEQ ID NO: 139731 - protein, 10 aa, Artificial Sequence
  Description of Artificial Sequence: Synthetic peptide
  Seed: LHLAVIGALL (PMEL_HUMAN)
LNLAVIGALL

SEQ ID NO: 139732 - protein, 10 aa, Artificial Sequence
  Description of Artificial Sequence: Synthetic peptide
  Seed: AVVLASLIYR (PMEL_HUMAN)
AFVLASLIYK

SEQ ID NO: 139733 - protein, 9 aa, Artificial Sequence
  Description of Artificial Sequence: Synthetic peptide
  Seed: AVGATKVPR (PMEL_HUMAN)
ASGATKVPR

SEQ ID NO: 139734 - protein, 10 aa, Artificial Sequence
  Description of Artificial Sequence: Synthetic peptide
  Seed: YVPLAHSSSA (PMEL_HUMAN)
YYPLAHSSSF

SEQ ID NO: 139735 - protein, 9 aa, Artificial Sequence
  Description of Artificial Sequence: Synthetic peptide
  Seed: TATLRLVKR (PMEL_HUMAN)
TFTLRLVKR

SEQ ID NO: 139736 - protein, 9 aa, Artificial Sequence
  Description of Artificial Sequence: Synthetic peptide
  Seed: ESAEILQAV (PMEL_HUMAN)
ELAEILQAW

SEQ ID NO: 139737 - protein, 9 aa, Artificial Sequence
  Description of Artificial Sequence: Synthetic peptide
  Seed: AVVSTQLIM (PMEL_HUMAN)
ASVSTQLIW

SEQ ID NO: 139738 - protein, 8 aa, Artificial Sequence
  Description of Artificial Sequence: Synthetic peptide
  Seed: LLDGTATL (PMEL_HUMAN)
LWDGTATL

SEQ ID NO: 139739 - protein, 9 aa, Artificial Sequence
  Description of Artificial Sequence: Synthetic peptide
  Seed: RAMLGTHTM (PMEL_HUMAN)
RPMLGTHTC

SEQ ID NO: 139740 - protein, 9 aa, Artificial Sequence
  Description of Artificial Sequence: Synthetic peptide
  Seed: ESAEILQAV (PMEL_HUMAN)
ETAEILQAK

SEQ ID NO: 139741 - protein, 8 aa, Artificial Sequence
  Description of Artificial Sequence: Synthetic peptide
  Seed: QDFSVPQL (PMEL_HUMAN)
QEFSVPQI

SEQ ID NO: 139742 - protein, 10 aa, Artificial Sequence
  Description of Artificial Sequence: Synthetic peptide
  Seed: MKQDFSVPQL (PMEL_HUMAN)
MLQDFSVPQF

SEQ ID NO: 139743 - protein, 9 aa, Artificial Sequence
  Description of Artificial Sequence: Synthetic peptide
  Seed: YLEPGPVTA (PMEL_HUMAN)
YLEPGPVTF

SEQ ID NO: 139744 - protein, 10 aa, Artificial Sequence
  Description of Artificial Sequence: Synthetic peptide
  Seed: LADTNSLAVV (PMEL_HUMAN)
LIDTNSLAVM

SEQ ID NO: 139745 - protein, 9 aa, Artificial Sequence
  Description of Artificial Sequence: Synthetic peptide
  Seed: SSIMSTESI (PMEL_HUMAN)
SHIMSTESY

SEQ ID NO: 139746 - protein, 9 aa, Artificial Sequence
  Description of Artificial Sequence: Synthetic peptide
  Seed: HSSSHWLRL (PMEL_HUMAN)
HASSHWLRY

SEQ ID NO: 139747 - protein, 9 aa, Artificial Sequence
  Description of Artificial Sequence: Synthetic peptide
  Seed: QAAIPLTSC (PMEL_HUMAN)
QPAIPLTST

SEQ ID NO: 139748 - protein, 9 aa, Artificial Sequence
  Description of Artificial Sequence: Synthetic peptide
  Seed: RAMLGTHTM (PMEL_HUMAN)
RLMLGTHTT

SEQ ID NO: 139749 - protein, 9 aa, Artificial Sequence
  Description of Artificial Sequence: Synthetic peptide
  Seed: FTITDQVPF (PMEL_HUMAN)
FQITDQVPM

SEQ ID NO: 139750 - protein, 8 aa, Artificial Sequence
  Description of Artificial Sequence: Synthetic peptide
  Seed: VLPDGQVI (PMEL_HUMAN)
VAPDGQVI

SEQ ID NO: 139751 - protein, 9 aa, Artificial Sequence
  Description of Artificial Sequence: Synthetic peptide
  Seed: KTWGQYWQV (PMEL_HUMAN)
KQWGQYWQR

SEQ ID NO: 139752 - protein, 9 aa, Artificial Sequence
  Description of Artificial Sequence: Synthetic peptide
  Seed: VISTAPVQM (PMEL_HUMAN)
VQSTAPVQI

SEQ ID NO: 139753 - protein, 10 aa, Artificial Sequence
  Description of Artificial Sequence: Synthetic peptide
  Seed: STAPVQMPTA (PMEL_HUMAN)
SLAPVQMPTM

SEQ ID NO: 139754 - protein, 9 aa, Artificial Sequence
  Description of Artificial Sequence: Synthetic peptide
  Seed: KQDFSVPQL (PMEL_HUMAN)
KFDFSVPQL

SEQ ID NO: 139755 - protein, 8 aa, Artificial Sequence
  Description of Artificial Sequence: Synthetic peptide
  Seed: LHDPSGYL (PMEL_HUMAN)
LWDPSGYM

SEQ ID NO: 139756 - protein, 10 aa, Artificial Sequence
  Description of Artificial Sequence: Synthetic peptide
  Seed: ESAEILQAVP (PMEL_HUMAN)
EAAEILQAVI

SEQ ID NO: 139757 - protein, 10 aa, Artificial Sequence
  Description of Artificial Sequence: Synthetic peptide
  Seed: TDQVPFSVSV (PMEL_HUMAN)
TYQVPFSVSV

SEQ ID NO: 139758 - protein, 11 aa, Artificial Sequence
  Description of Artificial Sequence: Synthetic peptide
  Seed: RRGSRSYVPLA (PMEL_HUMAN)
RVGSRSYVPLM

SEQ ID NO: 139759 - protein, 11 aa, Artificial Sequence
  Description of Artificial Sequence: Synthetic peptide
  Seed: YVPLAHSSSAF (PMEL_HUMAN)
YTPLAHSSSAY

SEQ ID NO: 139760 - protein, 9 aa, Artificial Sequence
  Description of Artificial Sequence: Synthetic peptide
  Seed: SSIMSTESI (PMEL_HUMAN)
SFIMSTESF

SEQ ID NO: 139761 - protein, 10 aa, Artificial Sequence
  Description of Artificial Sequence: Synthetic peptide
  Seed: GDSSGTLISR (PMEL_HUMAN)
GNSSGTLISK

SEQ ID NO: 139762 - protein, 10 aa, Artificial Sequence
  Description of Artificial Sequence: Synthetic peptide
  Seed: KVLPDGQVIW (PMEL_HUMAN)
KVLPDGQVIL

SEQ ID NO: 139763 - protein, 9 aa, Artificial Sequence
  Description of Artificial Sequence: Synthetic peptide
  Seed: FLRNQPLTF (PMEL_HUMAN)
FYRNQPLTV

SEQ ID NO: 139764 - protein, 9 aa, Artificial Sequence
  Description of Artificial Sequence: Synthetic peptide
  Seed: VSEVMGTTL (PMEL_HUMAN)
VYEVMGTTM

SEQ ID NO: 139765 - protein, 11 aa, Artificial Sequence
  Description of Artificial Sequence: Synthetic peptide
  Seed: QLYPEWTEAQR (PMEL_HUMAN)
QMYPEWTEAQR

SEQ ID NO: 139766 - protein, 9 aa, Artificial Sequence
  Description of Artificial Sequence: Synthetic peptide
  Seed: QVWGGQPVY (PMEL_HUMAN)
QVWGGQPVR

SEQ ID NO: 139767 - protein, 9 aa, Artificial Sequence
  Description of Artificial Sequence: Synthetic peptide
  Seed: SLADTNSLA (PMEL_HUMAN)
SMADTNSLT

SEQ ID NO: 139768 - protein, 9 aa, Artificial Sequence
  Description of Artificial Sequence: Synthetic peptide
  Seed: KTWGQYWQV (PMEL_HUMAN)
KLWGQYWQV

SEQ ID NO: 139769 - protein, 9 aa, Artificial Sequence
  Description of Artificial Sequence: Synthetic peptide
  Seed: MLGTHTMEV (PMEL_HUMAN)
MSGTHTMEL

SEQ ID NO: 139770 - protein, 9 aa, Artificial Sequence
  Description of Artificial Sequence: Synthetic peptide
  Seed: LIVGILLVL (PMEL_HUMAN)
LLVGILLVF

SEQ ID NO: 139771 - protein, 9 aa, Artificial Sequence
  Description of Artificial Sequence: Synthetic peptide
  Seed: RAMLGTHTM (PMEL_HUMAN)
RVMLGTHTI

SEQ ID NO: 139772 - protein, 9 aa, Artificial Sequence
  Description of Artificial Sequence: Synthetic peptide
  Seed: VLPSPACQL (PMEL_HUMAN)
VYPSPACQM

SEQ ID NO: 139773 - protein, 11 aa, Artificial Sequence
  Description of Artificial Sequence: Synthetic peptide
  Seed: HTMEVTVYHRR (PMEL_HUMAN)
HFMEVTVYHRR

SEQ ID NO: 139774 - protein, 10 aa, Artificial Sequence
  Description of Artificial Sequence: Synthetic peptide
  Seed: KRQVPLDCVL (PMEL_HUMAN)
KGQVPLDCVM

SEQ ID NO: 139775 - protein, 9 aa, Artificial Sequence
  Description of Artificial Sequence: Synthetic peptide
  Seed: ILLVLMAVV (PMEL_HUMAN)
ILLVLMAVI

SEQ ID NO: 139776 - protein, 10 aa, Artificial Sequence
  Description of Artificial Sequence: Synthetic peptide
  Seed: AVIGALLAVG (PMEL_HUMAN)
AVIGALLAVV

SEQ ID NO: 139777 - protein, 9 aa, Artificial Sequence
  Description of Artificial Sequence: Synthetic peptide
  Seed: RALVVTHTY (PMEL_HUMAN)
RMLVVTHTI

SEQ ID NO: 139778 - protein, 10 aa, Artificial Sequence
  Description of Artificial Sequence: Synthetic peptide
  Seed: GALLAVGATK (PMEL_HUMAN)
GMLLAVGATR

SEQ ID NO: 139779 - protein, 9 aa, Artificial Sequence
  Description of Artificial Sequence: Synthetic peptide
  Seed: AVVLASLIY (PMEL_HUMAN)
AKVLASLIM

SEQ ID NO: 139780 - protein, 10 aa, Artificial Sequence
  Description of Artificial Sequence: Synthetic peptide
  Seed: YLAEADLSYT (PMEL_HUMAN)
YAAEADLSYF

SEQ ID NO: 139781 - protein, 9 aa, Artificial Sequence
  Description of Artificial Sequence: Synthetic peptide
  Seed: RTKAWNRQL (PMEL_HUMAN)
RMKAWNRQA

SEQ ID NO: 139782 - protein, 9 aa, Artificial Sequence
  Description of Artificial Sequence: Synthetic peptide
  Seed: SQKRSFVYV (PMEL_HUMAN)
SLKRSFVYF

SEQ ID NO: 139783 - protein, 10 aa, Artificial Sequence
  Description of Artificial Sequence: Synthetic peptide
  Seed: VPQLPHSSSH (PMEL_HUMAN)
VFQLPHSSSY

SEQ ID NO: 139784 - protein, 9 aa, Artificial Sequence
  Description of Artificial Sequence: Synthetic peptide
  Seed: AEMSTPEAT (PMEL_HUMAN)
AEMSTPEAY

SEQ ID NO: 139785 - protein, 9 aa, Artificial Sequence
  Description of Artificial Sequence: Synthetic peptide
  Seed: ITDQVPFSV (PMEL_HUMAN)
IWDQVPFSV

SEQ ID NO: 139786 - protein, 9 aa, Artificial Sequence
  Description of Artificial Sequence: Synthetic peptide
  Seed: GSFSVTLDI (PMEL_HUMAN)
GTFSVTLDF

SEQ ID NO: 139787 - protein, 9 aa, Artificial Sequence
  Description of Artificial Sequence: Synthetic peptide
  Seed: FPDGGPCPS (PMEL_HUMAN)
FTDGGPCPY

SEQ ID NO: 139788 - protein, 9 aa, Artificial Sequence
  Description of Artificial Sequence: Synthetic peptide
  Seed: RALVVTHTY (PMEL_HUMAN)
RTLVVTHTK

SEQ ID NO: 139789 - protein, 10 aa, Artificial Sequence
  Description of Artificial Sequence: Synthetic peptide
  Seed: YGSFSVTLDI (PMEL_HUMAN)
YSSFSVTLDY

SEQ ID NO: 139790 - protein, 10 aa, Artificial Sequence
  Description of Artificial Sequence: Synthetic peptide
  Seed: MPTAESTGMT (PMEL_HUMAN)
MHTAESTGMI

SEQ ID NO: 139791 - protein, 11 aa, Artificial Sequence
  Description of Artificial Sequence: Synthetic peptide
  Seed: RALDGGNKHFL (PMEL_HUMAN)
RRLDGGNKHFY

SEQ ID NO: 139792 - protein, 10 aa, Artificial Sequence
  Description of Artificial Sequence: Synthetic peptide
  Seed: LVLKRCLLHL (PMEL_HUMAN)
LALKRCLLHV

SEQ ID NO: 139793 - protein, 8 aa, Artificial Sequence
  Description of Artificial Sequence: Synthetic peptide
  Seed: SNDGPTLI (PMEL_HUMAN)
SMDGPTLI

SEQ ID NO: 139794 - protein, 10 aa, Artificial Sequence
  Description of Artificial Sequence: Synthetic peptide
  Seed: VPLAHSSSAF (PMEL_HUMAN)
VNLAHSSSAY

SEQ ID NO: 139795 - protein, 10 aa, Artificial Sequence
  Description of Artificial Sequence: Synthetic peptide
  Seed: MSTESITGSL (PMEL_HUMAN)
MVTESITGSI

SEQ ID NO: 139796 - protein, 10 aa, Artificial Sequence
  Description of Artificial Sequence: Synthetic peptide
  Seed: ELTVSCQGGL (PMEL_HUMAN)
EETVSCQGGV

SEQ ID NO: 139797 - protein, 9 aa, Artificial Sequence
  Description of Artificial Sequence: Synthetic peptide
  Seed: FTITDQVPF (PMEL_HUMAN)
FPITDQVPE

SEQ ID NO: 139798 - protein, 9 aa, Artificial Sequence
  Description of Artificial Sequence: Synthetic peptide
  Seed: LIVGILLVL (PMEL_HUMAN)
LAVGILLVF

SEQ ID NO: 139799 - protein, 9 aa, Artificial Sequence
  Description of Artificial Sequence: Synthetic peptide
  Seed: VPFSVSVSQ (PMEL_HUMAN)
VPFSVSVSC

SEQ ID NO: 139800 - protein, 9 aa, Artificial Sequence
  Description of Artificial Sequence: Synthetic peptide
  Seed: ANASFSIAL (PMEL_HUMAN)
ATASFSIAI

SEQ ID NO: 139801 - protein, 9 aa, Artificial Sequence
  Description of Artificial Sequence: Synthetic peptide
  Seed: RYGSFSVTL (PMEL_HUMAN)
RMGSFSVTM

SEQ ID NO: 139802 - protein, 9 aa, Artificial Sequence
  Description of Artificial Sequence: Synthetic peptide
  Seed: YLAEADLSY (PMEL_HUMAN)
YHAEADLSY

SEQ ID NO: 139803 - protein, 10 aa, Artificial Sequence
  Description of Artificial Sequence: Synthetic peptide
  Seed: LIMPGQEAGL (PMEL_HUMAN)
LMMPGQEAGM

SEQ ID NO: 139804 - protein, 9 aa, Artificial Sequence
  Description of Artificial Sequence: Synthetic peptide
  Seed: TTPGQAPTA (PMEL_HUMAN)
TIPGQAPTY

SEQ ID NO: 139805 - protein, 9 aa, Artificial Sequence
  Description of Artificial Sequence: Synthetic peptide
  Seed: RQVPLDCVL (PMEL_HUMAN)
RQVPLDCVW

SEQ ID NO: 139806 - protein, 9 aa, Artificial Sequence
  Description of Artificial Sequence: Synthetic peptide
  Seed: KTWGQYWQV (PMEL_HUMAN)
KVWGQYWQF

SEQ ID NO: 139807 - protein, 9 aa, Artificial Sequence
  Description of Artificial Sequence: Synthetic peptide
  Seed: KHFLRNQPL (PMEL_HUMAN)
KFFLRNQPI

SEQ ID NO: 139808 - protein, 9 aa, Artificial Sequence
  Description of Artificial Sequence: Synthetic peptide
  Seed: LMAVVLASL (PMEL_HUMAN)
LVAVVLASR

SEQ ID NO: 139809 - protein, 10 aa, Artificial Sequence
  Description of Artificial Sequence: Synthetic peptide
  Seed: RQLYPEWTEA (PMEL_HUMAN)
RTLYPEWTEL

SEQ ID NO: 139810 - protein, 9 aa, Artificial Sequence
  Description of Artificial Sequence: Synthetic peptide
  Seed: AEPSGTTSV (PMEL_HUMAN)
AGPSGTTSV

SEQ ID NO: 139811 - protein, 11 aa, Artificial Sequence
  Description of Artificial Sequence: Synthetic peptide
  Seed: THTMEVTVYHR (PMEL_HUMAN)
TSTMEVTVYHR

SEQ ID NO: 139812 - protein, 10 aa, Artificial Sequence
  Description of Artificial Sequence: Synthetic peptide
  Seed: RNQDWLGVSR (PMEL_HUMAN)
RAQDWLGVSK

SEQ ID NO: 139813 - protein, 10 aa, Artificial Sequence
  Description of Artificial Sequence: Synthetic peptide
  Seed: MTPAEVSIVV (PMEL_HUMAN)
MHPAEVSIVL

SEQ ID NO: 139814 - protein, 11 aa, Artificial Sequence
  Description of Artificial Sequence: Synthetic peptide
  Seed: AEMSTPEATGM (PMEL_HUMAN)
AMMSTPEATGF

SEQ ID NO: 139815 - protein, 10 aa, Artificial Sequence
  Description of Artificial Sequence: Synthetic peptide
  Seed: YVWKTWGQYW (PMEL_HUMAN)
YYWKTWGQYM

SEQ ID NO: 139816 - protein, 10 aa, Artificial Sequence
  Description of Artificial Sequence: Synthetic peptide
  Seed: IALNFPGSQK (PMEL_HUMAN)
ISLNFPGSQK

SEQ ID NO: 139817 - protein, 9 aa, Artificial Sequence
  Description of Artificial Sequence: Synthetic peptide
  Seed: KVLPDGQVI (PMEL_HUMAN)
KTLPDGQVW

SEQ ID NO: 139818 - protein, 11 aa, Artificial Sequence
  Description of Artificial Sequence: Synthetic peptide
  Seed: YLAEADLSYTW (PMEL_HUMAN)
YSAEADLSYTY

SEQ ID NO: 139819 - protein, 11 aa, Artificial Sequence
  Description of Artificial Sequence: Synthetic peptide
  Seed: DCWRGGQVSLK (PMEL_HUMAN)
DAWRGGQVSLR

SEQ ID NO: 139820 - protein, 9 aa, Artificial Sequence
  Description of Artificial Sequence: Synthetic peptide
  Seed: LIYRRRLMK (PMEL_HUMAN)
LQYRRRLMR

SEQ ID NO: 139821 - protein, 9 aa, Artificial Sequence
  Description of Artificial Sequence: Synthetic peptide
  Seed: KQDFSVPQL (PMEL_HUMAN)
KMDFSVPQL

SEQ ID NO: 139822 - protein, 10 aa, Artificial Sequence
  Description of Artificial Sequence: Synthetic peptide
  Seed: VSLADTNSLA (PMEL_HUMAN)
VDLADTNSLV

SEQ ID NO: 139823 - protein, 8 aa, Artificial Sequence
  Description of Artificial Sequence: Synthetic peptide
  Seed: TLDIVQGI (PMEL_HUMAN)
TFDIVQGF

SEQ ID NO: 139824 - protein, 10 aa, Artificial Sequence
  Description of Artificial Sequence: Synthetic peptide
  Seed: KVLPDGQVIW (PMEL_HUMAN)
KILPDGQVIW

SEQ ID NO: 139825 - protein, 9 aa, Artificial Sequence
  Description of Artificial Sequence: Synthetic peptide
  Seed: ITDQVPFSV (PMEL_HUMAN)
IIDQVPFSM

SEQ ID NO: 139826 - protein, 9 aa, Artificial Sequence
  Description of Artificial Sequence: Synthetic peptide
  Seed: AEADLSYTW (PMEL_HUMAN)
AKADLSYTF

SEQ ID NO: 139827 - protein, 11 aa, Artificial Sequence
  Description of Artificial Sequence: Synthetic peptide
  Seed: GYLAEADLSYT (PMEL_HUMAN)
GHLAEADLSYV

SEQ ID NO: 139828 - protein, 11 aa, Artificial Sequence
  Description of Artificial Sequence: Synthetic peptide
  Seed: FSVSVSQLRAL (PMEL_HUMAN)
FAVSVSQLRAY

SEQ ID NO: 139829 - protein, 10 aa, Artificial Sequence
  Description of Artificial Sequence: Synthetic peptide
  Seed: SGTYCLNVSL (PMEL_HUMAN)
SKTYCLNVSV

SEQ ID NO: 139830 - protein, 9 aa, Artificial Sequence
  Description of Artificial Sequence: Synthetic peptide
  Seed: RAMLGTHTM (PMEL_HUMAN)
RGMLGTHTY

SEQ ID NO: 139831 - protein, 10 aa, Artificial Sequence
  Description of Artificial Sequence: Synthetic peptide
  Seed: VPQLPHSSSH (PMEL_HUMAN)
VNQLPHSSSY

SEQ ID NO: 139832 - protein, 10 aa, Artificial Sequence
  Description of Artificial Sequence: Synthetic peptide
  Seed: GPLLDGTATL (PMEL_HUMAN)
GNLLDGTATL

SEQ ID NO: 139833 - protein, 9 aa, Artificial Sequence
  Description of Artificial Sequence: Synthetic peptide
  Seed: KTWGQYWQV (PMEL_HUMAN)
KVWGQYWQR

SEQ ID NO: 139834 - protein, 9 aa, Artificial Sequence
  Description of Artificial Sequence: Synthetic peptide
  Seed: VPTTEVIST (PMEL_HUMAN)
VPTTEVISM

SEQ ID NO: 139835 - protein, 9 aa, Artificial Sequence
  Description of Artificial Sequence: Synthetic peptide
  Seed: FTITDQVPF (PMEL_HUMAN)
FNITDQVPY

SEQ ID NO: 139836 - protein, 11 aa, Artificial Sequence
  Description of Artificial Sequence: Synthetic peptide
  Seed: YLAEADLSYTW (PMEL_HUMAN)
YWAEADLSYTI

SEQ ID NO: 139837 - protein, 10 aa, Artificial Sequence
  Description of Artificial Sequence: Synthetic peptide
  Seed: LQLHDPSGYL (PMEL_HUMAN)
LMLHDPSGYI

SEQ ID NO: 139838 - protein, 10 aa, Artificial Sequence
  Description of Artificial Sequence: Synthetic peptide
  Seed: QVLGGPVSGL (PMEL_HUMAN)
QLLGGPVSGA

SEQ ID NO: 139839 - protein, 9 aa, Artificial Sequence
  Description of Artificial Sequence: Synthetic peptide
  Seed: RSYVPLAHS (PMEL_HUMAN)
RTYVPLAHR

SEQ ID NO: 139840 - protein, 8 aa, Artificial Sequence
  Description of Artificial Sequence: Synthetic peptide
  Seed: CQLVLHQI (PMEL_HUMAN)
CQLVLHQV

SEQ ID NO: 139841 - protein, 11 aa, Artificial Sequence
  Description of Artificial Sequence: Synthetic peptide
  Seed: KVLPDGQVIWV (PMEL_HUMAN)
KQLPDGQVIWW

SEQ ID NO: 139842 - protein, 10 aa, Artificial Sequence
  Description of Artificial Sequence: Synthetic peptide
  Seed: LAHSSSAFTI (PMEL_HUMAN)
LVHSSSAFTW

SEQ ID NO: 139843 - protein, 10 aa, Artificial Sequence
  Description of Artificial Sequence: Synthetic peptide
  Seed: MPTAESTGMT (PMEL_HUMAN)
MVTAESTGML

SEQ ID NO: 139844 - protein, 10 aa, Artificial Sequence
  Description of Artificial Sequence: Synthetic peptide
  Seed: ELTVSCQGGL (PMEL_HUMAN)
EKTVSCQGGV

SEQ ID NO: 139845 - protein, 9 aa, Artificial Sequence
  Description of Artificial Sequence: Synthetic peptide
  Seed: QLRTKAWNR (PMEL_HUMAN)
QVRTKAWNR

SEQ ID NO: 139846 - protein, 10 aa, Artificial Sequence
  Description of Artificial Sequence: Synthetic peptide
  Seed: YLAEADLSYT (PMEL_HUMAN)
YSAEADLSYV

SEQ ID NO: 139847 - protein, 9 aa, Artificial Sequence
  Description of Artificial Sequence: Synthetic peptide
  Seed: LSIGTGRAM (PMEL_HUMAN)
LKIGTGRAM

SEQ ID NO: 139848 - protein, 9 aa, Artificial Sequence
  Description of Artificial Sequence: Synthetic peptide
  Seed: QVWGGQPVY (PMEL_HUMAN)
QQWGGQPVL

SEQ ID NO: 139849 - protein, 11 aa, Artificial Sequence
  Description of Artificial Sequence: Synthetic peptide
  Seed: RALDGGNKHFL (PMEL_HUMAN)
RILDGGNKHFW

SEQ ID NO: 139850 - protein, 10 aa, Artificial Sequence
  Description of Artificial Sequence: Synthetic peptide
  Seed: VLPSPACQLV (PMEL_HUMAN)
VMPSPACQLL

SEQ ID NO: 139851 - protein, 9 aa, Artificial Sequence
  Description of Artificial Sequence: Synthetic peptide
  Seed: KQDFSVPQL (PMEL_HUMAN)
KLDFSVPQF

SEQ ID NO: 139852 - protein, 9 aa, Artificial Sequence
  Description of Artificial Sequence: Synthetic peptide
  Seed: LYRYGSFSV (PMEL_HUMAN)
LYRYGSFSI

SEQ ID NO: 139853 - protein, 10 aa, Artificial Sequence
  Description of Artificial Sequence: Synthetic peptide
  Seed: RGSRSYVPLA (PMEL_HUMAN)
RVSRSYVPLY

SEQ ID NO: 139854 - protein, 9 aa, Artificial Sequence
  Description of Artificial Sequence: Synthetic peptide
  Seed: YLAEADLSY (PMEL_HUMAN)
YPAEADLSF

SEQ ID NO: 139855 - protein, 9 aa, Artificial Sequence
  Description of Artificial Sequence: Synthetic peptide
  Seed: THTMEVTVY (PMEL_HUMAN)
TLTMEVTVY

SEQ ID NO: 139856 - protein, 10 aa, Artificial Sequence
  Description of Artificial Sequence: Synthetic peptide
  Seed: SQKRSFVYVW (PMEL_HUMAN)
SHKRSFVYVF

SEQ ID NO: 139857 - protein, 9 aa, Artificial Sequence
  Description of Artificial Sequence: Synthetic peptide
  Seed: SQKRSFVYV (PMEL_HUMAN)
STKRSFVYE

SEQ ID NO: 139858 - protein, 11 aa, Artificial Sequence
  Description of Artificial Sequence: Synthetic peptide
  Seed: HSSSHWLRLPR (PMEL_HUMAN)
HMSSHWLRLPR

SEQ ID NO: 139859 - protein, 9 aa, Artificial Sequence
  Description of Artificial Sequence: Synthetic peptide
  Seed: FTITDQVPF (PMEL_HUMAN)
FWITDQVPF
